United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 2

SEQ ID NO: 36228 - DNA, 22 bp, Homo sapiens
tgtgacgttgttctggattccc

SEQ ID NO: 36229 - DNA, 22 bp, Homo sapiens
tgatatgggaaaagggctcgga

SEQ ID NO: 36230 - DNA, 22 bp, Homo sapiens
ggcgccgcactcggtgcagccg

SEQ ID NO: 36231 - DNA, 22 bp, Homo sapiens
gcctgacttgtgtattttacat

SEQ ID NO: 36232 - DNA, 22 bp, Homo sapiens
tcactggaaagacagcactctt

SEQ ID NO: 36233 - DNA, 22 bp, Homo sapiens
ctctgcctcccaggttcaagcg

SEQ ID NO: 36234 - DNA, 19 bp, Homo sapiens
catctggatgattctcctg

SEQ ID NO: 36235 - DNA, 22 bp, Homo sapiens
gctgggttttcttccgggccta

SEQ ID NO: 36236 - DNA, 22 bp, Homo sapiens
actgtgaacggactgaagccca

SEQ ID NO: 36237 - DNA, 22 bp, Homo sapiens
tctgttttgcataatgttcttt

SEQ ID NO: 36238 - DNA, 21 bp, Homo sapiens
aggagcattgttgtggtggag

SEQ ID NO: 36239 - DNA, 22 bp, Homo sapiens
gtgcttgacgtgtagccgcccc

SEQ ID NO: 36240 - DNA, 22 bp, Homo sapiens
accacccagccagcttctccct

SEQ ID NO: 36241 - DNA, 22 bp, Homo sapiens
tgcctcagctgaggccgctcca

SEQ ID NO: 36242 - DNA, 22 bp, Homo sapiens
agcccaggttgaggctgcagtg

SEQ ID NO: 36243 - DNA, 22 bp, Homo sapiens
acgaggttggagagttgtttgg

SEQ ID NO: 36244 - DNA, 22 bp, Homo sapiens
cacacctcagccatgtggaggc

SEQ ID NO: 36245 - DNA, 22 bp, Homo sapiens
atttcctgtaggggcttgcgaa

SEQ ID NO: 36246 - DNA, 22 bp, Homo sapiens
tgtgcctactgatagagccaag

SEQ ID NO: 36247 - DNA, 22 bp, Homo sapiens
ggcgggcagcgtcttgctggcc

SEQ ID NO: 36248 - DNA, 22 bp, Homo sapiens
ctggctgggagcgagctgctca

SEQ ID NO: 36249 - DNA, 22 bp, Homo sapiens
gaactttgcgcagttcccgggg

SEQ ID NO: 36250 - DNA, 22 bp, Homo sapiens
gaagagtggttatccctgctgt

SEQ ID NO: 36251 - DNA, 22 bp, Homo sapiens
cacagacagtgtccctttgttg

SEQ ID NO: 36252 - DNA, 22 bp, Homo sapiens
tagctaaaccagtatgtgaagg

SEQ ID NO: 36253 - DNA, 22 bp, Homo sapiens
ggctttagtgtaggtttctgtt

SEQ ID NO: 36254 - DNA, 22 bp, Homo sapiens
gactatctgccaggtcccaggg

SEQ ID NO: 36255 - DNA, 22 bp, Homo sapiens
gtggcagaccttcccttctcct

SEQ ID NO: 36256 - DNA, 22 bp, Homo sapiens
taggtttcagaggtgccgggaa

SEQ ID NO: 36257 - DNA, 22 bp, Homo sapiens
tctccccagtatggattctctg

SEQ ID NO: 36258 - DNA, 22 bp, Homo sapiens
gcagctgacatctggctgggcc

SEQ ID NO: 36259 - DNA, 22 bp, Homo sapiens
tgacttcctgcactcaggtgat

SEQ ID NO: 36260 - DNA, 22 bp, Homo sapiens
ggctgtggcagctggaagtggt

SEQ ID NO: 36261 - DNA, 22 bp, Homo sapiens
cggggaagcggttctggcggta

SEQ ID NO: 36262 - DNA, 22 bp, Homo sapiens
gcctcctgagtagctgggattg

SEQ ID NO: 36263 - DNA, 22 bp, Homo sapiens
ggcatagcggctcagcgtccag

SEQ ID NO: 36264 - DNA, 19 bp, Homo sapiens
gctgttaaggaccctcgga

SEQ ID NO: 36265 - DNA, 22 bp, Homo sapiens
tgcgcggctcagtcatctccag

SEQ ID NO: 36266 - DNA, 20 bp, Homo sapiens
aatgctgcttctttttgcat

SEQ ID NO: 36267 - DNA, 22 bp, Homo sapiens
gcagactgtatcaatgtcagta

SEQ ID NO: 36268 - DNA, 22 bp, Homo sapiens
cagggatggcgctggctgcccg

SEQ ID NO: 36269 - DNA, 22 bp, Homo sapiens
agctggggctgtggttgtgatt

SEQ ID NO: 36270 - DNA, 22 bp, Homo sapiens
gcggggacagaaggcggttctc

SEQ ID NO: 36271 - DNA, 22 bp, Homo sapiens
ggcagcactgcagcttgttggg

SEQ ID NO: 36272 - DNA, 22 bp, Homo sapiens
ggttcccggatctccgagtccc

SEQ ID NO: 36273 - DNA, 18 bp, Homo sapiens
ccatcaccctaactagtg

SEQ ID NO: 36274 - DNA, 22 bp, Homo sapiens
aaagcgcttccctttggagcgt

SEQ ID NO: 36275 - DNA, 22 bp, Homo sapiens
ttagattttaagaagggaggta

SEQ ID NO: 36276 - DNA, 22 bp, Homo sapiens
gtgtttggtcagacgtccgggg

SEQ ID NO: 36277 - DNA, 22 bp, Homo sapiens
ggagttgacggccgacacccag

SEQ ID NO: 36278 - DNA, 22 bp, Homo sapiens
agacgcggtggtgcatgcctgt

SEQ ID NO: 36279 - DNA, 18 bp, Homo sapiens
ggagactaaactgttgac

SEQ ID NO: 36280 - DNA, 22 bp, Homo sapiens
ctccttctgggcctggcagtgg

SEQ ID NO: 36281 - DNA, 22 bp, Homo sapiens
aggtctcttgctgtctctgggc

SEQ ID NO: 36282 - DNA, 23 bp, Homo sapiens
tcctcgcaggagggagatgatgc

SEQ ID NO: 36283 - DNA, 22 bp, Homo sapiens
tgtgtgcatgcttggggcagca

SEQ ID NO: 36284 - DNA, 22 bp, Homo sapiens
ctgtcctgccagtcctggactc

SEQ ID NO: 36285 - DNA, 22 bp, Homo sapiens
gagggaaaggttaatacatgat

SEQ ID NO: 36286 - DNA, 22 bp, Homo sapiens
cctagagctctgctttatctaa

SEQ ID NO: 36287 - DNA, 22 bp, Homo sapiens
tgtgagcagagacatgaaaagc

SEQ ID NO: 36288 - DNA, 22 bp, Homo sapiens
cagtgggtcctgcgtctgccag

SEQ ID NO: 36289 - DNA, 22 bp, Homo sapiens
caggcagaagaagtggaaggac

SEQ ID NO: 36290 - DNA, 22 bp, Homo sapiens
caggctggagtgcagtggggcg

SEQ ID NO: 36291 - DNA, 22 bp, Homo sapiens
tatcacatttggagatttatga

SEQ ID NO: 36292 - DNA, 22 bp, Homo sapiens
tcccaggccacacttggggaac

SEQ ID NO: 36293 - DNA, 22 bp, Homo sapiens
acagcagcaatagcagtgacat

SEQ ID NO: 36294 - DNA, 22 bp, Homo sapiens
atcctcagacttcacgttccat

SEQ ID NO: 36295 - DNA, 22 bp, Homo sapiens
tcccagcgcggggggaggatcc

SEQ ID NO: 36296 - DNA, 22 bp, Homo sapiens
ctgggatgcggaggttgcggtg

SEQ ID NO: 36297 - DNA, 22 bp, Homo sapiens
aaatcgcttgaacccaggaagt

SEQ ID NO: 36298 - DNA, 22 bp, Homo sapiens
ttcaaatgatggcagtcctggc

SEQ ID NO: 36299 - DNA, 22 bp, Homo sapiens
aaggagcgcttagggggcagaa

SEQ ID NO: 36300 - DNA, 22 bp, Homo sapiens
tttctagttgttcatgaaagga

SEQ ID NO: 36301 - DNA, 22 bp, Homo sapiens
ctgcttaagcaagaaagcagca

SEQ ID NO: 36302 - DNA, 22 bp, Homo sapiens
cccaggccctggcagagcttgt

SEQ ID NO: 36303 - DNA, 22 bp, Homo sapiens
tgtcttcgctacaatgaaaagg

SEQ ID NO: 36304 - DNA, 22 bp, Homo sapiens
atgggctgtccattgctggctg

SEQ ID NO: 36305 - DNA, 22 bp, Homo sapiens
gaccttgtgctccgaggcgggc

SEQ ID NO: 36306 - DNA, 22 bp, Homo sapiens
tcctgtgatattgtttgttata

SEQ ID NO: 36307 - DNA, 22 bp, Homo sapiens
tgcctgataccctctgtctctc

SEQ ID NO: 36308 - DNA, 22 bp, Homo sapiens
atggcaccttccccagagctca

SEQ ID NO: 36309 - DNA, 22 bp, Homo sapiens
tctcgacagcctggcacagtgg

SEQ ID NO: 36310 - DNA, 22 bp, Homo sapiens
tagagctggccgggacagctgg

SEQ ID NO: 36311 - DNA, 22 bp, Homo sapiens
cagaggaacgtttggattgatt

SEQ ID NO: 36312 - DNA, 17 bp, Homo sapiens
gctccagaattctagtc

SEQ ID NO: 36313 - DNA, 22 bp, Homo sapiens
caggagctcaagaccaccctgg

SEQ ID NO: 36314 - DNA, 22 bp, Homo sapiens
tatcagtccagggttttgtgac

SEQ ID NO: 36315 - DNA, 22 bp, Homo sapiens
ctcactgcaacctctgcctccc

SEQ ID NO: 36316 - DNA, 22 bp, Homo sapiens
tcttttgtgattcttcagttac

SEQ ID NO: 36317 - DNA, 22 bp, Homo sapiens
tagactggtgaattagggggaa

SEQ ID NO: 36318 - DNA, 22 bp, Homo sapiens
catcttggatgacataactgtg

SEQ ID NO: 36319 - DNA, 22 bp, Homo sapiens
tctggagataagcagcaatgaa

SEQ ID NO: 36320 - DNA, 22 bp, Homo sapiens
tttatagtagcatgatttatag

SEQ ID NO: 36321 - DNA, 22 bp, Homo sapiens
atgagaaagttaatcatcatga

SEQ ID NO: 36322 - DNA, 22 bp, Homo sapiens
tgagccgtggtctctgagggtg

SEQ ID NO: 36323 - DNA, 22 bp, Homo sapiens
gctcatgactgtaatcccagca

SEQ ID NO: 36324 - DNA, 19 bp, Homo sapiens
gcctcatttccacctcccc

SEQ ID NO: 36325 - DNA, 22 bp, Homo sapiens
ggagaagaggagctggaagcct

SEQ ID NO: 36326 - DNA, 22 bp, Homo sapiens
agtgggccggacagcccaggcc

SEQ ID NO: 36327 - DNA, 22 bp, Homo sapiens
agaggacagagtgctggattta

SEQ ID NO: 36328 - DNA, 22 bp, Homo sapiens
tagcagcatttttgtagagtat

SEQ ID NO: 36329 - DNA, 22 bp, Homo sapiens
tagatctgatacaattcatctg

SEQ ID NO: 36330 - DNA, 22 bp, Homo sapiens
tcacttagatggggatcatcac

SEQ ID NO: 36331 - DNA, 22 bp, Homo sapiens
aactcactttgtggcttctgaa

SEQ ID NO: 36332 - DNA, 22 bp, Homo sapiens
aagacactcattatcactggtt

SEQ ID NO: 36333 - DNA, 22 bp, Homo sapiens
ccggtgttcaaagtctggtatg

SEQ ID NO: 36334 - DNA, 22 bp, Homo sapiens
ggagtgactctcggggccacta

SEQ ID NO: 36335 - DNA, 22 bp, Homo sapiens
ttccgctgtttagttgaagttt

SEQ ID NO: 36336 - DNA, 22 bp, Homo sapiens
cccaggaggtcgaagctgcagt

SEQ ID NO: 36337 - DNA, 22 bp, Homo sapiens
cccagaaggtcgaggctgcagt

SEQ ID NO: 36338 - DNA, 22 bp, Homo sapiens
gccaggctgaggctctggaaga

SEQ ID NO: 36339 - DNA, 23 bp, Homo sapiens
tcaagcaattctcctgcctcggc

SEQ ID NO: 36340 - DNA, 22 bp, Homo sapiens
gacaattgcttttgccgaataa

SEQ ID NO: 36341 - DNA, 22 bp, Homo sapiens
gttgcctaggctggagtgcagt

SEQ ID NO: 36342 - DNA, 22 bp, Homo sapiens
ttgtctaatgagctccacttca

SEQ ID NO: 36343 - DNA, 22 bp, Homo sapiens
tctgctggaaaaccagggaatt

SEQ ID NO: 36344 - DNA, 22 bp, Homo sapiens
tggagtgaagggttggcacggt

SEQ ID NO: 36345 - DNA, 22 bp, Homo sapiens
cgagcatgatgacggctgtggc

SEQ ID NO: 36346 - DNA, 22 bp, Homo sapiens
tgtccaggttagcttcaaacac

SEQ ID NO: 36347 - DNA, 22 bp, Homo sapiens
agctcttacatttaggtctatg

SEQ ID NO: 36348 - DNA, 22 bp, Homo sapiens
acatgtaatacatccagcaata

SEQ ID NO: 36349 - DNA, 22 bp, Homo sapiens
aacccgggaggcagaggttgtg

SEQ ID NO: 36350 - DNA, 22 bp, Homo sapiens
gctccgccacgcccactcctac

SEQ ID NO: 36351 - DNA, 18 bp, Homo sapiens
tcttccaacactgacacc

SEQ ID NO: 36352 - DNA, 17 bp, Homo sapiens
cgggcatggagggcagg

SEQ ID NO: 36353 - DNA, 22 bp, Homo sapiens
ctgggggtcttgaaagggagag

SEQ ID NO: 36354 - DNA, 22 bp, Homo sapiens
atggcctgcagtgctgccacag

SEQ ID NO: 36355 - DNA, 22 bp, Homo sapiens
cagtgcagccaaggacaggcac

SEQ ID NO: 36356 - DNA, 22 bp, Homo sapiens
aactagaaaaagactttctgag

SEQ ID NO: 36357 - DNA, 22 bp, Homo sapiens
cagtgatatttatcctactcac

SEQ ID NO: 36358 - DNA, 18 bp, Homo sapiens
cagggctgtggggtcact

SEQ ID NO: 36359 - DNA, 22 bp, Homo sapiens
ttactttaagggtgtcttatta

SEQ ID NO: 36360 - DNA, 22 bp, Homo sapiens
aggtgggcggattcatgaggtc

SEQ ID NO: 36361 - DNA, 22 bp, Homo sapiens
cgctgcgaggcgcccttgttgc

SEQ ID NO: 36362 - DNA, 22 bp, Homo sapiens
ttgtgaatagtgctgcaataaa

SEQ ID NO: 36363 - DNA, 22 bp, Homo sapiens
tcagccagccagctacaggctt

SEQ ID NO: 36364 - DNA, 22 bp, Homo sapiens
ctcttcatagcaaacatatggg

SEQ ID NO: 36365 - DNA, 22 bp, Homo sapiens
ctgctctgctgatcagtgtctc

SEQ ID NO: 36366 - DNA, 22 bp, Homo sapiens
acagttaattgttgttgggtgt

SEQ ID NO: 36367 - DNA, 22 bp, Homo sapiens
gattgtggaagtcagtggttct

SEQ ID NO: 36368 - DNA, 22 bp, Homo sapiens
aggagctcagctaagttggaga

SEQ ID NO: 36369 - DNA, 22 bp, Homo sapiens
atggtggacgggagacaggact

SEQ ID NO: 36370 - DNA, 22 bp, Homo sapiens
tatacactgttgttgggagtct

SEQ ID NO: 36371 - DNA, 22 bp, Homo sapiens
cagcacatgctcatcagggaag

SEQ ID NO: 36372 - DNA, 22 bp, Homo sapiens
gtctcgtcaatggcaggttccc

SEQ ID NO: 36373 - DNA, 22 bp, Homo sapiens
gaggtgctgctgtacttcttgc

SEQ ID NO: 36374 - DNA, 22 bp, Homo sapiens
tggagaagattggtcaccattc

SEQ ID NO: 36375 - DNA, 22 bp, Homo sapiens
atggccctaatgagttggtgtt

SEQ ID NO: 36376 - DNA, 22 bp, Homo sapiens
ttggcataccttagtggtggag

SEQ ID NO: 36377 - DNA, 22 bp, Homo sapiens
gctctagtaggaatgtccctct

SEQ ID NO: 36378 - DNA, 22 bp, Homo sapiens
catctgtaaagtaggaatattg

SEQ ID NO: 36379 - DNA, 22 bp, Homo sapiens
tcctcagaatcacctggcagct

SEQ ID NO: 36380 - DNA, 22 bp, Homo sapiens
attgaaaataaggccagaaaca

SEQ ID NO: 36381 - DNA, 22 bp, Homo sapiens
ggctgagttgagaggattactt

SEQ ID NO: 36382 - DNA, 22 bp, Homo sapiens
agatggggtttcatcatgttgg

SEQ ID NO: 36383 - DNA, 22 bp, Homo sapiens
ctcagtgaattggaggatggcc

SEQ ID NO: 36384 - DNA, 21 bp, Homo sapiens
gggcctggctgcgcaggacgg

SEQ ID NO: 36385 - DNA, 22 bp, Homo sapiens
tgcagcattgcactccagcctg

SEQ ID NO: 36386 - DNA, 22 bp, Homo sapiens
gcccgcgccagcctctccatct

SEQ ID NO: 36387 - DNA, 22 bp, Homo sapiens
tgggcaaggctggagcctgcag

SEQ ID NO: 36388 - DNA, 22 bp, Homo sapiens
tgcctgttgcccacctgataaa

SEQ ID NO: 36389 - DNA, 22 bp, Homo sapiens
attctacatgatagaagggaga

SEQ ID NO: 36390 - DNA, 22 bp, Homo sapiens
ggccactggccaggatctaaga

SEQ ID NO: 36391 - DNA, 22 bp, Homo sapiens
actgggaagtcagagagaggct

SEQ ID NO: 36392 - DNA, 22 bp, Homo sapiens
ggaggactcaggtctggccatg

SEQ ID NO: 36393 - DNA, 22 bp, Homo sapiens
gtgagttcccggatctgttcca

SEQ ID NO: 36394 - DNA, 22 bp, Homo sapiens
agagctgtgtttagtagttacg

SEQ ID NO: 36395 - DNA, 22 bp, Homo sapiens
aaagtaattgcagtttctgcca

SEQ ID NO: 36396 - DNA, 22 bp, Homo sapiens
agtggtcttagcttgctgggct

SEQ ID NO: 36397 - DNA, 22 bp, Homo sapiens
aatggctctgatgttgttgtga

SEQ ID NO: 36398 - DNA, 22 bp, Homo sapiens
gaaggaagtcattagtgcagac

SEQ ID NO: 36399 - DNA, 22 bp, Homo sapiens
ggctctgcttgaggccagcctg

SEQ ID NO: 36400 - DNA, 21 bp, Homo sapiens
cccagaagttccatggggggc

SEQ ID NO: 36401 - DNA, 22 bp, Homo sapiens
gatcccaggtgatcttatttgt

SEQ ID NO: 36402 - DNA, 22 bp, Homo sapiens
tcactgcgcttcagcctgggtg

SEQ ID NO: 36403 - DNA, 22 bp, Homo sapiens
gggtaggcaaagcaatgacgtt

SEQ ID NO: 36404 - DNA, 22 bp, Homo sapiens
cggctcactgcagctccgcctc

SEQ ID NO: 36405 - DNA, 22 bp, Homo sapiens
agccctggtttgcagcatttgc

SEQ ID NO: 36406 - DNA, 22 bp, Homo sapiens
tcacccaggctggactgcagtg

SEQ ID NO: 36407 - DNA, 22 bp, Homo sapiens
tgtgtcagaaggcaatggggat

SEQ ID NO: 36408 - DNA, 23 bp, Homo sapiens
attttttgtctttgtaactagat

SEQ ID NO: 36409 - DNA, 22 bp, Homo sapiens
acagattcactgcactggccat

SEQ ID NO: 36410 - DNA, 22 bp, Homo sapiens
cttcttgttgttagggtcctgt

SEQ ID NO: 36411 - DNA, 22 bp, Homo sapiens
ccacagtctatgcaacaaggtc

SEQ ID NO: 36412 - DNA, 21 bp, Homo sapiens
caaaagagactgattcttgga

SEQ ID NO: 36413 - DNA, 22 bp, Homo sapiens
tattgggtaaagatccagtttt

SEQ ID NO: 36414 - DNA, 22 bp, Homo sapiens
tcaccagctctgcctcgccagt

SEQ ID NO: 36415 - DNA, 20 bp, Homo sapiens
gacatgtctttctcacacaa

SEQ ID NO: 36416 - DNA, 17 bp, Homo sapiens
aatgtccttggaccaca

SEQ ID NO: 36417 - DNA, 22 bp, Homo sapiens
gaattcttttctttctgaaagt

SEQ ID NO: 36418 - DNA, 22 bp, Homo sapiens
agagcagctcgctacctctcta

SEQ ID NO: 36419 - DNA, 22 bp, Homo sapiens
aggcgaagggaccagacggtag

SEQ ID NO: 36420 - DNA, 22 bp, Homo sapiens
tgactacaacctccacctcccg

SEQ ID NO: 36421 - DNA, 22 bp, Homo sapiens
ttggaggttccatgatttgtct

SEQ ID NO: 36422 - DNA, 22 bp, Homo sapiens
gcgactgtacagaattgcccct

SEQ ID NO: 36423 - DNA, 21 bp, Homo sapiens
tgaaggtgttcatgatgcggt

SEQ ID NO: 36424 - DNA, 21 bp, Homo sapiens
gttctacagttttagaattcc

SEQ ID NO: 36425 - DNA, 22 bp, Homo sapiens
ggtgccagaaaacttgaagagt

SEQ ID NO: 36426 - DNA, 22 bp, Homo sapiens
gggtacagttcttccagtgtca

SEQ ID NO: 36427 - DNA, 22 bp, Homo sapiens
tcacaaatgtttgcatgtgtct

SEQ ID NO: 36428 - DNA, 22 bp, Homo sapiens
gtgaagttggccagtttagttt

SEQ ID NO: 36429 - DNA, 22 bp, Homo sapiens
atgggttcaagtgattctcctg

SEQ ID NO: 36430 - DNA, 22 bp, Homo sapiens
agaggccgggtgcctgctcaga

SEQ ID NO: 36431 - DNA, 19 bp, Homo sapiens
catggtgaaaccccgtctc

SEQ ID NO: 36432 - DNA, 20 bp, Homo sapiens
tggcctctgagatgccacgg

SEQ ID NO: 36433 - DNA, 22 bp, Homo sapiens
aggcaggaggatcatggatgca

SEQ ID NO: 36434 - DNA, 22 bp, Homo sapiens
gaagggaactgggtctccttgt

SEQ ID NO: 36435 - DNA, 22 bp, Homo sapiens
cagtcacaagcgtacctaattt

SEQ ID NO: 36436 - DNA, 22 bp, Homo sapiens
gagctactgaaatattgatttt

SEQ ID NO: 36437 - DNA, 23 bp, Homo sapiens
gacagagtgagaccttgtcttac

SEQ ID NO: 36438 - DNA, 22 bp, Homo sapiens
ctgggaggtggaggttgcattg

SEQ ID NO: 36439 - DNA, 22 bp, Homo sapiens
gcccagccacagtcactttcat

SEQ ID NO: 36440 - DNA, 22 bp, Homo sapiens
ccttgctcaagctagtgacggg

SEQ ID NO: 36441 - DNA, 22 bp, Homo sapiens
atattacacacggtatcacggg

SEQ ID NO: 36442 - DNA, 22 bp, Homo sapiens
ttcttctttccaattacatggt

SEQ ID NO: 36443 - DNA, 22 bp, Homo sapiens
attacctatttcattttctgtc

SEQ ID NO: 36444 - DNA, 22 bp, Homo sapiens
cactaggctggagtgcagtggc

SEQ ID NO: 36445 - DNA, 22 bp, Homo sapiens
tccgggaggcagaggttgcagt

SEQ ID NO: 36446 - DNA, 22 bp, Homo sapiens
tagggtacatgtgcacaacatg

SEQ ID NO: 36447 - DNA, 21 bp, Homo sapiens
tgtaagtttcatctgaattgg

SEQ ID NO: 36448 - DNA, 22 bp, Homo sapiens
atggctgcctgggcgctggccg

SEQ ID NO: 36449 - DNA, 22 bp, Homo sapiens
ttgtgtgtactggttatgggca

SEQ ID NO: 36450 - DNA, 16 bp, Homo sapiens
ttgccgcacaggtcgc

SEQ ID NO: 36451 - DNA, 22 bp, Homo sapiens
gagccaggtcgggccgcggcga

SEQ ID NO: 36452 - DNA, 22 bp, Homo sapiens
gaccaagatacagcatcataga

SEQ ID NO: 36453 - DNA, 22 bp, Homo sapiens
ctatgaccccagcatgaataag

SEQ ID NO: 36454 - DNA, 22 bp, Homo sapiens
agggcactgcaagggttgaagg

SEQ ID NO: 36455 - DNA, 22 bp, Homo sapiens
ctcctgaattgtccctcacagc

SEQ ID NO: 36456 - DNA, 22 bp, Homo sapiens
atttcctgcaaggagtgggttt

SEQ ID NO: 36457 - DNA, 22 bp, Homo sapiens
gcctcagtctcccgagtagctg

SEQ ID NO: 36458 - DNA, 22 bp, Homo sapiens
tgtcacagtttgtactttatag

SEQ ID NO: 36459 - DNA, 22 bp, Homo sapiens
tgaggcaggaggattgcaggat

SEQ ID NO: 36460 - DNA, 22 bp, Homo sapiens
ctaggtgatccactgctctctt

SEQ ID NO: 36461 - DNA, 22 bp, Homo sapiens
aacactctctgttggtaaggct

SEQ ID NO: 36462 - DNA, 20 bp, Homo sapiens
tctcgcactcggagcagccg

SEQ ID NO: 36463 - DNA, 22 bp, Homo sapiens
tgggggacaccagtctctctct

SEQ ID NO: 36464 - DNA, 22 bp, Homo sapiens
aggctgaggcaagaggatcact

SEQ ID NO: 36465 - DNA, 22 bp, Homo sapiens
tatgtgtttgacaccctgcaag

SEQ ID NO: 36466 - DNA, 21 bp, Homo sapiens
agaaggcaaaagcagacatct

SEQ ID NO: 36467 - DNA, 22 bp, Homo sapiens
ggcaatcattggcattctctgg

SEQ ID NO: 36468 - DNA, 22 bp, Homo sapiens
ctgcttctccctgagatagtgt

SEQ ID NO: 36469 - DNA, 19 bp, Homo sapiens
cgcctggcaggccctgcgc

SEQ ID NO: 36470 - DNA, 22 bp, Homo sapiens
tacaccattcccaggtggattt

SEQ ID NO: 36471 - DNA, 22 bp, Homo sapiens
ggacagaaaccatatgagtgta

SEQ ID NO: 36472 - DNA, 22 bp, Homo sapiens
gtggagggtgattgccggctgt

SEQ ID NO: 36473 - DNA, 22 bp, Homo sapiens
gctcttgtcaaaaattagttga

SEQ ID NO: 36474 - DNA, 22 bp, Homo sapiens
ttgtgctctgtgttatttaagg

SEQ ID NO: 36475 - DNA, 22 bp, Homo sapiens
gggtacttaatatttacggggt

SEQ ID NO: 36476 - DNA, 22 bp, Homo sapiens
tcctttaaacaaccagctctca

SEQ ID NO: 36477 - DNA, 22 bp, Homo sapiens
ttgtatagcccagagagtgaga

SEQ ID NO: 36478 - DNA, 22 bp, Homo sapiens
ctcccgcaggagcagctcgcag

SEQ ID NO: 36479 - DNA, 22 bp, Homo sapiens
ctcaggacccggtccaggtggg

SEQ ID NO: 36480 - DNA, 22 bp, Homo sapiens
ctcggggatccatccacgtggc

SEQ ID NO: 36481 - DNA, 22 bp, Homo sapiens
gccctgagaagaagtcggaggg

SEQ ID NO: 36482 - DNA, 23 bp, Homo sapiens
gtgcgccaggacaacctgacgga

SEQ ID NO: 36483 - DNA, 16 bp, Homo sapiens
aggtggagaagttcac

SEQ ID NO: 36484 - DNA, 22 bp, Homo sapiens
gggaggcagtgctggaggctgg

SEQ ID NO: 36485 - DNA, 22 bp, Homo sapiens
gagatcggtaaagagcatgcac

SEQ ID NO: 36486 - DNA, 22 bp, Homo sapiens
taggcatgcaaataaatgtgca

SEQ ID NO: 36487 - DNA, 22 bp, Homo sapiens
ggcatggacgtctctgaggcca

SEQ ID NO: 36488 - DNA, 22 bp, Homo sapiens
ggagtgcagtggtgggatctca

SEQ ID NO: 36489 - DNA, 22 bp, Homo sapiens
taagggaacagcttcaaactca

SEQ ID NO: 36490 - DNA, 22 bp, Homo sapiens
ctccaggctcgtccaagatcga

SEQ ID NO: 36491 - DNA, 22 bp, Homo sapiens
cagctgctgttcagttttgttt

SEQ ID NO: 36492 - DNA, 22 bp, Homo sapiens
tcagaacctcctagcagtgttc

SEQ ID NO: 36493 - DNA, 22 bp, Homo sapiens
ttttatctgtgacatctggcag

SEQ ID NO: 36494 - DNA, 22 bp, Homo sapiens
atgaccagccgagataaacaga

SEQ ID NO: 36495 - DNA, 22 bp, Homo sapiens
ttgagcagatcgggctgtgggg

SEQ ID NO: 36496 - DNA, 22 bp, Homo sapiens
tcattccctcattgttcactgg

SEQ ID NO: 36497 - DNA, 22 bp, Homo sapiens
actgtactcaagcctgggcaat

SEQ ID NO: 36498 - DNA, 22 bp, Homo sapiens
aagagagtcagtctgagcacca

SEQ ID NO: 36499 - DNA, 22 bp, Homo sapiens
tccagggccatctccatgaggc

SEQ ID NO: 36500 - DNA, 22 bp, Homo sapiens
ttcctaagtcctgccagcagtc

SEQ ID NO: 36501 - DNA, 22 bp, Homo sapiens
taaaggtagtgtgacatattgt

SEQ ID NO: 36502 - DNA, 22 bp, Homo sapiens
aaggtcatggcaaattactttt

SEQ ID NO: 36503 - DNA, 22 bp, Homo sapiens
tgctccatctagagctctgcag

SEQ ID NO: 36504 - DNA, 21 bp, Homo sapiens
ttgatggtgggtgatgctctg

SEQ ID NO: 36505 - DNA, 22 bp, Homo sapiens
gcctggccaacgtggtgaaacc

SEQ ID NO: 36506 - DNA, 22 bp, Homo sapiens
aagctcaaaccttggggctcag

SEQ ID NO: 36507 - DNA, 17 bp, Homo sapiens
gctactggttacctcta

SEQ ID NO: 36508 - DNA, 22 bp, Homo sapiens
cctggggtcacttgcagccgca

SEQ ID NO: 36509 - DNA, 22 bp, Homo sapiens
ggtggcagtagcactgggcctg

SEQ ID NO: 36510 - DNA, 23 bp, Homo sapiens
ctcctcgtaactctgtggtgggt

SEQ ID NO: 36511 - DNA, 22 bp, Homo sapiens
tacagtgcttggtatctagtaa

SEQ ID NO: 36512 - DNA, 22 bp, Homo sapiens
actgcgctccagcctgggtgac

SEQ ID NO: 36513 - DNA, 22 bp, Homo sapiens
cagccagtgtgaccgaggagga

SEQ ID NO: 36514 - DNA, 22 bp, Homo sapiens
tcttccagatggttctttagct

SEQ ID NO: 36515 - DNA, 22 bp, Homo sapiens
ccaggaggtggagattgcagtg

SEQ ID NO: 36516 - DNA, 20 bp, Homo sapiens
caggtccagcacgtgcacgg

SEQ ID NO: 36517 - DNA, 22 bp, Homo sapiens
tgacaggcaggacagaggtgtg

SEQ ID NO: 36518 - DNA, 22 bp, Homo sapiens
ctagggtgtgcagattttgcct

SEQ ID NO: 36519 - DNA, 22 bp, Homo sapiens
gcttaattctggctcagtttcc

SEQ ID NO: 36520 - DNA, 22 bp, Homo sapiens
cggaggcctcagctcatggttt

SEQ ID NO: 36521 - DNA, 22 bp, Homo sapiens
tgaggcccaccttggccccggc

SEQ ID NO: 36522 - DNA, 22 bp, Homo sapiens
tcaccaggctggagtgcagtgg

SEQ ID NO: 36523 - DNA, 22 bp, Homo sapiens
atattagtttggagactacaat

SEQ ID NO: 36524 - DNA, 22 bp, Homo sapiens
ctcaggagttggaggctacagt

SEQ ID NO: 36525 - DNA, 22 bp, Homo sapiens
tctgcaggtaagcgttcttgga

SEQ ID NO: 36526 - DNA, 22 bp, Homo sapiens
tcctttgcttctgtcattctcc

SEQ ID NO: 36527 - DNA, 18 bp, Homo sapiens
atactagagctctttgcc

SEQ ID NO: 36528 - DNA, 22 bp, Homo sapiens
ttgagcaggatggctatgcaca

SEQ ID NO: 36529 - DNA, 22 bp, Homo sapiens
taggctgggggtaggaattgag

SEQ ID NO: 36530 - DNA, 20 bp, Homo sapiens
gggactgtcccatcctcatc

SEQ ID NO: 36531 - DNA, 22 bp, Homo sapiens
ttccttacattcatatggcttc

SEQ ID NO: 36532 - DNA, 22 bp, Homo sapiens
gggaggcacgaggcgcgcagtg

SEQ ID NO: 36533 - DNA, 22 bp, Homo sapiens
cctcggaggcggaggctgcagt

SEQ ID NO: 36534 - DNA, 22 bp, Homo sapiens
aacctgggcttgaacagtgcct

SEQ ID NO: 36535 - DNA, 22 bp, Homo sapiens
gagcacagtaaagcagtgtcac

SEQ ID NO: 36536 - DNA, 22 bp, Homo sapiens
acccagccatgttcagttctct

SEQ ID NO: 36537 - DNA, 20 bp, Homo sapiens
tttgcgaggccaaggcgggc

SEQ ID NO: 36538 - DNA, 20 bp, Homo sapiens
tgaggcccagcagagtcggg

SEQ ID NO: 36539 - DNA, 22 bp, Homo sapiens
atgtaattattaacacctgtgc

SEQ ID NO: 36540 - DNA, 22 bp, Homo sapiens
atccccctcttggatggcggca

SEQ ID NO: 36541 - DNA, 22 bp, Homo sapiens
agtgaaaacctaatcatgcagt

SEQ ID NO: 36542 - DNA, 22 bp, Homo sapiens
catggggcccatgtgctccaag

SEQ ID NO: 36543 - DNA, 22 bp, Homo sapiens
cgtgatgaatggtgagacccgc

SEQ ID NO: 36544 - DNA, 22 bp, Homo sapiens
catgtgaattccaaagctaggt

SEQ ID NO: 36545 - DNA, 22 bp, Homo sapiens
ctgcagggagaggggacagcct

SEQ ID NO: 36546 - DNA, 22 bp, Homo sapiens
ttctcctacttaaggccttcca

SEQ ID NO: 36547 - DNA, 22 bp, Homo sapiens
gtacactgggtaagggactcct

SEQ ID NO: 36548 - DNA, 22 bp, Homo sapiens
tccaactttctcctccggcttg

SEQ ID NO: 36549 - DNA, 22 bp, Homo sapiens
ccagtgtgcaatctctggctta

SEQ ID NO: 36550 - DNA, 22 bp, Homo sapiens
ttagcacaggagtctctgttat

SEQ ID NO: 36551 - DNA, 22 bp, Homo sapiens
atacaaaaattagccgggagta

SEQ ID NO: 36552 - DNA, 20 bp, Homo sapiens
gagattaactgagaatctag

SEQ ID NO: 36553 - DNA, 22 bp, Homo sapiens
gtccccgccgtcgctcaggctg

SEQ ID NO: 36554 - DNA, 22 bp, Homo sapiens
ggggccttttctgaatgtggaa

SEQ ID NO: 36555 - DNA, 17 bp, Homo sapiens
tgtagcttctccttctc

SEQ ID NO: 36556 - DNA, 22 bp, Homo sapiens
aggaaagcttggcaaactaaat

SEQ ID NO: 36557 - DNA, 22 bp, Homo sapiens
tctaaattactttgggcagtat

SEQ ID NO: 36558 - DNA, 22 bp, Homo sapiens
gtgaccatcatctcagctagtt

SEQ ID NO: 36559 - DNA, 22 bp, Homo sapiens
gcaaagaatgcagatttgcctc

SEQ ID NO: 36560 - DNA, 22 bp, Homo sapiens
tacccaaggccctttcaatttc

SEQ ID NO: 36561 - DNA, 22 bp, Homo sapiens
catctgtctgcatgctctgggt

SEQ ID NO: 36562 - DNA, 22 bp, Homo sapiens
acccaggctggagtgcagtggc

SEQ ID NO: 36563 - DNA, 22 bp, Homo sapiens
atgcaggcagacactgtgggca

SEQ ID NO: 36564 - DNA, 22 bp, Homo sapiens
atgccactgcacttcagcttgg

SEQ ID NO: 36565 - DNA, 22 bp, Homo sapiens
ctggaatctttggagaatgtgg

SEQ ID NO: 36566 - DNA, 22 bp, Homo sapiens
cggtcaggtgcagcgttggcac

SEQ ID NO: 36567 - DNA, 22 bp, Homo sapiens
agtagatttctgctgaagcttt

SEQ ID NO: 36568 - DNA, 22 bp, Homo sapiens
ctcgggcttgaggctgtttacc

SEQ ID NO: 36569 - DNA, 22 bp, Homo sapiens
ctgctgagccgcacccaggagc

SEQ ID NO: 36570 - DNA, 22 bp, Homo sapiens
gtatccatgggggattggttcc

SEQ ID NO: 36571 - DNA, 19 bp, Homo sapiens
ggctgccttctgctcatct

SEQ ID NO: 36572 - DNA, 22 bp, Homo sapiens
cgtgggtcgggactccgcctcg

SEQ ID NO: 36573 - DNA, 22 bp, Homo sapiens
ggaaatctcagatctcccagat

SEQ ID NO: 36574 - DNA, 22 bp, Homo sapiens
actgagcaggagaatcacttta

SEQ ID NO: 36575 - DNA, 22 bp, Homo sapiens
actgtacctcaaactctggaac

SEQ ID NO: 36576 - DNA, 22 bp, Homo sapiens
caggaaagggatgggctgccac

SEQ ID NO: 36577 - DNA, 22 bp, Homo sapiens
tccctagtcgcatctgtggaga

SEQ ID NO: 36578 - DNA, 22 bp, Homo sapiens
agtcaaagatgaccgagttcct

SEQ ID NO: 36579 - DNA, 22 bp, Homo sapiens
ttgtgggggctgccctgtacgg

SEQ ID NO: 36580 - DNA, 22 bp, Homo sapiens
ttctcctttcattccctgtaga

SEQ ID NO: 36581 - DNA, 22 bp, Homo sapiens
accgagttagccaggatggtct

SEQ ID NO: 36582 - DNA, 22 bp, Homo sapiens
atgaggcaggtggaggctgcca

SEQ ID NO: 36583 - DNA, 22 bp, Homo sapiens
tggcacaggatctcagcggcca

SEQ ID NO: 36584 - DNA, 22 bp, Homo sapiens
tttgaagggcacgacaatagtt

SEQ ID NO: 36585 - DNA, 22 bp, Homo sapiens
gccagggtcctgaagaccaagt

SEQ ID NO: 36586 - DNA, 22 bp, Homo sapiens
aaggcaaggcttccagctcccc

SEQ ID NO: 36587 - DNA, 22 bp, Homo sapiens
gtgctggggagataggaagaga

SEQ ID NO: 36588 - DNA, 22 bp, Homo sapiens
ggtgccagatgaggcccgcgat

SEQ ID NO: 36589 - DNA, 22 bp, Homo sapiens
tacagtcacattctgaggtctt

SEQ ID NO: 36590 - DNA, 18 bp, Homo sapiens
tcactgtgtgtcttgggt

SEQ ID NO: 36591 - DNA, 22 bp, Homo sapiens
cagggtgctgcaccatccctca

SEQ ID NO: 36592 - DNA, 22 bp, Homo sapiens
aggtgacaggacaggagctggt

SEQ ID NO: 36593 - DNA, 18 bp, Homo sapiens
tctggaacaacttcatgt

SEQ ID NO: 36594 - DNA, 22 bp, Homo sapiens
tcaccgaggctggagtgcagtg

SEQ ID NO: 36595 - DNA, 22 bp, Homo sapiens
cacccaggctggagtgcagtga

SEQ ID NO: 36596 - DNA, 22 bp, Homo sapiens
cacccaggctggaatgcagtgg

SEQ ID NO: 36597 - DNA, 22 bp, Homo sapiens
gacctcgtgatccgccctcctt

SEQ ID NO: 36598 - DNA, 22 bp, Homo sapiens
ggctttgacatgctgaattaaa

SEQ ID NO: 36599 - DNA, 19 bp, Homo sapiens
aggaatggaattaattctg

SEQ ID NO: 36600 - DNA, 22 bp, Homo sapiens
gaggccactgtccctgccttcc

SEQ ID NO: 36601 - DNA, 22 bp, Homo sapiens
aagatacagacagagccaaaat

SEQ ID NO: 36602 - DNA, 22 bp, Homo sapiens
tctgacattagattaattggaa

SEQ ID NO: 36603 - DNA, 19 bp, Homo sapiens
atcccaaggagctgggact

SEQ ID NO: 36604 - DNA, 22 bp, Homo sapiens
actgcaacacctcctgggttca

SEQ ID NO: 36605 - DNA, 22 bp, Homo sapiens
tccgtgcccctggcactaggtc

SEQ ID NO: 36606 - DNA, 22 bp, Homo sapiens
tgggtgtccagaccctgcacat

SEQ ID NO: 36607 - DNA, 18 bp, Homo sapiens
gtcaggcatgaatctggg

SEQ ID NO: 36608 - DNA, 22 bp, Homo sapiens
gaggtggatgttgcagtgagct

SEQ ID NO: 36609 - DNA, 22 bp, Homo sapiens
tggttcctcaagcgctggcggc

SEQ ID NO: 36610 - DNA, 22 bp, Homo sapiens
accatgttggccaagctggtct

SEQ ID NO: 36611 - DNA, 22 bp, Homo sapiens
atttcccagggcctgggatttg

SEQ ID NO: 36612 - DNA, 22 bp, Homo sapiens
ggagttcacgatgttggccagg

SEQ ID NO: 36613 - DNA, 22 bp, Homo sapiens
tctgtcttagccatctcaggct

SEQ ID NO: 36614 - DNA, 22 bp, Homo sapiens
gtggcgtgatctcggctcactg

SEQ ID NO: 36615 - DNA, 22 bp, Homo sapiens
tgttcttgagcctttagaccta

SEQ ID NO: 36616 - DNA, 22 bp, Homo sapiens
caggctggagtacaattgtgtg

SEQ ID NO: 36617 - DNA, 22 bp, Homo sapiens
aaaagttattgatgcaggacaa

SEQ ID NO: 36618 - DNA, 23 bp, Homo sapiens
tcgttgaatagcaatagcacaac

SEQ ID NO: 36619 - DNA, 22 bp, Homo sapiens
attgcactccggcctgggtgac

SEQ ID NO: 36620 - DNA, 22 bp, Homo sapiens
agcctggcggtcgtcggtcagg

SEQ ID NO: 36621 - DNA, 22 bp, Homo sapiens
cagtcctgaatactggacggtg

SEQ ID NO: 36622 - DNA, 21 bp, Homo sapiens
agaacccagcagcactgttct

SEQ ID NO: 36623 - DNA, 22 bp, Homo sapiens
tgaggcaggagaatcaccggaa

SEQ ID NO: 36624 - DNA, 21 bp, Homo sapiens
agtagtttagcacagggtttg

SEQ ID NO: 36625 - DNA, 22 bp, Homo sapiens
ctgctttaaaactgatacatga

SEQ ID NO: 36626 - DNA, 21 bp, Homo sapiens
aaactgaccttgcctgagaca

SEQ ID NO: 36627 - DNA, 22 bp, Homo sapiens
atgcagttccacaggcgcatgg

SEQ ID NO: 36628 - DNA, 19 bp, Homo sapiens
tgctaccgtgggatgctta

SEQ ID NO: 36629 - DNA, 22 bp, Homo sapiens
cttgcctttgtcttcaaaggct

SEQ ID NO: 36630 - DNA, 22 bp, Homo sapiens
tctgcaacagtgccctgtaaat

SEQ ID NO: 36631 - DNA, 22 bp, Homo sapiens
aatggtttctgaagttaggcag

SEQ ID NO: 36632 - DNA, 22 bp, Homo sapiens
atgccactgcactccagcctgg

SEQ ID NO: 36633 - DNA, 22 bp, Homo sapiens
aggctatttccactcttctcat

SEQ ID NO: 36634 - DNA, 22 bp, Homo sapiens
ttattgcttatgattaggtgtt

SEQ ID NO: 36635 - DNA, 22 bp, Homo sapiens
tctgtgcctgcttccccaccca

SEQ ID NO: 36636 - DNA, 18 bp, Homo sapiens
tgtccctgcaaataacat

SEQ ID NO: 36637 - DNA, 22 bp, Homo sapiens
tatgccgcagccggatttcccc

SEQ ID NO: 36638 - DNA, 22 bp, Homo sapiens
tgcgatggcgtagacaaatccc

SEQ ID NO: 36639 - DNA, 22 bp, Homo sapiens
cagtggccaacttcctgcctct

SEQ ID NO: 36640 - DNA, 17 bp, Homo sapiens
acttcccacccctccag

SEQ ID NO: 36641 - DNA, 22 bp, Homo sapiens
ttgtcacagcagcaaaggctct

SEQ ID NO: 36642 - DNA, 22 bp, Homo sapiens
ggctcctgggggtgctcctgcc

SEQ ID NO: 36643 - DNA, 22 bp, Homo sapiens
gggaggttctgttcgcacttga

SEQ ID NO: 36644 - DNA, 22 bp, Homo sapiens
ggcaaaaagttcccatcagtgt

SEQ ID NO: 36645 - DNA, 22 bp, Homo sapiens
aggccagcctcaggcagggacc

SEQ ID NO: 36646 - DNA, 22 bp, Homo sapiens
tggcatttgagctggaaggatg

SEQ ID NO: 36647 - DNA, 22 bp, Homo sapiens
aagataagagggaggtgcctca

SEQ ID NO: 36648 - DNA, 23 bp, Homo sapiens
agtgggctcagtcctccaacccc

SEQ ID NO: 36649 - DNA, 22 bp, Homo sapiens
cccagcgagtttgccggtgaac

SEQ ID NO: 36650 - DNA, 22 bp, Homo sapiens
gttcatcactcagagacctccc

SEQ ID NO: 36651 - DNA, 22 bp, Homo sapiens
ctccgggtagctgaggccctgg

SEQ ID NO: 36652 - DNA, 22 bp, Homo sapiens
ctgtcaggttggtctcagagct

SEQ ID NO: 36653 - DNA, 22 bp, Homo sapiens
tcccctctttctggaaacacaa

SEQ ID NO: 36654 - DNA, 22 bp, Homo sapiens
agtactgtcagcagggtgttga

SEQ ID NO: 36655 - DNA, 22 bp, Homo sapiens
gtggcttgagcaggggcagagg

SEQ ID NO: 36656 - DNA, 22 bp, Homo sapiens
cccagggaggcccaggctctgc

SEQ ID NO: 36657 - DNA, 22 bp, Homo sapiens
acgtggcggccgccgtgagcgg

SEQ ID NO: 36658 - DNA, 22 bp, Homo sapiens
agagagcagtggatcacctagc

SEQ ID NO: 36659 - DNA, 22 bp, Homo sapiens
ctgagggtcaacttgattgtat

SEQ ID NO: 36660 - DNA, 22 bp, Homo sapiens
tcccagtttttctccactaagg

SEQ ID NO: 36661 - DNA, 22 bp, Homo sapiens
aggaaataggaccagacaaagc

SEQ ID NO: 36662 - DNA, 22 bp, Homo sapiens
ggggtggatttcaggcggtgtc

SEQ ID NO: 36663 - DNA, 22 bp, Homo sapiens
tccataaattttatgaacatat

SEQ ID NO: 36664 - DNA, 20 bp, Homo sapiens
gggcagagccagccagtccc

SEQ ID NO: 36665 - DNA, 22 bp, Homo sapiens
atgatgtaaaataagttgtgag

SEQ ID NO: 36666 - DNA, 22 bp, Homo sapiens
cggccgcagcagtgtcggccca

SEQ ID NO: 36667 - DNA, 22 bp, Homo sapiens
ccagatatcactgccgtgttgt

SEQ ID NO: 36668 - DNA, 17 bp, Homo sapiens
cccgttctcttcgctgg

SEQ ID NO: 36669 - DNA, 22 bp, Homo sapiens
gcaggcaggcttccttgaactg

SEQ ID NO: 36670 - DNA, 22 bp, Homo sapiens
gctccgtgggcattgctaggtg

SEQ ID NO: 36671 - DNA, 22 bp, Homo sapiens
agttcgagatctgctgatgaga

SEQ ID NO: 36672 - DNA, 22 bp, Homo sapiens
atgaagcgttcgagataggtag

SEQ ID NO: 36673 - DNA, 22 bp, Homo sapiens
gggcaggggtcagtggccccaa

SEQ ID NO: 36674 - DNA, 22 bp, Homo sapiens
tgctcgaggtccccaccggctc

SEQ ID NO: 36675 - DNA, 22 bp, Homo sapiens
atcctccagctcctgcttctgc

SEQ ID NO: 36676 - DNA, 22 bp, Homo sapiens
gggagctgagctggaagagaat

SEQ ID NO: 36677 - DNA, 22 bp, Homo sapiens
tgagctgtatattgttttaata

SEQ ID NO: 36678 - DNA, 22 bp, Homo sapiens
tgaatgtatggtcctgtgaatt

SEQ ID NO: 36679 - DNA, 22 bp, Homo sapiens
ctacaaaagtaattgtggtttt

SEQ ID NO: 36680 - DNA, 22 bp, Homo sapiens
atcatcatgcccacttgagact

SEQ ID NO: 36681 - DNA, 22 bp, Homo sapiens
tcagaagactgtcttttccatg

SEQ ID NO: 36682 - DNA, 22 bp, Homo sapiens
tttattctgtgctacatgaaga

SEQ ID NO: 36683 - DNA, 22 bp, Homo sapiens
tttgaaatgtatcagtataggt

SEQ ID NO: 36684 - DNA, 22 bp, Homo sapiens
tcactgcactccagcactcagg

SEQ ID NO: 36685 - DNA, 22 bp, Homo sapiens
attgcactccagcctgggggac

SEQ ID NO: 36686 - DNA, 22 bp, Homo sapiens
gcagatcaacactctctttcaa

SEQ ID NO: 36687 - DNA, 22 bp, Homo sapiens
tgtctttgttattgtggacagg

SEQ ID NO: 36688 - DNA, 22 bp, Homo sapiens
tgcctgatgcaggagtatcaga

SEQ ID NO: 36689 - DNA, 22 bp, Homo sapiens
gaggggagcccccatcctccag

SEQ ID NO: 36690 - DNA, 22 bp, Homo sapiens
agagctgggtggacttgtagtt

SEQ ID NO: 36691 - DNA, 22 bp, Homo sapiens
caagagtgaaactctgtctcaa

SEQ ID NO: 36692 - DNA, 22 bp, Homo sapiens
acgcccggtctccatagttttt

SEQ ID NO: 36693 - DNA, 23 bp, Homo sapiens
caggagatggctgctgtgtcagc

SEQ ID NO: 36694 - DNA, 22 bp, Homo sapiens
ctttggcaatgtcattttcaat

SEQ ID NO: 36695 - DNA, 22 bp, Homo sapiens
atctggttcttcttaggcatca

SEQ ID NO: 36696 - DNA, 22 bp, Homo sapiens
tagccaaagaccttttcaaccc

SEQ ID NO: 36697 - DNA, 22 bp, Homo sapiens
tgaagctttaggatgggttcat

SEQ ID NO: 36698 - DNA, 22 bp, Homo sapiens
ttgtgagtagtgccgcaataaa

SEQ ID NO: 36699 - DNA, 22 bp, Homo sapiens
ttgtgaatagtgccacaataaa

SEQ ID NO: 36700 - DNA, 22 bp, Homo sapiens
tgtcaatatgtaataactgaat

SEQ ID NO: 36701 - DNA, 22 bp, Homo sapiens
aggctccctgaatcgcccgttc

SEQ ID NO: 36702 - DNA, 22 bp, Homo sapiens
gactttctgatgtaaacattta

SEQ ID NO: 36703 - DNA, 22 bp, Homo sapiens
acgcccagactcccatactttg

SEQ ID NO: 36704 - DNA, 22 bp, Homo sapiens
ggcgctcagtgttgccccagag

SEQ ID NO: 36705 - DNA, 22 bp, Homo sapiens
aacccaggagacaggttgcagt

SEQ ID NO: 36706 - DNA, 21 bp, Homo sapiens
ttctcctaggctgaggcggga

SEQ ID NO: 36707 - DNA, 22 bp, Homo sapiens
agggtgaatctcacaactctta

SEQ ID NO: 36708 - DNA, 22 bp, Homo sapiens
gaagcctcaacatctctgcgtc

SEQ ID NO: 36709 - DNA, 22 bp, Homo sapiens
cgcagggccgcgagcgggacca

SEQ ID NO: 36710 - DNA, 22 bp, Homo sapiens
gtgcggatcggtgtcctccaaa

SEQ ID NO: 36711 - DNA, 22 bp, Homo sapiens
actgcatttggtaaagtcaaga

SEQ ID NO: 36712 - DNA, 22 bp, Homo sapiens
gtatgtgaggttggtttccagg

SEQ ID NO: 36713 - DNA, 22 bp, Homo sapiens
agggactatttacccatctcac

SEQ ID NO: 36714 - DNA, 22 bp, Homo sapiens
tgagtgattaggtttttccttc

SEQ ID NO: 36715 - DNA, 22 bp, Homo sapiens
gccaggttgctgacgacgatct

SEQ ID NO: 36716 - DNA, 21 bp, Homo sapiens
tctgagactgggttagaatgt

SEQ ID NO: 36717 - DNA, 22 bp, Homo sapiens
agaatacttgggaatgggttaa

SEQ ID NO: 36718 - DNA, 22 bp, Homo sapiens
tgatttcaagccagggggcgtt

SEQ ID NO: 36719 - DNA, 22 bp, Homo sapiens
aaggtgggcagatcacaaggtc

SEQ ID NO: 36720 - DNA, 22 bp, Homo sapiens
cgccccggacgtctgaccaaac

SEQ ID NO: 36721 - DNA, 22 bp, Homo sapiens
acgcagtttgtggacatttttt

SEQ ID NO: 36722 - DNA, 22 bp, Homo sapiens
cactgcaagctctgccacctgg

SEQ ID NO: 36723 - DNA, 22 bp, Homo sapiens
tgctggaggccagaagtctgag

SEQ ID NO: 36724 - DNA, 22 bp, Homo sapiens
gggccatgagaggttcatcaac

SEQ ID NO: 36725 - DNA, 22 bp, Homo sapiens
tgagatggagtctcactctgtt

SEQ ID NO: 36726 - DNA, 19 bp, Homo sapiens
tcctggggaggggcatggc

SEQ ID NO: 36727 - DNA, 22 bp, Homo sapiens
cctgggctctgtcagaattggg

SEQ ID NO: 36728 - DNA, 22 bp, Homo sapiens
tcttggccactaccacctggag

SEQ ID NO: 36729 - DNA, 22 bp, Homo sapiens
tgagctgtagcagatgctgttg

SEQ ID NO: 36730 - DNA, 22 bp, Homo sapiens
tggggcacagtctgaatgtttc

SEQ ID NO: 36731 - DNA, 22 bp, Homo sapiens
aatattatcaaaagctttttca

SEQ ID NO: 36732 - DNA, 22 bp, Homo sapiens
tctcatctgccatttgcaggag

SEQ ID NO: 36733 - DNA, 22 bp, Homo sapiens
tatactctgagaaacgtgtcac

SEQ ID NO: 36734 - DNA, 22 bp, Homo sapiens
tcacattttcaaaagctggtgc

SEQ ID NO: 36735 - DNA, 22 bp, Homo sapiens
ggagtgctttgaagccttcatt

SEQ ID NO: 36736 - DNA, 22 bp, Homo sapiens
tctgtgagaaccagtgccaggg

SEQ ID NO: 36737 - DNA, 23 bp, Homo sapiens
tctacaaagctgtgtcaggaccc

SEQ ID NO: 36738 - DNA, 22 bp, Homo sapiens
agaaagtgcttccctttggact

SEQ ID NO: 36739 - DNA, 22 bp, Homo sapiens
agggttcagtccagggcctggg

SEQ ID NO: 36740 - DNA, 22 bp, Homo sapiens
gtaaactcagagaatacttctt

SEQ ID NO: 36741 - DNA, 22 bp, Homo sapiens
ccagcttgctcctctgcaatgg

SEQ ID NO: 36742 - DNA, 22 bp, Homo sapiens
gctcgaccgccagaaacttcct

SEQ ID NO: 36743 - DNA, 22 bp, Homo sapiens
catgtaaagaatttcacacaag

SEQ ID NO: 36744 - DNA, 22 bp, Homo sapiens
ttggcttttatgcagcttaggt

SEQ ID NO: 36745 - DNA, 22 bp, Homo sapiens
ctggcagatagtaagtgatcaa

SEQ ID NO: 36746 - DNA, 22 bp, Homo sapiens
aggggatgcctagtggagtctc

SEQ ID NO: 36747 - DNA, 22 bp, Homo sapiens
ccaaccagctatggaatcttgt

SEQ ID NO: 36748 - DNA, 22 bp, Homo sapiens
catgttggtgtgctgcacccgt

SEQ ID NO: 36749 - DNA, 22 bp, Homo sapiens
ctccaccccgtgccggtgctgg

SEQ ID NO: 36750 - DNA, 22 bp, Homo sapiens
tcagggattgcaaaattcatcc

SEQ ID NO: 36751 - DNA, 22 bp, Homo sapiens
acaagtattggtgaggatgtag

SEQ ID NO: 36752 - DNA, 22 bp, Homo sapiens
acccggaggcgggggatgcagt

SEQ ID NO: 36753 - DNA, 22 bp, Homo sapiens
actgccctccagcctgggtgac

SEQ ID NO: 36754 - DNA, 22 bp, Homo sapiens
tgggatgccggcaggaggcaat

SEQ ID NO: 36755 - DNA, 22 bp, Homo sapiens
gagctgaaggagaaagcagggg

SEQ ID NO: 36756 - DNA, 22 bp, Homo sapiens
tgctgctgaggctaaagtatag

SEQ ID NO: 36757 - DNA, 22 bp, Homo sapiens
aaagatgttgctgctccgccct

SEQ ID NO: 36758 - DNA, 22 bp, Homo sapiens
ttggaaacgtcaccttttcctt

SEQ ID NO: 36759 - DNA, 22 bp, Homo sapiens
accagaagctggagcacaagga

SEQ ID NO: 36760 - DNA, 22 bp, Homo sapiens
aacccaggagttggaggctgtg

SEQ ID NO: 36761 - DNA, 21 bp, Homo sapiens
gcagcagtgttctagaatact

SEQ ID NO: 36762 - DNA, 22 bp, Homo sapiens
tagagctctccttcctctgtgg

SEQ ID NO: 36763 - DNA, 22 bp, Homo sapiens
ctatacagcagcttactagtta

SEQ ID NO: 36764 - DNA, 22 bp, Homo sapiens
tggccagctttgactgtaaacc

SEQ ID NO: 36765 - DNA, 22 bp, Homo sapiens
gtggctcacgcctgtaatccca

SEQ ID NO: 36766 - DNA, 22 bp, Homo sapiens
gcggggcccggacccagcctct

SEQ ID NO: 36767 - DNA, 22 bp, Homo sapiens
acaaacagagttgaaaaatagg

SEQ ID NO: 36768 - DNA, 22 bp, Homo sapiens
gggcaaaacctgggcatcatga

SEQ ID NO: 36769 - DNA, 22 bp, Homo sapiens
gatattcctgaaggacagggtt

SEQ ID NO: 36770 - DNA, 22 bp, Homo sapiens
tcagcaatcctcccacaggtgg

SEQ ID NO: 36771 - DNA, 22 bp, Homo sapiens
gcacagccacgtaatgtggtca

SEQ ID NO: 36772 - DNA, 22 bp, Homo sapiens
gtggccccagggccctgtctgg

SEQ ID NO: 36773 - DNA, 22 bp, Homo sapiens
ggtgccctggaagctgctgcat

SEQ ID NO: 36774 - DNA, 22 bp, Homo sapiens
aagatattcaaagatttattag

SEQ ID NO: 36775 - DNA, 22 bp, Homo sapiens
tcacaatatttatcttccaatt

SEQ ID NO: 36776 - DNA, 22 bp, Homo sapiens
ttttaatactgctattgtagga

SEQ ID NO: 36777 - DNA, 22 bp, Homo sapiens
ttctgcagtgttaacaatgtca

SEQ ID NO: 36778 - DNA, 22 bp, Homo sapiens
ctgcccgcaccatccccgggct

SEQ ID NO: 36779 - DNA, 22 bp, Homo sapiens
cagctggcgactctcctcgatg

SEQ ID NO: 36780 - DNA, 18 bp, Homo sapiens
tcttcatctcctgagctg

SEQ ID NO: 36781 - DNA, 23 bp, Homo sapiens
gtcacagtgggtggtgcctacat

SEQ ID NO: 36782 - DNA, 22 bp, Homo sapiens
gctgtgtccaggtgggggtgac

SEQ ID NO: 36783 - DNA, 22 bp, Homo sapiens
ccgggcgggggctctcgtcacc

SEQ ID NO: 36784 - DNA, 22 bp, Homo sapiens
ctgctcttgagggactgcggtc

SEQ ID NO: 36785 - DNA, 22 bp, Homo sapiens
aaggctgtggttctatacagaa

SEQ ID NO: 36786 - DNA, 22 bp, Homo sapiens
tcaggtccaagatggccatcca

SEQ ID NO: 36787 - DNA, 22 bp, Homo sapiens
ttgctgacctttgctctccgtt

SEQ ID NO: 36788 - DNA, 22 bp, Homo sapiens
caaagcaggaagctcctgacag

SEQ ID NO: 36789 - DNA, 22 bp, Homo sapiens
ggcatcttgttgctcaaatcta

SEQ ID NO: 36790 - DNA, 22 bp, Homo sapiens
ccggggacagcaggtccgactt

SEQ ID NO: 36791 - DNA, 22 bp, Homo sapiens
tgtcagtgtctatgaagaattt

SEQ ID NO: 36792 - DNA, 18 bp, Homo sapiens
tggtcactgtggatagtg

SEQ ID NO: 36793 - DNA, 19 bp, Homo sapiens
gttctttcatagtaagagc

SEQ ID NO: 36794 - DNA, 22 bp, Homo sapiens
ttctaattaaatctacgctagg

SEQ ID NO: 36795 - DNA, 21 bp, Homo sapiens
cagggccaatcctgacctcta

SEQ ID NO: 36796 - DNA, 22 bp, Homo sapiens
ggctgtgtggccgtgggctcta

SEQ ID NO: 36797 - DNA, 22 bp, Homo sapiens
agaaactctggaagaactttta

SEQ ID NO: 36798 - DNA, 22 bp, Homo sapiens
gcccaggaggagaggctgcagt

SEQ ID NO: 36799 - DNA, 22 bp, Homo sapiens
taggtcagaacaagcagtatcg

SEQ ID NO: 36800 - DNA, 22 bp, Homo sapiens
cccattgtggttgttgaggata

SEQ ID NO: 36801 - DNA, 20 bp, Homo sapiens
gccgactgccttgtgagcct

SEQ ID NO: 36802 - DNA, 22 bp, Homo sapiens
ctgaagagaaagggagctcttc

SEQ ID NO: 36803 - DNA, 22 bp, Homo sapiens
agcacctgtcaagtccaggctg

SEQ ID NO: 36804 - DNA, 22 bp, Homo sapiens
gaggctgaggttgcagtgagct

SEQ ID NO: 36805 - DNA, 22 bp, Homo sapiens
ctcccctagcccgttgggaggt

SEQ ID NO: 36806 - DNA, 22 bp, Homo sapiens
cccaggaggcctgcctggccgg

SEQ ID NO: 36807 - DNA, 22 bp, Homo sapiens
ccactgcactccagccttggca

SEQ ID NO: 36808 - DNA, 22 bp, Homo sapiens
tgagccaggagtttgaggctgt

SEQ ID NO: 36809 - DNA, 22 bp, Homo sapiens
cgtgatttctggctttctatat

SEQ ID NO: 36810 - DNA, 22 bp, Homo sapiens
gagatatgttggcagctggtat

SEQ ID NO: 36811 - DNA, 22 bp, Homo sapiens
agagctaagaaacagaattgct

SEQ ID NO: 36812 - DNA, 22 bp, Homo sapiens
agggctgcccagtgtgagagct

SEQ ID NO: 36813 - DNA, 19 bp, Homo sapiens
cggcccctcctctcgcgcc

SEQ ID NO: 36814 - DNA, 22 bp, Homo sapiens
attgtgaatagtgccgcagtaa

SEQ ID NO: 36815 - DNA, 22 bp, Homo sapiens
atttctctgcagtgttcggaat

SEQ ID NO: 36816 - DNA, 22 bp, Homo sapiens
tggccgggaagggacagtgtgg

SEQ ID NO: 36817 - DNA, 23 bp, Homo sapiens
atgacactcctgtgcgcaccctg

SEQ ID NO: 36818 - DNA, 22 bp, Homo sapiens
cagtggaggccttgggaccttt

SEQ ID NO: 36819 - DNA, 22 bp, Homo sapiens
aagccgggcctgagaaatgaca

SEQ ID NO: 36820 - DNA, 22 bp, Homo sapiens
actgcactccagcctgggtaac

SEQ ID NO: 36821 - DNA, 22 bp, Homo sapiens
actgcactccaacctgggtgac

SEQ ID NO: 36822 - DNA, 22 bp, Homo sapiens
tggctaggctggtgtcaagctc

SEQ ID NO: 36823 - DNA, 22 bp, Homo sapiens
tctagttctagatccctgagga

SEQ ID NO: 36824 - DNA, 22 bp, Homo sapiens
ccttcattcattaatttagccc

SEQ ID NO: 36825 - DNA, 22 bp, Homo sapiens
tcactgcagcctctgcctcccg

SEQ ID NO: 36826 - DNA, 22 bp, Homo sapiens
acaaggcactttatgaagagga

SEQ ID NO: 36827 - DNA, 22 bp, Homo sapiens
gtgcgggcctgggggtttctct

SEQ ID NO: 36828 - DNA, 22 bp, Homo sapiens
cgtcattgtcctggacttgcaa

SEQ ID NO: 36829 - DNA, 22 bp, Homo sapiens
agagagctctgctgctgcccag

SEQ ID NO: 36830 - DNA, 22 bp, Homo sapiens
acagagacacggaagctaaaga

SEQ ID NO: 36831 - DNA, 18 bp, Homo sapiens
gctatctctaagatcttt

SEQ ID NO: 36832 - DNA, 22 bp, Homo sapiens
agagtgcaaccgaaacaagcag

SEQ ID NO: 36833 - DNA, 22 bp, Homo sapiens
aggtagaaggaccagaatttat

SEQ ID NO: 36834 - DNA, 22 bp, Homo sapiens
ggtgtccgcgctgtagaaggtc

SEQ ID NO: 36835 - DNA, 22 bp, Homo sapiens
ttcctggaaattatgctcacct

SEQ ID NO: 36836 - DNA, 22 bp, Homo sapiens
ccattgcactccatcctgggca

SEQ ID NO: 36837 - DNA, 22 bp, Homo sapiens
ttgtgaatagtgccgctataaa

SEQ ID NO: 36838 - DNA, 22 bp, Homo sapiens
atccatttgacataatttcagc

SEQ ID NO: 36839 - DNA, 22 bp, Homo sapiens
gaatgctaagcatgtgggagtt

SEQ ID NO: 36840 - DNA, 22 bp, Homo sapiens
acagaactgggaaatgcacata

SEQ ID NO: 36841 - DNA, 22 bp, Homo sapiens
ccaggcagcctgctccattctg

SEQ ID NO: 36842 - DNA, 22 bp, Homo sapiens
aggagggagcttaagccaggca

SEQ ID NO: 36843 - DNA, 22 bp, Homo sapiens
ttcctgttcaggaaagttgtgt

SEQ ID NO: 36844 - DNA, 22 bp, Homo sapiens
ctggtgtggactccgcgcggag

SEQ ID NO: 36845 - DNA, 22 bp, Homo sapiens
aggtattattagcatctctatt

SEQ ID NO: 36846 - DNA, 22 bp, Homo sapiens
aaggagtctgggccattcagag

SEQ ID NO: 36847 - DNA, 22 bp, Homo sapiens
tttctcttcactgtgtgcctca

SEQ ID NO: 36848 - DNA, 21 bp, Homo sapiens
tctctttctggaagcttccct

SEQ ID NO: 36849 - DNA, 22 bp, Homo sapiens
agagagcccgggccagggcaca

SEQ ID NO: 36850 - DNA, 21 bp, Homo sapiens
ggcaagaaacacaatcaagta

SEQ ID NO: 36851 - DNA, 22 bp, Homo sapiens
cacctgtacagggccgggctgg

SEQ ID NO: 36852 - DNA, 22 bp, Homo sapiens
agacggaatttcatcatgttag

SEQ ID NO: 36853 - DNA, 22 bp, Homo sapiens
taggcccctagtgccacgtggc

SEQ ID NO: 36854 - DNA, 22 bp, Homo sapiens
agtgagtttagggtgcaggtgt

SEQ ID NO: 36855 - DNA, 22 bp, Homo sapiens
gccataggcagcgtggccagca

SEQ ID NO: 36856 - DNA, 22 bp, Homo sapiens
acccgccgcacgtccaggctga

SEQ ID NO: 36857 - DNA, 20 bp, Homo sapiens
gggtgtgtgcagggcctggt

SEQ ID NO: 36858 - DNA, 22 bp, Homo sapiens
attgataaattgcaatggggct

SEQ ID NO: 36859 - DNA, 22 bp, Homo sapiens
ctctaccaggagtctccaccgt

SEQ ID NO: 36860 - DNA, 22 bp, Homo sapiens
tgagatgaataactcctgctaa

SEQ ID NO: 36861 - DNA, 22 bp, Homo sapiens
acagtgcttagcacagagtaga

SEQ ID NO: 36862 - DNA, 22 bp, Homo sapiens
tggggccatctcacccactgtt

SEQ ID NO: 36863 - DNA, 20 bp, Homo sapiens
ggtggccgtagcgggcggcg

SEQ ID NO: 36864 - DNA, 22 bp, Homo sapiens
ttgggctgcagcaattattagt

SEQ ID NO: 36865 - DNA, 22 bp, Homo sapiens
tggaagacaatttgaaaacatt

SEQ ID NO: 36866 - DNA, 22 bp, Homo sapiens
tcttaagcagagaagaagttga

SEQ ID NO: 36867 - DNA, 22 bp, Homo sapiens
attctcaaaacataacttcact

SEQ ID NO: 36868 - DNA, 17 bp, Homo sapiens
tgggatccgtctctgtg

SEQ ID NO: 36869 - DNA, 22 bp, Homo sapiens
cggccaggcacagtggcccacg

SEQ ID NO: 36870 - DNA, 22 bp, Homo sapiens
ggctgccttccctgagccccgg

SEQ ID NO: 36871 - DNA, 22 bp, Homo sapiens
caggctggagtgcagtggcgcc

SEQ ID NO: 36872 - DNA, 22 bp, Homo sapiens
ggcctgggctccgggagttact

SEQ ID NO: 36873 - DNA, 22 bp, Homo sapiens
aaaactacatttgacattttgt

SEQ ID NO: 36874 - DNA, 19 bp, Homo sapiens
gttttgcaggcagagggga

SEQ ID NO: 36875 - DNA, 22 bp, Homo sapiens
ggaaaggcctgggtgtcctggg

SEQ ID NO: 36876 - DNA, 20 bp, Homo sapiens
aaacgagccatcattctggt

SEQ ID NO: 36877 - DNA, 20 bp, Homo sapiens
tgttgattggtgtcatctca

SEQ ID NO: 36878 - DNA, 22 bp, Homo sapiens
agctggagatgagtgacgtgcc

SEQ ID NO: 36879 - DNA, 22 bp, Homo sapiens
aggttttggtgatcattggaga

SEQ ID NO: 36880 - DNA, 22 bp, Homo sapiens
attgttcaatgtaataattttg

SEQ ID NO: 36881 - DNA, 22 bp, Homo sapiens
cagagctggtgtgtcctggcat

SEQ ID NO: 36882 - DNA, 20 bp, Homo sapiens
aggccccaggtggacactag

SEQ ID NO: 36883 - DNA, 19 bp, Homo sapiens
ccctcttgcacaaagcaaa

SEQ ID NO: 36884 - DNA, 22 bp, Homo sapiens
agctcaagctacacacagagtc

SEQ ID NO: 36885 - DNA, 22 bp, Homo sapiens
tcaatgtgaattaagaatactt

SEQ ID NO: 36886 - DNA, 22 bp, Homo sapiens
ggcgcagttgagcgtgctgttc

SEQ ID NO: 36887 - DNA, 22 bp, Homo sapiens
tggtattacttctagacacaag

SEQ ID NO: 36888 - DNA, 22 bp, Homo sapiens
tgcactactgtgatacacagcc

SEQ ID NO: 36889 - DNA, 22 bp, Homo sapiens
aggaatggtgctcagcagaaat

SEQ ID NO: 36890 - DNA, 22 bp, Homo sapiens
tggcaccagggaacaagcattt

SEQ ID NO: 36891 - DNA, 22 bp, Homo sapiens
ggtggttcacgcctataatccc

SEQ ID NO: 36892 - DNA, 22 bp, Homo sapiens
tcgtgatctgtccacctcggcc

SEQ ID NO: 36893 - DNA, 22 bp, Homo sapiens
ccaggcaggcgatggtgcagtg

SEQ ID NO: 36894 - DNA, 22 bp, Homo sapiens
atcacagttttaccatttggta

SEQ ID NO: 36895 - DNA, 22 bp, Homo sapiens
acttgccccagaattgctgctg

SEQ ID NO: 36896 - DNA, 23 bp, Homo sapiens
tgacctcatgatccgcccacctc

SEQ ID NO: 36897 - DNA, 22 bp, Homo sapiens
tgaatgtgatgctaaacatatg

SEQ ID NO: 36898 - DNA, 22 bp, Homo sapiens
ttctgggtttacatctgacttc

SEQ ID NO: 36899 - DNA, 22 bp, Homo sapiens
tctcctggtacccttcctagca

SEQ ID NO: 36900 - DNA, 22 bp, Homo sapiens
ctggccagatgttacgtccaat

SEQ ID NO: 36901 - DNA, 22 bp, Homo sapiens
atcaaatacaaagggcataagg

SEQ ID NO: 36902 - DNA, 22 bp, Homo sapiens
aagggcatgagaagcttgaaag

SEQ ID NO: 36903 - DNA, 22 bp, Homo sapiens
ctccagtcttctcatgtatccc

SEQ ID NO: 36904 - DNA, 22 bp, Homo sapiens
agcaagatttttcaggttagta

SEQ ID NO: 36905 - DNA, 22 bp, Homo sapiens
ttgcttcttagatattcctctc

SEQ ID NO: 36906 - DNA, 22 bp, Homo sapiens
ctgtgctccctctggcgccccg

SEQ ID NO: 36907 - DNA, 22 bp, Homo sapiens
cttatcagattatctgggctgt

SEQ ID NO: 36908 - DNA, 22 bp, Homo sapiens
cagcttggaggaggatctaaga

SEQ ID NO: 36909 - DNA, 22 bp, Homo sapiens
gaggtgtcatcaggcagctctg

SEQ ID NO: 36910 - DNA, 22 bp, Homo sapiens
tcactgcactccagcctggtga

SEQ ID NO: 36911 - DNA, 22 bp, Homo sapiens
acagagcaataacagggagagg

SEQ ID NO: 36912 - DNA, 22 bp, Homo sapiens
gcccagagtttgaagatacagt

SEQ ID NO: 36913 - DNA, 22 bp, Homo sapiens
gcttacaggtgaggcagcaaga

SEQ ID NO: 36914 - DNA, 22 bp, Homo sapiens
gcttctggtgaggcctcaggaa

SEQ ID NO: 36915 - DNA, 22 bp, Homo sapiens
ctcagcagtatactctgaagat

SEQ ID NO: 36916 - DNA, 22 bp, Homo sapiens
caggaggagggcagccgcctcc

SEQ ID NO: 36917 - DNA, 22 bp, Homo sapiens
gcggggttccgtgccccagagt

SEQ ID NO: 36918 - DNA, 22 bp, Homo sapiens
ttgtttccataattaagtgtga

SEQ ID NO: 36919 - DNA, 22 bp, Homo sapiens
ctgcactgacttccccggctgc

SEQ ID NO: 36920 - DNA, 22 bp, Homo sapiens
tccagtatcaaagtcctagtcc

SEQ ID NO: 36921 - DNA, 22 bp, Homo sapiens
ttggagatatcacaccttcaca

SEQ ID NO: 36922 - DNA, 22 bp, Homo sapiens
atggctagcaccgcgttgctgg

SEQ ID NO: 36923 - DNA, 22 bp, Homo sapiens
cctccctgccggctggactagt

SEQ ID NO: 36924 - DNA, 22 bp, Homo sapiens
tgatatgtaactactccttata

SEQ ID NO: 36925 - DNA, 22 bp, Homo sapiens
gaaaggagagggttaaggagct

SEQ ID NO: 36926 - DNA, 22 bp, Homo sapiens
ccccatcatctttgaggtcatt

SEQ ID NO: 36927 - DNA, 22 bp, Homo sapiens
gcagtggcatgatgtgggctca

SEQ ID NO: 36928 - DNA, 22 bp, Homo sapiens
ctggtagctcctgaatatccct

SEQ ID NO: 36929 - DNA, 22 bp, Homo sapiens
tatcagcgtgcaaatctttgga

SEQ ID NO: 36930 - DNA, 22 bp, Homo sapiens
gcggcccgagcaggacgggtgg

SEQ ID NO: 36931 - DNA, 22 bp, Homo sapiens
tccaggtgacagagacaggata

SEQ ID NO: 36932 - DNA, 18 bp, Homo sapiens
ggcgggtgttttattcac

SEQ ID NO: 36933 - DNA, 22 bp, Homo sapiens
tcctggatggcctgcaggcggt

SEQ ID NO: 36934 - DNA, 20 bp, Homo sapiens
agagtgagactccatctcag

SEQ ID NO: 36935 - DNA, 22 bp, Homo sapiens
ttcatgtgtttgttgtcaaggg

SEQ ID NO: 36936 - DNA, 22 bp, Homo sapiens
tgggaatgcaaggaaagctgtt

SEQ ID NO: 36937 - DNA, 22 bp, Homo sapiens
ttgtaagtcacaccagggcagg

SEQ ID NO: 36938 - DNA, 22 bp, Homo sapiens
tggggagaaatgtctttgttcc

SEQ ID NO: 36939 - DNA, 22 bp, Homo sapiens
gtgtcaataaatagcggtgtgg

SEQ ID NO: 36940 - DNA, 22 bp, Homo sapiens
gcaactgaacatgtgtgtggcc

SEQ ID NO: 36941 - DNA, 22 bp, Homo sapiens
cagagggttgatgtgaggctta

SEQ ID NO: 36942 - DNA, 22 bp, Homo sapiens
atgcggagccccaagcttgaag

SEQ ID NO: 36943 - DNA, 22 bp, Homo sapiens
ttcctttctctggactgcagcc

SEQ ID NO: 36944 - DNA, 22 bp, Homo sapiens
ggtgtgtctgccaggaactgca

SEQ ID NO: 36945 - DNA, 20 bp, Homo sapiens
tgtggtttttgccagttgaa

SEQ ID NO: 36946 - DNA, 22 bp, Homo sapiens
tggcactgaagctggaaagcct

SEQ ID NO: 36947 - DNA, 22 bp, Homo sapiens
tatctgttaaaacaagctttaa

SEQ ID NO: 36948 - DNA, 22 bp, Homo sapiens
aggctggagtgcagtggtgtga

SEQ ID NO: 36949 - DNA, 22 bp, Homo sapiens
tggctccgttgtacaggctgga

SEQ ID NO: 36950 - DNA, 22 bp, Homo sapiens
ggagagcttggagtgcgatttt

SEQ ID NO: 36951 - DNA, 21 bp, Homo sapiens
taggtgggagccccagtatgc

SEQ ID NO: 36952 - DNA, 22 bp, Homo sapiens
tttgagatggagtcttgctctg

SEQ ID NO: 36953 - DNA, 22 bp, Homo sapiens
atatacacatctttttaaatat

SEQ ID NO: 36954 - DNA, 22 bp, Homo sapiens
tgcacgtgtgagcattcacatg

SEQ ID NO: 36955 - DNA, 22 bp, Homo sapiens
tctcttgagctcagttctgatg

SEQ ID NO: 36956 - DNA, 22 bp, Homo sapiens
acttttcttatcagaaaggcca

SEQ ID NO: 36957 - DNA, 22 bp, Homo sapiens
gaacccggggaggttgcagtga

SEQ ID NO: 36958 - DNA, 22 bp, Homo sapiens
ctggcctaaaaatacagaacaa

SEQ ID NO: 36959 - DNA, 22 bp, Homo sapiens
tgtgctcagtctttggctggga

SEQ ID NO: 36960 - DNA, 22 bp, Homo sapiens
aaggaaagctgtggttctgaga

SEQ ID NO: 36961 - DNA, 22 bp, Homo sapiens
cctgtcatatacatacctcctc

SEQ ID NO: 36962 - DNA, 22 bp, Homo sapiens
gttggccaggctggtctcaaac

SEQ ID NO: 36963 - DNA, 22 bp, Homo sapiens
agctgccccgaggcggcgggaa

SEQ ID NO: 36964 - DNA, 22 bp, Homo sapiens
aaatgcctcattttctctcact

SEQ ID NO: 36965 - DNA, 20 bp, Homo sapiens
caaatccctgctctgtgctg

SEQ ID NO: 36966 - DNA, 22 bp, Homo sapiens
tgagtacaagcagtgctttctc

SEQ ID NO: 36967 - DNA, 22 bp, Homo sapiens
tgttgcacggccttcacagagc

SEQ ID NO: 36968 - DNA, 22 bp, Homo sapiens
cgggagcctctgggtcacactg

SEQ ID NO: 36969 - DNA, 22 bp, Homo sapiens
cctgccagagcagcttgtcctc

SEQ ID NO: 36970 - DNA, 22 bp, Homo sapiens
agcctctctgttagtcactggg

SEQ ID NO: 36971 - DNA, 22 bp, Homo sapiens
cagagagaatcttggcagctga

SEQ ID NO: 36972 - DNA, 22 bp, Homo sapiens
aacatagccagaatgtctcctg

SEQ ID NO: 36973 - DNA, 22 bp, Homo sapiens
ccagatgtccctctcaggtttg

SEQ ID NO: 36974 - DNA, 22 bp, Homo sapiens
gcagctggaagtgacactctgt

SEQ ID NO: 36975 - DNA, 22 bp, Homo sapiens
gcctggagaaaggaaggtggga

SEQ ID NO: 36976 - DNA, 22 bp, Homo sapiens
atgttattgatgcctgaggctt

SEQ ID NO: 36977 - DNA, 22 bp, Homo sapiens
cgctccttgagcgtgtcggcct

SEQ ID NO: 36978 - DNA, 22 bp, Homo sapiens
ttgatgagaccattgccgcgtc

SEQ ID NO: 36979 - DNA, 22 bp, Homo sapiens
gcctccggagttgcagtgtctt

SEQ ID NO: 36980 - DNA, 22 bp, Homo sapiens
tagagtgtcataacagtgccca

SEQ ID NO: 36981 - DNA, 22 bp, Homo sapiens
cttgtcagccaattgtggattt

SEQ ID NO: 36982 - DNA, 22 bp, Homo sapiens
ggcagagcttgcagtgagccga

SEQ ID NO: 36983 - DNA, 22 bp, Homo sapiens
gaagaaggtggcccaggggtag

SEQ ID NO: 36984 - DNA, 22 bp, Homo sapiens
taagtgagggagctgggacttg

SEQ ID NO: 36985 - DNA, 22 bp, Homo sapiens
tccaccctgcttttgtctttga

SEQ ID NO: 36986 - DNA, 22 bp, Homo sapiens
gggttggatcctggtggctgcc

SEQ ID NO: 36987 - DNA, 22 bp, Homo sapiens
gagtaaatgtcactgttgctgt

SEQ ID NO: 36988 - DNA, 22 bp, Homo sapiens
tttcttcctgctttgtcccatg

SEQ ID NO: 36989 - DNA, 22 bp, Homo sapiens
aaggggaagagaccgcagagtc

SEQ ID NO: 36990 - DNA, 22 bp, Homo sapiens
cttatttgcccatgtttcttta

SEQ ID NO: 36991 - DNA, 22 bp, Homo sapiens
gctgaggctcctcgggaggaca

SEQ ID NO: 36992 - DNA, 22 bp, Homo sapiens
tccacagtggttgaactagttt

SEQ ID NO: 36993 - DNA, 22 bp, Homo sapiens
tagaataatctgaggaaatgct

SEQ ID NO: 36994 - DNA, 22 bp, Homo sapiens
gaggcaggcagattgcttgagg

SEQ ID NO: 36995 - DNA, 22 bp, Homo sapiens
aataaacaaatccttccttccc

SEQ ID NO: 36996 - DNA, 22 bp, Homo sapiens
agacgctattttgaggggtcta

SEQ ID NO: 36997 - DNA, 22 bp, Homo sapiens
gaggctgaggttgcagtgagcc

SEQ ID NO: 36998 - DNA, 22 bp, Homo sapiens
tggtggctaccaggtcctgggg

SEQ ID NO: 36999 - DNA, 18 bp, Homo sapiens
acacttcctggtggtgtg

SEQ ID NO: 37000 - DNA, 22 bp, Homo sapiens
attcatcagctaatggacattt

SEQ ID NO: 37001 - DNA, 22 bp, Homo sapiens
tctcaatttgattacattcata

SEQ ID NO: 37002 - DNA, 22 bp, Homo sapiens
ttcaatagaaagtccctagtta

SEQ ID NO: 37003 - DNA, 22 bp, Homo sapiens
ggcctcacccatcggtgccttt

SEQ ID NO: 37004 - DNA, 23 bp, Homo sapiens
acagtcgtaggtatccttttcct

SEQ ID NO: 37005 - DNA, 22 bp, Homo sapiens
cttgtagaattgaaatggtctc

SEQ ID NO: 37006 - DNA, 22 bp, Homo sapiens
ggcccaggctggagtgcagtgg

SEQ ID NO: 37007 - DNA, 22 bp, Homo sapiens
ctgtggctcaggcctgtaagcc

SEQ ID NO: 37008 - DNA, 22 bp, Homo sapiens
tcctcagcttttatttcacttg

SEQ ID NO: 37009 - DNA, 22 bp, Homo sapiens
ggggtccctgcaccagcatgtc

SEQ ID NO: 37010 - DNA, 22 bp, Homo sapiens
atgagctagaaaaccatgtgga

SEQ ID NO: 37011 - DNA, 21 bp, Homo sapiens
gggcactgaaagggaatagca

SEQ ID NO: 37012 - DNA, 22 bp, Homo sapiens
tgacagtgaataagtctcttaa

SEQ ID NO: 37013 - DNA, 22 bp, Homo sapiens
agctcaccacaacctccgcctc

SEQ ID NO: 37014 - DNA, 22 bp, Homo sapiens
gccagggttgccaatgggggca

SEQ ID NO: 37015 - DNA, 22 bp, Homo sapiens
cctcggctgggccttggccact

SEQ ID NO: 37016 - DNA, 22 bp, Homo sapiens
tggcaatgttagcaaagcattt

SEQ ID NO: 37017 - DNA, 22 bp, Homo sapiens
cagcagcagtgttctagaatct

SEQ ID NO: 37018 - DNA, 22 bp, Homo sapiens
cctcccctcagacagagactgg

SEQ ID NO: 37019 - DNA, 22 bp, Homo sapiens
aagcgccatggttcctgcgcag

SEQ ID NO: 37020 - DNA, 20 bp, Homo sapiens
aaactaaaggtgtttggttt

SEQ ID NO: 37021 - DNA, 22 bp, Homo sapiens
ccaggaggttgaggctgcagtg

SEQ ID NO: 37022 - DNA, 22 bp, Homo sapiens
gagatgcagaaccctcaggagc

SEQ ID NO: 37023 - DNA, 22 bp, Homo sapiens
acaggcacctgccaccacatct

SEQ ID NO: 37024 - DNA, 22 bp, Homo sapiens
ttctctgcctcacaggtctaag

SEQ ID NO: 37025 - DNA, 22 bp, Homo sapiens
ggctcaggcctgtaatcctagc

SEQ ID NO: 37026 - DNA, 22 bp, Homo sapiens
aaactagctcttagtttagagg

SEQ ID NO: 37027 - DNA, 22 bp, Homo sapiens
tttgtagcagcatgatttataa

SEQ ID NO: 37028 - DNA, 22 bp, Homo sapiens
gggaacagcttgggctctgcca

SEQ ID NO: 37029 - DNA, 22 bp, Homo sapiens
ggaatgaatttccagctgggtc

SEQ ID NO: 37030 - DNA, 22 bp, Homo sapiens
tctttgctattgtgaatagtgc

SEQ ID NO: 37031 - DNA, 22 bp, Homo sapiens
gtgaggtggtacaatattaact

SEQ ID NO: 37032 - DNA, 22 bp, Homo sapiens
tgtgtttctgagaatcccacct

SEQ ID NO: 37033 - DNA, 22 bp, Homo sapiens
aagacttgaccaggttgaaggc

SEQ ID NO: 37034 - DNA, 22 bp, Homo sapiens
ttagcacaattatttcagttgt

SEQ ID NO: 37035 - DNA, 22 bp, Homo sapiens
ccagcatccatgctccctcggg

SEQ ID NO: 37036 - DNA, 22 bp, Homo sapiens
caagcttgtttctcctgggggt

SEQ ID NO: 37037 - DNA, 22 bp, Homo sapiens
acgtgctggagaagagctcgcc

SEQ ID NO: 37038 - DNA, 22 bp, Homo sapiens
tcacatctaattccatttctgc

SEQ ID NO: 37039 - DNA, 22 bp, Homo sapiens
atggtcacaccactgtactcca

SEQ ID NO: 37040 - DNA, 22 bp, Homo sapiens
ctggagtagccggacgggtctg

SEQ ID NO: 37041 - DNA, 22 bp, Homo sapiens
aacccgggaggcggaggttgtg

SEQ ID NO: 37042 - DNA, 22 bp, Homo sapiens
aggtaaagacagtgaaagaggg

SEQ ID NO: 37043 - DNA, 22 bp, Homo sapiens
aatatcatctctcttttctgca

SEQ ID NO: 37044 - DNA, 22 bp, Homo sapiens
tgcagattcaaatgaaatgcaa

SEQ ID NO: 37045 - DNA, 22 bp, Homo sapiens
agccctcgtttctgcatcctgt

SEQ ID NO: 37046 - DNA, 22 bp, Homo sapiens
tgcagtacagtataatcttgct

SEQ ID NO: 37047 - DNA, 22 bp, Homo sapiens
agtgcactggcaccatctcagc

SEQ ID NO: 37048 - DNA, 22 bp, Homo sapiens
gtaaaaaggccaagcccttgtg

SEQ ID NO: 37049 - DNA, 22 bp, Homo sapiens
gcctccagcccacgcaggcctg

SEQ ID NO: 37050 - DNA, 22 bp, Homo sapiens
agggcgacaatggagagcgttt

SEQ ID NO: 37051 - DNA, 22 bp, Homo sapiens
agaagcagaaactgggcttgtg

SEQ ID NO: 37052 - DNA, 22 bp, Homo sapiens
acattaaacttgcttggctgta

SEQ ID NO: 37053 - DNA, 22 bp, Homo sapiens
ctgcatgtttacatttttgaga

SEQ ID NO: 37054 - DNA, 20 bp, Homo sapiens
ttcgctgggagtggccaggc

SEQ ID NO: 37055 - DNA, 22 bp, Homo sapiens
atatttagataaaaatgggctt

SEQ ID NO: 37056 - DNA, 22 bp, Homo sapiens
tggccttggccgtgctggggtc

SEQ ID NO: 37057 - DNA, 22 bp, Homo sapiens
ttattttaccttcctctgagct

SEQ ID NO: 37058 - DNA, 22 bp, Homo sapiens
gacagtgaacaggttcccactg

SEQ ID NO: 37059 - DNA, 22 bp, Homo sapiens
gagtggggggtccgtctcagtg

SEQ ID NO: 37060 - DNA, 22 bp, Homo sapiens
gcgagtgccgagagggcagggc

SEQ ID NO: 37061 - DNA, 22 bp, Homo sapiens
aggacaaaggaccagatctgga

SEQ ID NO: 37062 - DNA, 22 bp, Homo sapiens
aagtgctgggattacaggtgtg

SEQ ID NO: 37063 - DNA, 22 bp, Homo sapiens
ttgtctgcatgattctaggcag

SEQ ID NO: 37064 - DNA, 22 bp, Homo sapiens
tccttgtaaaggagctctaaca

SEQ ID NO: 37065 - DNA, 22 bp, Homo sapiens
atttcagcagcccatgtttgga

SEQ ID NO: 37066 - DNA, 22 bp, Homo sapiens
cccaggaggtcaaggctgcagt

SEQ ID NO: 37067 - DNA, 22 bp, Homo sapiens
tagattcagatatttaggacaa

SEQ ID NO: 37068 - DNA, 22 bp, Homo sapiens
tcgagctctggagccaaggatg

SEQ ID NO: 37069 - DNA, 22 bp, Homo sapiens
ttgagcccaggaggcctgggtg

SEQ ID NO: 37070 - DNA, 22 bp, Homo sapiens
gaagtgtagtcttgagccccca

SEQ ID NO: 37071 - DNA, 22 bp, Homo sapiens
tttatagtagcatgatttataa

SEQ ID NO: 37072 - DNA, 22 bp, Homo sapiens
atatgggggggcgtgcagagga

SEQ ID NO: 37073 - DNA, 22 bp, Homo sapiens
gggttgaggcggatgtcggcgg

SEQ ID NO: 37074 - DNA, 22 bp, Homo sapiens
gtgccactgcactctagcctag

SEQ ID NO: 37075 - DNA, 22 bp, Homo sapiens
tgcaataactactttaatgttg

SEQ ID NO: 37076 - DNA, 22 bp, Homo sapiens
cttccccaggacctctgctaaa

SEQ ID NO: 37077 - DNA, 22 bp, Homo sapiens
ctgggaagaagggacaacagcg

SEQ ID NO: 37078 - DNA, 22 bp, Homo sapiens
gtacagaggttgctggaggctc

SEQ ID NO: 37079 - DNA, 22 bp, Homo sapiens
attggtagttttgtatttctct

SEQ ID NO: 37080 - DNA, 22 bp, Homo sapiens
ggaggcggaggctgcagtgagc

SEQ ID NO: 37081 - DNA, 22 bp, Homo sapiens
ccactattactgtgtggcagtc

SEQ ID NO: 37082 - DNA, 22 bp, Homo sapiens
tcactgtagcctcaactcttgg

SEQ ID NO: 37083 - DNA, 22 bp, Homo sapiens
cagagcttcctgctgggcttct

SEQ ID NO: 37084 - DNA, 22 bp, Homo sapiens
ttggggtcccacaggctgcctg

SEQ ID NO: 37085 - DNA, 22 bp, Homo sapiens
attgcacatctgcactacagcc

SEQ ID NO: 37086 - DNA, 22 bp, Homo sapiens
aaggagcacacaatctagaacc

SEQ ID NO: 37087 - DNA, 22 bp, Homo sapiens
agagcggggatagttaatattc

SEQ ID NO: 37088 - DNA, 22 bp, Homo sapiens
gtgctgacaggagcctggcggt

SEQ ID NO: 37089 - DNA, 22 bp, Homo sapiens
ctaggaccactgtaacaaagta

SEQ ID NO: 37090 - DNA, 22 bp, Homo sapiens
ttttgagatggagtcttgctct

SEQ ID NO: 37091 - DNA, 22 bp, Homo sapiens
ttccatttggcacttcactgag

SEQ ID NO: 37092 - DNA, 22 bp, Homo sapiens
ttttcagaattagcataccatt

SEQ ID NO: 37093 - DNA, 22 bp, Homo sapiens
ctgtgatttctaaagagtagca

SEQ ID NO: 37094 - DNA, 22 bp, Homo sapiens
tgacatgtatatcttacgctat

SEQ ID NO: 37095 - DNA, 22 bp, Homo sapiens
gtgcaaaagtaattgtggtttt

SEQ ID NO: 37096 - DNA, 22 bp, Homo sapiens
aggaatgtgaaacaggtggctg

SEQ ID NO: 37097 - DNA, 22 bp, Homo sapiens
tggctgtgtccctgtccagagt

SEQ ID NO: 37098 - DNA, 22 bp, Homo sapiens
acgcctgtaatcccagcacttt

SEQ ID NO: 37099 - DNA, 22 bp, Homo sapiens
gtggctgcagcggctgtggaga

SEQ ID NO: 37100 - DNA, 22 bp, Homo sapiens
agcttagtggttgtatgagtta

SEQ ID NO: 37101 - DNA, 22 bp, Homo sapiens
ataatctttcttttccagatag

SEQ ID NO: 37102 - DNA, 22 bp, Homo sapiens
gaagaaagatcaaatagtttcc

SEQ ID NO: 37103 - DNA, 22 bp, Homo sapiens
ggagtgaagtggcgcgatctcg

SEQ ID NO: 37104 - DNA, 22 bp, Homo sapiens
tgcaatccccgcctcaacagga

SEQ ID NO: 37105 - DNA, 22 bp, Homo sapiens
agagggatcaccctgtttctgg

SEQ ID NO: 37106 - DNA, 22 bp, Homo sapiens
ggctgggcaggtctgcacaggg

SEQ ID NO: 37107 - DNA, 22 bp, Homo sapiens
tgttgagtatatacctacaagt

SEQ ID NO: 37108 - DNA, 22 bp, Homo sapiens
accaggcccgctgctatggtgg

SEQ ID NO: 37109 - DNA, 22 bp, Homo sapiens
ggaactcctgctccaagcagct

SEQ ID NO: 37110 - DNA, 22 bp, Homo sapiens
aaagtgctgggattacaggcct

SEQ ID NO: 37111 - DNA, 23 bp, Homo sapiens
cagagctggctcagagctgcctg

SEQ ID NO: 37112 - DNA, 19 bp, Homo sapiens
ctccttgccatttcttttc

SEQ ID NO: 37113 - DNA, 22 bp, Homo sapiens
ggttgtagttggaggttgtata

SEQ ID NO: 37114 - DNA, 22 bp, Homo sapiens
tggcagtggcgggactcagggc

SEQ ID NO: 37115 - DNA, 22 bp, Homo sapiens
ctatggtctggaccgaggtcct

SEQ ID NO: 37116 - DNA, 22 bp, Homo sapiens
gagcccaggaagtggaggctga

SEQ ID NO: 37117 - DNA, 22 bp, Homo sapiens
catgcggctctttccaaaccgg

SEQ ID NO: 37118 - DNA, 22 bp, Homo sapiens
gaccctgtttctacaaataatt

SEQ ID NO: 37119 - DNA, 22 bp, Homo sapiens
agctttggttgccatgatctga

SEQ ID NO: 37120 - DNA, 22 bp, Homo sapiens
gctgcactttgactgctggggt

SEQ ID NO: 37121 - DNA, 22 bp, Homo sapiens
tggaagctcaaggcagggtgag

SEQ ID NO: 37122 - DNA, 22 bp, Homo sapiens
agtccggggtctggacacctgg

SEQ ID NO: 37123 - DNA, 22 bp, Homo sapiens
ctttgcttgacactgtgattgt

SEQ ID NO: 37124 - DNA, 22 bp, Homo sapiens
agaggaagtaatcaggacctgc

SEQ ID NO: 37125 - DNA, 22 bp, Homo sapiens
tggaaacacccacgcatgcata

SEQ ID NO: 37126 - DNA, 22 bp, Homo sapiens
ccccagtggaggtgagggtcct

SEQ ID NO: 37127 - DNA, 22 bp, Homo sapiens
acccagtctggagtgcagtgac

SEQ ID NO: 37128 - DNA, 22 bp, Homo sapiens
caaagtgctgggattacaggtg

SEQ ID NO: 37129 - DNA, 22 bp, Homo sapiens
ctggctcgcattatattttggg

SEQ ID NO: 37130 - DNA, 22 bp, Homo sapiens
atccatcctgccatctgagtag

SEQ ID NO: 37131 - DNA, 22 bp, Homo sapiens
atcttgttaaaaagcagattct

SEQ ID NO: 37132 - DNA, 22 bp, Homo sapiens
caagaatcaacattatttagtg

SEQ ID NO: 37133 - DNA, 22 bp, Homo sapiens
tgggaaggggagctggaaagga

SEQ ID NO: 37134 - DNA, 22 bp, Homo sapiens
acgggctgggacggggaagctc

SEQ ID NO: 37135 - DNA, 21 bp, Homo sapiens
tccctgagcccaaggggctcc

SEQ ID NO: 37136 - DNA, 22 bp, Homo sapiens
tggctcactgtagccttgacct

SEQ ID NO: 37137 - DNA, 22 bp, Homo sapiens
cagtttcttcctcccccagaga

SEQ ID NO: 37138 - DNA, 22 bp, Homo sapiens
cttggggaagccactgatccct

SEQ ID NO: 37139 - DNA, 22 bp, Homo sapiens
atacagttatagtcagggctaa

SEQ ID NO: 37140 - DNA, 22 bp, Homo sapiens
atctgggaatggaagccttctg

SEQ ID NO: 37141 - DNA, 22 bp, Homo sapiens
cggccaagccggggccccgaag

SEQ ID NO: 37142 - DNA, 22 bp, Homo sapiens
tcccctttgtcttcctgtgggt

SEQ ID NO: 37143 - DNA, 22 bp, Homo sapiens
ttcacagtggtagtgcatttag

SEQ ID NO: 37144 - DNA, 22 bp, Homo sapiens
tgtgtcattgccatgaaaaggc

SEQ ID NO: 37145 - DNA, 22 bp, Homo sapiens
tttggaaattttcatccagaca

SEQ ID NO: 37146 - DNA, 22 bp, Homo sapiens
gatgtagacacttggaggctta

SEQ ID NO: 37147 - DNA, 22 bp, Homo sapiens
ctggagagaatgtggaatgatt

SEQ ID NO: 37148 - DNA, 22 bp, Homo sapiens
gctgtatgtgaggccacagtga

SEQ ID NO: 37149 - DNA, 22 bp, Homo sapiens
agatttatgtggtcacactcag

SEQ ID NO: 37150 - DNA, 22 bp, Homo sapiens
agcttgtagaaggccacgagca

SEQ ID NO: 37151 - DNA, 22 bp, Homo sapiens
tggcacagcctccatgtcgtcc

SEQ ID NO: 37152 - DNA, 22 bp, Homo sapiens
ccacactccccgcaggcgtagg

SEQ ID NO: 37153 - DNA, 22 bp, Homo sapiens
ggacacgtggctgaaggcggcc

SEQ ID NO: 37154 - DNA, 22 bp, Homo sapiens
ctcctggaggatagtgactggg

SEQ ID NO: 37155 - DNA, 22 bp, Homo sapiens
cagtggttgaacccaaatactt

SEQ ID NO: 37156 - DNA, 22 bp, Homo sapiens
ccatgtggtgggaaggagaatg

SEQ ID NO: 37157 - DNA, 22 bp, Homo sapiens
atggaccagagcctcattctgt

SEQ ID NO: 37158 - DNA, 22 bp, Homo sapiens
aagtttgtgtagtttagcatcc

SEQ ID NO: 37159 - DNA, 22 bp, Homo sapiens
tcactgcaagctcctcctcctg

SEQ ID NO: 37160 - DNA, 22 bp, Homo sapiens
tgttgactcaacactgtgggca

SEQ ID NO: 37161 - DNA, 22 bp, Homo sapiens
tccaggatggtgacggtggcca

SEQ ID NO: 37162 - DNA, 22 bp, Homo sapiens
gtcagatgtttgcgtagggtat

SEQ ID NO: 37163 - DNA, 22 bp, Homo sapiens
ggctagggatctagaccaggac

SEQ ID NO: 37164 - DNA, 22 bp, Homo sapiens
ggcagcttgtcctggaggatgg

SEQ ID NO: 37165 - DNA, 22 bp, Homo sapiens
ggcggtctcagcaccctcttgg

SEQ ID NO: 37166 - DNA, 22 bp, Homo sapiens
gggaagtgagctggaatcaagg

SEQ ID NO: 37167 - DNA, 22 bp, Homo sapiens
tcattgagttgcacttttacta

SEQ ID NO: 37168 - DNA, 20 bp, Homo sapiens
agcggctggcggaggacacg

SEQ ID NO: 37169 - DNA, 22 bp, Homo sapiens
ctattattagataatctacttg

SEQ ID NO: 37170 - DNA, 22 bp, Homo sapiens
tataccatgtgtgcacactccc

SEQ ID NO: 37171 - DNA, 22 bp, Homo sapiens
ccctggaggcggagcttgcagt

SEQ ID NO: 37172 - DNA, 22 bp, Homo sapiens
accaggttggtgtccttctggc

SEQ ID NO: 37173 - DNA, 22 bp, Homo sapiens
tcctcctgtctaccagttcctg

SEQ ID NO: 37174 - DNA, 22 bp, Homo sapiens
tagagatggggtcttgctatga

SEQ ID NO: 37175 - DNA, 16 bp, Homo sapiens
tgcggcaacttgcggc

SEQ ID NO: 37176 - DNA, 22 bp, Homo sapiens
atataatttttggttagctcaa

SEQ ID NO: 37177 - DNA, 22 bp, Homo sapiens
attgcactccagcctgggcgac

SEQ ID NO: 37178 - DNA, 22 bp, Homo sapiens
ccgccgtgcaggccgcgacgtg

SEQ ID NO: 37179 - DNA, 22 bp, Homo sapiens
ctgatagacaatcaccatggga

SEQ ID NO: 37180 - DNA, 22 bp, Homo sapiens
ccctcccaggagtggccagaga

SEQ ID NO: 37181 - DNA, 22 bp, Homo sapiens
actcaaatagcaacggtgagaa

SEQ ID NO: 37182 - DNA, 22 bp, Homo sapiens
atgtgagtgctatgatagacag

SEQ ID NO: 37183 - DNA, 22 bp, Homo sapiens
cttgccttcagtccatcagtca

SEQ ID NO: 37184 - DNA, 22 bp, Homo sapiens
ggcgcccccttcaaacagagca

SEQ ID NO: 37185 - DNA, 22 bp, Homo sapiens
agaggcaggaggttgacttgag

SEQ ID NO: 37186 - DNA, 22 bp, Homo sapiens
aaggcaaaagaggtgtcatcac

SEQ ID NO: 37187 - DNA, 17 bp, Homo sapiens
ggctgcagtccaggagg

SEQ ID NO: 37188 - DNA, 19 bp, Homo sapiens
gatttaaacgtggctctat

SEQ ID NO: 37189 - DNA, 22 bp, Homo sapiens
atagcagggatgtcagcaagta

SEQ ID NO: 37190 - DNA, 22 bp, Homo sapiens
gacagacacaattgatccatga

SEQ ID NO: 37191 - DNA, 22 bp, Homo sapiens
acccggagtcggaggttgcagt

SEQ ID NO: 37192 - DNA, 22 bp, Homo sapiens
tgtccagctcgagacactatct

SEQ ID NO: 37193 - DNA, 22 bp, Homo sapiens
gctccccaaaagctccaggaaa

SEQ ID NO: 37194 - DNA, 22 bp, Homo sapiens
aaggagaaatggtagatgtgca

SEQ ID NO: 37195 - DNA, 22 bp, Homo sapiens
aagaggcgctcctcacttccta

SEQ ID NO: 37196 - DNA, 22 bp, Homo sapiens
aggggaccaaaatgtcctgcct

SEQ ID NO: 37197 - DNA, 23 bp, Homo sapiens
aggatgtaggatgtatggcagag

SEQ ID NO: 37198 - DNA, 22 bp, Homo sapiens
tgtttcaaattacttgaggatt

SEQ ID NO: 37199 - DNA, 22 bp, Homo sapiens
tgtcctgtgattccagctcttc

SEQ ID NO: 37200 - DNA, 22 bp, Homo sapiens
cccaggaggtggagttcacagt

SEQ ID NO: 37201 - DNA, 22 bp, Homo sapiens
agcactgatttaaactggattt

SEQ ID NO: 37202 - DNA, 22 bp, Homo sapiens
acctggccaatttttgtatttt

SEQ ID NO: 37203 - DNA, 21 bp, Homo sapiens
accactgcctccaaggttcag

SEQ ID NO: 37204 - DNA, 22 bp, Homo sapiens
agaatccctgcttgtcttcaaa

SEQ ID NO: 37205 - DNA, 22 bp, Homo sapiens
tggatatccttgttaactttct

SEQ ID NO: 37206 - DNA, 22 bp, Homo sapiens
ctggaaggcagaggttgcagtg

SEQ ID NO: 37207 - DNA, 22 bp, Homo sapiens
ccttcccatgcagcctgtctga

SEQ ID NO: 37208 - DNA, 22 bp, Homo sapiens
ccaggaggcggaaggtacagtg

SEQ ID NO: 37209 - DNA, 22 bp, Homo sapiens
ctctccattccctacagttttc

SEQ ID NO: 37210 - DNA, 22 bp, Homo sapiens
tactgtgtgcccagccgagctg

SEQ ID NO: 37211 - DNA, 19 bp, Homo sapiens
gccttcccaccacccgtcc

SEQ ID NO: 37212 - DNA, 22 bp, Homo sapiens
accaggggatggttggcactgt

SEQ ID NO: 37213 - DNA, 22 bp, Homo sapiens
tcatggggccacagctgccagc

SEQ ID NO: 37214 - DNA, 22 bp, Homo sapiens
tattattgacatttacttggtg

SEQ ID NO: 37215 - DNA, 22 bp, Homo sapiens
tgaggtgccacccaagagcctt

SEQ ID NO: 37216 - DNA, 22 bp, Homo sapiens
cgtgagcaaaatggacactccc

SEQ ID NO: 37217 - DNA, 22 bp, Homo sapiens
actgggcagcagctcgagccgc

SEQ ID NO: 37218 - DNA, 22 bp, Homo sapiens
gtaatctcagctacttgggagg

SEQ ID NO: 37219 - DNA, 22 bp, Homo sapiens
gcccatgcactttctgtgatgg

SEQ ID NO: 37220 - DNA, 22 bp, Homo sapiens
accgggctaatttttgtatctt

SEQ ID NO: 37221 - DNA, 22 bp, Homo sapiens
caaagtgctaggattacaggcg

SEQ ID NO: 37222 - DNA, 22 bp, Homo sapiens
ggggcagagaataaaaacctaa

SEQ ID NO: 37223 - DNA, 21 bp, Homo sapiens
tcctgtaagcttgggtggctc

SEQ ID NO: 37224 - DNA, 22 bp, Homo sapiens
gtggggtagatctttctcagga

SEQ ID NO: 37225 - DNA, 22 bp, Homo sapiens
ggccgccctttccacggtttct

SEQ ID NO: 37226 - DNA, 22 bp, Homo sapiens
ttagctcagaaaatttaaactt

SEQ ID NO: 37227 - DNA, 22 bp, Homo sapiens
tgcctagttctgtatttacagt

SEQ ID NO: 37228 - DNA, 22 bp, Homo sapiens
cgctgcagaagcgtgttcagga

SEQ ID NO: 37229 - DNA, 22 bp, Homo sapiens
tggaatggaaacaaactgagga

SEQ ID NO: 37230 - DNA, 22 bp, Homo sapiens
ggtcagaggtcccagaagaagc

SEQ ID NO: 37231 - DNA, 22 bp, Homo sapiens
ccagcctggttcagaattggct

SEQ ID NO: 37232 - DNA, 22 bp, Homo sapiens
catctttgcccatccacttcca

SEQ ID NO: 37233 - DNA, 22 bp, Homo sapiens
aactctatttaccctactaaac

SEQ ID NO: 37234 - DNA, 20 bp, Homo sapiens
tgtttgtgtggggccttggc

SEQ ID NO: 37235 - DNA, 22 bp, Homo sapiens
ttggccttagcttcttcttaaa

SEQ ID NO: 37236 - DNA, 22 bp, Homo sapiens
atgcttgcccatgtttctgaag

SEQ ID NO: 37237 - DNA, 22 bp, Homo sapiens
tccctgcaggtgtgcaagctga

SEQ ID NO: 37238 - DNA, 22 bp, Homo sapiens
catataaatacaacatgtgtta

SEQ ID NO: 37239 - DNA, 20 bp, Homo sapiens
tttcttgtcggctgttgctg

SEQ ID NO: 37240 - DNA, 22 bp, Homo sapiens
gccagagttgaggcagtttatt

SEQ ID NO: 37241 - DNA, 22 bp, Homo sapiens
atgagctcatccgagtcacact

SEQ ID NO: 37242 - DNA, 22 bp, Homo sapiens
actaaagctcacagagttgaac

SEQ ID NO: 37243 - DNA, 22 bp, Homo sapiens
tggattccacgcctgctcctgt

SEQ ID NO: 37244 - DNA, 22 bp, Homo sapiens
agacacttcatgtaagtggaat

SEQ ID NO: 37245 - DNA, 22 bp, Homo sapiens
gtcttttgctagccagagagct

SEQ ID NO: 37246 - DNA, 22 bp, Homo sapiens
tcactgtatcatgttgcactta

SEQ ID NO: 37247 - DNA, 22 bp, Homo sapiens
ctggcccaggtggtcgttgagg

SEQ ID NO: 37248 - DNA, 22 bp, Homo sapiens
ttggaatgttttaatataaatt

SEQ ID NO: 37249 - DNA, 22 bp, Homo sapiens
tggtgcaaaactaattgcggtt

SEQ ID NO: 37250 - DNA, 22 bp, Homo sapiens
agggagcaaaggtttcagggtt

SEQ ID NO: 37251 - DNA, 22 bp, Homo sapiens
accccagaggcggaggctgcag

SEQ ID NO: 37252 - DNA, 22 bp, Homo sapiens
tgccacctgtacatgctatctg

SEQ ID NO: 37253 - DNA, 22 bp, Homo sapiens
aagctctttccactaaaccact

SEQ ID NO: 37254 - DNA, 22 bp, Homo sapiens
ccagcagccaccttctcgaaat

SEQ ID NO: 37255 - DNA, 22 bp, Homo sapiens
aagcagaatagaggcccttccc

SEQ ID NO: 37256 - DNA, 22 bp, Homo sapiens
cattacagaatatgtaatgatc

SEQ ID NO: 37257 - DNA, 22 bp, Homo sapiens
tgccaggcgtggtggtgcgcac

SEQ ID NO: 37258 - DNA, 22 bp, Homo sapiens
gtgggctgcccttgaggtcagc

SEQ ID NO: 37259 - DNA, 22 bp, Homo sapiens
ataccaccatctatgaaaggta

SEQ ID NO: 37260 - DNA, 22 bp, Homo sapiens
gtctcccagcctacatctttct

SEQ ID NO: 37261 - DNA, 15 bp, Homo sapiens
tggcccacccgttga

SEQ ID NO: 37262 - DNA, 22 bp, Homo sapiens
gtggcagagccaaggctggagc

SEQ ID NO: 37263 - DNA, 20 bp, Homo sapiens
ccaccctgtccggggcggag

SEQ ID NO: 37264 - DNA, 22 bp, Homo sapiens
cccaggctggagtgcagtggcg

SEQ ID NO: 37265 - DNA, 17 bp, Homo sapiens
caggtgacctggtgatg

SEQ ID NO: 37266 - DNA, 22 bp, Homo sapiens
gggccctgcgactcgcggcgga

SEQ ID NO: 37267 - DNA, 22 bp, Homo sapiens
gatctcaaagcagtgtgggttg

SEQ ID NO: 37268 - DNA, 22 bp, Homo sapiens
cacagctgaagtagccatgtgg

SEQ ID NO: 37269 - DNA, 22 bp, Homo sapiens
tgagatggagtctcgctctgtt

SEQ ID NO: 37270 - DNA, 22 bp, Homo sapiens
agctcctgaaaatccagactgg

SEQ ID NO: 37271 - DNA, 22 bp, Homo sapiens
ggaggcagaatagagtgtgggt

SEQ ID NO: 37272 - DNA, 22 bp, Homo sapiens
tgtctgttattggtgtataaga

SEQ ID NO: 37273 - DNA, 22 bp, Homo sapiens
tccttgtaacgttgggctgggg

SEQ ID NO: 37274 - DNA, 20 bp, Homo sapiens
aagacaccagtggcagcccc

SEQ ID NO: 37275 - DNA, 22 bp, Homo sapiens
aaacttttttaggttcataggc

SEQ ID NO: 37276 - DNA, 19 bp, Homo sapiens
agaaccactgctctcttca

SEQ ID NO: 37277 - DNA, 22 bp, Homo sapiens
ttctatttttgtggaactgtag

SEQ ID NO: 37278 - DNA, 22 bp, Homo sapiens
gaggcaggaggattgcttgagc

SEQ ID NO: 37279 - DNA, 22 bp, Homo sapiens
gaagtattactctgaatgtatt

SEQ ID NO: 37280 - DNA, 22 bp, Homo sapiens
aatgcaatgcagcacctccttg

SEQ ID NO: 37281 - DNA, 21 bp, Homo sapiens
tcacgtggtcacatgagcttt

SEQ ID NO: 37282 - DNA, 22 bp, Homo sapiens
gggacttaatgcagagagggac

SEQ ID NO: 37283 - DNA, 22 bp, Homo sapiens
ttatagcagcatgatttatagt

SEQ ID NO: 37284 - DNA, 22 bp, Homo sapiens
agggaagtggtctgggaacttg

SEQ ID NO: 37285 - DNA, 22 bp, Homo sapiens
gagcccaggcagaggttgcagt

SEQ ID NO: 37286 - DNA, 22 bp, Homo sapiens
tgccacagacaggacagaacag

SEQ ID NO: 37287 - DNA, 20 bp, Homo sapiens
tttgaatgtaaagcatgtca

SEQ ID NO: 37288 - DNA, 22 bp, Homo sapiens
gcaccaggtgcagccgggcccc

SEQ ID NO: 37289 - DNA, 22 bp, Homo sapiens
aggggagccagggctgcgagtt

SEQ ID NO: 37290 - DNA, 22 bp, Homo sapiens
tagaggctttcagcggtaggtc

SEQ ID NO: 37291 - DNA, 22 bp, Homo sapiens
ccagtgtgcattatcatgtgtc

SEQ ID NO: 37292 - DNA, 22 bp, Homo sapiens
gggaatgtagcaaatctgcaat

SEQ ID NO: 37293 - DNA, 22 bp, Homo sapiens
gtgagccgagtatagttcatag

SEQ ID NO: 37294 - DNA, 23 bp, Homo sapiens
agagcaaggaaatgaggtgtgat

SEQ ID NO: 37295 - DNA, 18 bp, Homo sapiens
tctgtgggatcagtgagg

SEQ ID NO: 37296 - DNA, 22 bp, Homo sapiens
cataatttctaccagggccata

SEQ ID NO: 37297 - DNA, 22 bp, Homo sapiens
gtctccttgtggatctcaagga

SEQ ID NO: 37298 - DNA, 21 bp, Homo sapiens
gccatttcacacagacatttg

SEQ ID NO: 37299 - DNA, 22 bp, Homo sapiens
cgccgcctgctgcagcagctgt

SEQ ID NO: 37300 - DNA, 22 bp, Homo sapiens
tgtaccgcaaatgctgctgcct

SEQ ID NO: 37301 - DNA, 22 bp, Homo sapiens
taagcccaggaatgcacttcag

SEQ ID NO: 37302 - DNA, 23 bp, Homo sapiens
gctcatcaggcttagagtcaagg

SEQ ID NO: 37303 - DNA, 22 bp, Homo sapiens
ttgacacagtcaacttgatttt

SEQ ID NO: 37304 - DNA, 22 bp, Homo sapiens
ttgcttcctctagtttcttgaa

SEQ ID NO: 37305 - DNA, 22 bp, Homo sapiens
gagacacaggcacagaagaggc

SEQ ID NO: 37306 - DNA, 22 bp, Homo sapiens
tagcccaggctggagtgcaggg

SEQ ID NO: 37307 - DNA, 18 bp, Homo sapiens
gaggtagataagattttc

SEQ ID NO: 37308 - DNA, 22 bp, Homo sapiens
tgactggattgtcattacgacg

SEQ ID NO: 37309 - DNA, 22 bp, Homo sapiens
agtcttcccagaggaggtgcca

SEQ ID NO: 37310 - DNA, 22 bp, Homo sapiens
cactgggcgtgtcctgggtgag

SEQ ID NO: 37311 - DNA, 22 bp, Homo sapiens
taggtttactgaattagtggaa

SEQ ID NO: 37312 - DNA, 22 bp, Homo sapiens
cctagatgggatggcggccggg

SEQ ID NO: 37313 - DNA, 22 bp, Homo sapiens
gactttggttcagggctcagag

SEQ ID NO: 37314 - DNA, 22 bp, Homo sapiens
aaatactcatcccaggaactgg

SEQ ID NO: 37315 - DNA, 22 bp, Homo sapiens
ggccctggcagccacgaaagcc

SEQ ID NO: 37316 - DNA, 22 bp, Homo sapiens
agttctgcctatatagaaactc

SEQ ID NO: 37317 - DNA, 22 bp, Homo sapiens
aaagattaaatcaaattggtca

SEQ ID NO: 37318 - DNA, 22 bp, Homo sapiens
accgggaagtcctgcactgggc

SEQ ID NO: 37319 - DNA, 22 bp, Homo sapiens
tgcatattatgtgtatctgtct

SEQ ID NO: 37320 - DNA, 22 bp, Homo sapiens
gctgctgcttgaaggctcggag

SEQ ID NO: 37321 - DNA, 22 bp, Homo sapiens
ttagacatgatggtgcagagag

SEQ ID NO: 37322 - DNA, 22 bp, Homo sapiens
agccagtgcagctggaaattca

SEQ ID NO: 37323 - DNA, 22 bp, Homo sapiens
attgtggtgtcagttataggca

SEQ ID NO: 37324 - DNA, 22 bp, Homo sapiens
acagcagagcctggtacttact

SEQ ID NO: 37325 - DNA, 22 bp, Homo sapiens
gtcctgacggctgattggcctg

SEQ ID NO: 37326 - DNA, 22 bp, Homo sapiens
gtgttgatgacattttagaaac

SEQ ID NO: 37327 - DNA, 22 bp, Homo sapiens
tgagcaggcgcagcaggaggtc

SEQ ID NO: 37328 - DNA, 22 bp, Homo sapiens
gatggaggagatggcagggtgc

SEQ ID NO: 37329 - DNA, 22 bp, Homo sapiens
attgtactacaccatagtactg

SEQ ID NO: 37330 - DNA, 22 bp, Homo sapiens
ggtgagcagctgtctgtatgga

SEQ ID NO: 37331 - DNA, 22 bp, Homo sapiens
gggtgctttggctcacgcctgt

SEQ ID NO: 37332 - DNA, 22 bp, Homo sapiens
gacaattagatcattcctttga

SEQ ID NO: 37333 - DNA, 23 bp, Homo sapiens
cctgcctccccatcagttataca

SEQ ID NO: 37334 - DNA, 20 bp, Homo sapiens
ctgggtggcaagcaaggggg

SEQ ID NO: 37335 - DNA, 16 bp, Homo sapiens
aggctcagaggctgga

SEQ ID NO: 37336 - DNA, 22 bp, Homo sapiens
tagcacagagcttttaaacttc

SEQ ID NO: 37337 - DNA, 22 bp, Homo sapiens
tagcatgtcagtcgccacacgt

SEQ ID NO: 37338 - DNA, 22 bp, Homo sapiens
caggctgaagtgcagtggtgtg

SEQ ID NO: 37339 - DNA, 22 bp, Homo sapiens
aagacacaatgtagcccagcac

SEQ ID NO: 37340 - DNA, 22 bp, Homo sapiens
ggagagcagggaggctgctctg

SEQ ID NO: 37341 - DNA, 22 bp, Homo sapiens
cgggcagtgtggctccagagtc

SEQ ID NO: 37342 - DNA, 22 bp, Homo sapiens
ttttaagttggattgctaagta

SEQ ID NO: 37343 - DNA, 22 bp, Homo sapiens
accccactcacacatggacctg

SEQ ID NO: 37344 - DNA, 22 bp, Homo sapiens
cttgccttctctggggtggcag

SEQ ID NO: 37345 - DNA, 22 bp, Homo sapiens
ttcaatatgatattagctgtgg

SEQ ID NO: 37346 - DNA, 22 bp, Homo sapiens
ggtgacgaatccatagcatcga

SEQ ID NO: 37347 - DNA, 22 bp, Homo sapiens
gagcagtgtttgtggacctgga

SEQ ID NO: 37348 - DNA, 22 bp, Homo sapiens
taacagtatatttaccaaacct

SEQ ID NO: 37349 - DNA, 22 bp, Homo sapiens
taagtcttcatagtctaatgtc

SEQ ID NO: 37350 - DNA, 22 bp, Homo sapiens
gggaaatctcgtcctctattta

SEQ ID NO: 37351 - DNA, 22 bp, Homo sapiens
tgacaagaaagcgtcttctttt

SEQ ID NO: 37352 - DNA, 22 bp, Homo sapiens
gacactgcacttggggcccaca

SEQ ID NO: 37353 - DNA, 22 bp, Homo sapiens
cagaaaccaaatgggatgggga

SEQ ID NO: 37354 - DNA, 22 bp, Homo sapiens
gcggcaggagtaaaggaggaag

SEQ ID NO: 37355 - DNA, 22 bp, Homo sapiens
ttgaccactgaatggttctgaa

SEQ ID NO: 37356 - DNA, 22 bp, Homo sapiens
aggagggtgggaagcagtttta

SEQ ID NO: 37357 - DNA, 22 bp, Homo sapiens
ggtctcttgtccaaggtcacac

SEQ ID NO: 37358 - DNA, 22 bp, Homo sapiens
ttctagtgtccttggacttgct

SEQ ID NO: 37359 - DNA, 23 bp, Homo sapiens
catctagcatccagtgagtagtg

SEQ ID NO: 37360 - DNA, 22 bp, Homo sapiens
atgcccaatgtcacaatttttg

SEQ ID NO: 37361 - DNA, 22 bp, Homo sapiens
accctctagagggaagcacttt

SEQ ID NO: 37362 - DNA, 22 bp, Homo sapiens
acattcccaccaacagtgtaaa

SEQ ID NO: 37363 - DNA, 22 bp, Homo sapiens
gtcactgtatccaggttccagc

SEQ ID NO: 37364 - DNA, 22 bp, Homo sapiens
tgcgcatgcgtggctctccggc

SEQ ID NO: 37365 - DNA, 22 bp, Homo sapiens
gagagtctagtgcacctagttt

SEQ ID NO: 37366 - DNA, 18 bp, Homo sapiens
tttctcagactctctttc

SEQ ID NO: 37367 - DNA, 22 bp, Homo sapiens
accccaggaagtggaggtcatg

SEQ ID NO: 37368 - DNA, 22 bp, Homo sapiens
taagatgtttacagtatggaga

SEQ ID NO: 37369 - DNA, 22 bp, Homo sapiens
gaaagagaacctgggcctagat

SEQ ID NO: 37370 - DNA, 22 bp, Homo sapiens
gggtggagagaaagaaacgtga

SEQ ID NO: 37371 - DNA, 22 bp, Homo sapiens
cagctgcccctccagggctggg

SEQ ID NO: 37372 - DNA, 22 bp, Homo sapiens
aggaaataagggacaagacaaa

SEQ ID NO: 37373 - DNA, 22 bp, Homo sapiens
atggggggatgaaggagtccaa

SEQ ID NO: 37374 - DNA, 22 bp, Homo sapiens
cttgtcttgcacacggttgcca

SEQ ID NO: 37375 - DNA, 22 bp, Homo sapiens
tgtgaatggacaattaaatcta

SEQ ID NO: 37376 - DNA, 22 bp, Homo sapiens
gagcactgatttatttttgtct

SEQ ID NO: 37377 - DNA, 22 bp, Homo sapiens
actaggggctcaggcccaggga

SEQ ID NO: 37378 - DNA, 22 bp, Homo sapiens
ttatgtctcaaccgggcacggt

SEQ ID NO: 37379 - DNA, 22 bp, Homo sapiens
aggacagagggaccagagccca

SEQ ID NO: 37380 - DNA, 19 bp, Homo sapiens
ttctggtctggaatcaagg

SEQ ID NO: 37381 - DNA, 22 bp, Homo sapiens
cgttaataggtgcaaggtaagg

SEQ ID NO: 37382 - DNA, 22 bp, Homo sapiens
tcaccagacgcgtgggtctgag

SEQ ID NO: 37383 - DNA, 22 bp, Homo sapiens
aatgtattcttcaaccttgcta

SEQ ID NO: 37384 - DNA, 22 bp, Homo sapiens
actttaaaactgatcatcagag

SEQ ID NO: 37385 - DNA, 22 bp, Homo sapiens
agcccagaggctgggcgtgcat

SEQ ID NO: 37386 - DNA, 22 bp, Homo sapiens
gagctgtgtatgcatcattctg

SEQ ID NO: 37387 - DNA, 22 bp, Homo sapiens
ccaagcagagcagcctctctgg

SEQ ID NO: 37388 - DNA, 22 bp, Homo sapiens
aattacagtcggagcagcactg

SEQ ID NO: 37389 - DNA, 22 bp, Homo sapiens
gtagggctcagtaaatactttg

SEQ ID NO: 37390 - DNA, 21 bp, Homo sapiens
cagagctgtccaaaccctgac

SEQ ID NO: 37391 - DNA, 22 bp, Homo sapiens
gtctgctcatgctaccgcgggc

SEQ ID NO: 37392 - DNA, 22 bp, Homo sapiens
tttattggatatttacaagata

SEQ ID NO: 37393 - DNA, 22 bp, Homo sapiens
agggaaatctcagctctaaaat

SEQ ID NO: 37394 - DNA, 22 bp, Homo sapiens
gtggattacaagacagttgaga

SEQ ID NO: 37395 - DNA, 22 bp, Homo sapiens
cagcaggaggtgagtagcaggt

SEQ ID NO: 37396 - DNA, 22 bp, Homo sapiens
cagggggctcaaaggagagtgc

SEQ ID NO: 37397 - DNA, 22 bp, Homo sapiens
atcatccaagcgtagttcttct

SEQ ID NO: 37398 - DNA, 14 bp, Homo sapiens
gcaggcagatcacc

SEQ ID NO: 37399 - DNA, 22 bp, Homo sapiens
gtagctctgtttaaagttcttt

SEQ ID NO: 37400 - DNA, 22 bp, Homo sapiens
gttggccaggctggtctcaatc

SEQ ID NO: 37401 - DNA, 22 bp, Homo sapiens
caggagctcagatgacatctca

SEQ ID NO: 37402 - DNA, 22 bp, Homo sapiens
tttgaagactactgggagtgaa

SEQ ID NO: 37403 - DNA, 22 bp, Homo sapiens
gcacatgcatgcatattcctgg

SEQ ID NO: 37404 - DNA, 22 bp, Homo sapiens
tcactgcactccagcctgggtg

SEQ ID NO: 37405 - DNA, 22 bp, Homo sapiens
gcctcaaatgtggagcactatt

SEQ ID NO: 37406 - DNA, 22 bp, Homo sapiens
ctgaggcaggagagttgcttga

SEQ ID NO: 37407 - DNA, 22 bp, Homo sapiens
agtgctgtcagttttatagata

SEQ ID NO: 37408 - DNA, 22 bp, Homo sapiens
gaagccagtgtttgaagaattt

SEQ ID NO: 37409 - DNA, 22 bp, Homo sapiens
agatcggctttgcagacctcat

SEQ ID NO: 37410 - DNA, 22 bp, Homo sapiens
cccttggggtggaggttgcagt

SEQ ID NO: 37411 - DNA, 20 bp, Homo sapiens
tgtttactctagagggtaga

SEQ ID NO: 37412 - DNA, 22 bp, Homo sapiens
aacccagggtggaggttgcagt

SEQ ID NO: 37413 - DNA, 22 bp, Homo sapiens
tggctaacaaggtgaaaccccg

SEQ ID NO: 37414 - DNA, 19 bp, Homo sapiens
accttctgggaaacattcc

SEQ ID NO: 37415 - DNA, 22 bp, Homo sapiens
gagcaccgcctccacgatgccc

SEQ ID NO: 37416 - DNA, 22 bp, Homo sapiens
aataaaatggtcagttttctca

SEQ ID NO: 37417 - DNA, 21 bp, Homo sapiens
acagcctccatctcctgggct

SEQ ID NO: 37418 - DNA, 22 bp, Homo sapiens
tgcagcactgttcacaatagcc

SEQ ID NO: 37419 - DNA, 22 bp, Homo sapiens
tcactgcaacctccacctcctg

SEQ ID NO: 37420 - DNA, 22 bp, Homo sapiens
acggggctagagaaggtttctt

SEQ ID NO: 37421 - DNA, 20 bp, Homo sapiens
ttctccagtgcggtagccat

SEQ ID NO: 37422 - DNA, 22 bp, Homo sapiens
atcacaaaggtctcagagcaca

SEQ ID NO: 37423 - DNA, 22 bp, Homo sapiens
gccggggctggggagagacatg

SEQ ID NO: 37424 - DNA, 22 bp, Homo sapiens
gtgctttgttaagtctgaaatt

SEQ ID NO: 37425 - DNA, 22 bp, Homo sapiens
gagtttcttcatggtgcagagg

SEQ ID NO: 37426 - DNA, 22 bp, Homo sapiens
agagcacggccaccatttacaa

SEQ ID NO: 37427 - DNA, 21 bp, Homo sapiens
atctcgggcttctcgcccagc

SEQ ID NO: 37428 - DNA, 22 bp, Homo sapiens
aaagctaaggtagcattggaga

SEQ ID NO: 37429 - DNA, 22 bp, Homo sapiens
acattacctggcatttgatctt

SEQ ID NO: 37430 - DNA, 22 bp, Homo sapiens
tttcctcttctggcaggcaggg

SEQ ID NO: 37431 - DNA, 22 bp, Homo sapiens
gaggagggagctggaagctctt

SEQ ID NO: 37432 - DNA, 22 bp, Homo sapiens
agttggcactgagctgtgattg

SEQ ID NO: 37433 - DNA, 22 bp, Homo sapiens
ctgagccaaggggacagtgaca

SEQ ID NO: 37434 - DNA, 21 bp, Homo sapiens
tcagataccagactcaagggg

SEQ ID NO: 37435 - DNA, 22 bp, Homo sapiens
tataaagagtctcaaagaagtt

SEQ ID NO: 37436 - DNA, 22 bp, Homo sapiens
cgccgtcccctaggaaagagct

SEQ ID NO: 37437 - DNA, 19 bp, Homo sapiens
tcctgcccaccagccaggg

SEQ ID NO: 37438 - DNA, 19 bp, Homo sapiens
ggtatatgggcctcacttg

SEQ ID NO: 37439 - DNA, 22 bp, Homo sapiens
gaactagaatgttctgatggag

SEQ ID NO: 37440 - DNA, 22 bp, Homo sapiens
cattgctttgtgcatatttaaa

SEQ ID NO: 37441 - DNA, 22 bp, Homo sapiens
tccctgtgtcctgggggcacct

SEQ ID NO: 37442 - DNA, 22 bp, Homo sapiens
atctggttttggctgtgtccct

SEQ ID NO: 37443 - DNA, 22 bp, Homo sapiens
aagtgtgtgagcctgtcaggct

SEQ ID NO: 37444 - DNA, 22 bp, Homo sapiens
ctacttgttcactgtaggtcgc

SEQ ID NO: 37445 - DNA, 20 bp, Homo sapiens
cagcagtggatgagagtttt

SEQ ID NO: 37446 - DNA, 22 bp, Homo sapiens
gaggctggacgtgcatttctac

SEQ ID NO: 37447 - DNA, 22 bp, Homo sapiens
agccacatggacctgatgctag

SEQ ID NO: 37448 - DNA, 22 bp, Homo sapiens
cgactgtcatacacaagacatg

SEQ ID NO: 37449 - DNA, 22 bp, Homo sapiens
ggtttgacagcttggggctgtc

SEQ ID NO: 37450 - DNA, 22 bp, Homo sapiens
agattctaccagagctagtttg

SEQ ID NO: 37451 - DNA, 22 bp, Homo sapiens
gttggagtgcagcttgtgcgat

SEQ ID NO: 37452 - DNA, 23 bp, Homo sapiens
tactatggttattatccctctcc

SEQ ID NO: 37453 - DNA, 22 bp, Homo sapiens
cccctcttggcattgagtgcca

SEQ ID NO: 37454 - DNA, 22 bp, Homo sapiens
atgacaagagtgttcagggaga

SEQ ID NO: 37455 - DNA, 22 bp, Homo sapiens
gctgcgagctcttgttctgaga

SEQ ID NO: 37456 - DNA, 22 bp, Homo sapiens
tgtgttgtgacattcttggatg

SEQ ID NO: 37457 - DNA, 22 bp, Homo sapiens
agatggtagactatggaacgta

SEQ ID NO: 37458 - DNA, 22 bp, Homo sapiens
catgagataatttttctccagt

SEQ ID NO: 37459 - DNA, 22 bp, Homo sapiens
atgtgggccgtgcgggtgtcct

SEQ ID NO: 37460 - DNA, 22 bp, Homo sapiens
agctttacctgccttggggcac

SEQ ID NO: 37461 - DNA, 22 bp, Homo sapiens
ttatttgtggcatatgagacga

SEQ ID NO: 37462 - DNA, 22 bp, Homo sapiens
tttgtttgccacacaaaacagt

SEQ ID NO: 37463 - DNA, 22 bp, Homo sapiens
acccaggctggagtgcagtgat

SEQ ID NO: 37464 - DNA, 22 bp, Homo sapiens
gcctgtgacccagggcccagga

SEQ ID NO: 37465 - DNA, 22 bp, Homo sapiens
atatatgcgcaggcacccagct

SEQ ID NO: 37466 - DNA, 22 bp, Homo sapiens
tttgttttcaatgtgtcattca

SEQ ID NO: 37467 - DNA, 22 bp, Homo sapiens
ttgaggtcatctgaagtactag

SEQ ID NO: 37468 - DNA, 22 bp, Homo sapiens
tgctgagcgcatccggcggccg

SEQ ID NO: 37469 - DNA, 19 bp, Homo sapiens
tggttgtgcacgggttggt

SEQ ID NO: 37470 - DNA, 17 bp, Homo sapiens
cactagtagtctctggc

SEQ ID NO: 37471 - DNA, 22 bp, Homo sapiens
agctggtgtgccagttccagtt

SEQ ID NO: 37472 - DNA, 22 bp, Homo sapiens
caggcaggtcagtgaagaagga

SEQ ID NO: 37473 - DNA, 22 bp, Homo sapiens
caggagatgacagggaagaacc

SEQ ID NO: 37474 - DNA, 22 bp, Homo sapiens
aggccttaccatagctgtagca

SEQ ID NO: 37475 - DNA, 22 bp, Homo sapiens
gggaggaggaatgttttgtgta

SEQ ID NO: 37476 - DNA, 22 bp, Homo sapiens
cctctgtgtctccaagaggcct

SEQ ID NO: 37477 - DNA, 22 bp, Homo sapiens
ccagagtcccttgcagctcagt

SEQ ID NO: 37478 - DNA, 22 bp, Homo sapiens
gccagggttcaagctattctcc

SEQ ID NO: 37479 - DNA, 22 bp, Homo sapiens
ctggaggtgcttcgctggccac

SEQ ID NO: 37480 - DNA, 19 bp, Homo sapiens
tttgatagggcataatata

SEQ ID NO: 37481 - DNA, 22 bp, Homo sapiens
acccaggctggagtgcagtggg

SEQ ID NO: 37482 - DNA, 22 bp, Homo sapiens
tgactcagtacatctggagttg

SEQ ID NO: 37483 - DNA, 22 bp, Homo sapiens
ctgggctagaaggaccaggatg

SEQ ID NO: 37484 - DNA, 22 bp, Homo sapiens
gaagagctgacagtgtcatcct

SEQ ID NO: 37485 - DNA, 22 bp, Homo sapiens
taatatctacttcatagagttt

SEQ ID NO: 37486 - DNA, 17 bp, Homo sapiens
tggtccaggtggagcca

SEQ ID NO: 37487 - DNA, 17 bp, Homo sapiens
tctgagaatgctggagg

SEQ ID NO: 37488 - DNA, 22 bp, Homo sapiens
accctccccaagaggtcgtgcc

SEQ ID NO: 37489 - DNA, 22 bp, Homo sapiens
ttgcatttggttctgcctggta

SEQ ID NO: 37490 - DNA, 22 bp, Homo sapiens
tattgagaccagtgcttgctta

SEQ ID NO: 37491 - DNA, 22 bp, Homo sapiens
aagggctctgtgcttgtcccat

SEQ ID NO: 37492 - DNA, 22 bp, Homo sapiens
ggtatactgcatgacattgggg

SEQ ID NO: 37493 - DNA, 22 bp, Homo sapiens
tttgctttgtttaaaagtggta

SEQ ID NO: 37494 - DNA, 22 bp, Homo sapiens
ctgagcagatgaccagccccag

SEQ ID NO: 37495 - DNA, 22 bp, Homo sapiens
gggagagtagctggaaggttct

SEQ ID NO: 37496 - DNA, 22 bp, Homo sapiens
tgggagaaagaaccctgagtga

SEQ ID NO: 37497 - DNA, 22 bp, Homo sapiens
gagcgattgcgggggtcagagg

SEQ ID NO: 37498 - DNA, 21 bp, Homo sapiens
ttgaccaagggtgcgtgctcc

SEQ ID NO: 37499 - DNA, 16 bp, Homo sapiens
gcaggcagatcacatg

SEQ ID NO: 37500 - DNA, 22 bp, Homo sapiens
tatctattatgttctatgtgtc

SEQ ID NO: 37501 - DNA, 22 bp, Homo sapiens
cattgcactccagtctgggcca

SEQ ID NO: 37502 - DNA, 22 bp, Homo sapiens
agatgcttactatggttgtatg

SEQ ID NO: 37503 - DNA, 22 bp, Homo sapiens
ggaaggggtgggtgagcctcag

SEQ ID NO: 37504 - DNA, 22 bp, Homo sapiens
tagattatccctgatttgtcca

SEQ ID NO: 37505 - DNA, 22 bp, Homo sapiens
ggcggctactcctcctggtgag

SEQ ID NO: 37506 - DNA, 22 bp, Homo sapiens
tgtgagttcttagaaagtcagt

SEQ ID NO: 37507 - DNA, 22 bp, Homo sapiens
tgggccactgctgcggaaggcg

SEQ ID NO: 37508 - DNA, 22 bp, Homo sapiens
gcagggaggtttgctgacctgg

SEQ ID NO: 37509 - DNA, 22 bp, Homo sapiens
gggcccctgggaattctgtgat

SEQ ID NO: 37510 - DNA, 23 bp, Homo sapiens
aagtggttttgaacccggaccct

SEQ ID NO: 37511 - DNA, 22 bp, Homo sapiens
acatcctcccgatctactggct

SEQ ID NO: 37512 - DNA, 22 bp, Homo sapiens
aaagtgcttccttttagaggct

SEQ ID NO: 37513 - DNA, 22 bp, Homo sapiens
agctgcaccggctggaccactg

SEQ ID NO: 37514 - DNA, 22 bp, Homo sapiens
gaatgtcttcaaaactagactg

SEQ ID NO: 37515 - DNA, 22 bp, Homo sapiens
aatggcactttataaatgttaa

SEQ ID NO: 37516 - DNA, 22 bp, Homo sapiens
ctctgcaacttctagcagtgtc

SEQ ID NO: 37517 - DNA, 22 bp, Homo sapiens
aagcccttggcgcacaccgggc

SEQ ID NO: 37518 - DNA, 22 bp, Homo sapiens
aagtcacttcttaggaaaggag

SEQ ID NO: 37519 - DNA, 22 bp, Homo sapiens
gaccagtcattactcatgccct

SEQ ID NO: 37520 - DNA, 22 bp, Homo sapiens
tggtggggccagacttcagctc

SEQ ID NO: 37521 - DNA, 22 bp, Homo sapiens
tcaggaggtccgcccgggaggg

SEQ ID NO: 37522 - DNA, 22 bp, Homo sapiens
ctcagggccaaggatgctgttg

SEQ ID NO: 37523 - DNA, 22 bp, Homo sapiens
tgtagctctccagccagcaagg

SEQ ID NO: 37524 - DNA, 22 bp, Homo sapiens
aagtgattgttccgttgagtgt

SEQ ID NO: 37525 - DNA, 22 bp, Homo sapiens
ctggcaggagcattcacagagg

SEQ ID NO: 37526 - DNA, 22 bp, Homo sapiens
ttcactggtcctttataggaac

SEQ ID NO: 37527 - DNA, 22 bp, Homo sapiens
atcagagtagttgttgcccaga

SEQ ID NO: 37528 - DNA, 22 bp, Homo sapiens
agctgattccactttttcccca

SEQ ID NO: 37529 - DNA, 21 bp, Homo sapiens
ccgccgctgatagctctgggc

SEQ ID NO: 37530 - DNA, 22 bp, Homo sapiens
ttctcccctttagggcctacgg

SEQ ID NO: 37531 - DNA, 22 bp, Homo sapiens
gcagagtgctgtcgtacgcccc

SEQ ID NO: 37532 - DNA, 22 bp, Homo sapiens
cctgcacatgtgtgcgcctgta

SEQ ID NO: 37533 - DNA, 19 bp, Homo sapiens
tcttgggtcgagacataga

SEQ ID NO: 37534 - DNA, 22 bp, Homo sapiens
tcgtctgtgaaattgggataag

SEQ ID NO: 37535 - DNA, 22 bp, Homo sapiens
ccaatgatggtgcccacgatga

SEQ ID NO: 37536 - DNA, 22 bp, Homo sapiens
cccgactagctgggattacagg

SEQ ID NO: 37537 - DNA, 22 bp, Homo sapiens
cagctgttcattgttgccaccc

SEQ ID NO: 37538 - DNA, 22 bp, Homo sapiens
caaggtgccatgctgggcgggg

SEQ ID NO: 37539 - DNA, 22 bp, Homo sapiens
aggatgagccgcgcaagctgac

SEQ ID NO: 37540 - DNA, 22 bp, Homo sapiens
gaacactgctgttgggttctga

SEQ ID NO: 37541 - DNA, 22 bp, Homo sapiens
tgcctactagtactattttgtg

SEQ ID NO: 37542 - DNA, 22 bp, Homo sapiens
gactggtaaggaaattcactaa

SEQ ID NO: 37543 - DNA, 22 bp, Homo sapiens
tccggactcacctgacaatggc

SEQ ID NO: 37544 - DNA, 22 bp, Homo sapiens
accagcctggccaacatggcaa

SEQ ID NO: 37545 - DNA, 22 bp, Homo sapiens
atccccctgtatctggaagaat

SEQ ID NO: 37546 - DNA, 22 bp, Homo sapiens
ctccccagccctggtattctga

SEQ ID NO: 37547 - DNA, 22 bp, Homo sapiens
agtacctggtatatgattatga

SEQ ID NO: 37548 - DNA, 22 bp, Homo sapiens
cacagggcttctcatggggtgc

SEQ ID NO: 37549 - DNA, 22 bp, Homo sapiens
agatgtttataactcatgagtg

SEQ ID NO: 37550 - DNA, 22 bp, Homo sapiens
attaccgctgagtcctatggag

SEQ ID NO: 37551 - DNA, 22 bp, Homo sapiens
gtgtggctgaaatcaaggcagg

SEQ ID NO: 37552 - DNA, 22 bp, Homo sapiens
atggggaagcaattggatttcc

SEQ ID NO: 37553 - DNA, 22 bp, Homo sapiens
tttctcggcagagatgatgggc

SEQ ID NO: 37554 - DNA, 22 bp, Homo sapiens
tggactaaagaggaagcaaata

SEQ ID NO: 37555 - DNA, 22 bp, Homo sapiens
caggaggttgagggtgcagtga

SEQ ID NO: 37556 - DNA, 22 bp, Homo sapiens
tagatagattctcctatagagt

SEQ ID NO: 37557 - DNA, 22 bp, Homo sapiens
ctgggcagctgtatcagggagt

SEQ ID NO: 37558 - DNA, 22 bp, Homo sapiens
ccaaagtgctggggttacaggc

SEQ ID NO: 37559 - DNA, 22 bp, Homo sapiens
gcggggggaggaacatcttgca

SEQ ID NO: 37560 - DNA, 22 bp, Homo sapiens
gggggactggaccgtcctgggt

SEQ ID NO: 37561 - DNA, 22 bp, Homo sapiens
ggctcactgcaacttccgcctc

SEQ ID NO: 37562 - DNA, 15 bp, Homo sapiens
gcaggcaggtcacct

SEQ ID NO: 37563 - DNA, 22 bp, Homo sapiens
cagaggctggcggccgccccga

SEQ ID NO: 37564 - DNA, 22 bp, Homo sapiens
tgtgggtggcatcgtcctggcc

SEQ ID NO: 37565 - DNA, 22 bp, Homo sapiens
cttcatcagctggcttactgtt

SEQ ID NO: 37566 - DNA, 22 bp, Homo sapiens
tagtaacccacacaacagtaga

SEQ ID NO: 37567 - DNA, 20 bp, Homo sapiens
agatacagtggtttctttag

SEQ ID NO: 37568 - DNA, 22 bp, Homo sapiens
tagaagaaagtgaagctgggga

SEQ ID NO: 37569 - DNA, 22 bp, Homo sapiens
ctgaacttattgagtgcttgct

SEQ ID NO: 37570 - DNA, 22 bp, Homo sapiens
ccaggaggcggaggttgcagcg

SEQ ID NO: 37571 - DNA, 22 bp, Homo sapiens
aactcctctctggtggttcgtc

SEQ ID NO: 37572 - DNA, 22 bp, Homo sapiens
tgcagtttaaacttggcaactt

SEQ ID NO: 37573 - DNA, 22 bp, Homo sapiens
ttagaggaaagactgggactaa

SEQ ID NO: 37574 - DNA, 22 bp, Homo sapiens
gtggtgtttgagctgccaggga

SEQ ID NO: 37575 - DNA, 22 bp, Homo sapiens
ggctcactgcaaactgtgcctc

SEQ ID NO: 37576 - DNA, 22 bp, Homo sapiens
ctccagttggccccagttggtt

SEQ ID NO: 37577 - DNA, 22 bp, Homo sapiens
aagaggcgccgggtacgtggcg

SEQ ID NO: 37578 - DNA, 22 bp, Homo sapiens
gggaaggaaagttattagcaga

SEQ ID NO: 37579 - DNA, 22 bp, Homo sapiens
ggccaggcgatgacccctccac

SEQ ID NO: 37580 - DNA, 22 bp, Homo sapiens
tttcacagaggaggaagctgag

SEQ ID NO: 37581 - DNA, 22 bp, Homo sapiens
cccagtttcaactttccagtgg

SEQ ID NO: 37582 - DNA, 22 bp, Homo sapiens
ttcccactgtggcagagcctcg

SEQ ID NO: 37583 - DNA, 22 bp, Homo sapiens
ctactggccatctgatctacaa

SEQ ID NO: 37584 - DNA, 22 bp, Homo sapiens
aatttgttataacttgggctga

SEQ ID NO: 37585 - DNA, 22 bp, Homo sapiens
gtcagcgtgctcagcctattat

SEQ ID NO: 37586 - DNA, 22 bp, Homo sapiens
ttctccacccactcttttgttg

SEQ ID NO: 37587 - DNA, 20 bp, Homo sapiens
aagcagtgaggtgaggagtg

SEQ ID NO: 37588 - DNA, 22 bp, Homo sapiens
agtgctatcgagttctaatgct

SEQ ID NO: 37589 - DNA, 18 bp, Homo sapiens
gctttctatgcgacagta

SEQ ID NO: 37590 - DNA, 22 bp, Homo sapiens
cttctagagaggtgagctggag

SEQ ID NO: 37591 - DNA, 22 bp, Homo sapiens
gctcaagacccctctgtgactg

SEQ ID NO: 37592 - DNA, 22 bp, Homo sapiens
aggctgagataggtggatcatt

SEQ ID NO: 37593 - DNA, 22 bp, Homo sapiens
gggttcttatagtatcagagct

SEQ ID NO: 37594 - DNA, 18 bp, Homo sapiens
tccctcagaattatagaa

SEQ ID NO: 37595 - DNA, 22 bp, Homo sapiens
tgtgaccctctccgatgggcag

SEQ ID NO: 37596 - DNA, 22 bp, Homo sapiens
gctgcagacttctcatctcatt

SEQ ID NO: 37597 - DNA, 22 bp, Homo sapiens
gggaggctctgctcagcccccg

SEQ ID NO: 37598 - DNA, 22 bp, Homo sapiens
ggaagggcaaaagagatgaact

SEQ ID NO: 37599 - DNA, 22 bp, Homo sapiens
aacgcccagccttgatcaaatg

SEQ ID NO: 37600 - DNA, 22 bp, Homo sapiens
ggaggcggaggttgcagtgagc

SEQ ID NO: 37601 - DNA, 22 bp, Homo sapiens
gctcccaggatgaggagccagg

SEQ ID NO: 37602 - DNA, 22 bp, Homo sapiens
cctgtggcgggggccagtgcct

SEQ ID NO: 37603 - DNA, 22 bp, Homo sapiens
ccgaggtcctggacttggccct

SEQ ID NO: 37604 - DNA, 22 bp, Homo sapiens
taagaaatttagttatagaatg

SEQ ID NO: 37605 - DNA, 22 bp, Homo sapiens
ccaggggttggaggttgcagtg

SEQ ID NO: 37606 - DNA, 21 bp, Homo sapiens
ggccgccgccttgtgctctgc

SEQ ID NO: 37607 - DNA, 22 bp, Homo sapiens
tatgacttttcccaattcagga

SEQ ID NO: 37608 - DNA, 22 bp, Homo sapiens
tcccccaggctggagtgcagtg

SEQ ID NO: 37609 - DNA, 22 bp, Homo sapiens
ccagactgcttgcttcccagcc

SEQ ID NO: 37610 - DNA, 22 bp, Homo sapiens
taagcctgcatgaaccatgaga

SEQ ID NO: 37611 - DNA, 22 bp, Homo sapiens
ggcatggtggtacacatctgta

SEQ ID NO: 37612 - DNA, 22 bp, Homo sapiens
caccagagtgggtgagggtgat

SEQ ID NO: 37613 - DNA, 22 bp, Homo sapiens
ctgcgcagcaatcagagaggag

SEQ ID NO: 37614 - DNA, 22 bp, Homo sapiens
tatttaataaaactatggcatg

SEQ ID NO: 37615 - DNA, 22 bp, Homo sapiens
agtcaggggatctagacttgaa

SEQ ID NO: 37616 - DNA, 22 bp, Homo sapiens
ctgtcctggggaaagccagccc

SEQ ID NO: 37617 - DNA, 18 bp, Homo sapiens
tgagttcattagacttcc

SEQ ID NO: 37618 - DNA, 22 bp, Homo sapiens
cagaagatctcttagtggaggg

SEQ ID NO: 37619 - DNA, 22 bp, Homo sapiens
gttctgggagatcttgagcttc

SEQ ID NO: 37620 - DNA, 22 bp, Homo sapiens
catggcactgagcaggtatgca

SEQ ID NO: 37621 - DNA, 22 bp, Homo sapiens
caatccatcaattacacaggct

SEQ ID NO: 37622 - DNA, 22 bp, Homo sapiens
cgggaaggtggaggttgcagtg

SEQ ID NO: 37623 - DNA, 21 bp, Homo sapiens
atgtagggtttgccttctcta

SEQ ID NO: 37624 - DNA, 22 bp, Homo sapiens
tctcatggagtcaggagcagaa

SEQ ID NO: 37625 - DNA, 22 bp, Homo sapiens
gtctctatcatagctgaaccct

SEQ ID NO: 37626 - DNA, 22 bp, Homo sapiens
gcccaggctggagtgcagtggc

SEQ ID NO: 37627 - DNA, 22 bp, Homo sapiens
gtggttttattcgttcctctgt

SEQ ID NO: 37628 - DNA, 22 bp, Homo sapiens
ttttcagctaagtcacacgctg

SEQ ID NO: 37629 - DNA, 22 bp, Homo sapiens
catgtgtgtctccaccagctgc

SEQ ID NO: 37630 - DNA, 22 bp, Homo sapiens
taacaaagtattgtttgtgtat

SEQ ID NO: 37631 - DNA, 22 bp, Homo sapiens
ggagtgcagtggcgtgatctcg

SEQ ID NO: 37632 - DNA, 22 bp, Homo sapiens
agtggccagcagcctagcctag

SEQ ID NO: 37633 - DNA, 22 bp, Homo sapiens
ctgatcctcctttaagtagctg

SEQ ID NO: 37634 - DNA, 22 bp, Homo sapiens
aaggctccagtgaatgctggca

SEQ ID NO: 37635 - DNA, 22 bp, Homo sapiens
ttacttaaacagaaatgcagaa

SEQ ID NO: 37636 - DNA, 22 bp, Homo sapiens
gcagggtctgaggccacagagg

SEQ ID NO: 37637 - DNA, 22 bp, Homo sapiens
ggagtgcagtggcgtgagctcg

SEQ ID NO: 37638 - DNA, 22 bp, Homo sapiens
actagaaagaagttttttgaga

SEQ ID NO: 37639 - DNA, 22 bp, Homo sapiens
gtggctcacgtctgtcatctca

SEQ ID NO: 37640 - DNA, 22 bp, Homo sapiens
gtttcactgcaaactgactttt

SEQ ID NO: 37641 - DNA, 22 bp, Homo sapiens
gcaggaggttgagccaggactg

SEQ ID NO: 37642 - DNA, 17 bp, Homo sapiens
gaggccaaggcaggcgg

SEQ ID NO: 37643 - DNA, 22 bp, Homo sapiens
ggaccggtggcttcctcgggtc

SEQ ID NO: 37644 - DNA, 23 bp, Homo sapiens
aatggtcttcctccacccctctg

SEQ ID NO: 37645 - DNA, 22 bp, Homo sapiens
tggttgtggtcctccacatcgc

SEQ ID NO: 37646 - DNA, 22 bp, Homo sapiens
tgtagatatagaaaaagactga

SEQ ID NO: 37647 - DNA, 22 bp, Homo sapiens
agaaaatttaaagagacacaca

SEQ ID NO: 37648 - DNA, 22 bp, Homo sapiens
tttaatcataagaaggaaaata

SEQ ID NO: 37649 - DNA, 22 bp, Homo sapiens
tgtcttggttcttctgaaacac

SEQ ID NO: 37650 - DNA, 22 bp, Homo sapiens
tcttatacccctaaactgcagc

SEQ ID NO: 37651 - DNA, 22 bp, Homo sapiens
atgttggccaggctggtcttga

SEQ ID NO: 37652 - DNA, 22 bp, Homo sapiens
ctgaggcaggatggcctggctg

SEQ ID NO: 37653 - DNA, 22 bp, Homo sapiens
gcactgcaggtgggtggagagg

SEQ ID NO: 37654 - DNA, 22 bp, Homo sapiens
acatagttgatgagcgtgtacg

SEQ ID NO: 37655 - DNA, 22 bp, Homo sapiens
aaaatcctgctgactcgagatg

SEQ ID NO: 37656 - DNA, 22 bp, Homo sapiens
tttggtattgcacactgtcttc

SEQ ID NO: 37657 - DNA, 22 bp, Homo sapiens
taggccacagagaggagatttc

SEQ ID NO: 37658 - DNA, 22 bp, Homo sapiens
ccccaggacgtggccctcatag

SEQ ID NO: 37659 - DNA, 22 bp, Homo sapiens
gccctgggcaaggttctggcca

SEQ ID NO: 37660 - DNA, 22 bp, Homo sapiens
aagtcgtggcaggcttgcacga

SEQ ID NO: 37661 - DNA, 22 bp, Homo sapiens
aaggaggcctggcagatgaaga

SEQ ID NO: 37662 - DNA, 22 bp, Homo sapiens
agagattcctttggggaaagca

SEQ ID NO: 37663 - DNA, 22 bp, Homo sapiens
aagcagagaatctgggagcgag

SEQ ID NO: 37664 - DNA, 22 bp, Homo sapiens
tcacccaggctggagtgtagtg

SEQ ID NO: 37665 - DNA, 22 bp, Homo sapiens
aatgttgcagagtgattgtcca

SEQ ID NO: 37666 - DNA, 22 bp, Homo sapiens
ggtcacgtgaccgcacctgcct

SEQ ID NO: 37667 - DNA, 22 bp, Homo sapiens
gaccttgtgatctgcctgcctt

SEQ ID NO: 37668 - DNA, 23 bp, Homo sapiens
ggttctgccgcttactgctgtgc

SEQ ID NO: 37669 - DNA, 18 bp, Homo sapiens
tggcgatggtcatttttc

SEQ ID NO: 37670 - DNA, 21 bp, Homo sapiens
tactgtagccttgcactgtag

SEQ ID NO: 37671 - DNA, 22 bp, Homo sapiens
gctaatcaatgttaaggctgtg

SEQ ID NO: 37672 - DNA, 23 bp, Homo sapiens
gaggtggcaatgagggcagttgg

SEQ ID NO: 37673 - DNA, 22 bp, Homo sapiens
cacccaggctggagtgcagtgg

SEQ ID NO: 37674 - DNA, 22 bp, Homo sapiens
gtggaggagaggcgccttgcgg

SEQ ID NO: 37675 - DNA, 22 bp, Homo sapiens
tcgggctcgctctcctagcgga

SEQ ID NO: 37676 - DNA, 22 bp, Homo sapiens
catgctgtgtgttttagctcca

SEQ ID NO: 37677 - DNA, 22 bp, Homo sapiens
ggaggtggaggttgcagtgagc

SEQ ID NO: 37678 - DNA, 22 bp, Homo sapiens
ggaggcggaggttgcagtgagt

SEQ ID NO: 37679 - DNA, 22 bp, Homo sapiens
gaaggtggcgagcggattgctg

SEQ ID NO: 37680 - DNA, 22 bp, Homo sapiens
tgggctgtggagcacctttgca

SEQ ID NO: 37681 - DNA, 22 bp, Homo sapiens
aggggaggtgtccccaaatctc

SEQ ID NO: 37682 - DNA, 22 bp, Homo sapiens
gcaaaagtacagccggatttct

SEQ ID NO: 37683 - DNA, 22 bp, Homo sapiens
tcactgcaatctcagcctcctg

SEQ ID NO: 37684 - DNA, 22 bp, Homo sapiens
tttaatgtagcgtgaaatgatt

SEQ ID NO: 37685 - DNA, 22 bp, Homo sapiens
aagcccttggcgcacaccgggc

SEQ ID NO: 37686 - DNA, 22 bp, Homo sapiens
ccaggaggttgaggctgcagtg

SEQ ID NO: 37687 - DNA, 22 bp, Homo sapiens
catgagataatttttctccagt

SEQ ID NO: 37688 - DNA, 22 bp, Homo sapiens
cgcaccactgaattccagcctg

SEQ ID NO: 37689 - DNA, 21 bp, Homo sapiens
ggtgctcgctgatgaggagtg

SEQ ID NO: 37690 - DNA, 22 bp, Homo sapiens
atgaggcaggtggaggctgcca

SEQ ID NO: 37691 - DNA, 22 bp, Homo sapiens
tcactgcactccagcctgggca

SEQ ID NO: 37692 - DNA, 22 bp, Homo sapiens
gagcccaggaagtggaggctga

SEQ ID NO: 37693 - DNA, 22 bp, Homo sapiens
tcctcagcttttatttcacttg

SEQ ID NO: 37694 - DNA, 22 bp, Homo sapiens
gaccctctagatggaagcactg

SEQ ID NO: 37695 - DNA, 22 bp, Homo sapiens
tttgaagggcacgacaatagtt

SEQ ID NO: 37696 - DNA, 22 bp, Homo sapiens
aatgttacgatcaacaacacat

SEQ ID NO: 37697 - DNA, 22 bp, Homo sapiens
ggcaagagggcagatggagtgc

SEQ ID NO: 37698 - DNA, 22 bp, Homo sapiens
ttcattttctttcacgctgctg

SEQ ID NO: 37699 - DNA, 22 bp, Homo sapiens
gttttgaatactactagaactt

SEQ ID NO: 37700 - DNA, 22 bp, Homo sapiens
cacccaggctggagagcagtgg

SEQ ID NO: 37701 - DNA, 22 bp, Homo sapiens
cgccccggacgtctgaccaaac

SEQ ID NO: 37702 - DNA, 22 bp, Homo sapiens
cactgcactccagcccgggcaa

SEQ ID NO: 37703 - DNA, 22 bp, Homo sapiens
cgcaactcagcaacttaactgc

SEQ ID NO: 37704 - DNA, 22 bp, Homo sapiens
ggctgagttgagaggattactt

SEQ ID NO: 37705 - DNA, 22 bp, Homo sapiens
cactgcactccagcctgggtga

SEQ ID NO: 37706 - DNA, 22 bp, Homo sapiens
aagccctggcgggtggagggcc

SEQ ID NO: 37707 - DNA, 22 bp, Homo sapiens
cccaggaggtggagttcacagt

SEQ ID NO: 37708 - DNA, 22 bp, Homo sapiens
tcgcaccattgcactccagcca

SEQ ID NO: 37709 - DNA, 22 bp, Homo sapiens
tgtaagtagtaatggaaggaca

SEQ ID NO: 37710 - DNA, 22 bp, Homo sapiens
ttgtgaatagtgccgcaataaa

SEQ ID NO: 37711 - DNA, 18 bp, Homo sapiens
actctgcggaggccccag

SEQ ID NO: 37712 - DNA, 22 bp, Homo sapiens
tcactgcaacctctgcctcttg

SEQ ID NO: 37713 - DNA, 22 bp, Homo sapiens
cttgcctttgtcttcaaaggct

SEQ ID NO: 37714 - DNA, 22 bp, Homo sapiens
ggagaagaggagctggaagcct

SEQ ID NO: 37715 - DNA, 22 bp, Homo sapiens
tcactgcactccagcctgggtg

SEQ ID NO: 37716 - DNA, 22 bp, Homo sapiens
gtgttaaccagctaaactttgc

SEQ ID NO: 37717 - DNA, 22 bp, Homo sapiens
ggcaaggggtcaggctgagaca

SEQ ID NO: 37718 - DNA, 22 bp, Homo sapiens
agacactgttctcacatgcttg

SEQ ID NO: 37719 - DNA, 22 bp, Homo sapiens
cctcagctcccatgagatctgc

SEQ ID NO: 37720 - DNA, 19 bp, Homo sapiens
gcccacggccctgctctgc

SEQ ID NO: 37721 - DNA, 22 bp, Homo sapiens
tcactgcaacctctgcctgcca

SEQ ID NO: 37722 - DNA, 22 bp, Homo sapiens
tccttaggcaatttgggagagt

SEQ ID NO: 37723 - DNA, 22 bp, Homo sapiens
caggctggagtgcaatgacgcc

SEQ ID NO: 37724 - DNA, 22 bp, Homo sapiens
gctggcagacttcctctggaac

SEQ ID NO: 37725 - DNA, 21 bp, Homo sapiens
tggctaaaccctagtaaatta

SEQ ID NO: 37726 - DNA, 22 bp, Homo sapiens
cctccccacagcccaggagact

SEQ ID NO: 37727 - DNA, 22 bp, Homo sapiens
gtgcacttgatctagacagatt

SEQ ID NO: 37728 - DNA, 22 bp, Homo sapiens
tccaagatctacagcagtttag

SEQ ID NO: 37729 - DNA, 22 bp, Homo sapiens
cggctggtgtcgggcacagcaa

SEQ ID NO: 37730 - DNA, 22 bp, Homo sapiens
actcatgtcctaggagtaaagc

SEQ ID NO: 37731 - DNA, 22 bp, Homo sapiens
tccctagtcgcatctgtggaga

SEQ ID NO: 37732 - DNA, 23 bp, Homo sapiens
agctctgctcgggcatgccctgc

SEQ ID NO: 37733 - DNA, 18 bp, Homo sapiens
gaggatggaaggagatgc

SEQ ID NO: 37734 - DNA, 21 bp, Homo sapiens
gctcctggtgctgcgtggcgc

SEQ ID NO: 37735 - DNA, 22 bp, Homo sapiens
agaaaatttaaagagacacaca

SEQ ID NO: 37736 - DNA, 22 bp, Homo sapiens
tcactgcaagctccgccttccg

SEQ ID NO: 37737 - DNA, 22 bp, Homo sapiens
gagaggtggaggttgcagtgag

SEQ ID NO: 37738 - DNA, 20 bp, Homo sapiens
tggcctctgagatgccacgg

SEQ ID NO: 37739 - DNA, 22 bp, Homo sapiens
tcactgcaacctccacctcctg

SEQ ID NO: 37740 - DNA, 22 bp, Homo sapiens
ctctctgggcccagttggcacc

SEQ ID NO: 37741 - DNA, 22 bp, Homo sapiens
gcaggcagaggtggaggagaca

SEQ ID NO: 37742 - DNA, 22 bp, Homo sapiens
tgtgcacaatgtgcaggtttgt

SEQ ID NO: 37743 - DNA, 22 bp, Homo sapiens
atacaaaatatatactggagac

SEQ ID NO: 37744 - DNA, 22 bp, Homo sapiens
cccaggaggcagagcttgcagt

SEQ ID NO: 37745 - DNA, 22 bp, Homo sapiens
ggtgtagctctgtgtcccactg

SEQ ID NO: 37746 - DNA, 22 bp, Homo sapiens
cccaggaggcagatgttgcagt

SEQ ID NO: 37747 - DNA, 22 bp, Homo sapiens
actgcactcctgcctgggtaac

SEQ ID NO: 37748 - DNA, 22 bp, Homo sapiens
gtaggtcagacataagaggaca

SEQ ID NO: 37749 - DNA, 22 bp, Homo sapiens
tttgtgaataggttggcttcca

SEQ ID NO: 37750 - DNA, 22 bp, Homo sapiens
ctggcctcggcagcaggaacag

SEQ ID NO: 37751 - DNA, 22 bp, Homo sapiens
gcagcctcaaactccccagctc

SEQ ID NO: 37752 - DNA, 22 bp, Homo sapiens
taaagggtaggttttactgtaa

SEQ ID NO: 37753 - DNA, 22 bp, Homo sapiens
tcttggattttaatggatcaaa

SEQ ID NO: 37754 - DNA, 22 bp, Homo sapiens
ttcctttctctggactgcagcc

SEQ ID NO: 37755 - DNA, 22 bp, Homo sapiens
ggagactgatctgagtgataac

SEQ ID NO: 37756 - DNA, 22 bp, Homo sapiens
tcactgcactaggtaatgccac

SEQ ID NO: 37757 - DNA, 22 bp, Homo sapiens
caggaggacatactggctcaca

SEQ ID NO: 37758 - DNA, 22 bp, Homo sapiens
ttcaatatgatattagctgtgg

SEQ ID NO: 37759 - DNA, 23 bp, Homo sapiens
ggagcctccggtgtgtgagaggc

SEQ ID NO: 37760 - DNA, 21 bp, Homo sapiens
cactccacttagaacagggtt

SEQ ID NO: 37761 - DNA, 22 bp, Homo sapiens
cactgcactccagcctgggtca

SEQ ID NO: 37762 - DNA, 22 bp, Homo sapiens
tgggactcactcttttggccag

SEQ ID NO: 37763 - DNA, 22 bp, Homo sapiens
gacaatatagttgaatgagcaa

SEQ ID NO: 37764 - DNA, 22 bp, Homo sapiens
ataaaagatcccttctgagctc

SEQ ID NO: 37765 - DNA, 22 bp, Homo sapiens
ttgcaaatcagaagtatagatt

SEQ ID NO: 37766 - DNA, 18 bp, Homo sapiens
ccctcttgcacaaagcaa

SEQ ID NO: 37767 - DNA, 22 bp, Homo sapiens
tgcactccaggctgggtgacag

SEQ ID NO: 37768 - DNA, 22 bp, Homo sapiens
ggaggacaggggctgcagcaca

SEQ ID NO: 37769 - DNA, 22 bp, Homo sapiens
gatcgggtgggttctgccatca

SEQ ID NO: 37770 - DNA, 22 bp, Homo sapiens
taatgtataacaaatactcatc

SEQ ID NO: 37771 - DNA, 22 bp, Homo sapiens
gcctcctgagtagctgggattg

SEQ ID NO: 37772 - DNA, 22 bp, Homo sapiens
gattcactcatattttacgttt

SEQ ID NO: 37773 - DNA, 19 bp, Homo sapiens
tcctgcctggggccgcctg

SEQ ID NO: 37774 - DNA, 22 bp, Homo sapiens
ccctcccaggagtggccagaga

SEQ ID NO: 37775 - DNA, 22 bp, Homo sapiens
agtaatcaatttttcggtggat

SEQ ID NO: 37776 - DNA, 22 bp, Homo sapiens
cgcgaggtggaggttgcagtga

SEQ ID NO: 37777 - DNA, 22 bp, Homo sapiens
aaagggaagttgcacatgttcc

SEQ ID NO: 37778 - DNA, 22 bp, Homo sapiens
cctggcaggtggcgccctcggc

SEQ ID NO: 37779 - DNA, 22 bp, Homo sapiens
atacaaaaattagccgggagta

SEQ ID NO: 37780 - DNA, 22 bp, Homo sapiens
ttggaagttgatttaaaaagga

SEQ ID NO: 37781 - DNA, 22 bp, Homo sapiens
tccaccctgcttttgtctttga

SEQ ID NO: 37782 - DNA, 22 bp, Homo sapiens
tgagacaggcttccttcttggg

SEQ ID NO: 37783 - DNA, 22 bp, Homo sapiens
agcaagattgaggcttcctcag

SEQ ID NO: 37784 - DNA, 22 bp, Homo sapiens
tcactgcactccagcctggtga

SEQ ID NO: 37785 - DNA, 22 bp, Homo sapiens
gcagaggacacaggagggcaag

SEQ ID NO: 37786 - DNA, 22 bp, Homo sapiens
agccagggtctctcgctctgtt

SEQ ID NO: 37787 - DNA, 22 bp, Homo sapiens
ttcactgcaacctccgcctccc

SEQ ID NO: 37788 - DNA, 22 bp, Homo sapiens
atggtggacgggagacaggact

SEQ ID NO: 37789 - DNA, 22 bp, Homo sapiens
tcactgcaagctccgcctcccg

SEQ ID NO: 37790 - DNA, 22 bp, Homo sapiens
taatgtaaacacagagacagaa

SEQ ID NO: 37791 - DNA, 22 bp, Homo sapiens
cggaggttgaggctgcagtgag

SEQ ID NO: 37792 - DNA, 22 bp, Homo sapiens
tcactgcaacctctgcctcccg

SEQ ID NO: 37793 - DNA, 22 bp, Homo sapiens
aattgcaaattcagacttaaga

SEQ ID NO: 37794 - DNA, 22 bp, Homo sapiens
cccaggaggtggagcttgcagt

SEQ ID NO: 37795 - DNA, 22 bp, Homo sapiens
ccaggaggcggaggttgcagcg

SEQ ID NO: 37796 - DNA, 22 bp, Homo sapiens
agatgaatccacacatggcaaa

SEQ ID NO: 37797 - DNA, 20 bp, Homo sapiens
ataaaataactgccacaaga

SEQ ID NO: 37798 - DNA, 22 bp, Homo sapiens
gtcaggactctgacccgtcccg

SEQ ID NO: 37799 - DNA, 22 bp, Homo sapiens
atggcctgcagtgctgccacag

SEQ ID NO: 37800 - DNA, 22 bp, Homo sapiens
ccaggaggcggaaggtacagtg

SEQ ID NO: 37801 - DNA, 22 bp, Homo sapiens
actgcactccagcctgggtaac

SEQ ID NO: 37802 - DNA, 22 bp, Homo sapiens
tcactgcaacctccacctcccg

SEQ ID NO: 37803 - DNA, 22 bp, Homo sapiens
cgggcaaggcgagactaggccc

SEQ ID NO: 37804 - DNA, 22 bp, Homo sapiens
ctggcaggagcattcacagagg

SEQ ID NO: 37805 - DNA, 22 bp, Homo sapiens
ccaggaggcggaggttgcagtg

SEQ ID NO: 37806 - DNA, 22 bp, Homo sapiens
gccgggaccaaggccacggagc

SEQ ID NO: 37807 - DNA, 21 bp, Homo sapiens
tcacgtggtcacatgagcttt

SEQ ID NO: 37808 - DNA, 22 bp, Homo sapiens
gcaagacatgtctaaggtttaa

SEQ ID NO: 37809 - DNA, 22 bp, Homo sapiens
aagactgtgtctatggctactc

SEQ ID NO: 37810 - DNA, 22 bp, Homo sapiens
ccaggaggcagaagttgcagtg

SEQ ID NO: 37811 - DNA, 22 bp, Homo sapiens
agcaagatttttcaggttagta

SEQ ID NO: 37812 - DNA, 22 bp, Homo sapiens
tcactgcaagctccacctcccg

SEQ ID NO: 37813 - DNA, 22 bp, Homo sapiens
tcactgcaagctctgccttccg

SEQ ID NO: 37814 - DNA, 22 bp, Homo sapiens
ggtgccaggctgtagtcagggt

SEQ ID NO: 37815 - DNA, 22 bp, Homo sapiens
ctccaggctcgtccaagatcga

SEQ ID NO: 37816 - DNA, 22 bp, Homo sapiens
ctacaaaagtaattgtggtttt

SEQ ID NO: 37817 - DNA, 22 bp, Homo sapiens
gctgcgccggatcccacgttcc

SEQ ID NO: 37818 - DNA, 22 bp, Homo sapiens
acagacaagtagttcagacaag

SEQ ID NO: 37819 - DNA, 22 bp, Homo sapiens
gctcagacctgtaatcttagca

SEQ ID NO: 37820 - DNA, 22 bp, Homo sapiens
tcactgcaacctccgcctgctg

SEQ ID NO: 37821 - DNA, 22 bp, Homo sapiens
tagggtagtaccatgctgccag

SEQ ID NO: 37822 - DNA, 22 bp, Homo sapiens
ttggaacatgccggggtccagg

SEQ ID NO: 37823 - DNA, 22 bp, Homo sapiens
ttgtgaatagtgccgctataaa

SEQ ID NO: 37824 - DNA, 22 bp, Homo sapiens
ctggcaagaaatatatatctta

SEQ ID NO: 37825 - DNA, 22 bp, Homo sapiens
ctgaagagaaagggagctcttc

SEQ ID NO: 37826 - DNA, 22 bp, Homo sapiens
cactgcacttcagcctgggtga

SEQ ID NO: 37827 - DNA, 22 bp, Homo sapiens
ttttcatttttgtagatgcaag

SEQ ID NO: 37828 - DNA, 22 bp, Homo sapiens
tacaagatgacaggtgcatgat

SEQ ID NO: 37829 - DNA, 22 bp, Homo sapiens
gcctccggagtcacagtgtctt

SEQ ID NO: 37830 - DNA, 22 bp, Homo sapiens
cactgcactccatcctgggaaa

SEQ ID NO: 37831 - DNA, 22 bp, Homo sapiens
ccagaggagttgaggctttggg

SEQ ID NO: 37832 - DNA, 22 bp, Homo sapiens
aggatgagccgcgcaagctgac

SEQ ID NO: 37833 - DNA, 22 bp, Homo sapiens
tcactgcaagctcagcctcccg

SEQ ID NO: 37834 - DNA, 22 bp, Homo sapiens
aagaaatgctgatgttggatgg

SEQ ID NO: 37835 - DNA, 22 bp, Homo sapiens
gcctccggagttgcagtgtctt

SEQ ID NO: 37836 - DNA, 22 bp, Homo sapiens
tcctcggctgggccccaggctt

SEQ ID NO: 37837 - DNA, 22 bp, Homo sapiens
atcaacatgtcataaagtgaaa

SEQ ID NO: 37838 - DNA, 22 bp, Homo sapiens
tgagcaggcgcagcaggaggtc

SEQ ID NO: 37839 - DNA, 22 bp, Homo sapiens
gctgcagtgagccaagatcgtg

SEQ ID NO: 37840 - DNA, 22 bp, Homo sapiens
cttgacactgtcactcaggcca

SEQ ID NO: 37841 - DNA, 19 bp, Homo sapiens
ccctcttgcacaaagcaaa

SEQ ID NO: 37842 - DNA, 22 bp, Homo sapiens
tcactgcacttcaggctttctc

SEQ ID NO: 37843 - DNA, 22 bp, Homo sapiens
gtagttctgcagtgtcacctga

SEQ ID NO: 37844 - DNA, 22 bp, Homo sapiens
ggtccccgtggaggctggagcg

SEQ ID NO: 37845 - DNA, 22 bp, Homo sapiens
ctggcaggtggaggttgcagtg

SEQ ID NO: 37846 - DNA, 22 bp, Homo sapiens
gggtaaatctcttttcatggct

SEQ ID NO: 37847 - DNA, 22 bp, Homo sapiens
cccaggaggtcgaagctgcagt

SEQ ID NO: 37848 - DNA, 22 bp, Homo sapiens
gcgagcctctggagtcctctgg

SEQ ID NO: 37849 - DNA, 22 bp, Homo sapiens
ctccaggccatggctgcggagg

SEQ ID NO: 37850 - DNA, 22 bp, Homo sapiens
gggaagatagtgttgagggccc

SEQ ID NO: 37851 - DNA, 22 bp, Homo sapiens
ttgtgaatggtgccgcaataaa

SEQ ID NO: 37852 - DNA, 22 bp, Homo sapiens
cagatcacttgaagccaggagt

SEQ ID NO: 37853 - DNA, 22 bp, Homo sapiens
aaagatcacgtcccaggactcg

SEQ ID NO: 37854 - DNA, 22 bp, Homo sapiens
gtatggcactatcctctctgat

SEQ ID NO: 37855 - DNA, 22 bp, Homo sapiens
tactgtactgcagttctgcaaa

SEQ ID NO: 37856 - DNA, 22 bp, Homo sapiens
acagtcttcagaagggattggg

SEQ ID NO: 37857 - DNA, 22 bp, Homo sapiens
tccttgtaaaggagctctaaca

SEQ ID NO: 37858 - DNA, 22 bp, Homo sapiens
tgaacatgctgttgatggcctg

SEQ ID NO: 37859 - DNA, 22 bp, Homo sapiens
cccgagtgtctactcactccca

SEQ ID NO: 37860 - DNA, 22 bp, Homo sapiens
ggagacagggttgaaccacgca

SEQ ID NO: 37861 - DNA, 22 bp, Homo sapiens
cactgcactccagcctgggaga

SEQ ID NO: 37862 - DNA, 22 bp, Homo sapiens
tacaaaaaattgatactgacga

SEQ ID NO: 37863 - DNA, 22 bp, Homo sapiens
tcactgcatcctccgcctcctg

SEQ ID NO: 37864 - DNA, 22 bp, Homo sapiens
gcttccgcgatgtcctaggtgg

SEQ ID NO: 37865 - DNA, 22 bp, Homo sapiens
ctgagatctttatacgaggcac

SEQ ID NO: 37866 - DNA, 22 bp, Homo sapiens
tcactgcagcctctgcctcccg

SEQ ID NO: 37867 - DNA, 22 bp, Homo sapiens
tcctggcaaagatgttggtgtt

SEQ ID NO: 37868 - DNA, 22 bp, Homo sapiens
atgcattgtcaggcaatttcat

SEQ ID NO: 37869 - DNA, 22 bp, Homo sapiens
agaaatatgctgattagatgaa

SEQ ID NO: 37870 - DNA, 22 bp, Homo sapiens
cattcattacactcataaggtt

SEQ ID NO: 37871 - DNA, 22 bp, Homo sapiens
attcacctttccccaaaatgag

SEQ ID NO: 37872 - DNA, 22 bp, Homo sapiens
aagtcgtggcaggcttgcacga

SEQ ID NO: 37873 - DNA, 22 bp, Homo sapiens
tgcctaggctggagtgtagtgg

SEQ ID NO: 37874 - DNA, 22 bp, Homo sapiens
gccaggttgctgacgacgatct

SEQ ID NO: 37875 - DNA, 19 bp, Homo sapiens
ttcacattggaagaagtag

SEQ ID NO: 37876 - DNA, 22 bp, Homo sapiens
ataatacatggttgatcttttc

SEQ ID NO: 37877 - DNA, 21 bp, Homo sapiens
tggtacaccttgcctgtcaga

SEQ ID NO: 37878 - DNA, 18 bp, Homo sapiens
cttgttcttctcttggcg

SEQ ID NO: 37879 - DNA, 22 bp, Homo sapiens
tgttatctgagcaacgtcgacg

SEQ ID NO: 37880 - DNA, 22 bp, Homo sapiens
gctcccaggatgaggagccagg

SEQ ID NO: 37881 - DNA, 17 bp, Homo sapiens
ttaaggtggatcagcac

SEQ ID NO: 37882 - DNA, 22 bp, Homo sapiens
cccaggaggcagaagttgcagt

SEQ ID NO: 37883 - DNA, 22 bp, Homo sapiens
tcactgcactccagcactcagg

SEQ ID NO: 37884 - DNA, 22 bp, Homo sapiens
tggctaaaccctagtaaattaa

SEQ ID NO: 37885 - DNA, 22 bp, Homo sapiens
tcatctaagagtcttacattta

SEQ ID NO: 37886 - DNA, 23 bp, Homo sapiens
agcttttaggtggaaatggcact

SEQ ID NO: 37887 - DNA, 22 bp, Homo sapiens
catgagatctgcagggatgggc

SEQ ID NO: 37888 - DNA, 22 bp, Homo sapiens
taattgtaaagtagtagtacag

SEQ ID NO: 37889 - DNA, 22 bp, Homo sapiens
agagggatcaccctgtttctgg

SEQ ID NO: 37890 - DNA, 22 bp, Homo sapiens
cagaggaacgtttggattgatt

SEQ ID NO: 37891 - DNA, 22 bp, Homo sapiens
tcactgcaagctcctcctcctg

SEQ ID NO: 37892 - DNA, 22 bp, Homo sapiens
tcactgcacttcagcttgggca

SEQ ID NO: 37893 - DNA, 22 bp, Homo sapiens
tcactgcaacctccgcctcccg

SEQ ID NO: 37894 - DNA, 22 bp, Homo sapiens
tacaacaatttccacattagaa

SEQ ID NO: 37895 - DNA, 22 bp, Homo sapiens
ctgcatccatgttgctgcaaag

SEQ ID NO: 37896 - DNA, 22 bp, Homo sapiens
ggttcccggatctccgagtccc

SEQ ID NO: 37897 - DNA, 21 bp, Homo sapiens
cctcaaagatgatggggtttc

SEQ ID NO: 37898 - DNA, 22 bp, Homo sapiens
gcaaacaaggacatacatcctg

SEQ ID NO: 37899 - DNA, 22 bp, Homo sapiens
gggagctgagctggaagagaat

SEQ ID NO: 37900 - DNA, 22 bp, Homo sapiens
aggtgggcggattcatgaggtc

SEQ ID NO: 37901 - DNA, 22 bp, Homo sapiens
gactgtggggaagcagatgcca

SEQ ID NO: 37902 - DNA, 22 bp, Homo sapiens
tgcctgttgcccacctgataaa

SEQ ID NO: 37903 - DNA, 22 bp, Homo sapiens
ccaggctggagtgcagtggcac

SEQ ID NO: 37904 - DNA, 22 bp, Homo sapiens
cccagggaggcccaggctctgc

SEQ ID NO: 37905 - DNA, 22 bp, Homo sapiens
gacaggaggcagagctcaggtg

SEQ ID NO: 37906 - DNA, 22 bp, Homo sapiens
gctcaagccttctgcccacctc

SEQ ID NO: 37907 - DNA, 22 bp, Homo sapiens
ccctggaggcggagcttgcagt

SEQ ID NO: 37908 - DNA, 22 bp, Homo sapiens
gggagctggagctggaagactc

SEQ ID NO: 37909 - DNA, 22 bp, Homo sapiens
agcaggaaggggatgatgggca

SEQ ID NO: 37910 - DNA, 22 bp, Homo sapiens
cagtgatcgcactcaacagttt

SEQ ID NO: 37911 - DNA, 22 bp, Homo sapiens
tcctggtgctgacacccatagc

SEQ ID NO: 37912 - DNA, 22 bp, Homo sapiens
agaggccggccgagcccatggg

SEQ ID NO: 37913 - DNA, 22 bp, Homo sapiens
ccttacctgattgctggcatcc

SEQ ID NO: 37914 - DNA, 22 bp, Homo sapiens
gggccctgggattcagagcaag

SEQ ID NO: 37915 - DNA, 22 bp, Homo sapiens
ttttcatttttgtagatgcaag

SEQ ID NO: 37916 - DNA, 22 bp, Homo sapiens
ctggagggctgcagcgaggctg

SEQ ID NO: 37917 - DNA, 22 bp, Homo sapiens
catgagatttgggaggggccag

SEQ ID NO: 37918 - DNA, 23 bp, Homo sapiens
ggggtcttggaacaggtggccct

SEQ ID NO: 37919 - DNA, 22 bp, Homo sapiens
cccagacccagagggaggcagg

SEQ ID NO: 37920 - DNA, 22 bp, Homo sapiens
gtgtgggctgcagaggcacagc

SEQ ID NO: 37921 - DNA, 22 bp, Homo sapiens
caggctggagtgcagtggcgct

SEQ ID NO: 37922 - DNA, 22 bp, Homo sapiens
atatacacatctttttaaatat

SEQ ID NO: 37923 - DNA, 22 bp, Homo sapiens
ggggtgggcgtgcagggacacc

SEQ ID NO: 37924 - DNA, 22 bp, Homo sapiens
gcaggagaacaaagcaagctgc

SEQ ID NO: 37925 - DNA, 22 bp, Homo sapiens
ctggcaggttatagagctgccc

SEQ ID NO: 37926 - DNA, 22 bp, Homo sapiens
tggagccagagcgcagcctggg

SEQ ID NO: 37927 - DNA, 22 bp, Homo sapiens
agaggaagtaatcaggacctgc

SEQ ID NO: 37928 - DNA, 22 bp, Homo sapiens
gatggtgcaggtgaagtgctgg

SEQ ID NO: 37929 - DNA, 22 bp, Homo sapiens
gtgtgtccaaggcacggatgac

SEQ ID NO: 37930 - DNA, 22 bp, Homo sapiens
gagccaggggtcagctccgagg

SEQ ID NO: 37931 - DNA, 22 bp, Homo sapiens
gctgcgccggatcccacgttcc

SEQ ID NO: 37932 - DNA, 22 bp, Homo sapiens
gcctgcagggcctgggcctacc

SEQ ID NO: 37933 - DNA, 22 bp, Homo sapiens
agcctgggccctgcctcttctc

SEQ ID NO: 37934 - DNA, 22 bp, Homo sapiens
agagggtgggcacgtgatggat

SEQ ID NO: 37935 - DNA, 22 bp, Homo sapiens
gggcttcagttctgaccatctt

SEQ ID NO: 37936 - DNA, 22 bp, Homo sapiens
aggcaagggggcgccaccttcc

SEQ ID NO: 37937 - DNA, 22 bp, Homo sapiens
gtgaattacatgtatttttaag

SEQ ID NO: 37938 - DNA, 22 bp, Homo sapiens
aggtcaagagtaaatttgggta

SEQ ID NO: 37939 - DNA, 22 bp, Homo sapiens
gagggggctagcgcagtgccca

SEQ ID NO: 37940 - DNA, 22 bp, Homo sapiens
aataaaatggtcagttttctca

SEQ ID NO: 37941 - DNA, 22 bp, Homo sapiens
aggaattcaagaccagctgggc

SEQ ID NO: 37942 - DNA, 22 bp, Homo sapiens
gcttggcccattgatcagctgg

SEQ ID NO: 37943 - DNA, 22 bp, Homo sapiens
gccctagcgccagctcagcacc

SEQ ID NO: 37944 - DNA, 22 bp, Homo sapiens
tgctgggggtagctctgcgtag

SEQ ID NO: 37945 - DNA, 22 bp, Homo sapiens
gcccatgaggtggaggctgcag

SEQ ID NO: 37946 - DNA, 22 bp, Homo sapiens
ttatcacttatgagctttttgc

SEQ ID NO: 37947 - DNA, 22 bp, Homo sapiens
tttgaaatgtatcagtataggt

SEQ ID NO: 37948 - DNA, 22 bp, Homo sapiens
gggagtgggtttggcctaggcc

SEQ ID NO: 37949 - DNA, 22 bp, Homo sapiens
tgcctctgaggaagattgtgtt

SEQ ID NO: 37950 - DNA, 22 bp, Homo sapiens
ggtgggagagcttgctttgatg

SEQ ID NO: 37951 - DNA, 22 bp, Homo sapiens
ctgctttgcatagctgccagag

SEQ ID NO: 37952 - DNA, 22 bp, Homo sapiens
aagcagcacagcaatgactcta

SEQ ID NO: 37953 - DNA, 22 bp, Homo sapiens
ttatatgtttctgtttggaggc

SEQ ID NO: 37954 - DNA, 22 bp, Homo sapiens
gctgtctcatacaaggccctgc

SEQ ID NO: 37955 - DNA, 22 bp, Homo sapiens
cactgcactccagcctgggtga

SEQ ID NO: 37956 - DNA, 22 bp, Homo sapiens
ttggccatctaagcccagccac

SEQ ID NO: 37957 - DNA, 22 bp, Homo sapiens
cctcttctaggacgtccttgtg

SEQ ID NO: 37958 - DNA, 22 bp, Homo sapiens
aatgaattgcagtactgacttg

SEQ ID NO: 37959 - DNA, 22 bp, Homo sapiens
gtatgtgaggttggtttccagg

SEQ ID NO: 37960 - DNA, 22 bp, Homo sapiens
gtccaggcctgcctctgaggag

SEQ ID NO: 37961 - DNA, 20 bp, Homo sapiens
gggcaaggaaacagccccca

SEQ ID NO: 37962 - DNA, 22 bp, Homo sapiens
cccttggggtggaggttgcagt

SEQ ID NO: 37963 - DNA, 19 bp, Homo sapiens
caccaagatggctctagtc

SEQ ID NO: 37964 - DNA, 22 bp, Homo sapiens
gggtggtggccagcagtgggca

SEQ ID NO: 37965 - DNA, 22 bp, Homo sapiens
gaggaggcttccgggaggcacg

SEQ ID NO: 37966 - DNA, 18 bp, Homo sapiens
tgtagagccaggtttgcc

SEQ ID NO: 37967 - DNA, 22 bp, Homo sapiens
tggcacgacaattggcaccaat

SEQ ID NO: 37968 - DNA, 22 bp, Homo sapiens
catgtgtccacccttgaacaca

SEQ ID NO: 37969 - DNA, 22 bp, Homo sapiens
ggagcagggaattacagcgcag

SEQ ID NO: 37970 - DNA, 22 bp, Homo sapiens
gcaggcaggcttccttgaactg

SEQ ID NO: 37971 - DNA, 22 bp, Homo sapiens
acatacttctttacattccata

SEQ ID NO: 37972 - DNA, 22 bp, Homo sapiens
tgggtggcagcttcagcatgtt

SEQ ID NO: 37973 - DNA, 21 bp, Homo sapiens
gccatttcacacagacatttg

SEQ ID NO: 37974 - DNA, 22 bp, Homo sapiens
agcccaggttgaggctgcagtg

SEQ ID NO: 37975 - DNA, 19 bp, Homo sapiens
atgtacccagtgtcaatcc

SEQ ID NO: 37976 - DNA, 19 bp, Homo sapiens
ggcatggggtccggggacc

SEQ ID NO: 37977 - DNA, 22 bp, Homo sapiens
agacagggtgatcgcttgagcc

SEQ ID NO: 37978 - DNA, 22 bp, Homo sapiens
tgccttgtccttcgtcagggct

SEQ ID NO: 37979 - DNA, 22 bp, Homo sapiens
caggtggtcaggcaaggacacg

SEQ ID NO: 37980 - DNA, 22 bp, Homo sapiens
cagccctcctaccctgccaggc

SEQ ID NO: 37981 - DNA, 22 bp, Homo sapiens
gggggctccaggcgagaatgtg

SEQ ID NO: 37982 - DNA, 16 bp, Homo sapiens
aggctcagaggctgga

SEQ ID NO: 37983 - DNA, 22 bp, Homo sapiens
taagggttcagaatgcagtggt

SEQ ID NO: 37984 - DNA, 19 bp, Homo sapiens
agccccttggtactgtcct

SEQ ID NO: 37985 - DNA, 22 bp, Homo sapiens
gagccaggaggcagagactgca

SEQ ID NO: 37986 - DNA, 22 bp, Homo sapiens
ctgcatccatgttgctgcaaag

SEQ ID NO: 37987 - DNA, 22 bp, Homo sapiens
gcccatgcactttctgtgatgg

SEQ ID NO: 37988 - DNA, 22 bp, Homo sapiens
aaggctgaggcagtgaggcaga

SEQ ID NO: 37989 - DNA, 22 bp, Homo sapiens
gctgcagtgagccaagatcgtg

SEQ ID NO: 37990 - DNA, 22 bp, Homo sapiens
gcaggcagaggtggaggagaca

SEQ ID NO: 37991 - DNA, 22 bp, Homo sapiens
cctggtgctgctatcaggggta

SEQ ID NO: 37992 - DNA, 22 bp, Homo sapiens
ttagtttataattcatttctgt

SEQ ID NO: 37993 - DNA, 22 bp, Homo sapiens
atgccactgcgctctagcctgg

SEQ ID NO: 37994 - DNA, 22 bp, Homo sapiens
tgggcagggagctggaaccaca

SEQ ID NO: 37995 - DNA, 22 bp, Homo sapiens
tccacatggctgggaggcctca

SEQ ID NO: 37996 - DNA, 22 bp, Homo sapiens
cctggagagctcgggccaggca

SEQ ID NO: 37997 - DNA, 22 bp, Homo sapiens
ctcgattgagtaggccagcact

SEQ ID NO: 37998 - DNA, 22 bp, Homo sapiens
aggggatggagctggaaggcag

SEQ ID NO: 37999 - DNA, 22 bp, Homo sapiens
tgaagactcagaagctaagata

SEQ ID NO: 38000 - DNA, 22 bp, Homo sapiens
ttgtgctcctatgagaatctaa

SEQ ID NO: 38001 - DNA, 19 bp, Homo sapiens
tcctgcccaccagccaggg

SEQ ID NO: 38002 - DNA, 22 bp, Homo sapiens
tttgaagggcacgacaatagtt

SEQ ID NO: 38003 - DNA, 22 bp, Homo sapiens
ctctggagtgtctggccagggt

SEQ ID NO: 38004 - DNA, 22 bp, Homo sapiens
aggcaacttttggggatgatgg

SEQ ID NO: 38005 - DNA, 22 bp, Homo sapiens
ccacagaattctgtctccagga

SEQ ID NO: 38006 - DNA, 22 bp, Homo sapiens
tcacttcccagacggggtggca

SEQ ID NO: 38007 - DNA, 22 bp, Homo sapiens
cagcagcagtggctgcagaaca

SEQ ID NO: 38008 - DNA, 22 bp, Homo sapiens
ttgtgttaaggtgcatctagtg

SEQ ID NO: 38009 - DNA, 22 bp, Homo sapiens
gtagttctgcagtgtcacctga

SEQ ID NO: 38010 - DNA, 22 bp, Homo sapiens
gctcgcttagattttcctctga

SEQ ID NO: 38011 - DNA, 22 bp, Homo sapiens
tacaaaaaattgatactgacga

SEQ ID NO: 38012 - DNA, 22 bp, Homo sapiens
tcacccaggctggagtgtagtg

SEQ ID NO: 38013 - DNA, 17 bp, Homo sapiens
ggctgcagtccaggagg

SEQ ID NO: 38014 - DNA, 22 bp, Homo sapiens
aaggagtctgggccattcagag

SEQ ID NO: 38015 - DNA, 22 bp, Homo sapiens
tgagtagagaattcagctaagg

SEQ ID NO: 38016 - DNA, 22 bp, Homo sapiens
gctgctctcagagctcatgctg

SEQ ID NO: 38017 - DNA, 22 bp, Homo sapiens
gccaggacctcagatgcagggc

SEQ ID NO: 38018 - DNA, 22 bp, Homo sapiens
agctgctgagccaggctgatgt

SEQ ID NO: 38019 - DNA, 22 bp, Homo sapiens
ttgtgctcctgtgagaatctag

SEQ ID NO: 38020 - DNA, 22 bp, Homo sapiens
agccggccatgtggtcttgtgc

SEQ ID NO: 38021 - DNA, 22 bp, Homo sapiens
ttttgacaatgctaatctcaat

SEQ ID NO: 38022 - DNA, 22 bp, Homo sapiens
caggctggagtgcagtggtgcc

SEQ ID NO: 38023 - DNA, 23 bp, Homo sapiens
gtgtgttcccggagtagctcccg

SEQ ID NO: 38024 - DNA, 22 bp, Homo sapiens
ctggcaggtggaggttgcagtg

SEQ ID NO: 38025 - DNA, 22 bp, Homo sapiens
gtggagggtgattgccggctgt

SEQ ID NO: 38026 - DNA, 22 bp, Homo sapiens
ctcattgcagctgcattactgt

SEQ ID NO: 38027 - DNA, 21 bp, Homo sapiens
ctggaggcaggtggtgccagg

SEQ ID NO: 38028 - DNA, 22 bp, Homo sapiens
aggggagccagggctgcgagtt

SEQ ID NO: 38029 - DNA, 22 bp, Homo sapiens
cagtggctggttagggacagga

SEQ ID NO: 38030 - DNA, 22 bp, Homo sapiens
cctgggctctgtcagaattggg

SEQ ID NO: 38031 - DNA, 18 bp, Homo sapiens
cttgttcttctcttggcg

SEQ ID NO: 38032 - DNA, 22 bp, Homo sapiens
caggctggagttcagtggtgtg

SEQ ID NO: 38033 - DNA, 22 bp, Homo sapiens
ccaggctgctgttggtgtccgc

SEQ ID NO: 38034 - DNA, 22 bp, Homo sapiens
tggcactgaagctggaaagcct

SEQ ID NO: 38035 - DNA, 22 bp, Homo sapiens
cctaggagttcgaagctgcagt

SEQ ID NO: 38036 - DNA, 22 bp, Homo sapiens
agtggctgagtgactgtgactc

SEQ ID NO: 38037 - DNA, 22 bp, Homo sapiens
gattcactcatattttacgttt

SEQ ID NO: 38038 - DNA, 22 bp, Homo sapiens
tcccagattcctgctcttatat

SEQ ID NO: 38039 - DNA, 22 bp, Homo sapiens
atgccactgcgctccagcctgg

SEQ ID NO: 38040 - DNA, 22 bp, Homo sapiens
gtgggctgcccttgaggtcagc

SEQ ID NO: 38041 - DNA, 22 bp, Homo sapiens
tgagcctgagttcaaggctgca

SEQ ID NO: 38042 - DNA, 22 bp, Homo sapiens
cccccaaagtttgcacggataa

SEQ ID NO: 38043 - DNA, 22 bp, Homo sapiens
gcccaggctggagtgcagtggt

SEQ ID NO: 38044 - DNA, 21 bp, Homo sapiens
cagggccaatcctgacctcta

SEQ ID NO: 38045 - DNA, 23 bp, Homo sapiens
tgagctgggcctgcaggggtctc

SEQ ID NO: 38046 - DNA, 22 bp, Homo sapiens
atagggcctaaaaagtattgct

SEQ ID NO: 38047 - DNA, 22 bp, Homo sapiens
ggcagggcaggaaagtcaggaa

SEQ ID NO: 38048 - DNA, 22 bp, Homo sapiens
gggctgcatcagcaggacccgg

SEQ ID NO: 38049 - DNA, 22 bp, Homo sapiens
aaagaaatagatggcatttaaa

SEQ ID NO: 38050 - DNA, 22 bp, Homo sapiens
gacccggctccaggcccagcag

SEQ ID NO: 38051 - DNA, 20 bp, Homo sapiens
tagcatgggtgagggtagag

SEQ ID NO: 38052 - DNA, 22 bp, Homo sapiens
acaactccttcttgggtcctgg

SEQ ID NO: 38053 - DNA, 21 bp, Homo sapiens
gggcagaggggcctcctgggt

SEQ ID NO: 38054 - DNA, 21 bp, Homo sapiens
tggctaaaccctagtaaatta

SEQ ID NO: 38055 - DNA, 22 bp, Homo sapiens
aggagcagaccgtagtcctgca

SEQ ID NO: 38056 - DNA, 20 bp, Homo sapiens
ttcatgggagcaaagaggcc

SEQ ID NO: 38057 - DNA, 22 bp, Homo sapiens
cttgcctttgtcttcaaaggct

SEQ ID NO: 38058 - DNA, 22 bp, Homo sapiens
gggcagagactcagaaacagaa

SEQ ID NO: 38059 - DNA, 16 bp, Homo sapiens
ccacctgcagctctca

SEQ ID NO: 38060 - DNA, 18 bp, Homo sapiens
ccctcttgcacaaagcaa

SEQ ID NO: 38061 - DNA, 22 bp, Homo sapiens
actggacagaggaaatatggag

SEQ ID NO: 38062 - DNA, 23 bp, Homo sapiens
tcggtgggcgtggaggccgaggc

SEQ ID NO: 38063 - DNA, 21 bp, Homo sapiens
tcctgtaagcttgggtggctc

SEQ ID NO: 38064 - DNA, 22 bp, Homo sapiens
ccactgcactccagccttggca

SEQ ID NO: 38065 - DNA, 22 bp, Homo sapiens
tggtggcactgacatcagacac

SEQ ID NO: 38066 - DNA, 19 bp, Homo sapiens
gatttaaacgtggctctat

SEQ ID NO: 38067 - DNA, 22 bp, Homo sapiens
agcagcttgaggctggattcca

SEQ ID NO: 38068 - DNA, 18 bp, Homo sapiens
catgggtgacaggtggat

SEQ ID NO: 38069 - DNA, 22 bp, Homo sapiens
actgggccaggtgtgggtgagt

SEQ ID NO: 38070 - DNA, 22 bp, Homo sapiens
gcgggccaccttggagagcgct

SEQ ID NO: 38071 - DNA, 22 bp, Homo sapiens
ggagatatttgtattctgtctc

SEQ ID NO: 38072 - DNA, 22 bp, Homo sapiens
ggccctggcagccacgaaagcc

SEQ ID NO: 38073 - DNA, 22 bp, Homo sapiens
caggagtgttgattgctcagga

SEQ ID NO: 38074 - DNA, 22 bp, Homo sapiens
tgagatgagggctgcactcaaa

SEQ ID NO: 38075 - DNA, 22 bp, Homo sapiens
cccaggaggtggagttcacagt

SEQ ID NO: 38076 - DNA, 22 bp, Homo sapiens
caaggtgccatgctgggcgggg

SEQ ID NO: 38077 - DNA, 21 bp, Homo sapiens
ttagaagctaatgcagctggt

SEQ ID NO: 38078 - DNA, 22 bp, Homo sapiens
atcaacatgtcataaagtgaaa

SEQ ID NO: 38079 - DNA, 22 bp, Homo sapiens
gcccagagttcaaggctgcagt

SEQ ID NO: 38080 - DNA, 22 bp, Homo sapiens
atgccactgcactccagcctag

SEQ ID NO: 38081 - DNA, 22 bp, Homo sapiens
gctggaggatggactggaagaa

SEQ ID NO: 38082 - DNA, 22 bp, Homo sapiens
ggctgggcaggtctgcacaggg

SEQ ID NO: 38083 - DNA, 22 bp, Homo sapiens
ttacctctagctctttgcttgt

SEQ ID NO: 38084 - DNA, 22 bp, Homo sapiens
atgcaggcagacactgtgggca

SEQ ID NO: 38085 - DNA, 22 bp, Homo sapiens
actgcactcctgcctgggtaac

SEQ ID NO: 38086 - DNA, 22 bp, Homo sapiens
cagtcctgaatactggacggtg

SEQ ID NO: 38087 - DNA, 22 bp, Homo sapiens
agctcctgaaaatccagactgg

SEQ ID NO: 38088 - DNA, 22 bp, Homo sapiens
gctgctctccaagcctccttga

SEQ ID NO: 38089 - DNA, 23 bp, Homo sapiens
atcattactttgataccttttct

SEQ ID NO: 38090 - DNA, 22 bp, Homo sapiens
gtggcagagccaaggctggagc

SEQ ID NO: 38091 - DNA, 22 bp, Homo sapiens
gggttcagtccctcttgctact

SEQ ID NO: 38092 - DNA, 22 bp, Homo sapiens
tgtctcctcggctgtccagcca

SEQ ID NO: 38093 - DNA, 22 bp, Homo sapiens
cgggaaggtggaggttgcagtg

SEQ ID NO: 38094 - DNA, 22 bp, Homo sapiens
tggcaggcgggagccatagagg

SEQ ID NO: 38095 - DNA, 22 bp, Homo sapiens
cagccccatggtgtgctccagc

SEQ ID NO: 38096 - DNA, 22 bp, Homo sapiens
gctgcagggagctggaaggctc

SEQ ID NO: 38097 - DNA, 22 bp, Homo sapiens
aggagatggagctcagtgggca

SEQ ID NO: 38098 - DNA, 22 bp, Homo sapiens
ggcaggaggtgagtggcgggtg

SEQ ID NO: 38099 - DNA, 22 bp, Homo sapiens
cccagggagagcgcggaggcgg

SEQ ID NO: 38100 - DNA, 22 bp, Homo sapiens
agccctcttccagccagcacag

SEQ ID NO: 38101 - DNA, 22 bp, Homo sapiens
caggggcgggtaaaaggcctcc

SEQ ID NO: 38102 - DNA, 22 bp, Homo sapiens
tcgcaccattgcactccagcca

SEQ ID NO: 38103 - DNA, 22 bp, Homo sapiens
aggctcagatccttgtgtcctg

SEQ ID NO: 38104 - DNA, 22 bp, Homo sapiens
aggggaatgggtagactgttga

SEQ ID NO: 38105 - DNA, 22 bp, Homo sapiens
aactagaaaaagactttctgag

SEQ ID NO: 38106 - DNA, 22 bp, Homo sapiens
agtccaggcattccagccattc

SEQ ID NO: 38107 - DNA, 22 bp, Homo sapiens
caggcagggagctggaaaggat

SEQ ID NO: 38108 - DNA, 22 bp, Homo sapiens
tggcacaggatctcagcggcca

SEQ ID NO: 38109 - DNA, 22 bp, Homo sapiens
tgcttacgagctattttcactt

SEQ ID NO: 38110 - DNA, 22 bp, Homo sapiens
gcccaggagttcaagtctagtg

SEQ ID NO: 38111 - DNA, 22 bp, Homo sapiens
ttgtatagcccagagagtgaga

SEQ ID NO: 38112 - DNA, 22 bp, Homo sapiens
cccagaaggtcgaggctgcagt

SEQ ID NO: 38113 - DNA, 22 bp, Homo sapiens
tcactgcgcttcagcctgggtg

SEQ ID NO: 38114 - DNA, 22 bp, Homo sapiens
gtgggtggacggtgcttttgtt

SEQ ID NO: 38115 - DNA, 22 bp, Homo sapiens
ttattaggaactcaggattttt

SEQ ID NO: 38116 - DNA, 22 bp, Homo sapiens
tgagcctgggagatggaggctg

SEQ ID NO: 38117 - DNA, 22 bp, Homo sapiens
gagcccaggagtttgatgctgc

SEQ ID NO: 38118 - DNA, 22 bp, Homo sapiens
aagccaggttccatggaggagc

SEQ ID NO: 38119 - DNA, 22 bp, Homo sapiens
cagtgcagccaaggacaggcac

SEQ ID NO: 38120 - DNA, 22 bp, Homo sapiens
cgcaactcagcaacttaactgc

SEQ ID NO: 38121 - DNA, 22 bp, Homo sapiens
ggaggagcatgagagggtagtg

SEQ ID NO: 38122 - DNA, 22 bp, Homo sapiens
acgggccttctcttcaggcgag

SEQ ID NO: 38123 - DNA, 22 bp, Homo sapiens
gagccaagctcttctccatgag

SEQ ID NO: 38124 - DNA, 22 bp, Homo sapiens
catggcagctcctccagtgtga

SEQ ID NO: 38125 - DNA, 22 bp, Homo sapiens
cacagacagtgtccctttgttg

SEQ ID NO: 38126 - DNA, 22 bp, Homo sapiens
gggcagagagctggaactcctt

SEQ ID NO: 38127 - DNA, 22 bp, Homo sapiens
gaggggcacagtaaagggtccc

SEQ ID NO: 38128 - DNA, 22 bp, Homo sapiens
ttccagctaactcacatccctt

SEQ ID NO: 38129 - DNA, 22 bp, Homo sapiens
caggccagggttgagaagagaa

SEQ ID NO: 38130 - DNA, 22 bp, Homo sapiens
tcacttgaacctgggaggcaga

SEQ ID NO: 38131 - DNA, 22 bp, Homo sapiens
tgggcaggggccctgcttccgt

SEQ ID NO: 38132 - DNA, 22 bp, Homo sapiens
aggccagcctcaggcagggacc

SEQ ID NO: 38133 - DNA, 22 bp, Homo sapiens
agactcagccacacaagactac

SEQ ID NO: 38134 - DNA, 22 bp, Homo sapiens
gggaagagggagctggaatgat

SEQ ID NO: 38135 - DNA, 22 bp, Homo sapiens
acaggtcctcaagtcagctggg

SEQ ID NO: 38136 - DNA, 22 bp, Homo sapiens
agcgggtctgcaagccttccct

SEQ ID NO: 38137 - DNA, 20 bp, Homo sapiens
gggcagtggcgctatctcag

SEQ ID NO: 38138 - DNA, 22 bp, Homo sapiens
gtgattttcatgccctgctagg

SEQ ID NO: 38139 - DNA, 22 bp, Homo sapiens
agaaaatttaaagagacacaca

SEQ ID NO: 38140 - DNA, 22 bp, Homo sapiens
acacttggagcaacacttatgg

SEQ ID NO: 38141 - DNA, 22 bp, Homo sapiens
gcaagacctatctagttgctgt

SEQ ID NO: 38142 - DNA, 22 bp, Homo sapiens
ggaggcggaggttgcagtgagc

SEQ ID NO: 38143 - DNA, 22 bp, Homo sapiens
ctgggcagctgtatcagggagt

SEQ ID NO: 38144 - DNA, 18 bp, Homo sapiens
atggtctcatactgggag

SEQ ID NO: 38145 - DNA, 22 bp, Homo sapiens
accgggaagtcctgcactgggc

SEQ ID NO: 38146 - DNA, 23 bp, Homo sapiens
agcttttaggtggaaatggcact

SEQ ID NO: 38147 - DNA, 22 bp, Homo sapiens
ttggagatatcacaccttcaca

SEQ ID NO: 38148 - DNA, 22 bp, Homo sapiens
ctgcaccgtgtctcgggctgcc

SEQ ID NO: 38149 - DNA, 22 bp, Homo sapiens
gagagagctctgtgcctgggat

SEQ ID NO: 38150 - DNA, 22 bp, Homo sapiens
caggagtgtctccacacagcaa

SEQ ID NO: 38151 - DNA, 22 bp, Homo sapiens
cggggccctggggctgaaggtc

SEQ ID NO: 38152 - DNA, 22 bp, Homo sapiens
actgggcctacccagattggca

SEQ ID NO: 38153 - DNA, 22 bp, Homo sapiens
ggggcaggagcccttcttcagc

SEQ ID NO: 38154 - DNA, 22 bp, Homo sapiens
gtatggcactatcctctctgat

SEQ ID NO: 38155 - DNA, 17 bp, Homo sapiens
cttcccaccatctcctg

SEQ ID NO: 38156 - DNA, 22 bp, Homo sapiens
ctccaggccatggctgcggagg

SEQ ID NO: 38157 - DNA, 22 bp, Homo sapiens
actgcactccagcctgggtgat

SEQ ID NO: 38158 - DNA, 22 bp, Homo sapiens
ctgggcgcgtcccctgaggcgg

SEQ ID NO: 38159 - DNA, 22 bp, Homo sapiens
cattcattacactcataaggtt

SEQ ID NO: 38160 - DNA, 22 bp, Homo sapiens
taggcctggatctctgggagca

SEQ ID NO: 38161 - DNA, 22 bp, Homo sapiens
gggaaggccttgtcagcggatt

SEQ ID NO: 38162 - DNA, 22 bp, Homo sapiens
aagtcattggtagcttgatagg

SEQ ID NO: 38163 - DNA, 19 bp, Homo sapiens
aggaatggaattaattctg

SEQ ID NO: 38164 - DNA, 22 bp, Homo sapiens
tgccgtggggctgaggctggag

SEQ ID NO: 38165 - DNA, 22 bp, Homo sapiens
ccaggcaggcgatggtgcagtg

SEQ ID NO: 38166 - DNA, 22 bp, Homo sapiens
gatatcatgggaaggtgtactt

SEQ ID NO: 38167 - DNA, 18 bp, Homo sapiens
cagggctgtggggtcact

SEQ ID NO: 38168 - DNA, 23 bp, Homo sapiens
ggctgggagctccgggtgcacgt

SEQ ID NO: 38169 - DNA, 19 bp, Homo sapiens
ggctgccttctgctcatct

SEQ ID NO: 38170 - DNA, 22 bp, Homo sapiens
catgagataatttttctccagt

SEQ ID NO: 38171 - DNA, 22 bp, Homo sapiens
tgtctgggagactgatcacccg

SEQ ID NO: 38172 - DNA, 22 bp, Homo sapiens
tgcagtggcgccatctcagctc

SEQ ID NO: 38173 - DNA, 22 bp, Homo sapiens
cgcgaggtggaggttgcagtga

SEQ ID NO: 38174 - DNA, 22 bp, Homo sapiens
aagtggactaatacaaggacta

SEQ ID NO: 38175 - DNA, 22 bp, Homo sapiens
gcggggttccgtgccccagagt

SEQ ID NO: 38176 - DNA, 21 bp, Homo sapiens
ccaggccaggcctacggggat

SEQ ID NO: 38177 - DNA, 22 bp, Homo sapiens
ggaggcggaagttgcagtgagc

SEQ ID NO: 38178 - DNA, 21 bp, Homo sapiens
cagaggcctatcacagactcc

SEQ ID NO: 38179 - DNA, 22 bp, Homo sapiens
gggggtttctgggctgagcaga

SEQ ID NO: 38180 - DNA, 22 bp, Homo sapiens
ccagggtggcgtagatgctggg

SEQ ID NO: 38181 - DNA, 22 bp, Homo sapiens
gagtcgagcagaaagccgtcgg

SEQ ID NO: 38182 - DNA, 19 bp, Homo sapiens
ccacagcctgctgtcttcc

SEQ ID NO: 38183 - DNA, 22 bp, Homo sapiens
tttgcattgcattaagtattct

SEQ ID NO: 38184 - DNA, 22 bp, Homo sapiens
ggaggcggaggctgcagtgagc

SEQ ID NO: 38185 - DNA, 22 bp, Homo sapiens
tttgttttcaatgtgtcattca

SEQ ID NO: 38186 - DNA, 22 bp, Homo sapiens
atagaatatgacttttagatcc

SEQ ID NO: 38187 - DNA, 22 bp, Homo sapiens
ctgagggtcaacttgattgtat

SEQ ID NO: 38188 - DNA, 22 bp, Homo sapiens
ctggcctggcgcagtggctcac

SEQ ID NO: 38189 - DNA, 22 bp, Homo sapiens
cccagcaggaggaggttgcagt

SEQ ID NO: 38190 - DNA, 22 bp, Homo sapiens
acctggacacctgctgtcatct

SEQ ID NO: 38191 - DNA, 22 bp, Homo sapiens
gtgggcatctccttggaagcca

SEQ ID NO: 38192 - DNA, 22 bp, Homo sapiens
cccaggaggcctgcctggccgg

SEQ ID NO: 38193 - DNA, 22 bp, Homo sapiens
tcagccagccagctacaggctt

SEQ ID NO: 38194 - DNA, 22 bp, Homo sapiens
tcagggctgcagaagaggcagg

SEQ ID NO: 38195 - DNA, 22 bp, Homo sapiens
ggcagacctctccagccccaca

SEQ ID NO: 38196 - DNA, 22 bp, Homo sapiens
ggagggcagagtcccctgctga

SEQ ID NO: 38197 - DNA, 19 bp, Homo sapiens
gagcagtgaggaccaccag

SEQ ID NO: 38198 - DNA, 22 bp, Homo sapiens
cctggcaggtggcgccctcggc

SEQ ID NO: 38199 - DNA, 22 bp, Homo sapiens
agatttatgtggtcacactcag

SEQ ID NO: 38200 - DNA, 19 bp, Homo sapiens
tggctctgtcgaaggcaca

SEQ ID NO: 38201 - DNA, 22 bp, Homo sapiens
cctggtgcaggtgtgttgccag

SEQ ID NO: 38202 - DNA, 22 bp, Homo sapiens
ccaggtgtgctctgcagtggat

SEQ ID NO: 38203 - DNA, 22 bp, Homo sapiens
ccactgtggaaagcagttcaga

SEQ ID NO: 38204 - DNA, 22 bp, Homo sapiens
gcccagccacagtcactttcat

SEQ ID NO: 38205 - DNA, 22 bp, Homo sapiens
gcaccctgtcaaaatggaccaa

SEQ ID NO: 38206 - DNA, 22 bp, Homo sapiens
aagatattcaaagatttattag

SEQ ID NO: 38207 - DNA, 22 bp, Homo sapiens
tagcagcatttttgtagagtat

SEQ ID NO: 38208 - DNA, 22 bp, Homo sapiens
ctggcaggagcattcacagagg

SEQ ID NO: 38209 - DNA, 22 bp, Homo sapiens
cagtggcaggatttcagctcag

SEQ ID NO: 38210 - DNA, 22 bp, Homo sapiens
tgtcacagtttgtactttatag

SEQ ID NO: 38211 - DNA, 22 bp, Homo sapiens
tgctgagcgcatccggcggccg

SEQ ID NO: 38212 - DNA, 22 bp, Homo sapiens
atgaattgaggaaaacagtcgt

SEQ ID NO: 38213 - DNA, 22 bp, Homo sapiens
gcactggccgcacgcgtagggc

SEQ ID NO: 38214 - DNA, 22 bp, Homo sapiens
gcccaggctggagtgcagtggc

SEQ ID NO: 38215 - DNA, 22 bp, Homo sapiens
tcaccagatctctctgtaatgg

SEQ ID NO: 38216 - DNA, 22 bp, Homo sapiens
gcatgtgtctttatagcagcat

SEQ ID NO: 38217 - DNA, 22 bp, Homo sapiens
acactgtgtgacttctgagact

SEQ ID NO: 38218 - DNA, 23 bp, Homo sapiens
aaacttgctatggctgaaatcat

SEQ ID NO: 38219 - DNA, 22 bp, Homo sapiens
tttggtattgcacactgtcttc

SEQ ID NO: 38220 - DNA, 23 bp, Homo sapiens
tcatgcccaggctccagatgtca

SEQ ID NO: 38221 - DNA, 22 bp, Homo sapiens
cctcagctcccatgagatctgc

SEQ ID NO: 38222 - DNA, 22 bp, Homo sapiens
aggctagaggcttctggcttca

SEQ ID NO: 38223 - DNA, 22 bp, Homo sapiens
tgggaggccgaggcaggtggat

SEQ ID NO: 38224 - DNA, 22 bp, Homo sapiens
gagtggctattgatccgtgatg

SEQ ID NO: 38225 - DNA, 22 bp, Homo sapiens
ggggccgaccgcggttcaggcc

SEQ ID NO: 38226 - DNA, 20 bp, Homo sapiens
atcggcttgcctggaaacaa

SEQ ID NO: 38227 - DNA, 22 bp, Homo sapiens
tgggaagggtcaacagctggaa

SEQ ID NO: 38228 - DNA, 22 bp, Homo sapiens
ggccttggttccaaagcaggca

SEQ ID NO: 38229 - DNA, 22 bp, Homo sapiens
ggcagggagtggagactcccta

SEQ ID NO: 38230 - DNA, 22 bp, Homo sapiens
agcgccactgcactccagcctg

SEQ ID NO: 38231 - DNA, 22 bp, Homo sapiens
ggaggtggaggttgcagtgagc

SEQ ID NO: 38232 - DNA, 22 bp, Homo sapiens
ggaggcggaggttgcagtgagt

SEQ ID NO: 38233 - DNA, 20 bp, Homo sapiens
ctgggtggcaagcaaggggg

SEQ ID NO: 38234 - DNA, 22 bp, Homo sapiens
cccaggctggagtgcagtggcg

SEQ ID NO: 38235 - DNA, 22 bp, Homo sapiens
agtgcaggccccaggccaggcc

SEQ ID NO: 38236 - DNA, 22 bp, Homo sapiens
ggaggaggggtgactgaatgct

SEQ ID NO: 38237 - DNA, 22 bp, Homo sapiens
ggcccaggctggagtgcagtgg

SEQ ID NO: 38238 - DNA, 22 bp, Homo sapiens
aaagcctcccaggttatgagta

SEQ ID NO: 38239 - DNA, 23 bp, Homo sapiens
ttgtcctctggatcggtttggtt

SEQ ID NO: 38240 - DNA, 22 bp, Homo sapiens
ccgcccacactaaatatgagcg

SEQ ID NO: 38241 - DNA, 22 bp, Homo sapiens
actgcactccagcctgggtgac

SEQ ID NO: 38242 - DNA, 22 bp, Homo sapiens
ggagcatgcgctctgtgaccga

SEQ ID NO: 38243 - DNA, 23 bp, Homo sapiens
tgttccagatacgccttttcctc

SEQ ID NO: 38244 - DNA, 22 bp, Homo sapiens
tctgagctgggtcttgacagct

SEQ ID NO: 38245 - DNA, 22 bp, Homo sapiens
atggcagcggagctggaaatga

SEQ ID NO: 38246 - DNA, 22 bp, Homo sapiens
gcacagccacgtaatgtggtca

SEQ ID NO: 38247 - DNA, 22 bp, Homo sapiens
agtgactggtgtgaagttaaat

SEQ ID NO: 38248 - DNA, 18 bp, Homo sapiens
ccctgccagctcccagca

SEQ ID NO: 38249 - DNA, 22 bp, Homo sapiens
cccaggcttttctcttgcccca

SEQ ID NO: 38250 - DNA, 22 bp, Homo sapiens
cagcctggtccccggctcaccc

SEQ ID NO: 38251 - DNA, 22 bp, Homo sapiens
ttctttcagaacacaagtgatt

SEQ ID NO: 38252 - DNA, 22 bp, Homo sapiens
agccagggtctctcgctctgtt

SEQ ID NO: 38253 - DNA, 22 bp, Homo sapiens
cagggcctcctaaggcatctaa

SEQ ID NO: 38254 - DNA, 22 bp, Homo sapiens
cacggcctgtaaggacccagga

SEQ ID NO: 38255 - DNA, 22 bp, Homo sapiens
ggagtgactcacagctgggaca

SEQ ID NO: 38256 - DNA, 22 bp, Homo sapiens
tgagatgaataactcctgctaa

SEQ ID NO: 38257 - DNA, 22 bp, Homo sapiens
atggctgcctgggcgctggccg

SEQ ID NO: 38258 - DNA, 22 bp, Homo sapiens
tttaatgtagcgtgaaatgatt

SEQ ID NO: 38259 - DNA, 19 bp, Homo sapiens
gccgggcccgggttggccg

SEQ ID NO: 38260 - DNA, 22 bp, Homo sapiens
ttgtcttttgtgggaaatatgg

SEQ ID NO: 38261 - DNA, 22 bp, Homo sapiens
aggatgtggatggagtatttat

SEQ ID NO: 38262 - DNA, 22 bp, Homo sapiens
gtgggccactgggaggcaaggg

SEQ ID NO: 38263 - DNA, 22 bp, Homo sapiens
ctcccagccttcgccagtctga

SEQ ID NO: 38264 - DNA, 22 bp, Homo sapiens
tcacccaggctggagtgcagtg

SEQ ID NO: 38265 - DNA, 22 bp, Homo sapiens
ttgtgaatagtgccgctataaa

SEQ ID NO: 38266 - DNA, 22 bp, Homo sapiens
actgggcctgattgggtcggag

SEQ ID NO: 38267 - DNA, 22 bp, Homo sapiens
tgagaaattacttcagtgatgg

SEQ ID NO: 38268 - DNA, 19 bp, Homo sapiens
acccagcccaggagtggca

SEQ ID NO: 38269 - DNA, 22 bp, Homo sapiens
ccatcacagtccccatcgtgat

SEQ ID NO: 38270 - DNA, 22 bp, Homo sapiens
agagtactgcctcagttatgaa

SEQ ID NO: 38271 - DNA, 20 bp, Homo sapiens
aaattactgccacacatttc

SEQ ID NO: 38272 - DNA, 21 bp, Homo sapiens
gcccacagtgaggaggatccc

SEQ ID NO: 38273 - DNA, 22 bp, Homo sapiens
aggggcacgagtagagctctag

SEQ ID NO: 38274 - DNA, 22 bp, Homo sapiens
tgagcaggcgcagcaggaggtc

SEQ ID NO: 38275 - DNA, 22 bp, Homo sapiens
cgggcagtgtggctccagagtc

SEQ ID NO: 38276 - DNA, 22 bp, Homo sapiens
ataatacatggttgatcttttc

SEQ ID NO: 38277 - DNA, 22 bp, Homo sapiens
gctggggaggcagcagagaaca

SEQ ID NO: 38278 - DNA, 22 bp, Homo sapiens
caccgcggagtgatggagaaac

SEQ ID NO: 38279 - DNA, 22 bp, Homo sapiens
gctgctaagcgtttctgttcca

SEQ ID NO: 38280 - DNA, 22 bp, Homo sapiens
ccttgctcaagctagtgacggg

SEQ ID NO: 38281 - DNA, 22 bp, Homo sapiens
cagtctctaaatcaatctgaat

SEQ ID NO: 38282 - DNA, 22 bp, Homo sapiens
tgcgcctgtaagtccagagtcc

SEQ ID NO: 38283 - DNA, 22 bp, Homo sapiens
tgagcacatgccagcccttctc

SEQ ID NO: 38284 - DNA, 22 bp, Homo sapiens
tgcccaggctggagtacagtgg

SEQ ID NO: 38285 - DNA, 22 bp, Homo sapiens
atctggttcttcttaggcatca

SEQ ID NO: 38286 - DNA, 22 bp, Homo sapiens
tgccaggcgtggtggtgcgcac

SEQ ID NO: 38287 - DNA, 22 bp, Homo sapiens
ttaatgaaaggcagtttggaac

SEQ ID NO: 38288 - DNA, 22 bp, Homo sapiens
caagcgtggctgctctgatgga

SEQ ID NO: 38289 - DNA, 22 bp, Homo sapiens
catataaatacaacatgtgtta

SEQ ID NO: 38290 - DNA, 22 bp, Homo sapiens
acacagagccaaaccatatcac

SEQ ID NO: 38291 - DNA, 22 bp, Homo sapiens
gagcatcgctgagatcccagac

SEQ ID NO: 38292 - DNA, 22 bp, Homo sapiens
gggactggagtagaggccggtg

SEQ ID NO: 38293 - DNA, 22 bp, Homo sapiens
caaatactacgattcttgcagt

SEQ ID NO: 38294 - DNA, 22 bp, Homo sapiens
agcagctttcacctccccgcct

SEQ ID NO: 38295 - DNA, 23 bp, Homo sapiens
cagagctggctcagagctgcctg

SEQ ID NO: 38296 - DNA, 22 bp, Homo sapiens
ggaggctgaggcaggcggatca

SEQ ID NO: 38297 - DNA, 22 bp, Homo sapiens
ctcctctttagccccagctgga

SEQ ID NO: 38298 - DNA, 22 bp, Homo sapiens
ggtgaggggctcctctgcccgg

SEQ ID NO: 38299 - DNA, 22 bp, Homo sapiens
taggctaggctgaaggttttgg

SEQ ID NO: 38300 - DNA, 22 bp, Homo sapiens
gggaggctctgctcagcccccg

SEQ ID NO: 38301 - DNA, 22 bp, Homo sapiens
tcatcagggatattggcctgaa

SEQ ID NO: 38302 - DNA, 22 bp, Homo sapiens
ttcattttctttcacgctgctg

SEQ ID NO: 38303 - DNA, 22 bp, Homo sapiens
cagcaggaggtgagtagcaggt

SEQ ID NO: 38304 - DNA, 22 bp, Homo sapiens
cctgggcctctcaaagtgctgg

SEQ ID NO: 38305 - DNA, 22 bp, Homo sapiens
ctacaaaagtaattgtggtttt

SEQ ID NO: 38306 - DNA, 22 bp, Homo sapiens
atgttggagtcgtaaggcatgg

SEQ ID NO: 38307 - DNA, 22 bp, Homo sapiens
gcagaggacacaggagggcaag

SEQ ID NO: 38308 - DNA, 22 bp, Homo sapiens
gtgggggcaggcagtgctagga

SEQ ID NO: 38309 - DNA, 22 bp, Homo sapiens
agcaacctcatgagagtgaaat

SEQ ID NO: 38310 - DNA, 22 bp, Homo sapiens
ggtgggagccaacacccttctg

SEQ ID NO: 38311 - DNA, 22 bp, Homo sapiens
ctttttcactgtgtcctcacac

SEQ ID NO: 38312 - DNA, 22 bp, Homo sapiens
tgtaagtagtaatggaaggaca

SEQ ID NO: 38313 - DNA, 22 bp, Homo sapiens
gaggtgtcatcaggcagctctg

SEQ ID NO: 38314 - DNA, 22 bp, Homo sapiens
ttatttttaaaagttcacacag

SEQ ID NO: 38315 - DNA, 22 bp, Homo sapiens
gcctccccaagcagcagggatt

SEQ ID NO: 38316 - DNA, 22 bp, Homo sapiens
cccagctcttcaagtcaccccc

SEQ ID NO: 38317 - DNA, 22 bp, Homo sapiens
tgcttttagctagtaactagta

SEQ ID NO: 38318 - DNA, 22 bp, Homo sapiens
cggctgggttcggctgcaggcc

SEQ ID NO: 38319 - DNA, 20 bp, Homo sapiens
cctgtcatcccagcattttg

SEQ ID NO: 38320 - DNA, 22 bp, Homo sapiens
ggtggcagtagcactgggcctg

SEQ ID NO: 38321 - DNA, 22 bp, Homo sapiens
atgttgtgtttgactgttaccc

SEQ ID NO: 38322 - DNA, 22 bp, Homo sapiens
atgccactgcacttcagcctgg

SEQ ID NO: 38323 - DNA, 22 bp, Homo sapiens
gaagcctcaacatctctgcgtc

SEQ ID NO: 38324 - DNA, 22 bp, Homo sapiens
catcaggcagaggaaaggactg

SEQ ID NO: 38325 - DNA, 22 bp, Homo sapiens
cagccagtgtgaccgaggagga

SEQ ID NO: 38326 - DNA, 22 bp, Homo sapiens
caggtgtcggtcaggcggtttt

SEQ ID NO: 38327 - DNA, 22 bp, Homo sapiens
cactgcactccagcctgggtca

SEQ ID NO: 38328 - DNA, 22 bp, Homo sapiens
cccaggaggcagagcttgcagt

SEQ ID NO: 38329 - DNA, 22 bp, Homo sapiens
ttatttaatgtgatctgaagag

SEQ ID NO: 38330 - DNA, 22 bp, Homo sapiens
gccggggctggggagagacatg

SEQ ID NO: 38331 - DNA, 22 bp, Homo sapiens
gacagacacaattgatccatga

SEQ ID NO: 38332 - DNA, 22 bp, Homo sapiens
ccaggctagaaactgaggcaca

SEQ ID NO: 38333 - DNA, 22 bp, Homo sapiens
aggtattattagcatctctatt

SEQ ID NO: 38334 - DNA, 22 bp, Homo sapiens
tctgctctgtggcttcagctaa

SEQ ID NO: 38335 - DNA, 22 bp, Homo sapiens
agcgctgtgggcgtgcgaggag

SEQ ID NO: 38336 - DNA, 22 bp, Homo sapiens
aatggctctgatgttgttgtga

SEQ ID NO: 38337 - DNA, 22 bp, Homo sapiens
tccaggctttggggcaggagcg

SEQ ID NO: 38338 - DNA, 22 bp, Homo sapiens
tgaaatcttcactaagtctctt

SEQ ID NO: 38339 - DNA, 20 bp, Homo sapiens
agcggctggcggaggacacg

SEQ ID NO: 38340 - DNA, 22 bp, Homo sapiens
gttccaggtggtcacagagctc

SEQ ID NO: 38341 - DNA, 22 bp, Homo sapiens
attggtggtgaggacatgccag

SEQ ID NO: 38342 - DNA, 22 bp, Homo sapiens
ctggctggagtgcaggtgagtg

SEQ ID NO: 38343 - DNA, 22 bp, Homo sapiens
tgtagatattaattattccttt

SEQ ID NO: 38344 - DNA, 19 bp, Homo sapiens
agccagccagcaggtatgc

SEQ ID NO: 38345 - DNA, 22 bp, Homo sapiens
gctgtggcctggcgcagagctg

SEQ ID NO: 38346 - DNA, 18 bp, Homo sapiens
tcactgtgtgtcttgggt

SEQ ID NO: 38347 - DNA, 22 bp, Homo sapiens
atacagggacatccagtttttc

SEQ ID NO: 38348 - DNA, 22 bp, Homo sapiens
gccagccagaaacgtcacactg

SEQ ID NO: 38349 - DNA, 18 bp, Homo sapiens
ccatcaccctaactagtg

SEQ ID NO: 38350 - DNA, 22 bp, Homo sapiens
gtgggccagcttttctcctggg

SEQ ID NO: 38351 - DNA, 22 bp, Homo sapiens
tggagaattctatgttgagggg

SEQ ID NO: 38352 - DNA, 22 bp, Homo sapiens
gagccaggttggaggctgcagt

SEQ ID NO: 38353 - DNA, 22 bp, Homo sapiens
ctggaggccactgtacagattg

SEQ ID NO: 38354 - DNA, 22 bp, Homo sapiens
aactcaaagatgcatgacgctt

SEQ ID NO: 38355 - DNA, 22 bp, Homo sapiens
agcccaggtccagttcactgca

SEQ ID NO: 38356 - DNA, 22 bp, Homo sapiens
aggtggcagatgggggtgctcg

SEQ ID NO: 38357 - DNA, 22 bp, Homo sapiens
gctggcagacttcctctggaac

SEQ ID NO: 38358 - DNA, 22 bp, Homo sapiens
acatttttcacatttgtagggt

SEQ ID NO: 38359 - DNA, 22 bp, Homo sapiens
atgccaggaacaaacagtggtg

SEQ ID NO: 38360 - DNA, 22 bp, Homo sapiens
cccaggagttggaggctgcagt

SEQ ID NO: 38361 - DNA, 22 bp, Homo sapiens
tgagacgaagtcttgctctgtt

SEQ ID NO: 38362 - DNA, 22 bp, Homo sapiens
tgcctcagctgaggccgctcca

SEQ ID NO: 38363 - DNA, 22 bp, Homo sapiens
tcagtgccatgggcagacaggc

SEQ ID NO: 38364 - DNA, 22 bp, Homo sapiens
gcatggcttcggggtgctgcct

SEQ ID NO: 38365 - DNA, 22 bp, Homo sapiens
atggcaccttccccagagctca

SEQ ID NO: 38366 - DNA, 21 bp, Homo sapiens
tagcccttctccacctcgccc

SEQ ID NO: 38367 - DNA, 22 bp, Homo sapiens
ccctggaggttgaggctgcagt

SEQ ID NO: 38368 - DNA, 22 bp, Homo sapiens
tgccacagacaggacagaacag

SEQ ID NO: 38369 - DNA, 22 bp, Homo sapiens
cgtaggtggctcagcacctggg

SEQ ID NO: 38370 - DNA, 22 bp, Homo sapiens
cacagctgaagtagccatgtgg

SEQ ID NO: 38371 - DNA, 22 bp, Homo sapiens
gagcccaggaagtggaggctga

SEQ ID NO: 38372 - DNA, 22 bp, Homo sapiens
actgccaatggtagtttgatgg

SEQ ID NO: 38373 - DNA, 22 bp, Homo sapiens
gttcaagaccagcctggccaac

SEQ ID NO: 38374 - DNA, 23 bp, Homo sapiens
aggatgtaggatgtatggcagag

SEQ ID NO: 38375 - DNA, 22 bp, Homo sapiens
cccaggaggtggagcttgcagt

SEQ ID NO: 38376 - DNA, 22 bp, Homo sapiens
actgcacttcagcctgggtgtc

SEQ ID NO: 38377 - DNA, 22 bp, Homo sapiens
cagtggaggccttgggaccttt

SEQ ID NO: 38378 - DNA, 22 bp, Homo sapiens
taccagggaacagggatattaa

SEQ ID NO: 38379 - DNA, 22 bp, Homo sapiens
tgggaggccaaggcaggcggat

SEQ ID NO: 38380 - DNA, 22 bp, Homo sapiens
acggggctagagaaggtttctt

SEQ ID NO: 38381 - DNA, 22 bp, Homo sapiens
cactgcactccagcccgggcaa

SEQ ID NO: 38382 - DNA, 22 bp, Homo sapiens
ggctgggcctctccctcagctg

SEQ ID NO: 38383 - DNA, 23 bp, Homo sapiens
ggggcctgcaccggtctgcgcgg

SEQ ID NO: 38384 - DNA, 22 bp, Homo sapiens
tagactagaggatcagcaaggg

SEQ ID NO: 38385 - DNA, 22 bp, Homo sapiens
tgattcatcagaataggagttt

SEQ ID NO: 38386 - DNA, 22 bp, Homo sapiens
tccagctgaggtggcctctgtg

SEQ ID NO: 38387 - DNA, 22 bp, Homo sapiens
ccaggggggcgtagatgctggg

SEQ ID NO: 38388 - DNA, 22 bp, Homo sapiens
gtggcttggaccagtcacagtg

SEQ ID NO: 38389 - DNA, 22 bp, Homo sapiens
aggccctattcaatggggccca

SEQ ID NO: 38390 - DNA, 22 bp, Homo sapiens
ttgagcaatgtcactgaggctt

SEQ ID NO: 38391 - DNA, 22 bp, Homo sapiens
cacatgaaggctggggtcgtga

SEQ ID NO: 38392 - DNA, 21 bp, Homo sapiens
gctgctcgagatccagtgctt

SEQ ID NO: 38393 - DNA, 22 bp, Homo sapiens
gataccagacagggagggagaa

SEQ ID NO: 38394 - DNA, 22 bp, Homo sapiens
gcaggtggatcacctgaggtca

SEQ ID NO: 38395 - DNA, 22 bp, Homo sapiens
agcataagttggtacagccact

SEQ ID NO: 38396 - DNA, 22 bp, Homo sapiens
attcacctttccccaaaatgag

SEQ ID NO: 38397 - DNA, 22 bp, Homo sapiens
gccatgggcaaatgcagagctg

SEQ ID NO: 38398 - DNA, 22 bp, Homo sapiens
cctggaggcggaggttgcagtg

SEQ ID NO: 38399 - DNA, 22 bp, Homo sapiens
tttcttctatgtgtgatatttt

SEQ ID NO: 38400 - DNA, 21 bp, Homo sapiens
cactccacttagaacagggtt

SEQ ID NO: 38401 - DNA, 20 bp, Homo sapiens
gggcagagccagccagtccc

SEQ ID NO: 38402 - DNA, 22 bp, Homo sapiens
actcatgtcctaggagtaaagc

SEQ ID NO: 38403 - DNA, 22 bp, Homo sapiens
cctgacaggcggaggctgcagt

SEQ ID NO: 38404 - DNA, 22 bp, Homo sapiens
cctggggtcacttgcagccgca

SEQ ID NO: 38405 - DNA, 22 bp, Homo sapiens
ccagctttatagcttcaaagga

SEQ ID NO: 38406 - DNA, 22 bp, Homo sapiens
atgattgaaaatgacattgcca

SEQ ID NO: 38407 - DNA, 21 bp, Homo sapiens
agtggctctcagcttgctaag

SEQ ID NO: 38408 - DNA, 22 bp, Homo sapiens
gggtacagttcttccagtgtca

SEQ ID NO: 38409 - DNA, 22 bp, Homo sapiens
tccaagatctacagcagtttag

SEQ ID NO: 38410 - DNA, 22 bp, Homo sapiens
ggctgggctccgggagcatgcg

SEQ ID NO: 38411 - DNA, 22 bp, Homo sapiens
cagcagcattgctctggattcc

SEQ ID NO: 38412 - DNA, 22 bp, Homo sapiens
gatatcattgagcccaggagtt

SEQ ID NO: 38413 - DNA, 22 bp, Homo sapiens
ttcttttaattgtgggggagtg

SEQ ID NO: 38414 - DNA, 22 bp, Homo sapiens
aatattatacagtcaacctctt

SEQ ID NO: 38415 - DNA, 22 bp, Homo sapiens
gcttggccagcagccgggatgc

SEQ ID NO: 38416 - DNA, 19 bp, Homo sapiens
ggggcctgtgatggtcaca

SEQ ID NO: 38417 - DNA, 22 bp, Homo sapiens
tttaagaagttatgttataaat

SEQ ID NO: 38418 - DNA, 22 bp, Homo sapiens
cgctgataaacgtcacgttccc

SEQ ID NO: 38419 - DNA, 22 bp, Homo sapiens
gtgagatggagttggtgtcttt

SEQ ID NO: 38420 - DNA, 22 bp, Homo sapiens
agcccaggagtttgaggctgtg

SEQ ID NO: 38421 - DNA, 22 bp, Homo sapiens
agcaggcctgccacctcggggt

SEQ ID NO: 38422 - DNA, 22 bp, Homo sapiens
tgtcctcatcctccagtctgtc

SEQ ID NO: 38423 - DNA, 22 bp, Homo sapiens
ggagagggtaggggtcctgccc

SEQ ID NO: 38424 - DNA, 22 bp, Homo sapiens
tcactgcaacctccacctcctg

SEQ ID NO: 38425 - DNA, 22 bp, Homo sapiens
caggctggagtgcagtggggcg

SEQ ID NO: 38426 - DNA, 22 bp, Homo sapiens
gcagactgtatcaatgtcagta

SEQ ID NO: 38427 - DNA, 22 bp, Homo sapiens
acagcccagctctttctctgca

SEQ ID NO: 38428 - DNA, 22 bp, Homo sapiens
agtgctgtctccttcccccggg

SEQ ID NO: 38429 - DNA, 22 bp, Homo sapiens
tgctcgccccacatgccctcat

SEQ ID NO: 38430 - DNA, 22 bp, Homo sapiens
agtgaatgtccccgcgggtcag

SEQ ID NO: 38431 - DNA, 22 bp, Homo sapiens
cctgtgcttggccagagaggtt

SEQ ID NO: 38432 - DNA, 22 bp, Homo sapiens
aaccaggtgactcatggtgagc

SEQ ID NO: 38433 - DNA, 22 bp, Homo sapiens
ggtgggagagctctgtctccag

SEQ ID NO: 38434 - DNA, 22 bp, Homo sapiens
tgctcttcacagtttcagcatc

SEQ ID NO: 38435 - DNA, 22 bp, Homo sapiens
gagctgggcctgcgagtgctgc

SEQ ID NO: 38436 - DNA, 22 bp, Homo sapiens
taatgtataacaaatactcatc

SEQ ID NO: 38437 - DNA, 22 bp, Homo sapiens
taatgtaaacacagagacagaa

SEQ ID NO: 38438 - DNA, 22 bp, Homo sapiens
acaggggcaagggctcacggcc

SEQ ID NO: 38439 - DNA, 22 bp, Homo sapiens
catgtgtcttgctgccctccat

SEQ ID NO: 38440 - DNA, 22 bp, Homo sapiens
gagcactgatttatttttgtct

SEQ ID NO: 38441 - DNA, 22 bp, Homo sapiens
aagaagcattctttcattggtt

SEQ ID NO: 38442 - DNA, 21 bp, Homo sapiens
gctcctggtgctgcgtggcgc

SEQ ID NO: 38443 - DNA, 22 bp, Homo sapiens
aaatgcaacgggctttccttat

SEQ ID NO: 38444 - DNA, 22 bp, Homo sapiens
caggcaggtcagtgaagaagga

SEQ ID NO: 38445 - DNA, 20 bp, Homo sapiens
aactcctagcctcaagtgat

SEQ ID NO: 38446 - DNA, 22 bp, Homo sapiens
ctgagcagatgaccagccccag

SEQ ID NO: 38447 - DNA, 22 bp, Homo sapiens
atggggctgttctctgccctgc

SEQ ID NO: 38448 - DNA, 22 bp, Homo sapiens
gcggggggaggaacatcttgca

SEQ ID NO: 38449 - DNA, 22 bp, Homo sapiens
agccagggacgctgcaggctac

SEQ ID NO: 38450 - DNA, 22 bp, Homo sapiens
cgagcatgatgacggctgtggc

SEQ ID NO: 38451 - DNA, 22 bp, Homo sapiens
cactgcacttcagcctgggtga

SEQ ID NO: 38452 - DNA, 22 bp, Homo sapiens
gggaggcagtgctggaggctgg

SEQ ID NO: 38453 - DNA, 22 bp, Homo sapiens
ggacaagcctgtgagtgggttt

SEQ ID NO: 38454 - DNA, 22 bp, Homo sapiens
actgattgcattcatagggttt

SEQ ID NO: 38455 - DNA, 22 bp, Homo sapiens
gcctggagaaaggaaggtggga

SEQ ID NO: 38456 - DNA, 22 bp, Homo sapiens
aagtgatgctacgactttgaca

SEQ ID NO: 38457 - DNA, 22 bp, Homo sapiens
tttagcgtagctgacagctaat

SEQ ID NO: 38458 - DNA, 22 bp, Homo sapiens
aggccaggaatccttgtcccag

SEQ ID NO: 38459 - DNA, 22 bp, Homo sapiens
agcctgggcaacagagcaaaac

SEQ ID NO: 38460 - DNA, 22 bp, Homo sapiens
gggctgggattgcttgctgtga

SEQ ID NO: 38461 - DNA, 22 bp, Homo sapiens
gacaggtgctaagggacctggc

SEQ ID NO: 38462 - DNA, 23 bp, Homo sapiens
atgggccaagcaagacccatgac

SEQ ID NO: 38463 - DNA, 22 bp, Homo sapiens
taaagggtaggttttactgtaa

SEQ ID NO: 38464 - DNA, 22 bp, Homo sapiens
gggtaaatctcttttcatggct

SEQ ID NO: 38465 - DNA, 22 bp, Homo sapiens
tcccacacagcccgctcaccgg

SEQ ID NO: 38466 - DNA, 22 bp, Homo sapiens
cacggtggcccacaggtgcaag

SEQ ID NO: 38467 - DNA, 22 bp, Homo sapiens
tggcacagactgggccaaggaa

SEQ ID NO: 38468 - DNA, 22 bp, Homo sapiens
aagaagcaggtcacagacaggg

SEQ ID NO: 38469 - DNA, 22 bp, Homo sapiens
cggaggttgaggctgcagtgag

SEQ ID NO: 38470 - DNA, 22 bp, Homo sapiens
cctcgcggcactcgggccggat

SEQ ID NO: 38471 - DNA, 22 bp, Homo sapiens
gagacgtggcctttgcctgagc

SEQ ID NO: 38472 - DNA, 22 bp, Homo sapiens
tgaacatgctgttgatggcctg

SEQ ID NO: 38473 - DNA, 22 bp, Homo sapiens
cccaggccctggcagagcttgt

SEQ ID NO: 38474 - DNA, 22 bp, Homo sapiens
acccaggccattggcaagagtc

SEQ ID NO: 38475 - DNA, 22 bp, Homo sapiens
caattcccagctgccgggctgc

SEQ ID NO: 38476 - DNA, 22 bp, Homo sapiens
ctgcagggagaggggacagcct

SEQ ID NO: 38477 - DNA, 22 bp, Homo sapiens
tgctcattggcgatctgaggga

SEQ ID NO: 38478 - DNA, 22 bp, Homo sapiens
gaagccttgaactgcaaacccc

SEQ ID NO: 38479 - DNA, 22 bp, Homo sapiens
gctaggagtggtgggtcaagga

SEQ ID NO: 38480 - DNA, 22 bp, Homo sapiens
ctggcaagaaatatatatctta

SEQ ID NO: 38481 - DNA, 22 bp, Homo sapiens
aattgcaaattcagacttaaga

SEQ ID NO: 38482 - DNA, 22 bp, Homo sapiens
atatgggggggcgtgcagagga

SEQ ID NO: 38483 - DNA, 22 bp, Homo sapiens
ggcaggactgatcagtgggatg

SEQ ID NO: 38484 - DNA, 22 bp, Homo sapiens
ggcatggacgtctctgaggcca

SEQ ID NO: 38485 - DNA, 22 bp, Homo sapiens
acagattcactgcactggccat

SEQ ID NO: 38486 - DNA, 22 bp, Homo sapiens
gcaggatgagtgagtacattta

SEQ ID NO: 38487 - DNA, 23 bp, Homo sapiens
ctcctggtgctgctatcaggggt

SEQ ID NO: 38488 - DNA, 22 bp, Homo sapiens
ttatttaaaagtggtaagattc

SEQ ID NO: 38489 - DNA, 22 bp, Homo sapiens
gaggtggctgcttgctgggaaa

SEQ ID NO: 38490 - DNA, 22 bp, Homo sapiens
ttcctttctctggactgcagcc

SEQ ID NO: 38491 - DNA, 22 bp, Homo sapiens
tagatttgtttccttctctcca

SEQ ID NO: 38492 - DNA, 22 bp, Homo sapiens
gcagcctgggcaacagagtgag

SEQ ID NO: 38493 - DNA, 22 bp, Homo sapiens
tagcataacaggtaagagtgag

SEQ ID NO: 38494 - DNA, 22 bp, Homo sapiens
gggaacagcttgggctctgcca

SEQ ID NO: 38495 - DNA, 22 bp, Homo sapiens
cgcaccactgaattccagcctg

SEQ ID NO: 38496 - DNA, 22 bp, Homo sapiens
aagtggcagttcaggaagcaga

SEQ ID NO: 38497 - DNA, 22 bp, Homo sapiens
ctgggaggtggaggttgcattg

SEQ ID NO: 38498 - DNA, 22 bp, Homo sapiens
ttgtgaatggtgccgcaataaa

SEQ ID NO: 38499 - DNA, 22 bp, Homo sapiens
acctggaggcagaggttgcagt

SEQ ID NO: 38500 - DNA, 22 bp, Homo sapiens
ggaggtgggctaaggactctct

SEQ ID NO: 38501 - DNA, 22 bp, Homo sapiens
gttctgggagatcttgagcttc

SEQ ID NO: 38502 - DNA, 18 bp, Homo sapiens
cagctgccagctcatgga

SEQ ID NO: 38503 - DNA, 22 bp, Homo sapiens
ttgccgccgtctgctcgccccg

SEQ ID NO: 38504 - DNA, 22 bp, Homo sapiens
ctgccgttgtgaagctcttaga

SEQ ID NO: 38505 - DNA, 22 bp, Homo sapiens
tgggccacacacagaagaatca

SEQ ID NO: 38506 - DNA, 22 bp, Homo sapiens
gcagggaggtttgctgacctgg

SEQ ID NO: 38507 - DNA, 22 bp, Homo sapiens
gtagcccacctggggagggcga

SEQ ID NO: 38508 - DNA, 22 bp, Homo sapiens
attggccatttgcatgtattat

SEQ ID NO: 38509 - DNA, 22 bp, Homo sapiens
ggctcagatggtttgttctaga

SEQ ID NO: 38510 - DNA, 22 bp, Homo sapiens
cgcaggtgaaagaggctgggca

SEQ ID NO: 38511 - DNA, 22 bp, Homo sapiens
gtatagaaacccagaaagatag

SEQ ID NO: 38512 - DNA, 22 bp, Homo sapiens
cctgggaggctgaggctgcagt

SEQ ID NO: 38513 - DNA, 22 bp, Homo sapiens
ggagaggcttccagagtcgtgc

SEQ ID NO: 38514 - DNA, 22 bp, Homo sapiens
ctgggcacagcgttgggctctt

SEQ ID NO: 38515 - DNA, 22 bp, Homo sapiens
aggagctgtcagagtgccagag

SEQ ID NO: 38516 - DNA, 22 bp, Homo sapiens
tgggcaaggctggagcctgcag

SEQ ID NO: 38517 - DNA, 22 bp, Homo sapiens
agcagcagtatccttccccggc

SEQ ID NO: 38518 - DNA, 22 bp, Homo sapiens
tgggcttggtttctaggtaggt

SEQ ID NO: 38519 - DNA, 23 bp, Homo sapiens
aggtaggttattgctgctacctg

SEQ ID NO: 38520 - DNA, 22 bp, Homo sapiens
ccaggctggagtgcaatggcat

SEQ ID NO: 38521 - DNA, 22 bp, Homo sapiens
gctcttgtcaaaaattagttga

SEQ ID NO: 38522 - DNA, 22 bp, Homo sapiens
cccaggccccagggcttgtcag

SEQ ID NO: 38523 - DNA, 22 bp, Homo sapiens
ggcaaggggtcaggctgagaca

SEQ ID NO: 38524 - DNA, 22 bp, Homo sapiens
ctggccagatgttacgtccaat

SEQ ID NO: 38525 - DNA, 22 bp, Homo sapiens
tggtggggccagacttcagctc

SEQ ID NO: 38526 - DNA, 22 bp, Homo sapiens
atggcctgcagtgctgccacag

SEQ ID NO: 38527 - DNA, 22 bp, Homo sapiens
ttggaacatgccggggtccagg

SEQ ID NO: 38528 - DNA, 22 bp, Homo sapiens
tatttcttttcgtgacttattg

SEQ ID NO: 38529 - DNA, 22 bp, Homo sapiens
aagcctggcacattggagtctg

SEQ ID NO: 38530 - DNA, 22 bp, Homo sapiens
gggacaatggaggcctctctcc

SEQ ID NO: 38531 - DNA, 22 bp, Homo sapiens
aaacttttttaggttcataggc

SEQ ID NO: 38532 - DNA, 22 bp, Homo sapiens
cagcagcccacgcgtgctgtcc

SEQ ID NO: 38533 - DNA, 19 bp, Homo sapiens
gcagacaggtccagagagg

SEQ ID NO: 38534 - DNA, 23 bp, Homo sapiens
aggcgagctcttctccagcacgt

SEQ ID NO: 38535 - DNA, 22 bp, Homo sapiens
ccactgtgcccagcctcatggg

SEQ ID NO: 38536 - DNA, 19 bp, Homo sapiens
gctgaaggaggtgcctgca

SEQ ID NO: 38537 - DNA, 22 bp, Homo sapiens
ggaggggatttagtagatgcta

SEQ ID NO: 38538 - DNA, 22 bp, Homo sapiens
tcattacaagatttccaatttg

SEQ ID NO: 38539 - DNA, 22 bp, Homo sapiens
ttgtgaatagtgccgcaataaa

SEQ ID NO: 38540 - DNA, 21 bp, Homo sapiens
gggcctggctgcgcaggacgg

SEQ ID NO: 38541 - DNA, 22 bp, Homo sapiens
tggaatgcagtgggagcttacc

SEQ ID NO: 38542 - DNA, 22 bp, Homo sapiens
actttatttcctattgcatcca

SEQ ID NO: 38543 - DNA, 22 bp, Homo sapiens
acagttagttgaggagtgtttg

SEQ ID NO: 38544 - DNA, 22 bp, Homo sapiens
atacttctttagcatattgaac

SEQ ID NO: 38545 - DNA, 17 bp, Homo sapiens
tggctctgtcctcagct

SEQ ID NO: 38546 - DNA, 17 bp, Homo sapiens
gggcagggactcctggg

SEQ ID NO: 38547 - DNA, 22 bp, Homo sapiens
gaggcctgggcaagggggtctg

SEQ ID NO: 38548 - DNA, 22 bp, Homo sapiens
cccacgtcgaacttgctccaga

SEQ ID NO: 38549 - DNA, 22 bp, Homo sapiens
ggctgtggcagctggaagtggt

SEQ ID NO: 38550 - DNA, 22 bp, Homo sapiens
ctgctcttcacactacacccgt

SEQ ID NO: 38551 - DNA, 20 bp, Homo sapiens
ggcagagggcctgggagaag

SEQ ID NO: 38552 - DNA, 22 bp, Homo sapiens
gcaggcagatcacctgtcagga

SEQ ID NO: 38553 - DNA, 22 bp, Homo sapiens
atgccactgcactccagcctgg

SEQ ID NO: 38554 - DNA, 22 bp, Homo sapiens
tgtgggagaaggaagcaagctg

SEQ ID NO: 38555 - DNA, 22 bp, Homo sapiens
cccaggaggtcaaggctgcagt

SEQ ID NO: 38556 - DNA, 22 bp, Homo sapiens
aggactgggtgcagagggcatc

SEQ ID NO: 38557 - DNA, 22 bp, Homo sapiens
ttcttctttccaattacatggt

SEQ ID NO: 38558 - DNA, 22 bp, Homo sapiens
tctgctggaaaaccagggaatt

SEQ ID NO: 38559 - DNA, 19 bp, Homo sapiens
caggcctcttaccctctct

SEQ ID NO: 38560 - DNA, 22 bp, Homo sapiens
tgcaggcctggactgatgtggt

SEQ ID NO: 38561 - DNA, 22 bp, Homo sapiens
ggtgccagatgaggcccgcgat

SEQ ID NO: 38562 - DNA, 22 bp, Homo sapiens
atcttcccaggctggggagagg

SEQ ID NO: 38563 - DNA, 22 bp, Homo sapiens
tgagcccagagatctgagctat

SEQ ID NO: 38564 - DNA, 22 bp, Homo sapiens
gtgctggggagataggaagaga

SEQ ID NO: 38565 - DNA, 22 bp, Homo sapiens
ttgcaattgctatggagagcgt

SEQ ID NO: 38566 - DNA, 21 bp, Homo sapiens
agctgcctccacttctgaggc

SEQ ID NO: 38567 - DNA, 22 bp, Homo sapiens
tgggggtgtcctggtgcacaca

SEQ ID NO: 38568 - DNA, 18 bp, Homo sapiens
gaaagatgaacttttttc

SEQ ID NO: 38569 - DNA, 22 bp, Homo sapiens
tccagggccatctccatgaggc

SEQ ID NO: 38570 - DNA, 22 bp, Homo sapiens
tatggctaattctttactgacc

SEQ ID NO: 38571 - DNA, 22 bp, Homo sapiens
caggctgatcagggctgggatg

SEQ ID NO: 38572 - DNA, 22 bp, Homo sapiens
tcatctaagagtcttacattta

SEQ ID NO: 38573 - DNA, 22 bp, Homo sapiens
gcccaggctggagttcagtggt

SEQ ID NO: 38574 - DNA, 22 bp, Homo sapiens
gcagcctcaaactccccagctc

SEQ ID NO: 38575 - DNA, 22 bp, Homo sapiens
ccaggctggagtgcaatggcgt

SEQ ID NO: 38576 - DNA, 22 bp, Homo sapiens
atgccacttcattccagcctcg

SEQ ID NO: 38577 - DNA, 22 bp, Homo sapiens
agcccaggctggagtgcagtgg

SEQ ID NO: 38578 - DNA, 22 bp, Homo sapiens
gaggcagaggttgcagtgagct

SEQ ID NO: 38579 - DNA, 22 bp, Homo sapiens
tttcagaacataatgtgagcat

SEQ ID NO: 38580 - DNA, 22 bp, Homo sapiens
cttttgattgagcagtttcaaa

SEQ ID NO: 38581 - DNA, 22 bp, Homo sapiens
agacaaagaaaccgtagaagca

SEQ ID NO: 38582 - DNA, 22 bp, Homo sapiens
gttttgaatactactagaactt

SEQ ID NO: 38583 - DNA, 22 bp, Homo sapiens
ctgggaggcggaggttgcagtg

SEQ ID NO: 38584 - DNA, 22 bp, Homo sapiens
gtgtgtcccttggaacctcagc

SEQ ID NO: 38585 - DNA, 22 bp, Homo sapiens
actgcactccagcctgggtaac

SEQ ID NO: 38586 - DNA, 22 bp, Homo sapiens
actgcactccaacctgggtgac

SEQ ID NO: 38587 - DNA, 22 bp, Homo sapiens
ggtgtagctctgtgtcccactg

SEQ ID NO: 38588 - DNA, 22 bp, Homo sapiens
tggctaaaccctagtaaattaa

SEQ ID NO: 38589 - DNA, 22 bp, Homo sapiens
tcacccaggctggactgcagtg

SEQ ID NO: 38590 - DNA, 22 bp, Homo sapiens
tctcctggtacccttcctagca

SEQ ID NO: 38591 - DNA, 22 bp, Homo sapiens
acccagccatgttcagttctct

SEQ ID NO: 38592 - DNA, 22 bp, Homo sapiens
actccacaccacgggggccgcc

SEQ ID NO: 38593 - DNA, 22 bp, Homo sapiens
gggctagcctcttccctgctcc

SEQ ID NO: 38594 - DNA, 22 bp, Homo sapiens
cccaggaggttgaggctgcagt

SEQ ID NO: 38595 - DNA, 22 bp, Homo sapiens
ttcccacattctttacattcat

SEQ ID NO: 38596 - DNA, 22 bp, Homo sapiens
agaaatatgctgattagatgaa

SEQ ID NO: 38597 - DNA, 22 bp, Homo sapiens
caaccccactacacgttggaga

SEQ ID NO: 38598 - DNA, 22 bp, Homo sapiens
gtgacaggccactgcggctctg

SEQ ID NO: 38599 - DNA, 22 bp, Homo sapiens
ggtgacctcacctggtcccacc

SEQ ID NO: 38600 - DNA, 22 bp, Homo sapiens
acattacctggcatttgatctt

SEQ ID NO: 38601 - DNA, 22 bp, Homo sapiens
ataccaccatctatgaaaggta

SEQ ID NO: 38602 - DNA, 22 bp, Homo sapiens
gttctgagtcctcctttgaagg

SEQ ID NO: 38603 - DNA, 22 bp, Homo sapiens
tttgtgaataggttggcttcca

SEQ ID NO: 38604 - DNA, 22 bp, Homo sapiens
ttctaggcctggcttgggccca

SEQ ID NO: 38605 - DNA, 22 bp, Homo sapiens
gcagccagagggggtgtgatca

SEQ ID NO: 38606 - DNA, 22 bp, Homo sapiens
agtgctgggctatctactgcta

SEQ ID NO: 38607 - DNA, 22 bp, Homo sapiens
tgtgtggattcatctcaaagag

SEQ ID NO: 38608 - DNA, 22 bp, Homo sapiens
tagattcagatatttaggacaa

SEQ ID NO: 38609 - DNA, 22 bp, Homo sapiens
tacataggtacagcctttttta

SEQ ID NO: 38610 - DNA, 22 bp, Homo sapiens
gaggcagaagttgcagtgagca

SEQ ID NO: 38611 - DNA, 22 bp, Homo sapiens
ctgggaggcagaggttgcagtg

SEQ ID NO: 38612 - DNA, 22 bp, Homo sapiens
tgacatgtatatcttacgctat

SEQ ID NO: 38613 - DNA, 22 bp, Homo sapiens
gggaagtgatggagccaggatt

SEQ ID NO: 38614 - DNA, 22 bp, Homo sapiens
cactgcactccagcctgggaga

SEQ ID NO: 38615 - DNA, 22 bp, Homo sapiens
ctgggtggcagagcctgcagtg

SEQ ID NO: 38616 - DNA, 22 bp, Homo sapiens
tggagccagcggcctgctgagg

SEQ ID NO: 38617 - DNA, 22 bp, Homo sapiens
catggggcccatgtgctccaag

SEQ ID NO: 38618 - DNA, 22 bp, Homo sapiens
ctgggggcagcaagaagccatg

SEQ ID NO: 38619 - DNA, 22 bp, Homo sapiens
gcagtggcatgatgtgggctca

SEQ ID NO: 38620 - DNA, 22 bp, Homo sapiens
tgtctggtgggttgacaggcag

SEQ ID NO: 38621 - DNA, 22 bp, Homo sapiens
cccacacacatttatgatagga

SEQ ID NO: 38622 - DNA, 20 bp, Homo sapiens
ttcgctgggagtggccaggc

SEQ ID NO: 38623 - DNA, 22 bp, Homo sapiens
gggcatttcttgtcaatgtagg

SEQ ID NO: 38624 - DNA, 22 bp, Homo sapiens
aggcaaggtgctacagacagtg

SEQ ID NO: 38625 - DNA, 22 bp, Homo sapiens
gcaggtggatcaccacgtcagg

SEQ ID NO: 38626 - DNA, 22 bp, Homo sapiens
cagggatggcgctggctgcccg

SEQ ID NO: 38627 - DNA, 22 bp, Homo sapiens
tccagcttataggtagatttaa

SEQ ID NO: 38628 - DNA, 22 bp, Homo sapiens
ggccctggtcctaggggtggaa

SEQ ID NO: 38629 - DNA, 22 bp, Homo sapiens
ctcaggagttggaggctacagt

SEQ ID NO: 38630 - DNA, 22 bp, Homo sapiens
gggcaccttgggtctcaggcaa

SEQ ID NO: 38631 - DNA, 21 bp, Homo sapiens
cgcagagcgaacttgcggcgc

SEQ ID NO: 38632 - DNA, 22 bp, Homo sapiens
tggcaccatcaaggctgagaac

SEQ ID NO: 38633 - DNA, 22 bp, Homo sapiens
ttccacattccttacattcata

SEQ ID NO: 38634 - DNA, 22 bp, Homo sapiens
cactgcactccatcctgggaaa

SEQ ID NO: 38635 - DNA, 22 bp, Homo sapiens
gagcagtgtttgtggacctgga

SEQ ID NO: 38636 - DNA, 22 bp, Homo sapiens
tgagcctgtcattattcagaga

SEQ ID NO: 38637 - DNA, 22 bp, Homo sapiens
gggagctgaaggagccggcggg

SEQ ID NO: 38638 - DNA, 22 bp, Homo sapiens
gggaggttgaggctgcagtgag

SEQ ID NO: 38639 - DNA, 22 bp, Homo sapiens
agcatggccatctgggccgtcc

SEQ ID NO: 38640 - DNA, 22 bp, Homo sapiens
gcaaaagtacagccggatttct

SEQ ID NO: 38641 - DNA, 22 bp, Homo sapiens
ttggaaacgtcaccttttcctt

SEQ ID NO: 38642 - DNA, 22 bp, Homo sapiens
ccctgctgtcaggtgctgggag

SEQ ID NO: 38643 - DNA, 22 bp, Homo sapiens
gagaggtggaggttgcagtgag

SEQ ID NO: 38644 - DNA, 22 bp, Homo sapiens
caggctggagtgcagtggcgcc

SEQ ID NO: 38645 - DNA, 22 bp, Homo sapiens
aaggaatttgaggctgcagtga

SEQ ID NO: 38646 - DNA, 22 bp, Homo sapiens
acaattctgatggtttcccagt

SEQ ID NO: 38647 - DNA, 22 bp, Homo sapiens
tgggaaggggagctggaaagga

SEQ ID NO: 38648 - DNA, 18 bp, Homo sapiens
gaggatggaaggagatgc

SEQ ID NO: 38649 - DNA, 22 bp, Homo sapiens
taattgtaaagtagtagtacag

SEQ ID NO: 38650 - DNA, 22 bp, Homo sapiens
attgattttcagactatgcgag

SEQ ID NO: 38651 - DNA, 22 bp, Homo sapiens
gttgcagatgtggaactcgtgc

SEQ ID NO: 38652 - DNA, 22 bp, Homo sapiens
actgcacttcaccctgggtgac

SEQ ID NO: 38653 - DNA, 22 bp, Homo sapiens
gagacctcttggtatcgctagg

SEQ ID NO: 38654 - DNA, 22 bp, Homo sapiens
ccaggaggttgaggctgcagtg

SEQ ID NO: 38655 - DNA, 22 bp, Homo sapiens
gggcaggggtcagtggccccaa

SEQ ID NO: 38656 - DNA, 22 bp, Homo sapiens
aaagtaattgtggttcttgcca

SEQ ID NO: 38657 - DNA, 22 bp, Homo sapiens
gttattgaggtggagtctcact

SEQ ID NO: 38658 - DNA, 22 bp, Homo sapiens
tgttatcctcagctcacctcta

SEQ ID NO: 38659 - DNA, 22 bp, Homo sapiens
agattctaccagagctagtttg

SEQ ID NO: 38660 - DNA, 22 bp, Homo sapiens
caggtgcctcaggatgagacaa

SEQ ID NO: 38661 - DNA, 22 bp, Homo sapiens
cactgcactccagcttgggtga

SEQ ID NO: 38662 - DNA, 22 bp, Homo sapiens
aggtggggaggagtgtctcttt

SEQ ID NO: 38663 - DNA, 22 bp, Homo sapiens
agcattccacactgaagtctgc

SEQ ID NO: 38664 - DNA, 22 bp, Homo sapiens
ggctcaggcctgtaatcctagc

SEQ ID NO: 38665 - DNA, 22 bp, Homo sapiens
ggccagcctggggctcccagac

SEQ ID NO: 38666 - DNA, 22 bp, Homo sapiens
gggaggcacgaggcgcgcagtg

SEQ ID NO: 38667 - DNA, 22 bp, Homo sapiens
gtaggtcagacataagaggaca

SEQ ID NO: 38668 - DNA, 22 bp, Homo sapiens
ctggagggtggagagaagtctc

SEQ ID NO: 38669 - DNA, 22 bp, Homo sapiens
tgcctccctggcaagtctctcc

SEQ ID NO: 38670 - DNA, 22 bp, Homo sapiens
ctctccattccctacagttttc

SEQ ID NO: 38671 - DNA, 22 bp, Homo sapiens
ggctgcaggttggttggcagct

SEQ ID NO: 38672 - DNA, 22 bp, Homo sapiens
ctgggaggcggagcttgcagtg

SEQ ID NO: 38673 - DNA, 22 bp, Homo sapiens
ctgctctgctgatcagtgtctc

SEQ ID NO: 38674 - DNA, 22 bp, Homo sapiens
ggcgccccatgatgagggctag

SEQ ID NO: 38675 - DNA, 22 bp, Homo sapiens
tccaccatgtaacaagctctgt

SEQ ID NO: 38676 - DNA, 22 bp, Homo sapiens
ggaaggggtgggtgagcctcag

SEQ ID NO: 38677 - DNA, 22 bp, Homo sapiens
ggcagagcttgcagtgagccga

SEQ ID NO: 38678 - DNA, 22 bp, Homo sapiens
tgagtggacacctgcttcttta

SEQ ID NO: 38679 - DNA, 22 bp, Homo sapiens
agcaacctgccagtcactcagt

SEQ ID NO: 38680 - DNA, 22 bp, Homo sapiens
cctgggccctcaccgccggtgg

SEQ ID NO: 38681 - DNA, 22 bp, Homo sapiens
ggtgggaggactgtttgaggca

SEQ ID NO: 38682 - DNA, 22 bp, Homo sapiens
gccaggcgggtctcaaactcct

SEQ ID NO: 38683 - DNA, 22 bp, Homo sapiens
caggaagaccagggctgtggct

SEQ ID NO: 38684 - DNA, 22 bp, Homo sapiens
tgttgattagtgtttagactta

SEQ ID NO: 38685 - DNA, 22 bp, Homo sapiens
actaggggctcaggcccaggga

SEQ ID NO: 38686 - DNA, 22 bp, Homo sapiens
gggagaggttacccgagcaact

SEQ ID NO: 38687 - DNA, 22 bp, Homo sapiens
gaacgggtgcagccatgggccc

SEQ ID NO: 38688 - DNA, 22 bp, Homo sapiens
ctctctgggcccagttggcacc

SEQ ID NO: 38689 - DNA, 22 bp, Homo sapiens
aggacagagggaccagagccca

SEQ ID NO: 38690 - DNA, 22 bp, Homo sapiens
agaggctgcacttgctcatgat

SEQ ID NO: 38691 - DNA, 22 bp, Homo sapiens
gcaggaggttgagccaggactg

SEQ ID NO: 38692 - DNA, 22 bp, Homo sapiens
agggccagcactcctggcagga

SEQ ID NO: 38693 - DNA, 23 bp, Homo sapiens
ctggggctttcaaatctgggcag

SEQ ID NO: 38694 - DNA, 22 bp, Homo sapiens
ggttccacctggcgaggggtat

SEQ ID NO: 38695 - DNA, 22 bp, Homo sapiens
aggggctcctttgtgctgcgtc

SEQ ID NO: 38696 - DNA, 22 bp, Homo sapiens
ggtgccaggctgtagtcagggt

SEQ ID NO: 38697 - DNA, 22 bp, Homo sapiens
atatatttgagaatattcatga

SEQ ID NO: 38698 - DNA, 20 bp, Homo sapiens
gtttctgattcagtaggtct

SEQ ID NO: 38699 - DNA, 22 bp, Homo sapiens
gcaggcggaggttgcagtgagc

SEQ ID NO: 38700 - DNA, 20 bp, Homo sapiens
caagggtttgcattggcttt

SEQ ID NO: 38701 - DNA, 19 bp, Homo sapiens
taggaccctggtggccccc

SEQ ID NO: 38702 - DNA, 17 bp, Homo sapiens
ggcctgcacctcctgct

SEQ ID NO: 38703 - DNA, 22 bp, Homo sapiens
aggaggggttctcgggtgctga

SEQ ID NO: 38704 - DNA, 20 bp, Homo sapiens
catgtgtcagttctcaccca

SEQ ID NO: 38705 - DNA, 22 bp, Homo sapiens
cactgcactgcagcctggagac

SEQ ID NO: 38706 - DNA, 22 bp, Homo sapiens
agggctggagccacagctggga

SEQ ID NO: 38707 - DNA, 22 bp, Homo sapiens
ggactgggaatcagggagatgc

SEQ ID NO: 38708 - DNA, 22 bp, Homo sapiens
gcagctggaagtgacactctgt

SEQ ID NO: 38709 - DNA, 22 bp, Homo sapiens
tctcctggagcccagatgctgg

SEQ ID NO: 38710 - DNA, 22 bp, Homo sapiens
aggtggagaagagatgggcagt

SEQ ID NO: 38711 - DNA, 22 bp, Homo sapiens
cagctgcccctccagggctggg

SEQ ID NO: 38712 - DNA, 18 bp, Homo sapiens
ggtgagggagctggaagc

SEQ ID NO: 38713 - DNA, 22 bp, Homo sapiens
tctagctctgcttatcatggct

SEQ ID NO: 38714 - DNA, 22 bp, Homo sapiens
tcactgcaacctccacctcccg

SEQ ID NO: 38715 - DNA, 22 bp, Homo sapiens
gagcaggaaggccagaagggtc

SEQ ID NO: 38716 - DNA, 22 bp, Homo sapiens
cagcccaggactgcaggtgttt

SEQ ID NO: 38717 - DNA, 22 bp, Homo sapiens
agtgagagtattaatgtgaact

SEQ ID NO: 38718 - DNA, 22 bp, Homo sapiens
cccaggaggtggaggctgcagt

SEQ ID NO: 38719 - DNA, 22 bp, Homo sapiens
caggaaggcgcggctgtgcctg

SEQ ID NO: 38720 - DNA, 22 bp, Homo sapiens
agccaagcactcaactcctgga

SEQ ID NO: 38721 - DNA, 22 bp, Homo sapiens
ccaggctggagtatagtggcgc

SEQ ID NO: 38722 - DNA, 22 bp, Homo sapiens
cgtggggcgggtggacacttgc

SEQ ID NO: 38723 - DNA, 22 bp, Homo sapiens
ggcgggcagcgtcttgctggcc

SEQ ID NO: 38724 - DNA, 22 bp, Homo sapiens
tggaggctggagtgcagtggcg

SEQ ID NO: 38725 - DNA, 22 bp, Homo sapiens
aggaaataggaccagacaaagc

SEQ ID NO: 38726 - DNA, 22 bp, Homo sapiens
tgttatctgagcaacgtcgacg

SEQ ID NO: 38727 - DNA, 22 bp, Homo sapiens
cctgaggatgccagcatgggtg

SEQ ID NO: 38728 - DNA, 20 bp, Homo sapiens
aagacaccagtggcagcccc

SEQ ID NO: 38729 - DNA, 22 bp, Homo sapiens
tggtgggctgagtctcatcgga

SEQ ID NO: 38730 - DNA, 22 bp, Homo sapiens
cgccccggacgtctgaccaaac

SEQ ID NO: 38731 - DNA, 22 bp, Homo sapiens
caggaaagggatgggctgccac

SEQ ID NO: 38732 - DNA, 22 bp, Homo sapiens
aggggaggtgtccccaaatctc

SEQ ID NO: 38733 - DNA, 22 bp, Homo sapiens
ggcaatatggtgaaaccccatc

SEQ ID NO: 38734 - DNA, 22 bp, Homo sapiens
gtccccgacgtttggcttgatg

SEQ ID NO: 38735 - DNA, 18 bp, Homo sapiens
tccagttttcccagcatc

SEQ ID NO: 38736 - DNA, 22 bp, Homo sapiens
actgcacttcagcctgggtgac

SEQ ID NO: 38737 - DNA, 22 bp, Homo sapiens
tgtggttttggttcagaaacaa

SEQ ID NO: 38738 - DNA, 22 bp, Homo sapiens
ggcctgggctccgggagttact

SEQ ID NO: 38739 - DNA, 22 bp, Homo sapiens
tcctgagccctactctagacga

SEQ ID NO: 38740 - DNA, 22 bp, Homo sapiens
ccactgcacttcagcctgggtg

SEQ ID NO: 38741 - DNA, 21 bp, Homo sapiens
tgactgaggcttcttcacaca

SEQ ID NO: 38742 - DNA, 22 bp, Homo sapiens
aagggggcggcagccagtggaa

SEQ ID NO: 38743 - DNA, 22 bp, Homo sapiens
gcagggcacaaggacgcacagg

SEQ ID NO: 38744 - DNA, 22 bp, Homo sapiens
ataaaagatcccttctgagctc

SEQ ID NO: 38745 - DNA, 22 bp, Homo sapiens
gtggggtagatctttctcagga

SEQ ID NO: 38746 - DNA, 22 bp, Homo sapiens
gccatcatatcccctgtgacct

SEQ ID NO: 38747 - DNA, 22 bp, Homo sapiens
cgcagggccgcgagcgggacca

SEQ ID NO: 38748 - DNA, 22 bp, Homo sapiens
aggctctgtcaggcggagcagc

SEQ ID NO: 38749 - DNA, 22 bp, Homo sapiens
gtgagtaaaggttcattgaatt

SEQ ID NO: 38750 - DNA, 22 bp, Homo sapiens
agctggggctgtggttgtgatt

SEQ ID NO: 38751 - DNA, 22 bp, Homo sapiens
cactgcactccagcctgggcaa

SEQ ID NO: 38752 - DNA, 22 bp, Homo sapiens
agcgccactgcactccagcctg

SEQ ID NO: 38753 - DNA, 22 bp, Homo sapiens
gtggggtagatctttctcagga

SEQ ID NO: 38754 - DNA, 22 bp, Homo sapiens
agaggctgcacttgctcatgat

SEQ ID NO: 38755 - DNA, 22 bp, Homo sapiens
ggagagggtaggggtcctgccc

SEQ ID NO: 38756 - DNA, 22 bp, Homo sapiens
gctgatagactgaatgttggga

SEQ ID NO: 38757 - DNA, 22 bp, Homo sapiens
aagaaggcggaccagaagggag

SEQ ID NO: 38758 - DNA, 22 bp, Homo sapiens
gtaggccatggtggttgtctct

SEQ ID NO: 38759 - DNA, 22 bp, Homo sapiens
gacagctccagctcctccaggc

SEQ ID NO: 38760 - DNA, 22 bp, Homo sapiens
ggcttagcaactcctgaggctc

SEQ ID NO: 38761 - DNA, 22 bp, Homo sapiens
ggggccttggatctgtgccccg

SEQ ID NO: 38762 - DNA, 22 bp, Homo sapiens
gctactgattgaccttggagag

SEQ ID NO: 38763 - DNA, 22 bp, Homo sapiens
gtagttctgcagtgtcacctga

SEQ ID NO: 38764 - DNA, 22 bp, Homo sapiens
cacagtcctgccagagggcctt

SEQ ID NO: 38765 - DNA, 22 bp, Homo sapiens
ggggccttttctgaatgtggaa

SEQ ID NO: 38766 - DNA, 23 bp, Homo sapiens
tgaggcaggcggatcacgaggtc

SEQ ID NO: 38767 - DNA, 19 bp, Homo sapiens
gctgaaggaggtgcctgca

SEQ ID NO: 38768 - DNA, 22 bp, Homo sapiens
aggacagagggaccagagccca

SEQ ID NO: 38769 - DNA, 22 bp, Homo sapiens
gggtaggcaaagcaatgacgtt

SEQ ID NO: 38770 - DNA, 22 bp, Homo sapiens
actgcgctccagcctgggtgac

SEQ ID NO: 38771 - DNA, 22 bp, Homo sapiens
ttgaccactgaatggttctgaa

SEQ ID NO: 38772 - DNA, 22 bp, Homo sapiens
gatgcgggcccgctccactgcc

SEQ ID NO: 38773 - DNA, 22 bp, Homo sapiens
ccaggaggttgaggctgcagtg

SEQ ID NO: 38774 - DNA, 22 bp, Homo sapiens
gagaggtggaggttgcagtgag

SEQ ID NO: 38775 - DNA, 22 bp, Homo sapiens
ctgatcctcctttaagtagctg

SEQ ID NO: 38776 - DNA, 22 bp, Homo sapiens
ggggaccctcaggactgcgtct

SEQ ID NO: 38777 - DNA, 22 bp, Homo sapiens
tccttgactgtgaggaactagc

SEQ ID NO: 38778 - DNA, 22 bp, Homo sapiens
cggaggttgaggctgcagtgag

SEQ ID NO: 38779 - DNA, 22 bp, Homo sapiens
tggggtacttgtatcaaagcac

SEQ ID NO: 38780 - DNA, 22 bp, Homo sapiens
ctgggctagaaggaccaggatg

SEQ ID NO: 38781 - DNA, 22 bp, Homo sapiens
aagagggctgcaatcttattgc

SEQ ID NO: 38782 - DNA, 22 bp, Homo sapiens
gtagggctcagtaaatactttg

SEQ ID NO: 38783 - DNA, 22 bp, Homo sapiens
ggacctgaacataaaacgaggc

SEQ ID NO: 38784 - DNA, 22 bp, Homo sapiens
gctgaaggcccggaggacaggg

SEQ ID NO: 38785 - DNA, 22 bp, Homo sapiens
agctcctgaaaatccagactgg

SEQ ID NO: 38786 - DNA, 22 bp, Homo sapiens
tctagctctgcttatcatggct

SEQ ID NO: 38787 - DNA, 21 bp, Homo sapiens
gctcctggtgctgcgtggcgc

SEQ ID NO: 38788 - DNA, 22 bp, Homo sapiens
tgaggcaggagttcaggctgcg

SEQ ID NO: 38789 - DNA, 22 bp, Homo sapiens
gggctagcctcttccctgctcc

SEQ ID NO: 38790 - DNA, 22 bp, Homo sapiens
gctgcagtgagccaagatcgtg

SEQ ID NO: 38791 - DNA, 22 bp, Homo sapiens
gggactggagtagaggccggtg

SEQ ID NO: 38792 - DNA, 22 bp, Homo sapiens
aatttcggttcaaggcccagtt

SEQ ID NO: 38793 - DNA, 22 bp, Homo sapiens
gggcagccgcgtgacctgccag

SEQ ID NO: 38794 - DNA, 22 bp, Homo sapiens
ggagaggggaacttgttgcttg

SEQ ID NO: 38795 - DNA, 20 bp, Homo sapiens
ttcgctgggagtggccaggc

SEQ ID NO: 38796 - DNA, 22 bp, Homo sapiens
gccatcatatcccctgtgacct

SEQ ID NO: 38797 - DNA, 22 bp, Homo sapiens
tttcctcttctggcaggcaggg

SEQ ID NO: 38798 - DNA, 22 bp, Homo sapiens
gtcaccagtgctaagaggtgga

SEQ ID NO: 38799 - DNA, 22 bp, Homo sapiens
cattccttaacgtggggagtct

SEQ ID NO: 38800 - DNA, 22 bp, Homo sapiens
ttgcatcagaattacttggagg

SEQ ID NO: 38801 - DNA, 22 bp, Homo sapiens
tccttagacaaagagtgggctt

SEQ ID NO: 38802 - DNA, 22 bp, Homo sapiens
cctcgacctccccaggctcagg

SEQ ID NO: 38803 - DNA, 22 bp, Homo sapiens
atgctttctcttagttcattga

SEQ ID NO: 38804 - DNA, 22 bp, Homo sapiens
cctgccagagcagcttgtcctc

SEQ ID NO: 38805 - DNA, 22 bp, Homo sapiens
ttgcccaggctggagtgcagta

SEQ ID NO: 38806 - DNA, 22 bp, Homo sapiens
aagagggctgcaatcttattgc

SEQ ID NO: 38807 - DNA, 22 bp, Homo sapiens
gcaggcaggcttccttgaactg

SEQ ID NO: 38808 - DNA, 22 bp, Homo sapiens
atacctgtgtatccacaagcgt

SEQ ID NO: 38809 - DNA, 22 bp, Homo sapiens
atccccctgtatctggaagaat

SEQ ID NO: 38810 - DNA, 22 bp, Homo sapiens
accagcctggccaacatggcaa

SEQ ID NO: 38811 - DNA, 22 bp, Homo sapiens
ccagcttgaagatgtgctggtt

SEQ ID NO: 38812 - DNA, 22 bp, Homo sapiens
tcttaattctgtgtcttcacta

SEQ ID NO: 38813 - DNA, 23 bp, Homo sapiens
gcagaggagcaagctggacacca

SEQ ID NO: 38814 - DNA, 22 bp, Homo sapiens
acggtgctgggtattggggttc

SEQ ID NO: 38815 - DNA, 22 bp, Homo sapiens
tttctttatcatagcatctttg

SEQ ID NO: 38816 - DNA, 22 bp, Homo sapiens
cgagagttagctaggagtcaca

SEQ ID NO: 38817 - DNA, 22 bp, Homo sapiens
cacccaggctggagagcagtgg

SEQ ID NO: 38818 - DNA, 22 bp, Homo sapiens
gtccacagctctgaggtctccc

SEQ ID NO: 38819 - DNA, 22 bp, Homo sapiens
gggacatctttctagtcagggt

SEQ ID NO: 38820 - DNA, 22 bp, Homo sapiens
gaccagtcattactcatgccct

SEQ ID NO: 38821 - DNA, 22 bp, Homo sapiens
ggtgacagtggttaaaatttgt

SEQ ID NO: 38822 - DNA, 22 bp, Homo sapiens
cggctgggttcggctgcaggcc

SEQ ID NO: 38823 - DNA, 22 bp, Homo sapiens
tgcctgttgcccacctgataaa

SEQ ID NO: 38824 - DNA, 22 bp, Homo sapiens
agaacctctggatacagtttaa

SEQ ID NO: 38825 - DNA, 22 bp, Homo sapiens
cagagctgtccaaaccctgaca

SEQ ID NO: 38826 - DNA, 22 bp, Homo sapiens
agggctggagccacagctggga

SEQ ID NO: 38827 - DNA, 22 bp, Homo sapiens
caaagtgctggaattacaggtg

SEQ ID NO: 38828 - DNA, 22 bp, Homo sapiens
gccttgatctgctgtgtttgag

SEQ ID NO: 38829 - DNA, 22 bp, Homo sapiens
ttgttgtcattgtagaggattt

SEQ ID NO: 38830 - DNA, 22 bp, Homo sapiens
ggctgagttgagaggattactt

SEQ ID NO: 38831 - DNA, 22 bp, Homo sapiens
cactctgcagctgaagggctgg

SEQ ID NO: 38832 - DNA, 22 bp, Homo sapiens
tgaggcaggagttcaggctgcg

SEQ ID NO: 38833 - DNA, 22 bp, Homo sapiens
agccagggacgctgcaggctac

SEQ ID NO: 38834 - DNA, 22 bp, Homo sapiens
ctgctcagtaatagtcctatct

SEQ ID NO: 38835 - DNA, 22 bp, Homo sapiens
gaggtgggtgtatcacaggtca

SEQ ID NO: 38836 - DNA, 22 bp, Homo sapiens
tgagatgtaaggtatgcttact

SEQ ID NO: 38837 - DNA, 22 bp, Homo sapiens
tgcgttgcgctcctgcagcagg

SEQ ID NO: 38838 - DNA, 22 bp, Homo sapiens
ggctccaccctgcttccagaag

SEQ ID NO: 38839 - DNA, 22 bp, Homo sapiens
agggaagaaaatccatcgctgc

SEQ ID NO: 38840 - DNA, 22 bp, Homo sapiens
tggaaagaaagtaaaggcgtat

SEQ ID NO: 38841 - DNA, 22 bp, Homo sapiens
gcagatcaacactctctttcaa

SEQ ID NO: 38842 - DNA, 22 bp, Homo sapiens
cttgcctttgtcttcaaaggct

SEQ ID NO: 38843 - DNA, 22 bp, Homo sapiens
cctgcacatgtgtgcgcctgta

SEQ ID NO: 38844 - DNA, 22 bp, Homo sapiens
tgtggttttggttcagaaacaa

SEQ ID NO: 38845 - DNA, 22 bp, Homo sapiens
tgaggcaggaggttgagaactg

SEQ ID NO: 38846 - DNA, 22 bp, Homo sapiens
catccgcatgcaagtgctgtcc

SEQ ID NO: 38847 - DNA, 22 bp, Homo sapiens
agacgctattttgaggggtcta

SEQ ID NO: 38848 - DNA, 22 bp, Homo sapiens
tgtttgagttctagcgcattta

SEQ ID NO: 38849 - DNA, 22 bp, Homo sapiens
ctgggaggcggaggttgcagtg

SEQ ID NO: 38850 - DNA, 22 bp, Homo sapiens
tcccggcgctgggaggtgggtc

SEQ ID NO: 38851 - DNA, 22 bp, Homo sapiens
tgttgcccaggttctctcctgc

SEQ ID NO: 38852 - DNA, 22 bp, Homo sapiens
gggcatggtggcaggcacctgt

SEQ ID NO: 38853 - DNA, 22 bp, Homo sapiens
aatcagaaattgagggtctggt

SEQ ID NO: 38854 - DNA, 22 bp, Homo sapiens
tttccagagggtgctcagggcg

SEQ ID NO: 38855 - DNA, 22 bp, Homo sapiens
tggaggctggagtgcagtggcg

SEQ ID NO: 38856 - DNA, 22 bp, Homo sapiens
ggcctcacccatcggtgccttt

SEQ ID NO: 38857 - DNA, 23 bp, Homo sapiens
aggatgtaggatgtatggcagag

SEQ ID NO: 38858 - DNA, 22 bp, Homo sapiens
tggtatgtaaattgtaactcaa

SEQ ID NO: 38859 - DNA, 22 bp, Homo sapiens
tgatcaaaacattactccacca

SEQ ID NO: 38860 - DNA, 21 bp, Homo sapiens
tcacgtggtcacatgagcttt

SEQ ID NO: 38861 - DNA, 22 bp, Homo sapiens
attcttcctcatcaatctgtag

SEQ ID NO: 38862 - DNA, 23 bp, Homo sapiens
ggttctgccgcttactgctgtgc

SEQ ID NO: 38863 - DNA, 22 bp, Homo sapiens
ccttcccatgcagcctgtctga

SEQ ID NO: 38864 - DNA, 22 bp, Homo sapiens
tgggggacaccagtctctctct

SEQ ID NO: 38865 - DNA, 22 bp, Homo sapiens
ttccacaatggttaagctcgtt

SEQ ID NO: 38866 - DNA, 22 bp, Homo sapiens
gcctcctggggtgccatcatct

SEQ ID NO: 38867 - DNA, 18 bp, Homo sapiens
taggagagaatttattta

SEQ ID NO: 38868 - DNA, 22 bp, Homo sapiens
ttggaggcaatgggaaggaggc

SEQ ID NO: 38869 - DNA, 22 bp, Homo sapiens
tagaatgtaaattccaagggca

SEQ ID NO: 38870 - DNA, 22 bp, Homo sapiens
gtggtgtttgagctgccaggga

SEQ ID NO: 38871 - DNA, 20 bp, Homo sapiens
gggcagtggcgctatctcag

SEQ ID NO: 38872 - DNA, 22 bp, Homo sapiens
gcgctgcgcctcctcttccgca

SEQ ID NO: 38873 - DNA, 22 bp, Homo sapiens
agcaagattgaggcttcctcag

SEQ ID NO: 38874 - DNA, 22 bp, Homo sapiens
actgcacttcagcctgggtgac

SEQ ID NO: 38875 - DNA, 22 bp, Homo sapiens
atgattgaaaatgacattgcca

SEQ ID NO: 38876 - DNA, 19 bp, Homo sapiens
acacagggatcagagggtt

SEQ ID NO: 38877 - DNA, 22 bp, Homo sapiens
gagcacagtaaagcagtgtcac

SEQ ID NO: 38878 - DNA, 22 bp, Homo sapiens
ggggaccctcaggactgcgtct

SEQ ID NO: 38879 - DNA, 23 bp, Homo sapiens
tcagaacagttcttggtgcatag

SEQ ID NO: 38880 - DNA, 22 bp, Homo sapiens
ccaggctgctgttggtgtccgc

SEQ ID NO: 38881 - DNA, 22 bp, Homo sapiens
ccacaggggcccacgagccgct

SEQ ID NO: 38882 - DNA, 22 bp, Homo sapiens
tcccaggccacacttggggaac

SEQ ID NO: 38883 - DNA, 22 bp, Homo sapiens
ggtgactggtttatctggcagt

SEQ ID NO: 38884 - DNA, 22 bp, Homo sapiens
tcctgagataaatctcatgtga

SEQ ID NO: 38885 - DNA, 22 bp, Homo sapiens
tctctcaggctggagtgcagtg

SEQ ID NO: 38886 - DNA, 22 bp, Homo sapiens
tgagtagagaattcagctaagg

SEQ ID NO: 38887 - DNA, 22 bp, Homo sapiens
tcgggctcgctctcctagcgga

SEQ ID NO: 38888 - DNA, 22 bp, Homo sapiens
ttctgattgctgatgaggccca

SEQ ID NO: 38889 - DNA, 22 bp, Homo sapiens
catataaatacaacatgtgtta

SEQ ID NO: 38890 - DNA, 22 bp, Homo sapiens
caaagtgctaggattacaggcg

SEQ ID NO: 38891 - DNA, 22 bp, Homo sapiens
ttgactgtgatgggctcagctg

SEQ ID NO: 38892 - DNA, 22 bp, Homo sapiens
gagccccaccctagacattctg

SEQ ID NO: 38893 - DNA, 22 bp, Homo sapiens
agatggggtttcatcatgttgg

SEQ ID NO: 38894 - DNA, 22 bp, Homo sapiens
tgtgtggattcatctcaaagag

SEQ ID NO: 38895 - DNA, 22 bp, Homo sapiens
aagacttgaccaggttgaaggc

SEQ ID NO: 38896 - DNA, 22 bp, Homo sapiens
ccaggcaggcgatggtgcagtg

SEQ ID NO: 38897 - DNA, 22 bp, Homo sapiens
ccacagtctatgcaacaaggtc

SEQ ID NO: 38898 - DNA, 22 bp, Homo sapiens
cagggccagcgtctcgggctat

SEQ ID NO: 38899 - DNA, 22 bp, Homo sapiens
cctggcaggtggcgccctcggc

SEQ ID NO: 38900 - DNA, 22 bp, Homo sapiens
ttgtgttaaggtgcatctagtg

SEQ ID NO: 38901 - DNA, 22 bp, Homo sapiens
aatccaggtggcggaggttgtg

SEQ ID NO: 38902 - DNA, 18 bp, Homo sapiens
gaggatggaaggagatgc

SEQ ID NO: 38903 - DNA, 22 bp, Homo sapiens
cactccagcctcagtgacagag

SEQ ID NO: 38904 - DNA, 22 bp, Homo sapiens
gcaggcagaggtggaggagaca

SEQ ID NO: 38905 - DNA, 22 bp, Homo sapiens
tttccatgtgtactggccagaa

SEQ ID NO: 38906 - DNA, 20 bp, Homo sapiens
ggggcccaagccctcttgcc

SEQ ID NO: 38907 - DNA, 22 bp, Homo sapiens
cctggaagttggaggttgcagt

SEQ ID NO: 38908 - DNA, 22 bp, Homo sapiens
gatggcctcatggctgcaggcc

SEQ ID NO: 38909 - DNA, 22 bp, Homo sapiens
cattgctttgtgcatatttaaa

SEQ ID NO: 38910 - DNA, 22 bp, Homo sapiens
gcaggtggatcacctgaggtca

SEQ ID NO: 38911 - DNA, 22 bp, Homo sapiens
acctggacacctgctgtcatct

SEQ ID NO: 38912 - DNA, 22 bp, Homo sapiens
tcccccaggctggagtgcagtg

SEQ ID NO: 38913 - DNA, 22 bp, Homo sapiens
tgtgggtggcatcgtcctggcc

SEQ ID NO: 38914 - DNA, 22 bp, Homo sapiens
gagtgtatggaaggaagagatt

SEQ ID NO: 38915 - DNA, 22 bp, Homo sapiens
tgtgtcagaaggcaatggggat

SEQ ID NO: 38916 - DNA, 22 bp, Homo sapiens
ccaggctggagtatagtggcgc

SEQ ID NO: 38917 - DNA, 18 bp, Homo sapiens
catgggtgacaggtggat

SEQ ID NO: 38918 - DNA, 22 bp, Homo sapiens
tgtatattctgcctaaaagctt

SEQ ID NO: 38919 - DNA, 22 bp, Homo sapiens
cagggtttcaccatgttagcag

SEQ ID NO: 38920 - DNA, 22 bp, Homo sapiens
tttgctattgtgaatagtgcca

SEQ ID NO: 38921 - DNA, 22 bp, Homo sapiens
ccctggaggttgaggctgcagt

SEQ ID NO: 38922 - DNA, 22 bp, Homo sapiens
ccagcagccaccttctcgaaat

SEQ ID NO: 38923 - DNA, 22 bp, Homo sapiens
gtgctccctccttcctcaagga

SEQ ID NO: 38924 - DNA, 18 bp, Homo sapiens
cagggctgtggggtcact

SEQ ID NO: 38925 - DNA, 20 bp, Homo sapiens
ctgggtggcaagcaaggggg

SEQ ID NO: 38926 - DNA, 22 bp, Homo sapiens
cctgggaggctgaggctgcagt

SEQ ID NO: 38927 - DNA, 22 bp, Homo sapiens
cctttcccgctttgagggcaag

SEQ ID NO: 38928 - DNA, 22 bp, Homo sapiens
cagcagagaaattacatatttg

SEQ ID NO: 38929 - DNA, 22 bp, Homo sapiens
tcatcagaggcatctggcaagg

SEQ ID NO: 38930 - DNA, 17 bp, Homo sapiens
cagtcgaggaggacctg

SEQ ID NO: 38931 - DNA, 22 bp, Homo sapiens
aatgttacgatcaacaacacat

SEQ ID NO: 38932 - DNA, 23 bp, Homo sapiens
ttggcaaagcctatgaagtcctc

SEQ ID NO: 38933 - DNA, 22 bp, Homo sapiens
agccagggtctctcgctctgtt

SEQ ID NO: 38934 - DNA, 22 bp, Homo sapiens
agtgcagtggttaggagccagg

SEQ ID NO: 38935 - DNA, 22 bp, Homo sapiens
atatacacatctttttaaatat

SEQ ID NO: 38936 - DNA, 22 bp, Homo sapiens
gaggggctgccctggtgtcagg

SEQ ID NO: 38937 - DNA, 22 bp, Homo sapiens
cagcttggaggaggatctaaga

SEQ ID NO: 38938 - DNA, 22 bp, Homo sapiens
tgattcatcagaataggagttt

SEQ ID NO: 38939 - DNA, 22 bp, Homo sapiens
ccaggaggcggaggttgcagcg

SEQ ID NO: 38940 - DNA, 22 bp, Homo sapiens
cttcctcctccatctcgaaggc

SEQ ID NO: 38941 - DNA, 22 bp, Homo sapiens
ttgcactccagcccgagcaaca

SEQ ID NO: 38942 - DNA, 22 bp, Homo sapiens
caggctggagtgcagtggtgcc

SEQ ID NO: 38943 - DNA, 22 bp, Homo sapiens
accctcaacaaattcactctat

SEQ ID NO: 38944 - DNA, 22 bp, Homo sapiens
acttttaaatgagtttcagttg

SEQ ID NO: 38945 - DNA, 22 bp, Homo sapiens
ggcctggcagagcgcgcggctg

SEQ ID NO: 38946 - DNA, 22 bp, Homo sapiens
gagtgtgtcggtcagcgtggcg

SEQ ID NO: 38947 - DNA, 22 bp, Homo sapiens
tgctcatcaacatgatgatcat

SEQ ID NO: 38948 - DNA, 22 bp, Homo sapiens
ttatttaatgtgatctgaagag

SEQ ID NO: 38949 - DNA, 22 bp, Homo sapiens
tgaagcaaattgtttagcctga

SEQ ID NO: 38950 - DNA, 22 bp, Homo sapiens
tcactgcaacctccacctcccg

SEQ ID NO: 38951 - DNA, 22 bp, Homo sapiens
ggctagggatctagaccaggac

SEQ ID NO: 38952 - DNA, 22 bp, Homo sapiens
aggagcagaccgtagtcctgca

SEQ ID NO: 38953 - DNA, 22 bp, Homo sapiens
atatgcagtctcttgcccttct

SEQ ID NO: 38954 - DNA, 22 bp, Homo sapiens
ggttggacactaggtaggagcg

SEQ ID NO: 38955 - DNA, 22 bp, Homo sapiens
agcccaggagtttgaggctgtg

SEQ ID NO: 38956 - DNA, 22 bp, Homo sapiens
ttaatgaaaggcagtttggaac

SEQ ID NO: 38957 - DNA, 22 bp, Homo sapiens
ggaagaaaggtggacaacaggt

SEQ ID NO: 38958 - DNA, 22 bp, Homo sapiens
aagtcattggtagcttgatagg

SEQ ID NO: 38959 - DNA, 22 bp, Homo sapiens
tgatttatgcattatactgttg

SEQ ID NO: 38960 - DNA, 22 bp, Homo sapiens
tcactgcaacctctgcctcccg

SEQ ID NO: 38961 - DNA, 22 bp, Homo sapiens
tacctcaagttccaggaaagcg

SEQ ID NO: 38962 - DNA, 22 bp, Homo sapiens
ctggagcaaaagtgactcctct

SEQ ID NO: 38963 - DNA, 22 bp, Homo sapiens
catcagaacgtgagctccttgt

SEQ ID NO: 38964 - DNA, 22 bp, Homo sapiens
ttgtcccaggacttgcatagat

SEQ ID NO: 38965 - DNA, 22 bp, Homo sapiens
ttggatccatctcaggcatagg

SEQ ID NO: 38966 - DNA, 22 bp, Homo sapiens
ctccttctgggcctggcagtgg

SEQ ID NO: 38967 - DNA, 22 bp, Homo sapiens
gccacctcggctttctctgctc

SEQ ID NO: 38968 - DNA, 22 bp, Homo sapiens
acaattctgatggtttcccagt

SEQ ID NO: 38969 - DNA, 22 bp, Homo sapiens
atattgaaccctacagactgta

SEQ ID NO: 38970 - DNA, 22 bp, Homo sapiens
ctgggaggcagaggttgtagtg

SEQ ID NO: 38971 - DNA, 22 bp, Homo sapiens
tctgttgcaatgtgcatggtga

SEQ ID NO: 38972 - DNA, 22 bp, Homo sapiens
agtgaggggcagctgagtgggc

SEQ ID NO: 38973 - DNA, 22 bp, Homo sapiens
actgcactccagcctgggtgat

SEQ ID NO: 38974 - DNA, 22 bp, Homo sapiens
aggctctgtcaggcggagcagc

SEQ ID NO: 38975 - DNA, 22 bp, Homo sapiens
ggaggagacagtaaaaagcacg

SEQ ID NO: 38976 - DNA, 22 bp, Homo sapiens
ctgctcttgagggactgcggtc

SEQ ID NO: 38977 - DNA, 22 bp, Homo sapiens
aaagcctcccaggttatgagta

SEQ ID NO: 38978 - DNA, 22 bp, Homo sapiens
agcctgcgatcccacctggcct

SEQ ID NO: 38979 - DNA, 22 bp, Homo sapiens
tgtgccataggcagcgtggcca

SEQ ID NO: 38980 - DNA, 22 bp, Homo sapiens
actgcacttcaccctgggtgac

SEQ ID NO: 38981 - DNA, 22 bp, Homo sapiens
ccaggcagcctgctccattctg

SEQ ID NO: 38982 - DNA, 21 bp, Homo sapiens
ctagcccctactccaagttga

SEQ ID NO: 38983 - DNA, 22 bp, Homo sapiens
caaggtgccatgctgggcgggg

SEQ ID NO: 38984 - DNA, 22 bp, Homo sapiens
ctcatcagaaatacctgacaaa

SEQ ID NO: 38985 - DNA, 21 bp, Homo sapiens
gttcaaatcctgacactacac

SEQ ID NO: 38986 - DNA, 22 bp, Homo sapiens
tgctcattggcgatctgaggga

SEQ ID NO: 38987 - DNA, 22 bp, Homo sapiens
agggctctgagtgggaaagagg

SEQ ID NO: 38988 - DNA, 18 bp, Homo sapiens
gatcgggggcgccccaag

SEQ ID NO: 38989 - DNA, 22 bp, Homo sapiens
aagccaggttccatggaggagc

SEQ ID NO: 38990 - DNA, 22 bp, Homo sapiens
aggacaaaggaccagatctgga

SEQ ID NO: 38991 - DNA, 22 bp, Homo sapiens
agaggccggccgagcccatggg

SEQ ID NO: 38992 - DNA, 22 bp, Homo sapiens
gagaggtggaggttgcagtgag

SEQ ID NO: 38993 - DNA, 22 bp, Homo sapiens
tacatgctccttatgagaatct

SEQ ID NO: 38994 - DNA, 22 bp, Homo sapiens
accaggggatggttggcactgt

SEQ ID NO: 38995 - DNA, 22 bp, Homo sapiens
tgtgtctttgttccaggtacga

SEQ ID NO: 38996 - DNA, 22 bp, Homo sapiens
acaaagtgaattgcatcgagtt

SEQ ID NO: 38997 - DNA, 22 bp, Homo sapiens
cctcggctgggccttggccact

SEQ ID NO: 38998 - DNA, 22 bp, Homo sapiens
ccaatgatggtgcccacgatga

SEQ ID NO: 38999 - DNA, 22 bp, Homo sapiens
gtttctctgtctgttacattgg

SEQ ID NO: 39000 - DNA, 22 bp, Homo sapiens
agcctggtttaagcattttata

SEQ ID NO: 39001 - DNA, 22 bp, Homo sapiens
ctcggagggcaacagaagtgct

SEQ ID NO: 39002 - DNA, 22 bp, Homo sapiens
gagggtggtggcttaaggtgct

SEQ ID NO: 39003 - DNA, 22 bp, Homo sapiens
ctcaggacccggtccaggtggg

SEQ ID NO: 39004 - DNA, 22 bp, Homo sapiens
atagacgcggccgctgatgcag

SEQ ID NO: 39005 - DNA, 22 bp, Homo sapiens
gcccagcacctctctcagggtt

SEQ ID NO: 39006 - DNA, 22 bp, Homo sapiens
ccaaagtgctggggttacaggc

SEQ ID NO: 39007 - DNA, 22 bp, Homo sapiens
atgggttcaagtgattctcctg

SEQ ID NO: 39008 - DNA, 22 bp, Homo sapiens
tgcctcagctgaggccgctcca

SEQ ID NO: 39009 - DNA, 22 bp, Homo sapiens
aggcaatcccctgaggatactt

SEQ ID NO: 39010 - DNA, 22 bp, Homo sapiens
agaggcagtatacaatccgagc

SEQ ID NO: 39011 - DNA, 22 bp, Homo sapiens
acccatccagtgtccctgctag

SEQ ID NO: 39012 - DNA, 19 bp, Homo sapiens
agagtattgaatttgccct

SEQ ID NO: 39013 - DNA, 22 bp, Homo sapiens
gggaggcagtgctggaggctgg

SEQ ID NO: 39014 - DNA, 22 bp, Homo sapiens
ctgggaggcagaggttgcagtg

SEQ ID NO: 39015 - DNA, 22 bp, Homo sapiens
aacctcaaactcttgggcttaa

SEQ ID NO: 39016 - DNA, 22 bp, Homo sapiens
gcccagcccagaaaggttcgga

SEQ ID NO: 39017 - DNA, 22 bp, Homo sapiens
tctgagccagggtctcctccct

SEQ ID NO: 39018 - DNA, 22 bp, Homo sapiens
tccagggagagccgctgctcca

SEQ ID NO: 39019 - DNA, 22 bp, Homo sapiens
tgtggaaggggccccatgacca

SEQ ID NO: 39020 - DNA, 22 bp, Homo sapiens
aggtggagaagagatgggcagt

SEQ ID NO: 39021 - DNA, 22 bp, Homo sapiens
tccacaaggcagctcctccagg

SEQ ID NO: 39022 - DNA, 22 bp, Homo sapiens
tcaccagatctctctgtaatgg

SEQ ID NO: 39023 - DNA, 22 bp, Homo sapiens
tgtgactaggcctgagctcttg

SEQ ID NO: 39024 - DNA, 22 bp, Homo sapiens
atgtgccaacgtgcaggtttgt

SEQ ID NO: 39025 - DNA, 22 bp, Homo sapiens
aaaagcaattgcagttcttgcc

SEQ ID NO: 39026 - DNA, 22 bp, Homo sapiens
caaagtgctgggattacaggct

SEQ ID NO: 39027 - DNA, 22 bp, Homo sapiens
ctccaggccatggctgcggagg

SEQ ID NO: 39028 - DNA, 22 bp, Homo sapiens
gttcaagaccagcctggccaac

SEQ ID NO: 39029 - DNA, 22 bp, Homo sapiens
ggtcacgtgaccgcacctgcct

SEQ ID NO: 39030 - DNA, 22 bp, Homo sapiens
gaaaggagagggttaaggagct

SEQ ID NO: 39031 - DNA, 22 bp, Homo sapiens
ttgggtgctgtcatggggcacg

SEQ ID NO: 39032 - DNA, 19 bp, Homo sapiens
tcctgcctggggccgcctg

SEQ ID NO: 39033 - DNA, 18 bp, Homo sapiens
tgtccctgcaaataacat

SEQ ID NO: 39034 - DNA, 22 bp, Homo sapiens
gaggcaggcagattgcttgagg

SEQ ID NO: 39035 - DNA, 22 bp, Homo sapiens
ctcattgcccagatccccacag

SEQ ID NO: 39036 - DNA, 22 bp, Homo sapiens
ccaggaggcagaagttgcagtg

SEQ ID NO: 39037 - DNA, 22 bp, Homo sapiens
aggtggggaggagtgtctcttt

SEQ ID NO: 39038 - DNA, 22 bp, Homo sapiens
ttactcgtgacaatgtccttga

SEQ ID NO: 39039 - DNA, 22 bp, Homo sapiens
ctagcctgggatttgaacttat

SEQ ID NO: 39040 - DNA, 22 bp, Homo sapiens
aaagcactgcacatatatttgc

SEQ ID NO: 39041 - DNA, 22 bp, Homo sapiens
tctgcaggtaagcgttcttgga

SEQ ID NO: 39042 - DNA, 22 bp, Homo sapiens
cctggaggcggaggttgcagtg

SEQ ID NO: 39043 - DNA, 22 bp, Homo sapiens
tcacagagttaaaagtttcttt

SEQ ID NO: 39044 - DNA, 22 bp, Homo sapiens
gccacgtagaagtgccgcgaga

SEQ ID NO: 39045 - DNA, 22 bp, Homo sapiens
atagagtgatgtaaggtatgtg

SEQ ID NO: 39046 - DNA, 22 bp, Homo sapiens
tacgcctgtaatcccagcactt

SEQ ID NO: 39047 - DNA, 22 bp, Homo sapiens
cccaggcttttctcttgcccca

SEQ ID NO: 39048 - DNA, 22 bp, Homo sapiens
caggaggattgcttgaggccag

SEQ ID NO: 39049 - DNA, 22 bp, Homo sapiens
atgaaaacggaccagagctatt

SEQ ID NO: 39050 - DNA, 22 bp, Homo sapiens
tcactcaggctggagtgcagtg

SEQ ID NO: 39051 - DNA, 22 bp, Homo sapiens
atgccacttcattccagcctcg

SEQ ID NO: 39052 - DNA, 22 bp, Homo sapiens
ataatacatggttgatcttttc

SEQ ID NO: 39053 - DNA, 22 bp, Homo sapiens
agctgattccactttttcccca

SEQ ID NO: 39054 - DNA, 20 bp, Homo sapiens
gggactgtcccatcctcatc

SEQ ID NO: 39055 - DNA, 22 bp, Homo sapiens
gcaggcagatcacctgtcagga

SEQ ID NO: 39056 - DNA, 22 bp, Homo sapiens
gggggcttggcccggtctggtt

SEQ ID NO: 39057 - DNA, 22 bp, Homo sapiens
agcagcagtgttctggaattct

SEQ ID NO: 39058 - DNA, 22 bp, Homo sapiens
tcgtctgtgaaattgggataag

SEQ ID NO: 39059 - DNA, 22 bp, Homo sapiens
acgcctgtaatcccagcacttt

SEQ ID NO: 39060 - DNA, 22 bp, Homo sapiens
gagacctcttggtatcgctagg

SEQ ID NO: 39061 - DNA, 22 bp, Homo sapiens
agcagcagtatccttccccggc

SEQ ID NO: 39062 - DNA, 22 bp, Homo sapiens
aagaatgagctcaaagatctta

SEQ ID NO: 39063 - DNA, 22 bp, Homo sapiens
ttgctctgactggagtgcagtg

SEQ ID NO: 39064 - DNA, 22 bp, Homo sapiens
gccatgactctccataccaaag

SEQ ID NO: 39065 - DNA, 23 bp, Homo sapiens
ggagtgcaatggcgccatctcgg

SEQ ID NO: 39066 - DNA, 22 bp, Homo sapiens
tgtgtcccttggaacctcagct

SEQ ID NO: 39067 - DNA, 22 bp, Homo sapiens
atttggcagtataaattctggc

SEQ ID NO: 39068 - DNA, 22 bp, Homo sapiens
tgagcaggcgcagcaggaggtc

SEQ ID NO: 39069 - DNA, 22 bp, Homo sapiens
tttggcatgggctatttgcttt

SEQ ID NO: 39070 - DNA, 22 bp, Homo sapiens
ttgtctaatgagctccacttca

SEQ ID NO: 39071 - DNA, 22 bp, Homo sapiens
gtctttatttgagattgtcatt

SEQ ID NO: 39072 - DNA, 22 bp, Homo sapiens
gaggcagaagttgcagtgagca

SEQ ID NO: 39073 - DNA, 22 bp, Homo sapiens
ctggcctggcgcagtggctcac

SEQ ID NO: 39074 - DNA, 22 bp, Homo sapiens
ccctgctgtcaggtgctgggag

SEQ ID NO: 39075 - DNA, 22 bp, Homo sapiens
cttcagctgcagttatgtttag

SEQ ID NO: 39076 - DNA, 22 bp, Homo sapiens
cagcagcccacgcgtgctgtcc

SEQ ID NO: 39077 - DNA, 22 bp, Homo sapiens
gcagctggaagtgacactctgt

SEQ ID NO: 39078 - DNA, 22 bp, Homo sapiens
caggctggagtgcagtggcgct

SEQ ID NO: 39079 - DNA, 19 bp, Homo sapiens
taggaccctggtggccccc

SEQ ID NO: 39080 - DNA, 21 bp, Homo sapiens
cagagctgtccaaaccctgac

SEQ ID NO: 39081 - DNA, 23 bp, Homo sapiens
ccagtgattgcctggaaggaggt

SEQ ID NO: 39082 - DNA, 22 bp, Homo sapiens
agggccagcactcctggcagga

SEQ ID NO: 39083 - DNA, 22 bp, Homo sapiens
agcctgggccctgcctcttctc

SEQ ID NO: 39084 - DNA, 21 bp, Homo sapiens
gggcagaggggcctcctgggt

SEQ ID NO: 39085 - DNA, 22 bp, Homo sapiens
ccaggaggcggaaggtacagtg

SEQ ID NO: 39086 - DNA, 22 bp, Homo sapiens
ggtgcagaggagccagctgggg

SEQ ID NO: 39087 - DNA, 22 bp, Homo sapiens
gcaccacatcaatgaggggagc

SEQ ID NO: 39088 - DNA, 22 bp, Homo sapiens
agagtgtaccaaatatcctaca

SEQ ID NO: 39089 - DNA, 22 bp, Homo sapiens
caagtctgacctctgggtgaag

SEQ ID NO: 39090 - DNA, 22 bp, Homo sapiens
caggctggagtgcagtggggcg

SEQ ID NO: 39091 - DNA, 22 bp, Homo sapiens
caaagtaattacggttttggcc

SEQ ID NO: 39092 - DNA, 18 bp, Homo sapiens
tcttccaacactgacacc

SEQ ID NO: 39093 - DNA, 22 bp, Homo sapiens
gctgctgcttgaaggctcggag

SEQ ID NO: 39094 - DNA, 22 bp, Homo sapiens
gcttctcgggcctgatgtcgtc

SEQ ID NO: 39095 - DNA, 22 bp, Homo sapiens
cgctgctccgccttgtccatat

SEQ ID NO: 39096 - DNA, 22 bp, Homo sapiens
tcccagcgcggggggaggatcc

SEQ ID NO: 39097 - DNA, 22 bp, Homo sapiens
gggagaggttacccgagcaact

SEQ ID NO: 39098 - DNA, 22 bp, Homo sapiens
aggggagagttaatgtgaatgt

SEQ ID NO: 39099 - DNA, 22 bp, Homo sapiens
ggacctgaacataaaacgaggc

SEQ ID NO: 39100 - DNA, 22 bp, Homo sapiens
gctggggaggcagcagagaaca

SEQ ID NO: 39101 - DNA, 22 bp, Homo sapiens
acaaacagagttgaaaaatagg

SEQ ID NO: 39102 - DNA, 22 bp, Homo sapiens
agaacctcaattatttttgcac

SEQ ID NO: 39103 - DNA, 22 bp, Homo sapiens
aggaaataggaccagacaaagc

SEQ ID NO: 39104 - DNA, 22 bp, Homo sapiens
ggctgcaggttggttggcagct

SEQ ID NO: 39105 - DNA, 22 bp, Homo sapiens
ctcgcatgccctgcctcatcca

SEQ ID NO: 39106 - DNA, 22 bp, Homo sapiens
tcacttcccagacggggtggca

SEQ ID NO: 39107 - DNA, 22 bp, Homo sapiens
tgctgctccccagcacacagca

SEQ ID NO: 39108 - DNA, 22 bp, Homo sapiens
acaagcgggccacagtgctggt

SEQ ID NO: 39109 - DNA, 22 bp, Homo sapiens
acagagacacggaagctaaaga

SEQ ID NO: 39110 - DNA, 22 bp, Homo sapiens
gctcccaccttaaccttcacat

SEQ ID NO: 39111 - DNA, 20 bp, Homo sapiens
ataaaataactgccacaaga

SEQ ID NO: 39112 - DNA, 22 bp, Homo sapiens
gtggaggagaggcgccttgcgg

SEQ ID NO: 39113 - DNA, 22 bp, Homo sapiens
tcaccttgtgatctccctgcct

SEQ ID NO: 39114 - DNA, 22 bp, Homo sapiens
agaggcaggaggttgacttgag

SEQ ID NO: 39115 - DNA, 22 bp, Homo sapiens
ttggaagacaatgctgattctc

SEQ ID NO: 39116 - DNA, 22 bp, Homo sapiens
aaggagaggttgtccgtgttgt

SEQ ID NO: 39117 - DNA, 22 bp, Homo sapiens
ggtgccaggctgtagtcagggt

SEQ ID NO: 39118 - DNA, 22 bp, Homo sapiens
ctggcaggagcattcacagagg

SEQ ID NO: 39119 - DNA, 22 bp, Homo sapiens
cgtcccgggttcacgccattct

SEQ ID NO: 39120 - DNA, 22 bp, Homo sapiens
tctgtcttagccatctcaggct

SEQ ID NO: 39121 - DNA, 22 bp, Homo sapiens
gggctaaatgcagaaatgcaga

SEQ ID NO: 39122 - DNA, 22 bp, Homo sapiens
gcctgtgtggatgcgccggtgc

SEQ ID NO: 39123 - DNA, 22 bp, Homo sapiens
tgtctggtgggttgacaggcag

SEQ ID NO: 39124 - DNA, 22 bp, Homo sapiens
gctgtgtatcagatgccacggg

SEQ ID NO: 39125 - DNA, 22 bp, Homo sapiens
tctagctctgcttatcatggct

SEQ ID NO: 39126 - DNA, 22 bp, Homo sapiens
cccaccagtacagatggtagat

SEQ ID NO: 39127 - DNA, 22 bp, Homo sapiens
gtcagaggggcagctgccaggc

SEQ ID NO: 39128 - DNA, 22 bp, Homo sapiens
tctgagacaggaagtggagggt

SEQ ID NO: 39129 - DNA, 22 bp, Homo sapiens
cccactgtttccctgaggctct

SEQ ID NO: 39130 - DNA, 22 bp, Homo sapiens
gcctcctgagtagctgggattg

SEQ ID NO: 39131 - DNA, 22 bp, Homo sapiens
tggcaatgttagcaaagcattt

SEQ ID NO: 39132 - DNA, 22 bp, Homo sapiens
cccagagcatgtgctgcctttg

SEQ ID NO: 39133 - DNA, 22 bp, Homo sapiens
gccactgagcccggccattgtt

SEQ ID NO: 39134 - DNA, 22 bp, Homo sapiens
gggggagagacgagcggctctg

SEQ ID NO: 39135 - DNA, 19 bp, Homo sapiens
tccagatgatatggattac

SEQ ID NO: 39136 - DNA, 22 bp, Homo sapiens
agagggcattaactctgtcttg

SEQ ID NO: 39137 - DNA, 22 bp, Homo sapiens
gctcaagccttctgcccacctc

SEQ ID NO: 39138 - DNA, 22 bp, Homo sapiens
aggggcgtgctcttccccgacg

SEQ ID NO: 39139 - DNA, 22 bp, Homo sapiens
gaggcaggaggattgcttgagc

SEQ ID NO: 39140 - DNA, 20 bp, Homo sapiens
gggcagagccagccagtccc

SEQ ID NO: 39141 - DNA, 22 bp, Homo sapiens
ttattttaccttcctctgagct

SEQ ID NO: 39142 - DNA, 22 bp, Homo sapiens
tttgttttcaatgtgtcattca

SEQ ID NO: 39143 - DNA, 22 bp, Homo sapiens
ggttcccggatctccgagtccc

SEQ ID NO: 39144 - DNA, 22 bp, Homo sapiens
tttgtcttatccaatctctcag

SEQ ID NO: 39145 - DNA, 20 bp, Homo sapiens
ctgccgaccacagccatgga

SEQ ID NO: 39146 - DNA, 19 bp, Homo sapiens
ggggcctgtgatggtcaca

SEQ ID NO: 39147 - DNA, 22 bp, Homo sapiens
ggtttgttggggtccaggccca

SEQ ID NO: 39148 - DNA, 22 bp, Homo sapiens
gtgaaatatttaacgtccaggt

SEQ ID NO: 39149 - DNA, 22 bp, Homo sapiens
agcgccactgcactccagcctg

SEQ ID NO: 39150 - DNA, 22 bp, Homo sapiens
tcttttgtgattctttagttac

SEQ ID NO: 39151 - DNA, 22 bp, Homo sapiens
agtcccaacagcttacaaggaa

SEQ ID NO: 39152 - DNA, 22 bp, Homo sapiens
cctagagctctgctttatctaa

SEQ ID NO: 39153 - DNA, 22 bp, Homo sapiens
agtcaaagatgaccgagttcct

SEQ ID NO: 39154 - DNA, 22 bp, Homo sapiens
atcctagaatcagcccttgctg

SEQ ID NO: 39155 - DNA, 23 bp, Homo sapiens
ggctgggagctccgggtgcacgt

SEQ ID NO: 39156 - DNA, 22 bp, Homo sapiens
cctcgcggcactcgggccggat

SEQ ID NO: 39157 - DNA, 22 bp, Homo sapiens
gagaaatgcatgcatgtcatca

SEQ ID NO: 39158 - DNA, 22 bp, Homo sapiens
cccaggccccagggcttgtcag

SEQ ID NO: 39159 - DNA, 22 bp, Homo sapiens
ccaaagtgctaggattacaggt

SEQ ID NO: 39160 - DNA, 21 bp, Homo sapiens
tccttcagtctagatgattgt

SEQ ID NO: 39161 - DNA, 22 bp, Homo sapiens
gaaagagaacctgggcctagat

SEQ ID NO: 39162 - DNA, 22 bp, Homo sapiens
ggccgtgctccaaagtcatcgt

SEQ ID NO: 39163 - DNA, 22 bp, Homo sapiens
tgccatggcctagacctgtgat

SEQ ID NO: 39164 - DNA, 22 bp, Homo sapiens
tagcataacaggtaagagtgag

SEQ ID NO: 39165 - DNA, 22 bp, Homo sapiens
acctcctggcctcaagcaatcc

SEQ ID NO: 39166 - DNA, 22 bp, Homo sapiens
ggcagagcttgcagtgagccga

SEQ ID NO: 39167 - DNA, 22 bp, Homo sapiens
tcctgccttgcctgggacatca

SEQ ID NO: 39168 - DNA, 22 bp, Homo sapiens
tcgcgggttgcacatggccatc

SEQ ID NO: 39169 - DNA, 22 bp, Homo sapiens
aatcggttgaacccaggaagtg

SEQ ID NO: 39170 - DNA, 22 bp, Homo sapiens
gagacgtggcctttgcctgagc

SEQ ID NO: 39171 - DNA, 22 bp, Homo sapiens
gcctgctcccagttggcgcctc

SEQ ID NO: 39172 - DNA, 22 bp, Homo sapiens
tcaaatgaagacagttgacttg

SEQ ID NO: 39173 - DNA, 22 bp, Homo sapiens
gcaaatgctaaagtgtagagac

SEQ ID NO: 39174 - DNA, 22 bp, Homo sapiens
gcagctgacatctggctgggcc

SEQ ID NO: 39175 - DNA, 22 bp, Homo sapiens
tgctccatgcgctcggccggcg

SEQ ID NO: 39176 - DNA, 22 bp, Homo sapiens
aggctatttccactcttctcat

SEQ ID NO: 39177 - DNA, 22 bp, Homo sapiens
atctggttttggctgtgtccct

SEQ ID NO: 39178 - DNA, 22 bp, Homo sapiens
cggggttcatccatgctgtggc

SEQ ID NO: 39179 - DNA, 22 bp, Homo sapiens
tgtgacctcatcttaactggaa

SEQ ID NO: 39180 - DNA, 22 bp, Homo sapiens
cagggcctcctaaggcatctaa

SEQ ID NO: 39181 - DNA, 22 bp, Homo sapiens
atgtttaaagggttgagaaata

SEQ ID NO: 39182 - DNA, 22 bp, Homo sapiens
tggagccagagcgcagcctggg

SEQ ID NO: 39183 - DNA, 21 bp, Homo sapiens
tcttttctcagctttgtggtt

SEQ ID NO: 39184 - DNA, 22 bp, Homo sapiens
actgccaatggtagtttgatgg

SEQ ID NO: 39185 - DNA, 19 bp, Homo sapiens
tggctctgtcgaaggcaca

SEQ ID NO: 39186 - DNA, 22 bp, Homo sapiens
ggtgctggacacgtggcactcc

SEQ ID NO: 39187 - DNA, 22 bp, Homo sapiens
tttcttcctgctttgtcccatg

SEQ ID NO: 39188 - DNA, 22 bp, Homo sapiens
ctggcaggttatagagctgccc

SEQ ID NO: 39189 - DNA, 22 bp, Homo sapiens
ttcttcatgggttcttttagga

SEQ ID NO: 39190 - DNA, 22 bp, Homo sapiens
acacagggctgcgcctgacccc

SEQ ID NO: 39191 - DNA, 22 bp, Homo sapiens
tgtctttgttattgtggacagg

SEQ ID NO: 39192 - DNA, 19 bp, Homo sapiens
gatgctcattcaggtggaa

SEQ ID NO: 39193 - DNA, 22 bp, Homo sapiens
ggagtgactcacagctgggaca

SEQ ID NO: 39194 - DNA, 22 bp, Homo sapiens
gaggtggccaagcgaggaaggg

SEQ ID NO: 39195 - DNA, 20 bp, Homo sapiens
cagcctgcatcatctgcagc

SEQ ID NO: 39196 - DNA, 22 bp, Homo sapiens
ccctcccagatgggcttgaggt

SEQ ID NO: 39197 - DNA, 22 bp, Homo sapiens
ccaggaggcggaggttgcagtg

SEQ ID NO: 39198 - DNA, 19 bp, Homo sapiens
acccagcccaggagtggca

SEQ ID NO: 39199 - DNA, 22 bp, Homo sapiens
ctgaggagaggtggcctgtgtt

SEQ ID NO: 39200 - DNA, 22 bp, Homo sapiens
ccacccttgggttcggaggccg

SEQ ID NO: 39201 - DNA, 22 bp, Homo sapiens
gatgatcatctgtaaagttaga

SEQ ID NO: 39202 - DNA, 22 bp, Homo sapiens
tttctcttcactgtgtgcctca

SEQ ID NO: 39203 - DNA, 22 bp, Homo sapiens
gagatcggtaaagagcatgcac

SEQ ID NO: 39204 - DNA, 22 bp, Homo sapiens
tcaatgtgaattaagaatactt

SEQ ID NO: 39205 - DNA, 22 bp, Homo sapiens
cacagtcctgccagagggcctt

SEQ ID NO: 39206 - DNA, 22 bp, Homo sapiens
gtggctgcagcggctgtggaga

SEQ ID NO: 39207 - DNA, 22 bp, Homo sapiens
atgaaatatcttgaagaaattc

SEQ ID NO: 39208 - DNA, 22 bp, Homo sapiens
ccacagtcctggcttctgtctg

SEQ ID NO: 39209 - DNA, 22 bp, Homo sapiens
tgccgtggggctgaggctggag

SEQ ID NO: 39210 - DNA, 22 bp, Homo sapiens
tatcagcgtgcaaatctttgga

SEQ ID NO: 39211 - DNA, 22 bp, Homo sapiens
cggggacacactggcagctcct

SEQ ID NO: 39212 - DNA, 22 bp, Homo sapiens
tcggggtctttgacacgctctg

SEQ ID NO: 39213 - DNA, 22 bp, Homo sapiens
ttgtgctgtgagaatgctcatt

SEQ ID NO: 39214 - DNA, 22 bp, Homo sapiens
agggctgcccagtgtgagagct

SEQ ID NO: 39215 - DNA, 17 bp, Homo sapiens
tccttcagtgcctctgc

SEQ ID NO: 39216 - DNA, 22 bp, Homo sapiens
ggagtgactctcggggccacta

SEQ ID NO: 39217 - DNA, 22 bp, Homo sapiens
cccctcgcctgcagagcacagc

SEQ ID NO: 39218 - DNA, 19 bp, Homo sapiens
ccatggcaatgatctgatg

SEQ ID NO: 39219 - DNA, 22 bp, Homo sapiens
gccgtgtcatctgcgggtggca

SEQ ID NO: 39220 - DNA, 22 bp, Homo sapiens
ggtgacctcacctggtcccacc

SEQ ID NO: 39221 - DNA, 20 bp, Homo sapiens
aaaatatgtataactcttct

SEQ ID NO: 39222 - DNA, 22 bp, Homo sapiens
ctgctccccagcctgcgccttt

SEQ ID NO: 39223 - DNA, 22 bp, Homo sapiens
gagacacaggcacagaagaggc

SEQ ID NO: 39224 - DNA, 22 bp, Homo sapiens
tagtttcatctccaccctgccc

SEQ ID NO: 39225 - DNA, 22 bp, Homo sapiens
gagagaagggggatatgagcct

SEQ ID NO: 39226 - DNA, 22 bp, Homo sapiens
aatgccagtgtgttgattccag

SEQ ID NO: 39227 - DNA, 22 bp, Homo sapiens
gagccaggttggaggctgcagt

SEQ ID NO: 39228 - DNA, 22 bp, Homo sapiens
tgtctctgtgactccttccgcc

SEQ ID NO: 39229 - DNA, 22 bp, Homo sapiens
ggctgggcctctccctcagctg

SEQ ID NO: 39230 - DNA, 22 bp, Homo sapiens
ggtgagcagctgtctgtatgga

SEQ ID NO: 39231 - DNA, 22 bp, Homo sapiens
gagctctgactgctgggtgaca

SEQ ID NO: 39232 - DNA, 22 bp, Homo sapiens
caggctggagttcagtggtgtg

SEQ ID NO: 39233 - DNA, 22 bp, Homo sapiens
ttgacctatgtttcttcatctg

SEQ ID NO: 39234 - DNA, 22 bp, Homo sapiens
ttatttttaaaagttcacacag

SEQ ID NO: 39235 - DNA, 14 bp, Homo sapiens
aagatcaccttcct

SEQ ID NO: 39236 - DNA, 22 bp, Homo sapiens
cacagctgaagtagccatgtgg

SEQ ID NO: 39237 - DNA, 19 bp, Homo sapiens
aggagcactgccagcacca

SEQ ID NO: 39238 - DNA, 22 bp, Homo sapiens
atatatttgagaatattcatga

SEQ ID NO: 39239 - DNA, 22 bp, Homo sapiens
agtgctgggctatctactgcta

SEQ ID NO: 39240 - DNA, 20 bp, Homo sapiens
tgtggtttttgccagttgaa

SEQ ID NO: 39241 - DNA, 22 bp, Homo sapiens
acagattcactgcactggccat

SEQ ID NO: 39242 - DNA, 22 bp, Homo sapiens
aggagccagtggagttcctgcc

SEQ ID NO: 39243 - DNA, 22 bp, Homo sapiens
gaggagggagctggaagctctt

SEQ ID NO: 39244 - DNA, 22 bp, Homo sapiens
cctcctgcacctccaggaactc

SEQ ID NO: 39245 - DNA, 22 bp, Homo sapiens
aagttactggcaagggctgcag

SEQ ID NO: 39246 - DNA, 22 bp, Homo sapiens
ggagagggtaggggtcctgccc

SEQ ID NO: 39247 - DNA, 22 bp, Homo sapiens
gagatggagtctttttctgtca

SEQ ID NO: 39248 - DNA, 22 bp, Homo sapiens
ccggcgtctcttccacttccta

SEQ ID NO: 39249 - DNA, 19 bp, Homo sapiens
ctctggagtcattgctccc

SEQ ID NO: 39250 - DNA, 20 bp, Homo sapiens
aggaaaaatggaaactggag

SEQ ID NO: 39251 - DNA, 22 bp, Homo sapiens
caggcagaagaagtggaaggac

SEQ ID NO: 39252 - DNA, 22 bp, Homo sapiens
ccacctgagataagagagctca

SEQ ID NO: 39253 - DNA, 22 bp, Homo sapiens
cagtggaggccttgggaccttt

SEQ ID NO: 39254 - DNA, 22 bp, Homo sapiens
cacccaggcaaggattctgcaa

SEQ ID NO: 39255 - DNA, 20 bp, Homo sapiens
ccagagctgatggctgcccg

SEQ ID NO: 39256 - DNA, 22 bp, Homo sapiens
tggatctcggcaatgcgggact

SEQ ID NO: 39257 - DNA, 22 bp, Homo sapiens
taattgtaaagtagtagtacag

SEQ ID NO: 39258 - DNA, 22 bp, Homo sapiens
tgcactccaggctgggtgacag

SEQ ID NO: 39259 - DNA, 22 bp, Homo sapiens
tccttcagcctcccagctcaaa

SEQ ID NO: 39260 - DNA, 22 bp, Homo sapiens
ttggcttttatgcagcttaggt

SEQ ID NO: 39261 - DNA, 22 bp, Homo sapiens
gcacctgcctgggactgaagat

SEQ ID NO: 39262 - DNA, 22 bp, Homo sapiens
tgggggtgtcctggtgcacaca

SEQ ID NO: 39263 - DNA, 22 bp, Homo sapiens
ttgagggtctggatctgctgct

SEQ ID NO: 39264 - DNA, 23 bp, Homo sapiens
aaataggagtatctggatcatga

SEQ ID NO: 39265 - DNA, 19 bp, Homo sapiens
gactcacaccttccgctgt

SEQ ID NO: 39266 - DNA, 22 bp, Homo sapiens
gaatttcctctaaacccctgag

SEQ ID NO: 39267 - DNA, 19 bp, Homo sapiens
ctgctgccggagactcgtc

SEQ ID NO: 39268 - DNA, 22 bp, Homo sapiens
tggggagtgatgcctcggataa

SEQ ID NO: 39269 - DNA, 22 bp, Homo sapiens
tcactgcactccagcactcagg

SEQ ID NO: 39270 - DNA, 22 bp, Homo sapiens
tcagtgatttctggggtgaggg

SEQ ID NO: 39271 - DNA, 22 bp, Homo sapiens
gctgtctcatacaaggccctgc

SEQ ID NO: 39272 - DNA, 21 bp, Homo sapiens
tctgatggtagatgagatgtg

SEQ ID NO: 39273 - DNA, 20 bp, Homo sapiens
atggggtgagtgacgccctc

SEQ ID NO: 39274 - DNA, 22 bp, Homo sapiens
ccctcccaggagtggccagaga

SEQ ID NO: 39275 - DNA, 22 bp, Homo sapiens
tgcaccctcatcagtcaaatgg

SEQ ID NO: 39276 - DNA, 22 bp, Homo sapiens
cagggggctcaaaggagagtgc

SEQ ID NO: 39277 - DNA, 22 bp, Homo sapiens
cgccaggcttggtagctcatgc

SEQ ID NO: 39278 - DNA, 22 bp, Homo sapiens
gagtcgagcagaaagccgtcgg

SEQ ID NO: 39279 - DNA, 22 bp, Homo sapiens
acaggcttacaggctgcaagta

SEQ ID NO: 39280 - DNA, 22 bp, Homo sapiens
ggtgtagctctgtgtcccactg

SEQ ID NO: 39281 - DNA, 22 bp, Homo sapiens
ctgccctttgaaagaacgtctt

SEQ ID NO: 39282 - DNA, 22 bp, Homo sapiens
ctgcagtctacctggattttta

SEQ ID NO: 39283 - DNA, 22 bp, Homo sapiens
ctctggagtgtctggccagggt

SEQ ID NO: 39284 - DNA, 22 bp, Homo sapiens
agaagccaccagctgaggaaga

SEQ ID NO: 39285 - DNA, 22 bp, Homo sapiens
ctggctgggagcgagctgctca

SEQ ID NO: 39286 - DNA, 22 bp, Homo sapiens
ataaaatttgctactgttaaat

SEQ ID NO: 39287 - DNA, 22 bp, Homo sapiens
ctggcttttttcccattatgca

SEQ ID NO: 39288 - DNA, 22 bp, Homo sapiens
agggaattcactggaacgccct

SEQ ID NO: 39289 - DNA, 22 bp, Homo sapiens
tcccagtttttctccactaagg

SEQ ID NO: 39290 - DNA, 22 bp, Homo sapiens
ggaggtggaggttgcagtgagc

SEQ ID NO: 39291 - DNA, 22 bp, Homo sapiens
ctgagggtcaacttgattgtat

SEQ ID NO: 39292 - DNA, 22 bp, Homo sapiens
actgcactccaacctgggtgac

SEQ ID NO: 39293 - DNA, 22 bp, Homo sapiens
atgcacctgaactccatcagct

SEQ ID NO: 39294 - DNA, 22 bp, Homo sapiens
atgccactgcactccagcctgg

SEQ ID NO: 39295 - DNA, 22 bp, Homo sapiens
tagtatagattgaagcagatca

SEQ ID NO: 39296 - DNA, 22 bp, Homo sapiens
atgttgtgtttgactgttaccc

SEQ ID NO: 39297 - DNA, 22 bp, Homo sapiens
aaggagaaatggtagatgtgca

SEQ ID NO: 39298 - DNA, 22 bp, Homo sapiens
ttcctagggcagagccgctggg

SEQ ID NO: 39299 - DNA, 22 bp, Homo sapiens
tcaccgaggctggagtgcagtg

SEQ ID NO: 39300 - DNA, 22 bp, Homo sapiens
cccagcaggtcggtgctgcctg

SEQ ID NO: 39301 - DNA, 22 bp, Homo sapiens
ctgggaggcggaggttgtagtg

SEQ ID NO: 39302 - DNA, 21 bp, Homo sapiens
ccaccaggtcttctgctcggg

SEQ ID NO: 39303 - DNA, 18 bp, Homo sapiens
acacttcctggtggtgtg

SEQ ID NO: 39304 - DNA, 22 bp, Homo sapiens
tcagggattgcaaaattcatcc

SEQ ID NO: 39305 - DNA, 22 bp, Homo sapiens
gtccaagagtcaagaagggggc

SEQ ID NO: 39306 - DNA, 22 bp, Homo sapiens
aaggagtggggcatatcacaga

SEQ ID NO: 39307 - DNA, 18 bp, Homo sapiens
ccgggctttggtgacaca

SEQ ID NO: 39308 - DNA, 22 bp, Homo sapiens
ttgcccaggctggagtgcagtg

SEQ ID NO: 39309 - DNA, 22 bp, Homo sapiens
ccctgccttgtctgggctaggt

SEQ ID NO: 39310 - DNA, 22 bp, Homo sapiens
atatgtggcattatttctgagg

SEQ ID NO: 39311 - DNA, 22 bp, Homo sapiens
aagtccaggtcctcattccatc

SEQ ID NO: 39312 - DNA, 22 bp, Homo sapiens
gcctgttctccagcatccaggt

SEQ ID NO: 39313 - DNA, 22 bp, Homo sapiens
gaggtgggcggatcacaaggtc

SEQ ID NO: 39314 - DNA, 22 bp, Homo sapiens
tggaggagaccgcattttattt

SEQ ID NO: 39315 - DNA, 22 bp, Homo sapiens
ccaaagtgctgagattacaggt

SEQ ID NO: 39316 - DNA, 22 bp, Homo sapiens
ggaagggcaaaagagatgaact

SEQ ID NO: 39317 - DNA, 22 bp, Homo sapiens
caggcaggtcagtgaagaagga

SEQ ID NO: 39318 - DNA, 22 bp, Homo sapiens
gatagtcacctcccttaacttt

SEQ ID NO: 39319 - DNA, 22 bp, Homo sapiens
gagggaaaggttaatacatgat

SEQ ID NO: 39320 - DNA, 22 bp, Homo sapiens
gcaggctgtctaaagttagagt

SEQ ID NO: 39321 - DNA, 22 bp, Homo sapiens
tcactgcaagctcctcctcctg

SEQ ID NO: 39322 - DNA, 22 bp, Homo sapiens
aaatgtggggctggaggcagga

SEQ ID NO: 39323 - DNA, 22 bp, Homo sapiens
tccaagatctacagcagtttag

SEQ ID NO: 39324 - DNA, 22 bp, Homo sapiens
agtggcctggagccccgcctgg

SEQ ID NO: 39325 - DNA, 23 bp, Homo sapiens
ggcctcagtgatgatgggttaaa

SEQ ID NO: 39326 - DNA, 22 bp, Homo sapiens
aggaggggttctcgggtgctga

SEQ ID NO: 39327 - DNA, 22 bp, Homo sapiens
aatgccttggagagcctagagg

SEQ ID NO: 39328 - DNA, 22 bp, Homo sapiens
tgccacctgtacatgctatctg

SEQ ID NO: 39329 - DNA, 22 bp, Homo sapiens
ggcttttgtttcagctctgcta

SEQ ID NO: 39330 - DNA, 22 bp, Homo sapiens
ggccagcctggggctcccagac

SEQ ID NO: 39331 - DNA, 22 bp, Homo sapiens
actgcactccagcccgagcaac

SEQ ID NO: 39332 - DNA, 22 bp, Homo sapiens
tcttttgtgattcttcagttac

SEQ ID NO: 39333 - DNA, 21 bp, Homo sapiens
gcagcagtgttctagaatact

SEQ ID NO: 39334 - DNA, 22 bp, Homo sapiens
atggggctgttctctgccctgc

SEQ ID NO: 39335 - DNA, 22 bp, Homo sapiens
tctcaagcttgttggtatgttt

SEQ ID NO: 39336 - DNA, 22 bp, Homo sapiens
gagaacagaagcattcctaatt

SEQ ID NO: 39337 - DNA, 22 bp, Homo sapiens
tgggccgtggagcactctgaga

SEQ ID NO: 39338 - DNA, 22 bp, Homo sapiens
aggtgcttggctcgtgcacaca

SEQ ID NO: 39339 - DNA, 23 bp, Homo sapiens
ctggggctttcaaatctgggcag

SEQ ID NO: 39340 - DNA, 22 bp, Homo sapiens
cattctgcgatcctcaagcaca

SEQ ID NO: 39341 - DNA, 22 bp, Homo sapiens
gtaatctcagctacttgggagg

SEQ ID NO: 39342 - DNA, 22 bp, Homo sapiens
tccagctctgctgtgcgccggt

SEQ ID NO: 39343 - DNA, 20 bp, Homo sapiens
acgtggccaccagtggctta

SEQ ID NO: 39344 - DNA, 22 bp, Homo sapiens
agcagagcaaagctcagaaatg

SEQ ID NO: 39345 - DNA, 22 bp, Homo sapiens
agttgcagacgcagagatgttg

SEQ ID NO: 39346 - DNA, 22 bp, Homo sapiens
ctcataaggagctcacaaccta

SEQ ID NO: 39347 - DNA, 22 bp, Homo sapiens
tgccaggcgtggtggtgcgcac

SEQ ID NO: 39348 - DNA, 22 bp, Homo sapiens
aggtattattagcatctctatt

SEQ ID NO: 39349 - DNA, 22 bp, Homo sapiens
tccttgtaaaggagctctaaca

SEQ ID NO: 39350 - DNA, 22 bp, Homo sapiens
aggactgggtgcagagggcatc

SEQ ID NO: 39351 - DNA, 20 bp, Homo sapiens
cagcagtggatgagagtttt

SEQ ID NO: 39352 - DNA, 22 bp, Homo sapiens
acaggggaatttactgtcatta

SEQ ID NO: 39353 - DNA, 22 bp, Homo sapiens
cttcttgctgggggcctcagtg

SEQ ID NO: 39354 - DNA, 22 bp, Homo sapiens
ggggatggaggcgtgtggtcct

SEQ ID NO: 39355 - DNA, 22 bp, Homo sapiens
cagggtgccaaagaacaaatat

SEQ ID NO: 39356 - DNA, 22 bp, Homo sapiens
tttctggcagcgggacaggggt

SEQ ID NO: 39357 - DNA, 22 bp, Homo sapiens
ctctggaggtggaggttgcagt

SEQ ID NO: 39358 - DNA, 22 bp, Homo sapiens
ccaaagtgctgggattacaggc

SEQ ID NO: 39359 - DNA, 22 bp, Homo sapiens
tgagccatgggactccaaggga

SEQ ID NO: 39360 - DNA, 22 bp, Homo sapiens
aagatgcggttgaccatggtgt

SEQ ID NO: 39361 - DNA, 22 bp, Homo sapiens
aaggccctggcaggaagcagga

SEQ ID NO: 39362 - DNA, 21 bp, Homo sapiens
cactccacttagaacagggtt

SEQ ID NO: 39363 - DNA, 22 bp, Homo sapiens
cagtgcagccaaggacaggcac

SEQ ID NO: 39364 - DNA, 22 bp, Homo sapiens
tgttcttgagcctttagaccta

SEQ ID NO: 39365 - DNA, 22 bp, Homo sapiens
tgacctattagatttccttgcc

SEQ ID NO: 39366 - DNA, 22 bp, Homo sapiens
cggggccctggggctgaaggtc

SEQ ID NO: 39367 - DNA, 22 bp, Homo sapiens
cagcatgaatgtgttcgtaggg

SEQ ID NO: 39368 - DNA, 22 bp, Homo sapiens
cttctcggccgtgtggatgcgc

SEQ ID NO: 39369 - DNA, 22 bp, Homo sapiens
gctgtctgtcttcacatctcgc

SEQ ID NO: 39370 - DNA, 22 bp, Homo sapiens
accctccccaagaggtcgtgcc

SEQ ID NO: 39371 - DNA, 22 bp, Homo sapiens
gagaagtcatttgaccacctag

SEQ ID NO: 39372 - DNA, 22 bp, Homo sapiens
aggggtgaaagagggccctcaa

SEQ ID NO: 39373 - DNA, 22 bp, Homo sapiens
cccacgtcgaacttgctccaga

SEQ ID NO: 39374 - DNA, 22 bp, Homo sapiens
tgtccttcttgtcttgcccaaa

SEQ ID NO: 39375 - DNA, 22 bp, Homo sapiens
tggagggcatgctgtccatggg

SEQ ID NO: 39376 - DNA, 22 bp, Homo sapiens
agggtgaatctcacaactctta

SEQ ID NO: 39377 - DNA, 22 bp, Homo sapiens
ggcctcgcggcttctggtggct

SEQ ID NO: 39378 - DNA, 22 bp, Homo sapiens
gcagcctcaaactccccagctc

SEQ ID NO: 39379 - DNA, 22 bp, Homo sapiens
tgaaatgtgtaatgtggatgcc

SEQ ID NO: 39380 - DNA, 22 bp, Homo sapiens
gggactggagtagaggccggtg

SEQ ID NO: 39381 - DNA, 22 bp, Homo sapiens
ttatttaaaagtggtaagattc

SEQ ID NO: 39382 - DNA, 22 bp, Homo sapiens
gtgtttggtcagacgtccgggg

SEQ ID NO: 39383 - DNA, 22 bp, Homo sapiens
agtccaaagcagatgagggcca

SEQ ID NO: 39384 - DNA, 22 bp, Homo sapiens
agttgggtttgtgtcagttgca

SEQ ID NO: 39385 - DNA, 22 bp, Homo sapiens
tcaaagtccttgctttttctgt

SEQ ID NO: 39386 - DNA, 23 bp, Homo sapiens
ggggcctgcaccggtctgcgcgg

SEQ ID NO: 39387 - DNA, 22 bp, Homo sapiens
gctgcagtgagccaagatcgtg

SEQ ID NO: 39388 - DNA, 22 bp, Homo sapiens
agggcagagctgtctaaatggc

SEQ ID NO: 39389 - DNA, 22 bp, Homo sapiens
gagagagctctgtgcctgggat

SEQ ID NO: 39390 - DNA, 22 bp, Homo sapiens
ggggtgggcgtgcagggacacc

SEQ ID NO: 39391 - DNA, 22 bp, Homo sapiens
ccaggaggttgaggctgcagtg

SEQ ID NO: 39392 - DNA, 22 bp, Homo sapiens
ggtccccgtggaggctggagcg

SEQ ID NO: 39393 - DNA, 22 bp, Homo sapiens
tgaatgtgatgctaaacatatg

SEQ ID NO: 39394 - DNA, 22 bp, Homo sapiens
gaccctctagatggaagcactg

SEQ ID NO: 39395 - DNA, 22 bp, Homo sapiens
attttttgttaactcaggatag

SEQ ID NO: 39396 - DNA, 22 bp, Homo sapiens
gcggcctgcgctgctcccgacg

SEQ ID NO: 39397 - DNA, 23 bp, Homo sapiens
ctgtggtgaggccctagaatctg

SEQ ID NO: 39398 - DNA, 22 bp, Homo sapiens
agcccaggctggagtgcagtgg

SEQ ID NO: 39399 - DNA, 22 bp, Homo sapiens
ctggagggctgcagcgaggctg

SEQ ID NO: 39400 - DNA, 22 bp, Homo sapiens
tccaactttctcctccggcttg

SEQ ID NO: 39401 - DNA, 22 bp, Homo sapiens
attaatgaaactttggttaagc

SEQ ID NO: 39402 - DNA, 22 bp, Homo sapiens
caccaggctggagtgcagtggc

SEQ ID NO: 39403 - DNA, 22 bp, Homo sapiens
actccacaccacgggggccgcc

SEQ ID NO: 39404 - DNA, 22 bp, Homo sapiens
ggtggctgcaatggctaacttc

SEQ ID NO: 39405 - DNA, 22 bp, Homo sapiens
aacatagaataaatgagttagg

SEQ ID NO: 39406 - DNA, 22 bp, Homo sapiens
ctgggtggcagagcctgcagtg

SEQ ID NO: 39407 - DNA, 22 bp, Homo sapiens
tttattctgtgctacatgaaga

SEQ ID NO: 39408 - DNA, 23 bp, Homo sapiens
tgttccagatacgccttttcctc

SEQ ID NO: 39409 - DNA, 22 bp, Homo sapiens
aatgagatggaattcccgccta

SEQ ID NO: 39410 - DNA, 17 bp, Homo sapiens
tggctctgtcctcagct

SEQ ID NO: 39411 - DNA, 22 bp, Homo sapiens
aggagaagccaagttgtgagca

SEQ ID NO: 39412 - DNA, 22 bp, Homo sapiens
aggcaggaggatcatggatgca

SEQ ID NO: 39413 - DNA, 22 bp, Homo sapiens
cggctggtgtcgggcacagcaa

SEQ ID NO: 39414 - DNA, 22 bp, Homo sapiens
ctgcatccatgttgctgcaaag

SEQ ID NO: 39415 - DNA, 21 bp, Homo sapiens
gctgctcgagatccagtgctt

SEQ ID NO: 39416 - DNA, 22 bp, Homo sapiens
aataaaatggtcagttttctca

SEQ ID NO: 39417 - DNA, 22 bp, Homo sapiens
ctgtcaggttggtctcagagct

SEQ ID NO: 39418 - DNA, 16 bp, Homo sapiens
gaggagcccctctgcc

SEQ ID NO: 39419 - DNA, 22 bp, Homo sapiens
gaggcagaggttgcagtgagct

SEQ ID NO: 39420 - DNA, 22 bp, Homo sapiens
gtctctatcatagctgaaccct

SEQ ID NO: 39421 - DNA, 22 bp, Homo sapiens
ccggctcggcgaccaggctgaa

SEQ ID NO: 39422 - DNA, 22 bp, Homo sapiens
ttgtatagcccagagagtgaga

SEQ ID NO: 39423 - DNA, 22 bp, Homo sapiens
aacttaggaaaataaggcatga

SEQ ID NO: 39424 - DNA, 22 bp, Homo sapiens
gtgggggcaggcagtgctagga

SEQ ID NO: 39425 - DNA, 22 bp, Homo sapiens
agtcttcccagaggaggtgcca

SEQ ID NO: 39426 - DNA, 22 bp, Homo sapiens
gcagagccatgggaggtttttg

SEQ ID NO: 39427 - DNA, 22 bp, Homo sapiens
tgtgactggttgtcccgctttc

SEQ ID NO: 39428 - DNA, 22 bp, Homo sapiens
caggcagggagctggaaaggat

SEQ ID NO: 39429 - DNA, 22 bp, Homo sapiens
tggagacacaggaccagactgc

SEQ ID NO: 39430 - DNA, 22 bp, Homo sapiens
gttctgagtcctcctttgaagg

SEQ ID NO: 39431 - DNA, 22 bp, Homo sapiens
tctgacattttgagaatgacat

SEQ ID NO: 39432 - DNA, 22 bp, Homo sapiens
aaggagtctgggccattcagag

SEQ ID NO: 39433 - DNA, 22 bp, Homo sapiens
tgagccgtggtctctgagggtg

SEQ ID NO: 39434 - DNA, 22 bp, Homo sapiens
tgtggacgtcattaaagcagtg

SEQ ID NO: 39435 - DNA, 22 bp, Homo sapiens
ctgtcctggggaaagccagccc

SEQ ID NO: 39436 - DNA, 22 bp, Homo sapiens
ccttttgctctcccatccagaa

SEQ ID NO: 39437 - DNA, 22 bp, Homo sapiens
gctgctctcagagctcatgctg

SEQ ID NO: 39438 - DNA, 22 bp, Homo sapiens
gttgagtgggttaggatgctga

SEQ ID NO: 39439 - DNA, 22 bp, Homo sapiens
aaggctcggcaatgtgcggctc

SEQ ID NO: 39440 - DNA, 22 bp, Homo sapiens
gggctgcatcagcaggacccgg

SEQ ID NO: 39441 - DNA, 22 bp, Homo sapiens
ttggcgcccaggacgccgccgc

SEQ ID NO: 39442 - DNA, 22 bp, Homo sapiens
cactgggcgtgtcctgggtgag

SEQ ID NO: 39443 - DNA, 22 bp, Homo sapiens
tttgaagactactgggagtgaa

SEQ ID NO: 39444 - DNA, 22 bp, Homo sapiens
cagcagcagtggctgcagaaca

SEQ ID NO: 39445 - DNA, 19 bp, Homo sapiens
ttgacgttgtggaattaac

SEQ ID NO: 39446 - DNA, 23 bp, Homo sapiens
cagagctggcttcatgggtgtgc

SEQ ID NO: 39447 - DNA, 22 bp, Homo sapiens
tgctcttcacagtttcagcatc

SEQ ID NO: 39448 - DNA, 22 bp, Homo sapiens
gacagacacaattgatccatga

SEQ ID NO: 39449 - DNA, 22 bp, Homo sapiens
ggaggacaggggctgcagcaca

SEQ ID NO: 39450 - DNA, 22 bp, Homo sapiens
gctggtgagcaaaggagaagga

SEQ ID NO: 39451 - DNA, 22 bp, Homo sapiens
tccgcccgcacgtatggagtgg

SEQ ID NO: 39452 - DNA, 22 bp, Homo sapiens
acaggggattgattggaagtct

SEQ ID NO: 39453 - DNA, 22 bp, Homo sapiens
aaaatcctgctgactcgagatg

SEQ ID NO: 39454 - DNA, 22 bp, Homo sapiens
ccctgcctacagggttttcttt

SEQ ID NO: 39455 - DNA, 22 bp, Homo sapiens
gtgatctgccagcctcagcctc

SEQ ID NO: 39456 - DNA, 22 bp, Homo sapiens
cgtgcgcctcagcctcgtgcgc

SEQ ID NO: 39457 - DNA, 23 bp, Homo sapiens
ctcaaccctagtaagggagtagg

SEQ ID NO: 39458 - DNA, 22 bp, Homo sapiens
ccaaagtgctaggattacaggc

SEQ ID NO: 39459 - DNA, 22 bp, Homo sapiens
agtacccttttcactgtcacaa

SEQ ID NO: 39460 - DNA, 22 bp, Homo sapiens
tcactgcaacctccacctcctg

SEQ ID NO: 39461 - DNA, 22 bp, Homo sapiens
tcttgcacttcatgaatatgtt

SEQ ID NO: 39462 - DNA, 22 bp, Homo sapiens
caggaggttgagggtgcagtga

SEQ ID NO: 39463 - DNA, 22 bp, Homo sapiens
caaagtgctgggattacaggtg

SEQ ID NO: 39464 - DNA, 16 bp, Homo sapiens
cttgtctgttgctcat

SEQ ID NO: 39465 - DNA, 22 bp, Homo sapiens
ctgggaggtggaggttgcattg

SEQ ID NO: 39466 - DNA, 22 bp, Homo sapiens
gctggcagacttcctctggaac

SEQ ID NO: 39467 - DNA, 22 bp, Homo sapiens
ctctggaccctcctgctgagag

SEQ ID NO: 39468 - DNA, 22 bp, Homo sapiens
gcttaattctggctcagtttcc

SEQ ID NO: 39469 - DNA, 17 bp, Homo sapiens
gtaaggcttgcagatgc

SEQ ID NO: 39470 - DNA, 22 bp, Homo sapiens
agggaagaggaccagagtctct

SEQ ID NO: 39471 - DNA, 22 bp, Homo sapiens
tttgaaatgtatcagtataggt

SEQ ID NO: 39472 - DNA, 22 bp, Homo sapiens
gcctggccaacgtggtgaaacc

SEQ ID NO: 39473 - DNA, 22 bp, Homo sapiens
atgccactgcgctccagcctgg

SEQ ID NO: 39474 - DNA, 22 bp, Homo sapiens
cttgtattaggaagaatgcttt

SEQ ID NO: 39475 - DNA, 22 bp, Homo sapiens
actttatttcctattgcatcca

SEQ ID NO: 39476 - DNA, 22 bp, Homo sapiens
gcccagccacagtcactttcat

SEQ ID NO: 39477 - DNA, 22 bp, Homo sapiens
tgtgaaagatactaggcagagg

SEQ ID NO: 39478 - DNA, 22 bp, Homo sapiens
gtgcgccagctcaaggggaggc

SEQ ID NO: 39479 - DNA, 22 bp, Homo sapiens
gactttgtgccaaacgccagaa

SEQ ID NO: 39480 - DNA, 22 bp, Homo sapiens
caaagtgctaggattacaggcc

SEQ ID NO: 39481 - DNA, 22 bp, Homo sapiens
tagagctggccgggacagctgg

SEQ ID NO: 39482 - DNA, 22 bp, Homo sapiens
gagccaggtcgggccgcggcga

SEQ ID NO: 39483 - DNA, 22 bp, Homo sapiens
ggggcagagaataaaaacctaa

SEQ ID NO: 39484 - DNA, 22 bp, Homo sapiens
acagcagcaatagcagtgacat

SEQ ID NO: 39485 - DNA, 22 bp, Homo sapiens
tgtcttcgctacaatgaaaagg

SEQ ID NO: 39486 - DNA, 22 bp, Homo sapiens
aggtcaccatggcatgctccac

SEQ ID NO: 39487 - DNA, 22 bp, Homo sapiens
caggaaagggatgggctgccac

SEQ ID NO: 39488 - DNA, 22 bp, Homo sapiens
atggggagctcaccacctgttt

SEQ ID NO: 39489 - DNA, 22 bp, Homo sapiens
caggtggcagtgcctgcattct

SEQ ID NO: 39490 - DNA, 22 bp, Homo sapiens
tccacgtgagcttcgtgtgcag

SEQ ID NO: 39491 - DNA, 22 bp, Homo sapiens
cctgcctatgagacgttttgcc

SEQ ID NO: 39492 - DNA, 22 bp, Homo sapiens
gggcagagactcagaaacagaa

SEQ ID NO: 39493 - DNA, 23 bp, Homo sapiens
tgaggcaggcggatcacgaggtc

SEQ ID NO: 39494 - DNA, 22 bp, Homo sapiens
ctcgggcttgaggctgtttacc

SEQ ID NO: 39495 - DNA, 22 bp, Homo sapiens
ggcaggaggtgagtggcgggtg

SEQ ID NO: 39496 - DNA, 22 bp, Homo sapiens
ggcctacgccagtatccccagg

SEQ ID NO: 39497 - DNA, 22 bp, Homo sapiens
tggtatgaccgtggtgcaagca

SEQ ID NO: 39498 - DNA, 22 bp, Homo sapiens
agggaaattaatgtgagcaatg

SEQ ID NO: 39499 - DNA, 22 bp, Homo sapiens
acccaagttttccatgcctgtt

SEQ ID NO: 39500 - DNA, 22 bp, Homo sapiens
gggaggttgaggctgcagtgag

SEQ ID NO: 39501 - DNA, 22 bp, Homo sapiens
atttttctctttccactgagat

SEQ ID NO: 39502 - DNA, 23 bp, Homo sapiens
atgacactcctgtgcgcaccctg

SEQ ID NO: 39503 - DNA, 22 bp, Homo sapiens
atatattttttgagacagagtc

SEQ ID NO: 39504 - DNA, 22 bp, Homo sapiens
gctcccaccgccgctatgggta

SEQ ID NO: 39505 - DNA, 22 bp, Homo sapiens
atgtcttctctgtaggtaaatt

SEQ ID NO: 39506 - DNA, 22 bp, Homo sapiens
aggtgactggtttatctggcag

SEQ ID NO: 39507 - DNA, 22 bp, Homo sapiens
acacagagccaaaccatatcac

SEQ ID NO: 39508 - DNA, 22 bp, Homo sapiens
ggctcaatgcaacttctgcctc

SEQ ID NO: 39509 - DNA, 22 bp, Homo sapiens
cacccaggctggaatgcagtgg

SEQ ID NO: 39510 - DNA, 23 bp, Homo sapiens
aatgggtgcaactatccatgaca

SEQ ID NO: 39511 - DNA, 22 bp, Homo sapiens
gtccccgacgtttggcttgatg

SEQ ID NO: 39512 - DNA, 22 bp, Homo sapiens
ctcagggccaaggatgctgttg

SEQ ID NO: 39513 - DNA, 22 bp, Homo sapiens
agcctctctgttagtcactggg

SEQ ID NO: 39514 - DNA, 22 bp, Homo sapiens
agcccaggttgaggctgcagtg

SEQ ID NO: 39515 - DNA, 20 bp, Homo sapiens
attagagctacatggctaca

SEQ ID NO: 39516 - DNA, 22 bp, Homo sapiens
gccagggttcgaatccgtatgg

SEQ ID NO: 39517 - DNA, 22 bp, Homo sapiens
tgagctgtagcagatgctgttg

SEQ ID NO: 39518 - DNA, 22 bp, Homo sapiens
ttgtgctctgtgttatttaagg

SEQ ID NO: 39519 - DNA, 22 bp, Homo sapiens
gggtaattggggccttgcagtg

SEQ ID NO: 39520 - DNA, 22 bp, Homo sapiens
atgagctcatccgagtcacact

SEQ ID NO: 39521 - DNA, 22 bp, Homo sapiens
tggctcctcacgtcctcagagc

SEQ ID NO: 39522 - DNA, 22 bp, Homo sapiens
cagagctggtgtgtcctggcat

SEQ ID NO: 39523 - DNA, 22 bp, Homo sapiens
attctcaaaacataacttcact

SEQ ID NO: 39524 - DNA, 22 bp, Homo sapiens
tgtggcttaagaatgcctttaa

SEQ ID NO: 39525 - DNA, 22 bp, Homo sapiens
tagcttatcccacagtgcccag

SEQ ID NO: 39526 - DNA, 22 bp, Homo sapiens
ttgaccactgaatggttctgaa

SEQ ID NO: 39527 - DNA, 22 bp, Homo sapiens
tggtctgctgaacagccgtatc

SEQ ID NO: 39528 - DNA, 22 bp, Homo sapiens
acatcccatgcgcatctggcaa

SEQ ID NO: 39529 - DNA, 22 bp, Homo sapiens
tactgtgtgcccagccgagctg

SEQ ID NO: 39530 - DNA, 22 bp, Homo sapiens
ctcccagccttcgccagtctga

SEQ ID NO: 39531 - DNA, 22 bp, Homo sapiens
aatggaatacctaggtggccca

SEQ ID NO: 39532 - DNA, 22 bp, Homo sapiens
taattataacagttacatctta

SEQ ID NO: 39533 - DNA, 22 bp, Homo sapiens
aggcactgtgcagtcccaagca

SEQ ID NO: 39534 - DNA, 22 bp, Homo sapiens
actgcacttcagcctgggtgtc

SEQ ID NO: 39535 - DNA, 22 bp, Homo sapiens
ctccagttggccccagttggtt

SEQ ID NO: 39536 - DNA, 22 bp, Homo sapiens
tccacgctgtgtgaccttgggc

SEQ ID NO: 39537 - DNA, 22 bp, Homo sapiens
gcagggtctgaggccacagagg

SEQ ID NO: 39538 - DNA, 22 bp, Homo sapiens
ccagggatgcagaggttgcagt

SEQ ID NO: 39539 - DNA, 22 bp, Homo sapiens
agtgttagattcttactcagtt

SEQ ID NO: 39540 - DNA, 22 bp, Homo sapiens
ataatggtagatgtccacgcag

SEQ ID NO: 39541 - DNA, 22 bp, Homo sapiens
gtgaggtggtacaatattaact

SEQ ID NO: 39542 - DNA, 22 bp, Homo sapiens
actgcactccagcctgggtgac

SEQ ID NO: 39543 - DNA, 22 bp, Homo sapiens
gaccctgtttctacaaataatt

SEQ ID NO: 39544 - DNA, 19 bp, Homo sapiens
gggcaaagtgatcgtcctg

SEQ ID NO: 39545 - DNA, 21 bp, Homo sapiens
ttggccgtgcagatgaacagc

SEQ ID NO: 39546 - DNA, 22 bp, Homo sapiens
catccaggctgaagtgcagtgg

SEQ ID NO: 39547 - DNA, 16 bp, Homo sapiens
ccacctgcagctctca

SEQ ID NO: 39548 - DNA, 22 bp, Homo sapiens
gtcttgatctcctgaccttgtg

SEQ ID NO: 39549 - DNA, 22 bp, Homo sapiens
ccaaagtgctgggattacaggt

SEQ ID NO: 39550 - DNA, 22 bp, Homo sapiens
tgggctgtggagcacctttgca

SEQ ID NO: 39551 - DNA, 22 bp, Homo sapiens
aggctagaggcttctggcttca

SEQ ID NO: 39552 - DNA, 22 bp, Homo sapiens
ggctggtgttgagtgcctgtag

SEQ ID NO: 39553 - DNA, 22 bp, Homo sapiens
cctcggaggcggaggctgcagt

SEQ ID NO: 39554 - DNA, 22 bp, Homo sapiens
tgggtggcagcttcagcatgtt

SEQ ID NO: 39555 - DNA, 22 bp, Homo sapiens
cggagcctgcttgttgcagctg

SEQ ID NO: 39556 - DNA, 19 bp, Homo sapiens
catctggatgattctcctg

SEQ ID NO: 39557 - DNA, 22 bp, Homo sapiens
ttaataaagtatgaattggaaa

SEQ ID NO: 39558 - DNA, 22 bp, Homo sapiens
tgtggtgccgagagtctggacg

SEQ ID NO: 39559 - DNA, 22 bp, Homo sapiens
tcagacaactctggaggctggc

SEQ ID NO: 39560 - DNA, 22 bp, Homo sapiens
gagagtctaggaacctcatata

SEQ ID NO: 39561 - DNA, 22 bp, Homo sapiens
ggctcctgggggtgctcctgcc

SEQ ID NO: 39562 - DNA, 22 bp, Homo sapiens
agactttaacaatgggtatgaa

SEQ ID NO: 39563 - DNA, 22 bp, Homo sapiens
ggctgggcaggtctgcacaggg

SEQ ID NO: 39564 - DNA, 22 bp, Homo sapiens
gtggagacctcctaggatgtgt

SEQ ID NO: 39565 - DNA, 22 bp, Homo sapiens
ttcagcagtgcagacacccagt

SEQ ID NO: 39566 - DNA, 18 bp, Homo sapiens
actctttctgcccacagg

SEQ ID NO: 39567 - DNA, 22 bp, Homo sapiens
tctgctctgtggcttcagctaa

SEQ ID NO: 39568 - DNA, 22 bp, Homo sapiens
caggagtgtctccacacagcaa

SEQ ID NO: 39569 - DNA, 22 bp, Homo sapiens
attataggcttgagccaccgtg

SEQ ID NO: 39570 - DNA, 22 bp, Homo sapiens
ccgggcctcgggacaccgggta

SEQ ID NO: 39571 - DNA, 23 bp, Homo sapiens
cagagctggctcagagctgcctg

SEQ ID NO: 39572 - DNA, 20 bp, Homo sapiens
tgtttgtgtggggccttggc

SEQ ID NO: 39573 - DNA, 22 bp, Homo sapiens
tcaggcagtagaattgcttgaa

SEQ ID NO: 39574 - DNA, 22 bp, Homo sapiens
acccagccatgttcagttctct

SEQ ID NO: 39575 - DNA, 21 bp, Homo sapiens
aggcaccacatctccctcccc

SEQ ID NO: 39576 - DNA, 22 bp, Homo sapiens
gggctgggattgcttgctgtga

SEQ ID NO: 39577 - DNA, 22 bp, Homo sapiens
gcagcctgggcaacagagtgag

SEQ ID NO: 39578 - DNA, 22 bp, Homo sapiens
tcagccccacggggtcagccaa

SEQ ID NO: 39579 - DNA, 22 bp, Homo sapiens
agcccaggtccagttcactgca

SEQ ID NO: 39580 - DNA, 22 bp, Homo sapiens
cgtgccactgcactctagcctg

SEQ ID NO: 39581 - DNA, 22 bp, Homo sapiens
gaatgacgccctgtggtcactt

SEQ ID NO: 39582 - DNA, 22 bp, Homo sapiens
agaggaggctctgggatcgtcc

SEQ ID NO: 39583 - DNA, 22 bp, Homo sapiens
gactgtggggaagcagatgcca

SEQ ID NO: 39584 - DNA, 22 bp, Homo sapiens
tgcgaccctagccccctcactt

SEQ ID NO: 39585 - DNA, 22 bp, Homo sapiens
caggctggagtgcagtggcgcc

SEQ ID NO: 39586 - DNA, 22 bp, Homo sapiens
ggcctttgcgtccacgccgctt

SEQ ID NO: 39587 - DNA, 22 bp, Homo sapiens
caggccagggttgagaagagaa

SEQ ID NO: 39588 - DNA, 22 bp, Homo sapiens
tcccacacagcccgctcaccgg

SEQ ID NO: 39589 - DNA, 22 bp, Homo sapiens
gcctggagaaaggaaggtggga

SEQ ID NO: 39590 - DNA, 16 bp, Homo sapiens
gtagccgtggccgctg

SEQ ID NO: 39591 - DNA, 21 bp, Homo sapiens
tgttttccaccttgaggcaag

SEQ ID NO: 39592 - DNA, 22 bp, Homo sapiens
cggtctcccgtgtgtgtgcgct

SEQ ID NO: 39593 - DNA, 21 bp, Homo sapiens
aaactgaccttgcctgagaca

SEQ ID NO: 39594 - DNA, 22 bp, Homo sapiens
aggggctcctttgtgctgcgtc

SEQ ID NO: 39595 - DNA, 22 bp, Homo sapiens
gcttcggggtccaagcgcgtgt

SEQ ID NO: 39596 - DNA, 22 bp, Homo sapiens
gggagctggagctggaagactc

SEQ ID NO: 39597 - DNA, 21 bp, Homo sapiens
gggcctggctgcgcaggacgg

SEQ ID NO: 39598 - DNA, 22 bp, Homo sapiens
ctgctctgctgatcagtgtctc

SEQ ID NO: 39599 - DNA, 22 bp, Homo sapiens
attgtggtgtcagttataggca

SEQ ID NO: 39600 - DNA, 22 bp, Homo sapiens
cacagggcttctcatggggtgc

SEQ ID NO: 39601 - DNA, 22 bp, Homo sapiens
gtggagagagataagcctggtc

SEQ ID NO: 39602 - DNA, 22 bp, Homo sapiens
gggcagagagctggaactcctt

SEQ ID NO: 39603 - DNA, 22 bp, Homo sapiens
agaaatatgctgattagatgaa

SEQ ID NO: 39604 - DNA, 22 bp, Homo sapiens
cagctgctgttcagttttgttt

SEQ ID NO: 39605 - DNA, 22 bp, Homo sapiens
tggcagtggcgggactcagggc

SEQ ID NO: 39606 - DNA, 22 bp, Homo sapiens
gccaggctgaggctctggaaga

SEQ ID NO: 39607 - DNA, 21 bp, Homo sapiens
taggtgggagccccagtatgc

SEQ ID NO: 39608 - DNA, 22 bp, Homo sapiens
cagcagcattgctctggattcc

SEQ ID NO: 39609 - DNA, 22 bp, Homo sapiens
tttgccagtattttattgatga

SEQ ID NO: 39610 - DNA, 20 bp, Homo sapiens
gccaacgcgctggggctgcc

SEQ ID NO: 39611 - DNA, 22 bp, Homo sapiens
ggctgggctccgggagcatgcg

SEQ ID NO: 39612 - DNA, 21 bp, Homo sapiens
tagcccttctccacctcgccc

SEQ ID NO: 39613 - DNA, 22 bp, Homo sapiens
agagagcccgggccagggcaca

SEQ ID NO: 39614 - DNA, 22 bp, Homo sapiens
tggaggccagaggtactgggac

SEQ ID NO: 39615 - DNA, 20 bp, Homo sapiens
caagggtttgcattggcttt

SEQ ID NO: 39616 - DNA, 22 bp, Homo sapiens
tgtcttcagcagtcatctgggg

SEQ ID NO: 39617 - DNA, 22 bp, Homo sapiens
ctgctcctgtccagcagggcca

SEQ ID NO: 39618 - DNA, 22 bp, Homo sapiens
gagctgaaggagaaagcagggg

SEQ ID NO: 39619 - DNA, 22 bp, Homo sapiens
gcctggattccttgtttctcag

SEQ ID NO: 39620 - DNA, 22 bp, Homo sapiens
tatactctgagaaacgtgtcac

SEQ ID NO: 39621 - DNA, 22 bp, Homo sapiens
agacaaagaaaccgtagaagca

SEQ ID NO: 39622 - DNA, 22 bp, Homo sapiens
ctgtccctgagcaactcctgtt

SEQ ID NO: 39623 - DNA, 22 bp, Homo sapiens
ttttctaacatctagtaatttg

SEQ ID NO: 39624 - DNA, 22 bp, Homo sapiens
cgtggggcgggtggacacttgc

SEQ ID NO: 39625 - DNA, 22 bp, Homo sapiens
ctgggaggcggagcttgcagtg

SEQ ID NO: 39626 - DNA, 22 bp, Homo sapiens
gcactggccgcacgcgtagggc

SEQ ID NO: 39627 - DNA, 22 bp, Homo sapiens
tcactgcagcctctgcctcccg

SEQ ID NO: 39628 - DNA, 22 bp, Homo sapiens
gggccatgagaggttcatcaac

SEQ ID NO: 39629 - DNA, 22 bp, Homo sapiens
tggttgtggtcctccacatcgc

SEQ ID NO: 39630 - DNA, 22 bp, Homo sapiens
ttctccgctaagttctctgcag

SEQ ID NO: 39631 - DNA, 22 bp, Homo sapiens
cacagagatggtctggcaggtg

SEQ ID NO: 39632 - DNA, 22 bp, Homo sapiens
ccgggcgggggctctcgtcacc

SEQ ID NO: 39633 - DNA, 22 bp, Homo sapiens
ctgctcttcacactacacccgt

SEQ ID NO: 39634 - DNA, 22 bp, Homo sapiens
atgccactgcactccagcctag

SEQ ID NO: 39635 - DNA, 22 bp, Homo sapiens
aagggcctgccagctcttcatg

SEQ ID NO: 39636 - DNA, 22 bp, Homo sapiens
ttggccatctaagcccagccac

SEQ ID NO: 39637 - DNA, 22 bp, Homo sapiens
aggcaagggggcgccaccttcc

SEQ ID NO: 39638 - DNA, 22 bp, Homo sapiens
ccctctacagggaagcgctttc

SEQ ID NO: 39639 - DNA, 22 bp, Homo sapiens
gacgagagactccatccaccac

SEQ ID NO: 39640 - DNA, 22 bp, Homo sapiens
tcagccagccagctacaggctt

SEQ ID NO: 39641 - DNA, 22 bp, Homo sapiens
gggagtgggtttggcctaggcc

SEQ ID NO: 39642 - DNA, 22 bp, Homo sapiens
agagggtgggcacgtgatggat

SEQ ID NO: 39643 - DNA, 22 bp, Homo sapiens
ggtgttgcagttgaagactggt

SEQ ID NO: 39644 - DNA, 22 bp, Homo sapiens
atgttctacagatggaaagggg

SEQ ID NO: 39645 - DNA, 22 bp, Homo sapiens
tggcttccccggagtgacatgt

SEQ ID NO: 39646 - DNA, 23 bp, Homo sapiens
ggttccaggaacacagcctgatg

SEQ ID NO: 39647 - DNA, 17 bp, Homo sapiens
aggtgggtggatcacct

SEQ ID NO: 39648 - DNA, 22 bp, Homo sapiens
tggtggggccagacttcagctc

SEQ ID NO: 39649 - DNA, 22 bp, Homo sapiens
cttgtctgctataaaaatccag

SEQ ID NO: 39650 - DNA, 22 bp, Homo sapiens
ggggccttggatctgtgccccg

SEQ ID NO: 39651 - DNA, 18 bp, Homo sapiens
ggtgagggagctggaagc

SEQ ID NO: 39652 - DNA, 22 bp, Homo sapiens
agtgaagctggagaaaggcagt

SEQ ID NO: 39653 - DNA, 22 bp, Homo sapiens
tgtgcgtcctgtgcgcacactg

SEQ ID NO: 39654 - DNA, 22 bp, Homo sapiens
cccagggaggcccaggctctgc

SEQ ID NO: 39655 - DNA, 22 bp, Homo sapiens
ctgcagggagaggggacagcct

SEQ ID NO: 39656 - DNA, 22 bp, Homo sapiens
tgtgactggttgtcccgctttc

SEQ ID NO: 39657 - DNA, 22 bp, Homo sapiens
tgcctccctggcaagtctctcc

SEQ ID NO: 39658 - DNA, 22 bp, Homo sapiens
atgctttctcttagttcattga

SEQ ID NO: 39659 - DNA, 22 bp, Homo sapiens
agaggccggccgagcccatggg

SEQ ID NO: 39660 - DNA, 22 bp, Homo sapiens
tgttttaagggtcaactgtcac

SEQ ID NO: 39661 - DNA, 22 bp, Homo sapiens
ggggccgccagagagagccttg

SEQ ID NO: 39662 - DNA, 22 bp, Homo sapiens
gcagggaggtttgctgacctgg

SEQ ID NO: 39663 - DNA, 22 bp, Homo sapiens
agtgcaggccccaggccaggcc

SEQ ID NO: 39664 - DNA, 19 bp, Homo sapiens
aggaatggaattaattctg

SEQ ID NO: 39665 - DNA, 22 bp, Homo sapiens
catcatactgtttacactcaaa

SEQ ID NO: 39666 - DNA, 22 bp, Homo sapiens
ctgggcagctgtatcagggagt

SEQ ID NO: 39667 - DNA, 22 bp, Homo sapiens
agggggctccttggtgtgcaga

SEQ ID NO: 39668 - DNA, 22 bp, Homo sapiens
acaaacagagttgaaaaatagg

SEQ ID NO: 39669 - DNA, 22 bp, Homo sapiens
agagtgtaccaaatatcctaca

SEQ ID NO: 39670 - DNA, 22 bp, Homo sapiens
aaagcactgcacatatatttgc

SEQ ID NO: 39671 - DNA, 22 bp, Homo sapiens
gtgggggcaggcagtgctagga

SEQ ID NO: 39672 - DNA, 22 bp, Homo sapiens
tcccagagctctggaggttgga

SEQ ID NO: 39673 - DNA, 22 bp, Homo sapiens
cactgggcacttgggttgcttc

SEQ ID NO: 39674 - DNA, 22 bp, Homo sapiens
cttatttgcccatgtttcttta

SEQ ID NO: 39675 - DNA, 22 bp, Homo sapiens
ggaaaagtgttaaggtgttgat

SEQ ID NO: 39676 - DNA, 22 bp, Homo sapiens
ttaaattttagaaacagactct

SEQ ID NO: 39677 - DNA, 20 bp, Homo sapiens
aaattactgccacacatttc

SEQ ID NO: 39678 - DNA, 22 bp, Homo sapiens
aggcttttctccagaatgtact

SEQ ID NO: 39679 - DNA, 22 bp, Homo sapiens
ttatagcagcatgatttatagt

SEQ ID NO: 39680 - DNA, 22 bp, Homo sapiens
ctgcttctagcaccaagtccct

SEQ ID NO: 39681 - DNA, 22 bp, Homo sapiens
aaaatcttgtgacttaggaagg

SEQ ID NO: 39682 - DNA, 22 bp, Homo sapiens
gggagctgaaggagccggcggg

SEQ ID NO: 39683 - DNA, 22 bp, Homo sapiens
ggcagggagtggagactcccta

SEQ ID NO: 39684 - DNA, 22 bp, Homo sapiens
tagatgtgttgcctggagttgt

SEQ ID NO: 39685 - DNA, 22 bp, Homo sapiens
aaagcagaactgagagagctgg

SEQ ID NO: 39686 - DNA, 22 bp, Homo sapiens
tcagccccacggggtcagccaa

SEQ ID NO: 39687 - DNA, 22 bp, Homo sapiens
tcacccaggctggactgcagtg

SEQ ID NO: 39688 - DNA, 22 bp, Homo sapiens
gaagaggttcaacgtggtcatc

SEQ ID NO: 39689 - DNA, 22 bp, Homo sapiens
ttgcaattgctatggagagcgt

SEQ ID NO: 39690 - DNA, 22 bp, Homo sapiens
cttctcggggttcccgcgccct

SEQ ID NO: 39691 - DNA, 22 bp, Homo sapiens
tctttctacatcatttgcttct

SEQ ID NO: 39692 - DNA, 22 bp, Homo sapiens
taaagattgctcaaaactgtga

SEQ ID NO: 39693 - DNA, 22 bp, Homo sapiens
gtatgtgaggttggtttccagg

SEQ ID NO: 39694 - DNA, 21 bp, Homo sapiens
caaaagagactgattcttgga

SEQ ID NO: 39695 - DNA, 22 bp, Homo sapiens
gctgcagacttctcatctcatt

SEQ ID NO: 39696 - DNA, 22 bp, Homo sapiens
tcttgggggactttggcatgga

SEQ ID NO: 39697 - DNA, 22 bp, Homo sapiens
caggctggagtgcagtggcgcc

SEQ ID NO: 39698 - DNA, 22 bp, Homo sapiens
agaagccaccagctgaggaaga

SEQ ID NO: 39699 - DNA, 20 bp, Homo sapiens
aactcctagcctcaagtgat

SEQ ID NO: 39700 - DNA, 22 bp, Homo sapiens
atattacacacggtatcacggg

SEQ ID NO: 39701 - DNA, 22 bp, Homo sapiens
tcagttatagatacttttacca

SEQ ID NO: 39702 - DNA, 22 bp, Homo sapiens
cgctgctccgccttgtccatat

SEQ ID NO: 39703 - DNA, 22 bp, Homo sapiens
tgctgctccccagcacacagca

SEQ ID NO: 39704 - DNA, 22 bp, Homo sapiens
ggtttgacagcttggggctgtc

SEQ ID NO: 39705 - DNA, 22 bp, Homo sapiens
tacaaaaaattgatactgacga

SEQ ID NO: 39706 - DNA, 22 bp, Homo sapiens
ttccctccatttcattttataa

SEQ ID NO: 39707 - DNA, 22 bp, Homo sapiens
gggctagcctcttccctgctcc

SEQ ID NO: 39708 - DNA, 22 bp, Homo sapiens
gttaggtagaagtttactttga

SEQ ID NO: 39709 - DNA, 23 bp, Homo sapiens
tcatcttcctcatttctccaggg

SEQ ID NO: 39710 - DNA, 22 bp, Homo sapiens
tacaaaggaggtgcatagaaca

SEQ ID NO: 39711 - DNA, 22 bp, Homo sapiens
tctgcaggaagctggcggctga

SEQ ID NO: 39712 - DNA, 22 bp, Homo sapiens
ctgactgggttaagttcatgta

SEQ ID NO: 39713 - DNA, 22 bp, Homo sapiens
ctggcctggcgcagtggctcac

SEQ ID NO: 39714 - DNA, 22 bp, Homo sapiens
aggtgacaggacaggagctggt

SEQ ID NO: 39715 - DNA, 22 bp, Homo sapiens
agcctggcggtcgtcggtcagg

SEQ ID NO: 39716 - DNA, 22 bp, Homo sapiens
agagttgctccattagaactta

SEQ ID NO: 39717 - DNA, 22 bp, Homo sapiens
acatgtttaagtttgttatatg

SEQ ID NO: 39718 - DNA, 22 bp, Homo sapiens
ttattttaccttcctctgagct

SEQ ID NO: 39719 - DNA, 22 bp, Homo sapiens
cagggccctgctcaatttctcc

SEQ ID NO: 39720 - DNA, 22 bp, Homo sapiens
tagtgaatgggggttatgagac

SEQ ID NO: 39721 - DNA, 22 bp, Homo sapiens
cactgcaacctccacctcctgg

SEQ ID NO: 39722 - DNA, 22 bp, Homo sapiens
ttattagagtgctttgagaaag

SEQ ID NO: 39723 - DNA, 22 bp, Homo sapiens
tttagtgcatcagacaccctct

SEQ ID NO: 39724 - DNA, 22 bp, Homo sapiens
aggtgactggtttatctggcag

SEQ ID NO: 39725 - DNA, 22 bp, Homo sapiens
ggctgcaggttggttggcagct

SEQ ID NO: 39726 - DNA, 22 bp, Homo sapiens
tgcgatgcaacagcttggcgga

SEQ ID NO: 39727 - DNA, 22 bp, Homo sapiens
actattagcatatcatgaatgg

SEQ ID NO: 39728 - DNA, 22 bp, Homo sapiens
attgcactccagcctgggggac

SEQ ID NO: 39729 - DNA, 22 bp, Homo sapiens
gaaagacatagttgcaagatgg

SEQ ID NO: 39730 - DNA, 20 bp, Homo sapiens
ttctccagtgcggtagccat

SEQ ID NO: 39731 - DNA, 23 bp, Homo sapiens
cttcacaggttcaggggattaag

SEQ ID NO: 39732 - DNA, 22 bp, Homo sapiens
tgggggctgggatgtcactttc

SEQ ID NO: 39733 - DNA, 22 bp, Homo sapiens
tttgtagcagcatgatttataa

SEQ ID NO: 39734 - DNA, 22 bp, Homo sapiens
actaaagctcacagagttgaac

SEQ ID NO: 39735 - DNA, 22 bp, Homo sapiens
ttaggcaattttgtcattgtgt

SEQ ID NO: 39736 - DNA, 22 bp, Homo sapiens
gaggcagaagttgcagtgagca

SEQ ID NO: 39737 - DNA, 22 bp, Homo sapiens
gcagggtttagcacctgtagct

SEQ ID NO: 39738 - DNA, 22 bp, Homo sapiens
ccagccgcggtgagggtggctg

SEQ ID NO: 39739 - DNA, 22 bp, Homo sapiens
tactttaatatatgtgaagttc

SEQ ID NO: 39740 - DNA, 22 bp, Homo sapiens
tttcttcctgctttgtcccatg

SEQ ID NO: 39741 - DNA, 22 bp, Homo sapiens
tcaccaggctggagtgcagtgg

SEQ ID NO: 39742 - DNA, 22 bp, Homo sapiens
ctggacacactggagtctggca

SEQ ID NO: 39743 - DNA, 22 bp, Homo sapiens
ctgggaggcggaggttgcagtg

SEQ ID NO: 39744 - DNA, 22 bp, Homo sapiens
ggacaattcagtgatttgggga

SEQ ID NO: 39745 - DNA, 22 bp, Homo sapiens
ttgcccagagtcacccagctca

SEQ ID NO: 39746 - DNA, 22 bp, Homo sapiens
ttatgatttgccacagattggt

SEQ ID NO: 39747 - DNA, 22 bp, Homo sapiens
tctgcatattgttaatggaatg

SEQ ID NO: 39748 - DNA, 22 bp, Homo sapiens
tgctgctcatcagattttaaaa

SEQ ID NO: 39749 - DNA, 22 bp, Homo sapiens
tcagtgttaatcagtggtacct

SEQ ID NO: 39750 - DNA, 22 bp, Homo sapiens
cgtaggtggctcagcacctggg

SEQ ID NO: 39751 - DNA, 22 bp, Homo sapiens
agtcaggggatctagacttgaa

SEQ ID NO: 39752 - DNA, 22 bp, Homo sapiens
agctgctcattggcgtagttga

SEQ ID NO: 39753 - DNA, 22 bp, Homo sapiens
tgggctgcaggggttgagagct

SEQ ID NO: 39754 - DNA, 22 bp, Homo sapiens
tttaaaaaactagtctgagtct

SEQ ID NO: 39755 - DNA, 22 bp, Homo sapiens
attttctatgttgtaattgtta

SEQ ID NO: 39756 - DNA, 22 bp, Homo sapiens
tgcagaaacaagccatcattca

SEQ ID NO: 39757 - DNA, 22 bp, Homo sapiens
ggccgtcagccccgatttgcca

SEQ ID NO: 39758 - DNA, 22 bp, Homo sapiens
ctgagtgaaagaagccagacat

SEQ ID NO: 39759 - DNA, 22 bp, Homo sapiens
cctgtggcgggggccagtgcct

SEQ ID NO: 39760 - DNA, 22 bp, Homo sapiens
ggtgaatttgcctcccgactga

SEQ ID NO: 39761 - DNA, 22 bp, Homo sapiens
tataaactcctcttgcattcct

SEQ ID NO: 39762 - DNA, 23 bp, Homo sapiens
attttttgtctttgtaactagat

SEQ ID NO: 39763 - DNA, 22 bp, Homo sapiens
cctggcctttgaacgctagact

SEQ ID NO: 39764 - DNA, 22 bp, Homo sapiens
cattctctctacttgttttcaa

SEQ ID NO: 39765 - DNA, 22 bp, Homo sapiens
aagtctctcacatatctggtcc

SEQ ID NO: 39766 - DNA, 22 bp, Homo sapiens
acccagggctcaagcgtaggca

SEQ ID NO: 39767 - DNA, 22 bp, Homo sapiens
ttcttttaattgtgggggagtg

SEQ ID NO: 39768 - DNA, 22 bp, Homo sapiens
tgggaagctgcattttaacaag

SEQ ID NO: 39769 - DNA, 23 bp, Homo sapiens
ggagtgcaatggcgccatctcgg

SEQ ID NO: 39770 - DNA, 22 bp, Homo sapiens
catataaatacaacatgtgtta

SEQ ID NO: 39771 - DNA, 22 bp, Homo sapiens
ggagacagggttgaaccacgca

SEQ ID NO: 39772 - DNA, 22 bp, Homo sapiens
cccaggagttggaggctgcagt

SEQ ID NO: 39773 - DNA, 22 bp, Homo sapiens
gaggcagaggttgcagtgagct

SEQ ID NO: 39774 - DNA, 22 bp, Homo sapiens
ctacaaaagtaattgtggtttt

SEQ ID NO: 39775 - DNA, 22 bp, Homo sapiens
cccaggaggcctgcctggccgg

SEQ ID NO: 39776 - DNA, 22 bp, Homo sapiens
cagtgccagctgcttggcctac

SEQ ID NO: 39777 - DNA, 22 bp, Homo sapiens
agaaaatttaaagagacacaca

SEQ ID NO: 39778 - DNA, 22 bp, Homo sapiens
ttagatttgtagtgagttcaga

SEQ ID NO: 39779 - DNA, 22 bp, Homo sapiens
agcatggccatctgggccgtcc

SEQ ID NO: 39780 - DNA, 22 bp, Homo sapiens
ctgctttgcatagctgccagag

SEQ ID NO: 39781 - DNA, 22 bp, Homo sapiens
tggagggcatgctgtccatggg

SEQ ID NO: 39782 - DNA, 22 bp, Homo sapiens
acccagtgttgggcagaactgt

SEQ ID NO: 39783 - DNA, 22 bp, Homo sapiens
ctgggggcagcaagaagccatg

SEQ ID NO: 39784 - DNA, 22 bp, Homo sapiens
aaaatatgtataactcttctgc

SEQ ID NO: 39785 - DNA, 22 bp, Homo sapiens
gggggactggaccgtcctgggt

SEQ ID NO: 39786 - DNA, 22 bp, Homo sapiens
cactgcacttcagcctgggtga

SEQ ID NO: 39787 - DNA, 22 bp, Homo sapiens
ctacccttaagtttctgtgggg

SEQ ID NO: 39788 - DNA, 22 bp, Homo sapiens
ctggcttttttcccattatgca

SEQ ID NO: 39789 - DNA, 22 bp, Homo sapiens
ggcctgggctccgggagttact

SEQ ID NO: 39790 - DNA, 22 bp, Homo sapiens
gctgtctcatacaaggccctgc

SEQ ID NO: 39791 - DNA, 23 bp, Homo sapiens
agaaagtcatggccaggtttgat

SEQ ID NO: 39792 - DNA, 22 bp, Homo sapiens
tggctcctcacgtcctcagagc

SEQ ID NO: 39793 - DNA, 22 bp, Homo sapiens
tcacttagatggggatcatcac

SEQ ID NO: 39794 - DNA, 22 bp, Homo sapiens
aggccagcctcaggcagggacc

SEQ ID NO: 39795 - DNA, 22 bp, Homo sapiens
gagaacagaagcattcctaatt

SEQ ID NO: 39796 - DNA, 21 bp, Homo sapiens
acacaggcagtgtcccgaggt

SEQ ID NO: 39797 - DNA, 22 bp, Homo sapiens
ctatacagcagcttactagtta

SEQ ID NO: 39798 - DNA, 22 bp, Homo sapiens
cgggcagcggcgtggccatggt

SEQ ID NO: 39799 - DNA, 22 bp, Homo sapiens
ttaagctagtgaagtccctcaa

SEQ ID NO: 39800 - DNA, 22 bp, Homo sapiens
gctcccaggatgaggagccagg

SEQ ID NO: 39801 - DNA, 22 bp, Homo sapiens
gaagggaactgggtctccttgt

SEQ ID NO: 39802 - DNA, 22 bp, Homo sapiens
tgggcagggagctggaaccaca

SEQ ID NO: 39803 - DNA, 22 bp, Homo sapiens
aaatgcacaaagattttgcact

SEQ ID NO: 39804 - DNA, 19 bp, Homo sapiens
tctcacagctctactatgt

SEQ ID NO: 39805 - DNA, 22 bp, Homo sapiens
agaccaaagaaaacacatctgg

SEQ ID NO: 39806 - DNA, 22 bp, Homo sapiens
tttaatcaggcaaagcataata

SEQ ID NO: 39807 - DNA, 21 bp, Homo sapiens
cagaggcctatcacagactcc

SEQ ID NO: 39808 - DNA, 21 bp, Homo sapiens
ctcccagggtgactgttcaac

SEQ ID NO: 39809 - DNA, 22 bp, Homo sapiens
tacaacaatttccacattagaa

SEQ ID NO: 39810 - DNA, 22 bp, Homo sapiens
agttctttgcatagatttggct

SEQ ID NO: 39811 - DNA, 22 bp, Homo sapiens
gttttgaatactactagaactt

SEQ ID NO: 39812 - DNA, 22 bp, Homo sapiens
attgcactccagcctgggtgac

SEQ ID NO: 39813 - DNA, 22 bp, Homo sapiens
ttatttaaaagtggtaagattc

SEQ ID NO: 39814 - DNA, 22 bp, Homo sapiens
ggctcctgggggtgctcctgcc

SEQ ID NO: 39815 - DNA, 23 bp, Homo sapiens
aatatcaaggtgatgttcccaga

SEQ ID NO: 39816 - DNA, 22 bp, Homo sapiens
gctcactgcaacctccacctcc

SEQ ID NO: 39817 - DNA, 22 bp, Homo sapiens
tgttcagaacaaaggtaaatga

SEQ ID NO: 39818 - DNA, 22 bp, Homo sapiens
cccaggaggtcaaggctgcagt

SEQ ID NO: 39819 - DNA, 23 bp, Homo sapiens
ttgcagaagcagacgaccataat

SEQ ID NO: 39820 - DNA, 22 bp, Homo sapiens
ggcagggcaggaaagtcaggaa

SEQ ID NO: 39821 - DNA, 22 bp, Homo sapiens
gcagttaaaaataaaccttcat

SEQ ID NO: 39822 - DNA, 22 bp, Homo sapiens
gctcactgcaagctccgcctcc

SEQ ID NO: 39823 - DNA, 22 bp, Homo sapiens
ctgaggcctctcccactccagc

SEQ ID NO: 39824 - DNA, 22 bp, Homo sapiens
atgagaaagttaatcatcatga

SEQ ID NO: 39825 - DNA, 22 bp, Homo sapiens
gcagggcacaaggacgcacagg

SEQ ID NO: 39826 - DNA, 22 bp, Homo sapiens
tggcccgaagatccgagggtca

SEQ ID NO: 39827 - DNA, 22 bp, Homo sapiens
ctagggtgtgcagattttgcct

SEQ ID NO: 39828 - DNA, 22 bp, Homo sapiens
taacatttaaatttttcacata

SEQ ID NO: 39829 - DNA, 22 bp, Homo sapiens
tgtacacatggtgtacactccc

SEQ ID NO: 39830 - DNA, 22 bp, Homo sapiens
aattttctggtgtgtaatgaag

SEQ ID NO: 39831 - DNA, 22 bp, Homo sapiens
atttagacatgtatctgatagc

SEQ ID NO: 39832 - DNA, 20 bp, Homo sapiens
cgcccagtgcggttctgacc

SEQ ID NO: 39833 - DNA, 22 bp, Homo sapiens
gcccagctgcaccctggtgggt

SEQ ID NO: 39834 - DNA, 22 bp, Homo sapiens
cccaggggttcaaggctgcagt

SEQ ID NO: 39835 - DNA, 22 bp, Homo sapiens
ctttaaggtgatgagagatgct

SEQ ID NO: 39836 - DNA, 22 bp, Homo sapiens
cactgcactccagcttgggtga

SEQ ID NO: 39837 - DNA, 18 bp, Homo sapiens
tctgccccagccgcactg

SEQ ID NO: 39838 - DNA, 22 bp, Homo sapiens
aaaacctcagttctgctcttaa

SEQ ID NO: 39839 - DNA, 22 bp, Homo sapiens
ccagggtggcgtagatgctggg

SEQ ID NO: 39840 - DNA, 22 bp, Homo sapiens
tccttgccctaaatgtctgtgt

SEQ ID NO: 39841 - DNA, 22 bp, Homo sapiens
ttgtgaaacattcatggatttg

SEQ ID NO: 39842 - DNA, 22 bp, Homo sapiens
gctagtgcagggaaatctttgg

SEQ ID NO: 39843 - DNA, 22 bp, Homo sapiens
actttaaaactgatcatcagag

SEQ ID NO: 39844 - DNA, 22 bp, Homo sapiens
cctgggaggctgaggctgcagt

SEQ ID NO: 39845 - DNA, 22 bp, Homo sapiens
tgaggcaggagttcaggctgcg

SEQ ID NO: 39846 - DNA, 22 bp, Homo sapiens
cccaggcttttctcttgcccca

SEQ ID NO: 39847 - DNA, 22 bp, Homo sapiens
acccagtgagcccgaccgatgg

SEQ ID NO: 39848 - DNA, 22 bp, Homo sapiens
tgagacgaagtcttgctctgtt

SEQ ID NO: 39849 - DNA, 23 bp, Homo sapiens
aaacttgctatggctgaaatcat

SEQ ID NO: 39850 - DNA, 22 bp, Homo sapiens
ctggcctcggcagcaggaacag

SEQ ID NO: 39851 - DNA, 22 bp, Homo sapiens
cagcatgttcttgtctcactgg

SEQ ID NO: 39852 - DNA, 22 bp, Homo sapiens
cagggatggcgctggctgcccg

SEQ ID NO: 39853 - DNA, 22 bp, Homo sapiens
ggactgggaatcagggagatgc

SEQ ID NO: 39854 - DNA, 22 bp, Homo sapiens
acaaagtgctgacattacaggc

SEQ ID NO: 39855 - DNA, 22 bp, Homo sapiens
tcctccccaaagcccagcctgg

SEQ ID NO: 39856 - DNA, 22 bp, Homo sapiens
ttatagcagcatgatttataat

SEQ ID NO: 39857 - DNA, 22 bp, Homo sapiens
agggctgcccagtgtgagagct

SEQ ID NO: 39858 - DNA, 22 bp, Homo sapiens
cacccaggctggagtgcagtga

SEQ ID NO: 39859 - DNA, 22 bp, Homo sapiens
gggcagcagccactcatttagc

SEQ ID NO: 39860 - DNA, 22 bp, Homo sapiens
tgtcagggatttccaactcccc

SEQ ID NO: 39861 - DNA, 22 bp, Homo sapiens
tggctgtgtccctgtccagagt

SEQ ID NO: 39862 - DNA, 22 bp, Homo sapiens
tcccaggccacacttggggaac

SEQ ID NO: 39863 - DNA, 22 bp, Homo sapiens
cccaggaggttgaggctgcagt

SEQ ID NO: 39864 - DNA, 22 bp, Homo sapiens
ccgcccacactaaatatgagcg

SEQ ID NO: 39865 - DNA, 22 bp, Homo sapiens
cacccaggctggagagcagtgg

SEQ ID NO: 39866 - DNA, 22 bp, Homo sapiens
ttcaatttgtgctaaggcaccg

SEQ ID NO: 39867 - DNA, 22 bp, Homo sapiens
ttttaagttggattgctaagta

SEQ ID NO: 39868 - DNA, 22 bp, Homo sapiens
ggtgcccaaggaaggttgccgt

SEQ ID NO: 39869 - DNA, 22 bp, Homo sapiens
cactgcactccatcctgggaaa

SEQ ID NO: 39870 - DNA, 23 bp, Homo sapiens
ctcctcgtaactctgtggtgggt

SEQ ID NO: 39871 - DNA, 23 bp, Homo sapiens
gttttacaggtgagaaaatggag

SEQ ID NO: 39872 - DNA, 16 bp, Homo sapiens
ttgccgcacaggtcgc

SEQ ID NO: 39873 - DNA, 22 bp, Homo sapiens
cactgcactccagcctgggaga

SEQ ID NO: 39874 - DNA, 22 bp, Homo sapiens
ataaaatttgctactgttaaat

SEQ ID NO: 39875 - DNA, 22 bp, Homo sapiens
tgagatgaataactcctgctaa

SEQ ID NO: 39876 - DNA, 22 bp, Homo sapiens
agcaacacgcagtagtatacga

SEQ ID NO: 39877 - DNA, 22 bp, Homo sapiens
tgggggctttatgtaatgcaca

SEQ ID NO: 39878 - DNA, 22 bp, Homo sapiens
gtctttcttaaacaacagaaca

SEQ ID NO: 39879 - DNA, 22 bp, Homo sapiens
gtgggggctggaaatcttgcca

SEQ ID NO: 39880 - DNA, 22 bp, Homo sapiens
ggctgggcaggtctgcacaggg

SEQ ID NO: 39881 - DNA, 22 bp, Homo sapiens
cctggctctgccacttactgcc

SEQ ID NO: 39882 - DNA, 22 bp, Homo sapiens
ctacattaaattggcttactta

SEQ ID NO: 39883 - DNA, 19 bp, Homo sapiens
ttttggaaatgtgaacagc

SEQ ID NO: 39884 - DNA, 22 bp, Homo sapiens
atacaaaatatatactggagac

SEQ ID NO: 39885 - DNA, 22 bp, Homo sapiens
tgctgctcagaacccctgggct

SEQ ID NO: 39886 - DNA, 23 bp, Homo sapiens
cagggccctgctcaatttctcca

SEQ ID NO: 39887 - DNA, 22 bp, Homo sapiens
gagacacaggcacagaagaggc

SEQ ID NO: 39888 - DNA, 22 bp, Homo sapiens
aaggcaggatgggaaaagattt

SEQ ID NO: 39889 - DNA, 22 bp, Homo sapiens
ttatttttaaaagttcacacag

SEQ ID NO: 39890 - DNA, 22 bp, Homo sapiens
gctgatagactgaatgttggga

SEQ ID NO: 39891 - DNA, 22 bp, Homo sapiens
agttattactctttaacatatt

SEQ ID NO: 39892 - DNA, 22 bp, Homo sapiens
tgggcaggggccctgcttccgt

SEQ ID NO: 39893 - DNA, 22 bp, Homo sapiens
tttgtcttatccaatctctcag

SEQ ID NO: 39894 - DNA, 22 bp, Homo sapiens
ctgggaggtggaggttgcattg

SEQ ID NO: 39895 - DNA, 22 bp, Homo sapiens
aaaagtcttggggaaggccagg

SEQ ID NO: 39896 - DNA, 23 bp, Homo sapiens
cagagctggctcagagctgcctg

SEQ ID NO: 39897 - DNA, 22 bp, Homo sapiens
ttttaatactgctattgtagga

SEQ ID NO: 39898 - DNA, 22 bp, Homo sapiens
cattacagaatatgtaatgatc

SEQ ID NO: 39899 - DNA, 18 bp, Homo sapiens
agagtatacagacaacaa

SEQ ID NO: 39900 - DNA, 21 bp, Homo sapiens
cactccacttagaacagggtt

SEQ ID NO: 39901 - DNA, 22 bp, Homo sapiens
cacccaggttggagtgcagtgg

SEQ ID NO: 39902 - DNA, 22 bp, Homo sapiens
accttcaggtgagcacacagat

SEQ ID NO: 39903 - DNA, 22 bp, Homo sapiens
gtcttttgctagccagagagct

SEQ ID NO: 39904 - DNA, 22 bp, Homo sapiens
tgtcagtgtctatgaagaattt

SEQ ID NO: 39905 - DNA, 22 bp, Homo sapiens
tctttcttgtgggtgccctttt

SEQ ID NO: 39906 - DNA, 22 bp, Homo sapiens
tgaggcaggagaatcacatgaa

SEQ ID NO: 39907 - DNA, 22 bp, Homo sapiens
cactgcactccagcctgggtca

SEQ ID NO: 39908 - DNA, 22 bp, Homo sapiens
ggaggagacagtaaaaagcacg

SEQ ID NO: 39909 - DNA, 22 bp, Homo sapiens
aaaaaattatcatagttcctga

SEQ ID NO: 39910 - DNA, 22 bp, Homo sapiens
agccagggacgctgcaggctac

SEQ ID NO: 39911 - DNA, 22 bp, Homo sapiens
tctgccttctatcttttgtctg

SEQ ID NO: 39912 - DNA, 22 bp, Homo sapiens
cccagttttctgattgaagagc

SEQ ID NO: 39913 - DNA, 22 bp, Homo sapiens
gctcactgcaacctccgccttc

SEQ ID NO: 39914 - DNA, 22 bp, Homo sapiens
tctgttttgcataatgttcttt

SEQ ID NO: 39915 - DNA, 17 bp, Homo sapiens
aatctgtttacagtcag

SEQ ID NO: 39916 - DNA, 22 bp, Homo sapiens
aacagtgtttttcttcagcact

SEQ ID NO: 39917 - DNA, 22 bp, Homo sapiens
tttacacagaggacactgggct

SEQ ID NO: 39918 - DNA, 22 bp, Homo sapiens
gtgccccagacacgcatgtggg

SEQ ID NO: 39919 - DNA, 22 bp, Homo sapiens
gctgcagggagctggaaggctc

SEQ ID NO: 39920 - DNA, 22 bp, Homo sapiens
aaaaatcacttttataggcagc

SEQ ID NO: 39921 - DNA, 22 bp, Homo sapiens
tgagtgaggctgggcagtccct

SEQ ID NO: 39922 - DNA, 22 bp, Homo sapiens
taagtcgtggatgattcttcgg

SEQ ID NO: 39923 - DNA, 22 bp, Homo sapiens
aaagcctcccaggttatgagta

SEQ ID NO: 39924 - DNA, 22 bp, Homo sapiens
tctaaattactttgggcagtat

SEQ ID NO: 39925 - DNA, 22 bp, Homo sapiens
gaggaggcttccgggaggcacg

SEQ ID NO: 39926 - DNA, 22 bp, Homo sapiens
atcacaaaggtctcagagcaca

SEQ ID NO: 39927 - DNA, 17 bp, Homo sapiens
gggcagggactcctggg

SEQ ID NO: 39928 - DNA, 22 bp, Homo sapiens
gggggcttggcccggtctggtt

SEQ ID NO: 39929 - DNA, 22 bp, Homo sapiens
aaattgcaaaagtacttttagg

SEQ ID NO: 39930 - DNA, 22 bp, Homo sapiens
cactgcactccagcctgggtga

SEQ ID NO: 39931 - DNA, 22 bp, Homo sapiens
gtgaattacatgtatttttaag

SEQ ID NO: 39932 - DNA, 22 bp, Homo sapiens
tacttttagcctatttgattct

SEQ ID NO: 39933 - DNA, 22 bp, Homo sapiens
atgccccagtgtgtgcttcctt

SEQ ID NO: 39934 - DNA, 22 bp, Homo sapiens
ggcctcacccatcggtgccttt

SEQ ID NO: 39935 - DNA, 22 bp, Homo sapiens
tacagaagcttttgaaaagatg

SEQ ID NO: 39936 - DNA, 22 bp, Homo sapiens
taacaatacccattctaattac

SEQ ID NO: 39937 - DNA, 22 bp, Homo sapiens
tctgacattagattaattggaa

SEQ ID NO: 39938 - DNA, 22 bp, Homo sapiens
cacccaggctggagtgcagtgg

SEQ ID NO: 39939 - DNA, 22 bp, Homo sapiens
cattaaacaaccttgaatcaat

SEQ ID NO: 39940 - DNA, 22 bp, Homo sapiens
acaatgaagctccactgagctt

SEQ ID NO: 39941 - DNA, 22 bp, Homo sapiens
ggggcaggagcccttcttcagc

SEQ ID NO: 39942 - DNA, 22 bp, Homo sapiens
cctttcccgctttgagggcaag

SEQ ID NO: 39943 - DNA, 22 bp, Homo sapiens
cctgggggccaggaaggtgtga

SEQ ID NO: 39944 - DNA, 22 bp, Homo sapiens
attgcactccggcctgggtgac

SEQ ID NO: 39945 - DNA, 22 bp, Homo sapiens
tatttcttttcgtgacttattg

SEQ ID NO: 39946 - DNA, 22 bp, Homo sapiens
gctcactgcctgggcaacaaga

SEQ ID NO: 39947 - DNA, 22 bp, Homo sapiens
tgagctgacacccaatcatact

SEQ ID NO: 39948 - DNA, 22 bp, Homo sapiens
gctcactgcaacctctgcctcc

SEQ ID NO: 39949 - DNA, 22 bp, Homo sapiens
atacaaaaattagccgggagta

SEQ ID NO: 39950 - DNA, 22 bp, Homo sapiens
cttagatgaagtcacagaaccc

SEQ ID NO: 39951 - DNA, 22 bp, Homo sapiens
ccgaggtcctggacttggccct

SEQ ID NO: 39952 - DNA, 22 bp, Homo sapiens
gtatccatgggggattggttcc

SEQ ID NO: 39953 - DNA, 22 bp, Homo sapiens
gggcaggggtcagtggccccaa

SEQ ID NO: 39954 - DNA, 22 bp, Homo sapiens
agtgaaaacctaatcatgcagt

SEQ ID NO: 39955 - DNA, 22 bp, Homo sapiens
ttaagtgcaaaaatgaaagtat

SEQ ID NO: 39956 - DNA, 22 bp, Homo sapiens
caggctggagtgcagtggcgct

SEQ ID NO: 39957 - DNA, 22 bp, Homo sapiens
cagtctctaaatcaatctgaat

SEQ ID NO: 39958 - DNA, 22 bp, Homo sapiens
cctcggctgggccttggccact

SEQ ID NO: 39959 - DNA, 22 bp, Homo sapiens
ctcccagccttcgccagtctga

SEQ ID NO: 39960 - DNA, 22 bp, Homo sapiens
tcaccaggctagagtgcagtgg

SEQ ID NO: 39961 - DNA, 22 bp, Homo sapiens
attgataaattgcaatggggct

SEQ ID NO: 39962 - DNA, 22 bp, Homo sapiens
cccaggaggtggaggctgcagt

SEQ ID NO: 39963 - DNA, 22 bp, Homo sapiens
gctcactgcaagctctgcctcc

SEQ ID NO: 39964 - DNA, 22 bp, Homo sapiens
ttgactagaattatttaatcga

SEQ ID NO: 39965 - DNA, 22 bp, Homo sapiens
atgtttaaagggttgagaaata

SEQ ID NO: 39966 - DNA, 22 bp, Homo sapiens
agctgccgatgcccagctgcat

SEQ ID NO: 39967 - DNA, 22 bp, Homo sapiens
tggtatgaccgtggtgcaagca

SEQ ID NO: 39968 - DNA, 22 bp, Homo sapiens
cagtcctgaatactggacggtg

SEQ ID NO: 39969 - DNA, 22 bp, Homo sapiens
taaaatttgtccctgagtgttg

SEQ ID NO: 39970 - DNA, 23 bp, Homo sapiens
tgaggcaggcggatcacgaggtc

SEQ ID NO: 39971 - DNA, 22 bp, Homo sapiens
tcagtttttctatactttgtag

SEQ ID NO: 39972 - DNA, 22 bp, Homo sapiens
ttaataaagtatgaattggaaa

SEQ ID NO: 39973 - DNA, 22 bp, Homo sapiens
ttgcaaatcagaagtatagatt

SEQ ID NO: 39974 - DNA, 22 bp, Homo sapiens
tagcagcatttttgtagagtat

SEQ ID NO: 39975 - DNA, 22 bp, Homo sapiens
cttccccaggacctctgctaaa

SEQ ID NO: 39976 - DNA, 22 bp, Homo sapiens
ggaaaatgggaacctgaagcca

SEQ ID NO: 39977 - DNA, 22 bp, Homo sapiens
tctagcaagctcgtgctcaagg

SEQ ID NO: 39978 - DNA, 22 bp, Homo sapiens
gatttttatataaagtgagaaa

SEQ ID NO: 39979 - DNA, 22 bp, Homo sapiens
agatttggcagtataaattctg

SEQ ID NO: 39980 - DNA, 22 bp, Homo sapiens
ttcagtttcaagtccctctggg

SEQ ID NO: 39981 - DNA, 22 bp, Homo sapiens
cagggtgacaagtggcaaggag

SEQ ID NO: 39982 - DNA, 22 bp, Homo sapiens
ttggcttttatgcagcttaggt

SEQ ID NO: 39983 - DNA, 22 bp, Homo sapiens
gtgtaagtatctttgtatcttt

SEQ ID NO: 39984 - DNA, 22 bp, Homo sapiens
aaagcagaggttgcagtgagct

SEQ ID NO: 39985 - DNA, 22 bp, Homo sapiens
aacaattactaccaaggcctgt

SEQ ID NO: 39986 - DNA, 22 bp, Homo sapiens
gccagtggtcactgaggaagaa

SEQ ID NO: 39987 - DNA, 22 bp, Homo sapiens
acttttaaatgagtttcagttg

SEQ ID NO: 39988 - DNA, 22 bp, Homo sapiens
aatgaattgcagtactgacttg

SEQ ID NO: 39989 - DNA, 22 bp, Homo sapiens
aagcatttcaggtagagatatt

SEQ ID NO: 39990 - DNA, 22 bp, Homo sapiens
ccttcccatgcagcctgtctga

SEQ ID NO: 39991 - DNA, 22 bp, Homo sapiens
gtctatatattgcttgaataat

SEQ ID NO: 39992 - DNA, 22 bp, Homo sapiens
agtgctgtctccttcccccggg

SEQ ID NO: 39993 - DNA, 22 bp, Homo sapiens
catgatctggtcctactgtggg

SEQ ID NO: 39994 - DNA, 22 bp, Homo sapiens
aggaaaatggaccagagttgtt

SEQ ID NO: 39995 - DNA, 22 bp, Homo sapiens
cggccgcagcagtgtcggccca

SEQ ID NO: 39996 - DNA, 22 bp, Homo sapiens
gagtctctgaccagggtgccaa

SEQ ID NO: 39997 - DNA, 22 bp, Homo sapiens
ctcatcagaaatacctgacaaa

SEQ ID NO: 39998 - DNA, 22 bp, Homo sapiens
tccaagatctacagcagtttag

SEQ ID NO: 39999 - DNA, 22 bp, Homo sapiens
aactcaaagatgcatgacgctt

SEQ ID NO: 40000 - DNA, 18 bp, Homo sapiens
cttgttcttctcttggcg

SEQ ID NO: 40001 - DNA, 22 bp, Homo sapiens
tggttcctcaagcgctggcggc

SEQ ID NO: 40002 - DNA, 22 bp, Homo sapiens
cctacagttatattcttgattg

SEQ ID NO: 40003 - DNA, 22 bp, Homo sapiens
cttctcttcctttgtcaactga

SEQ ID NO: 40004 - DNA, 22 bp, Homo sapiens
cccaggggttctgagcagcagc

SEQ ID NO: 40005 - DNA, 22 bp, Homo sapiens
cactgcactccagcccgggcaa

SEQ ID NO: 40006 - DNA, 22 bp, Homo sapiens
aaacatggccattcagactgtg

SEQ ID NO: 40007 - DNA, 22 bp, Homo sapiens
ctgggaggcagaggttgcagtg

SEQ ID NO: 40008 - DNA, 22 bp, Homo sapiens
ttgtgctctgtgttatttaagg

SEQ ID NO: 40009 - DNA, 22 bp, Homo sapiens
gtctttatttgagattgtcatt

SEQ ID NO: 40010 - DNA, 22 bp, Homo sapiens
cccatgattcaattgtctccat

SEQ ID NO: 40011 - DNA, 22 bp, Homo sapiens
ttttctaacatctagtaatttg

SEQ ID NO: 40012 - DNA, 22 bp, Homo sapiens
aagtcagacagctgagctgcct

SEQ ID NO: 40013 - DNA, 22 bp, Homo sapiens
attgcacttcagcctgggtgac

SEQ ID NO: 40014 - DNA, 22 bp, Homo sapiens
actttcttggtcccatgtttga

SEQ ID NO: 40015 - DNA, 22 bp, Homo sapiens
gaagcttgaacagggccaggct

SEQ ID NO: 40016 - DNA, 22 bp, Homo sapiens
tccattatacttctgattcaaa

SEQ ID NO: 40017 - DNA, 22 bp, Homo sapiens
ctggctttgatcagagtgacct

SEQ ID NO: 40018 - DNA, 22 bp, Homo sapiens
ctttggaacacccagctctgtg

SEQ ID NO: 40019 - DNA, 21 bp, Homo sapiens
ttgctgttttcccaatgcagt

SEQ ID NO: 40020 - DNA, 22 bp, Homo sapiens
cgcatgagacctgccggccatc

SEQ ID NO: 40021 - DNA, 22 bp, Homo sapiens
taaccaagcaaactttcattgt

SEQ ID NO: 40022 - DNA, 22 bp, Homo sapiens
catgtaaagaatttcacacaag

SEQ ID NO: 40023 - DNA, 22 bp, Homo sapiens
aactcactttgtggcttctgaa

SEQ ID NO: 40024 - DNA, 22 bp, Homo sapiens
ttatttaatgtgatctgaagag

SEQ ID NO: 40025 - DNA, 22 bp, Homo sapiens
tgtaatattgtagtgacagtac

SEQ ID NO: 40026 - DNA, 22 bp, Homo sapiens
tctcacagcctctggaggtagt

SEQ ID NO: 40027 - DNA, 22 bp, Homo sapiens
aagattttcagtgcctaaaaca

SEQ ID NO: 40028 - DNA, 22 bp, Homo sapiens
ttctagtgtccttggacttgct

SEQ ID NO: 40029 - DNA, 22 bp, Homo sapiens
ttcattttctttcacgctgctg

SEQ ID NO: 40030 - DNA, 22 bp, Homo sapiens
ctttttcactgtgtcctcacac

SEQ ID NO: 40031 - DNA, 22 bp, Homo sapiens
aagaagcaggtcacagacaggg

SEQ ID NO: 40032 - DNA, 22 bp, Homo sapiens
aaacttttttaggttcataggc

SEQ ID NO: 40033 - DNA, 22 bp, Homo sapiens
cagtggccaacttcctgcctct

SEQ ID NO: 40034 - DNA, 22 bp, Homo sapiens
taattcttcaggccttttgtct

SEQ ID NO: 40035 - DNA, 22 bp, Homo sapiens
tgtcctgcccaaggtcacatac

SEQ ID NO: 40036 - DNA, 22 bp, Homo sapiens
tttttgggtccaggctgtatct

SEQ ID NO: 40037 - DNA, 22 bp, Homo sapiens
accctcaagatggaagcagttt

SEQ ID NO: 40038 - DNA, 22 bp, Homo sapiens
gtgctggggagataggaagaga

SEQ ID NO: 40039 - DNA, 22 bp, Homo sapiens
aggaggggttctcgggtgctga

SEQ ID NO: 40040 - DNA, 22 bp, Homo sapiens
accccaggaagtggaggtcatg

SEQ ID NO: 40041 - DNA, 16 bp, Homo sapiens
aggctcagaggctgga

SEQ ID NO: 40042 - DNA, 22 bp, Homo sapiens
ttttaatactgctattgtagga

SEQ ID NO: 40043 - DNA, 22 bp, Homo sapiens
ttcttcagcctaccttgacctc

SEQ ID NO: 40044 - DNA, 22 bp, Homo sapiens
tctgagccagggtctcctccct

SEQ ID NO: 40045 - DNA, 22 bp, Homo sapiens
cctgggccctcaccgccggtgg

SEQ ID NO: 40046 - DNA, 22 bp, Homo sapiens
gcaggcagaggtggaggagaca

SEQ ID NO: 40047 - DNA, 22 bp, Homo sapiens
gccacctcggctttctctgctc

SEQ ID NO: 40048 - DNA, 22 bp, Homo sapiens
ggtgggagagcttgctttgatg

SEQ ID NO: 40049 - DNA, 22 bp, Homo sapiens
gcaggagaacaaagcaagctgc

SEQ ID NO: 40050 - DNA, 22 bp, Homo sapiens
tcgcgggttgcacatggccatc

SEQ ID NO: 40051 - DNA, 22 bp, Homo sapiens
ggttccccaggcggcccttgga

SEQ ID NO: 40052 - DNA, 22 bp, Homo sapiens
cctgggaggctgaggctgcagt

SEQ ID NO: 40053 - DNA, 22 bp, Homo sapiens
cggctgggttcggctgcaggcc

SEQ ID NO: 40054 - DNA, 22 bp, Homo sapiens
gcaggcggaggttgcagtgagc

SEQ ID NO: 40055 - DNA, 22 bp, Homo sapiens
tggtacacatgtccaaggtcag

SEQ ID NO: 40056 - DNA, 22 bp, Homo sapiens
gaggtaacactgttcagtgggc

SEQ ID NO: 40057 - DNA, 22 bp, Homo sapiens
tagctcaaaggttaagtgtgga

SEQ ID NO: 40058 - DNA, 22 bp, Homo sapiens
gggagctggagctggaagactc

SEQ ID NO: 40059 - DNA, 22 bp, Homo sapiens
atctggttcttcttaggcatca

SEQ ID NO: 40060 - DNA, 22 bp, Homo sapiens
acactctagagggaagcgcttt

SEQ ID NO: 40061 - DNA, 22 bp, Homo sapiens
ggcaggactgatcagtgggatg

SEQ ID NO: 40062 - DNA, 21 bp, Homo sapiens
ctgtggtacagctgggacgga

SEQ ID NO: 40063 - DNA, 22 bp, Homo sapiens
cgcaccactgaattccagcctg

SEQ ID NO: 40064 - DNA, 22 bp, Homo sapiens
cctagagctctgctttatctaa

SEQ ID NO: 40065 - DNA, 22 bp, Homo sapiens
acagcagcaatagcagtgacat

SEQ ID NO: 40066 - DNA, 22 bp, Homo sapiens
gagcaggaaggccagaagggtc

SEQ ID NO: 40067 - DNA, 22 bp, Homo sapiens
tgggccacacacagaagaatca

SEQ ID NO: 40068 - DNA, 22 bp, Homo sapiens
gcagcctcaaactccccagctc

SEQ ID NO: 40069 - DNA, 22 bp, Homo sapiens
taaatgttgtaagtacatctaa

SEQ ID NO: 40070 - DNA, 20 bp, Homo sapiens
ctgtggaattttaccatgcg

SEQ ID NO: 40071 - DNA, 22 bp, Homo sapiens
gggtacagttcttccagtgtca

SEQ ID NO: 40072 - DNA, 22 bp, Homo sapiens
atatatttgagaatattcatga

SEQ ID NO: 40073 - DNA, 22 bp, Homo sapiens
ggtgggagagctctgtctccag

SEQ ID NO: 40074 - DNA, 22 bp, Homo sapiens
gaggtgctgctgtacttcttgc

SEQ ID NO: 40075 - DNA, 22 bp, Homo sapiens
ggctgggcaggtctgcacaggg

SEQ ID NO: 40076 - DNA, 20 bp, Homo sapiens
ctgggtggcaagcaaggggg

SEQ ID NO: 40077 - DNA, 22 bp, Homo sapiens
ggtccccgtggaggctggagcg

SEQ ID NO: 40078 - DNA, 22 bp, Homo sapiens
cagaggaacgtttggattgatt

SEQ ID NO: 40079 - DNA, 23 bp, Homo sapiens
ttacagcttcagcagctaacccc

SEQ ID NO: 40080 - DNA, 22 bp, Homo sapiens
gtgtttggtcagacgtccgggg

SEQ ID NO: 40081 - DNA, 22 bp, Homo sapiens
tgcctcaagccctccactgcac

SEQ ID NO: 40082 - DNA, 22 bp, Homo sapiens
agtccaaagcagatgagggcca

SEQ ID NO: 40083 - DNA, 22 bp, Homo sapiens
tcagccccacggggtcagccaa

SEQ ID NO: 40084 - DNA, 19 bp, Homo sapiens
gcagacaggtccagagagg

SEQ ID NO: 40085 - DNA, 22 bp, Homo sapiens
ggcttggaccagtcacagtggt

SEQ ID NO: 40086 - DNA, 22 bp, Homo sapiens
ccaggaggttgaggctgcagtg

SEQ ID NO: 40087 - DNA, 17 bp, Homo sapiens
gggcagggactcctggg

SEQ ID NO: 40088 - DNA, 22 bp, Homo sapiens
tctcgctctgtcgcccaggctg

SEQ ID NO: 40089 - DNA, 22 bp, Homo sapiens
ggctgggcctctccctcagctg

SEQ ID NO: 40090 - DNA, 22 bp, Homo sapiens
tacagcctggcactaccctggg

SEQ ID NO: 40091 - DNA, 22 bp, Homo sapiens
cagtggaggccttgggaccttt

SEQ ID NO: 40092 - DNA, 22 bp, Homo sapiens
ggctgtggcagctggaagtggt

SEQ ID NO: 40093 - DNA, 22 bp, Homo sapiens
gtagcccacctggggagggcga

SEQ ID NO: 40094 - DNA, 22 bp, Homo sapiens
cccagggagagcgcggaggcgg

SEQ ID NO: 40095 - DNA, 22 bp, Homo sapiens
ggatgttgattgaatggccatt

SEQ ID NO: 40096 - DNA, 22 bp, Homo sapiens
gacagacacaattgatccatga

SEQ ID NO: 40097 - DNA, 22 bp, Homo sapiens
ccactgtggaaagcagttcaga

SEQ ID NO: 40098 - DNA, 22 bp, Homo sapiens
ctcttagtaatgccatgaagca

SEQ ID NO: 40099 - DNA, 22 bp, Homo sapiens
ccagatgtccctctcaggtttg

SEQ ID NO: 40100 - DNA, 18 bp, Homo sapiens
cccggctaatttttggta

SEQ ID NO: 40101 - DNA, 22 bp, Homo sapiens
aggcactgtgcagtcccaagca

SEQ ID NO: 40102 - DNA, 22 bp, Homo sapiens
ctcagggccaaggatgctgttg

SEQ ID NO: 40103 - DNA, 22 bp, Homo sapiens
ctcctctttagccccagctgga

SEQ ID NO: 40104 - DNA, 22 bp, Homo sapiens
gggagtgggtttggcctaggcc

SEQ ID NO: 40105 - DNA, 22 bp, Homo sapiens
cacagacagtgtccctttgttg

SEQ ID NO: 40106 - DNA, 22 bp, Homo sapiens
caggagtgtctccacacagcaa

SEQ ID NO: 40107 - DNA, 20 bp, Homo sapiens
acgtggccaccagtggctta

SEQ ID NO: 40108 - DNA, 22 bp, Homo sapiens
actgcaacacctcctgggttca

SEQ ID NO: 40109 - DNA, 22 bp, Homo sapiens
cccagttgttgccggctctgga

SEQ ID NO: 40110 - DNA, 22 bp, Homo sapiens
acttcttcttcagctgggggat

SEQ ID NO: 40111 - DNA, 22 bp, Homo sapiens
cactgcaatatctgcatcctgg

SEQ ID NO: 40112 - DNA, 22 bp, Homo sapiens
cttcctcctccatctcgaaggc

SEQ ID NO: 40113 - DNA, 22 bp, Homo sapiens
tataaagagtctcaaagaagtt

SEQ ID NO: 40114 - DNA, 22 bp, Homo sapiens
ccaggctggagtatagtggcgc

SEQ ID NO: 40115 - DNA, 22 bp, Homo sapiens
cgagagttagctaggagtcaca

SEQ ID NO: 40116 - DNA, 22 bp, Homo sapiens
gtgcaattcactgttatgtctg

SEQ ID NO: 40117 - DNA, 22 bp, Homo sapiens
ggctgggctccgggagcatgcg

SEQ ID NO: 40118 - DNA, 22 bp, Homo sapiens
gtggcagagccaaggctggagc

SEQ ID NO: 40119 - DNA, 22 bp, Homo sapiens
gcagggaggtttgctgacctgg

SEQ ID NO: 40120 - DNA, 22 bp, Homo sapiens
tcccggcgctgggaggtgggtc

SEQ ID NO: 40121 - DNA, 22 bp, Homo sapiens
actgggccaggtgtgggtgagt

SEQ ID NO: 40122 - DNA, 22 bp, Homo sapiens
agccagggacgctgcaggctac

SEQ ID NO: 40123 - DNA, 22 bp, Homo sapiens
ctgattgagaaggaaggggatc

SEQ ID NO: 40124 - DNA, 22 bp, Homo sapiens
atcttcccaggctggggagagg

SEQ ID NO: 40125 - DNA, 22 bp, Homo sapiens
gagtgctttgtcttgtaattct

SEQ ID NO: 40126 - DNA, 21 bp, Homo sapiens
cagagctgtccaaaccctgac

SEQ ID NO: 40127 - DNA, 22 bp, Homo sapiens
cccgagtgtctactcactccca

SEQ ID NO: 40128 - DNA, 22 bp, Homo sapiens
taagagaatgttgtggctaggt

SEQ ID NO: 40129 - DNA, 22 bp, Homo sapiens
caccctccagctcccgggggct

SEQ ID NO: 40130 - DNA, 22 bp, Homo sapiens
agggctgcccagtgtgagagct

SEQ ID NO: 40131 - DNA, 22 bp, Homo sapiens
aggagctgtcagagtgccagag

SEQ ID NO: 40132 - DNA, 22 bp, Homo sapiens
tgcccaggctggagtacagtgg

SEQ ID NO: 40133 - DNA, 22 bp, Homo sapiens
aaagcctcccaggttatgagta

SEQ ID NO: 40134 - DNA, 22 bp, Homo sapiens
ccaggggggcgtagatgctggg

SEQ ID NO: 40135 - DNA, 22 bp, Homo sapiens
gcccaggctggagtgcagtggt

SEQ ID NO: 40136 - DNA, 22 bp, Homo sapiens
aataaaatggtcagttttctca

SEQ ID NO: 40137 - DNA, 22 bp, Homo sapiens
gagcccaggcagaggttgcagt

SEQ ID NO: 40138 - DNA, 22 bp, Homo sapiens
tcactgcaacctccacctcccg

SEQ ID NO: 40139 - DNA, 22 bp, Homo sapiens
agcgggtctgcaagccttccct

SEQ ID NO: 40140 - DNA, 22 bp, Homo sapiens
ttctcctacttaaggccttcca

SEQ ID NO: 40141 - DNA, 22 bp, Homo sapiens
ccaccgccatggcgttgtacag

SEQ ID NO: 40142 - DNA, 22 bp, Homo sapiens
ccaggctgctgttggtgtccgc

SEQ ID NO: 40143 - DNA, 22 bp, Homo sapiens
cgtcccgggttcacgccattct

SEQ ID NO: 40144 - DNA, 22 bp, Homo sapiens
cgggcaaggcgagactaggccc

SEQ ID NO: 40145 - DNA, 22 bp, Homo sapiens
ctgggcacagcgttgggctctt

SEQ ID NO: 40146 - DNA, 22 bp, Homo sapiens
gtgggctgcccttgaggtcagc

SEQ ID NO: 40147 - DNA, 22 bp, Homo sapiens
gaggcagaggttgcagtgagct

SEQ ID NO: 40148 - DNA, 22 bp, Homo sapiens
ggaggcggaagttgcagtgagc

SEQ ID NO: 40149 - DNA, 22 bp, Homo sapiens
ctacaaaagtaattgtggtttt

SEQ ID NO: 40150 - DNA, 22 bp, Homo sapiens
tgggcaaggctggagcctgcag

SEQ ID NO: 40151 - DNA, 18 bp, Homo sapiens
catgggtgacaggtggat

SEQ ID NO: 40152 - DNA, 22 bp, Homo sapiens
ggctagggatctagaccaggac

SEQ ID NO: 40153 - DNA, 22 bp, Homo sapiens
gtgtgggctgcagaggcacagc

SEQ ID NO: 40154 - DNA, 22 bp, Homo sapiens
aggtcaccatggcatgctccac

SEQ ID NO: 40155 - DNA, 22 bp, Homo sapiens
ggatgttctggggttctcttgt

SEQ ID NO: 40156 - DNA, 22 bp, Homo sapiens
gccactgagcccggccattgtt

SEQ ID NO: 40157 - DNA, 23 bp, Homo sapiens
atcattactttgataccttttct

SEQ ID NO: 40158 - DNA, 22 bp, Homo sapiens
ggagcagggaattacagcgcag

SEQ ID NO: 40159 - DNA, 22 bp, Homo sapiens
gtgggccactgggaggcaaggg

SEQ ID NO: 40160 - DNA, 20 bp, Homo sapiens
gccaacgcgctggggctgcc

SEQ ID NO: 40161 - DNA, 20 bp, Homo sapiens
ccagagctgatggctgcccg

SEQ ID NO: 40162 - DNA, 22 bp, Homo sapiens
tctcgatctcctgaccttgtga

SEQ ID NO: 40163 - DNA, 22 bp, Homo sapiens
ctgggcgcgtcccctgaggcgg

SEQ ID NO: 40164 - DNA, 22 bp, Homo sapiens
cggccaggcacagtggcccacg

SEQ ID NO: 40165 - DNA, 22 bp, Homo sapiens
aagaggttgtctgtgatgagtt

SEQ ID NO: 40166 - DNA, 22 bp, Homo sapiens
ctcttcctagtgtgcagcgtgg

SEQ ID NO: 40167 - DNA, 22 bp, Homo sapiens
ctccaggccatggctgcggagg

SEQ ID NO: 40168 - DNA, 22 bp, Homo sapiens
tcacctctactcagcctagttc

SEQ ID NO: 40169 - DNA, 23 bp, Homo sapiens
ccagtgattgcctggaaggaggt

SEQ ID NO: 40170 - DNA, 19 bp, Homo sapiens
agccagccagcaggtatgc

SEQ ID NO: 40171 - DNA, 22 bp, Homo sapiens
tagaagaaagtgaagctgggga

SEQ ID NO: 40172 - DNA, 22 bp, Homo sapiens
caggaaagggatgggctgccac

SEQ ID NO: 40173 - DNA, 22 bp, Homo sapiens
actttaaaactgatcatcagag

SEQ ID NO: 40174 - DNA, 22 bp, Homo sapiens
cccaggaggtggaggctgcagt

SEQ ID NO: 40175 - DNA, 22 bp, Homo sapiens
ctgctctgctgatcagtgtctc

SEQ ID NO: 40176 - DNA, 22 bp, Homo sapiens
cccaggagttggaggctgcagt

SEQ ID NO: 40177 - DNA, 22 bp, Homo sapiens
gttggtcctttgagcaagatcc

SEQ ID NO: 40178 - DNA, 22 bp, Homo sapiens
ggctcactgcaacttccgcctc

SEQ ID NO: 40179 - DNA, 22 bp, Homo sapiens
gggacgacaggctctgtggtag

SEQ ID NO: 40180 - DNA, 22 bp, Homo sapiens
acccaggccattggcaagagtc

SEQ ID NO: 40181 - DNA, 22 bp, Homo sapiens
tggctaacaaggtgaaaccccg

SEQ ID NO: 40182 - DNA, 22 bp, Homo sapiens
cagcctggtccccggctcaccc

SEQ ID NO: 40183 - DNA, 20 bp, Homo sapiens
gggcaaggaaacagccccca

SEQ ID NO: 40184 - DNA, 22 bp, Homo sapiens
gaggagggagctggaagctctt

SEQ ID NO: 40185 - DNA, 22 bp, Homo sapiens
agctggggctgtggttgtgatt

SEQ ID NO: 40186 - DNA, 22 bp, Homo sapiens
accatgttggccaagctggtct

SEQ ID NO: 40187 - DNA, 22 bp, Homo sapiens
cggggccctggggctgaaggtc

SEQ ID NO: 40188 - DNA, 22 bp, Homo sapiens
tcccagattcctgctcttatat

SEQ ID NO: 40189 - DNA, 22 bp, Homo sapiens
atatattttttgagacagagtc

SEQ ID NO: 40190 - DNA, 22 bp, Homo sapiens
cccaggaggtggagttcacagt

SEQ ID NO: 40191 - DNA, 22 bp, Homo sapiens
gcaccaccaccatcggcacctc

SEQ ID NO: 40192 - DNA, 22 bp, Homo sapiens
agatttctgggcttcaccacct

SEQ ID NO: 40193 - DNA, 22 bp, Homo sapiens
ggcaggaggtgagtggcgggtg

SEQ ID NO: 40194 - DNA, 22 bp, Homo sapiens
cggggttcatccatgctgtggc

SEQ ID NO: 40195 - DNA, 22 bp, Homo sapiens
gcgtccacgctgccgctcagga

SEQ ID NO: 40196 - DNA, 22 bp, Homo sapiens
acagattcactgcactggccat

SEQ ID NO: 40197 - DNA, 22 bp, Homo sapiens
atttcacttagtgtaatgtctt

SEQ ID NO: 40198 - DNA, 22 bp, Homo sapiens
cccaggaggttgaggctgcagt

SEQ ID NO: 40199 - DNA, 17 bp, Homo sapiens
cgggcatggagggcagg

SEQ ID NO: 40200 - DNA, 22 bp, Homo sapiens
cagagctgtccaaaccctgaca

SEQ ID NO: 40201 - DNA, 22 bp, Homo sapiens
ggaggggatttagtagatgcta

SEQ ID NO: 40202 - DNA, 22 bp, Homo sapiens
gttggtgagtttctgatcacaa

SEQ ID NO: 40203 - DNA, 22 bp, Homo sapiens
aaaggtcaaaatcgtgacattg

SEQ ID NO: 40204 - DNA, 22 bp, Homo sapiens
aatgtattcttcaaccttgcta

SEQ ID NO: 40205 - DNA, 22 bp, Homo sapiens
ctcccgcaggagcagctcgcag

SEQ ID NO: 40206 - DNA, 22 bp, Homo sapiens
gcagcctgggcaacagagtgag

SEQ ID NO: 40207 - DNA, 21 bp, Homo sapiens
ctctgaatcctgcttctcagt

SEQ ID NO: 40208 - DNA, 22 bp, Homo sapiens
ttatgatttgccacagattggt

SEQ ID NO: 40209 - DNA, 22 bp, Homo sapiens
acactgtgtgacttctgagact

SEQ ID NO: 40210 - DNA, 20 bp, Homo sapiens
ttgagcttttagtacagaca

SEQ ID NO: 40211 - DNA, 22 bp, Homo sapiens
tcagggattgcaaaattcatcc

SEQ ID NO: 40212 - DNA, 22 bp, Homo sapiens
ttatttaaaagtggtaagattc

SEQ ID NO: 40213 - DNA, 22 bp, Homo sapiens
ttggccatctaagcccagccac

SEQ ID NO: 40214 - DNA, 22 bp, Homo sapiens
gagctgggcctgcgagtgctgc

SEQ ID NO: 40215 - DNA, 22 bp, Homo sapiens
gcccgcagagatctttaacaaa

SEQ ID NO: 40216 - DNA, 22 bp, Homo sapiens
ttcagatgattagaatagtatt

SEQ ID NO: 40217 - DNA, 22 bp, Homo sapiens
tgtacttgaacttgactgtaga

SEQ ID NO: 40218 - DNA, 19 bp, Homo sapiens
acccagcccaggagtggca

SEQ ID NO: 40219 - DNA, 22 bp, Homo sapiens
gcttcggggtccaagcgcgtgt

SEQ ID NO: 40220 - DNA, 22 bp, Homo sapiens
cagctgctgttcagttttgttt

SEQ ID NO: 40221 - DNA, 23 bp, Homo sapiens
aggcgagctcttctccagcacgt

SEQ ID NO: 40222 - DNA, 22 bp, Homo sapiens
agacactgttctcacatgcttg

SEQ ID NO: 40223 - DNA, 22 bp, Homo sapiens
gtggtgtaggtcacagttagga

SEQ ID NO: 40224 - DNA, 23 bp, Homo sapiens
ggagtgcaatggcgccatctcgg

SEQ ID NO: 40225 - DNA, 22 bp, Homo sapiens
agtccaggcattccagccattc

SEQ ID NO: 40226 - DNA, 22 bp, Homo sapiens
accctccccaagaggtcgtgcc

SEQ ID NO: 40227 - DNA, 22 bp, Homo sapiens
catataaatacaacatgtgtta

SEQ ID NO: 40228 - DNA, 22 bp, Homo sapiens
aactcaaagatgcatgacgctt

SEQ ID NO: 40229 - DNA, 22 bp, Homo sapiens
gcaccctgtcaaaatggaccaa

SEQ ID NO: 40230 - DNA, 22 bp, Homo sapiens
cactgcactccagcctgggtga

SEQ ID NO: 40231 - DNA, 22 bp, Homo sapiens
gagtcgagcagaaagccgtcgg

SEQ ID NO: 40232 - DNA, 22 bp, Homo sapiens
cgtgcgcctcagcctcgtgcgc

SEQ ID NO: 40233 - DNA, 22 bp, Homo sapiens
caggaagaccagggctgtggct

SEQ ID NO: 40234 - DNA, 22 bp, Homo sapiens
gaggggcacagtaaagggtccc

SEQ ID NO: 40235 - DNA, 20 bp, Homo sapiens
ataaaataactgccacaaga

SEQ ID NO: 40236 - DNA, 22 bp, Homo sapiens
agcaggcctgccacctcggggt

SEQ ID NO: 40237 - DNA, 22 bp, Homo sapiens
cttaatctcacctgcaaagtcc

SEQ ID NO: 40238 - DNA, 22 bp, Homo sapiens
actgggcctacccagattggca

SEQ ID NO: 40239 - DNA, 22 bp, Homo sapiens
ctggccagatgttacgtccaat

SEQ ID NO: 40240 - DNA, 22 bp, Homo sapiens
ctcattgcaacctccgcctccc

SEQ ID NO: 40241 - DNA, 22 bp, Homo sapiens
aaggctcggcaatgtgcggctc

SEQ ID NO: 40242 - DNA, 22 bp, Homo sapiens
tggcacagactgggccaaggaa

SEQ ID NO: 40243 - DNA, 22 bp, Homo sapiens
gcgggccaccttggagagcgct

SEQ ID NO: 40244 - DNA, 22 bp, Homo sapiens
tctggtgtcagtattctttgaa

SEQ ID NO: 40245 - DNA, 22 bp, Homo sapiens
cactgcactccagcttgggtga

SEQ ID NO: 40246 - DNA, 20 bp, Homo sapiens
gggcagtggcgctatctcag

SEQ ID NO: 40247 - DNA, 22 bp, Homo sapiens
cccagcaaggccagctcagggc

SEQ ID NO: 40248 - DNA, 22 bp, Homo sapiens
ttttctagggtgctaaatgaac

SEQ ID NO: 40249 - DNA, 22 bp, Homo sapiens
acaagcatgggctttgacatca

SEQ ID NO: 40250 - DNA, 22 bp, Homo sapiens
ggtggcagtagcactgggcctg

SEQ ID NO: 40251 - DNA, 22 bp, Homo sapiens
cagggccagcgtctcgggctat

SEQ ID NO: 40252 - DNA, 22 bp, Homo sapiens
agcgccactgcactccagcctg

SEQ ID NO: 40253 - DNA, 22 bp, Homo sapiens
tccgcccgcacgtatggagtgg

SEQ ID NO: 40254 - DNA, 22 bp, Homo sapiens
actaggggctcaggcccaggga

SEQ ID NO: 40255 - DNA, 22 bp, Homo sapiens
tcggggtctttgacacgctctg

SEQ ID NO: 40256 - DNA, 22 bp, Homo sapiens
gggaggctctgctcagcccccg

SEQ ID NO: 40257 - DNA, 22 bp, Homo sapiens
ctgctcctgtccagcagggcca

SEQ ID NO: 40258 - DNA, 22 bp, Homo sapiens
agagggtgggcacgtgatggat

SEQ ID NO: 40259 - DNA, 22 bp, Homo sapiens
gctaggagtggtgggtcaagga

SEQ ID NO: 40260 - DNA, 22 bp, Homo sapiens
agtgcaggccccaggccaggcc

SEQ ID NO: 40261 - DNA, 22 bp, Homo sapiens
cccaccagtacagatggtagat

SEQ ID NO: 40262 - DNA, 22 bp, Homo sapiens
ggaggcggaggctgcagtgagc

SEQ ID NO: 40263 - DNA, 22 bp, Homo sapiens
acggggctagagaaggtttctt

SEQ ID NO: 40264 - DNA, 22 bp, Homo sapiens
gcccaggctggagtgcagtggc

SEQ ID NO: 40265 - DNA, 23 bp, Homo sapiens
cagagctggcttcatgggtgtgc

SEQ ID NO: 40266 - DNA, 22 bp, Homo sapiens
gagccaggttggaggctgcagt

SEQ ID NO: 40267 - DNA, 22 bp, Homo sapiens
tgggaggccgaggcaggtggat

SEQ ID NO: 40268 - DNA, 22 bp, Homo sapiens
gtctatatattgcttgaataat

SEQ ID NO: 40269 - DNA, 22 bp, Homo sapiens
tccatgaggaccaaattcgtag

SEQ ID NO: 40270 - DNA, 21 bp, Homo sapiens
ccaccaggtcttctgctcggg

SEQ ID NO: 40271 - DNA, 22 bp, Homo sapiens
gtcactgtatccaggttccagc

SEQ ID NO: 40272 - DNA, 19 bp, Homo sapiens
gccgggcccgggttggccg

SEQ ID NO: 40273 - DNA, 22 bp, Homo sapiens
gggactggagtagaggccggtg

SEQ ID NO: 40274 - DNA, 22 bp, Homo sapiens
gtcaccttgaacaggctactca

SEQ ID NO: 40275 - DNA, 23 bp, Homo sapiens
ccactagcacctgttcaacttct

SEQ ID NO: 40276 - DNA, 22 bp, Homo sapiens
cctcgcggcactcgggccggat

SEQ ID NO: 40277 - DNA, 22 bp, Homo sapiens
cttctcaaagttgtgaatcagg

SEQ ID NO: 40278 - DNA, 22 bp, Homo sapiens
cctgggcctctcaaagtgctgg

SEQ ID NO: 40279 - DNA, 22 bp, Homo sapiens
ataccaccatctatgaaaggta

SEQ ID NO: 40280 - DNA, 22 bp, Homo sapiens
cccaggaggcagagatagcagt

SEQ ID NO: 40281 - DNA, 22 bp, Homo sapiens
gggctgggattgcttgctgtga

SEQ ID NO: 40282 - DNA, 22 bp, Homo sapiens
ttgagacacagtttcactctgt

SEQ ID NO: 40283 - DNA, 22 bp, Homo sapiens
taatatctacttcatagagttt

SEQ ID NO: 40284 - DNA, 22 bp, Homo sapiens
tatagcagcatgatttatagtc

SEQ ID NO: 40285 - DNA, 22 bp, Homo sapiens
ggcctcgcggcttctggtggct

SEQ ID NO: 40286 - DNA, 22 bp, Homo sapiens
gctcccaccttaaccttcacat

SEQ ID NO: 40287 - DNA, 22 bp, Homo sapiens
tcaggctcaggttaggggccaa

SEQ ID NO: 40288 - DNA, 22 bp, Homo sapiens
aggctcagatccttgtgtcctg

SEQ ID NO: 40289 - DNA, 22 bp, Homo sapiens
caggaattcatagcattgttct

SEQ ID NO: 40290 - DNA, 22 bp, Homo sapiens
gggagctgaaggagccggcggg

SEQ ID NO: 40291 - DNA, 22 bp, Homo sapiens
tgagatgtaaggtatgcttact

SEQ ID NO: 40292 - DNA, 22 bp, Homo sapiens
gtgggggcaggcagtgctagga

SEQ ID NO: 40293 - DNA, 22 bp, Homo sapiens
ctccgcagcgggccaatccgga

SEQ ID NO: 40294 - DNA, 22 bp, Homo sapiens
tcgggctcgctctcctagcgga

SEQ ID NO: 40295 - DNA, 22 bp, Homo sapiens
ttcccaggaagcctctccaagc

SEQ ID NO: 40296 - DNA, 22 bp, Homo sapiens
cactgcactgcagcctggagac

SEQ ID NO: 40297 - DNA, 22 bp, Homo sapiens
ctcctgggaaaggctggacaca

SEQ ID NO: 40298 - DNA, 22 bp, Homo sapiens
gagccccaccctagacattctg

SEQ ID NO: 40299 - DNA, 20 bp, Homo sapiens
aagacaccagtggcagcccc

SEQ ID NO: 40300 - DNA, 22 bp, Homo sapiens
tcttacccggcaacgtgtgtcg

SEQ ID NO: 40301 - DNA, 22 bp, Homo sapiens
tttaaaaaactagtctgagtct

SEQ ID NO: 40302 - DNA, 22 bp, Homo sapiens
tccgggaggcagaggttgcagt

SEQ ID NO: 40303 - DNA, 22 bp, Homo sapiens
tagagctggccgggacagctgg

SEQ ID NO: 40304 - DNA, 16 bp, Homo sapiens
gtagccgtggccgctg

SEQ ID NO: 40305 - DNA, 22 bp, Homo sapiens
cgtgccactgcactctagcctg

SEQ ID NO: 40306 - DNA, 22 bp, Homo sapiens
agcccaggagtttgaggctgtg

SEQ ID NO: 40307 - DNA, 22 bp, Homo sapiens
atgagttgaagctacaagaggc

SEQ ID NO: 40308 - DNA, 22 bp, Homo sapiens
ggtatttcagtattatacaact

SEQ ID NO: 40309 - DNA, 22 bp, Homo sapiens
gaccttgtgatccgcccgcctt

SEQ ID NO: 40310 - DNA, 22 bp, Homo sapiens
actcaagtcataggcttctttc

SEQ ID NO: 40311 - DNA, 22 bp, Homo sapiens
ggtgccaggctgtagtcagggt

SEQ ID NO: 40312 - DNA, 22 bp, Homo sapiens
aggctctcaccctctgaccaga

SEQ ID NO: 40313 - DNA, 22 bp, Homo sapiens
tagcccctgcctttgaacctgg

SEQ ID NO: 40314 - DNA, 22 bp, Homo sapiens
ctgggggcagcaagaagccatg

SEQ ID NO: 40315 - DNA, 22 bp, Homo sapiens
gacaggaggcagagctcaggtg

SEQ ID NO: 40316 - DNA, 22 bp, Homo sapiens
tcactacaacctccgcctcctg

SEQ ID NO: 40317 - DNA, 22 bp, Homo sapiens
gcacatgaggctgtctttgtct

SEQ ID NO: 40318 - DNA, 22 bp, Homo sapiens
ggcccaggctggagtgcagtgg

SEQ ID NO: 40319 - DNA, 22 bp, Homo sapiens
gggcaccttgggtctcaggcaa

SEQ ID NO: 40320 - DNA, 22 bp, Homo sapiens
tccaagatctacagcagtttag

SEQ ID NO: 40321 - DNA, 22 bp, Homo sapiens
agggctggagccacagctggga

SEQ ID NO: 40322 - DNA, 22 bp, Homo sapiens
agttattactctttaacatatt

SEQ ID NO: 40323 - DNA, 20 bp, Homo sapiens
caagggtttgcattggcttt

SEQ ID NO: 40324 - DNA, 22 bp, Homo sapiens
accacctcatcaagctggattg

SEQ ID NO: 40325 - DNA, 22 bp, Homo sapiens
gcctcactgcagccccaggaag

SEQ ID NO: 40326 - DNA, 22 bp, Homo sapiens
ggtgggaggactgtttgaggca

SEQ ID NO: 40327 - DNA, 22 bp, Homo sapiens
ggtgggagccaacacccttctg

SEQ ID NO: 40328 - DNA, 22 bp, Homo sapiens
ttaaatattatgttgtctgcaa

SEQ ID NO: 40329 - DNA, 22 bp, Homo sapiens
caggaaggcgcggctgtgcctg

SEQ ID NO: 40330 - DNA, 22 bp, Homo sapiens
ggctccccaggtccaggagctg

SEQ ID NO: 40331 - DNA, 22 bp, Homo sapiens
gggttgaggcggatgtcggcgg

SEQ ID NO: 40332 - DNA, 22 bp, Homo sapiens
gtctcctccctttcattcacct

SEQ ID NO: 40333 - DNA, 22 bp, Homo sapiens
cactgcaagctccgcctctggg

SEQ ID NO: 40334 - DNA, 22 bp, Homo sapiens
ccaccagctgcatatgcacgta

SEQ ID NO: 40335 - DNA, 22 bp, Homo sapiens
gtgggcatctccttggaagcca

SEQ ID NO: 40336 - DNA, 21 bp, Homo sapiens
tctcttcctccgcgccgccgc

SEQ ID NO: 40337 - DNA, 22 bp, Homo sapiens
ttggatccatctcaggcatagg

SEQ ID NO: 40338 - DNA, 22 bp, Homo sapiens
cacttcaacctctgagtcctgg

SEQ ID NO: 40339 - DNA, 22 bp, Homo sapiens
gctgcagtgagccaagatcgtg

SEQ ID NO: 40340 - DNA, 22 bp, Homo sapiens
tgtgggagaaggaagcaagctg

SEQ ID NO: 40341 - DNA, 22 bp, Homo sapiens
cacctagggtttcgcctttctt

SEQ ID NO: 40342 - DNA, 22 bp, Homo sapiens
agggccagcactcctggcagga

SEQ ID NO: 40343 - DNA, 21 bp, Homo sapiens
cctcaagtgcctcctgctgct

SEQ ID NO: 40344 - DNA, 19 bp, Homo sapiens
tccaggggctccacctcct

SEQ ID NO: 40345 - DNA, 22 bp, Homo sapiens
gacctggtccttgtactttgaa

SEQ ID NO: 40346 - DNA, 22 bp, Homo sapiens
agcaggaaggggatgatgggca

SEQ ID NO: 40347 - DNA, 21 bp, Homo sapiens
ctcccagggtgactgttcaac

SEQ ID NO: 40348 - DNA, 22 bp, Homo sapiens
agccggccatgtggtcttgtgc

SEQ ID NO: 40349 - DNA, 22 bp, Homo sapiens
actgccaatggtagtttgatgg

SEQ ID NO: 40350 - DNA, 22 bp, Homo sapiens
tggcacaggatctcagcggcca

SEQ ID NO: 40351 - DNA, 22 bp, Homo sapiens
agtgctgtctccttcccccggg

SEQ ID NO: 40352 - DNA, 22 bp, Homo sapiens
tggcactgaagctggaaagcct

SEQ ID NO: 40353 - DNA, 22 bp, Homo sapiens
gcagggcacaaggacgcacagg

SEQ ID NO: 40354 - DNA, 22 bp, Homo sapiens
cccggacagaggggcagagtgt

SEQ ID NO: 40355 - DNA, 22 bp, Homo sapiens
atgattgaaaatgacattgcca

SEQ ID NO: 40356 - DNA, 21 bp, Homo sapiens
ctagcccctactccaagttga

SEQ ID NO: 40357 - DNA, 22 bp, Homo sapiens
accgggaagtcctgcactgggc

SEQ ID NO: 40358 - DNA, 22 bp, Homo sapiens
ccctgctgtcaggtgctgggag

SEQ ID NO: 40359 - DNA, 22 bp, Homo sapiens
ctctgcctgtctcatcctgcaa

SEQ ID NO: 40360 - DNA, 22 bp, Homo sapiens
cacagcctcctctggctcacgg

SEQ ID NO: 40361 - DNA, 22 bp, Homo sapiens
ctctgcctcccaggttcaagcg

SEQ ID NO: 40362 - DNA, 22 bp, Homo sapiens
ggaggagcatgagagggtagtg

SEQ ID NO: 40363 - DNA, 22 bp, Homo sapiens
ggagttgattttggatatatta

SEQ ID NO: 40364 - DNA, 22 bp, Homo sapiens
tcatcagggatattggcctgaa

SEQ ID NO: 40365 - DNA, 22 bp, Homo sapiens
tcacccaggctggagtgtagtg

SEQ ID NO: 40366 - DNA, 22 bp, Homo sapiens
tttattctgtgctacatgaaga

SEQ ID NO: 40367 - DNA, 23 bp, Homo sapiens
cagagctggctcagagctgcctg

SEQ ID NO: 40368 - DNA, 22 bp, Homo sapiens
actgcactccagcccgagcaac

SEQ ID NO: 40369 - DNA, 22 bp, Homo sapiens
tgaaggggttcagcatgggggt

SEQ ID NO: 40370 - DNA, 22 bp, Homo sapiens
gactgtggggaagcagatgcca

SEQ ID NO: 40371 - DNA, 22 bp, Homo sapiens
tgatcagcatcttcccagctcg

SEQ ID NO: 40372 - DNA, 22 bp, Homo sapiens
gaccttgtgatccccctgcctt

SEQ ID NO: 40373 - DNA, 22 bp, Homo sapiens
ggtgaggggctcctctgcccgg

SEQ ID NO: 40374 - DNA, 22 bp, Homo sapiens
gcagaggacacaggagggcaag

SEQ ID NO: 40375 - DNA, 22 bp, Homo sapiens
gaggcagaagttgcagtgagca

SEQ ID NO: 40376 - DNA, 19 bp, Homo sapiens
ccctcttgcacaaagcaaa

SEQ ID NO: 40377 - DNA, 22 bp, Homo sapiens
gaatttcctctaaacccctgag

SEQ ID NO: 40378 - DNA, 22 bp, Homo sapiens
gcaggaggttgagccaggactg

SEQ ID NO: 40379 - DNA, 22 bp, Homo sapiens
aagtggactaatacaaggacta

SEQ ID NO: 40380 - DNA, 22 bp, Homo sapiens
cagggtttcaccatgttagcag

SEQ ID NO: 40381 - DNA, 22 bp, Homo sapiens
tattgtccaataggatgttcct

SEQ ID NO: 40382 - DNA, 22 bp, Homo sapiens
cccagggaggcccaggctctgc

SEQ ID NO: 40383 - DNA, 23 bp, Homo sapiens
cactgcaatctctgcctcctggg

SEQ ID NO: 40384 - DNA, 23 bp, Homo sapiens
ggctgggagctccgggtgcacgt

SEQ ID NO: 40385 - DNA, 22 bp, Homo sapiens
gatgtagacacttggaggctta

SEQ ID NO: 40386 - DNA, 22 bp, Homo sapiens
tttattggatatttacaagata

SEQ ID NO: 40387 - DNA, 18 bp, Homo sapiens
tcttccaacactgacacc

SEQ ID NO: 40388 - DNA, 22 bp, Homo sapiens
aagcagaatagaggcccttccc

SEQ ID NO: 40389 - DNA, 22 bp, Homo sapiens
tgatctaggttggcttcaactg

SEQ ID NO: 40390 - DNA, 22 bp, Homo sapiens
tccaggctttggggcaggagcg

SEQ ID NO: 40391 - DNA, 22 bp, Homo sapiens
gcagtggcatgatgtgggctca

SEQ ID NO: 40392 - DNA, 22 bp, Homo sapiens
ctgctccccagcctgcgccttt

SEQ ID NO: 40393 - DNA, 22 bp, Homo sapiens
tatttcttttcgtgacttattg

SEQ ID NO: 40394 - DNA, 22 bp, Homo sapiens
gctgtggcctggcgcagagctg

SEQ ID NO: 40395 - DNA, 22 bp, Homo sapiens
caaatgtataaatgtactttct

SEQ ID NO: 40396 - DNA, 22 bp, Homo sapiens
acatcctcccgatctactggct

SEQ ID NO: 40397 - DNA, 22 bp, Homo sapiens
tgggtactcctattagttcagt

SEQ ID NO: 40398 - DNA, 22 bp, Homo sapiens
ggtgacctcacctggtcccacc

SEQ ID NO: 40399 - DNA, 22 bp, Homo sapiens
tggcacagcctccatgtcgtcc

SEQ ID NO: 40400 - DNA, 22 bp, Homo sapiens
gctgctctcagagctcatgctg

SEQ ID NO: 40401 - DNA, 22 bp, Homo sapiens
caggagttttaaatctagcatg

SEQ ID NO: 40402 - DNA, 22 bp, Homo sapiens
ccagagtcccttgcagctcagt

SEQ ID NO: 40403 - DNA, 19 bp, Homo sapiens
atgtacccagtgtcaatcc

SEQ ID NO: 40404 - DNA, 22 bp, Homo sapiens
ctccagttggccccagttggtt

SEQ ID NO: 40405 - DNA, 22 bp, Homo sapiens
ggaggcggaggttgcagtgagc

SEQ ID NO: 40406 - DNA, 22 bp, Homo sapiens
agttcaacaccagcctgaccaa

SEQ ID NO: 40407 - DNA, 22 bp, Homo sapiens
ttctcctttcattccctgtaga

SEQ ID NO: 40408 - DNA, 21 bp, Homo sapiens
agcctcaggttgttggttctt

SEQ ID NO: 40409 - DNA, 22 bp, Homo sapiens
ttctgattgctgatgaggccca

SEQ ID NO: 40410 - DNA, 22 bp, Homo sapiens
gaccttgtgatctgcctgcctt

SEQ ID NO: 40411 - DNA, 22 bp, Homo sapiens
gaggctgcagctatcagacatt

SEQ ID NO: 40412 - DNA, 22 bp, Homo sapiens
agccaagcactcaactcctgga

SEQ ID NO: 40413 - DNA, 21 bp, Homo sapiens
gcccacagtgaggaggatccc

SEQ ID NO: 40414 - DNA, 22 bp, Homo sapiens
gccatcatatcccctgtgacct

SEQ ID NO: 40415 - DNA, 22 bp, Homo sapiens
caggctggagtgcagtggggcg

SEQ ID NO: 40416 - DNA, 22 bp, Homo sapiens
gtgaccatcatctcagctagtt

SEQ ID NO: 40417 - DNA, 22 bp, Homo sapiens
ttattgaaggaactgaaataaa

SEQ ID NO: 40418 - DNA, 22 bp, Homo sapiens
attataggcttgagccaccgtg

SEQ ID NO: 40419 - DNA, 22 bp, Homo sapiens
ggcgctcagtgttgccccagag

SEQ ID NO: 40420 - DNA, 22 bp, Homo sapiens
tggcaccatcaaggctgagaac

SEQ ID NO: 40421 - DNA, 21 bp, Homo sapiens
ttggccgtgcagatgaacagc

SEQ ID NO: 40422 - DNA, 22 bp, Homo sapiens
atccccctgtatctggaagaat

SEQ ID NO: 40423 - DNA, 22 bp, Homo sapiens
ctggagggctgcagcgaggctg

SEQ ID NO: 40424 - DNA, 18 bp, Homo sapiens
ccctcttgcacaaagcaa

SEQ ID NO: 40425 - DNA, 22 bp, Homo sapiens
ttgtgaatagtgccacaataaa

SEQ ID NO: 40426 - DNA, 22 bp, Homo sapiens
gtcccataagtagtgcaacttg

SEQ ID NO: 40427 - DNA, 23 bp, Homo sapiens
gacagagtgagaccttgtcttac

SEQ ID NO: 40428 - DNA, 19 bp, Homo sapiens
atctgccttagtgctgctg

SEQ ID NO: 40429 - DNA, 22 bp, Homo sapiens
accaggggatggttggcactgt

SEQ ID NO: 40430 - DNA, 22 bp, Homo sapiens
ggttcccggatctccgagtccc

SEQ ID NO: 40431 - DNA, 22 bp, Homo sapiens
caggctggagttcagtggtgtg

SEQ ID NO: 40432 - DNA, 22 bp, Homo sapiens
gccatgactctccataccaaag

SEQ ID NO: 40433 - DNA, 22 bp, Homo sapiens
ttacctaaaatagctcaattta

SEQ ID NO: 40434 - DNA, 18 bp, Homo sapiens
gatcgggggcgccccaag

SEQ ID NO: 40435 - DNA, 22 bp, Homo sapiens
ccttcccatgcagcctgtctga

SEQ ID NO: 40436 - DNA, 22 bp, Homo sapiens
ccccaggacgtggccctcatag

SEQ ID NO: 40437 - DNA, 22 bp, Homo sapiens
cctccaaccataggtccagggg

SEQ ID NO: 40438 - DNA, 22 bp, Homo sapiens
ctgggcagctgtatcagggagt

SEQ ID NO: 40439 - DNA, 22 bp, Homo sapiens
cactgcaacctccatcttctgg

SEQ ID NO: 40440 - DNA, 22 bp, Homo sapiens
tccttgccctaaatgtctgtgt

SEQ ID NO: 40441 - DNA, 22 bp, Homo sapiens
aagatgcggttgaccatggtgt

SEQ ID NO: 40442 - DNA, 22 bp, Homo sapiens
gtgggccagcttttctcctggg

SEQ ID NO: 40443 - DNA, 22 bp, Homo sapiens
gagcccaggaagtggaggctga

SEQ ID NO: 40444 - DNA, 22 bp, Homo sapiens
ccactgtgcccagcctcatggg

SEQ ID NO: 40445 - DNA, 22 bp, Homo sapiens
tgggggtgtcctggtgcacaca

SEQ ID NO: 40446 - DNA, 22 bp, Homo sapiens
gcaggcagatcacctgtcagga

SEQ ID NO: 40447 - DNA, 22 bp, Homo sapiens
atcccaggcggcacaggttgca

SEQ ID NO: 40448 - DNA, 22 bp, Homo sapiens
gtaggtcagacataagaggaca

SEQ ID NO: 40449 - DNA, 22 bp, Homo sapiens
tcgcaccattgcactccagcca

SEQ ID NO: 40450 - DNA, 22 bp, Homo sapiens
cccaccagacctgcaccggcac

SEQ ID NO: 40451 - DNA, 18 bp, Homo sapiens
tggttccttgaaggggca

SEQ ID NO: 40452 - DNA, 22 bp, Homo sapiens
atttgtgggactataatgcagg

SEQ ID NO: 40453 - DNA, 22 bp, Homo sapiens
taggtttactgaattagtggaa

SEQ ID NO: 40454 - DNA, 22 bp, Homo sapiens
tcacccaggctggagtgcagtg

SEQ ID NO: 40455 - DNA, 22 bp, Homo sapiens
gcaggtggatcacctgaggtca

SEQ ID NO: 40456 - DNA, 22 bp, Homo sapiens
tgcagattcaaatgaaatgcaa

SEQ ID NO: 40457 - DNA, 22 bp, Homo sapiens
cagcaggaggtgagtagcaggt

SEQ ID NO: 40458 - DNA, 22 bp, Homo sapiens
atacacgtgccatgttggtgtg

SEQ ID NO: 40459 - DNA, 22 bp, Homo sapiens
actgcaacctccacctcctggg

SEQ ID NO: 40460 - DNA, 22 bp, Homo sapiens
ggggtgggcgtgcagggacacc

SEQ ID NO: 40461 - DNA, 22 bp, Homo sapiens
ccaatgatggtgcccacgatga

SEQ ID NO: 40462 - DNA, 22 bp, Homo sapiens
tgctccagcaccaagagctcca

SEQ ID NO: 40463 - DNA, 22 bp, Homo sapiens
agcccaggttgaggctgcagtg

SEQ ID NO: 40464 - DNA, 22 bp, Homo sapiens
gcatctaaataaacgtgggagt

SEQ ID NO: 40465 - DNA, 22 bp, Homo sapiens
ggagggcagagtcccctgctga

SEQ ID NO: 40466 - DNA, 18 bp, Homo sapiens
tcactgtgtgtcttgggt

SEQ ID NO: 40467 - DNA, 22 bp, Homo sapiens
tcactgcaacctccacctcctg

SEQ ID NO: 40468 - DNA, 22 bp, Homo sapiens
ggagagggtaggggtcctgccc

SEQ ID NO: 40469 - DNA, 22 bp, Homo sapiens
tgtgtgagtaaggctgagagag

SEQ ID NO: 40470 - DNA, 22 bp, Homo sapiens
gtccaagagtcaagaagggggc

SEQ ID NO: 40471 - DNA, 22 bp, Homo sapiens
gtggcagaccttcccttctcct

SEQ ID NO: 40472 - DNA, 22 bp, Homo sapiens
cagggatggcgctggctgcccg

SEQ ID NO: 40473 - DNA, 22 bp, Homo sapiens
ctagcctgggatttgaacttat

SEQ ID NO: 40474 - DNA, 22 bp, Homo sapiens
agtggcctggagccccgcctgg

SEQ ID NO: 40475 - DNA, 22 bp, Homo sapiens
ctccaggctcgtccaagatcga

SEQ ID NO: 40476 - DNA, 22 bp, Homo sapiens
acactgcagatgaaagcataag

SEQ ID NO: 40477 - DNA, 22 bp, Homo sapiens
ggccagcctggggctcccagac

SEQ ID NO: 40478 - DNA, 22 bp, Homo sapiens
acccagccatgttcagttctct

SEQ ID NO: 40479 - DNA, 22 bp, Homo sapiens
attctcaaaacataacttcact

SEQ ID NO: 40480 - DNA, 22 bp, Homo sapiens
ttaaattttagaaacagactct

SEQ ID NO: 40481 - DNA, 22 bp, Homo sapiens
tgccgtggggctgaggctggag

SEQ ID NO: 40482 - DNA, 22 bp, Homo sapiens
attacctatttcattttctgtc

SEQ ID NO: 40483 - DNA, 22 bp, Homo sapiens
acagcccagctctttctctgca

SEQ ID NO: 40484 - DNA, 20 bp, Homo sapiens
gggcagagccagccagtccc

SEQ ID NO: 40485 - DNA, 22 bp, Homo sapiens
tgaagaaacgcagagaggtagg

SEQ ID NO: 40486 - DNA, 22 bp, Homo sapiens
cagagctggtgtgtcctggcat

SEQ ID NO: 40487 - DNA, 22 bp, Homo sapiens
gcccagccacagtcactttcat

SEQ ID NO: 40488 - DNA, 22 bp, Homo sapiens
ggctccctgcaacctccgcctc

SEQ ID NO: 40489 - DNA, 22 bp, Homo sapiens
cccatgaggtggaggttgcagt

SEQ ID NO: 40490 - DNA, 22 bp, Homo sapiens
tgtctcctcggctgtccagcca

SEQ ID NO: 40491 - DNA, 22 bp, Homo sapiens
tacttttagcctatttgattct

SEQ ID NO: 40492 - DNA, 22 bp, Homo sapiens
ctctgcctcagtgatttcttta

SEQ ID NO: 40493 - DNA, 22 bp, Homo sapiens
tcgccccgaggcagccctatgc

SEQ ID NO: 40494 - DNA, 23 bp, Homo sapiens
aatggtcttcctccacccctctg

SEQ ID NO: 40495 - DNA, 22 bp, Homo sapiens
tctaggtaggctgtgtgtggaa

SEQ ID NO: 40496 - DNA, 22 bp, Homo sapiens
tgggcagggagctggaaccaca

SEQ ID NO: 40497 - DNA, 22 bp, Homo sapiens
gtccaaaagagccagccgggcg

SEQ ID NO: 40498 - DNA, 22 bp, Homo sapiens
caagcttgtttctcctgggggt

SEQ ID NO: 40499 - DNA, 22 bp, Homo sapiens
ggaggtcccaggcctggcagca

SEQ ID NO: 40500 - DNA, 22 bp, Homo sapiens
tgcaatctcggcactttgggag

SEQ ID NO: 40501 - DNA, 19 bp, Homo sapiens
gccttcccaccacccgtcc

SEQ ID NO: 40502 - DNA, 22 bp, Homo sapiens
gcgtctcaaggcccccaggcca

SEQ ID NO: 40503 - DNA, 22 bp, Homo sapiens
cagcagcagtggctgcagaaca

SEQ ID NO: 40504 - DNA, 22 bp, Homo sapiens
gctccctggtagccatgctctc

SEQ ID NO: 40505 - DNA, 22 bp, Homo sapiens
agcccaggctggagtgcagtgg

SEQ ID NO: 40506 - DNA, 20 bp, Homo sapiens
tttctgtgagaaacactgtt

SEQ ID NO: 40507 - DNA, 22 bp, Homo sapiens
ggcgggcagcgtcttgctggcc

SEQ ID NO: 40508 - DNA, 22 bp, Homo sapiens
tcgagctctggagccaaggatg

SEQ ID NO: 40509 - DNA, 22 bp, Homo sapiens
gaccttgtgatccacctgcctt

SEQ ID NO: 40510 - DNA, 22 bp, Homo sapiens
acttgccccagaattgctgctg

SEQ ID NO: 40511 - DNA, 22 bp, Homo sapiens
aggggagccagggctgcgagtt

SEQ ID NO: 40512 - DNA, 22 bp, Homo sapiens
gtccaggcctgcctctgaggag

SEQ ID NO: 40513 - DNA, 22 bp, Homo sapiens
caggcagggagctggaaaggat

SEQ ID NO: 40514 - DNA, 22 bp, Homo sapiens
ttcacagcttaataaggctcag

SEQ ID NO: 40515 - DNA, 22 bp, Homo sapiens
tggtggcactgacatcagacac

SEQ ID NO: 40516 - DNA, 22 bp, Homo sapiens
tcctgagataaatctcatgtga

SEQ ID NO: 40517 - DNA, 22 bp, Homo sapiens
tggaatggaaacaaactgagga

SEQ ID NO: 40518 - DNA, 22 bp, Homo sapiens
aacccgagggccccaggctcgg

SEQ ID NO: 40519 - DNA, 22 bp, Homo sapiens
atgccactgcacttcagcctgg

SEQ ID NO: 40520 - DNA, 22 bp, Homo sapiens
gccaggacctcagatgcagggc

SEQ ID NO: 40521 - DNA, 22 bp, Homo sapiens
tagggcaatatttcccagaaaa

SEQ ID NO: 40522 - DNA, 22 bp, Homo sapiens
tacaggcatgtagcatggtgat

SEQ ID NO: 40523 - DNA, 22 bp, Homo sapiens
cactgaacaacaaatagtgaat

SEQ ID NO: 40524 - DNA, 22 bp, Homo sapiens
agaaaatttaaagagacacaca

SEQ ID NO: 40525 - DNA, 22 bp, Homo sapiens
aggtgcttggctcgtgcacaca

SEQ ID NO: 40526 - DNA, 22 bp, Homo sapiens
ctacttgttcactgtaggtcgc

SEQ ID NO: 40527 - DNA, 22 bp, Homo sapiens
ccctcccaggagtggccagaga

SEQ ID NO: 40528 - DNA, 22 bp, Homo sapiens
ggaccggtggcttcctcgggtc

SEQ ID NO: 40529 - DNA, 22 bp, Homo sapiens
tctcagggctcagagctcaggc

SEQ ID NO: 40530 - DNA, 22 bp, Homo sapiens
ttatatgtttctgtttggaggc

SEQ ID NO: 40531 - DNA, 22 bp, Homo sapiens
tggagccagagcgcagcctggg

SEQ ID NO: 40532 - DNA, 22 bp, Homo sapiens
tgacatttcctagtgctttgtg

SEQ ID NO: 40533 - DNA, 22 bp, Homo sapiens
catggggcccatgtgctccaag

SEQ ID NO: 40534 - DNA, 22 bp, Homo sapiens
gagggggctagcgcagtgccca

SEQ ID NO: 40535 - DNA, 22 bp, Homo sapiens
ttctgccttggcagggtggtcc

SEQ ID NO: 40536 - DNA, 22 bp, Homo sapiens
gcccaggagttcaagtctagtg

SEQ ID NO: 40537 - DNA, 22 bp, Homo sapiens
caggccagggttgagaagagaa

SEQ ID NO: 40538 - DNA, 22 bp, Homo sapiens
caggctggagtgcagtggtgcc

SEQ ID NO: 40539 - DNA, 20 bp, Homo sapiens
tttgagaccagtctgcccaa

SEQ ID NO: 40540 - DNA, 22 bp, Homo sapiens
cagagcccctcgtctccaccac

SEQ ID NO: 40541 - DNA, 22 bp, Homo sapiens
gaaccacaatgtgaagaaggag

SEQ ID NO: 40542 - DNA, 22 bp, Homo sapiens
cgccccggacgtctgaccaaac

SEQ ID NO: 40543 - DNA, 22 bp, Homo sapiens
actctccttttgatcttcagaa

SEQ ID NO: 40544 - DNA, 21 bp, Homo sapiens
tgaaggggtggcagtgtgctt

SEQ ID NO: 40545 - DNA, 21 bp, Homo sapiens
cctggttcaagtgatgcccct

SEQ ID NO: 40546 - DNA, 18 bp, Homo sapiens
ggtgagggagctggaagc

SEQ ID NO: 40547 - DNA, 22 bp, Homo sapiens
cactgcaacctccacctcctgg

SEQ ID NO: 40548 - DNA, 22 bp, Homo sapiens
gagcccaggagtttgatgctgc

SEQ ID NO: 40549 - DNA, 22 bp, Homo sapiens
cagcccaggactgcaggtgttt

SEQ ID NO: 40550 - DNA, 22 bp, Homo sapiens
actgcaagaatggtaatatttg

SEQ ID NO: 40551 - DNA, 22 bp, Homo sapiens
cccaggatggggctgcagttat

SEQ ID NO: 40552 - DNA, 22 bp, Homo sapiens
aggccaggaatccttgtcccag

SEQ ID NO: 40553 - DNA, 23 bp, Homo sapiens
ctatttctcatagttcaggtctt

SEQ ID NO: 40554 - DNA, 22 bp, Homo sapiens
gtggggtagatctttctcagga

SEQ ID NO: 40555 - DNA, 22 bp, Homo sapiens
ttctgtgaatcttttttcccac

SEQ ID NO: 40556 - DNA, 23 bp, Homo sapiens
ctcaaccctagtaagggagtagg

SEQ ID NO: 40557 - DNA, 22 bp, Homo sapiens
tcccagagctctggaggttgga

SEQ ID NO: 40558 - DNA, 22 bp, Homo sapiens
actttatttcctattgcatcca

SEQ ID NO: 40559 - DNA, 22 bp, Homo sapiens
cccaggaggtcaaggctgcagt

SEQ ID NO: 40560 - DNA, 22 bp, Homo sapiens
gtctccttgtggatctcaagga

SEQ ID NO: 40561 - DNA, 22 bp, Homo sapiens
ttctcttttcaccagttgctaa

SEQ ID NO: 40562 - DNA, 22 bp, Homo sapiens
aaatggaagctatttatgattc

SEQ ID NO: 40563 - DNA, 22 bp, Homo sapiens
aagggggcggcagccagtggaa

SEQ ID NO: 40564 - DNA, 22 bp, Homo sapiens
gggcaggggtcagtggccccaa

SEQ ID NO: 40565 - DNA, 19 bp, Homo sapiens
gtgtccatggagcatggag

SEQ ID NO: 40566 - DNA, 22 bp, Homo sapiens
tagcccaggctggagtgcaggg

SEQ ID NO: 40567 - DNA, 22 bp, Homo sapiens
tcctcagaatcacctggcagct

SEQ ID NO: 40568 - DNA, 22 bp, Homo sapiens
cactgcaatctccatctcctgg

SEQ ID NO: 40569 - DNA, 22 bp, Homo sapiens
tgggccgtggagcactctgaga

SEQ ID NO: 40570 - DNA, 22 bp, Homo sapiens
tcacccaggctggactgcagtg

SEQ ID NO: 40571 - DNA, 22 bp, Homo sapiens
ggaagaaaggtggacaacaggt

SEQ ID NO: 40572 - DNA, 22 bp, Homo sapiens
ccggctcggcgaccaggctgaa

SEQ ID NO: 40573 - DNA, 22 bp, Homo sapiens
gcttctcgggcctgatgtcgtc

SEQ ID NO: 40574 - DNA, 22 bp, Homo sapiens
tatttcacatctatgaagtgag

SEQ ID NO: 40575 - DNA, 22 bp, Homo sapiens
agactttaacaatgggtatgaa

SEQ ID NO: 40576 - DNA, 22 bp, Homo sapiens
ggaggcggaggttgcagtgagt

SEQ ID NO: 40577 - DNA, 22 bp, Homo sapiens
ggaggtggaggttgcagtgagc

SEQ ID NO: 40578 - DNA, 22 bp, Homo sapiens
ttatttaatgtgatctgaagag

SEQ ID NO: 40579 - DNA, 22 bp, Homo sapiens
tctgagacaggaagtggagggt

SEQ ID NO: 40580 - DNA, 22 bp, Homo sapiens
cactgcactccagcctgggtca

SEQ ID NO: 40581 - DNA, 22 bp, Homo sapiens
caccttggccttgctatttctc

SEQ ID NO: 40582 - DNA, 22 bp, Homo sapiens
tgcagtggcgccatctcagctc

SEQ ID NO: 40583 - DNA, 22 bp, Homo sapiens
cactgcacttcagcctgggtga

SEQ ID NO: 40584 - DNA, 22 bp, Homo sapiens
gcggggggaggaacatcttgca

SEQ ID NO: 40585 - DNA, 22 bp, Homo sapiens
tactgtactgcagttctgcaaa

SEQ ID NO: 40586 - DNA, 18 bp, Homo sapiens
cagggctgtggggtcact

SEQ ID NO: 40587 - DNA, 22 bp, Homo sapiens
actcaaatagcaacggtgagaa

SEQ ID NO: 40588 - DNA, 22 bp, Homo sapiens
gtccttccacatggccaacttc

SEQ ID NO: 40589 - DNA, 22 bp, Homo sapiens
ctggctgggagcgagctgctca

SEQ ID NO: 40590 - DNA, 22 bp, Homo sapiens
tggtgggctgagtctcatcgga

SEQ ID NO: 40591 - DNA, 22 bp, Homo sapiens
aggggcgtgctcttccccgacg

SEQ ID NO: 40592 - DNA, 22 bp, Homo sapiens
cggctcactgcagctccgcctc

SEQ ID NO: 40593 - DNA, 22 bp, Homo sapiens
actgggcctgattgggtcggag

SEQ ID NO: 40594 - DNA, 23 bp, Homo sapiens
atgggccaagcaagacccatgac

SEQ ID NO: 40595 - DNA, 22 bp, Homo sapiens
gggtggtggccagcagtgggca

SEQ ID NO: 40596 - DNA, 23 bp, Homo sapiens
atgacactcctgtgcgcaccctg

SEQ ID NO: 40597 - DNA, 22 bp, Homo sapiens
gcagctattgtctcctgggccc

SEQ ID NO: 40598 - DNA, 22 bp, Homo sapiens
gtgaggtggtacaatattaact

SEQ ID NO: 40599 - DNA, 22 bp, Homo sapiens
tcacagcctggacagttgcctg

SEQ ID NO: 40600 - DNA, 22 bp, Homo sapiens
ttcaccctggaccagaaattgg

SEQ ID NO: 40601 - DNA, 22 bp, Homo sapiens
gctggccacagatccccaggga

SEQ ID NO: 40602 - DNA, 22 bp, Homo sapiens
agcctggtttaagcattttata

SEQ ID NO: 40603 - DNA, 22 bp, Homo sapiens
aaagcagaggttgcagtgagct

SEQ ID NO: 40604 - DNA, 23 bp, Homo sapiens
gcctgggagttgcgatctgcccg

SEQ ID NO: 40605 - DNA, 22 bp, Homo sapiens
cgccggcttgaggcaggcggca

SEQ ID NO: 40606 - DNA, 22 bp, Homo sapiens
attgtgaatagtgccgcagtaa

SEQ ID NO: 40607 - DNA, 22 bp, Homo sapiens
aaatgcacaaagattttgcact

SEQ ID NO: 40608 - DNA, 22 bp, Homo sapiens
gatggcctcatggctgcaggcc

SEQ ID NO: 40609 - DNA, 22 bp, Homo sapiens
aagctgttgttcatcctgaatt

SEQ ID NO: 40610 - DNA, 23 bp, Homo sapiens
ggatggacgtgatgccttagcca

SEQ ID NO: 40611 - DNA, 22 bp, Homo sapiens
ggagagggtaggggtcctgccc

SEQ ID NO: 40612 - DNA, 22 bp, Homo sapiens
tgtggggatcttctagcttttc

SEQ ID NO: 40613 - DNA, 22 bp, Homo sapiens
aatggcactttataaatgttaa

SEQ ID NO: 40614 - DNA, 22 bp, Homo sapiens
gccagcagcttcttctcatcct

SEQ ID NO: 40615 - DNA, 22 bp, Homo sapiens
aaggtccttttgcagtgtgatc

SEQ ID NO: 40616 - DNA, 22 bp, Homo sapiens
attgcactccagcctgggtgac

SEQ ID NO: 40617 - DNA, 22 bp, Homo sapiens
attgcactccggcctgggtgac

SEQ ID NO: 40618 - DNA, 21 bp, Homo sapiens
tcgtgcagcagctgaggcttg

SEQ ID NO: 40619 - DNA, 22 bp, Homo sapiens
tgagtggacacctgcttcttta

SEQ ID NO: 40620 - DNA, 22 bp, Homo sapiens
attgcacttcagcctgggtgac

SEQ ID NO: 40621 - DNA, 22 bp, Homo sapiens
tggggagaaatgtctttgttcc

SEQ ID NO: 40622 - DNA, 22 bp, Homo sapiens
cctgcctatgagacgttttgcc

SEQ ID NO: 40623 - DNA, 21 bp, Homo sapiens
gggcagaggggcctcctgggt

SEQ ID NO: 40624 - DNA, 19 bp, Homo sapiens
tggctctgtcgaaggcaca

SEQ ID NO: 40625 - DNA, 22 bp, Homo sapiens
cactgcaacctccacctcctgg

SEQ ID NO: 40626 - DNA, 22 bp, Homo sapiens
caggaaggcgcggctgtgcctg

SEQ ID NO: 40627 - DNA, 22 bp, Homo sapiens
gttgtgaatagtgccgcaataa

SEQ ID NO: 40628 - DNA, 22 bp, Homo sapiens
ttttggctctgtctgtatcttt

SEQ ID NO: 40629 - DNA, 22 bp, Homo sapiens
gtggagaggaacccagctctgt

SEQ ID NO: 40630 - DNA, 22 bp, Homo sapiens
tcactgcaacctccacctcccg

SEQ ID NO: 40631 - DNA, 22 bp, Homo sapiens
gttctgagtcctcctttgaagg

SEQ ID NO: 40632 - DNA, 22 bp, Homo sapiens
gggccggagctgggtcccgcgc

SEQ ID NO: 40633 - DNA, 22 bp, Homo sapiens
gcacagccacgtaatgtggtca

SEQ ID NO: 40634 - DNA, 22 bp, Homo sapiens
aggtgactggtttatctggcag

SEQ ID NO: 40635 - DNA, 22 bp, Homo sapiens
agctgattccactttttcccca

SEQ ID NO: 40636 - DNA, 22 bp, Homo sapiens
ccgggcctcgggacaccgggta

SEQ ID NO: 40637 - DNA, 22 bp, Homo sapiens
ggcatagcggctcagcgtccag

SEQ ID NO: 40638 - DNA, 22 bp, Homo sapiens
tcactgcaacctccacctcctg

SEQ ID NO: 40639 - DNA, 22 bp, Homo sapiens
gagcaggtgcctgtagctctct

SEQ ID NO: 40640 - DNA, 22 bp, Homo sapiens
aggaggggttctcgggtgctga

SEQ ID NO: 40641 - DNA, 22 bp, Homo sapiens
aggtctcttgctgtctctgggc

SEQ ID NO: 40642 - DNA, 22 bp, Homo sapiens
gagagtctagtgcacctagttt

SEQ ID NO: 40643 - DNA, 22 bp, Homo sapiens
cttgtagaattgaaatggtctc

SEQ ID NO: 40644 - DNA, 22 bp, Homo sapiens
attgcactccagcctgggggac

SEQ ID NO: 40645 - DNA, 22 bp, Homo sapiens
gcaggagaacaaagcaagctgc

SEQ ID NO: 40646 - DNA, 22 bp, Homo sapiens
tttgtgaataggttggcttcca

SEQ ID NO: 40647 - DNA, 22 bp, Homo sapiens
ggggccttggatctgtgccccg

SEQ ID NO: 40648 - DNA, 22 bp, Homo sapiens
tggcacaggatctcagcggcca

SEQ ID NO: 40649 - DNA, 22 bp, Homo sapiens
cttgcctttgtcttcaaaggct

SEQ ID NO: 40650 - DNA, 22 bp, Homo sapiens
gggagaggttacccgagcaact

SEQ ID NO: 40651 - DNA, 22 bp, Homo sapiens
ttgcactccagcccgagcaaca

SEQ ID NO: 40652 - DNA, 22 bp, Homo sapiens
caggaaggggctcactctggcc

SEQ ID NO: 40653 - DNA, 22 bp, Homo sapiens
gggacaatggaggcctctctcc

SEQ ID NO: 40654 - DNA, 22 bp, Homo sapiens
tcttgcacttcatgaatatgtt

SEQ ID NO: 40655 - DNA, 22 bp, Homo sapiens
aggaaggactccatggtccgtc

SEQ ID NO: 40656 - DNA, 22 bp, Homo sapiens
acggcttcttgactgtgggttg

SEQ ID NO: 40657 - DNA, 22 bp, Homo sapiens
cgcggtggcggcctccagcgcc

SEQ ID NO: 40658 - DNA, 20 bp, Homo sapiens
aaacgagccatcattctggt

SEQ ID NO: 40659 - DNA, 22 bp, Homo sapiens
ggtccccgtggaggctggagcg

SEQ ID NO: 40660 - DNA, 22 bp, Homo sapiens
tttcccaggctggaatgcagtg

SEQ ID NO: 40661 - DNA, 22 bp, Homo sapiens
aggagggagcttaagccaggca

SEQ ID NO: 40662 - DNA, 22 bp, Homo sapiens
aggggtcagcccttttgtcagc

SEQ ID NO: 40663 - DNA, 22 bp, Homo sapiens
gtgcacatcgtgcaggtttgtt

SEQ ID NO: 40664 - DNA, 22 bp, Homo sapiens
aactaatacattaatacatgtg

SEQ ID NO: 40665 - DNA, 22 bp, Homo sapiens
taccagggaacagggatattaa

SEQ ID NO: 40666 - DNA, 22 bp, Homo sapiens
gggaagagggagctggaatgat

SEQ ID NO: 40667 - DNA, 22 bp, Homo sapiens
tcctgggaggcggaggttgcag

SEQ ID NO: 40668 - DNA, 22 bp, Homo sapiens
tctgccacttgaggtcattggc

SEQ ID NO: 40669 - DNA, 22 bp, Homo sapiens
gcctgtgtggatgcgccggtgc

SEQ ID NO: 40670 - DNA, 22 bp, Homo sapiens
acaaagtgctgacattacaggc

SEQ ID NO: 40671 - DNA, 22 bp, Homo sapiens
gatcctgggcccttctgggtca

SEQ ID NO: 40672 - DNA, 22 bp, Homo sapiens
ggggatggaggcgtgtggtcct

SEQ ID NO: 40673 - DNA, 22 bp, Homo sapiens
gcactccagcctgggtaacagc

SEQ ID NO: 40674 - DNA, 22 bp, Homo sapiens
tggaggctggagtgcagtggcg

SEQ ID NO: 40675 - DNA, 22 bp, Homo sapiens
gcaaacaaggacatacatcctg

SEQ ID NO: 40676 - DNA, 22 bp, Homo sapiens
tgatattttatgagctttcata

SEQ ID NO: 40677 - DNA, 22 bp, Homo sapiens
ggctcactgcaaactgtgcctc

SEQ ID NO: 40678 - DNA, 22 bp, Homo sapiens
accatgttggccaagctggtct

SEQ ID NO: 40679 - DNA, 22 bp, Homo sapiens
agggtgaatctcacaactctta

SEQ ID NO: 40680 - DNA, 22 bp, Homo sapiens
gctgctgggatcctgggtctca

SEQ ID NO: 40681 - DNA, 21 bp, Homo sapiens
gttcttgcaggatttccttcc

SEQ ID NO: 40682 - DNA, 22 bp, Homo sapiens
cctcagacccctgctgagcttc

SEQ ID NO: 40683 - DNA, 22 bp, Homo sapiens
gtggggtagatctttctcagga

SEQ ID NO: 40684 - DNA, 22 bp, Homo sapiens
gatattcctgaaggacagggtt

SEQ ID NO: 40685 - DNA, 23 bp, Homo sapiens
gcagaggagcaagctggacacca

SEQ ID NO: 40686 - DNA, 22 bp, Homo sapiens
gaggtgggcggatcacaaggtc

SEQ ID NO: 40687 - DNA, 22 bp, Homo sapiens
aatccaggtggcggaggttgtg

SEQ ID NO: 40688 - DNA, 22 bp, Homo sapiens
ggagaggcttccagagtcgtgc

SEQ ID NO: 40689 - DNA, 22 bp, Homo sapiens
tttgaaatgtatcagtataggt

SEQ ID NO: 40690 - DNA, 22 bp, Homo sapiens
actgcactcctgcctgggtaac

SEQ ID NO: 40691 - DNA, 22 bp, Homo sapiens
gtagcccacctggggagggcga

SEQ ID NO: 40692 - DNA, 22 bp, Homo sapiens
attttctctttgtatatgctag

SEQ ID NO: 40693 - DNA, 22 bp, Homo sapiens
tgtagctctccagccagcaagg

SEQ ID NO: 40694 - DNA, 22 bp, Homo sapiens
aggcaaatgatcctgctccttg

SEQ ID NO: 40695 - DNA, 22 bp, Homo sapiens
ttgggctcaggagtttgagacc

SEQ ID NO: 40696 - DNA, 22 bp, Homo sapiens
taaagggtaggttttactgtaa

SEQ ID NO: 40697 - DNA, 22 bp, Homo sapiens
tacaaagtcttgggttctaggc

SEQ ID NO: 40698 - DNA, 22 bp, Homo sapiens
gtagaccatttatctggggagt

SEQ ID NO: 40699 - DNA, 22 bp, Homo sapiens
actgggccaggtgtgggtgagt

SEQ ID NO: 40700 - DNA, 22 bp, Homo sapiens
tgacttgtctctttgggagaca

SEQ ID NO: 40701 - DNA, 22 bp, Homo sapiens
cactgcacttcagcctgggtga

SEQ ID NO: 40702 - DNA, 22 bp, Homo sapiens
cctgcacagccggacccctgct

SEQ ID NO: 40703 - DNA, 22 bp, Homo sapiens
acagacaagtagttcagacaag

SEQ ID NO: 40704 - DNA, 19 bp, Homo sapiens
tgtgatattgttagtaata

SEQ ID NO: 40705 - DNA, 22 bp, Homo sapiens
agtgccctttacaacttcttga

SEQ ID NO: 40706 - DNA, 22 bp, Homo sapiens
atatgggggggcgtgcagagga

SEQ ID NO: 40707 - DNA, 22 bp, Homo sapiens
ttgcacagaatgacaatatgta

SEQ ID NO: 40708 - DNA, 22 bp, Homo sapiens
taaatacttagttttgtgtcta

SEQ ID NO: 40709 - DNA, 22 bp, Homo sapiens
atttctctgcagtgttcggaat

SEQ ID NO: 40710 - DNA, 22 bp, Homo sapiens
tgggaggccgaggcaggtggat

SEQ ID NO: 40711 - DNA, 18 bp, Homo sapiens
gatatggaaggccatgcc

SEQ ID NO: 40712 - DNA, 22 bp, Homo sapiens
tggtcttagctggaaggaggga

SEQ ID NO: 40713 - DNA, 22 bp, Homo sapiens
ctcactgcaagctctgcctccc

SEQ ID NO: 40714 - DNA, 22 bp, Homo sapiens
atgccactgcactccagcctag

SEQ ID NO: 40715 - DNA, 22 bp, Homo sapiens
cccagttgttgccggctctgga

SEQ ID NO: 40716 - DNA, 22 bp, Homo sapiens
ggagggcagagtcccctgctga

SEQ ID NO: 40717 - DNA, 22 bp, Homo sapiens
gagaggtggaggttgcagtgag

SEQ ID NO: 40718 - DNA, 21 bp, Homo sapiens
atatcaatacagcaggacttc

SEQ ID NO: 40719 - DNA, 22 bp, Homo sapiens
ctggagggtggagagaagtctc

SEQ ID NO: 40720 - DNA, 22 bp, Homo sapiens
agaacctcaattatttttgcac

SEQ ID NO: 40721 - DNA, 22 bp, Homo sapiens
ttttaatactgctattgtagga

SEQ ID NO: 40722 - DNA, 22 bp, Homo sapiens
gaccttgtgatccacccgcctt

SEQ ID NO: 40723 - DNA, 22 bp, Homo sapiens
gtggcagaccttcccttctcct

SEQ ID NO: 40724 - DNA, 22 bp, Homo sapiens
gtggatggagctggaagccatt

SEQ ID NO: 40725 - DNA, 22 bp, Homo sapiens
agtgaatgtccccgcgggtcag

SEQ ID NO: 40726 - DNA, 22 bp, Homo sapiens
aggaatggtgctcagcagaaat

SEQ ID NO: 40727 - DNA, 22 bp, Homo sapiens
ggaaggggtgggtgagcctcag

SEQ ID NO: 40728 - DNA, 22 bp, Homo sapiens
atgcagaagactgaaaagctga

SEQ ID NO: 40729 - DNA, 22 bp, Homo sapiens
ctgagtttccagataagacctt

SEQ ID NO: 40730 - DNA, 19 bp, Homo sapiens
gactcacaccttccgctgt

SEQ ID NO: 40731 - DNA, 23 bp, Homo sapiens
aaacttgctatggctgaaatcat

SEQ ID NO: 40732 - DNA, 22 bp, Homo sapiens
gggcagatcacctgaggtcagg

SEQ ID NO: 40733 - DNA, 22 bp, Homo sapiens
atatattttttgagacagagtc

SEQ ID NO: 40734 - DNA, 22 bp, Homo sapiens
ggtgccctggaagctgctgcat

SEQ ID NO: 40735 - DNA, 22 bp, Homo sapiens
ctgccctggggggcctccttgc

SEQ ID NO: 40736 - DNA, 22 bp, Homo sapiens
cacccaggctggaatgcagtgg

SEQ ID NO: 40737 - DNA, 21 bp, Homo sapiens
gctgctcgagatccagtgctt

SEQ ID NO: 40738 - DNA, 22 bp, Homo sapiens
tcactacaacctccgcctcctg

SEQ ID NO: 40739 - DNA, 22 bp, Homo sapiens
gggccctgggattcagagcaag

SEQ ID NO: 40740 - DNA, 22 bp, Homo sapiens
tgattcatcagaataggagttt

SEQ ID NO: 40741 - DNA, 22 bp, Homo sapiens
agaggccggccgagcccatggg

SEQ ID NO: 40742 - DNA, 22 bp, Homo sapiens
ctgctaaacctctctgagagct

SEQ ID NO: 40743 - DNA, 22 bp, Homo sapiens
atttcatactaaggctcaaaaa

SEQ ID NO: 40744 - DNA, 22 bp, Homo sapiens
tttattctgtgctacatgaaga

SEQ ID NO: 40745 - DNA, 22 bp, Homo sapiens
gcttctggtgaggcctcaggaa

SEQ ID NO: 40746 - DNA, 22 bp, Homo sapiens
gcccatgcactttctgtgatgg

SEQ ID NO: 40747 - DNA, 22 bp, Homo sapiens
cacatgaaggctggggtcgtga

SEQ ID NO: 40748 - DNA, 22 bp, Homo sapiens
ttggcataccttagtggtggag

SEQ ID NO: 40749 - DNA, 22 bp, Homo sapiens
cagtaatgggcaagacaatatg

SEQ ID NO: 40750 - DNA, 22 bp, Homo sapiens
ctggaaggcggaggttgtagtg

SEQ ID NO: 40751 - DNA, 19 bp, Homo sapiens
gcctatgtcttcaaatcat

SEQ ID NO: 40752 - DNA, 22 bp, Homo sapiens
gtatcggtttatttttgggata

SEQ ID NO: 40753 - DNA, 22 bp, Homo sapiens
cctggcaggtggcgccctcggc

SEQ ID NO: 40754 - DNA, 23 bp, Homo sapiens
tgcatggggctatactgctgttc

SEQ ID NO: 40755 - DNA, 20 bp, Homo sapiens
ttggatgtgcatggccgtgc

SEQ ID NO: 40756 - DNA, 22 bp, Homo sapiens
acatacttctttacattccata

SEQ ID NO: 40757 - DNA, 22 bp, Homo sapiens
gcaggagaacaaagcaagctgc

SEQ ID NO: 40758 - DNA, 22 bp, Homo sapiens
aagagggctgcaatcttattgc

SEQ ID NO: 40759 - DNA, 19 bp, Homo sapiens
catggtgaaaccccgtctc

SEQ ID NO: 40760 - DNA, 22 bp, Homo sapiens
ggaggctgagaggtcgcagtgg

SEQ ID NO: 40761 - DNA, 22 bp, Homo sapiens
gagccaggaggcagagactgca

SEQ ID NO: 40762 - DNA, 22 bp, Homo sapiens
cgcgctgcagacagcggaggcc

SEQ ID NO: 40763 - DNA, 22 bp, Homo sapiens
gcccagcacctctctcagggtt

SEQ ID NO: 40764 - DNA, 22 bp, Homo sapiens
tctctagtctcctttaacctga

SEQ ID NO: 40765 - DNA, 22 bp, Homo sapiens
atacaaagtattaatcctggat

SEQ ID NO: 40766 - DNA, 22 bp, Homo sapiens
cagagagaatcttggcagctga

SEQ ID NO: 40767 - DNA, 22 bp, Homo sapiens
ttcaatttgtgctaaggcaccg

SEQ ID NO: 40768 - DNA, 22 bp, Homo sapiens
agcctgggccctgcctcttctc

SEQ ID NO: 40769 - DNA, 22 bp, Homo sapiens
aaaaatcacttttataggcagc

SEQ ID NO: 40770 - DNA, 22 bp, Homo sapiens
ctctgcctgtctcatcctgcaa

SEQ ID NO: 40771 - DNA, 22 bp, Homo sapiens
gtagttctgcagtgtcacctga

SEQ ID NO: 40772 - DNA, 22 bp, Homo sapiens
ctacaaaagtaattgtggtttt

SEQ ID NO: 40773 - DNA, 23 bp, Homo sapiens
aggatgtaggatgtatggcagag

SEQ ID NO: 40774 - DNA, 22 bp, Homo sapiens
cagagatgtgatccagctgtct

SEQ ID NO: 40775 - DNA, 17 bp, Homo sapiens
ttcttttctgagccttg

SEQ ID NO: 40776 - DNA, 22 bp, Homo sapiens
aaatgtaagtctttgtttctta

SEQ ID NO: 40777 - DNA, 22 bp, Homo sapiens
caatttctaacattccatggat

SEQ ID NO: 40778 - DNA, 22 bp, Homo sapiens
ttacctaaaatagctcaattta

SEQ ID NO: 40779 - DNA, 22 bp, Homo sapiens
ccagcccgaatccctggccagg

SEQ ID NO: 40780 - DNA, 22 bp, Homo sapiens
cacatttttactgccaacttaa

SEQ ID NO: 40781 - DNA, 22 bp, Homo sapiens
ggaggtgactggatcatgggca

SEQ ID NO: 40782 - DNA, 22 bp, Homo sapiens
accttgatggggctgttggagt

SEQ ID NO: 40783 - DNA, 22 bp, Homo sapiens
agatcacagtggcaactccctt

SEQ ID NO: 40784 - DNA, 22 bp, Homo sapiens
acatttttcacatttgtagggt

SEQ ID NO: 40785 - DNA, 22 bp, Homo sapiens
tctttcttgtgggtgccctttt

SEQ ID NO: 40786 - DNA, 22 bp, Homo sapiens
ggaggtgggctaaggactctct

SEQ ID NO: 40787 - DNA, 22 bp, Homo sapiens
gctcccagtctgatggaggaga

SEQ ID NO: 40788 - DNA, 22 bp, Homo sapiens
atttttctctttccactgagat

SEQ ID NO: 40789 - DNA, 22 bp, Homo sapiens
ctgagctcaagcgatcctccca

SEQ ID NO: 40790 - DNA, 22 bp, Homo sapiens
tacaggcatgtagcatggtgat

SEQ ID NO: 40791 - DNA, 22 bp, Homo sapiens
cttgtcagccaattgtggattt

SEQ ID NO: 40792 - DNA, 22 bp, Homo sapiens
gaccctctagatggaagcactg

SEQ ID NO: 40793 - DNA, 22 bp, Homo sapiens
gtttacttgtgccttggcttaa

SEQ ID NO: 40794 - DNA, 22 bp, Homo sapiens
ctggagagaatgtggaatgatt

SEQ ID NO: 40795 - DNA, 22 bp, Homo sapiens
ggagagggtaggggtcctgccc

SEQ ID NO: 40796 - DNA, 19 bp, Homo sapiens
tggttctccttccacagtc

SEQ ID NO: 40797 - DNA, 22 bp, Homo sapiens
actgcaacacctcctgggttca

SEQ ID NO: 40798 - DNA, 23 bp, Homo sapiens
gcctgggagttgcgatctgcccg

SEQ ID NO: 40799 - DNA, 22 bp, Homo sapiens
tgctgggggtagctctgcgtag

SEQ ID NO: 40800 - DNA, 22 bp, Homo sapiens
agggaattcactggaacgccct

SEQ ID NO: 40801 - DNA, 22 bp, Homo sapiens
gcaactgaacatgtgtgtggcc

SEQ ID NO: 40802 - DNA, 21 bp, Homo sapiens
gggcagaggggcctcctgggt

SEQ ID NO: 40803 - DNA, 22 bp, Homo sapiens
cccaggccctggcagagcttgt

SEQ ID NO: 40804 - DNA, 22 bp, Homo sapiens
acacttggagcaacacttatgg

SEQ ID NO: 40805 - DNA, 23 bp, Homo sapiens
ccagtgattgcctggaaggaggt

SEQ ID NO: 40806 - DNA, 22 bp, Homo sapiens
ggaggcggaggttgcagtgagc

SEQ ID NO: 40807 - DNA, 22 bp, Homo sapiens
ctgggaggcggaggttgtagtg

SEQ ID NO: 40808 - DNA, 22 bp, Homo sapiens
catgagataatttttctccagt

SEQ ID NO: 40809 - DNA, 22 bp, Homo sapiens
aggccctattcaatggggccca

SEQ ID NO: 40810 - DNA, 22 bp, Homo sapiens
ttcaccagcagctcactagtca

SEQ ID NO: 40811 - DNA, 22 bp, Homo sapiens
ggagcagggaattacagcgcag

SEQ ID NO: 40812 - DNA, 18 bp, Homo sapiens
ccctgccagctcccagca

SEQ ID NO: 40813 - DNA, 22 bp, Homo sapiens
ggctggtgttgagtgcctgtag

SEQ ID NO: 40814 - DNA, 22 bp, Homo sapiens
ctgaggagaggtggcctgtgtt

SEQ ID NO: 40815 - DNA, 22 bp, Homo sapiens
agcagcttgaggctggattcca

SEQ ID NO: 40816 - DNA, 22 bp, Homo sapiens
agccagggacgctgcaggctac

SEQ ID NO: 40817 - DNA, 22 bp, Homo sapiens
ttttctaacatctagtaatttg

SEQ ID NO: 40818 - DNA, 21 bp, Homo sapiens
taaacataaccttgtatggct

SEQ ID NO: 40819 - DNA, 22 bp, Homo sapiens
actgcaacctccgcctgccagg

SEQ ID NO: 40820 - DNA, 22 bp, Homo sapiens
gaatatcccgctatgcaaagta

SEQ ID NO: 40821 - DNA, 22 bp, Homo sapiens
cgtcatcacggcaagcatctcc

SEQ ID NO: 40822 - DNA, 22 bp, Homo sapiens
ttctcttacattttctcagcct

SEQ ID NO: 40823 - DNA, 22 bp, Homo sapiens
ctgcggctggggacagctgttg

SEQ ID NO: 40824 - DNA, 22 bp, Homo sapiens
ttccatatctgttgcatatcat

SEQ ID NO: 40825 - DNA, 23 bp, Homo sapiens
tgagctgggcctgcaggggtctc

SEQ ID NO: 40826 - DNA, 22 bp, Homo sapiens
ccaggcagcctgctccattctg

SEQ ID NO: 40827 - DNA, 22 bp, Homo sapiens
ttcccttaaattatggcatcta

SEQ ID NO: 40828 - DNA, 17 bp, Homo sapiens
gtaaggcttgcagatgc

SEQ ID NO: 40829 - DNA, 22 bp, Homo sapiens
aagaaatgtgaatattgaatag

SEQ ID NO: 40830 - DNA, 22 bp, Homo sapiens
tgatatgtaactactccttata

SEQ ID NO: 40831 - DNA, 22 bp, Homo sapiens
cttgaggctgcactccagggcc

SEQ ID NO: 40832 - DNA, 22 bp, Homo sapiens
agtggcctggagccccgcctgg

SEQ ID NO: 40833 - DNA, 22 bp, Homo sapiens
tagcttatcccacagtgcccag

SEQ ID NO: 40834 - DNA, 22 bp, Homo sapiens
tgcacgtgggctctctgctctt

SEQ ID NO: 40835 - DNA, 22 bp, Homo sapiens
ctgaggcctctcccactccagc

SEQ ID NO: 40836 - DNA, 22 bp, Homo sapiens
ccaggctggagtgcaatggcgt

SEQ ID NO: 40837 - DNA, 22 bp, Homo sapiens
atcacccaagctggagtgcagt

SEQ ID NO: 40838 - DNA, 22 bp, Homo sapiens
atgccactgcacttcagcctgg

SEQ ID NO: 40839 - DNA, 22 bp, Homo sapiens
ctggtagctcctgaatatccct

SEQ ID NO: 40840 - DNA, 22 bp, Homo sapiens
gtctctatcatagctgaaccct

SEQ ID NO: 40841 - DNA, 19 bp, Homo sapiens
gttggcactgaaaatggct

SEQ ID NO: 40842 - DNA, 22 bp, Homo sapiens
gatctcaaagcagtgtgggttg

SEQ ID NO: 40843 - DNA, 23 bp, Homo sapiens
ctcaaccctagtaagggagtagg

SEQ ID NO: 40844 - DNA, 22 bp, Homo sapiens
cagatcacttgaagccaggagt

SEQ ID NO: 40845 - DNA, 22 bp, Homo sapiens
agaggcaggaggttgacttgag

SEQ ID NO: 40846 - DNA, 22 bp, Homo sapiens
gaggcgggcagatcacctgagg

SEQ ID NO: 40847 - DNA, 22 bp, Homo sapiens
cagctgttcattgttgccaccc

SEQ ID NO: 40848 - DNA, 22 bp, Homo sapiens
cagagctggtgtgtcctggcat

SEQ ID NO: 40849 - DNA, 22 bp, Homo sapiens
gaaacactcaatttagtaattc

SEQ ID NO: 40850 - DNA, 22 bp, Homo sapiens
tcaggaggtccgcccgggaggg

SEQ ID NO: 40851 - DNA, 22 bp, Homo sapiens
gccaggcgggtctcaaactcct

SEQ ID NO: 40852 - DNA, 22 bp, Homo sapiens
gaatttcctctaaacccctgag

SEQ ID NO: 40853 - DNA, 22 bp, Homo sapiens
tcctcgatgggcaggaagatct

SEQ ID NO: 40854 - DNA, 22 bp, Homo sapiens
ccctgctgtcaggtgctgggag

SEQ ID NO: 40855 - DNA, 22 bp, Homo sapiens
ggcaaggggtcaggctgagaca

SEQ ID NO: 40856 - DNA, 22 bp, Homo sapiens
accagaagctggagcacaagga

SEQ ID NO: 40857 - DNA, 19 bp, Homo sapiens
tcctgcctggggccgcctg

SEQ ID NO: 40858 - DNA, 22 bp, Homo sapiens
ctagataacttattttcaagga

SEQ ID NO: 40859 - DNA, 22 bp, Homo sapiens
ttcagcttgctgactgcggcag

SEQ ID NO: 40860 - DNA, 22 bp, Homo sapiens
ctgggcctggggctgttgagag

SEQ ID NO: 40861 - DNA, 22 bp, Homo sapiens
agatttatgtggtcacactcag

SEQ ID NO: 40862 - DNA, 22 bp, Homo sapiens
gcagcctgggcaacagagtgag

SEQ ID NO: 40863 - DNA, 22 bp, Homo sapiens
ttattttaccttcctctgagct

SEQ ID NO: 40864 - DNA, 22 bp, Homo sapiens
ttttcatttttgtagatgcaag

SEQ ID NO: 40865 - DNA, 22 bp, Homo sapiens
caggaaggggctcactctggcc

SEQ ID NO: 40866 - DNA, 22 bp, Homo sapiens
aaagaaatagatggcatttaaa

SEQ ID NO: 40867 - DNA, 22 bp, Homo sapiens
gaggcagaagttgcagtgagca

SEQ ID NO: 40868 - DNA, 22 bp, Homo sapiens
gaggctggacgtgcatttctac

SEQ ID NO: 40869 - DNA, 22 bp, Homo sapiens
atgacaagagtgttcagggaga

SEQ ID NO: 40870 - DNA, 22 bp, Homo sapiens
tgcagcacttgccaaactaact

SEQ ID NO: 40871 - DNA, 22 bp, Homo sapiens
ctgctgagccgcacccaggagc

SEQ ID NO: 40872 - DNA, 22 bp, Homo sapiens
acccacaacagctctaggaagt

SEQ ID NO: 40873 - DNA, 22 bp, Homo sapiens
tcattgccatggcatttgcaga

SEQ ID NO: 40874 - DNA, 22 bp, Homo sapiens
gaggtggccaagcgaggaaggg

SEQ ID NO: 40875 - DNA, 22 bp, Homo sapiens
tgttgatttgtgggctgcaaaa

SEQ ID NO: 40876 - DNA, 22 bp, Homo sapiens
tgagaaattacttcagtgatgg

SEQ ID NO: 40877 - DNA, 22 bp, Homo sapiens
caatcaatgctgctagttcctt

SEQ ID NO: 40878 - DNA, 22 bp, Homo sapiens
gggcaggggtcagtggccccaa

SEQ ID NO: 40879 - DNA, 22 bp, Homo sapiens
actgcactccagcctgggtaac

SEQ ID NO: 40880 - DNA, 22 bp, Homo sapiens
actgcactccaacctgggtgac

SEQ ID NO: 40881 - DNA, 22 bp, Homo sapiens
cccatgcaccctctaagaagga

SEQ ID NO: 40882 - DNA, 22 bp, Homo sapiens
agacagggtgatcgcttgagcc

SEQ ID NO: 40883 - DNA, 22 bp, Homo sapiens
ggcaggaggtgagtggcgggtg

SEQ ID NO: 40884 - DNA, 22 bp, Homo sapiens
ctgtaatcccagctactcggga

SEQ ID NO: 40885 - DNA, 22 bp, Homo sapiens
cactgcactccagcctgggaga

SEQ ID NO: 40886 - DNA, 22 bp, Homo sapiens
ggagagtggattccagctgtat

SEQ ID NO: 40887 - DNA, 22 bp, Homo sapiens
taagtcatagattaatggccac

SEQ ID NO: 40888 - DNA, 22 bp, Homo sapiens
tcagggattgcaaaattcatcc

SEQ ID NO: 40889 - DNA, 22 bp, Homo sapiens
ccgaggtcctggacttggccct

SEQ ID NO: 40890 - DNA, 22 bp, Homo sapiens
aggtaaagacagtgaaagaggg

SEQ ID NO: 40891 - DNA, 22 bp, Homo sapiens
tatcttaaaaatcgaagcagat

SEQ ID NO: 40892 - DNA, 22 bp, Homo sapiens
cataaaaggtagcagtttgaaa

SEQ ID NO: 40893 - DNA, 22 bp, Homo sapiens
ccccacaactcatgttgaaact

SEQ ID NO: 40894 - DNA, 22 bp, Homo sapiens
gtggctgcagcggctgtggaga

SEQ ID NO: 40895 - DNA, 22 bp, Homo sapiens
gggctgcatcagcaggacccgg

SEQ ID NO: 40896 - DNA, 22 bp, Homo sapiens
agaccaaagaaaacacatctgg

SEQ ID NO: 40897 - DNA, 22 bp, Homo sapiens
tcactgcaacctccgcctgctg

SEQ ID NO: 40898 - DNA, 22 bp, Homo sapiens
acagcagcaatagcagtgacat

SEQ ID NO: 40899 - DNA, 22 bp, Homo sapiens
actgcatttggtaaagtcaaga

SEQ ID NO: 40900 - DNA, 23 bp, Homo sapiens
tctacaaagctgtgtcaggaccc

SEQ ID NO: 40901 - DNA, 22 bp, Homo sapiens
ggtgacagtggttaaaatttgt

SEQ ID NO: 40902 - DNA, 22 bp, Homo sapiens
gtcagatctttggggatgctgt

SEQ ID NO: 40903 - DNA, 22 bp, Homo sapiens
gggctgcactagggcaaggtga

SEQ ID NO: 40904 - DNA, 22 bp, Homo sapiens
gaggagggagctggaagctctt

SEQ ID NO: 40905 - DNA, 22 bp, Homo sapiens
ccaggaggtggagattgcagtg

SEQ ID NO: 40906 - DNA, 22 bp, Homo sapiens
gaggcaggcagattgcttgagg

SEQ ID NO: 40907 - DNA, 22 bp, Homo sapiens
gctggaggatggactggaagaa

SEQ ID NO: 40908 - DNA, 22 bp, Homo sapiens
agcattccacactgaagtctgc

SEQ ID NO: 40909 - DNA, 22 bp, Homo sapiens
ttgcagattcggctgctcagga

SEQ ID NO: 40910 - DNA, 22 bp, Homo sapiens
actgcactccagcctgggtgat

SEQ ID NO: 40911 - DNA, 22 bp, Homo sapiens
aataaaatggtcagttttctca

SEQ ID NO: 40912 - DNA, 22 bp, Homo sapiens
aaggagtctgggccattcagag

SEQ ID NO: 40913 - DNA, 22 bp, Homo sapiens
taagaaatttagttatagaatg

SEQ ID NO: 40914 - DNA, 22 bp, Homo sapiens
aagtaaatatctgtagtcttta

SEQ ID NO: 40915 - DNA, 22 bp, Homo sapiens
tgcctcagctgaggccgctcca

SEQ ID NO: 40916 - DNA, 22 bp, Homo sapiens
tgacaatgaggccctccacaaa

SEQ ID NO: 40917 - DNA, 22 bp, Homo sapiens
gccctgccctctcggcactcgc

SEQ ID NO: 40918 - DNA, 22 bp, Homo sapiens
acgcagtttgtggacatttttt

SEQ ID NO: 40919 - DNA, 22 bp, Homo sapiens
ctgaagcagggagtgatgaagt

SEQ ID NO: 40920 - DNA, 22 bp, Homo sapiens
cgtgccctgcgcaagtgctgct

SEQ ID NO: 40921 - DNA, 22 bp, Homo sapiens
gatggaggagatggcagggtgc

SEQ ID NO: 40922 - DNA, 22 bp, Homo sapiens
gaggtgggtgtatcacaggtca

SEQ ID NO: 40923 - DNA, 22 bp, Homo sapiens
ctggagggctgcagcgaggctg

SEQ ID NO: 40924 - DNA, 22 bp, Homo sapiens
attctaaatcagagagctctgt

SEQ ID NO: 40925 - DNA, 22 bp, Homo sapiens
cctccctgccggctggactagt

SEQ ID NO: 40926 - DNA, 22 bp, Homo sapiens
gtgtttggtcagacgtccgggg

SEQ ID NO: 40927 - DNA, 21 bp, Homo sapiens
gccatttcacacagacatttg

SEQ ID NO: 40928 - DNA, 22 bp, Homo sapiens
ggtggcagtagcactgggcctg

SEQ ID NO: 40929 - DNA, 22 bp, Homo sapiens
tgagtgaccagaagtccccctc

SEQ ID NO: 40930 - DNA, 22 bp, Homo sapiens
ttgtcccaggacttgcatagat

SEQ ID NO: 40931 - DNA, 22 bp, Homo sapiens
atgctaaggcccaggagaaaat

SEQ ID NO: 40932 - DNA, 16 bp, Homo sapiens
gcagaggaaaggggag

SEQ ID NO: 40933 - DNA, 22 bp, Homo sapiens
cattctgaccctatgatttaag

SEQ ID NO: 40934 - DNA, 22 bp, Homo sapiens
ccctgggattcaatttcactct

SEQ ID NO: 40935 - DNA, 22 bp, Homo sapiens
tggctaacaaggtgaaaccccg

SEQ ID NO: 40936 - DNA, 23 bp, Homo sapiens
cagtacaatgtggaaaaggagtg

SEQ ID NO: 40937 - DNA, 22 bp, Homo sapiens
ctgggaagaagggacaacagcg

SEQ ID NO: 40938 - DNA, 22 bp, Homo sapiens
ttgtctaatgagctccacttca

SEQ ID NO: 40939 - DNA, 22 bp, Homo sapiens
ggctgtggcagctggaagtggt

SEQ ID NO: 40940 - DNA, 22 bp, Homo sapiens
aggagcaccattgtgctggtgt

SEQ ID NO: 40941 - DNA, 18 bp, Homo sapiens
tcactgggtgtatgtggc

SEQ ID NO: 40942 - DNA, 22 bp, Homo sapiens
aagagagtcagtctgagcacca

SEQ ID NO: 40943 - DNA, 22 bp, Homo sapiens
actgcacttcagcctgggtgac

SEQ ID NO: 40944 - DNA, 22 bp, Homo sapiens
agatgtgtttctagttcctgca

SEQ ID NO: 40945 - DNA, 22 bp, Homo sapiens
gcagcagtgctttggaatcctg

SEQ ID NO: 40946 - DNA, 22 bp, Homo sapiens
atcagaatgttttggtgtgctc

SEQ ID NO: 40947 - DNA, 22 bp, Homo sapiens
ggagccgcacgtgctgggcccg

SEQ ID NO: 40948 - DNA, 22 bp, Homo sapiens
tattctcatcatcactggagct

SEQ ID NO: 40949 - DNA, 22 bp, Homo sapiens
aggaggggttctcgggtgctga

SEQ ID NO: 40950 - DNA, 22 bp, Homo sapiens
ttcaaatgatggcagtcctggc

SEQ ID NO: 40951 - DNA, 20 bp, Homo sapiens
tgtttactctagagggtaga

SEQ ID NO: 40952 - DNA, 22 bp, Homo sapiens
tggatatccttgttaactttct

SEQ ID NO: 40953 - DNA, 22 bp, Homo sapiens
ttttctcttccctctggacctg

SEQ ID NO: 40954 - DNA, 22 bp, Homo sapiens
actgcactccagcctcggggtc

SEQ ID NO: 40955 - DNA, 22 bp, Homo sapiens
ggattgcaacaagctagtttag

SEQ ID NO: 40956 - DNA, 22 bp, Homo sapiens
ttgcccagagtcacccagctca

SEQ ID NO: 40957 - DNA, 22 bp, Homo sapiens
ccaggctggagtatagtggcgc

SEQ ID NO: 40958 - DNA, 22 bp, Homo sapiens
gagcacgttgaagcgcactgtc

SEQ ID NO: 40959 - DNA, 22 bp, Homo sapiens
catataaatacaacatgtgtta

SEQ ID NO: 40960 - DNA, 22 bp, Homo sapiens
cattccttaacgtggggagtct

SEQ ID NO: 40961 - DNA, 22 bp, Homo sapiens
gcctgcagggcctgggcctacc

SEQ ID NO: 40962 - DNA, 19 bp, Homo sapiens
tctgccgagctagaccact

SEQ ID NO: 40963 - DNA, 22 bp, Homo sapiens
tcttgcacttcatgaatatgtt

SEQ ID NO: 40964 - DNA, 22 bp, Homo sapiens
agggctggagccacagctggga

SEQ ID NO: 40965 - DNA, 22 bp, Homo sapiens
attaagactgcccatgttttta

SEQ ID NO: 40966 - DNA, 22 bp, Homo sapiens
agtgaggggcagctgagtgggc

SEQ ID NO: 40967 - DNA, 22 bp, Homo sapiens
acccagtgttgggcagaactgt

SEQ ID NO: 40968 - DNA, 22 bp, Homo sapiens
gagagcaggaggcagcgggacg

SEQ ID NO: 40969 - DNA, 22 bp, Homo sapiens
cactgcactccagcttgggtga

SEQ ID NO: 40970 - DNA, 22 bp, Homo sapiens
ggaggggatttagtagatgcta

SEQ ID NO: 40971 - DNA, 22 bp, Homo sapiens
gcaggcagaggtggaggagaca

SEQ ID NO: 40972 - DNA, 17 bp, Homo sapiens
gaggccaaggcaggcgg

SEQ ID NO: 40973 - DNA, 22 bp, Homo sapiens
atacttctttagcatattgaac

SEQ ID NO: 40974 - DNA, 22 bp, Homo sapiens
cggagtcttgctatgttgccca

SEQ ID NO: 40975 - DNA, 22 bp, Homo sapiens
gcttccacctactaaatgccac

SEQ ID NO: 40976 - DNA, 22 bp, Homo sapiens
caactcgatgggtggagaaaat

SEQ ID NO: 40977 - DNA, 22 bp, Homo sapiens
ctgcactgagcatctaacctta

SEQ ID NO: 40978 - DNA, 22 bp, Homo sapiens
tgagcttccctcctgcactaca

SEQ ID NO: 40979 - DNA, 21 bp, Homo sapiens
tcttttctcagctttgtggtt

SEQ ID NO: 40980 - DNA, 22 bp, Homo sapiens
ctcactgcaacctctgcctccc

SEQ ID NO: 40981 - DNA, 22 bp, Homo sapiens
gcccagagttcaaggctgcagt

SEQ ID NO: 40982 - DNA, 22 bp, Homo sapiens
tgggcagggagctggaaccaca

SEQ ID NO: 40983 - DNA, 22 bp, Homo sapiens
tggtatgtaaattgtaactcaa

SEQ ID NO: 40984 - DNA, 22 bp, Homo sapiens
ccagaccctccattcaagctcc

SEQ ID NO: 40985 - DNA, 22 bp, Homo sapiens
aagtccaggtcctcattccatc

SEQ ID NO: 40986 - DNA, 22 bp, Homo sapiens
atatccagcagcaggtgagtat

SEQ ID NO: 40987 - DNA, 22 bp, Homo sapiens
cactgggcgtgtcctgggtgag

SEQ ID NO: 40988 - DNA, 22 bp, Homo sapiens
ggtgttgcagttgaagactggt

SEQ ID NO: 40989 - DNA, 22 bp, Homo sapiens
agatgctgctccacaggccagg

SEQ ID NO: 40990 - DNA, 22 bp, Homo sapiens
gctggccacagatccccaggga

SEQ ID NO: 40991 - DNA, 22 bp, Homo sapiens
gttgcagatgtggaactcgtgc

SEQ ID NO: 40992 - DNA, 22 bp, Homo sapiens
tcactgcaacctccacctcccg

SEQ ID NO: 40993 - DNA, 22 bp, Homo sapiens
ctggccagatgttacgtccaat

SEQ ID NO: 40994 - DNA, 22 bp, Homo sapiens
gggctgagacgatggggtcttc

SEQ ID NO: 40995 - DNA, 22 bp, Homo sapiens
gcagctattgtctcctgggccc

SEQ ID NO: 40996 - DNA, 22 bp, Homo sapiens
ctgggaggcggaggttgcagtg

SEQ ID NO: 40997 - DNA, 17 bp, Homo sapiens
ccctcactcctgccggg

SEQ ID NO: 40998 - DNA, 18 bp, Homo sapiens
agtgtcagctgcagctca

SEQ ID NO: 40999 - DNA, 22 bp, Homo sapiens
ctggcaggtggaggttgcagtg

SEQ ID NO: 41000 - DNA, 22 bp, Homo sapiens
tatgtgtttgacaccctgcaag

SEQ ID NO: 41001 - DNA, 21 bp, Homo sapiens
tggacttatggagtgtttctt

SEQ ID NO: 41002 - DNA, 22 bp, Homo sapiens
tcaaaattaaaccaacgtccag

SEQ ID NO: 41003 - DNA, 22 bp, Homo sapiens
gaggcggaggttgcagtgagct

SEQ ID NO: 41004 - DNA, 22 bp, Homo sapiens
agtgtggagcatcgagggcaga

SEQ ID NO: 41005 - DNA, 22 bp, Homo sapiens
cccggaggcagaggttgcagtg

SEQ ID NO: 41006 - DNA, 22 bp, Homo sapiens
gggtattaaaatgaaggagaaa

SEQ ID NO: 41007 - DNA, 22 bp, Homo sapiens
gggaggaggaatgttttgtgta

SEQ ID NO: 41008 - DNA, 22 bp, Homo sapiens
gcagagctgggatatgaaccca

SEQ ID NO: 41009 - DNA, 22 bp, Homo sapiens
accactgcccatggtgaaaact

SEQ ID NO: 41010 - DNA, 22 bp, Homo sapiens
caggaggacatactggctcaca

SEQ ID NO: 41011 - DNA, 22 bp, Homo sapiens
gcctgtgtctgggtggccagag

SEQ ID NO: 41012 - DNA, 22 bp, Homo sapiens
gcagagctcatgcctgcacctc

SEQ ID NO: 41013 - DNA, 22 bp, Homo sapiens
tcttcatgtcatggtatattga

SEQ ID NO: 41014 - DNA, 22 bp, Homo sapiens
ctggctggagtgcaggtgagtg

SEQ ID NO: 41015 - DNA, 22 bp, Homo sapiens
ctggaaggcagaggttgcagtg

SEQ ID NO: 41016 - DNA, 22 bp, Homo sapiens
tgctgtgaggttgagaaggaag

SEQ ID NO: 41017 - DNA, 22 bp, Homo sapiens
cacattccttacattcatagag

SEQ ID NO: 41018 - DNA, 22 bp, Homo sapiens
tgttttaagggtcaactgtcac

SEQ ID NO: 41019 - DNA, 22 bp, Homo sapiens
agccagggtctctcgctctgtt

SEQ ID NO: 41020 - DNA, 22 bp, Homo sapiens
ctggaaggagcccgggcggatc

SEQ ID NO: 41021 - DNA, 22 bp, Homo sapiens
gggactggagtagaggccggtg

SEQ ID NO: 41022 - DNA, 22 bp, Homo sapiens
tactaggaagcagctgcattgg

SEQ ID NO: 41023 - DNA, 22 bp, Homo sapiens
agagggatcaccctgtttctgg

SEQ ID NO: 41024 - DNA, 22 bp, Homo sapiens
cttagagatgggttttacttag

SEQ ID NO: 41025 - DNA, 22 bp, Homo sapiens
tctcgctctgtcgcccaggctg

SEQ ID NO: 41026 - DNA, 22 bp, Homo sapiens
cgtcacttcttagtctattttc

SEQ ID NO: 41027 - DNA, 22 bp, Homo sapiens
ctcactgcaagctctgcctcca

SEQ ID NO: 41028 - DNA, 22 bp, Homo sapiens
atgtttaaagggttgagaaata

SEQ ID NO: 41029 - DNA, 22 bp, Homo sapiens
tgtctgttattggtgtataaga

SEQ ID NO: 41030 - DNA, 22 bp, Homo sapiens
ggcaagagggcagatggagtgc

SEQ ID NO: 41031 - DNA, 22 bp, Homo sapiens
tgagcccagagatctgagctat

SEQ ID NO: 41032 - DNA, 22 bp, Homo sapiens
ctgggaggtggaggttgcattg

SEQ ID NO: 41033 - DNA, 22 bp, Homo sapiens
cagcagcccacgcgtgctgtcc

SEQ ID NO: 41034 - DNA, 22 bp, Homo sapiens
aaaaaattatcatagttcctga

SEQ ID NO: 41035 - DNA, 22 bp, Homo sapiens
atacaaagtattgatcctgagt

SEQ ID NO: 41036 - DNA, 22 bp, Homo sapiens
ggggcattgtgtctgggttcct

SEQ ID NO: 41037 - DNA, 22 bp, Homo sapiens
gctgggctgcgtcggggaagcc

SEQ ID NO: 41038 - DNA, 22 bp, Homo sapiens
tcaaagatcagatggttgtagg

SEQ ID NO: 41039 - DNA, 22 bp, Homo sapiens
ataaaatttgctactgttaaat

SEQ ID NO: 41040 - DNA, 22 bp, Homo sapiens
ggaggtggaggttgcagtgagc

SEQ ID NO: 41041 - DNA, 22 bp, Homo sapiens
ggaggcggaggttgcagtgagt

SEQ ID NO: 41042 - DNA, 22 bp, Homo sapiens
ttcttctttccaattacatggt

SEQ ID NO: 41043 - DNA, 22 bp, Homo sapiens
ctgaggctggagtgcagtggtg

SEQ ID NO: 41044 - DNA, 22 bp, Homo sapiens
tgctgagcgcatccggcggccg

SEQ ID NO: 41045 - DNA, 22 bp, Homo sapiens
ggctttgacatgctgaattaaa

SEQ ID NO: 41046 - DNA, 22 bp, Homo sapiens
tttctcttcactgtgtgcctca

SEQ ID NO: 41047 - DNA, 22 bp, Homo sapiens
gtggcagagccaaggctggagc

SEQ ID NO: 41048 - DNA, 22 bp, Homo sapiens
aatgttacgatcaacaacacat

SEQ ID NO: 41049 - DNA, 22 bp, Homo sapiens
ccaggctggagtgcaatggcat

SEQ ID NO: 41050 - DNA, 22 bp, Homo sapiens
acactgcagatgaaagcataag

SEQ ID NO: 41051 - DNA, 22 bp, Homo sapiens
ccctcccggcgtgctgggctcg

SEQ ID NO: 41052 - DNA, 23 bp, Homo sapiens
atgtttgcagtaacccatcctgg

SEQ ID NO: 41053 - DNA, 22 bp, Homo sapiens
aggctcagatccttgtgtcctg

SEQ ID NO: 41054 - DNA, 22 bp, Homo sapiens
ttgcctgtgtcagcaggtggaa

SEQ ID NO: 41055 - DNA, 22 bp, Homo sapiens
atgccactgcgctccagcctgg

SEQ ID NO: 41056 - DNA, 22 bp, Homo sapiens
tttgccagtattttattgatga

SEQ ID NO: 41057 - DNA, 22 bp, Homo sapiens
tatcacatttggagatttatga

SEQ ID NO: 41058 - DNA, 22 bp, Homo sapiens
gggctgggattgcttgctgtga

SEQ ID NO: 41059 - DNA, 22 bp, Homo sapiens
caagtctgacctctgggtgaag

SEQ ID NO: 41060 - DNA, 21 bp, Homo sapiens
gtggttctagagaaacagaat

SEQ ID NO: 41061 - DNA, 22 bp, Homo sapiens
aggaggaagggaagacaagtaa

SEQ ID NO: 41062 - DNA, 22 bp, Homo sapiens
tttcctcttctggcaggcaggg

SEQ ID NO: 41063 - DNA, 22 bp, Homo sapiens
gcaggtggatcacctgaggtca

SEQ ID NO: 41064 - DNA, 23 bp, Homo sapiens
tcccatctattgtgatcaatgcc

SEQ ID NO: 41065 - DNA, 22 bp, Homo sapiens
ggactgggaatcagggagatgc

SEQ ID NO: 41066 - DNA, 20 bp, Homo sapiens
caagggtttgcattggcttt

SEQ ID NO: 41067 - DNA, 22 bp, Homo sapiens
tcctgggatcaagtgatcctcc

SEQ ID NO: 41068 - DNA, 22 bp, Homo sapiens
ttttcagaattagcataccatt

SEQ ID NO: 41069 - DNA, 22 bp, Homo sapiens
attgcactccggcctgggtgac

SEQ ID NO: 41070 - DNA, 22 bp, Homo sapiens
tttctttatcatagcatctttg

SEQ ID NO: 41071 - DNA, 22 bp, Homo sapiens
aggctgaggcaagaggatcact

SEQ ID NO: 41072 - DNA, 22 bp, Homo sapiens
gggaggcacgaggcgcgcagtg

SEQ ID NO: 41073 - DNA, 22 bp, Homo sapiens
aaggccctgtctccaaatacag

SEQ ID NO: 41074 - DNA, 22 bp, Homo sapiens
ctgcatccatgttgctgcaaag

SEQ ID NO: 41075 - DNA, 22 bp, Homo sapiens
ttgtgttggcgaaagcatgtca

SEQ ID NO: 41076 - DNA, 22 bp, Homo sapiens
tcagcctgctccaagtgctgcc

SEQ ID NO: 41077 - DNA, 22 bp, Homo sapiens
gaggtgttgggtgaggtgcctg

SEQ ID NO: 41078 - DNA, 22 bp, Homo sapiens
cgggcagtgtggctccagagtc

SEQ ID NO: 41079 - DNA, 22 bp, Homo sapiens
agtgcaggccccaggccaggcc

SEQ ID NO: 41080 - DNA, 22 bp, Homo sapiens
gttcagatttgactggtttctc

SEQ ID NO: 41081 - DNA, 22 bp, Homo sapiens
tgtgcctttcttcccaagtaga

SEQ ID NO: 41082 - DNA, 22 bp, Homo sapiens
tatgccactgctctccatccta

SEQ ID NO: 41083 - DNA, 22 bp, Homo sapiens
aggccaggaatccttgtcccag

SEQ ID NO: 41084 - DNA, 21 bp, Homo sapiens
tctgatggtagatgagatgtg

SEQ ID NO: 41085 - DNA, 22 bp, Homo sapiens
ggatgcacgaaggcgcctcgga

SEQ ID NO: 41086 - DNA, 22 bp, Homo sapiens
gggaaggccttgtcagcggatt

SEQ ID NO: 41087 - DNA, 22 bp, Homo sapiens
aggaattcaagaccagctgggc

SEQ ID NO: 41088 - DNA, 22 bp, Homo sapiens
cccagcagtagagctcatatgg

SEQ ID NO: 41089 - DNA, 23 bp, Homo sapiens
ctgagcaaagggggaagctgctt

SEQ ID NO: 41090 - DNA, 22 bp, Homo sapiens
cgagagatgggttggcaggggc

SEQ ID NO: 41091 - DNA, 22 bp, Homo sapiens
ctccagttggccccagttggtt

SEQ ID NO: 41092 - DNA, 22 bp, Homo sapiens
tttcacagaggaggaagctgag

SEQ ID NO: 41093 - DNA, 22 bp, Homo sapiens
caggcagggagctggaaaggat

SEQ ID NO: 41094 - DNA, 22 bp, Homo sapiens
cctgtgcttggccagagaggtt

SEQ ID NO: 41095 - DNA, 22 bp, Homo sapiens
gagggtggtggcttaaggtgct

SEQ ID NO: 41096 - DNA, 22 bp, Homo sapiens
gtgttgatgacattttagaaac

SEQ ID NO: 41097 - DNA, 22 bp, Homo sapiens
tagtgccctcccctttgggata

SEQ ID NO: 41098 - DNA, 22 bp, Homo sapiens
cactgctacctctgcctcccgg

SEQ ID NO: 41099 - DNA, 22 bp, Homo sapiens
cagcagcattgctctggattcc

SEQ ID NO: 41100 - DNA, 22 bp, Homo sapiens
cctgaggatgccagcatgggtg

SEQ ID NO: 41101 - DNA, 22 bp, Homo sapiens
gatcgggtgggttctgccatca

SEQ ID NO: 41102 - DNA, 22 bp, Homo sapiens
gcctggagaaaggaaggtggga

SEQ ID NO: 41103 - DNA, 22 bp, Homo sapiens
gcctcctgagtagctgggattg

SEQ ID NO: 41104 - DNA, 22 bp, Homo sapiens
agcctgggcaacagagcaaaac

SEQ ID NO: 41105 - DNA, 22 bp, Homo sapiens
ccctctacagggaagcgctttc

SEQ ID NO: 41106 - DNA, 22 bp, Homo sapiens
gccagagttgaggcagtttatt

SEQ ID NO: 41107 - DNA, 22 bp, Homo sapiens
cgtgagcaaaatggacactccc

SEQ ID NO: 41108 - DNA, 22 bp, Homo sapiens
gaggcaggaggattgcttgagc

SEQ ID NO: 41109 - DNA, 22 bp, Homo sapiens
caggcaggtcagtgaagaagga

SEQ ID NO: 41110 - DNA, 22 bp, Homo sapiens
agatacattgttctaagcattg

SEQ ID NO: 41111 - DNA, 22 bp, Homo sapiens
gtcttagatttcaccgataatg

SEQ ID NO: 41112 - DNA, 22 bp, Homo sapiens
ctggggtccttgccatgtgtca

SEQ ID NO: 41113 - DNA, 23 bp, Homo sapiens
acagtcgtaggtatccttttcct

SEQ ID NO: 41114 - DNA, 22 bp, Homo sapiens
gaccagtcattactcatgccct

SEQ ID NO: 41115 - DNA, 22 bp, Homo sapiens
tgcactccaggctgggtgacag

SEQ ID NO: 41116 - DNA, 22 bp, Homo sapiens
gatcctggagctccatcactat

SEQ ID NO: 41117 - DNA, 22 bp, Homo sapiens
ctggggtcagggatcagagagc

SEQ ID NO: 41118 - DNA, 22 bp, Homo sapiens
atctagattaggtataagagct

SEQ ID NO: 41119 - DNA, 22 bp, Homo sapiens
gtcctggggattatagagtgtt

SEQ ID NO: 41120 - DNA, 22 bp, Homo sapiens
caagtgatcctcccatcttggc

SEQ ID NO: 41121 - DNA, 22 bp, Homo sapiens
ctatgaccccagcatgaataag

SEQ ID NO: 41122 - DNA, 22 bp, Homo sapiens
gctggcagacttcctctggaac

SEQ ID NO: 41123 - DNA, 22 bp, Homo sapiens
cccatgaggtggaggttgcagt

SEQ ID NO: 41124 - DNA, 22 bp, Homo sapiens
gtgggccttcaaccctgtctgg

SEQ ID NO: 41125 - DNA, 22 bp, Homo sapiens
actattagcatatcatgaatgg

SEQ ID NO: 41126 - DNA, 22 bp, Homo sapiens
atgccactgcactccagcctgg

SEQ ID NO: 41127 - DNA, 22 bp, Homo sapiens
tgtgggagaaggaagcaagctg

SEQ ID NO: 41128 - DNA, 22 bp, Homo sapiens
atgtttttggaaatgggaacat

SEQ ID NO: 41129 - DNA, 22 bp, Homo sapiens
tgcctgcctaggaagctgtgaa

SEQ ID NO: 41130 - DNA, 22 bp, Homo sapiens
actgcactccagcctgggtgac

SEQ ID NO: 41131 - DNA, 22 bp, Homo sapiens
gtggcctggctggcaccacctc

SEQ ID NO: 41132 - DNA, 22 bp, Homo sapiens
ccctgctgtgtagcggaggaac

SEQ ID NO: 41133 - DNA, 22 bp, Homo sapiens
tcctgccaccgggggtggcgat

SEQ ID NO: 41134 - DNA, 22 bp, Homo sapiens
aggctatttccactcttctcat

SEQ ID NO: 41135 - DNA, 22 bp, Homo sapiens
taaaatttgtccctgagtgttg

SEQ ID NO: 41136 - DNA, 22 bp, Homo sapiens
ggctgcaggttggttggcagct

SEQ ID NO: 41137 - DNA, 22 bp, Homo sapiens
tgggaagctgcattttaacaag

SEQ ID NO: 41138 - DNA, 22 bp, Homo sapiens
cactgcaacctccacctcctgg

SEQ ID NO: 41139 - DNA, 22 bp, Homo sapiens
ccaggggttggaggttgcagtg

SEQ ID NO: 41140 - DNA, 22 bp, Homo sapiens
gaggttggggctgcagtgagct

SEQ ID NO: 41141 - DNA, 22 bp, Homo sapiens
ttaataaagtatgaattggaaa

SEQ ID NO: 41142 - DNA, 21 bp, Homo sapiens
tgcaatccagcctgggcgaca

SEQ ID NO: 41143 - DNA, 22 bp, Homo sapiens
atcacaaaggtctcagagcaca

SEQ ID NO: 41144 - DNA, 22 bp, Homo sapiens
catggggcccatgtgctccaag

SEQ ID NO: 41145 - DNA, 22 bp, Homo sapiens
gaccttcttgctgtgtcctaac

SEQ ID NO: 41146 - DNA, 22 bp, Homo sapiens
ttcataaacaaattaaggcctg

SEQ ID NO: 41147 - DNA, 22 bp, Homo sapiens
tcttaagcagagaagaagttga

SEQ ID NO: 41148 - DNA, 22 bp, Homo sapiens
cctcattctcgcgtgtgtttct

SEQ ID NO: 41149 - DNA, 22 bp, Homo sapiens
tcacaaatgtttgcatgtgtct

SEQ ID NO: 41150 - DNA, 22 bp, Homo sapiens
gtggccccagggccctgtctgg

SEQ ID NO: 41151 - DNA, 22 bp, Homo sapiens
aggggatggagctggaaggcag

SEQ ID NO: 41152 - DNA, 22 bp, Homo sapiens
gctactgattgaccttggagag

SEQ ID NO: 41153 - DNA, 22 bp, Homo sapiens
cctgggacttggtctggggttt

SEQ ID NO: 41154 - DNA, 22 bp, Homo sapiens
aggattgtgcctccagtcagaa

SEQ ID NO: 41155 - DNA, 22 bp, Homo sapiens
tagcataacaggtaagagtgag

SEQ ID NO: 41156 - DNA, 22 bp, Homo sapiens
ctgagcctcctgcttctatttc

SEQ ID NO: 41157 - DNA, 22 bp, Homo sapiens
cactctcagcataatgaatgtg

SEQ ID NO: 41158 - DNA, 22 bp, Homo sapiens
gaggcagtccagtgggtaagaa

SEQ ID NO: 41159 - DNA, 22 bp, Homo sapiens
gttcacagtttctaatcccagc

SEQ ID NO: 41160 - DNA, 23 bp, Homo sapiens
aaactacaacgccaggcactgag

SEQ ID NO: 41161 - DNA, 22 bp, Homo sapiens
tggaagggagctggaatttgga

SEQ ID NO: 41162 - DNA, 22 bp, Homo sapiens
ggaggagcatgagagggtagtg

SEQ ID NO: 41163 - DNA, 22 bp, Homo sapiens
ttcagagaattggataattcgt

SEQ ID NO: 41164 - DNA, 22 bp, Homo sapiens
ttatcacttatgagctttttgc

SEQ ID NO: 41165 - DNA, 22 bp, Homo sapiens
caggagatgacagggaagaacc

SEQ ID NO: 41166 - DNA, 22 bp, Homo sapiens
tgatatgcatgtaagggagaca

SEQ ID NO: 41167 - DNA, 22 bp, Homo sapiens
ccactgtgcccagcctcatggg

SEQ ID NO: 41168 - DNA, 22 bp, Homo sapiens
gcgtctcaaggcccccaggcca

SEQ ID NO: 41169 - DNA, 22 bp, Homo sapiens
gaggccacggaagggagctgtg

SEQ ID NO: 41170 - DNA, 22 bp, Homo sapiens
ttatgatttgccacagattggt

SEQ ID NO: 41171 - DNA, 22 bp, Homo sapiens
tgggaagggtcaacagctggaa

SEQ ID NO: 41172 - DNA, 22 bp, Homo sapiens
tttgtggcaggagcggagaccg

SEQ ID NO: 41173 - DNA, 22 bp, Homo sapiens
cagctgctgttcagttttgttt

SEQ ID NO: 41174 - DNA, 22 bp, Homo sapiens
cggctcactgcagctccgcctc

SEQ ID NO: 41175 - DNA, 22 bp, Homo sapiens
ctccagattccgtttattcagg

SEQ ID NO: 41176 - DNA, 22 bp, Homo sapiens
tatgtcactcggctcggcccac

SEQ ID NO: 41177 - DNA, 22 bp, Homo sapiens
tccaaacgggagccaaatgagc

SEQ ID NO: 41178 - DNA, 22 bp, Homo sapiens
ttgatacccaagtgttatgggt

SEQ ID NO: 41179 - DNA, 22 bp, Homo sapiens
ttgtacttgccatagaacaaca

SEQ ID NO: 41180 - DNA, 22 bp, Homo sapiens
tcctgccttgcctgggacatca

SEQ ID NO: 41181 - DNA, 22 bp, Homo sapiens
cggctggtgtcgggcacagcaa

SEQ ID NO: 41182 - DNA, 22 bp, Homo sapiens
atgaaaacggaccagagctatt

SEQ ID NO: 41183 - DNA, 22 bp, Homo sapiens
gcccgcagagatctttaacaaa

SEQ ID NO: 41184 - DNA, 22 bp, Homo sapiens
agtgctatcgagttctaatgct

SEQ ID NO: 41185 - DNA, 22 bp, Homo sapiens
ctgggaggcagaggttgcagtg

SEQ ID NO: 41186 - DNA, 22 bp, Homo sapiens
cgggaaggtggaggttgcagtg

SEQ ID NO: 41187 - DNA, 22 bp, Homo sapiens
aggggatgcctagtggagtctc

SEQ ID NO: 41188 - DNA, 22 bp, Homo sapiens
agcccaggttgaggctgcagtg

SEQ ID NO: 41189 - DNA, 22 bp, Homo sapiens
gactttctgatgtaaacattta

SEQ ID NO: 41190 - DNA, 22 bp, Homo sapiens
ggagtgactcacagctgggaca

SEQ ID NO: 41191 - DNA, 22 bp, Homo sapiens
tcgtgatctgtccacctcggcc

SEQ ID NO: 41192 - DNA, 22 bp, Homo sapiens
ctcctgggaaaggctggacaca

SEQ ID NO: 41193 - DNA, 22 bp, Homo sapiens
tttgttttcaatgtgtcattca

SEQ ID NO: 41194 - DNA, 22 bp, Homo sapiens
aaagtgcaaggattacaggcat

SEQ ID NO: 41195 - DNA, 22 bp, Homo sapiens
agcctattccaggatgagctca

SEQ ID NO: 41196 - DNA, 22 bp, Homo sapiens
agttattactctttaacatatt

SEQ ID NO: 41197 - DNA, 22 bp, Homo sapiens
ggctgggcctctccctcagctg

SEQ ID NO: 41198 - DNA, 20 bp, Homo sapiens
ggcagagggcctgggagaag

SEQ ID NO: 41199 - DNA, 22 bp, Homo sapiens
atgccactgcacttcagcttgg

SEQ ID NO: 41200 - DNA, 22 bp, Homo sapiens
gcacatccaatgattgttttga

SEQ ID NO: 41201 - DNA, 22 bp, Homo sapiens
ttagggttacaccagcctcctg

SEQ ID NO: 41202 - DNA, 22 bp, Homo sapiens
tctgctggaaaaccagggaatt

SEQ ID NO: 41203 - DNA, 22 bp, Homo sapiens
ttcagcagtgcagacacccagt

SEQ ID NO: 41204 - DNA, 22 bp, Homo sapiens
tgaggcaggagttcaggctgcg

SEQ ID NO: 41205 - DNA, 22 bp, Homo sapiens
acttttcttatcagaaaggcca

SEQ ID NO: 41206 - DNA, 22 bp, Homo sapiens
atggaaggctttatgactcaaa

SEQ ID NO: 41207 - DNA, 22 bp, Homo sapiens
ggctgggcaggtctgcacaggg

SEQ ID NO: 41208 - DNA, 22 bp, Homo sapiens
ctgggaggcggagcttgcagtg

SEQ ID NO: 41209 - DNA, 22 bp, Homo sapiens
gtggttcacttgaggtcaggag

SEQ ID NO: 41210 - DNA, 22 bp, Homo sapiens
tttcataatactgtacatgaaa

SEQ ID NO: 41211 - DNA, 22 bp, Homo sapiens
cctcctgcacctccaggaactc

SEQ ID NO: 41212 - DNA, 22 bp, Homo sapiens
ggaggcagaatagagtgtgggt

SEQ ID NO: 41213 - DNA, 22 bp, Homo sapiens
tggttgcctctcagagattccg

SEQ ID NO: 41214 - DNA, 22 bp, Homo sapiens
gtagggttggagagcacaacca

SEQ ID NO: 41215 - DNA, 22 bp, Homo sapiens
gcagaggacacaggagggcaag

SEQ ID NO: 41216 - DNA, 22 bp, Homo sapiens
gcagtgagttatgatcatgcca

SEQ ID NO: 41217 - DNA, 22 bp, Homo sapiens
aggtagaaggaccagaatttat

SEQ ID NO: 41218 - DNA, 22 bp, Homo sapiens
aaatatcttaggagtatatgag

SEQ ID NO: 41219 - DNA, 22 bp, Homo sapiens
gtggagggtgattgccggctgt

SEQ ID NO: 41220 - DNA, 22 bp, Homo sapiens
ggaggctgaggcaggcggatca

SEQ ID NO: 41221 - DNA, 22 bp, Homo sapiens
ggccttggcctagccctccagg

SEQ ID NO: 41222 - DNA, 22 bp, Homo sapiens
cctgtggcgggggccagtgcct

SEQ ID NO: 41223 - DNA, 22 bp, Homo sapiens
ccaggaggttgaggctgcagtg

SEQ ID NO: 41224 - DNA, 22 bp, Homo sapiens
ggccagcctggggctcccagac

SEQ ID NO: 41225 - DNA, 22 bp, Homo sapiens
ttatttttaaaagttcacacag

SEQ ID NO: 41226 - DNA, 22 bp, Homo sapiens
gaaaggagagggttaaggagct

SEQ ID NO: 41227 - DNA, 22 bp, Homo sapiens
gttggagtgcagcttgtgcgat

SEQ ID NO: 41228 - DNA, 22 bp, Homo sapiens
cctgcacatgtgtgcgcctgta

SEQ ID NO: 41229 - DNA, 19 bp, Homo sapiens
gctggatggatcctggagt

SEQ ID NO: 41230 - DNA, 22 bp, Homo sapiens
tacaaaaaattgatactgacga

SEQ ID NO: 41231 - DNA, 22 bp, Homo sapiens
aatgcaatgcagcacctccttg

SEQ ID NO: 41232 - DNA, 22 bp, Homo sapiens
ggcccagacccaagagtggtgg

SEQ ID NO: 41233 - DNA, 20 bp, Homo sapiens
ataaaataactgccacaaga

SEQ ID NO: 41234 - DNA, 22 bp, Homo sapiens
ttatttaaaagtggtaagattc

SEQ ID NO: 41235 - DNA, 22 bp, Homo sapiens
tgcctgtggaaaggctggtgct

SEQ ID NO: 41236 - DNA, 22 bp, Homo sapiens
tttcttctatgtgtgatatttt

SEQ ID NO: 41237 - DNA, 22 bp, Homo sapiens
cgtgccactgcactctagcctg

SEQ ID NO: 41238 - DNA, 21 bp, Homo sapiens
acataggcgaatgttcgggag

SEQ ID NO: 41239 - DNA, 22 bp, Homo sapiens
gccgggttcaagccattctcct

SEQ ID NO: 41240 - DNA, 22 bp, Homo sapiens
ccagaggagttgaggctttggg

SEQ ID NO: 41241 - DNA, 22 bp, Homo sapiens
gaaagagaacctgggcctagat

SEQ ID NO: 41242 - DNA, 22 bp, Homo sapiens
gggacatctttctagtcagggt

SEQ ID NO: 41243 - DNA, 22 bp, Homo sapiens
cagtggccaacttcctgcctct

SEQ ID NO: 41244 - DNA, 22 bp, Homo sapiens
gtctttatttgagattgtcatt

SEQ ID NO: 41245 - DNA, 22 bp, Homo sapiens
tccaccatgtaacaagctctgt

SEQ ID NO: 41246 - DNA, 22 bp, Homo sapiens
tgccgtggggctgaggctggag

SEQ ID NO: 41247 - DNA, 22 bp, Homo sapiens
aactctatttaccctactaaac

SEQ ID NO: 41248 - DNA, 22 bp, Homo sapiens
tcctgccaggagatggtagcca

SEQ ID NO: 41249 - DNA, 22 bp, Homo sapiens
attgtgtcctcattgaccttca

SEQ ID NO: 41250 - DNA, 22 bp, Homo sapiens
ggctgggctccgggagcatgcg

SEQ ID NO: 41251 - DNA, 22 bp, Homo sapiens
acactgaaagaagccagcttgt

SEQ ID NO: 41252 - DNA, 22 bp, Homo sapiens
tcttttgtgattctttagttac

SEQ ID NO: 41253 - DNA, 22 bp, Homo sapiens
gaggcacagagtaggtgcacac

SEQ ID NO: 41254 - DNA, 21 bp, Homo sapiens
gttcaaatcctgacactacac

SEQ ID NO: 41255 - DNA, 22 bp, Homo sapiens
gggaggcagtgctggaggctgg

SEQ ID NO: 41256 - DNA, 22 bp, Homo sapiens
acttgccccagaattgctgctg

SEQ ID NO: 41257 - DNA, 22 bp, Homo sapiens
aaacttttttaggttcataggc

SEQ ID NO: 41258 - DNA, 22 bp, Homo sapiens
tccaagatctacagcagtttag

SEQ ID NO: 41259 - DNA, 22 bp, Homo sapiens
agaatagaattctcatagaatt

SEQ ID NO: 41260 - DNA, 22 bp, Homo sapiens
gccagtgcctcgccgcgctcct

SEQ ID NO: 41261 - DNA, 22 bp, Homo sapiens
ggcagagcttgcagtgagccga

SEQ ID NO: 41262 - DNA, 22 bp, Homo sapiens
gaggaggcagcctatcccttag

SEQ ID NO: 41263 - DNA, 22 bp, Homo sapiens
cttgcctttgtcttcaaaggct

SEQ ID NO: 41264 - DNA, 22 bp, Homo sapiens
tggacaacatagtgagacctca

SEQ ID NO: 41265 - DNA, 22 bp, Homo sapiens
agccaggatggtctcgatcggc

SEQ ID NO: 41266 - DNA, 22 bp, Homo sapiens
cgggcgcactccgggcagctgt

SEQ ID NO: 41267 - DNA, 22 bp, Homo sapiens
ggaggtggagctggaagttcca

SEQ ID NO: 41268 - DNA, 22 bp, Homo sapiens
acagcagagcctggtacttact

SEQ ID NO: 41269 - DNA, 22 bp, Homo sapiens
tttttgggtccaggctgtatct

SEQ ID NO: 41270 - DNA, 22 bp, Homo sapiens
caggaaggcgcggctgtgcctg

SEQ ID NO: 41271 - DNA, 22 bp, Homo sapiens
tcgcttgaacccaggaagtgga

SEQ ID NO: 41272 - DNA, 22 bp, Homo sapiens
acaggatcgccctgttgcccag

SEQ ID NO: 41273 - DNA, 22 bp, Homo sapiens
gttactcctggttgagcttggt

SEQ ID NO: 41274 - DNA, 22 bp, Homo sapiens
atggtactggggtcccggagtt

SEQ ID NO: 41275 - DNA, 22 bp, Homo sapiens
tctcgatctcctgaccttgtga

SEQ ID NO: 41276 - DNA, 22 bp, Homo sapiens
ggggccttttctgaatgtggaa

SEQ ID NO: 41277 - DNA, 22 bp, Homo sapiens
gaccctgtttctacaaataatt

SEQ ID NO: 41278 - DNA, 20 bp, Homo sapiens
tctgccacgtctggtgactg

SEQ ID NO: 41279 - DNA, 22 bp, Homo sapiens
aaggtggaggttgcagtgagct

SEQ ID NO: 41280 - DNA, 22 bp, Homo sapiens
tccattatacttctgattcaaa

SEQ ID NO: 41281 - DNA, 22 bp, Homo sapiens
actgtgaacggactgaagccca

SEQ ID NO: 41282 - DNA, 22 bp, Homo sapiens
tgagacgaagtcttgctctgtt

SEQ ID NO: 41283 - DNA, 22 bp, Homo sapiens
gctcccaggatgaggagccagg

SEQ ID NO: 41284 - DNA, 22 bp, Homo sapiens
cactgcactccatcctgggaaa

SEQ ID NO: 41285 - DNA, 22 bp, Homo sapiens
gtttcgtcaggcttattctatc

SEQ ID NO: 41286 - DNA, 22 bp, Homo sapiens
ctgaggcaggatggcctggctg

SEQ ID NO: 41287 - DNA, 22 bp, Homo sapiens
tccaactttctcctccggcttg

SEQ ID NO: 41288 - DNA, 22 bp, Homo sapiens
ggggtggatttcaggcggtgtc

SEQ ID NO: 41289 - DNA, 22 bp, Homo sapiens
gaggggtccaggaggcacttac

SEQ ID NO: 41290 - DNA, 22 bp, Homo sapiens
caggctggagttcagtggtgtg

SEQ ID NO: 41291 - DNA, 22 bp, Homo sapiens
atcctccagctcctgcttctgc

SEQ ID NO: 41292 - DNA, 22 bp, Homo sapiens
ttgattatagactcactaatct

SEQ ID NO: 41293 - DNA, 23 bp, Homo sapiens
aaggggatacttccactttcttt

SEQ ID NO: 41294 - DNA, 22 bp, Homo sapiens
gggcagagagctggaactcctt

SEQ ID NO: 41295 - DNA, 22 bp, Homo sapiens
tctgcaggaagctggcggctga

SEQ ID NO: 41296 - DNA, 22 bp, Homo sapiens
tgtgaatggacaattaaatcta

SEQ ID NO: 41297 - DNA, 22 bp, Homo sapiens
tccagcccaggctggagtgtag

SEQ ID NO: 41298 - DNA, 22 bp, Homo sapiens
ggttccccaggcggcccttgga

SEQ ID NO: 41299 - DNA, 22 bp, Homo sapiens
ccttacctgattgctggcatcc

SEQ ID NO: 41300 - DNA, 22 bp, Homo sapiens
gatgctgctcgggtgcctggga

SEQ ID NO: 41301 - DNA, 22 bp, Homo sapiens
tcgtgaggctctgcatcgcaca

SEQ ID NO: 41302 - DNA, 21 bp, Homo sapiens
tctgccagctgaagaggtgga

SEQ ID NO: 41303 - DNA, 22 bp, Homo sapiens
tttgaggttagctagcagatca

SEQ ID NO: 41304 - DNA, 20 bp, Homo sapiens
tgttgattggtgtcatctca

SEQ ID NO: 41305 - DNA, 22 bp, Homo sapiens
tgcttgattctgtccctttatt

SEQ ID NO: 41306 - DNA, 22 bp, Homo sapiens
ggcctttgcgtccacgccgctt

SEQ ID NO: 41307 - DNA, 22 bp, Homo sapiens
gcggggttccgtgccccagagt

SEQ ID NO: 41308 - DNA, 23 bp, Homo sapiens
gctcatcaggcttagagtcaagg

SEQ ID NO: 41309 - DNA, 22 bp, Homo sapiens
ggagtgactctcggggccacta

SEQ ID NO: 41310 - DNA, 22 bp, Homo sapiens
gactttgtgccaaacgccagaa

SEQ ID NO: 41311 - DNA, 22 bp, Homo sapiens
tgaggcccaccttggccccggc

SEQ ID NO: 41312 - DNA, 22 bp, Homo sapiens
ggccactgctctccagcctggg

SEQ ID NO: 41313 - DNA, 22 bp, Homo sapiens
ctgggaggcagaggttgtagtg

SEQ ID NO: 41314 - DNA, 22 bp, Homo sapiens
cccacgtcgaacttgctccaga

SEQ ID NO: 41315 - DNA, 22 bp, Homo sapiens
cagagctgtccaaaccctgaca

SEQ ID NO: 41316 - DNA, 22 bp, Homo sapiens
ccaggctggagtgcagtggcac

SEQ ID NO: 41317 - DNA, 22 bp, Homo sapiens
gtccaaaagagccagccgggcg

SEQ ID NO: 41318 - DNA, 22 bp, Homo sapiens
tcagtgcacccaattctctcca

SEQ ID NO: 41319 - DNA, 22 bp, Homo sapiens
gacgagagactccatccaccac

SEQ ID NO: 41320 - DNA, 22 bp, Homo sapiens
ttctttcagaacacaagtgatt

SEQ ID NO: 41321 - DNA, 22 bp, Homo sapiens
gtttctctgtctgttacattgg

SEQ ID NO: 41322 - DNA, 22 bp, Homo sapiens
attaagtgactaaagtaatgct

SEQ ID NO: 41323 - DNA, 22 bp, Homo sapiens
attataggcttgagccaccgtg

SEQ ID NO: 41324 - DNA, 22 bp, Homo sapiens
tgggaaggggagctggaaagga

SEQ ID NO: 41325 - DNA, 22 bp, Homo sapiens
actttaaaactgatcatcagag

SEQ ID NO: 41326 - DNA, 23 bp, Homo sapiens
ggctgggagctccgggtgcacgt

SEQ ID NO: 41327 - DNA, 22 bp, Homo sapiens
attgataaattgcaatggggct

SEQ ID NO: 41328 - DNA, 22 bp, Homo sapiens
gaggaggcttccgggaggcacg

SEQ ID NO: 41329 - DNA, 22 bp, Homo sapiens
cagcctttgggtcagaagattc

SEQ ID NO: 41330 - DNA, 22 bp, Homo sapiens
gagggagggactagcattctct

SEQ ID NO: 41331 - DNA, 22 bp, Homo sapiens
tccagcttataggtagatttaa

SEQ ID NO: 41332 - DNA, 21 bp, Homo sapiens
aaactgaccttgcctgagaca

SEQ ID NO: 41333 - DNA, 22 bp, Homo sapiens
tgtttcttacgtttttagaggc

SEQ ID NO: 41334 - DNA, 22 bp, Homo sapiens
tcgcccaggctggaagtgcagt

SEQ ID NO: 41335 - DNA, 22 bp, Homo sapiens
acccaaaagtcactcaggagca

SEQ ID NO: 41336 - DNA, 22 bp, Homo sapiens
tcactgcaagctccacctcccg

SEQ ID NO: 41337 - DNA, 22 bp, Homo sapiens
tgggaggccaaggcaggcggat

SEQ ID NO: 41338 - DNA, 22 bp, Homo sapiens
gattcactcatattttacgttt

SEQ ID NO: 41339 - DNA, 22 bp, Homo sapiens
attcacagggggagaagggtat

SEQ ID NO: 41340 - DNA, 22 bp, Homo sapiens
aatatcatctctcttttctgca

SEQ ID NO: 41341 - DNA, 22 bp, Homo sapiens
tgagggaatattgatagatccg

SEQ ID NO: 41342 - DNA, 22 bp, Homo sapiens
tcagcctggcaggatggcctgg

SEQ ID NO: 41343 - DNA, 22 bp, Homo sapiens
caggaagctgtgaaggagacgg

SEQ ID NO: 41344 - DNA, 22 bp, Homo sapiens
gcctccagcccacgcaggcctg

SEQ ID NO: 41345 - DNA, 22 bp, Homo sapiens
tcagaattgtggagaaagggga

SEQ ID NO: 41346 - DNA, 22 bp, Homo sapiens
attttttgttaactcaggatag

SEQ ID NO: 41347 - DNA, 22 bp, Homo sapiens
acaactccttcttgggtcctgg

SEQ ID NO: 41348 - DNA, 22 bp, Homo sapiens
cctgggaatcggtgcgttgagg

SEQ ID NO: 41349 - DNA, 22 bp, Homo sapiens
aaatcgcttgaacccaggaagt

SEQ ID NO: 41350 - DNA, 22 bp, Homo sapiens
tccttaggcaatttgggagagt

SEQ ID NO: 41351 - DNA, 22 bp, Homo sapiens
gtgacaatattagctcaggggc

SEQ ID NO: 41352 - DNA, 22 bp, Homo sapiens
ctgctctgctgatcagtgtctc

SEQ ID NO: 41353 - DNA, 19 bp, Homo sapiens
ctgctgccggagactcgtc

SEQ ID NO: 41354 - DNA, 22 bp, Homo sapiens
tgatctcctgaccttgtaatcc

SEQ ID NO: 41355 - DNA, 22 bp, Homo sapiens
gtgggggcaggcagtgctagga

SEQ ID NO: 41356 - DNA, 22 bp, Homo sapiens
tcacatctaattccatttctgc

SEQ ID NO: 41357 - DNA, 21 bp, Homo sapiens
gctcctggtgctgcgtggcgc

SEQ ID NO: 41358 - DNA, 22 bp, Homo sapiens
ttaggcctttgattggggtgct

SEQ ID NO: 41359 - DNA, 22 bp, Homo sapiens
actcttgattgatttagtcttt

SEQ ID NO: 41360 - DNA, 22 bp, Homo sapiens
ctggtctgccacccacacccct

SEQ ID NO: 41361 - DNA, 22 bp, Homo sapiens
gggccctgcgactcgcggcgga

SEQ ID NO: 41362 - DNA, 22 bp, Homo sapiens
agctgccgatgcccagctgcat

SEQ ID NO: 41363 - DNA, 22 bp, Homo sapiens
acagaactgggaaatgcacata

SEQ ID NO: 41364 - DNA, 22 bp, Homo sapiens
aggtcacccgtttgactatcca

SEQ ID NO: 41365 - DNA, 20 bp, Homo sapiens
gtctccactgggggttaacc

SEQ ID NO: 41366 - DNA, 22 bp, Homo sapiens
attgcactccagcctgggggac

SEQ ID NO: 41367 - DNA, 22 bp, Homo sapiens
ggggtgggcgtgcagggacacc

SEQ ID NO: 41368 - DNA, 18 bp, Homo sapiens
agcctgtcccttctcctg

SEQ ID NO: 41369 - DNA, 20 bp, Homo sapiens
gggcagagccagccagtccc

SEQ ID NO: 41370 - DNA, 22 bp, Homo sapiens
gctggtagacctcactgcactc

SEQ ID NO: 41371 - DNA, 22 bp, Homo sapiens
ttccaactttgtcatatattat

SEQ ID NO: 41372 - DNA, 22 bp, Homo sapiens
ttccgagggctcggcggccgcc

SEQ ID NO: 41373 - DNA, 22 bp, Homo sapiens
atagaatatgacttttagatcc

SEQ ID NO: 41374 - DNA, 22 bp, Homo sapiens
gggagctgaaggagccggcggg

SEQ ID NO: 41375 - DNA, 22 bp, Homo sapiens
gagctgggcctgcgagtgctgc

SEQ ID NO: 41376 - DNA, 22 bp, Homo sapiens
gagccaggttggaggctgcagt

SEQ ID NO: 41377 - DNA, 22 bp, Homo sapiens
tttagattgtgacctcccccca

SEQ ID NO: 41378 - DNA, 22 bp, Homo sapiens
gggcagagactcagaaacagaa

SEQ ID NO: 41379 - DNA, 22 bp, Homo sapiens
ttgggcctctcaaagtgctggg

SEQ ID NO: 41380 - DNA, 22 bp, Homo sapiens
tgtgaagaattaatgtgaatca

SEQ ID NO: 41381 - DNA, 22 bp, Homo sapiens
ccagagtcccttgcagctcagt

SEQ ID NO: 41382 - DNA, 22 bp, Homo sapiens
gcctcctggggtgccatcatct

SEQ ID NO: 41383 - DNA, 22 bp, Homo sapiens
agtacccttttcactgtcacaa

SEQ ID NO: 41384 - DNA, 22 bp, Homo sapiens
taacaatacccattctaattac

SEQ ID NO: 41385 - DNA, 22 bp, Homo sapiens
gatgcacggtcatgtcttttca

SEQ ID NO: 41386 - DNA, 22 bp, Homo sapiens
ctcactgcaagctcagcctccc

SEQ ID NO: 41387 - DNA, 22 bp, Homo sapiens
cacttgttggtggtgaaatcac

SEQ ID NO: 41388 - DNA, 22 bp, Homo sapiens
gatctgtgtgattggatgcatt

SEQ ID NO: 41389 - DNA, 18 bp, Homo sapiens
cttgttcttctcttggcg

SEQ ID NO: 41390 - DNA, 22 bp, Homo sapiens
gaaaattattgaaaatggctct

SEQ ID NO: 41391 - DNA, 22 bp, Homo sapiens
tcaccagctctgcctcgccagt

SEQ ID NO: 41392 - DNA, 22 bp, Homo sapiens
ctgcactgacttccccggctgc

SEQ ID NO: 41393 - DNA, 22 bp, Homo sapiens
atgtaaactactgactacacta

SEQ ID NO: 41394 - DNA, 22 bp, Homo sapiens
aggggaggtgtccccaaatctc

SEQ ID NO: 41395 - DNA, 22 bp, Homo sapiens
actgggcctgattgggtcggag

SEQ ID NO: 41396 - DNA, 22 bp, Homo sapiens
gggagagtagctggaaggttct

SEQ ID NO: 41397 - DNA, 22 bp, Homo sapiens
aggtggagaagagatgggcagt

SEQ ID NO: 41398 - DNA, 22 bp, Homo sapiens
cctgtcatatacatacctcctc

SEQ ID NO: 41399 - DNA, 22 bp, Homo sapiens
cctgcttaacattgccatgaca

SEQ ID NO: 41400 - DNA, 22 bp, Homo sapiens
tgttcagaacaaaggtaaatga

SEQ ID NO: 41401 - DNA, 22 bp, Homo sapiens
tcctttgcttctgtcattctcc

SEQ ID NO: 41402 - DNA, 22 bp, Homo sapiens
ggagagtgggagcaactgttgc

SEQ ID NO: 41403 - DNA, 22 bp, Homo sapiens
aataaacaaaggacaaggaggt

SEQ ID NO: 41404 - DNA, 22 bp, Homo sapiens
aagcagagaatctgggagcgag

SEQ ID NO: 41405 - DNA, 22 bp, Homo sapiens
ggaactgaatgtctcggtataa

SEQ ID NO: 41406 - DNA, 22 bp, Homo sapiens
gttatataagacaaatcagagt

SEQ ID NO: 41407 - DNA, 22 bp, Homo sapiens
cgtggggcgggtggacacttgc

SEQ ID NO: 41408 - DNA, 22 bp, Homo sapiens
attgcacttcagcctgggtgac

SEQ ID NO: 41409 - DNA, 22 bp, Homo sapiens
cctgggcctctcaaagtgctgg

SEQ ID NO: 41410 - DNA, 23 bp, Homo sapiens
gaggtggcaatgagggcagttgg

SEQ ID NO: 41411 - DNA, 22 bp, Homo sapiens
cagtttcttcctcccccagaga

SEQ ID NO: 41412 - DNA, 22 bp, Homo sapiens
gggtacttaatatttacggggt

SEQ ID NO: 41413 - DNA, 22 bp, Homo sapiens
gaggcggaggttgcagtgagcc

SEQ ID NO: 41414 - DNA, 22 bp, Homo sapiens
cctgctggctctgttgctcggc

SEQ ID NO: 41415 - DNA, 22 bp, Homo sapiens
acgcctgtaatcccagcacttt

SEQ ID NO: 41416 - DNA, 22 bp, Homo sapiens
ggaggcggaggctgcagtgagc

SEQ ID NO: 41417 - DNA, 23 bp, Homo sapiens
ctggggctttcaaatctgggcag

SEQ ID NO: 41418 - DNA, 22 bp, Homo sapiens
gagcaggaaggccagaagggtc

SEQ ID NO: 41419 - DNA, 23 bp, Homo sapiens
cttcacaggttcaggggattaag

SEQ ID NO: 41420 - DNA, 22 bp, Homo sapiens
acccatggtctggtggggccct

SEQ ID NO: 41421 - DNA, 22 bp, Homo sapiens
tcctgggacaagccgtggaagt

SEQ ID NO: 41422 - DNA, 22 bp, Homo sapiens
ctcagtgaattggaggatggcc

SEQ ID NO: 41423 - DNA, 22 bp, Homo sapiens
atgaaatatcttgaagaaattc

SEQ ID NO: 41424 - DNA, 22 bp, Homo sapiens
gagtcacatactatgtaataga

SEQ ID NO: 41425 - DNA, 22 bp, Homo sapiens
acccgggaggcaggagtcatag

SEQ ID NO: 41426 - DNA, 22 bp, Homo sapiens
tgttgattagtgtttagactta

SEQ ID NO: 41427 - DNA, 22 bp, Homo sapiens
tgtatattctgcctaaaagctt

SEQ ID NO: 41428 - DNA, 22 bp, Homo sapiens
actgttgaagtgccagcttgat

SEQ ID NO: 41429 - DNA, 22 bp, Homo sapiens
tcagagtctgtgcattctgcta

SEQ ID NO: 41430 - DNA, 22 bp, Homo sapiens
atacaaaatatatactggagac

SEQ ID NO: 41431 - DNA, 22 bp, Homo sapiens
tctgttgcaatgtgcatggtga

SEQ ID NO: 41432 - DNA, 22 bp, Homo sapiens
gttcagaaattaggagaataaa

SEQ ID NO: 41433 - DNA, 20 bp, Homo sapiens
atcggcttgcctggaaacaa

SEQ ID NO: 41434 - DNA, 22 bp, Homo sapiens
cgtcccgggttcacgccattct

SEQ ID NO: 41435 - DNA, 22 bp, Homo sapiens
cgggttcacgccattctcctgc

SEQ ID NO: 41436 - DNA, 22 bp, Homo sapiens
ctgcggctctgcgggcagctgg

SEQ ID NO: 41437 - DNA, 21 bp, Homo sapiens
cagagctgtccaaaccctgac

SEQ ID NO: 41438 - DNA, 20 bp, Homo sapiens
tgaggcccagcagagtcggg

SEQ ID NO: 41439 - DNA, 22 bp, Homo sapiens
agaggaggctctgggatcgtcc

SEQ ID NO: 41440 - DNA, 22 bp, Homo sapiens
actgctggggctcattcatctc

SEQ ID NO: 41441 - DNA, 22 bp, Homo sapiens
ctgtcctgccagtcctggactc

SEQ ID NO: 41442 - DNA, 22 bp, Homo sapiens
gccttgatctgctgtgtttgag

SEQ ID NO: 41443 - DNA, 22 bp, Homo sapiens
ctgagatctttatacgaggcac

SEQ ID NO: 41444 - DNA, 22 bp, Homo sapiens
ttccaaagaagttcacatttac

SEQ ID NO: 41445 - DNA, 22 bp, Homo sapiens
cggcatgggcgtccccctcact

SEQ ID NO: 41446 - DNA, 22 bp, Homo sapiens
tcccagattcctgctcttatat

SEQ ID NO: 41447 - DNA, 22 bp, Homo sapiens
ggtgggagagctctgtctccag

SEQ ID NO: 41448 - DNA, 22 bp, Homo sapiens
tttcactcagctctcattgtct

SEQ ID NO: 41449 - DNA, 22 bp, Homo sapiens
aactcaaagatgcatgacgctt

SEQ ID NO: 41450 - DNA, 22 bp, Homo sapiens
tatttaataaaactatggcatg

SEQ ID NO: 41451 - DNA, 22 bp, Homo sapiens
ttcagaagagacactgtgacag

SEQ ID NO: 41452 - DNA, 22 bp, Homo sapiens
gccctgggcaaggttctggcca

SEQ ID NO: 41453 - DNA, 22 bp, Homo sapiens
ctcagactagcctgtaccgaca

SEQ ID NO: 41454 - DNA, 20 bp, Homo sapiens
tgacctcctgggctcaagcc

SEQ ID NO: 41455 - DNA, 22 bp, Homo sapiens
ggggccttggatctgtgccccg

SEQ ID NO: 41456 - DNA, 22 bp, Homo sapiens
gtgcacttgatctagacagatt

SEQ ID NO: 41457 - DNA, 22 bp, Homo sapiens
cctggaagttggaggttgcagt

SEQ ID NO: 41458 - DNA, 22 bp, Homo sapiens
tagattcagatatttaggacaa

SEQ ID NO: 41459 - DNA, 22 bp, Homo sapiens
caacaacatgggattcatttct

SEQ ID NO: 41460 - DNA, 22 bp, Homo sapiens
aagtcagacagctgagctgcct

SEQ ID NO: 41461 - DNA, 22 bp, Homo sapiens
ttgatcatttttctggtaaaat

SEQ ID NO: 41462 - DNA, 22 bp, Homo sapiens
gaggggagcccccatcctccag

SEQ ID NO: 41463 - DNA, 22 bp, Homo sapiens
attgcactccagcctgggtgac

SEQ ID NO: 41464 - DNA, 22 bp, Homo sapiens
cctgccctgctcactgtcggta

SEQ ID NO: 41465 - DNA, 22 bp, Homo sapiens
agaagccaccagctgaggaaga

SEQ ID NO: 41466 - DNA, 22 bp, Homo sapiens
cactgcactccagcctgggtga

SEQ ID NO: 41467 - DNA, 22 bp, Homo sapiens
atttgtgggactataatgcagg

SEQ ID NO: 41468 - DNA, 22 bp, Homo sapiens
tctgttgactcctagcagccat

SEQ ID NO: 41469 - DNA, 22 bp, Homo sapiens
atcacccaggctggagtgcagt

SEQ ID NO: 41470 - DNA, 22 bp, Homo sapiens
atccccctgtatctggaagaat

SEQ ID NO: 41471 - DNA, 22 bp, Homo sapiens
atgccacttcattccagcctcg

SEQ ID NO: 41472 - DNA, 22 bp, Homo sapiens
tattcatagtaaacaaaagtgg

SEQ ID NO: 41473 - DNA, 22 bp, Homo sapiens
gctgacccctacaggttgtgtt

SEQ ID NO: 41474 - DNA, 22 bp, Homo sapiens
aaatgcctcattttctctcact

SEQ ID NO: 41475 - DNA, 22 bp, Homo sapiens
tactttgtccatttgcaggcag

SEQ ID NO: 41476 - DNA, 22 bp, Homo sapiens
agaaggggcccaaggatgtcag

SEQ ID NO: 41477 - DNA, 22 bp, Homo sapiens
caggctggagtgcagtggtgcc

SEQ ID NO: 41478 - DNA, 22 bp, Homo sapiens
ggctcactgcaacttccgcctc

SEQ ID NO: 41479 - DNA, 22 bp, Homo sapiens
caggaggagggcagccgcctcc

SEQ ID NO: 41480 - DNA, 22 bp, Homo sapiens
ttgtaacaggtactaaataact

SEQ ID NO: 41481 - DNA, 22 bp, Homo sapiens
aggtggggaggagtgtctcttt

SEQ ID NO: 41482 - DNA, 22 bp, Homo sapiens
tttgtcttatccaatctctcag

SEQ ID NO: 41483 - DNA, 22 bp, Homo sapiens
ctgggcacagcgttgggctctt

SEQ ID NO: 41484 - DNA, 22 bp, Homo sapiens
tgctcccaaacctgacaggctc

SEQ ID NO: 41485 - DNA, 22 bp, Homo sapiens
ggcagcactgcagcttgttggg

SEQ ID NO: 41486 - DNA, 21 bp, Homo sapiens
tcagataccagactcaagggg

SEQ ID NO: 41487 - DNA, 22 bp, Homo sapiens
tgctagtgtgtgagatgttcaa

SEQ ID NO: 41488 - DNA, 22 bp, Homo sapiens
cctactctgagcgcctccgcat

SEQ ID NO: 41489 - DNA, 22 bp, Homo sapiens
tgatcaaaacattactccacca

SEQ ID NO: 41490 - DNA, 22 bp, Homo sapiens
gcacagccacgtaatgtggtca

SEQ ID NO: 41491 - DNA, 22 bp, Homo sapiens
ggaggcggaagttgcagtgagc

SEQ ID NO: 41492 - DNA, 22 bp, Homo sapiens
aggaaggcttctttggtcttct

SEQ ID NO: 41493 - DNA, 22 bp, Homo sapiens
ggccactgacctacatctgggg

SEQ ID NO: 41494 - DNA, 22 bp, Homo sapiens
tgactggattgtcattacgacg

SEQ ID NO: 41495 - DNA, 22 bp, Homo sapiens
cttctcttcctttgtcaactga

SEQ ID NO: 41496 - DNA, 22 bp, Homo sapiens
gaaggaagtcattagtgcagac

SEQ ID NO: 41497 - DNA, 22 bp, Homo sapiens
ctcgggcttgaggctgtttacc

SEQ ID NO: 41498 - DNA, 22 bp, Homo sapiens
tgttcttaggtatttgacagtc

SEQ ID NO: 41499 - DNA, 22 bp, Homo sapiens
tatttcttttcgtgacttattg

SEQ ID NO: 41500 - DNA, 22 bp, Homo sapiens
aaacaacctaaagttactgatc

SEQ ID NO: 41501 - DNA, 22 bp, Homo sapiens
tgagctcaagcaattcacccgc

SEQ ID NO: 41502 - DNA, 21 bp, Homo sapiens
gcagcagtgttctagaatact

SEQ ID NO: 41503 - DNA, 22 bp, Homo sapiens
atcaaatacaaagggcataagg

SEQ ID NO: 41504 - DNA, 22 bp, Homo sapiens
atacaaaaattagccgggagta

SEQ ID NO: 41505 - DNA, 22 bp, Homo sapiens
cagcagcagtgttctagaatct

SEQ ID NO: 41506 - DNA, 22 bp, Homo sapiens
tgttcctctgaacttcttccaa

SEQ ID NO: 41507 - DNA, 22 bp, Homo sapiens
actgcacttcagcctgggtgtc

SEQ ID NO: 41508 - DNA, 20 bp, Homo sapiens
aaaattgctctgcagtcccc

SEQ ID NO: 41509 - DNA, 22 bp, Homo sapiens
atgggctgtccattgctggctg

SEQ ID NO: 41510 - DNA, 22 bp, Homo sapiens
catcagaacgtgagctccttgt

SEQ ID NO: 41511 - DNA, 22 bp, Homo sapiens
actttatttcctattgcatcca

SEQ ID NO: 41512 - DNA, 22 bp, Homo sapiens
tgaatgtgatgctaaacatatg

SEQ ID NO: 41513 - DNA, 22 bp, Homo sapiens
tcctcctgtctaccagttcctg

SEQ ID NO: 41514 - DNA, 22 bp, Homo sapiens
gagatggagtctttttctgtca

SEQ ID NO: 41515 - DNA, 22 bp, Homo sapiens
aagatacagacagagccaaaat

SEQ ID NO: 41516 - DNA, 22 bp, Homo sapiens
ggtccccccatggtgagcactg

SEQ ID NO: 41517 - DNA, 22 bp, Homo sapiens
cactgcactccagcccgggcaa

SEQ ID NO: 41518 - DNA, 22 bp, Homo sapiens
gaggtggctgcttgctgggaaa

SEQ ID NO: 41519 - DNA, 22 bp, Homo sapiens
gaggcctgggcaagggggtctg

SEQ ID NO: 41520 - DNA, 22 bp, Homo sapiens
ctggtctggctacccagcgaat

SEQ ID NO: 41521 - DNA, 22 bp, Homo sapiens
cagagggttgatgtgaggctta

SEQ ID NO: 41522 - DNA, 22 bp, Homo sapiens
tcatctaagagtcttacattta

SEQ ID NO: 41523 - DNA, 22 bp, Homo sapiens
ttatatgtttctgtttggaggc

SEQ ID NO: 41524 - DNA, 22 bp, Homo sapiens
gaggcagaggttgcagtgagct

SEQ ID NO: 41525 - DNA, 22 bp, Homo sapiens
cccagtttcaactttccagtgg

SEQ ID NO: 41526 - DNA, 22 bp, Homo sapiens
actgggcctacccagattggca

SEQ ID NO: 41527 - DNA, 22 bp, Homo sapiens
tgtgcctgttcccactttgcct

SEQ ID NO: 41528 - DNA, 22 bp, Homo sapiens
tggaggagaccgcattttattt

SEQ ID NO: 41529 - DNA, 22 bp, Homo sapiens
tggagggcatgctgtccatggg

SEQ ID NO: 41530 - DNA, 22 bp, Homo sapiens
ctcattgcaacctccgcctccc

SEQ ID NO: 41531 - DNA, 22 bp, Homo sapiens
atacataattacttccgatgtt

SEQ ID NO: 41532 - DNA, 22 bp, Homo sapiens
ctgtccatattcaaggggtagg

SEQ ID NO: 41533 - DNA, 22 bp, Homo sapiens
agtcatgtgttcatctttcatt

SEQ ID NO: 41534 - DNA, 22 bp, Homo sapiens
agttgctgggaaagatttcagt

SEQ ID NO: 41535 - DNA, 22 bp, Homo sapiens
tggcctcggcatccagcaagag

SEQ ID NO: 41536 - DNA, 22 bp, Homo sapiens
ggcctgggctccgggagttact

SEQ ID NO: 41537 - DNA, 22 bp, Homo sapiens
ttctgatgaggaggtctctaag

SEQ ID NO: 41538 - DNA, 22 bp, Homo sapiens
ggaatgcactagactgtgaaac

SEQ ID NO: 41539 - DNA, 22 bp, Homo sapiens
gctcaagccttctgcccacctc

SEQ ID NO: 41540 - DNA, 22 bp, Homo sapiens
gcaggtggatcaccacgtcagg

SEQ ID NO: 41541 - DNA, 22 bp, Homo sapiens
ctgtggctctcagaggctgctg

SEQ ID NO: 41542 - DNA, 22 bp, Homo sapiens
cagctgcccctccagggctggg

SEQ ID NO: 41543 - DNA, 23 bp, Homo sapiens
cctgcctccccatcagttataca

SEQ ID NO: 41544 - DNA, 22 bp, Homo sapiens
tttaaaaaactagtctgagtct

SEQ ID NO: 41545 - DNA, 22 bp, Homo sapiens
ctgctccccagcctgcgccttt

SEQ ID NO: 41546 - DNA, 22 bp, Homo sapiens
cagggtttcaccatgttagcag

SEQ ID NO: 41547 - DNA, 22 bp, Homo sapiens
gcttggaagtaggattgggaga

SEQ ID NO: 41548 - DNA, 22 bp, Homo sapiens
tagatctgatacaattcatctg

SEQ ID NO: 41549 - DNA, 22 bp, Homo sapiens
ctgtaatcccagctacctggga

SEQ ID NO: 41550 - DNA, 22 bp, Homo sapiens
gctgcagtgagccaagatcgtg

SEQ ID NO: 41551 - DNA, 22 bp, Homo sapiens
cactgcactccagcctgggtca

SEQ ID NO: 41552 - DNA, 21 bp, Homo sapiens
gggcctggctgcgcaggacgg

SEQ ID NO: 41553 - DNA, 22 bp, Homo sapiens
actgcacttcaccctgggtgac

SEQ ID NO: 41554 - DNA, 22 bp, Homo sapiens
tcactgcaacctccacctcctg

SEQ ID NO: 41555 - DNA, 22 bp, Homo sapiens
gacggagctggttgctgcggct

SEQ ID NO: 41556 - DNA, 22 bp, Homo sapiens
ccaagctacttaggagtctgag

SEQ ID NO: 41557 - DNA, 22 bp, Homo sapiens
agagggcattaactctgtcttg

SEQ ID NO: 41558 - DNA, 22 bp, Homo sapiens
ctaccgggttctcagccaggca

SEQ ID NO: 41559 - DNA, 22 bp, Homo sapiens
acgtggcggccgccgtgagcgg

SEQ ID NO: 41560 - DNA, 22 bp, Homo sapiens
tgaaggggttcagcatgggggt

SEQ ID NO: 41561 - DNA, 20 bp, Homo sapiens
caagggtttgcattggcttt

SEQ ID NO: 41562 - DNA, 22 bp, Homo sapiens
cagccagtgtgaccgaggagga

SEQ ID NO: 41563 - DNA, 22 bp, Homo sapiens
aacactctctgttggtaaggct

SEQ ID NO: 41564 - DNA, 22 bp, Homo sapiens
agaaagtgcttccctttggact

SEQ ID NO: 41565 - DNA, 22 bp, Homo sapiens
cactgcactccagcctgggtga

SEQ ID NO: 41566 - DNA, 22 bp, Homo sapiens
tcagcctgctccaagtgctgcc

SEQ ID NO: 41567 - DNA, 22 bp, Homo sapiens
gctccctggtagccatgctctc

SEQ ID NO: 41568 - DNA, 22 bp, Homo sapiens
gagagtctagtgcacctagttt

SEQ ID NO: 41569 - DNA, 22 bp, Homo sapiens
gagggtggtggcttaaggtgct

SEQ ID NO: 41570 - DNA, 22 bp, Homo sapiens
aatgttgcagagtgattgtcca

SEQ ID NO: 41571 - DNA, 22 bp, Homo sapiens
tcccctctttctggaaacacaa

SEQ ID NO: 41572 - DNA, 22 bp, Homo sapiens
agaagccaccagctgaggaaga

SEQ ID NO: 41573 - DNA, 22 bp, Homo sapiens
aggcgcctgcgggatccttgcc

SEQ ID NO: 41574 - DNA, 22 bp, Homo sapiens
ctcccagccttcgccagtctga

SEQ ID NO: 41575 - DNA, 22 bp, Homo sapiens
ccaggtgtgctctgcagtggat

SEQ ID NO: 41576 - DNA, 22 bp, Homo sapiens
ttctcccatctcagtcttacat

SEQ ID NO: 41577 - DNA, 22 bp, Homo sapiens
caggctggagtgcagtggcgcc

SEQ ID NO: 41578 - DNA, 22 bp, Homo sapiens
gtctcccagcctacatctttct

SEQ ID NO: 41579 - DNA, 22 bp, Homo sapiens
ctaaagtgccaggaatacaggt

SEQ ID NO: 41580 - DNA, 22 bp, Homo sapiens
atgttggagtcgtaaggcatgg

SEQ ID NO: 41581 - DNA, 22 bp, Homo sapiens
agccacacagcttaatgacaga

SEQ ID NO: 41582 - DNA, 22 bp, Homo sapiens
agggccagcactcctggcagga

SEQ ID NO: 41583 - DNA, 22 bp, Homo sapiens
atgtacataaaatgtataatga

SEQ ID NO: 41584 - DNA, 22 bp, Homo sapiens
ccaggcaggcgatggtgcagtg

SEQ ID NO: 41585 - DNA, 22 bp, Homo sapiens
gcacggctaatttttgtatttt

SEQ ID NO: 41586 - DNA, 22 bp, Homo sapiens
cataatttctaccagggccata

SEQ ID NO: 41587 - DNA, 22 bp, Homo sapiens
cctggaggcggaggttgcagtg

SEQ ID NO: 41588 - DNA, 22 bp, Homo sapiens
cactgcactccatcctgggaaa

SEQ ID NO: 41589 - DNA, 22 bp, Homo sapiens
ctctagctcccagggagcgtct

SEQ ID NO: 41590 - DNA, 22 bp, Homo sapiens
taggcatgcaaataaatgtgca

SEQ ID NO: 41591 - DNA, 22 bp, Homo sapiens
tcaagcggactgagatactctg

SEQ ID NO: 41592 - DNA, 19 bp, Homo sapiens
ctctggagtcattgctccc

SEQ ID NO: 41593 - DNA, 22 bp, Homo sapiens
tccctagtcgcatctgtggaga

SEQ ID NO: 41594 - DNA, 23 bp, Homo sapiens
agctctgctcgggcatgccctgc

SEQ ID NO: 41595 - DNA, 19 bp, Homo sapiens
gcagacaggtccagagagg

SEQ ID NO: 41596 - DNA, 22 bp, Homo sapiens
ttcaatatgatattagctgtgg

SEQ ID NO: 41597 - DNA, 22 bp, Homo sapiens
acatatgcgatcataggatgca

SEQ ID NO: 41598 - DNA, 18 bp, Homo sapiens
tcaagccattctcctgcc

SEQ ID NO: 41599 - DNA, 21 bp, Homo sapiens
agtagtttagcacagggtttg

SEQ ID NO: 41600 - DNA, 22 bp, Homo sapiens
accgggaagtcctgcactgggc

SEQ ID NO: 41601 - DNA, 22 bp, Homo sapiens
ggtcccaggttgacagggagac

SEQ ID NO: 41602 - DNA, 22 bp, Homo sapiens
tcacagacccttgctgagctct

SEQ ID NO: 41603 - DNA, 22 bp, Homo sapiens
gtaggtcagacataagaggaca

SEQ ID NO: 41604 - DNA, 18 bp, Homo sapiens
gaggtagataagattttc

SEQ ID NO: 41605 - DNA, 22 bp, Homo sapiens
tgggccacacacagaagaatca

SEQ ID NO: 41606 - DNA, 22 bp, Homo sapiens
atgcacctgaactccatcagct

SEQ ID NO: 41607 - DNA, 22 bp, Homo sapiens
catttacatttaaggttaatat

SEQ ID NO: 41608 - DNA, 22 bp, Homo sapiens
ccaggaggcggaggttgcagtg

SEQ ID NO: 41609 - DNA, 22 bp, Homo sapiens
cagccccatggtgtgctccagc

SEQ ID NO: 41610 - DNA, 22 bp, Homo sapiens
gtcactgtatccaggttccagc

SEQ ID NO: 41611 - DNA, 22 bp, Homo sapiens
cgtgaggggggtaaggcgtccg

SEQ ID NO: 41612 - DNA, 22 bp, Homo sapiens
tcctccccaaagcccagcctgg

SEQ ID NO: 41613 - DNA, 22 bp, Homo sapiens
ccctcccaggagtggccagaga

SEQ ID NO: 41614 - DNA, 22 bp, Homo sapiens
gccatgcttggtatgctgtgag

SEQ ID NO: 41615 - DNA, 22 bp, Homo sapiens
acccaggctggagtgcagtggc

SEQ ID NO: 41616 - DNA, 22 bp, Homo sapiens
tcagtgatttctggggtgaggg

SEQ ID NO: 41617 - DNA, 22 bp, Homo sapiens
gcccccgtagtagatgaggcgc

SEQ ID NO: 41618 - DNA, 22 bp, Homo sapiens
tttggaaatgaccccgtctaag

SEQ ID NO: 41619 - DNA, 22 bp, Homo sapiens
tcaccaggctggagtgcagtgg

SEQ ID NO: 41620 - DNA, 22 bp, Homo sapiens
caaagtgctgggattacaggct

SEQ ID NO: 41621 - DNA, 22 bp, Homo sapiens
atctagattaggtataagagct

SEQ ID NO: 41622 - DNA, 22 bp, Homo sapiens
gcaaaagtacagccggatttct

SEQ ID NO: 41623 - DNA, 22 bp, Homo sapiens
agatgaatccacacatggcaaa

SEQ ID NO: 41624 - DNA, 22 bp, Homo sapiens
ctggcctcggcagcaggaacag

SEQ ID NO: 41625 - DNA, 22 bp, Homo sapiens
tttgtcttatccaatctctcag

SEQ ID NO: 41626 - DNA, 22 bp, Homo sapiens
acacccaggctggcgtgcagtg

SEQ ID NO: 41627 - DNA, 22 bp, Homo sapiens
gtgtggtcgaagttctcccgga

SEQ ID NO: 41628 - DNA, 22 bp, Homo sapiens
gctgacccctacaggttgtgtt

SEQ ID NO: 41629 - DNA, 22 bp, Homo sapiens
ggagaagcagcttcttgatgaa

SEQ ID NO: 41630 - DNA, 22 bp, Homo sapiens
atttacaggtagaattttaagt

SEQ ID NO: 41631 - DNA, 22 bp, Homo sapiens
agtcaaagatgaccgagttcct

SEQ ID NO: 41632 - DNA, 22 bp, Homo sapiens
cgccaggcttggtagctcatgc

SEQ ID NO: 41633 - DNA, 22 bp, Homo sapiens
aacccaggaggtggaggttgtg

SEQ ID NO: 41634 - DNA, 22 bp, Homo sapiens
cactgcactccagcctgggaga

SEQ ID NO: 41635 - DNA, 22 bp, Homo sapiens
taggtgcagtggctcatgcctg

SEQ ID NO: 41636 - DNA, 22 bp, Homo sapiens
gcccaggctggagtgcagtggt

SEQ ID NO: 41637 - DNA, 22 bp, Homo sapiens
ggaggagcatgagagggtagtg

SEQ ID NO: 41638 - DNA, 22 bp, Homo sapiens
gtgtgcacagagctccagtgtt

SEQ ID NO: 41639 - DNA, 22 bp, Homo sapiens
tagtggatgttcagagatttga

SEQ ID NO: 41640 - DNA, 22 bp, Homo sapiens
ctccagttggccccagttggtt

SEQ ID NO: 41641 - DNA, 22 bp, Homo sapiens
tgcaggctcttggtgacgtggg

SEQ ID NO: 41642 - DNA, 22 bp, Homo sapiens
aactatgttaataagtttcatt

SEQ ID NO: 41643 - DNA, 22 bp, Homo sapiens
cggaggttgaggctgcagtgag

SEQ ID NO: 41644 - DNA, 22 bp, Homo sapiens
ctcgttgctgaagccaaagtca

SEQ ID NO: 41645 - DNA, 22 bp, Homo sapiens
gccgggaccaaggccacggagc

SEQ ID NO: 41646 - DNA, 22 bp, Homo sapiens
gaggggcacagtaaagggtccc

SEQ ID NO: 41647 - DNA, 22 bp, Homo sapiens
cagagcccctcgtctccaccac

SEQ ID NO: 41648 - DNA, 22 bp, Homo sapiens
aagccctggcgggtggagggcc

SEQ ID NO: 41649 - DNA, 22 bp, Homo sapiens
cccaggaggcagaagttgcagt

SEQ ID NO: 41650 - DNA, 22 bp, Homo sapiens
tggacaggcaagcaagacatac

SEQ ID NO: 41651 - DNA, 22 bp, Homo sapiens
agaatttcctatgagagattcc

SEQ ID NO: 41652 - DNA, 22 bp, Homo sapiens
ggaggaggggtgactgaatgct

SEQ ID NO: 41653 - DNA, 20 bp, Homo sapiens
agagtgagactccatctcag

SEQ ID NO: 41654 - DNA, 22 bp, Homo sapiens
aggctgagataggtggatcatt

SEQ ID NO: 41655 - DNA, 21 bp, Homo sapiens
ttagaagctaatgcagctggt

SEQ ID NO: 41656 - DNA, 18 bp, Homo sapiens
gcagtgaagaaagagctt

SEQ ID NO: 41657 - DNA, 22 bp, Homo sapiens
aggggaggtgtccccaaatctc

SEQ ID NO: 41658 - DNA, 22 bp, Homo sapiens
gtgacaatattagctcaggggc

SEQ ID NO: 41659 - DNA, 22 bp, Homo sapiens
gatggcacacagacatccccgc

SEQ ID NO: 41660 - DNA, 22 bp, Homo sapiens
gcctccggagtcacagtgtctt

SEQ ID NO: 41661 - DNA, 22 bp, Homo sapiens
atggtggacgggagacaggact

SEQ ID NO: 41662 - DNA, 22 bp, Homo sapiens
acgcccagactcccatactttg

SEQ ID NO: 41663 - DNA, 22 bp, Homo sapiens
caggctggagtgcagtggtgcc

SEQ ID NO: 41664 - DNA, 22 bp, Homo sapiens
ctggcctaaaaatacagaacaa

SEQ ID NO: 41665 - DNA, 22 bp, Homo sapiens
ctcaggacccggtccaggtggg

SEQ ID NO: 41666 - DNA, 22 bp, Homo sapiens
actctccttttgatcttcagaa

SEQ ID NO: 41667 - DNA, 22 bp, Homo sapiens
tggaatggaaacaaactgagga

SEQ ID NO: 41668 - DNA, 21 bp, Homo sapiens
aaactgaccttgcctgagaca

SEQ ID NO: 41669 - DNA, 22 bp, Homo sapiens
aagcactttatgtcaatgtcct

SEQ ID NO: 41670 - DNA, 21 bp, Homo sapiens
gtggttctagagaaacagaat

SEQ ID NO: 41671 - DNA, 22 bp, Homo sapiens
cactgcactccagcactccagc

SEQ ID NO: 41672 - DNA, 22 bp, Homo sapiens
aagaagagaactggcatcctaa

SEQ ID NO: 41673 - DNA, 22 bp, Homo sapiens
gcagggtctgaggccacagagg

SEQ ID NO: 41674 - DNA, 22 bp, Homo sapiens
ggctagggatctagaccaggac

SEQ ID NO: 41675 - DNA, 22 bp, Homo sapiens
aggatgagccgcgcaagctgac

SEQ ID NO: 41676 - DNA, 22 bp, Homo sapiens
ccactgtgcccagcctcatggg

SEQ ID NO: 41677 - DNA, 22 bp, Homo sapiens
aggggtgacacatatcagtgca

SEQ ID NO: 41678 - DNA, 22 bp, Homo sapiens
cccacgttgaaccgcttacaga

SEQ ID NO: 41679 - DNA, 22 bp, Homo sapiens
gcagaggacacaggagggcaag

SEQ ID NO: 41680 - DNA, 22 bp, Homo sapiens
tggcaagaaccgcaattacttt

SEQ ID NO: 41681 - DNA, 21 bp, Homo sapiens
tgactgaggcttcttcacaca

SEQ ID NO: 41682 - DNA, 22 bp, Homo sapiens
tgccgcagtgcggggagggccc

SEQ ID NO: 41683 - DNA, 22 bp, Homo sapiens
ggtgtagctctgtgtcccactg

SEQ ID NO: 41684 - DNA, 22 bp, Homo sapiens
ggacattgaagctggaaaggga

SEQ ID NO: 41685 - DNA, 22 bp, Homo sapiens
agcccttggtattttccgatcc

SEQ ID NO: 41686 - DNA, 22 bp, Homo sapiens
tccacaaggcagctcctccagg

SEQ ID NO: 41687 - DNA, 22 bp, Homo sapiens
gcctcctgagtagctgggattg

SEQ ID NO: 41688 - DNA, 22 bp, Homo sapiens
atgaaatatcttgaagaaattc

SEQ ID NO: 41689 - DNA, 22 bp, Homo sapiens
tggccaccaccaatacttgcct

SEQ ID NO: 41690 - DNA, 22 bp, Homo sapiens
ttcctgttcaggaaagttgtgt

SEQ ID NO: 41691 - DNA, 22 bp, Homo sapiens
tgctgtgaggttgagaaggaag

SEQ ID NO: 41692 - DNA, 19 bp, Homo sapiens
catctggatgattctcctg

SEQ ID NO: 41693 - DNA, 22 bp, Homo sapiens
tccctctacagggaagcgcttt

SEQ ID NO: 41694 - DNA, 22 bp, Homo sapiens
tgttgattagtgtttagactta

SEQ ID NO: 41695 - DNA, 22 bp, Homo sapiens
tctctatttgcctaggcttgtg

SEQ ID NO: 41696 - DNA, 22 bp, Homo sapiens
atgccactgcgctccagcctgg

SEQ ID NO: 41697 - DNA, 22 bp, Homo sapiens
aagcctggactatcgcgtgtgc

SEQ ID NO: 41698 - DNA, 20 bp, Homo sapiens
atcctctcctgattaattca

SEQ ID NO: 41699 - DNA, 22 bp, Homo sapiens
ccctgccttgtctgggctaggt

SEQ ID NO: 41700 - DNA, 22 bp, Homo sapiens
cccaggaggtcgaagctgcagt

SEQ ID NO: 41701 - DNA, 22 bp, Homo sapiens
aagttactggcaagggctgcag

SEQ ID NO: 41702 - DNA, 22 bp, Homo sapiens
cccatgcaccctctaagaagga

SEQ ID NO: 41703 - DNA, 22 bp, Homo sapiens
actcatgtaagcggaatgtagt

SEQ ID NO: 41704 - DNA, 22 bp, Homo sapiens
tcgcccaggctggaagtgcagt

SEQ ID NO: 41705 - DNA, 22 bp, Homo sapiens
ctgggagtggtgacagctctcg

SEQ ID NO: 41706 - DNA, 22 bp, Homo sapiens
cccaggctggagtgtaatggtg

SEQ ID NO: 41707 - DNA, 22 bp, Homo sapiens
cacccaggttggagtgcagtgg

SEQ ID NO: 41708 - DNA, 22 bp, Homo sapiens
gagagtgagatcctcctgggga

SEQ ID NO: 41709 - DNA, 22 bp, Homo sapiens
agcggcgccgagcttggccagg

SEQ ID NO: 41710 - DNA, 19 bp, Homo sapiens
caggcctcttaccctctct

SEQ ID NO: 41711 - DNA, 22 bp, Homo sapiens
aggaggaagggaagacaagtaa

SEQ ID NO: 41712 - DNA, 22 bp, Homo sapiens
acatcctcccgatctactggct

SEQ ID NO: 41713 - DNA, 22 bp, Homo sapiens
gggagtgggtttggcctaggcc

SEQ ID NO: 41714 - DNA, 22 bp, Homo sapiens
agtgcactggcaccatctcagc

SEQ ID NO: 41715 - DNA, 22 bp, Homo sapiens
tgttgcccaggttctctcctgc

SEQ ID NO: 41716 - DNA, 22 bp, Homo sapiens
agagtgcaaccgaaacaagcag

SEQ ID NO: 41717 - DNA, 22 bp, Homo sapiens
cacccaggctggagtgcagtgg

SEQ ID NO: 41718 - DNA, 22 bp, Homo sapiens
aggacttagaacattatgtact

SEQ ID NO: 41719 - DNA, 22 bp, Homo sapiens
ctcactgcaagttccacctacc

SEQ ID NO: 41720 - DNA, 22 bp, Homo sapiens
cccaggaggtggagttcacagt

SEQ ID NO: 41721 - DNA, 22 bp, Homo sapiens
tgacagaactcattctcaccaa

SEQ ID NO: 41722 - DNA, 22 bp, Homo sapiens
agtggagacaggacagtcgata

SEQ ID NO: 41723 - DNA, 22 bp, Homo sapiens
agcgccactgcactccagcctg

SEQ ID NO: 41724 - DNA, 22 bp, Homo sapiens
ggctgcaggttggttggcagct

SEQ ID NO: 41725 - DNA, 22 bp, Homo sapiens
gttaggtagaagtttactttga

SEQ ID NO: 41726 - DNA, 22 bp, Homo sapiens
tgtgtggattcatctcaaagag

SEQ ID NO: 41727 - DNA, 22 bp, Homo sapiens
ttttctgtttgcttcaagacat

SEQ ID NO: 41728 - DNA, 22 bp, Homo sapiens
aaagggaagttgcacatgttcc

SEQ ID NO: 41729 - DNA, 22 bp, Homo sapiens
aatgtgagccaatgcccgtggg

SEQ ID NO: 41730 - DNA, 22 bp, Homo sapiens
gggagaggttacccgagcaact

SEQ ID NO: 41731 - DNA, 22 bp, Homo sapiens
aggtcaagagtaaatttgggta

SEQ ID NO: 41732 - DNA, 22 bp, Homo sapiens
gagacacaggcacagaagaggc

SEQ ID NO: 41733 - DNA, 22 bp, Homo sapiens
ggggaccctcaggactgcgtct

SEQ ID NO: 41734 - DNA, 22 bp, Homo sapiens
aagatactttgcatgcatgaag

SEQ ID NO: 41735 - DNA, 22 bp, Homo sapiens
atgtatatgcatgcattcaaag

SEQ ID NO: 41736 - DNA, 22 bp, Homo sapiens
caaccccactacacgttggaga

SEQ ID NO: 41737 - DNA, 22 bp, Homo sapiens
gcgagcctctggagtcctctgg

SEQ ID NO: 41738 - DNA, 22 bp, Homo sapiens
ggaggcggaagttgcagtgagc

SEQ ID NO: 41739 - DNA, 22 bp, Homo sapiens
ggctgggctccgggagcatgcg

SEQ ID NO: 41740 - DNA, 22 bp, Homo sapiens
ggggcaggagcccttcttcagc

SEQ ID NO: 41741 - DNA, 22 bp, Homo sapiens
aaaaagtattggccatggttga

SEQ ID NO: 41742 - DNA, 23 bp, Homo sapiens
cctgcctccccatcagttataca

SEQ ID NO: 41743 - DNA, 22 bp, Homo sapiens
gggaagtgatggagccaggatt

SEQ ID NO: 41744 - DNA, 22 bp, Homo sapiens
gacaggaggcagagctcaggtg

SEQ ID NO: 41745 - DNA, 22 bp, Homo sapiens
ttatgggagcaattggggaggt

SEQ ID NO: 41746 - DNA, 22 bp, Homo sapiens
gcaggcagatcacctgtcagga

SEQ ID NO: 41747 - DNA, 22 bp, Homo sapiens
ggagactgatctgagtgataac

SEQ ID NO: 41748 - DNA, 22 bp, Homo sapiens
aggcaatcccctgaggatactt

SEQ ID NO: 41749 - DNA, 21 bp, Homo sapiens
ctggaggcaggtggtgccagg

SEQ ID NO: 41750 - DNA, 22 bp, Homo sapiens
cttcagctgcagttatgtttag

SEQ ID NO: 41751 - DNA, 22 bp, Homo sapiens
attcgcgggcctggagggtggg

SEQ ID NO: 41752 - DNA, 21 bp, Homo sapiens
gctgctcgagatccagtgctt

SEQ ID NO: 41753 - DNA, 22 bp, Homo sapiens
agcctgggcaacagagcaaaac

SEQ ID NO: 41754 - DNA, 22 bp, Homo sapiens
tggagaagattggtcaccattc

SEQ ID NO: 41755 - DNA, 22 bp, Homo sapiens
tcttggattttaatggatcaaa

SEQ ID NO: 41756 - DNA, 22 bp, Homo sapiens
agcaggaaggggatgatgggca

SEQ ID NO: 41757 - DNA, 22 bp, Homo sapiens
tttggaaattttcatccagaca

SEQ ID NO: 41758 - DNA, 22 bp, Homo sapiens
ttgtatagcccagagagtgaga

SEQ ID NO: 41759 - DNA, 22 bp, Homo sapiens
gcctggagaaaggaaggtggga

SEQ ID NO: 41760 - DNA, 23 bp, Homo sapiens
acagtcgtaggtatccttttcct

SEQ ID NO: 41761 - DNA, 22 bp, Homo sapiens
gggagaagaatgtgtcaattgt

SEQ ID NO: 41762 - DNA, 22 bp, Homo sapiens
gggaaatctcgtcctctattta

SEQ ID NO: 41763 - DNA, 22 bp, Homo sapiens
ccaggaggtggagattgcagtg

SEQ ID NO: 41764 - DNA, 22 bp, Homo sapiens
ctggctggagtgcaggtgagtg

SEQ ID NO: 41765 - DNA, 22 bp, Homo sapiens
atacctgtgtatccacaagcgt

SEQ ID NO: 41766 - DNA, 22 bp, Homo sapiens
ttccactctacacactgctggc

SEQ ID NO: 41767 - DNA, 22 bp, Homo sapiens
caggcagggagctggaaaggat

SEQ ID NO: 41768 - DNA, 22 bp, Homo sapiens
caggctggagttcagtggtgtg

SEQ ID NO: 41769 - DNA, 22 bp, Homo sapiens
ctggagggtggagagaagtctc

SEQ ID NO: 41770 - DNA, 22 bp, Homo sapiens
cccaggaattggaggctgcagt

SEQ ID NO: 41771 - DNA, 22 bp, Homo sapiens
gtggttttattcgttcctctgt

SEQ ID NO: 41772 - DNA, 22 bp, Homo sapiens
cacccaggctggattgcagtgg

SEQ ID NO: 41773 - DNA, 22 bp, Homo sapiens
tgacagagtgacactcttgtct

SEQ ID NO: 41774 - DNA, 22 bp, Homo sapiens
tgtctggtgggttgacaggcag

SEQ ID NO: 41775 - DNA, 22 bp, Homo sapiens
ggacacgtggctgaaggcggcc

SEQ ID NO: 41776 - DNA, 22 bp, Homo sapiens
gatagtcacctcccttaacttt

SEQ ID NO: 41777 - DNA, 22 bp, Homo sapiens
tggtcgaccagttggaaagtaa

SEQ ID NO: 41778 - DNA, 22 bp, Homo sapiens
ttcatagtgtttccttccagtg

SEQ ID NO: 41779 - DNA, 22 bp, Homo sapiens
ctagttgaagaggctgtcatca

SEQ ID NO: 41780 - DNA, 22 bp, Homo sapiens
acccaggctggagtgcagtgat

SEQ ID NO: 41781 - DNA, 22 bp, Homo sapiens
catctgctgttccttggactca

SEQ ID NO: 41782 - DNA, 22 bp, Homo sapiens
gctgcacagacttgctcattta

SEQ ID NO: 41783 - DNA, 22 bp, Homo sapiens
cagccacttgtgatgctgggga

SEQ ID NO: 41784 - DNA, 22 bp, Homo sapiens
cggtcaggtgcagcgttggcac

SEQ ID NO: 41785 - DNA, 22 bp, Homo sapiens
tgccaggcgtggtggtgcgcac

SEQ ID NO: 41786 - DNA, 22 bp, Homo sapiens
ccggagtgtctggcctgctggg

SEQ ID NO: 41787 - DNA, 22 bp, Homo sapiens
gtgggctgcccttgaggtcagc

SEQ ID NO: 41788 - DNA, 23 bp, Homo sapiens
gctcatcaggcttagagtcaagg

SEQ ID NO: 41789 - DNA, 22 bp, Homo sapiens
tgtgacagcacggttcaactgc

SEQ ID NO: 41790 - DNA, 22 bp, Homo sapiens
gcttctgagttcttgcttaata

SEQ ID NO: 41791 - DNA, 22 bp, Homo sapiens
tggttgtggtcctccacatcgc

SEQ ID NO: 41792 - DNA, 22 bp, Homo sapiens
aacactgctgctgggttctgtg

SEQ ID NO: 41793 - DNA, 21 bp, Homo sapiens
cctcaaagatgatggggtttc

SEQ ID NO: 41794 - DNA, 22 bp, Homo sapiens
gctctctgcagcctccttggag

SEQ ID NO: 41795 - DNA, 20 bp, Homo sapiens
gggcagagccagccagtccc

SEQ ID NO: 41796 - DNA, 22 bp, Homo sapiens
gagggggctagcgcagtgccca

SEQ ID NO: 41797 - DNA, 22 bp, Homo sapiens
ttgcagcccgggttggtttgtg

SEQ ID NO: 41798 - DNA, 22 bp, Homo sapiens
ttgtgaatggtgccgcaataaa

SEQ ID NO: 41799 - DNA, 22 bp, Homo sapiens
tgagcaggcgcagcaggaggtc

SEQ ID NO: 41800 - DNA, 22 bp, Homo sapiens
gtgtttggtcagacgtccgggg

SEQ ID NO: 41801 - DNA, 21 bp, Homo sapiens
ggtgctcgctgatgaggagtg

SEQ ID NO: 41802 - DNA, 22 bp, Homo sapiens
aggggatggagctggaaggcag

SEQ ID NO: 41803 - DNA, 22 bp, Homo sapiens
aaattagtcatgttgtattact

SEQ ID NO: 41804 - DNA, 22 bp, Homo sapiens
acagcccagctctttctctgca

SEQ ID NO: 41805 - DNA, 22 bp, Homo sapiens
ctctggaggtggaggttgcagt

SEQ ID NO: 41806 - DNA, 22 bp, Homo sapiens
ccaggctggagtatagtggcgc

SEQ ID NO: 41807 - DNA, 22 bp, Homo sapiens
gcgagggcacgcggttgaaggc

SEQ ID NO: 41808 - DNA, 22 bp, Homo sapiens
cctgcacatgtgtgcgcctgta

SEQ ID NO: 41809 - DNA, 16 bp, Homo sapiens
aggtggagaagttcac

SEQ ID NO: 41810 - DNA, 22 bp, Homo sapiens
ctgggctagaaggaccaggatg

SEQ ID NO: 41811 - DNA, 22 bp, Homo sapiens
tgtgactaggcctgagctcttg

SEQ ID NO: 41812 - DNA, 22 bp, Homo sapiens
cacccaggctggagagcagtgg

SEQ ID NO: 41813 - DNA, 22 bp, Homo sapiens
gatttttatataaagtgagaaa

SEQ ID NO: 41814 - DNA, 22 bp, Homo sapiens
acagacaagtagttcagacaag

SEQ ID NO: 41815 - DNA, 22 bp, Homo sapiens
agacactgttctcacatgcttg

SEQ ID NO: 41816 - DNA, 22 bp, Homo sapiens
aagtgcttccatgtttgagtgt

SEQ ID NO: 41817 - DNA, 22 bp, Homo sapiens
gctcttgtcaaaaattagttga

SEQ ID NO: 41818 - DNA, 22 bp, Homo sapiens
gaggcagaggttgcagtgagct

SEQ ID NO: 41819 - DNA, 22 bp, Homo sapiens
ccattgtaaattctgtggaagt

SEQ ID NO: 41820 - DNA, 22 bp, Homo sapiens
caggaggacatactggctcaca

SEQ ID NO: 41821 - DNA, 22 bp, Homo sapiens
ctcgcatgccctgcctcatcca

SEQ ID NO: 41822 - DNA, 22 bp, Homo sapiens
aggagaagccaagttgtgagca

SEQ ID NO: 41823 - DNA, 19 bp, Homo sapiens
agggaatccggctgaggga

SEQ ID NO: 41824 - DNA, 22 bp, Homo sapiens
cgggcgcactccgggcagctgt

SEQ ID NO: 41825 - DNA, 22 bp, Homo sapiens
gcccaggctggagtgcagtggc

SEQ ID NO: 41826 - DNA, 22 bp, Homo sapiens
cagtggaggccttgggaccttt

SEQ ID NO: 41827 - DNA, 22 bp, Homo sapiens
atgccacttcattccagcctcg

SEQ ID NO: 41828 - DNA, 22 bp, Homo sapiens
acacggcactttaggaaggggc

SEQ ID NO: 41829 - DNA, 22 bp, Homo sapiens
ccagaggagttgaggctttggg

SEQ ID NO: 41830 - DNA, 22 bp, Homo sapiens
aggaggggttctcgggtgctga

SEQ ID NO: 41831 - DNA, 22 bp, Homo sapiens
aacccagggtggaggttgcagt

SEQ ID NO: 41832 - DNA, 22 bp, Homo sapiens
tcttcctggatgggggttgatg

SEQ ID NO: 41833 - DNA, 22 bp, Homo sapiens
gaggctgaggttgcagtgagcc

SEQ ID NO: 41834 - DNA, 22 bp, Homo sapiens
aaggcaggatgggaaaagattt

SEQ ID NO: 41835 - DNA, 22 bp, Homo sapiens
gacctcatgatccacctgcctt

SEQ ID NO: 41836 - DNA, 22 bp, Homo sapiens
gggaggaggaatgttttgtgta

SEQ ID NO: 41837 - DNA, 22 bp, Homo sapiens
ctctgcctgtctcatcctgcaa

SEQ ID NO: 41838 - DNA, 22 bp, Homo sapiens
gtacacaaagtgagacttgata

SEQ ID NO: 41839 - DNA, 22 bp, Homo sapiens
aaaggacacacaggaggtgtct

SEQ ID NO: 41840 - DNA, 22 bp, Homo sapiens
aagtggactaatacaaggacta

SEQ ID NO: 41841 - DNA, 22 bp, Homo sapiens
ggagcagggaattacagcgcag

SEQ ID NO: 41842 - DNA, 22 bp, Homo sapiens
tctgccgtgcgaggtcccacca

SEQ ID NO: 41843 - DNA, 22 bp, Homo sapiens
cacctagggtttcgcctttctt

SEQ ID NO: 41844 - DNA, 22 bp, Homo sapiens
acaaacagagttgaaaaatagg

SEQ ID NO: 41845 - DNA, 22 bp, Homo sapiens
acaaagtgaattgcatcgagtt

SEQ ID NO: 41846 - DNA, 22 bp, Homo sapiens
cggggccctggggctgaaggtc

SEQ ID NO: 41847 - DNA, 22 bp, Homo sapiens
gcctccggagttgcagtgtctt

SEQ ID NO: 41848 - DNA, 20 bp, Homo sapiens
tgctggaaattgttctagga

SEQ ID NO: 41849 - DNA, 22 bp, Homo sapiens
tagcccctgcctttgaacctgg

SEQ ID NO: 41850 - DNA, 22 bp, Homo sapiens
tctgcaggtaagcgttcttgga

SEQ ID NO: 41851 - DNA, 18 bp, Homo sapiens
cagctgccagctcatgga

SEQ ID NO: 41852 - DNA, 22 bp, Homo sapiens
atgaggcaggtggaggctgcca

SEQ ID NO: 41853 - DNA, 22 bp, Homo sapiens
caaagtgctggaattacaggtg

SEQ ID NO: 41854 - DNA, 21 bp, Homo sapiens
tgaaggggtggcagtgtgctt

SEQ ID NO: 41855 - DNA, 22 bp, Homo sapiens
gctcccagtctgatggaggaga

SEQ ID NO: 41856 - DNA, 22 bp, Homo sapiens
cccacgtcgaacttgctccaga

SEQ ID NO: 41857 - DNA, 22 bp, Homo sapiens
tctatgcttgagacagatgggg

SEQ ID NO: 41858 - DNA, 22 bp, Homo sapiens
gctggaggatggactggaagaa

SEQ ID NO: 41859 - DNA, 18 bp, Homo sapiens
tcactgggtgtatgtggc

SEQ ID NO: 41860 - DNA, 22 bp, Homo sapiens
ggagagggtaggggtcctgccc

SEQ ID NO: 41861 - DNA, 22 bp, Homo sapiens
gccaggcgggtctcaaactcct

SEQ ID NO: 41862 - DNA, 21 bp, Homo sapiens
gctcctggtgctgcgtggcgc

SEQ ID NO: 41863 - DNA, 22 bp, Homo sapiens
tagatttgtttccttctctcca

SEQ ID NO: 41864 - DNA, 22 bp, Homo sapiens
ggaagaaaggtggacaacaggt

SEQ ID NO: 41865 - DNA, 22 bp, Homo sapiens
gggctgagacgatggggtcttc

SEQ ID NO: 41866 - DNA, 22 bp, Homo sapiens
ctgccctggggggcctccttgc

SEQ ID NO: 41867 - DNA, 22 bp, Homo sapiens
ctgtatctgtgttggatgagtt

SEQ ID NO: 41868 - DNA, 23 bp, Homo sapiens
cagggccctgctcaatttctcca

SEQ ID NO: 41869 - DNA, 22 bp, Homo sapiens
tctcccaggcaggagtgcagtg

SEQ ID NO: 41870 - DNA, 22 bp, Homo sapiens
cttagatgaagtcacagaaccc

SEQ ID NO: 41871 - DNA, 22 bp, Homo sapiens
agacagggtgatcgcttgagcc

SEQ ID NO: 41872 - DNA, 22 bp, Homo sapiens
caggaaggcgcggctgtgcctg

SEQ ID NO: 41873 - DNA, 22 bp, Homo sapiens
aggctggagtgcagttgcatga

SEQ ID NO: 41874 - DNA, 22 bp, Homo sapiens
atttagaactttgtttgccaat

SEQ ID NO: 41875 - DNA, 22 bp, Homo sapiens
aaagaaggtagggctggtgact

SEQ ID NO: 41876 - DNA, 22 bp, Homo sapiens
cactgcactccagcccgggcaa

SEQ ID NO: 41877 - DNA, 22 bp, Homo sapiens
ctgtccagcgactaggggatgg

SEQ ID NO: 41878 - DNA, 22 bp, Homo sapiens
cttgcctttgtcttcaaaggct

SEQ ID NO: 41879 - DNA, 22 bp, Homo sapiens
cctgtggcgggggccagtgcct

SEQ ID NO: 41880 - DNA, 22 bp, Homo sapiens
ttcagatgattagaatagtatt

SEQ ID NO: 41881 - DNA, 22 bp, Homo sapiens
ccaggctggagtgcagtggcac

SEQ ID NO: 41882 - DNA, 22 bp, Homo sapiens
tccaccatgtaacaagctctgt

SEQ ID NO: 41883 - DNA, 22 bp, Homo sapiens
ttttcatttttgtagatgcaag

SEQ ID NO: 41884 - DNA, 22 bp, Homo sapiens
tggtattacttctagacacaag

SEQ ID NO: 41885 - DNA, 22 bp, Homo sapiens
cgtcctctagagggaagcactt

SEQ ID NO: 41886 - DNA, 22 bp, Homo sapiens
agagtggagagaaacaactctg

SEQ ID NO: 41887 - DNA, 22 bp, Homo sapiens
gcaagacatgtctaaggtttaa

SEQ ID NO: 41888 - DNA, 22 bp, Homo sapiens
tcctttgcttctgtcattctcc

SEQ ID NO: 41889 - DNA, 22 bp, Homo sapiens
ctgaagagaaagggagctcttc

SEQ ID NO: 41890 - DNA, 22 bp, Homo sapiens
gctcccaggatgaggagccagg

SEQ ID NO: 41891 - DNA, 22 bp, Homo sapiens
ttacctaaaatagctcaattta

SEQ ID NO: 41892 - DNA, 22 bp, Homo sapiens
ggcagacctctccagccccaca

SEQ ID NO: 41893 - DNA, 22 bp, Homo sapiens
aagccggctgggccgaggctgc

SEQ ID NO: 41894 - DNA, 22 bp, Homo sapiens
tctcaagcttgttggtatgttt

SEQ ID NO: 41895 - DNA, 22 bp, Homo sapiens
tcagtggagagcttccaggatt

SEQ ID NO: 41896 - DNA, 22 bp, Homo sapiens
agagggatcaccctgtttctgg

SEQ ID NO: 41897 - DNA, 22 bp, Homo sapiens
tccaagatctacagcagtttag

SEQ ID NO: 41898 - DNA, 22 bp, Homo sapiens
ttgctgacctttgctctccgtt

SEQ ID NO: 41899 - DNA, 22 bp, Homo sapiens
tctgctctgtggcttcagctaa

SEQ ID NO: 41900 - DNA, 21 bp, Homo sapiens
cgcagagcgaacttgcggcgc

SEQ ID NO: 41901 - DNA, 22 bp, Homo sapiens
ggttgcaaactcctgggatcaa

SEQ ID NO: 41902 - DNA, 22 bp, Homo sapiens
ttagattctgttgttgctagtg

SEQ ID NO: 41903 - DNA, 22 bp, Homo sapiens
ttaaatattatgttgtctgcaa

SEQ ID NO: 41904 - DNA, 17 bp, Homo sapiens
cgggcatggagggcagg

SEQ ID NO: 41905 - DNA, 22 bp, Homo sapiens
gctgaaggcccggaggacaggg

SEQ ID NO: 41906 - DNA, 22 bp, Homo sapiens
atctggttcttcttaggcatca

SEQ ID NO: 41907 - DNA, 22 bp, Homo sapiens
ggctccccaggtccaggagctg

SEQ ID NO: 41908 - DNA, 22 bp, Homo sapiens
caaagtgctgggattataggca

SEQ ID NO: 41909 - DNA, 22 bp, Homo sapiens
ctgagatctttatacgaggcac

SEQ ID NO: 41910 - DNA, 22 bp, Homo sapiens
tcctccactttgtctagcaaca

SEQ ID NO: 41911 - DNA, 22 bp, Homo sapiens
gatcgggtgggttctgccatca

SEQ ID NO: 41912 - DNA, 22 bp, Homo sapiens
ttgtgtgtactggttatgggca

SEQ ID NO: 41913 - DNA, 22 bp, Homo sapiens
gagagaagggggatatgagcct

SEQ ID NO: 41914 - DNA, 22 bp, Homo sapiens
aggtggagaagagatgggcagt

SEQ ID NO: 41915 - DNA, 22 bp, Homo sapiens
gggactggagtagaggccggtg

SEQ ID NO: 41916 - DNA, 21 bp, Homo sapiens
tctgatggtagatgagatgtg

SEQ ID NO: 41917 - DNA, 22 bp, Homo sapiens
tcgctgaggctgcacggctgcc

SEQ ID NO: 41918 - DNA, 22 bp, Homo sapiens
tttttgggtccaggctgtatct

SEQ ID NO: 41919 - DNA, 22 bp, Homo sapiens
ggctgtggcagctggaagtggt

SEQ ID NO: 41920 - DNA, 18 bp, Homo sapiens
cagggctgtggggtcact

SEQ ID NO: 41921 - DNA, 22 bp, Homo sapiens
aaagtgcttcctttttgagggt

SEQ ID NO: 41922 - DNA, 22 bp, Homo sapiens
ccagatgtccctctcaggtttg

SEQ ID NO: 41923 - DNA, 22 bp, Homo sapiens
ttgcagatgaagaaactgaagc

SEQ ID NO: 41924 - DNA, 20 bp, Homo sapiens
tgtttgtgtggggccttggc

SEQ ID NO: 41925 - DNA, 22 bp, Homo sapiens
tatactctgagaaacgtgtcac

SEQ ID NO: 41926 - DNA, 22 bp, Homo sapiens
tgtgcacaatgtgcaggtttgt

SEQ ID NO: 41927 - DNA, 22 bp, Homo sapiens
agtggccagcagcctagcctag

SEQ ID NO: 41928 - DNA, 22 bp, Homo sapiens
cccaggggttcaaggctgcagt

SEQ ID NO: 41929 - DNA, 22 bp, Homo sapiens
ggtcacgtgaccgcacctgcct

SEQ ID NO: 41930 - DNA, 22 bp, Homo sapiens
aagaatgagctcaaagatctta

SEQ ID NO: 41931 - DNA, 22 bp, Homo sapiens
actgtacctcaaactctggaac

SEQ ID NO: 41932 - DNA, 22 bp, Homo sapiens
gagcaggaaggccagaagggtc

SEQ ID NO: 41933 - DNA, 22 bp, Homo sapiens
tcccacaggtggagcttgcagt

SEQ ID NO: 41934 - DNA, 22 bp, Homo sapiens
agggaagaggaccagagtctct

SEQ ID NO: 41935 - DNA, 23 bp, Homo sapiens
cccagaccttgtgctgcccttgg

SEQ ID NO: 41936 - DNA, 22 bp, Homo sapiens
ttgtctaatgagctccacttca

SEQ ID NO: 41937 - DNA, 22 bp, Homo sapiens
gagggagggactagcattctct

SEQ ID NO: 41938 - DNA, 22 bp, Homo sapiens
cccaggcttttctcttgcccca

SEQ ID NO: 41939 - DNA, 22 bp, Homo sapiens
ccaggaggcagaagttgcagtg

SEQ ID NO: 41940 - DNA, 22 bp, Homo sapiens
caggacatctacccagtgtttc

SEQ ID NO: 41941 - DNA, 22 bp, Homo sapiens
agaggccggccgagcccatggg

SEQ ID NO: 41942 - DNA, 22 bp, Homo sapiens
gggaagatagtgttgagggccc

SEQ ID NO: 41943 - DNA, 22 bp, Homo sapiens
tctgcaggaagctggcggctga

SEQ ID NO: 41944 - DNA, 22 bp, Homo sapiens
gggaagagggagctggaatgat

SEQ ID NO: 41945 - DNA, 20 bp, Homo sapiens
acgtggccaccagtggctta

SEQ ID NO: 41946 - DNA, 22 bp, Homo sapiens
aaccccgctcaggctgggtgag

SEQ ID NO: 41947 - DNA, 22 bp, Homo sapiens
ctcactgcaagctccacctctt

SEQ ID NO: 41948 - DNA, 22 bp, Homo sapiens
aacccaggagacaggttgcagt

SEQ ID NO: 41949 - DNA, 22 bp, Homo sapiens
caggcactgtgctgagctctgc

SEQ ID NO: 41950 - DNA, 22 bp, Homo sapiens
ttgtaagtcacaccagggcagg

SEQ ID NO: 41951 - DNA, 22 bp, Homo sapiens
ttgacctatgtttcttcatctg

SEQ ID NO: 41952 - DNA, 22 bp, Homo sapiens
cctccagagggaagtactttct

SEQ ID NO: 41953 - DNA, 22 bp, Homo sapiens
aaagtgctgggattataggcat

SEQ ID NO: 41954 - DNA, 22 bp, Homo sapiens
cactgcactccagcttgggtga

SEQ ID NO: 41955 - DNA, 18 bp, Homo sapiens
gaccccgggatctgtcga

SEQ ID NO: 41956 - DNA, 22 bp, Homo sapiens
aggctcagatccttgtgtcctg

SEQ ID NO: 41957 - DNA, 22 bp, Homo sapiens
tagtgccctcccctttgggata

SEQ ID NO: 41958 - DNA, 22 bp, Homo sapiens
taagggttcagaatgcagtggt

SEQ ID NO: 41959 - DNA, 22 bp, Homo sapiens
gcctgcagggcctgggcctacc

SEQ ID NO: 41960 - DNA, 22 bp, Homo sapiens
ccaggaggcggaggttgcagcg

SEQ ID NO: 41961 - DNA, 22 bp, Homo sapiens
gaatgcagatggctggtgtatg

SEQ ID NO: 41962 - DNA, 22 bp, Homo sapiens
ccaggctggagtgcaatggcgt

SEQ ID NO: 41963 - DNA, 22 bp, Homo sapiens
atggtactggggtcccggagtt

SEQ ID NO: 41964 - DNA, 22 bp, Homo sapiens
ctgcatccatgttgctgcaaag

SEQ ID NO: 41965 - DNA, 22 bp, Homo sapiens
gaggcagaagttgcagtgagca

SEQ ID NO: 41966 - DNA, 22 bp, Homo sapiens
caaagtgctaggattacaggcg

SEQ ID NO: 41967 - DNA, 22 bp, Homo sapiens
gagccccaccctagacattctg

SEQ ID NO: 41968 - DNA, 23 bp, Homo sapiens
ggagcctccggtgtgtgagaggc

SEQ ID NO: 41969 - DNA, 22 bp, Homo sapiens
cttgtcagccaattgtggattt

SEQ ID NO: 41970 - DNA, 22 bp, Homo sapiens
actccacatttgaacacagttc

SEQ ID NO: 41971 - DNA, 22 bp, Homo sapiens
tgtacttgaacttgactgtaga

SEQ ID NO: 41972 - DNA, 22 bp, Homo sapiens
agcctggtttaagcattttata

SEQ ID NO: 41973 - DNA, 22 bp, Homo sapiens
aaccattcactgaacagttcaa

SEQ ID NO: 41974 - DNA, 22 bp, Homo sapiens
tcttaagcagagaagaagttga

SEQ ID NO: 41975 - DNA, 22 bp, Homo sapiens
ccatgtggtgggaaggagaatg

SEQ ID NO: 41976 - DNA, 22 bp, Homo sapiens
ttggttttgaaatagcttattg

SEQ ID NO: 41977 - DNA, 22 bp, Homo sapiens
ttagggttacaccagcctcctg

SEQ ID NO: 41978 - DNA, 22 bp, Homo sapiens
tagtttcatctccaccctgccc

SEQ ID NO: 41979 - DNA, 22 bp, Homo sapiens
aactctatttaccctactaaac

SEQ ID NO: 41980 - DNA, 22 bp, Homo sapiens
cctactctgagcgcctccgcat

SEQ ID NO: 41981 - DNA, 22 bp, Homo sapiens
gaatgctaagcatgtgggagtt

SEQ ID NO: 41982 - DNA, 22 bp, Homo sapiens
tccaggctttggggcaggagcg

SEQ ID NO: 41983 - DNA, 22 bp, Homo sapiens
gaagccagtgtttgaagaattt

SEQ ID NO: 41984 - DNA, 21 bp, Homo sapiens
cagggccaatcctgacctcta

SEQ ID NO: 41985 - DNA, 22 bp, Homo sapiens
caaagtgctgggattacaggtg

SEQ ID NO: 41986 - DNA, 22 bp, Homo sapiens
tgacagaggagctggaatgatt

SEQ ID NO: 41987 - DNA, 22 bp, Homo sapiens
cggagtcttgctatgttgccca

SEQ ID NO: 41988 - DNA, 22 bp, Homo sapiens
ccacactccccgcaggcgtagg

SEQ ID NO: 41989 - DNA, 22 bp, Homo sapiens
cgtgtggacatgactagctgcc

SEQ ID NO: 41990 - DNA, 18 bp, Homo sapiens
tgtagagccaggtttgcc

SEQ ID NO: 41991 - DNA, 22 bp, Homo sapiens
agctgccgatgcccagctgcat

SEQ ID NO: 41992 - DNA, 22 bp, Homo sapiens
agtgaggggcagctgagtgggc

SEQ ID NO: 41993 - DNA, 22 bp, Homo sapiens
tcctcggctgggccccaggctt

SEQ ID NO: 41994 - DNA, 18 bp, Homo sapiens
tcctttctccctcatctt

SEQ ID NO: 41995 - DNA, 22 bp, Homo sapiens
ggggccgaccgcggttcaggcc

SEQ ID NO: 41996 - DNA, 22 bp, Homo sapiens
tgtctggatagagcctaggccc

SEQ ID NO: 41997 - DNA, 22 bp, Homo sapiens
gggccatgagaggttcatcaac

SEQ ID NO: 41998 - DNA, 22 bp, Homo sapiens
gggcgccgtgggaaacagccgg

SEQ ID NO: 41999 - DNA, 22 bp, Homo sapiens
ccctgttgggaagagagatggc

SEQ ID NO: 42000 - DNA, 22 bp, Homo sapiens
aaggaaagctgtggttctgaga

SEQ ID NO: 42001 - DNA, 22 bp, Homo sapiens
accccaggaagtggaggtcatg

SEQ ID NO: 42002 - DNA, 22 bp, Homo sapiens
tctgagaatggtggatgtggtg

SEQ ID NO: 42003 - DNA, 22 bp, Homo sapiens
gtgaccatcatctcagctagtt

SEQ ID NO: 42004 - DNA, 22 bp, Homo sapiens
tgttgatttgtgggctgcaaaa

SEQ ID NO: 42005 - DNA, 22 bp, Homo sapiens
gcccagtggtaaaagcaggcct

SEQ ID NO: 42006 - DNA, 22 bp, Homo sapiens
gctggtagacctcactgcactc

SEQ ID NO: 42007 - DNA, 22 bp, Homo sapiens
cccgtgtgtgcgaggctcccgc

SEQ ID NO: 42008 - DNA, 22 bp, Homo sapiens
tttgaagggcacgacaatagtt

SEQ ID NO: 42009 - DNA, 20 bp, Homo sapiens
ggcagagggcctgggagaag

SEQ ID NO: 42010 - DNA, 22 bp, Homo sapiens
cccaggaggcagagcttgcagt

SEQ ID NO: 42011 - DNA, 22 bp, Homo sapiens
catggcattgcataacggggct

SEQ ID NO: 42012 - DNA, 22 bp, Homo sapiens
ggaaggggtgggtgagcctcag

SEQ ID NO: 42013 - DNA, 21 bp, Homo sapiens
ttgaccaagggtgcgtgctcc

SEQ ID NO: 42014 - DNA, 22 bp, Homo sapiens
tgtctttgttattgtggacagg

SEQ ID NO: 42015 - DNA, 22 bp, Homo sapiens
ttgatcaaatcagctactgagg

SEQ ID NO: 42016 - DNA, 22 bp, Homo sapiens
tctttgctccacactctagaga

SEQ ID NO: 42017 - DNA, 22 bp, Homo sapiens
tgaacgcaggtccacatggctc

SEQ ID NO: 42018 - DNA, 22 bp, Homo sapiens
taattataacagttacatctta

SEQ ID NO: 42019 - DNA, 22 bp, Homo sapiens
aacccaggagccggaggttgtg

SEQ ID NO: 42020 - DNA, 22 bp, Homo sapiens
agcaagatttttcaggttagta

SEQ ID NO: 42021 - DNA, 22 bp, Homo sapiens
ggagagtggattccagctgtat

SEQ ID NO: 42022 - DNA, 22 bp, Homo sapiens
ggggtcggggcatagccactta

SEQ ID NO: 42023 - DNA, 22 bp, Homo sapiens
cactgcactccagcctgggcaa

SEQ ID NO: 42024 - DNA, 22 bp, Homo sapiens
gtctcccaaactctgatggtcc

SEQ ID NO: 42025 - DNA, 22 bp, Homo sapiens
actttaaaactgatcatcagag

SEQ ID NO: 42026 - DNA, 21 bp, Homo sapiens
tcacgtggtcacatgagcttt

SEQ ID NO: 42027 - DNA, 22 bp, Homo sapiens
cactgcaccctcaaactcctgg

SEQ ID NO: 42028 - DNA, 22 bp, Homo sapiens
acttgccccagaattgctgctg

SEQ ID NO: 42029 - DNA, 22 bp, Homo sapiens
gcctcctgtcccaggctgagga

SEQ ID NO: 42030 - DNA, 22 bp, Homo sapiens
tgagacaggcttccttcttggg

SEQ ID NO: 42031 - DNA, 22 bp, Homo sapiens
tgcactccaggctgggtgacag

SEQ ID NO: 42032 - DNA, 22 bp, Homo sapiens
gggtggagagaaagaaacgtga

SEQ ID NO: 42033 - DNA, 22 bp, Homo sapiens
gcgggccaccttggagagcgct

SEQ ID NO: 42034 - DNA, 22 bp, Homo sapiens
aggcaaggtgctacagacagtg

SEQ ID NO: 42035 - DNA, 22 bp, Homo sapiens
ctccagattccgtttattcagg

SEQ ID NO: 42036 - DNA, 22 bp, Homo sapiens
aaagtgctgcgacatttgagcg

SEQ ID NO: 42037 - DNA, 22 bp, Homo sapiens
accaggcccgctgctatggtgg

SEQ ID NO: 42038 - DNA, 22 bp, Homo sapiens
acccgggaggcaggagtcatag

SEQ ID NO: 42039 - DNA, 22 bp, Homo sapiens
tccacttccacgtgtgcagaat

SEQ ID NO: 42040 - DNA, 21 bp, Homo sapiens
ccaccaggtcttctgctcggg

SEQ ID NO: 42041 - DNA, 22 bp, Homo sapiens
tttaaaaaactagtctgagtct

SEQ ID NO: 42042 - DNA, 18 bp, Homo sapiens
ctgccagtgtgctctccg

SEQ ID NO: 42043 - DNA, 19 bp, Homo sapiens
gcccacggccctgctctgc

SEQ ID NO: 42044 - DNA, 22 bp, Homo sapiens
cagtcactggaatagctgagga

SEQ ID NO: 42045 - DNA, 22 bp, Homo sapiens
tccagcttataggtagatttaa

SEQ ID NO: 42046 - DNA, 22 bp, Homo sapiens
cactgcacttcagcctgggtga

SEQ ID NO: 42047 - DNA, 22 bp, Homo sapiens
tttgcttgttcaagatttctgt

SEQ ID NO: 42048 - DNA, 16 bp, Homo sapiens
gcagaggaaaggggag

SEQ ID NO: 42049 - DNA, 22 bp, Homo sapiens
aacccaggagatggaggttgtg

SEQ ID NO: 42050 - DNA, 22 bp, Homo sapiens
agagggtgggcacgtgatggat

SEQ ID NO: 42051 - DNA, 22 bp, Homo sapiens
ttttggctctgtctgtatcttt

SEQ ID NO: 42052 - DNA, 22 bp, Homo sapiens
ttgagacacagtttcactctgt

SEQ ID NO: 42053 - DNA, 23 bp, Homo sapiens
gcagaggagcaagctggacacca

SEQ ID NO: 42054 - DNA, 22 bp, Homo sapiens
catgagatctgcagggatgggc

SEQ ID NO: 42055 - DNA, 22 bp, Homo sapiens
caggaaagggatgggctgccac

SEQ ID NO: 42056 - DNA, 22 bp, Homo sapiens
gagcccaggaagtggaggctga

SEQ ID NO: 42057 - DNA, 22 bp, Homo sapiens
tccctgcaggtgtgcaagctga

SEQ ID NO: 42058 - DNA, 22 bp, Homo sapiens
cccagttgttgccggctctgga

SEQ ID NO: 42059 - DNA, 19 bp, Homo sapiens
gcctcatttccacctcccc

SEQ ID NO: 42060 - DNA, 22 bp, Homo sapiens
gcaggaggttgagccaggactg

SEQ ID NO: 42061 - DNA, 22 bp, Homo sapiens
cctcagctcccatgagatctgc

SEQ ID NO: 42062 - DNA, 22 bp, Homo sapiens
tagatacctgctggacctcatt

SEQ ID NO: 42063 - DNA, 22 bp, Homo sapiens
ctctctgggcccagttggcacc

SEQ ID NO: 42064 - DNA, 22 bp, Homo sapiens
cccaggctggagtgcagtggcg

SEQ ID NO: 42065 - DNA, 22 bp, Homo sapiens
cctcgacctccccaggctcagg

SEQ ID NO: 42066 - DNA, 22 bp, Homo sapiens
cggagcgctgggggactctgca

SEQ ID NO: 42067 - DNA, 22 bp, Homo sapiens
aagacccacaaggctgaatgtt

SEQ ID NO: 42068 - DNA, 22 bp, Homo sapiens
ccttctcagccccagctcccgc

SEQ ID NO: 42069 - DNA, 22 bp, Homo sapiens
attttctatgttgtaattgtta

SEQ ID NO: 42070 - DNA, 22 bp, Homo sapiens
gcccgcagagatctttaacaaa

SEQ ID NO: 42071 - DNA, 22 bp, Homo sapiens
tgaggcaggagttcaggctgcg

SEQ ID NO: 42072 - DNA, 22 bp, Homo sapiens
ttggccatctaagcccagccac

SEQ ID NO: 42073 - DNA, 22 bp, Homo sapiens
caggctgtccaggctcctttgg

SEQ ID NO: 42074 - DNA, 22 bp, Homo sapiens
tctcagggctcagagctcaggc

SEQ ID NO: 42075 - DNA, 19 bp, Homo sapiens
agagtattgaatttgccct

SEQ ID NO: 42076 - DNA, 22 bp, Homo sapiens
gtgccactgcactctagcctag

SEQ ID NO: 42077 - DNA, 22 bp, Homo sapiens
cttgccttcagtccatcagtca

SEQ ID NO: 42078 - DNA, 22 bp, Homo sapiens
taaaatttgtccctgagtgttg

SEQ ID NO: 42079 - DNA, 22 bp, Homo sapiens
ccttttgctctcccatccagaa

SEQ ID NO: 42080 - DNA, 22 bp, Homo sapiens
gacccaggggcagggagaaagt

SEQ ID NO: 42081 - DNA, 22 bp, Homo sapiens
cctcttctaggacgtccttgtg

SEQ ID NO: 42082 - DNA, 22 bp, Homo sapiens
tgactggattgtcattacgacg

SEQ ID NO: 42083 - DNA, 22 bp, Homo sapiens
ttcttctcagggtcccacatgg

SEQ ID NO: 42084 - DNA, 19 bp, Homo sapiens
aggaatggaattaattctg

SEQ ID NO: 42085 - DNA, 22 bp, Homo sapiens
tcagggattgcaaaattcatcc

SEQ ID NO: 42086 - DNA, 22 bp, Homo sapiens
caaagttgcagttatgtgatta

SEQ ID NO: 42087 - DNA, 22 bp, Homo sapiens
ttgtgaatagtgccgctataaa

SEQ ID NO: 42088 - DNA, 22 bp, Homo sapiens
cagccccacacggtctagctct

SEQ ID NO: 42089 - DNA, 22 bp, Homo sapiens
gaaaggagagggttaaggagct

SEQ ID NO: 42090 - DNA, 21 bp, Homo sapiens
agcgtcaatatcgtcaacagg

SEQ ID NO: 42091 - DNA, 22 bp, Homo sapiens
ttccagctaactcacatccctt

SEQ ID NO: 42092 - DNA, 22 bp, Homo sapiens
atttaagggatttggagaccaa

SEQ ID NO: 42093 - DNA, 22 bp, Homo sapiens
tctgttgcaatgtgcatggtga

SEQ ID NO: 42094 - DNA, 22 bp, Homo sapiens
cggagcctgcttgttgcagctg

SEQ ID NO: 42095 - DNA, 22 bp, Homo sapiens
agtgagagtattaatgtgaact

SEQ ID NO: 42096 - DNA, 22 bp, Homo sapiens
aggagcagaccgtagtcctgca

SEQ ID NO: 42097 - DNA, 22 bp, Homo sapiens
acccaggagacggaggtgcagt

SEQ ID NO: 42098 - DNA, 22 bp, Homo sapiens
ttctgtgaatcttttttcccac

SEQ ID NO: 42099 - DNA, 22 bp, Homo sapiens
atgcaggcagacactgtgggca

SEQ ID NO: 42100 - DNA, 22 bp, Homo sapiens
tggaagggagctggaatttgga

SEQ ID NO: 42101 - DNA, 22 bp, Homo sapiens
tacttttagcctatttgattct

SEQ ID NO: 42102 - DNA, 22 bp, Homo sapiens
aggagggagcttaagccaggca

SEQ ID NO: 42103 - DNA, 22 bp, Homo sapiens
ggaggcggaggttgcagtgagc

SEQ ID NO: 42104 - DNA, 22 bp, Homo sapiens
ctacttgttcactgtaggtcgc

SEQ ID NO: 42105 - DNA, 22 bp, Homo sapiens
attggccatttgcatgtattat

SEQ ID NO: 42106 - DNA, 22 bp, Homo sapiens
ctggcaggagcattcacagagg

SEQ ID NO: 42107 - DNA, 22 bp, Homo sapiens
ctacaaaagtaattgtggtttt

SEQ ID NO: 42108 - DNA, 22 bp, Homo sapiens
agaaggggcccaaggatgtcag

SEQ ID NO: 42109 - DNA, 22 bp, Homo sapiens
aagaaatgctgatgttggatgg

SEQ ID NO: 42110 - DNA, 22 bp, Homo sapiens
tgctagtgtgtgagatgttcaa

SEQ ID NO: 42111 - DNA, 22 bp, Homo sapiens
tgccgtggggctgaggctggag

SEQ ID NO: 42112 - DNA, 22 bp, Homo sapiens
atctggttttggctgtgtccct

SEQ ID NO: 42113 - DNA, 22 bp, Homo sapiens
gaggagggagctggaagctctt

SEQ ID NO: 42114 - DNA, 22 bp, Homo sapiens
tgagtgtggggaatgtcatgag

SEQ ID NO: 42115 - DNA, 22 bp, Homo sapiens
agaaagtgcttccctttggtga

SEQ ID NO: 42116 - DNA, 18 bp, Homo sapiens
ggtgagggagctggaagc

SEQ ID NO: 42117 - DNA, 22 bp, Homo sapiens
ccacagtcctggcttctgtctg

SEQ ID NO: 42118 - DNA, 22 bp, Homo sapiens
ctggagggctgcagcgaggctg

SEQ ID NO: 42119 - DNA, 22 bp, Homo sapiens
gaggctgaggttgcagtgagct

SEQ ID NO: 42120 - DNA, 22 bp, Homo sapiens
gtgcgcaccctcccggcatccc

SEQ ID NO: 42121 - DNA, 22 bp, Homo sapiens
cacccaggcaaggattctgcaa

SEQ ID NO: 42122 - DNA, 22 bp, Homo sapiens
ggcgctcagtgttgccccagag

SEQ ID NO: 42123 - DNA, 22 bp, Homo sapiens
caggctgctgcctagaatgaca

SEQ ID NO: 42124 - DNA, 22 bp, Homo sapiens
cgggcagcggcgtggccatggt

SEQ ID NO: 42125 - DNA, 22 bp, Homo sapiens
tggagaattctatgttgagggg

SEQ ID NO: 42126 - DNA, 21 bp, Homo sapiens
tgaaggtgttcatgatgcggt

SEQ ID NO: 42127 - DNA, 22 bp, Homo sapiens
atgccactgcactccagcctgg

SEQ ID NO: 42128 - DNA, 22 bp, Homo sapiens
agccaccaccactgaaaggtta

SEQ ID NO: 42129 - DNA, 22 bp, Homo sapiens
caaagggaaaagccatgtgggc

SEQ ID NO: 42130 - DNA, 22 bp, Homo sapiens
ttcctagggcagagccgctggg

SEQ ID NO: 42131 - DNA, 22 bp, Homo sapiens
tgacttgtctctttgggagaca

SEQ ID NO: 42132 - DNA, 22 bp, Homo sapiens
ggaggacaggggctgcagcaca

SEQ ID NO: 42133 - DNA, 22 bp, Homo sapiens
tgagggaatattgatagatccg

SEQ ID NO: 42134 - DNA, 22 bp, Homo sapiens
ttgtgaatagtgccgcaataaa

SEQ ID NO: 42135 - DNA, 22 bp, Homo sapiens
ggccaggcgatgacccctccac

SEQ ID NO: 42136 - DNA, 22 bp, Homo sapiens
gccagtggtcactgaggaagaa

SEQ ID NO: 42137 - DNA, 22 bp, Homo sapiens
actgtgaacggactgaagccca

SEQ ID NO: 42138 - DNA, 22 bp, Homo sapiens
acccaggctggcgtgcagtggc

SEQ ID NO: 42139 - DNA, 17 bp, Homo sapiens
ggctgcagtccaggagg

SEQ ID NO: 42140 - DNA, 22 bp, Homo sapiens
gaaggaagtcattagtgcagac

SEQ ID NO: 42141 - DNA, 22 bp, Homo sapiens
agcccaggagtttgaggctgtg

SEQ ID NO: 42142 - DNA, 22 bp, Homo sapiens
caggctggagtgcagtggggcg

SEQ ID NO: 42143 - DNA, 22 bp, Homo sapiens
ccagcagccaccttctcgaaat

SEQ ID NO: 42144 - DNA, 22 bp, Homo sapiens
ctcattgcagctgcattactgt

SEQ ID NO: 42145 - DNA, 22 bp, Homo sapiens
atgccactgcactccagcctag

SEQ ID NO: 42146 - DNA, 22 bp, Homo sapiens
gctgctctcagagctcatgctg

SEQ ID NO: 42147 - DNA, 22 bp, Homo sapiens
ggagaagaggagctggaagcct

SEQ ID NO: 42148 - DNA, 22 bp, Homo sapiens
tgtgactggttgtcccgctttc

SEQ ID NO: 42149 - DNA, 22 bp, Homo sapiens
ttctggaaggatgtttctatct

SEQ ID NO: 42150 - DNA, 22 bp, Homo sapiens
ggagtgactcacagctgggaca

SEQ ID NO: 42151 - DNA, 19 bp, Homo sapiens
ctgctgccggagactcgtc

SEQ ID NO: 42152 - DNA, 22 bp, Homo sapiens
ccaggctgctgttggtgtccgc

SEQ ID NO: 42153 - DNA, 22 bp, Homo sapiens
tgagtggacacctgcttcttta

SEQ ID NO: 42154 - DNA, 22 bp, Homo sapiens
agatcacagtggcaactccctt

SEQ ID NO: 42155 - DNA, 22 bp, Homo sapiens
aagcagaatagaggcccttccc

SEQ ID NO: 42156 - DNA, 22 bp, Homo sapiens
cagccctcctaccctgccaggc

SEQ ID NO: 42157 - DNA, 19 bp, Homo sapiens
gttggcactgaaaatggct

SEQ ID NO: 42158 - DNA, 22 bp, Homo sapiens
gggctgcatcagcaggacccgg

SEQ ID NO: 42159 - DNA, 22 bp, Homo sapiens
aggaaataggaccagacaaagc

SEQ ID NO: 42160 - DNA, 22 bp, Homo sapiens
aggctgaggcaagaggatcact

SEQ ID NO: 42161 - DNA, 17 bp, Homo sapiens
tgtatttatcatgtcag

SEQ ID NO: 42162 - DNA, 22 bp, Homo sapiens
ggagaggggaacttgttgcttg

SEQ ID NO: 42163 - DNA, 22 bp, Homo sapiens
ggaggcggaggctgcagtgagc

SEQ ID NO: 42164 - DNA, 22 bp, Homo sapiens
ctctggagtgtctggccagggt

SEQ ID NO: 42165 - DNA, 23 bp, Homo sapiens
catctagcatccagtgagtagtg

SEQ ID NO: 42166 - DNA, 22 bp, Homo sapiens
ggcctgggctccgggagttact

SEQ ID NO: 42167 - DNA, 22 bp, Homo sapiens
cagtgcagccaaggacaggcac

SEQ ID NO: 42168 - DNA, 22 bp, Homo sapiens
tgaggaaacttacaaggcagaa

SEQ ID NO: 42169 - DNA, 22 bp, Homo sapiens
tgagagttctctcttcaggtgg

SEQ ID NO: 42170 - DNA, 22 bp, Homo sapiens
tagatgaccttgtgttaggcaa

SEQ ID NO: 42171 - DNA, 22 bp, Homo sapiens
agagcagctcgctacctctcta

SEQ ID NO: 42172 - DNA, 22 bp, Homo sapiens
gcgccccatctacagtactttt

SEQ ID NO: 42173 - DNA, 22 bp, Homo sapiens
tgaagaaacgcagagaggtagg

SEQ ID NO: 42174 - DNA, 22 bp, Homo sapiens
aaggagaaatggtagatgtgca

SEQ ID NO: 42175 - DNA, 18 bp, Homo sapiens
tctggaacaacttcatgt

SEQ ID NO: 42176 - DNA, 22 bp, Homo sapiens
ttcagacatgcaggctgaggct

SEQ ID NO: 42177 - DNA, 22 bp, Homo sapiens
tcctcagcttttatttcacttg

SEQ ID NO: 42178 - DNA, 22 bp, Homo sapiens
caaagtgctaggattataggtg

SEQ ID NO: 42179 - DNA, 22 bp, Homo sapiens
tctggtgtcagtattctttgaa

SEQ ID NO: 42180 - DNA, 21 bp, Homo sapiens
acacaggcagtgtcccgaggt

SEQ ID NO: 42181 - DNA, 22 bp, Homo sapiens
atgccaggaacaaacagtggtg

SEQ ID NO: 42182 - DNA, 22 bp, Homo sapiens
taagtcccccacttgccacagg

SEQ ID NO: 42183 - DNA, 22 bp, Homo sapiens
accctcaacaaattcactctat

SEQ ID NO: 42184 - DNA, 22 bp, Homo sapiens
cctcgtccacaatccttgcaca

SEQ ID NO: 42185 - DNA, 22 bp, Homo sapiens
ggacagaaaccatatgagtgta

SEQ ID NO: 42186 - DNA, 22 bp, Homo sapiens
tgttcagaacaaaggtaaatga

SEQ ID NO: 42187 - DNA, 22 bp, Homo sapiens
tcctgggacaagccgtggaagt

SEQ ID NO: 42188 - DNA, 22 bp, Homo sapiens
ggagtgaagtggcgcgatctcg

SEQ ID NO: 42189 - DNA, 22 bp, Homo sapiens
gctggagaggatcccaaagcca

SEQ ID NO: 42190 - DNA, 22 bp, Homo sapiens
gctggcagacttcctctggaac

SEQ ID NO: 42191 - DNA, 22 bp, Homo sapiens
aaggggtgagcagaggcttcgc

SEQ ID NO: 42192 - DNA, 22 bp, Homo sapiens
tgcttctgactaagctgcatga

SEQ ID NO: 42193 - DNA, 22 bp, Homo sapiens
tttcccaggctggaatgcagtg

SEQ ID NO: 42194 - DNA, 22 bp, Homo sapiens
cctggaagttggaggttgcagt

SEQ ID NO: 42195 - DNA, 22 bp, Homo sapiens
gcagctattgtctcctgggccc

SEQ ID NO: 42196 - DNA, 22 bp, Homo sapiens
tgcagtcttccagctgcacaaa

SEQ ID NO: 42197 - DNA, 22 bp, Homo sapiens
gcaagacctatctagttgctgt

SEQ ID NO: 42198 - DNA, 22 bp, Homo sapiens
agacgcggtggtgcatgcctgt

SEQ ID NO: 42199 - DNA, 22 bp, Homo sapiens
ggccttggttccaaagcaggca

SEQ ID NO: 42200 - DNA, 22 bp, Homo sapiens
cattccttaacgtggggagtct

SEQ ID NO: 42201 - DNA, 22 bp, Homo sapiens
cagaggaacgtttggattgatt

SEQ ID NO: 42202 - DNA, 22 bp, Homo sapiens
cagctgctgttcagttttgttt

SEQ ID NO: 42203 - DNA, 22 bp, Homo sapiens
aaacttgagccaagggcttggg

SEQ ID NO: 42204 - DNA, 22 bp, Homo sapiens
tcctgagataaatctcatgtga

SEQ ID NO: 42205 - DNA, 22 bp, Homo sapiens
gatctggaatctgaaggctgag

SEQ ID NO: 42206 - DNA, 22 bp, Homo sapiens
tggtacacatgtccaaggtcag

SEQ ID NO: 42207 - DNA, 22 bp, Homo sapiens
acccaggccattggcaagagtc

SEQ ID NO: 42208 - DNA, 22 bp, Homo sapiens
tgggaaggggagctggaaagga

SEQ ID NO: 42209 - DNA, 22 bp, Homo sapiens
tgtgacctcatcttaactggaa

SEQ ID NO: 42210 - DNA, 22 bp, Homo sapiens
actcagtacatctggagttggc

SEQ ID NO: 42211 - DNA, 19 bp, Homo sapiens
gactccaactttaagcatg

SEQ ID NO: 42212 - DNA, 22 bp, Homo sapiens
gccaggctgaggctctggaaga

SEQ ID NO: 42213 - DNA, 22 bp, Homo sapiens
caggctggagtgcaatgacgcc

SEQ ID NO: 42214 - DNA, 22 bp, Homo sapiens
tctttctacatcatttgcttct

SEQ ID NO: 42215 - DNA, 22 bp, Homo sapiens
gcctgtgtggatgcgccggtgc

SEQ ID NO: 42216 - DNA, 22 bp, Homo sapiens
ccaggaggcggaaggtacagtg

SEQ ID NO: 42217 - DNA, 22 bp, Homo sapiens
ggaactcctgctccaagcagct

SEQ ID NO: 42218 - DNA, 22 bp, Homo sapiens
cctggcaggtggcgccctcggc

SEQ ID NO: 42219 - DNA, 22 bp, Homo sapiens
cgccgtaaatgcaagcctgtag

SEQ ID NO: 42220 - DNA, 22 bp, Homo sapiens
tgcccaggctggagtacagtgg

SEQ ID NO: 42221 - DNA, 22 bp, Homo sapiens
aaagtgcttctctttggtgggt

SEQ ID NO: 42222 - DNA, 22 bp, Homo sapiens
ggctcctgggggtgctcctgcc

SEQ ID NO: 42223 - DNA, 22 bp, Homo sapiens
gtggggcctgtggcttccgtgg

SEQ ID NO: 42224 - DNA, 22 bp, Homo sapiens
ctagttctagatccctgaggaa

SEQ ID NO: 42225 - DNA, 22 bp, Homo sapiens
ctgggcagctgtatcagggagt

SEQ ID NO: 42226 - DNA, 22 bp, Homo sapiens
aacccaggagttggaggctgtg

SEQ ID NO: 42227 - DNA, 22 bp, Homo sapiens
tgctcgccccacatgccctcat

SEQ ID NO: 42228 - DNA, 22 bp, Homo sapiens
agtgaccgaggcacttggcaac

SEQ ID NO: 42229 - DNA, 22 bp, Homo sapiens
cacgcctgtaatcccagcactt

SEQ ID NO: 42230 - DNA, 22 bp, Homo sapiens
gtggagggtgattgccggctgt

SEQ ID NO: 42231 - DNA, 22 bp, Homo sapiens
agcctgggccctgcctcttctc

SEQ ID NO: 42232 - DNA, 22 bp, Homo sapiens
tgcgcctctaatctcgggcgtc

SEQ ID NO: 42233 - DNA, 22 bp, Homo sapiens
tatcacagtaaatctgggtgca

SEQ ID NO: 42234 - DNA, 22 bp, Homo sapiens
gctgatggaaggacaggcgccg

SEQ ID NO: 42235 - DNA, 22 bp, Homo sapiens
gtccaagagtcaagaagggggc

SEQ ID NO: 42236 - DNA, 22 bp, Homo sapiens
gaaagtgctctctctatacaca

SEQ ID NO: 42237 - DNA, 18 bp, Homo sapiens
tgtccctgcaaataacat

SEQ ID NO: 42238 - DNA, 22 bp, Homo sapiens
gaggccactgtccctgccttcc

SEQ ID NO: 42239 - DNA, 22 bp, Homo sapiens
caggctggagtacaattgtgtg

SEQ ID NO: 42240 - DNA, 22 bp, Homo sapiens
tgagaaattacttcagtgatgg

SEQ ID NO: 42241 - DNA, 22 bp, Homo sapiens
gggttcagtccctcttgctact

SEQ ID NO: 42242 - DNA, 22 bp, Homo sapiens
gctgcagggagctggaaggctc

SEQ ID NO: 42243 - DNA, 22 bp, Homo sapiens
gatggaggagatggcagggtgc

SEQ ID NO: 42244 - DNA, 22 bp, Homo sapiens
ggaagggcaaaagagatgaact

SEQ ID NO: 42245 - DNA, 22 bp, Homo sapiens
ccgggagcaggcgccaccgcca

SEQ ID NO: 42246 - DNA, 22 bp, Homo sapiens
aacccaggaggcggaggttgtg

SEQ ID NO: 42247 - DNA, 22 bp, Homo sapiens
cacccaggctggaatgcagtgg

SEQ ID NO: 42248 - DNA, 22 bp, Homo sapiens
cacccaggctggagtgcagtga

SEQ ID NO: 42249 - DNA, 19 bp, Homo sapiens
ttcacattggaagaagtag

SEQ ID NO: 42250 - DNA, 22 bp, Homo sapiens
tctagttctagatccctgagga

SEQ ID NO: 42251 - DNA, 22 bp, Homo sapiens
gcccttacagggtggtcagcca

SEQ ID NO: 42252 - DNA, 22 bp, Homo sapiens
tttgagaagcatggctgtattc

SEQ ID NO: 42253 - DNA, 20 bp, Homo sapiens
gttaggaggttggacatgga

SEQ ID NO: 42254 - DNA, 22 bp, Homo sapiens
ctgcagggagaggggacagcct

SEQ ID NO: 42255 - DNA, 22 bp, Homo sapiens
cttgtagaattgaaatggtctc

SEQ ID NO: 42256 - DNA, 22 bp, Homo sapiens
ttgcaaatcagaagtatagatt

SEQ ID NO: 42257 - DNA, 22 bp, Homo sapiens
ctcaggagttggaggctacagt

SEQ ID NO: 42258 - DNA, 22 bp, Homo sapiens
tcaccaggctagagtgcagtgg

SEQ ID NO: 42259 - DNA, 22 bp, Homo sapiens
tacgttttaaacacggagccag

SEQ ID NO: 42260 - DNA, 22 bp, Homo sapiens
ccaggctggagtgcaatggcat

SEQ ID NO: 42261 - DNA, 23 bp, Homo sapiens
tgctggagaagcaaagttctgag

SEQ ID NO: 42262 - DNA, 22 bp, Homo sapiens
ctcctctttagccccagctgga

SEQ ID NO: 42263 - DNA, 22 bp, Homo sapiens
gggggaagaaagaacatggcat

SEQ ID NO: 42264 - DNA, 22 bp, Homo sapiens
ggcatggacgtctctgaggcca

SEQ ID NO: 42265 - DNA, 22 bp, Homo sapiens
gggcagagactcagaaacagaa

SEQ ID NO: 42266 - DNA, 22 bp, Homo sapiens
tgcaggctgtgtcatttagtga

SEQ ID NO: 42267 - DNA, 22 bp, Homo sapiens
cactgcactccagcctgggtca

SEQ ID NO: 42268 - DNA, 22 bp, Homo sapiens
gggcagagagctggaactcctt

SEQ ID NO: 42269 - DNA, 22 bp, Homo sapiens
tggctgagttacgaacagagca

SEQ ID NO: 42270 - DNA, 22 bp, Homo sapiens
attctcataggagcgtgaacct

SEQ ID NO: 42271 - DNA, 22 bp, Homo sapiens
tttctttatcatagcatctttg

SEQ ID NO: 42272 - DNA, 22 bp, Homo sapiens
gtatcggtttatttttgggata

SEQ ID NO: 42273 - DNA, 20 bp, Homo sapiens
caaatccctgctctgtgctg

SEQ ID NO: 42274 - DNA, 22 bp, Homo sapiens
ccaggaggttgaggctgcagtg

SEQ ID NO: 42275 - DNA, 22 bp, Homo sapiens
gctgggctgcgtcggggaagcc

SEQ ID NO: 42276 - DNA, 22 bp, Homo sapiens
ccttgctcaagctagtgacggg

SEQ ID NO: 42277 - DNA, 22 bp, Homo sapiens
ctttaattgtagctcccataat

SEQ ID NO: 42278 - DNA, 22 bp, Homo sapiens
cccaggaggtggagcttgcagt

SEQ ID NO: 42279 - DNA, 22 bp, Homo sapiens
ggggtggatttcaggcggtgtc

SEQ ID NO: 42280 - DNA, 22 bp, Homo sapiens
ggagacagggttgaaccacgca

SEQ ID NO: 42281 - DNA, 22 bp, Homo sapiens
tggtctgctgaacagccgtatc

SEQ ID NO: 42282 - DNA, 22 bp, Homo sapiens
cctgcacagccggacccctgct

SEQ ID NO: 42283 - DNA, 22 bp, Homo sapiens
ctgtaatcccagctacctggga

SEQ ID NO: 42284 - DNA, 22 bp, Homo sapiens
gttttgaatactactagaactt

SEQ ID NO: 42285 - DNA, 22 bp, Homo sapiens
aatgttacgatcaacaacacat

SEQ ID NO: 42286 - DNA, 22 bp, Homo sapiens
acctagaatttaaaacattgct

SEQ ID NO: 42287 - DNA, 22 bp, Homo sapiens
gttgaagtaaggcagccacagg

SEQ ID NO: 42288 - DNA, 22 bp, Homo sapiens
agggtggcactggtggctctat

SEQ ID NO: 42289 - DNA, 22 bp, Homo sapiens
ttccgagtctccaaggggttgt

SEQ ID NO: 42290 - DNA, 22 bp, Homo sapiens
ggggtgggcgtgcagggacacc

SEQ ID NO: 42291 - DNA, 22 bp, Homo sapiens
cagagctggtgtgtcctggcat

SEQ ID NO: 42292 - DNA, 22 bp, Homo sapiens
agtattctggaattctatgtga

SEQ ID NO: 42293 - DNA, 22 bp, Homo sapiens
gaccctctagatggaagcactg

SEQ ID NO: 42294 - DNA, 22 bp, Homo sapiens
cccagccaaaagcaagtttacc

SEQ ID NO: 42295 - DNA, 18 bp, Homo sapiens
gaggatggaaggagatgc

SEQ ID NO: 42296 - DNA, 22 bp, Homo sapiens
aagctgcagcacagagaggtgg

SEQ ID NO: 42297 - DNA, 22 bp, Homo sapiens
acccaggctggagtgcagtggg

SEQ ID NO: 42298 - DNA, 22 bp, Homo sapiens
atatatttgagaatattcatga

SEQ ID NO: 42299 - DNA, 22 bp, Homo sapiens
gcagtggcatgatgtgggctca

SEQ ID NO: 42300 - DNA, 22 bp, Homo sapiens
cccaggaggcagatgttgcagt

SEQ ID NO: 42301 - DNA, 22 bp, Homo sapiens
ctggcaggtggaggttgcagtg

SEQ ID NO: 42302 - DNA, 22 bp, Homo sapiens
ttcctttctctggactgcagcc

SEQ ID NO: 42303 - DNA, 20 bp, Homo sapiens
ataaaataactgccacaaga

SEQ ID NO: 42304 - DNA, 22 bp, Homo sapiens
ggaactgaggaacgaactggga

SEQ ID NO: 42305 - DNA, 22 bp, Homo sapiens
gacccacctcaccaagcatgtg

SEQ ID NO: 42306 - DNA, 22 bp, Homo sapiens
tcccacacagcccgctcaccgg

SEQ ID NO: 42307 - DNA, 22 bp, Homo sapiens
aggtagaaggaccagaatttat

SEQ ID NO: 42308 - DNA, 22 bp, Homo sapiens
tgaatgtgatgctaaacatatg

SEQ ID NO: 42309 - DNA, 22 bp, Homo sapiens
gggctgtaggagctggaatggg

SEQ ID NO: 42310 - DNA, 22 bp, Homo sapiens
ggactgggaatcagggagatgc

SEQ ID NO: 42311 - DNA, 22 bp, Homo sapiens
gggtacagttcttccagtgtca

SEQ ID NO: 42312 - DNA, 22 bp, Homo sapiens
gcaggcagaggtggaggagaca

SEQ ID NO: 42313 - DNA, 22 bp, Homo sapiens
caggctggagtgcagtggcgct

SEQ ID NO: 42314 - DNA, 22 bp, Homo sapiens
gcaggctgtctaaagttagagt

SEQ ID NO: 42315 - DNA, 22 bp, Homo sapiens
agaggggcccggttctccgtct

SEQ ID NO: 42316 - DNA, 22 bp, Homo sapiens
gttatacgcctgtcaggaagct

SEQ ID NO: 42317 - DNA, 22 bp, Homo sapiens
tgttgagtatatacctacaagt

SEQ ID NO: 42318 - DNA, 22 bp, Homo sapiens
aaggagtctgggccattcagag

SEQ ID NO: 42319 - DNA, 22 bp, Homo sapiens
cctccccacagcccaggagact

SEQ ID NO: 42320 - DNA, 22 bp, Homo sapiens
ggcctctcttgggacagctgtc

SEQ ID NO: 42321 - DNA, 22 bp, Homo sapiens
gagtggggggtccgtctcagtg

SEQ ID NO: 42322 - DNA, 22 bp, Homo sapiens
gtgtgggctgcagaggcacagc

SEQ ID NO: 42323 - DNA, 22 bp, Homo sapiens
gtgccgcgacgcagtcggtgcc

SEQ ID NO: 42324 - DNA, 22 bp, Homo sapiens
attgataaattgcaatggggct

SEQ ID NO: 42325 - DNA, 22 bp, Homo sapiens
tagggtagtaccatgctgccag

SEQ ID NO: 42326 - DNA, 22 bp, Homo sapiens
ggaggtggaggttgcagtgagc

SEQ ID NO: 42327 - DNA, 22 bp, Homo sapiens
ggaggcggaggttgcagtgagt

SEQ ID NO: 42328 - DNA, 23 bp, Homo sapiens
cagagctggctcagagctgcctg

SEQ ID NO: 42329 - DNA, 22 bp, Homo sapiens
ttattttaccttcctctgagct

SEQ ID NO: 42330 - DNA, 22 bp, Homo sapiens
cccagcaggaggaggttgcagt

SEQ ID NO: 42331 - DNA, 22 bp, Homo sapiens
caaagtgctaggattacaggcc

SEQ ID NO: 42332 - DNA, 22 bp, Homo sapiens
aagcccttggcgcacaccgggc

SEQ ID NO: 42333 - DNA, 22 bp, Homo sapiens
tcaatcacgtgttccatgttct

SEQ ID NO: 42334 - DNA, 22 bp, Homo sapiens
tatgttgcaccaacctaataat

SEQ ID NO: 42335 - DNA, 22 bp, Homo sapiens
agaggctgcacttgctcatgat

SEQ ID NO: 42336 - DNA, 22 bp, Homo sapiens
tttatgtagttacggactatca

SEQ ID NO: 42337 - DNA, 22 bp, Homo sapiens
cggggcgagcagacggcggcaa

SEQ ID NO: 42338 - DNA, 22 bp, Homo sapiens
ggaggagcatgagagggtagtg

SEQ ID NO: 42339 - DNA, 19 bp, Homo sapiens
atcccaaggagctgggact

SEQ ID NO: 42340 - DNA, 22 bp, Homo sapiens
agatttatgtggtcacactcag

SEQ ID NO: 42341 - DNA, 22 bp, Homo sapiens
agccacacttgccaggggaagg

SEQ ID NO: 42342 - DNA, 22 bp, Homo sapiens
tgcctgtgtcagcaggtggaag

SEQ ID NO: 42343 - DNA, 22 bp, Homo sapiens
tcctccccaaagcccagcctgg

SEQ ID NO: 42344 - DNA, 22 bp, Homo sapiens
ctgggtggcagagcctgcagtg

SEQ ID NO: 42345 - DNA, 22 bp, Homo sapiens
cgcggtggcggcctccagcgcc

SEQ ID NO: 42346 - DNA, 22 bp, Homo sapiens
tggggcagttaataaacattct

SEQ ID NO: 42347 - DNA, 16 bp, Homo sapiens
aggctcagaggctgga

SEQ ID NO: 42348 - DNA, 22 bp, Homo sapiens
tctttgttattgtgaatagggt

SEQ ID NO: 42349 - DNA, 22 bp, Homo sapiens
gtgcgcaccctcccggcatccc

SEQ ID NO: 42350 - DNA, 22 bp, Homo sapiens
aggggcacgagtagagctctag

SEQ ID NO: 42351 - DNA, 22 bp, Homo sapiens
ggctgggcctctccctcagctg

SEQ ID NO: 42352 - DNA, 22 bp, Homo sapiens
gtctccggccgccctggtgctg

SEQ ID NO: 42353 - DNA, 19 bp, Homo sapiens
tccaaagaagttcacattt

SEQ ID NO: 42354 - DNA, 22 bp, Homo sapiens
ccgccgtgtcgacaggccctgg

SEQ ID NO: 42355 - DNA, 22 bp, Homo sapiens
cactgcactccatcctgggaaa

SEQ ID NO: 42356 - DNA, 22 bp, Homo sapiens
tgcctcagctgaggccgctcca

SEQ ID NO: 42357 - DNA, 22 bp, Homo sapiens
cctcagacccctgctgagcttc

SEQ ID NO: 42358 - DNA, 22 bp, Homo sapiens
cttcctctgtggccagagtgta

SEQ ID NO: 42359 - DNA, 23 bp, Homo sapiens
gtcacagtgggtggtgcctacat

SEQ ID NO: 42360 - DNA, 22 bp, Homo sapiens
cgtgtgttgaaagatgtacatc

SEQ ID NO: 42361 - DNA, 22 bp, Homo sapiens
cttgatctacatagtgaaaccc

SEQ ID NO: 42362 - DNA, 22 bp, Homo sapiens
tcaatactaatcttgctggaag

SEQ ID NO: 42363 - DNA, 22 bp, Homo sapiens
gaggtgggcggatcacaaggtc

SEQ ID NO: 42364 - DNA, 22 bp, Homo sapiens
agtgctgggctatctactgcta

SEQ ID NO: 42365 - DNA, 22 bp, Homo sapiens
tcagaacatgtttgagtaagac

SEQ ID NO: 42366 - DNA, 22 bp, Homo sapiens
ggcctgcctcacagtcagcacc

SEQ ID NO: 42367 - DNA, 22 bp, Homo sapiens
cttcctcctccatctcgaaggc

SEQ ID NO: 42368 - DNA, 22 bp, Homo sapiens
acccgatgttggtgctctagta

SEQ ID NO: 42369 - DNA, 22 bp, Homo sapiens
ttgtgtgtactggttatgggca

SEQ ID NO: 42370 - DNA, 22 bp, Homo sapiens
gccctagcgccagctcagcacc

SEQ ID NO: 42371 - DNA, 22 bp, Homo sapiens
gaggggagcccccatcctccag

SEQ ID NO: 42372 - DNA, 20 bp, Homo sapiens
atcggcttgcctggaaacaa

SEQ ID NO: 42373 - DNA, 22 bp, Homo sapiens
gaaggagccgagctcttcccca

SEQ ID NO: 42374 - DNA, 22 bp, Homo sapiens
gggacatctttctagtcagggt

SEQ ID NO: 42375 - DNA, 22 bp, Homo sapiens
aggccagcagcatgacggcatc

SEQ ID NO: 42376 - DNA, 22 bp, Homo sapiens
gagcacagtaaagcagtgtcac

SEQ ID NO: 42377 - DNA, 22 bp, Homo sapiens
agggcagagctgtctaaatggc

SEQ ID NO: 42378 - DNA, 20 bp, Homo sapiens
ggcagagggcctgggagaag

SEQ ID NO: 42379 - DNA, 22 bp, Homo sapiens
atgattgaaaatgacattgcca

SEQ ID NO: 42380 - DNA, 22 bp, Homo sapiens
agccagtgcagctggaaattca

SEQ ID NO: 42381 - DNA, 18 bp, Homo sapiens
ccatcaccctaactagtg

SEQ ID NO: 42382 - DNA, 22 bp, Homo sapiens
gctccggcttggtgtgcagggt

SEQ ID NO: 42383 - DNA, 16 bp, Homo sapiens
ggcaggcgcggagccc

SEQ ID NO: 42384 - DNA, 22 bp, Homo sapiens
aatttctgctgagcactgggcc

SEQ ID NO: 42385 - DNA, 22 bp, Homo sapiens
caggctggagtgcagtggggcg

SEQ ID NO: 42386 - DNA, 22 bp, Homo sapiens
atatatttgagaatattcatga

SEQ ID NO: 42387 - DNA, 22 bp, Homo sapiens
tgggggagctcagtccagccca

SEQ ID NO: 42388 - DNA, 22 bp, Homo sapiens
tgactctgataagacatatggc

SEQ ID NO: 42389 - DNA, 22 bp, Homo sapiens
tgggctgcaggggttgagagct

SEQ ID NO: 42390 - DNA, 22 bp, Homo sapiens
ttcacagtggtagtgcatttag

SEQ ID NO: 42391 - DNA, 22 bp, Homo sapiens
taatactgtatactgcaaattt

SEQ ID NO: 42392 - DNA, 22 bp, Homo sapiens
tcttttgtgattctttagttac

SEQ ID NO: 42393 - DNA, 22 bp, Homo sapiens
gaggtggctgcttgctgggaaa

SEQ ID NO: 42394 - DNA, 22 bp, Homo sapiens
gaaagcatccgcctggaggtgg

SEQ ID NO: 42395 - DNA, 22 bp, Homo sapiens
cactgcactccagcctgggaga

SEQ ID NO: 42396 - DNA, 22 bp, Homo sapiens
tcgtgaggctctgcatcgcaca

SEQ ID NO: 42397 - DNA, 22 bp, Homo sapiens
ctccggccgcggtgcccagcgc

SEQ ID NO: 42398 - DNA, 22 bp, Homo sapiens
agaggaggctctgggatcgtcc

SEQ ID NO: 42399 - DNA, 22 bp, Homo sapiens
acactgtgtgacttctgagact

SEQ ID NO: 42400 - DNA, 22 bp, Homo sapiens
gccccgtcgtggggccagggat

SEQ ID NO: 42401 - DNA, 22 bp, Homo sapiens
tggtatgtaaattgtaactcaa

SEQ ID NO: 42402 - DNA, 22 bp, Homo sapiens
atatccagcagcaggtgagtat

SEQ ID NO: 42403 - DNA, 22 bp, Homo sapiens
aggtggggaggagtgtctcttt

SEQ ID NO: 42404 - DNA, 22 bp, Homo sapiens
ttgcatcagaattacttggagg

SEQ ID NO: 42405 - DNA, 17 bp, Homo sapiens
gggcagggactcctggg

SEQ ID NO: 42406 - DNA, 22 bp, Homo sapiens
aggggctcctttgtgctgcgtc

SEQ ID NO: 42407 - DNA, 22 bp, Homo sapiens
tatactctgagaaacgtgtcac

SEQ ID NO: 42408 - DNA, 22 bp, Homo sapiens
acaaagtgctgacattacaggc

SEQ ID NO: 42409 - DNA, 22 bp, Homo sapiens
ttttctaacatctagtaatttg

SEQ ID NO: 42410 - DNA, 23 bp, Homo sapiens
gcgtccggcctctctcgctcccg

SEQ ID NO: 42411 - DNA, 22 bp, Homo sapiens
ctgctgagccgcacccaggagc

SEQ ID NO: 42412 - DNA, 22 bp, Homo sapiens
caattctgaggcctgctttgtt

SEQ ID NO: 42413 - DNA, 22 bp, Homo sapiens
tggaggccagaggtactgggac

SEQ ID NO: 42414 - DNA, 22 bp, Homo sapiens
aggaggggttctcgggtgctga

SEQ ID NO: 42415 - DNA, 22 bp, Homo sapiens
tgctccagcaccaagagctcca

SEQ ID NO: 42416 - DNA, 22 bp, Homo sapiens
ttccgagggctcggcggccgcc

SEQ ID NO: 42417 - DNA, 21 bp, Homo sapiens
ccaggccaggcctacggggat

SEQ ID NO: 42418 - DNA, 22 bp, Homo sapiens
ctgagcagatgaccagccccag

SEQ ID NO: 42419 - DNA, 22 bp, Homo sapiens
tgggcccgcagctgctgctcca

SEQ ID NO: 42420 - DNA, 22 bp, Homo sapiens
caggctggagtacaattgtgtg

SEQ ID NO: 42421 - DNA, 22 bp, Homo sapiens
ctcttcctagtgtgcagcgtgg

SEQ ID NO: 42422 - DNA, 22 bp, Homo sapiens
cgcggctctgcgggccgctgag

SEQ ID NO: 42423 - DNA, 22 bp, Homo sapiens
aagaggagaaaggctggctttg

SEQ ID NO: 42424 - DNA, 22 bp, Homo sapiens
tccaaggtcagcgagagtcact

SEQ ID NO: 42425 - DNA, 22 bp, Homo sapiens
tggagaattctatgttgagggg

SEQ ID NO: 42426 - DNA, 22 bp, Homo sapiens
ctgatcctcctttaagtagctg

SEQ ID NO: 42427 - DNA, 22 bp, Homo sapiens
gggccctgcgactcgcggcgga

SEQ ID NO: 42428 - DNA, 21 bp, Homo sapiens
agggttttatagatctcttcc

SEQ ID NO: 42429 - DNA, 22 bp, Homo sapiens
ttaattctgcctttcatgtaac

SEQ ID NO: 42430 - DNA, 22 bp, Homo sapiens
gggcaggggtcagtggccccaa

SEQ ID NO: 42431 - DNA, 22 bp, Homo sapiens
gccatcatatcccctgtgacct

SEQ ID NO: 42432 - DNA, 22 bp, Homo sapiens
cagctgctgttcagttttgttt

SEQ ID NO: 42433 - DNA, 22 bp, Homo sapiens
agggccagcactcctggcagga

SEQ ID NO: 42434 - DNA, 22 bp, Homo sapiens
tgtgttaaggtgcatctagtgc

SEQ ID NO: 42435 - DNA, 22 bp, Homo sapiens
gattgagtctgaggatgctgca

SEQ ID NO: 42436 - DNA, 22 bp, Homo sapiens
caaggtgccatgctgggcgggg

SEQ ID NO: 42437 - DNA, 22 bp, Homo sapiens
ggcctctcttgggacagctgtc

SEQ ID NO: 42438 - DNA, 22 bp, Homo sapiens
atttcagcagcccatgtttgga

SEQ ID NO: 42439 - DNA, 22 bp, Homo sapiens
ggcgggacggggcgtgcacaga

SEQ ID NO: 42440 - DNA, 22 bp, Homo sapiens
gccgtggggagagagggtgcgt

SEQ ID NO: 42441 - DNA, 22 bp, Homo sapiens
tctggacaggggcgctttgggg

SEQ ID NO: 42442 - DNA, 22 bp, Homo sapiens
ccttacctgattgctggcatcc

SEQ ID NO: 42443 - DNA, 22 bp, Homo sapiens
acctggacacctgctgtcatct

SEQ ID NO: 42444 - DNA, 22 bp, Homo sapiens
acccagggctcaagcgtaggca

SEQ ID NO: 42445 - DNA, 22 bp, Homo sapiens
gaaagacatagttgcaagatgg

SEQ ID NO: 42446 - DNA, 22 bp, Homo sapiens
ccaggctggagtgcagtggcac

SEQ ID NO: 42447 - DNA, 22 bp, Homo sapiens
ggtcgggcactctccagggctg

SEQ ID NO: 42448 - DNA, 21 bp, Homo sapiens
ctggaggcaggtggtgccagg

SEQ ID NO: 42449 - DNA, 22 bp, Homo sapiens
gcaggcggaggttgcagtgagc

SEQ ID NO: 42450 - DNA, 20 bp, Homo sapiens
ggccggggagctctccaggg

SEQ ID NO: 42451 - DNA, 22 bp, Homo sapiens
gcttaattctggctcagtttcc

SEQ ID NO: 42452 - DNA, 21 bp, Homo sapiens
ctgtcatgcaaccattctcca

SEQ ID NO: 42453 - DNA, 23 bp, Homo sapiens
ccagtgattgcctggaaggaggt

SEQ ID NO: 42454 - DNA, 22 bp, Homo sapiens
cctgggggccaggaaggtgtga

SEQ ID NO: 42455 - DNA, 18 bp, Homo sapiens
ggaaggtgattcagtttt

SEQ ID NO: 42456 - DNA, 22 bp, Homo sapiens
gcgcactgggcgcacgcgtagg

SEQ ID NO: 42457 - DNA, 19 bp, Homo sapiens
gccgggcccgggttggccg

SEQ ID NO: 42458 - DNA, 22 bp, Homo sapiens
ggctctgcttgaggccagcctg

SEQ ID NO: 42459 - DNA, 22 bp, Homo sapiens
ttatttttaaaagttcacacag

SEQ ID NO: 42460 - DNA, 22 bp, Homo sapiens
ctgggaggcagaggttgcagtg

SEQ ID NO: 42461 - DNA, 21 bp, Homo sapiens
gcccacagtgaggaggatccc

SEQ ID NO: 42462 - DNA, 22 bp, Homo sapiens
cggagcgctgggggactctgca

SEQ ID NO: 42463 - DNA, 22 bp, Homo sapiens
gggcagagactcagaaacagaa

SEQ ID NO: 42464 - DNA, 22 bp, Homo sapiens
gaggcgggcagatcacctgagg

SEQ ID NO: 42465 - DNA, 22 bp, Homo sapiens
gctgcagggagctggaaggctc

SEQ ID NO: 42466 - DNA, 22 bp, Homo sapiens
gcctccccaagcagcagggatt

SEQ ID NO: 42467 - DNA, 22 bp, Homo sapiens
tcagagagcagaacttttttac

SEQ ID NO: 42468 - DNA, 22 bp, Homo sapiens
gaggggcacagtaaagggtccc

SEQ ID NO: 42469 - DNA, 22 bp, Homo sapiens
gttgctcaggcaggagtacagt

SEQ ID NO: 42470 - DNA, 22 bp, Homo sapiens
gctgtgtatcagatgccacggg

SEQ ID NO: 42471 - DNA, 22 bp, Homo sapiens
tggccggggctgatggacagtg

SEQ ID NO: 42472 - DNA, 22 bp, Homo sapiens
gggaaggccttgtcagcggatt

SEQ ID NO: 42473 - DNA, 22 bp, Homo sapiens
ggctccccaggtccaggagctg

SEQ ID NO: 42474 - DNA, 22 bp, Homo sapiens
caggcgggcaggtgcggcccct

SEQ ID NO: 42475 - DNA, 22 bp, Homo sapiens
ggggctgaacctggaggtggtc

SEQ ID NO: 42476 - DNA, 22 bp, Homo sapiens
cctggaggcggaggttgcagtg

SEQ ID NO: 42477 - DNA, 22 bp, Homo sapiens
ttcaatatgatattagctgtgg

SEQ ID NO: 42478 - DNA, 22 bp, Homo sapiens
gagggggctagcgcagtgccca

SEQ ID NO: 42479 - DNA, 22 bp, Homo sapiens
gcgtctcaaggcccccaggcca

SEQ ID NO: 42480 - DNA, 22 bp, Homo sapiens
gagcccaggaagtggaggctga

SEQ ID NO: 42481 - DNA, 22 bp, Homo sapiens
ctgggaggtggaggttgcattg

SEQ ID NO: 42482 - DNA, 22 bp, Homo sapiens
cgcgctctccttctggcaccca

SEQ ID NO: 42483 - DNA, 21 bp, Homo sapiens
tctctttctggaagcttccct

SEQ ID NO: 42484 - DNA, 22 bp, Homo sapiens
caggctggagtgcagtggtgcc

SEQ ID NO: 42485 - DNA, 22 bp, Homo sapiens
gggagctgagctggaagagaat

SEQ ID NO: 42486 - DNA, 22 bp, Homo sapiens
caggctggagtgcaatgacgcc

SEQ ID NO: 42487 - DNA, 22 bp, Homo sapiens
cgcggaggaggtcaggaggtga

SEQ ID NO: 42488 - DNA, 22 bp, Homo sapiens
caggcgctgtggctcccacctg

SEQ ID NO: 42489 - DNA, 22 bp, Homo sapiens
cactgcactccagcccgggcaa

SEQ ID NO: 42490 - DNA, 22 bp, Homo sapiens
gaaccattgttgaaaagaatag

SEQ ID NO: 42491 - DNA, 22 bp, Homo sapiens
aaactgctttccacagtggcta

SEQ ID NO: 42492 - DNA, 22 bp, Homo sapiens
agtggagcttttcctatcagag

SEQ ID NO: 42493 - DNA, 19 bp, Homo sapiens
tctcacagctctactatgt

SEQ ID NO: 42494 - DNA, 20 bp, Homo sapiens
attagagctacatggctaca

SEQ ID NO: 42495 - DNA, 22 bp, Homo sapiens
atctggttcttcttaggcatca

SEQ ID NO: 42496 - DNA, 22 bp, Homo sapiens
tgaaggtgggaattcaccaggt

SEQ ID NO: 42497 - DNA, 22 bp, Homo sapiens
agcccttagtacatttctcaag

SEQ ID NO: 42498 - DNA, 22 bp, Homo sapiens
cactgcactccagcctgggtca

SEQ ID NO: 42499 - DNA, 22 bp, Homo sapiens
ggcaggactgatcagtgggatg

SEQ ID NO: 42500 - DNA, 22 bp, Homo sapiens
caggccagggttgagaagagaa

SEQ ID NO: 42501 - DNA, 22 bp, Homo sapiens
ctctgcctgtctcatcctgcaa

SEQ ID NO: 42502 - DNA, 21 bp, Homo sapiens
tgctccaggagggggcagtcc

SEQ ID NO: 42503 - DNA, 23 bp, Homo sapiens
gcagaggagcaagctggacacca

SEQ ID NO: 42504 - DNA, 22 bp, Homo sapiens
tgaaatgtgttctagtgttttg

SEQ ID NO: 42505 - DNA, 22 bp, Homo sapiens
agcaggaaggggatgatgggca

SEQ ID NO: 42506 - DNA, 22 bp, Homo sapiens
ggccactgacctacatctgggg

SEQ ID NO: 42507 - DNA, 22 bp, Homo sapiens
taatggtgtttttctgtaattt

SEQ ID NO: 42508 - DNA, 22 bp, Homo sapiens
gctgctgcttgaaggctcggag

SEQ ID NO: 42509 - DNA, 22 bp, Homo sapiens
acatttatataactcactagga

SEQ ID NO: 42510 - DNA, 22 bp, Homo sapiens
taaatgttttgtgggttgagtt

SEQ ID NO: 42511 - DNA, 22 bp, Homo sapiens
gccctgagaagaagtcggaggg

SEQ ID NO: 42512 - DNA, 22 bp, Homo sapiens
gccctgccctctcggcactcgc

SEQ ID NO: 42513 - DNA, 22 bp, Homo sapiens
aagaagcattctttcattggtt

SEQ ID NO: 42514 - DNA, 22 bp, Homo sapiens
aattttctggtgtgtaatgaag

SEQ ID NO: 42515 - DNA, 20 bp, Homo sapiens
aggggcacctgcgacggggc

SEQ ID NO: 42516 - DNA, 22 bp, Homo sapiens
cgtctctggcccggcccctggg

SEQ ID NO: 42517 - DNA, 22 bp, Homo sapiens
gaaacactcaatttagtaattc

SEQ ID NO: 42518 - DNA, 22 bp, Homo sapiens
ctgtccgccgacttggccaggc

SEQ ID NO: 42519 - DNA, 22 bp, Homo sapiens
ccaggctggagtatagtggcgc

SEQ ID NO: 42520 - DNA, 22 bp, Homo sapiens
tccatgaggaccaaattcgtag

SEQ ID NO: 42521 - DNA, 22 bp, Homo sapiens
agccacacagcttaatgacaga

SEQ ID NO: 42522 - DNA, 22 bp, Homo sapiens
gtgagccgagtatagttcatag

SEQ ID NO: 42523 - DNA, 22 bp, Homo sapiens
ctgggaggcggaggttgtagtg

SEQ ID NO: 42524 - DNA, 22 bp, Homo sapiens
ccgaggctggagtgcagtggcg

SEQ ID NO: 42525 - DNA, 20 bp, Homo sapiens
gtttctgattcagtaggtct

SEQ ID NO: 42526 - DNA, 22 bp, Homo sapiens
ggggtgggcgtgcagggacacc

SEQ ID NO: 42527 - DNA, 22 bp, Homo sapiens
ggggcagagaataaaaacctaa

SEQ ID NO: 42528 - DNA, 22 bp, Homo sapiens
ggtgtccgcgctgtagaaggtc

SEQ ID NO: 42529 - DNA, 22 bp, Homo sapiens
gcagcctcaaactccccagctc

SEQ ID NO: 42530 - DNA, 22 bp, Homo sapiens
atgtacataaaatgtataatga

SEQ ID NO: 42531 - DNA, 22 bp, Homo sapiens
ccgggccccacggtgacctcag

SEQ ID NO: 42532 - DNA, 22 bp, Homo sapiens
ggccagcctggggctcccagac

SEQ ID NO: 42533 - DNA, 22 bp, Homo sapiens
aggggaggtgtccccaaatctc

SEQ ID NO: 42534 - DNA, 21 bp, Homo sapiens
gctgctcgagatccagtgctt

SEQ ID NO: 42535 - DNA, 22 bp, Homo sapiens
caaagtgggtgccctgatgctc

SEQ ID NO: 42536 - DNA, 22 bp, Homo sapiens
tggtgggctgagtctcatcgga

SEQ ID NO: 42537 - DNA, 22 bp, Homo sapiens
accagctagggtagcacatctc

SEQ ID NO: 42538 - DNA, 22 bp, Homo sapiens
ctctgtagaaagagcccaggtg

SEQ ID NO: 42539 - DNA, 22 bp, Homo sapiens
atgttggagtcgtaaggcatgg

SEQ ID NO: 42540 - DNA, 18 bp, Homo sapiens
cccacggtgctgtagggc

SEQ ID NO: 42541 - DNA, 22 bp, Homo sapiens
ttcccacattctttacattcat

SEQ ID NO: 42542 - DNA, 22 bp, Homo sapiens
ggaggcggaggctgcagtgagc

SEQ ID NO: 42543 - DNA, 22 bp, Homo sapiens
accccactcacacatggacctg

SEQ ID NO: 42544 - DNA, 22 bp, Homo sapiens
ttgggctcaggagtttgagacc

SEQ ID NO: 42545 - DNA, 22 bp, Homo sapiens
cactgcacttcagcctgggtga

SEQ ID NO: 42546 - DNA, 22 bp, Homo sapiens
aagaatgagctcaaagatctta

SEQ ID NO: 42547 - DNA, 22 bp, Homo sapiens
ctgaggagaggtggcctgtgtt

SEQ ID NO: 42548 - DNA, 22 bp, Homo sapiens
tgacaggaaacatgcagtgatt

SEQ ID NO: 42549 - DNA, 22 bp, Homo sapiens
ttccgctgtttagttgaagttt

SEQ ID NO: 42550 - DNA, 22 bp, Homo sapiens
agacccaggattggggctgccg

SEQ ID NO: 42551 - DNA, 22 bp, Homo sapiens
actatagatgctggcgaggctg

SEQ ID NO: 42552 - DNA, 22 bp, Homo sapiens
gggtaaatctcttttcatggct

SEQ ID NO: 42553 - DNA, 22 bp, Homo sapiens
caagaggattattaataaataa

SEQ ID NO: 42554 - DNA, 22 bp, Homo sapiens
ttgtctaatgagctccacttca

SEQ ID NO: 42555 - DNA, 19 bp, Homo sapiens
tcctggggaggggcatggc

SEQ ID NO: 42556 - DNA, 22 bp, Homo sapiens
taccagggaacagggatattaa

SEQ ID NO: 42557 - DNA, 22 bp, Homo sapiens
cggctgggttcggctgcaggcc

SEQ ID NO: 42558 - DNA, 22 bp, Homo sapiens
gaggaggcagcctatcccttag

SEQ ID NO: 42559 - DNA, 22 bp, Homo sapiens
cacagagatggtctggcaggtg

SEQ ID NO: 42560 - DNA, 22 bp, Homo sapiens
cagagagaatcttggcagctga

SEQ ID NO: 42561 - DNA, 22 bp, Homo sapiens
ccgcggggtcatggctgggccg

SEQ ID NO: 42562 - DNA, 22 bp, Homo sapiens
ctgctccccagcctgcgccttt

SEQ ID NO: 42563 - DNA, 22 bp, Homo sapiens
actgtgaacggactgaagccca

SEQ ID NO: 42564 - DNA, 22 bp, Homo sapiens
catgcacttacctgaaattcaa

SEQ ID NO: 42565 - DNA, 22 bp, Homo sapiens
gagggccctggctggctccagc

SEQ ID NO: 42566 - DNA, 22 bp, Homo sapiens
gggggagagacgagcggctctg

SEQ ID NO: 42567 - DNA, 21 bp, Homo sapiens
ggccccgcagacccagcacgt

SEQ ID NO: 42568 - DNA, 22 bp, Homo sapiens
ggtgcagaggagccagctgggg

SEQ ID NO: 42569 - DNA, 22 bp, Homo sapiens
cctgggccctcaccgccggtgg

SEQ ID NO: 42570 - DNA, 18 bp, Homo sapiens
ggcgggtgttttattcac

SEQ ID NO: 42571 - DNA, 22 bp, Homo sapiens
tctgcaggaagctggcggctga

SEQ ID NO: 42572 - DNA, 22 bp, Homo sapiens
ctgggcagctgtatcagggagt

SEQ ID NO: 42573 - DNA, 22 bp, Homo sapiens
agaagcagaaactgggcttgtg

SEQ ID NO: 42574 - DNA, 22 bp, Homo sapiens
gaggctggacgtgcatttctac

SEQ ID NO: 42575 - DNA, 22 bp, Homo sapiens
agattctaccagagctagtttg

SEQ ID NO: 42576 - DNA, 22 bp, Homo sapiens
gtggagaggaacccagctctgt

SEQ ID NO: 42577 - DNA, 22 bp, Homo sapiens
gggcagagagctggaactcctt

SEQ ID NO: 42578 - DNA, 22 bp, Homo sapiens
attgctaggaacaggttgcacc

SEQ ID NO: 42579 - DNA, 22 bp, Homo sapiens
tttgaagggcacgacaatagtt

SEQ ID NO: 42580 - DNA, 22 bp, Homo sapiens
ggccggggcctgctcgcctgtg

SEQ ID NO: 42581 - DNA, 22 bp, Homo sapiens
tggtgccatcatagctcactgc

SEQ ID NO: 42582 - DNA, 22 bp, Homo sapiens
gggccctgggattcagagcaag

SEQ ID NO: 42583 - DNA, 22 bp, Homo sapiens
ctgtggctctcagaggctgctg

SEQ ID NO: 42584 - DNA, 22 bp, Homo sapiens
cctacagttatattcttgattg

SEQ ID NO: 42585 - DNA, 22 bp, Homo sapiens
atgagttgaagctacaagaggc

SEQ ID NO: 42586 - DNA, 22 bp, Homo sapiens
cgaggaggaaacgcggagaact

SEQ ID NO: 42587 - DNA, 22 bp, Homo sapiens
tagtggatgttcagagatttga

SEQ ID NO: 42588 - DNA, 19 bp, Homo sapiens
aggaatggaattaattctg

SEQ ID NO: 42589 - DNA, 22 bp, Homo sapiens
ctgtcatggtttgaatgctcgc

SEQ ID NO: 42590 - DNA, 20 bp, Homo sapiens
ttcatgggagcaaagaggcc

SEQ ID NO: 42591 - DNA, 22 bp, Homo sapiens
ttgcactccagtctgggaacaa

SEQ ID NO: 42592 - DNA, 22 bp, Homo sapiens
tagctgggactactggccctgc

SEQ ID NO: 42593 - DNA, 23 bp, Homo sapiens
ggctgggagctccgggtgcacgt

SEQ ID NO: 42594 - DNA, 22 bp, Homo sapiens
actggggctgatgcgttcgtgt

SEQ ID NO: 42595 - DNA, 22 bp, Homo sapiens
ggtgccagatgaggcccgcgat

SEQ ID NO: 42596 - DNA, 21 bp, Homo sapiens
acagcctccatctcctgggct

SEQ ID NO: 42597 - DNA, 22 bp, Homo sapiens
attttctatgttgtaattgtta

SEQ ID NO: 42598 - DNA, 22 bp, Homo sapiens
tgatatgtaactactccttata

SEQ ID NO: 42599 - DNA, 22 bp, Homo sapiens
ggaggtggaggttgcagtgagc

SEQ ID NO: 42600 - DNA, 22 bp, Homo sapiens
ggaggcggaggttgcagtgagt

SEQ ID NO: 42601 - DNA, 22 bp, Homo sapiens
cctgggaggctgaggctgcagt

SEQ ID NO: 42602 - DNA, 22 bp, Homo sapiens
tgtgggagaaggaagcaagctg

SEQ ID NO: 42603 - DNA, 22 bp, Homo sapiens
tgggcagggagctggaaccaca

SEQ ID NO: 42604 - DNA, 21 bp, Homo sapiens
acatggactgtgaatggggac

SEQ ID NO: 42605 - DNA, 22 bp, Homo sapiens
tcacaactgggtgtcttcatca

SEQ ID NO: 42606 - DNA, 22 bp, Homo sapiens
ccaggcaggcgatggtgcagtg

SEQ ID NO: 42607 - DNA, 21 bp, Homo sapiens
tggcggggacttgtggctgcc

SEQ ID NO: 42608 - DNA, 22 bp, Homo sapiens
tgggaggccgaggcaggtggat

SEQ ID NO: 42609 - DNA, 19 bp, Homo sapiens
acacagggatcagagggtt

SEQ ID NO: 42610 - DNA, 22 bp, Homo sapiens
ggcctcacccatcggtgccttt

SEQ ID NO: 42611 - DNA, 22 bp, Homo sapiens
atgtgagtgctatgatagacag

SEQ ID NO: 42612 - DNA, 22 bp, Homo sapiens
caccaagaatcttcacttttta

SEQ ID NO: 42613 - DNA, 22 bp, Homo sapiens
gctctgccagcccaaggcgcag

SEQ ID NO: 42614 - DNA, 22 bp, Homo sapiens
caggctggagttcagtggtgtg

SEQ ID NO: 42615 - DNA, 22 bp, Homo sapiens
gtctctatcatagctgaaccct

SEQ ID NO: 42616 - DNA, 22 bp, Homo sapiens
aaagcagggaaatctatttgca

SEQ ID NO: 42617 - DNA, 23 bp, Homo sapiens
tcagaacagttcttggtgcatag

SEQ ID NO: 42618 - DNA, 22 bp, Homo sapiens
ctgcagggagaggggacagcct

SEQ ID NO: 42619 - DNA, 22 bp, Homo sapiens
tgggaagggtcaacagctggaa

SEQ ID NO: 42620 - DNA, 22 bp, Homo sapiens
gcaggaggttgagccaggactg

SEQ ID NO: 42621 - DNA, 22 bp, Homo sapiens
atccatttgacataatttcagc

SEQ ID NO: 42622 - DNA, 22 bp, Homo sapiens
gggccggagctgggtcccgcgc

SEQ ID NO: 42623 - DNA, 22 bp, Homo sapiens
tcagcagtgagaattaatgttg

SEQ ID NO: 42624 - DNA, 22 bp, Homo sapiens
caggctggagtgcagtggcgct

SEQ ID NO: 42625 - DNA, 22 bp, Homo sapiens
agggctggagccacagctggga

SEQ ID NO: 42626 - DNA, 22 bp, Homo sapiens
aatcacttagaacccaggaagt

SEQ ID NO: 42627 - DNA, 21 bp, Homo sapiens
taagagcctaacacagaaagg

SEQ ID NO: 42628 - DNA, 22 bp, Homo sapiens
tagtatagattgaagcagatca

SEQ ID NO: 42629 - DNA, 22 bp, Homo sapiens
gctggaggatggactggaagaa

SEQ ID NO: 42630 - DNA, 20 bp, Homo sapiens
tatttctgggcaaccattta

SEQ ID NO: 42631 - DNA, 22 bp, Homo sapiens
catttctgggagacatgctaga

SEQ ID NO: 42632 - DNA, 22 bp, Homo sapiens
gcagaggacacaggagggcaag

SEQ ID NO: 42633 - DNA, 22 bp, Homo sapiens
tggaatgtcagctacaagaggg

SEQ ID NO: 42634 - DNA, 22 bp, Homo sapiens
ctcagctcattgtggatccggt

SEQ ID NO: 42635 - DNA, 22 bp, Homo sapiens
tcaacagtggcaaagaggcacg

SEQ ID NO: 42636 - DNA, 22 bp, Homo sapiens
ctgatagacaatcaccatggga

SEQ ID NO: 42637 - DNA, 16 bp, Homo sapiens
gcagaggaaaggggag

SEQ ID NO: 42638 - DNA, 22 bp, Homo sapiens
gcggcccgagcaggacgggtgg

SEQ ID NO: 42639 - DNA, 22 bp, Homo sapiens
agggctgcccagtgtgagagct

SEQ ID NO: 42640 - DNA, 22 bp, Homo sapiens
gccctgggcaaggttctggcca

SEQ ID NO: 42641 - DNA, 21 bp, Homo sapiens
agaaggcaaaagcagacatct

SEQ ID NO: 42642 - DNA, 22 bp, Homo sapiens
gaggagggagctggaagctctt

SEQ ID NO: 42643 - DNA, 22 bp, Homo sapiens
tgcgggagggcaacgcggcatt

SEQ ID NO: 42644 - DNA, 16 bp, Homo sapiens
atgctgctattagagg

SEQ ID NO: 42645 - DNA, 22 bp, Homo sapiens
taatttcagtgcaagctcacgg

SEQ ID NO: 42646 - DNA, 22 bp, Homo sapiens
ttttaatactgctattgtagga

SEQ ID NO: 42647 - DNA, 22 bp, Homo sapiens
caggcagggagctggaaaggat

SEQ ID NO: 42648 - DNA, 20 bp, Homo sapiens
gggcaaggaaacagccccca

SEQ ID NO: 42649 - DNA, 22 bp, Homo sapiens
gacaggaggcagagctcaggtg

SEQ ID NO: 42650 - DNA, 22 bp, Homo sapiens
gaggtgctgctgtacttcttgc

SEQ ID NO: 42651 - DNA, 22 bp, Homo sapiens
ctgggaggcagaggttgtagtg

SEQ ID NO: 42652 - DNA, 18 bp, Homo sapiens
actctttctgcccacagg

SEQ ID NO: 42653 - DNA, 22 bp, Homo sapiens
agcaacacgcagtagtatacga

SEQ ID NO: 42654 - DNA, 22 bp, Homo sapiens
aaaactgaaatacgatccaatg

SEQ ID NO: 42655 - DNA, 22 bp, Homo sapiens
atctggttttggctgtgtccct

SEQ ID NO: 42656 - DNA, 22 bp, Homo sapiens
ggcgccgcactcggtgcagccg

SEQ ID NO: 42657 - DNA, 22 bp, Homo sapiens
gaggtaggtgtaggaggcctgc

SEQ ID NO: 42658 - DNA, 22 bp, Homo sapiens
cgcgctgcagacagcggaggcc

SEQ ID NO: 42659 - DNA, 22 bp, Homo sapiens
ggggcaggagcccttcttcagc

SEQ ID NO: 42660 - DNA, 22 bp, Homo sapiens
cctgcgggctgtgctgaagcct

SEQ ID NO: 42661 - DNA, 22 bp, Homo sapiens
ggaggaggggtgactgaatgct

SEQ ID NO: 42662 - DNA, 22 bp, Homo sapiens
cgggcccgagcacggcacccac

SEQ ID NO: 42663 - DNA, 19 bp, Homo sapiens
ccagagagctaggtacaga

SEQ ID NO: 42664 - DNA, 22 bp, Homo sapiens
gacggagctggttgctgcggct

SEQ ID NO: 42665 - DNA, 22 bp, Homo sapiens
tggggccatctcacccactgtt

SEQ ID NO: 42666 - DNA, 20 bp, Homo sapiens
cctgtcatcccagcattttg

SEQ ID NO: 42667 - DNA, 22 bp, Homo sapiens
gcgggcgggggttcccaggtct

SEQ ID NO: 42668 - DNA, 22 bp, Homo sapiens
cctggggccccgagccagaagc

SEQ ID NO: 42669 - DNA, 22 bp, Homo sapiens
ggccactgctctccagcctggg

SEQ ID NO: 42670 - DNA, 22 bp, Homo sapiens
gtggggcctgtggcttccgtgg

SEQ ID NO: 42671 - DNA, 22 bp, Homo sapiens
ttcccacagtgactccagagaa

SEQ ID NO: 42672 - DNA, 22 bp, Homo sapiens
aggtggagaagagatgggcagt

SEQ ID NO: 42673 - DNA, 22 bp, Homo sapiens
tctgctctgtggcttcagctaa

SEQ ID NO: 42674 - DNA, 23 bp, Homo sapiens
tgtgggcgcattgtaagggtagc

SEQ ID NO: 42675 - DNA, 22 bp, Homo sapiens
caaagcaggaagctcctgacag

SEQ ID NO: 42676 - DNA, 22 bp, Homo sapiens
actgcactccagcctgggtaac

SEQ ID NO: 42677 - DNA, 22 bp, Homo sapiens
cttgtagaattgaaatggtctc

SEQ ID NO: 42678 - DNA, 22 bp, Homo sapiens
atgattgaccatctgctgggct

SEQ ID NO: 42679 - DNA, 22 bp, Homo sapiens
tcactgcaacctccacctcctg

SEQ ID NO: 42680 - DNA, 22 bp, Homo sapiens
gcccaggctggagtgcagtggt

SEQ ID NO: 42681 - DNA, 22 bp, Homo sapiens
gcaggcagatcacctgtcagga

SEQ ID NO: 42682 - DNA, 22 bp, Homo sapiens
gagcacgttgaagcgcactgtc

SEQ ID NO: 42683 - DNA, 21 bp, Homo sapiens
ggtgctcgctgatgaggagtg

SEQ ID NO: 42684 - DNA, 22 bp, Homo sapiens
gcctcactgcagccccaggaag

SEQ ID NO: 42685 - DNA, 23 bp, Homo sapiens
ggggcctgcaccggtctgcgcgg

SEQ ID NO: 42686 - DNA, 22 bp, Homo sapiens
gaatgctaagcatgtgggagtt

SEQ ID NO: 42687 - DNA, 22 bp, Homo sapiens
gagcccgagcgcgtacccggcg

SEQ ID NO: 42688 - DNA, 23 bp, Homo sapiens
cagagctggctcagagctgcctg

SEQ ID NO: 42689 - DNA, 22 bp, Homo sapiens
ctggaggtgcttcgctggccac

SEQ ID NO: 42690 - DNA, 22 bp, Homo sapiens
gctggggaggcagcagagaaca

SEQ ID NO: 42691 - DNA, 22 bp, Homo sapiens
ggaggcggaggttgcagtgagc

SEQ ID NO: 42692 - DNA, 22 bp, Homo sapiens
acgggctgggacggggaagctc

SEQ ID NO: 42693 - DNA, 22 bp, Homo sapiens
ttatttaatgtgatctgaagag

SEQ ID NO: 42694 - DNA, 22 bp, Homo sapiens
gaggaggcttccgggaggcacg

SEQ ID NO: 42695 - DNA, 22 bp, Homo sapiens
tggagccagcggcctgctgagg

SEQ ID NO: 42696 - DNA, 22 bp, Homo sapiens
atcacaaaggtctcagagcaca

SEQ ID NO: 42697 - DNA, 20 bp, Homo sapiens
tcactgtaacatttgggggg

SEQ ID NO: 42698 - DNA, 22 bp, Homo sapiens
actgattgcattcatagggttt

SEQ ID NO: 42699 - DNA, 22 bp, Homo sapiens
cccagggaggcccaggctctgc

SEQ ID NO: 42700 - DNA, 22 bp, Homo sapiens
ggagttgattttggatatatta

SEQ ID NO: 42701 - DNA, 22 bp, Homo sapiens
ggcgtggggccttctgcccgct

SEQ ID NO: 42702 - DNA, 22 bp, Homo sapiens
tgagcaggcgcagcaggaggtc

SEQ ID NO: 42703 - DNA, 22 bp, Homo sapiens
tttattctgtgctacatgaaga

SEQ ID NO: 42704 - DNA, 22 bp, Homo sapiens
gggctctcccacaacgtgccag

SEQ ID NO: 42705 - DNA, 22 bp, Homo sapiens
tgggcaggggccctgcttccgt

SEQ ID NO: 42706 - DNA, 17 bp, Homo sapiens
aggaggccctggcgttt

SEQ ID NO: 42707 - DNA, 22 bp, Homo sapiens
ggtggcagtagcactgggcctg

SEQ ID NO: 42708 - DNA, 22 bp, Homo sapiens
tgttgagtatatacctacaagt

SEQ ID NO: 42709 - DNA, 22 bp, Homo sapiens
agtgcaggccccaggccaggcc

SEQ ID NO: 42710 - DNA, 22 bp, Homo sapiens
tgtgacctcatcttaactggaa

SEQ ID NO: 42711 - DNA, 22 bp, Homo sapiens
ggctcactgcaacttccgcctc

SEQ ID NO: 42712 - DNA, 22 bp, Homo sapiens
tcactgcaacctccacctcccg

SEQ ID NO: 42713 - DNA, 22 bp, Homo sapiens
gggcttcagttctgaccatctt

SEQ ID NO: 42714 - DNA, 22 bp, Homo sapiens
gtggcagagccaaggctggagc

SEQ ID NO: 42715 - DNA, 22 bp, Homo sapiens
ccaggctggagtgcaatggcat

SEQ ID NO: 42716 - DNA, 22 bp, Homo sapiens
agagcgagtctggggctcggat

SEQ ID NO: 42717 - DNA, 22 bp, Homo sapiens
gtggcccaggttggagtgcagt

SEQ ID NO: 42718 - DNA, 22 bp, Homo sapiens
tggccgggaagggacagtgtgg

SEQ ID NO: 42719 - DNA, 22 bp, Homo sapiens
gggctgggattgcttgctgtga

SEQ ID NO: 42720 - DNA, 22 bp, Homo sapiens
agaggggcccggttctccgtct

SEQ ID NO: 42721 - DNA, 22 bp, Homo sapiens
tgtcatagtgtggtagcagtgg

SEQ ID NO: 42722 - DNA, 22 bp, Homo sapiens
tgtggactggcgggacgcaatg

SEQ ID NO: 42723 - DNA, 22 bp, Homo sapiens
gtctatgatattttgttatagc

SEQ ID NO: 42724 - DNA, 22 bp, Homo sapiens
gagcaggaaggccagaagggtc

SEQ ID NO: 42725 - DNA, 22 bp, Homo sapiens
ctgcgggctgtcaggcgtgcca

SEQ ID NO: 42726 - DNA, 22 bp, Homo sapiens
atgagctagaaaaccatgtgga

SEQ ID NO: 42727 - DNA, 22 bp, Homo sapiens
tcgcggggaagtggtgggctaa

SEQ ID NO: 42728 - DNA, 22 bp, Homo sapiens
gggaggcagtgctggaggctgg

SEQ ID NO: 42729 - DNA, 22 bp, Homo sapiens
tttagcgtagctgacagctaat

SEQ ID NO: 42730 - DNA, 19 bp, Homo sapiens
gagtattttccaacttggt

SEQ ID NO: 42731 - DNA, 22 bp, Homo sapiens
agacactgttctcacatgcttg

SEQ ID NO: 42732 - DNA, 22 bp, Homo sapiens
ctgcttctccctgagatagtgt

SEQ ID NO: 42733 - DNA, 22 bp, Homo sapiens
tttggactgcatgatgatctgg

SEQ ID NO: 42734 - DNA, 22 bp, Homo sapiens
aggccagcctcaggcagggacc

SEQ ID NO: 42735 - DNA, 22 bp, Homo sapiens
gccaggacctcagatgcagggc

SEQ ID NO: 42736 - DNA, 22 bp, Homo sapiens
actgcactcctgcctgggtaac

SEQ ID NO: 42737 - DNA, 22 bp, Homo sapiens
tgggaggccaaggcaggcggat

SEQ ID NO: 42738 - DNA, 22 bp, Homo sapiens
gggtggtggccagcagtgggca

SEQ ID NO: 42739 - DNA, 20 bp, Homo sapiens
aaaatatgtataactcttct

SEQ ID NO: 42740 - DNA, 22 bp, Homo sapiens
agttgcagacgcagagatgttg

SEQ ID NO: 42741 - DNA, 22 bp, Homo sapiens
ttgtgagtagtgccgcaataaa

SEQ ID NO: 42742 - DNA, 22 bp, Homo sapiens
tagcatgtcagtcgccacacgt

SEQ ID NO: 42743 - DNA, 22 bp, Homo sapiens
gagggagggactagcattctct

SEQ ID NO: 42744 - DNA, 22 bp, Homo sapiens
ggtgatccaccagcctcggcct

SEQ ID NO: 42745 - DNA, 19 bp, Homo sapiens
ggggcccggggtctgcgag

SEQ ID NO: 42746 - DNA, 18 bp, Homo sapiens
ccctgccagctcccagca

SEQ ID NO: 42747 - DNA, 22 bp, Homo sapiens
aaaaatcacttttataggcagc

SEQ ID NO: 42748 - DNA, 22 bp, Homo sapiens
gttgacagtgaccctgaaagca

SEQ ID NO: 42749 - DNA, 22 bp, Homo sapiens
cccatgaggtggaggttgcagt

SEQ ID NO: 42750 - DNA, 22 bp, Homo sapiens
aggtgggcggattcatgaggtc

SEQ ID NO: 42751 - DNA, 22 bp, Homo sapiens
ggaggctgaggcaggcggatca

SEQ ID NO: 42752 - DNA, 22 bp, Homo sapiens
cacaaaccttctgcagcctgta

SEQ ID NO: 42753 - DNA, 22 bp, Homo sapiens
gagagagctctgtgcctgggat

SEQ ID NO: 42754 - DNA, 22 bp, Homo sapiens
gcgaggaggggtgctgggcccc

SEQ ID NO: 42755 - DNA, 22 bp, Homo sapiens
atcacagttttaccatttggta

SEQ ID NO: 42756 - DNA, 22 bp, Homo sapiens
aagagggctgcaatcttattgc

SEQ ID NO: 42757 - DNA, 22 bp, Homo sapiens
cgtctggcttctccacggtaaa

SEQ ID NO: 42758 - DNA, 23 bp, Homo sapiens
ctggggctttcaaatctgggcag

SEQ ID NO: 42759 - DNA, 22 bp, Homo sapiens
gggaggcacgaggcgcgcagtg

SEQ ID NO: 42760 - DNA, 22 bp, Homo sapiens
atgctgtttgcttttagtctgc

SEQ ID NO: 42761 - DNA, 22 bp, Homo sapiens
gtggaggagaggcgccttgcgg

SEQ ID NO: 42762 - DNA, 22 bp, Homo sapiens
cctcggggcaccgcggcctgct

SEQ ID NO: 42763 - DNA, 22 bp, Homo sapiens
catggtgggtgtagtttccgcc

SEQ ID NO: 42764 - DNA, 22 bp, Homo sapiens
cataatttctaccagggccata

SEQ ID NO: 42765 - DNA, 23 bp, Homo sapiens
cgcccagcctcagtgacctgggc

SEQ ID NO: 42766 - DNA, 23 bp, Homo sapiens
atgacactcctgtgcgcaccctg

SEQ ID NO: 42767 - DNA, 22 bp, Homo sapiens
tttcataatactgtacatgaaa

SEQ ID NO: 42768 - DNA, 22 bp, Homo sapiens
agctggggctgtggttgtgatt

SEQ ID NO: 42769 - DNA, 22 bp, Homo sapiens
agaggaagtaatcaggacctgc

SEQ ID NO: 42770 - DNA, 22 bp, Homo sapiens
tgagagcctgtgttcaaatgcc

SEQ ID NO: 42771 - DNA, 22 bp, Homo sapiens
actccacatttgaacacagttc

SEQ ID NO: 42772 - DNA, 22 bp, Homo sapiens
agtgtgttgtaggctcaaatgg

SEQ ID NO: 42773 - DNA, 22 bp, Homo sapiens
cacgcacgctgggtggaggcgc

SEQ ID NO: 42774 - DNA, 22 bp, Homo sapiens
tgtcaatatgtaataactgaat

SEQ ID NO: 42775 - DNA, 22 bp, Homo sapiens
ttgcaattgctatggagagcgt

SEQ ID NO: 42776 - DNA, 22 bp, Homo sapiens
ggcccaggctggagtgcagtgg

SEQ ID NO: 42777 - DNA, 20 bp, Homo sapiens
caaatccctgctctgtgctg

SEQ ID NO: 42778 - DNA, 22 bp, Homo sapiens
ttttaagttggattgctaagta

SEQ ID NO: 42779 - DNA, 22 bp, Homo sapiens
gagacacaggcacagaagaggc

SEQ ID NO: 42780 - DNA, 22 bp, Homo sapiens
caggctggagtgcagtggcgcc

SEQ ID NO: 42781 - DNA, 22 bp, Homo sapiens
gaggtggccaagcgaggaaggg

SEQ ID NO: 42782 - DNA, 22 bp, Homo sapiens
ttttctgtttgcttcaagacat

SEQ ID NO: 42783 - DNA, 22 bp, Homo sapiens
ttgagcatctgaggattttcct

SEQ ID NO: 42784 - DNA, 22 bp, Homo sapiens
atgttatgtctgggaaggggta

SEQ ID NO: 42785 - DNA, 22 bp, Homo sapiens
cagtggccaacttcctgcctct

SEQ ID NO: 42786 - DNA, 22 bp, Homo sapiens
tggtgctgccaggctcctgcca

SEQ ID NO: 42787 - DNA, 16 bp, Homo sapiens
tgggtgggaggagcgg

SEQ ID NO: 42788 - DNA, 21 bp, Homo sapiens
ggcctcccggaccgcagcgcc

SEQ ID NO: 42789 - DNA, 22 bp, Homo sapiens
ttcccaggaagcctctccaagc

SEQ ID NO: 42790 - DNA, 22 bp, Homo sapiens
aagaagcaggtcacagacaggg

SEQ ID NO: 42791 - DNA, 22 bp, Homo sapiens
tcaccagatctctctgtaatgg

SEQ ID NO: 42792 - DNA, 19 bp, Homo sapiens
ggagccgccgcccttcatt

SEQ ID NO: 42793 - DNA, 22 bp, Homo sapiens
cctgcaccacaaggcttcagag

SEQ ID NO: 42794 - DNA, 22 bp, Homo sapiens
gcgagggcacgcggttgaaggc

SEQ ID NO: 42795 - DNA, 22 bp, Homo sapiens
aaaagagcttggttgattttgc

SEQ ID NO: 42796 - DNA, 22 bp, Homo sapiens
attgaaaataaggccagaaaca

SEQ ID NO: 42797 - DNA, 22 bp, Homo sapiens
tcaggggcttgaggtgcatgtc

SEQ ID NO: 42798 - DNA, 22 bp, Homo sapiens
aggtgggcgctgctcccgctgg

SEQ ID NO: 42799 - DNA, 22 bp, Homo sapiens
atatattttttgagacagagtc

SEQ ID NO: 42800 - DNA, 22 bp, Homo sapiens
cactgggcgtgtcctgggtgag

SEQ ID NO: 42801 - DNA, 22 bp, Homo sapiens
ggaggagacagtaaaaagcacg

SEQ ID NO: 42802 - DNA, 22 bp, Homo sapiens
gggcggggggagctggaatgaa

SEQ ID NO: 42803 - DNA, 22 bp, Homo sapiens
gagccaggtcgggccgcggcga

SEQ ID NO: 42804 - DNA, 22 bp, Homo sapiens
ccaggctggagtgcaatggcgt

SEQ ID NO: 42805 - DNA, 22 bp, Homo sapiens
ctgaagcagggagtgatgaagt

SEQ ID NO: 42806 - DNA, 22 bp, Homo sapiens
ttctgattgctgatgaggccca

SEQ ID NO: 42807 - DNA, 22 bp, Homo sapiens
tgggcggactcgggcatggaat

SEQ ID NO: 42808 - DNA, 22 bp, Homo sapiens
gtctatatattgcttgaataat

SEQ ID NO: 42809 - DNA, 22 bp, Homo sapiens
ggggatggaggcgtgtggtcct

SEQ ID NO: 42810 - DNA, 22 bp, Homo sapiens
tgggggtgtcctggtgcacaca

SEQ ID NO: 42811 - DNA, 20 bp, Homo sapiens
ctgggtggcaagcaaggggg

SEQ ID NO: 42812 - DNA, 20 bp, Homo sapiens
ataaaataactgccacaaga

SEQ ID NO: 42813 - DNA, 22 bp, Homo sapiens
atgaccagccgagataaacaga

SEQ ID NO: 42814 - DNA, 22 bp, Homo sapiens
gcaggcagaggtggaggagaca

SEQ ID NO: 42815 - DNA, 22 bp, Homo sapiens
gggctagcctcttccctgctcc

SEQ ID NO: 42816 - DNA, 22 bp, Homo sapiens
cgggcagcggcgtggccatggt

SEQ ID NO: 42817 - DNA, 22 bp, Homo sapiens
ctggagggctgcagcgaggctg

SEQ ID NO: 42818 - DNA, 22 bp, Homo sapiens
ggcaggaggtgagtggcgggtg

SEQ ID NO: 42819 - DNA, 22 bp, Homo sapiens
gcaggtggatcaccacgtcagg

SEQ ID NO: 42820 - DNA, 22 bp, Homo sapiens
agtgagagtattaatgtgaact

SEQ ID NO: 42821 - DNA, 22 bp, Homo sapiens
tcagcctccgaaagtgctggga

SEQ ID NO: 42822 - DNA, 20 bp, Homo sapiens
ggtggccgtagcgggcggcg

SEQ ID NO: 42823 - DNA, 22 bp, Homo sapiens
ctgagcatcatggcagaatctt

SEQ ID NO: 42824 - DNA, 22 bp, Homo sapiens
ctcacagtctgcctttcccttg

SEQ ID NO: 42825 - DNA, 22 bp, Homo sapiens
tgctgggggtagctctgcgtag

SEQ ID NO: 42826 - DNA, 22 bp, Homo sapiens
ccaggctgctgttggtgtccgc

SEQ ID NO: 42827 - DNA, 22 bp, Homo sapiens
tgagtgtggggaatgtcatgag

SEQ ID NO: 42828 - DNA, 22 bp, Homo sapiens
agcctattccaggatgagctca

SEQ ID NO: 42829 - DNA, 22 bp, Homo sapiens
ggaggcggaagttgcagtgagc

SEQ ID NO: 42830 - DNA, 22 bp, Homo sapiens
tgaggcaggagaatcaccggaa

SEQ ID NO: 42831 - DNA, 22 bp, Homo sapiens
aaccattcactgaacagttcaa

SEQ ID NO: 42832 - DNA, 22 bp, Homo sapiens
tgcagcctggcttcgcgcctcc

SEQ ID NO: 42833 - DNA, 22 bp, Homo sapiens
tgcctgtggaaaggctggtgct

SEQ ID NO: 42834 - DNA, 22 bp, Homo sapiens
gcccaggctggagtgcagtggc

SEQ ID NO: 42835 - DNA, 22 bp, Homo sapiens
cttcagctgcagttatgtttag

SEQ ID NO: 42836 - DNA, 23 bp, Homo sapiens
atgtttgcagtaacccatcctgg

SEQ ID NO: 42837 - DNA, 22 bp, Homo sapiens
tgcgcggctcagtcatctccag

SEQ ID NO: 42838 - DNA, 21 bp, Homo sapiens
gggcagaggggcctcctgggt

SEQ ID NO: 42839 - DNA, 22 bp, Homo sapiens
gcaggtggatcacctgaggtca

SEQ ID NO: 42840 - DNA, 22 bp, Homo sapiens
ggggtggatttcaggcggtgtc

SEQ ID NO: 42841 - DNA, 21 bp, Homo sapiens
atcagggatgggttggacacc

SEQ ID NO: 42842 - DNA, 22 bp, Homo sapiens
gaggagctgcccgtgtgtctgc

SEQ ID NO: 42843 - DNA, 22 bp, Homo sapiens
gcagatggatgtggacggcgcc

SEQ ID NO: 42844 - DNA, 22 bp, Homo sapiens
gtggcccaggctggagtgcagt

SEQ ID NO: 42845 - DNA, 22 bp, Homo sapiens
ttcctttctctggactgcagcc

SEQ ID NO: 42846 - DNA, 20 bp, Homo sapiens
gggcagagccagccagtccc

SEQ ID NO: 42847 - DNA, 22 bp, Homo sapiens
tctgcgtgaaactagatggcag

SEQ ID NO: 42848 - DNA, 22 bp, Homo sapiens
atataatttttggttagctcaa

SEQ ID NO: 42849 - DNA, 22 bp, Homo sapiens
tccggcggccggcctgagcccg

SEQ ID NO: 42850 - DNA, 22 bp, Homo sapiens
gcgggttgaagggcgcatcgaa

SEQ ID NO: 42851 - DNA, 22 bp, Homo sapiens
aaatgcctcattttctctcact

SEQ ID NO: 42852 - DNA, 22 bp, Homo sapiens
gcggggcccggacccagcctct

SEQ ID NO: 42853 - DNA, 22 bp, Homo sapiens
ggaggcagaatagagtgtgggt

SEQ ID NO: 42854 - DNA, 22 bp, Homo sapiens
gcggggcctgactctgacccgc

SEQ ID NO: 42855 - DNA, 22 bp, Homo sapiens
gaggtgggtgtatcacaggtca

SEQ ID NO: 42856 - DNA, 23 bp, Homo sapiens
acagcaagaggaccagatgtgag

SEQ ID NO: 42857 - DNA, 22 bp, Homo sapiens
ctgggcgcgtcccctgaggcgg

SEQ ID NO: 42858 - DNA, 22 bp, Homo sapiens
attgagaagaaaatctaatata

SEQ ID NO: 42859 - DNA, 22 bp, Homo sapiens
gctcgcgccgcaccggtccacc

SEQ ID NO: 42860 - DNA, 22 bp, Homo sapiens
agggagcattgtgacatatcac

SEQ ID NO: 42861 - DNA, 22 bp, Homo sapiens
taaatgttgtaagtacatctaa

SEQ ID NO: 42862 - DNA, 22 bp, Homo sapiens
cactgcactccagcctgggtga

SEQ ID NO: 42863 - DNA, 22 bp, Homo sapiens
ggctctgcgcctgcggggactt

SEQ ID NO: 42864 - DNA, 22 bp, Homo sapiens
gagctgggcctgcgagtgctgc

SEQ ID NO: 42865 - DNA, 22 bp, Homo sapiens
ggaggggatttagtagatgcta

SEQ ID NO: 42866 - DNA, 22 bp, Homo sapiens
tctgctcagccgatctgctccg

SEQ ID NO: 42867 - DNA, 21 bp, Homo sapiens
aaactgaccttgcctgagaca

SEQ ID NO: 42868 - DNA, 22 bp, Homo sapiens
ccgggcgggggctctcgtcacc

SEQ ID NO: 42869 - DNA, 22 bp, Homo sapiens
caggtgttggaagggcagtggg

SEQ ID NO: 42870 - DNA, 22 bp, Homo sapiens
ggcgtgggcgaggtgctctatc

SEQ ID NO: 42871 - DNA, 22 bp, Homo sapiens
tgagatgtaaggtatgcttact

SEQ ID NO: 42872 - DNA, 22 bp, Homo sapiens
tttgaaatgtatcagtataggt

SEQ ID NO: 42873 - DNA, 22 bp, Homo sapiens
agaaaacataggagacaggaaa

SEQ ID NO: 42874 - DNA, 22 bp, Homo sapiens
tgtcatggggttgttttgtaca

SEQ ID NO: 42875 - DNA, 22 bp, Homo sapiens
cagaggatatactatctggaaa

SEQ ID NO: 42876 - DNA, 22 bp, Homo sapiens
ctgggaggcggaggttgcagtg

SEQ ID NO: 42877 - DNA, 22 bp, Homo sapiens
aagcatttcaggtagagatatt

SEQ ID NO: 42878 - DNA, 22 bp, Homo sapiens
ggagcagggaattacagcgcag

SEQ ID NO: 42879 - DNA, 22 bp, Homo sapiens
ggaggcccagaaggaagcccag

SEQ ID NO: 42880 - DNA, 22 bp, Homo sapiens
gaagccttgaactgcaaacccc

SEQ ID NO: 42881 - DNA, 22 bp, Homo sapiens
cccacacacatttatgatagga

SEQ ID NO: 42882 - DNA, 22 bp, Homo sapiens
gttgtgattgtagctaaactag

SEQ ID NO: 42883 - DNA, 22 bp, Homo sapiens
gatggcacacagacatccccgc

SEQ ID NO: 42884 - DNA, 22 bp, Homo sapiens
tggtccttctgtcttccgcacc

SEQ ID NO: 42885 - DNA, 22 bp, Homo sapiens
agggactatttacccatctcac

SEQ ID NO: 42886 - DNA, 22 bp, Homo sapiens
atgccactgcacttcagcttgg

SEQ ID NO: 42887 - DNA, 21 bp, Homo sapiens
cactccacttagaacagggtt

SEQ ID NO: 42888 - DNA, 22 bp, Homo sapiens
tacaacaatttccacattagaa

SEQ ID NO: 42889 - DNA, 22 bp, Homo sapiens
aactcactttgtggcttctgaa

SEQ ID NO: 42890 - DNA, 22 bp, Homo sapiens
tttctcctcatgactggttgtg

SEQ ID NO: 42891 - DNA, 22 bp, Homo sapiens
tgttcagaacaaaggtaaatga

SEQ ID NO: 42892 - DNA, 22 bp, Homo sapiens
gttactcttgagaggctgaggt

SEQ ID NO: 42893 - DNA, 22 bp, Homo sapiens
gttgcagatgtggaactcgtgc

SEQ ID NO: 42894 - DNA, 22 bp, Homo sapiens
atgccacttcattccagcctcg

SEQ ID NO: 42895 - DNA, 22 bp, Homo sapiens
gtggtgtaggtcacagttagga

SEQ ID NO: 42896 - DNA, 22 bp, Homo sapiens
atacaaaatatatactggagac

SEQ ID NO: 42897 - DNA, 22 bp, Homo sapiens
tatccaattcaccattgatggg

SEQ ID NO: 42898 - DNA, 22 bp, Homo sapiens
tcagtatcaatagcgtcacaat

SEQ ID NO: 42899 - DNA, 22 bp, Homo sapiens
acaattctgatggtttcccagt

SEQ ID NO: 42900 - DNA, 22 bp, Homo sapiens
atgccactgcactccagcctgg

SEQ ID NO: 42901 - DNA, 22 bp, Homo sapiens
ttcaccatgttggccaggctgg

SEQ ID NO: 42902 - DNA, 21 bp, Homo sapiens
ggagtttttctggaagggact

SEQ ID NO: 42903 - DNA, 22 bp, Homo sapiens
ccaccagctgcatatgcacgta

SEQ ID NO: 42904 - DNA, 22 bp, Homo sapiens
tgttgactcaacactgtgggca

SEQ ID NO: 42905 - DNA, 23 bp, Homo sapiens
tgttccagatacgccttttcctc

SEQ ID NO: 42906 - DNA, 22 bp, Homo sapiens
taggattccagaacagtgctgc

SEQ ID NO: 42907 - DNA, 22 bp, Homo sapiens
caggagatgacagggaagaacc

SEQ ID NO: 42908 - DNA, 22 bp, Homo sapiens
ttgctgacctttgctctccgtt

SEQ ID NO: 42909 - DNA, 22 bp, Homo sapiens
acagagacacggaagctaaaga

SEQ ID NO: 42910 - DNA, 22 bp, Homo sapiens
gtgagccgagtatagttcatag

SEQ ID NO: 42911 - DNA, 21 bp, Homo sapiens
agtagtttagcacagggtttg

SEQ ID NO: 42912 - DNA, 22 bp, Homo sapiens
gtgtttgttcgtgactccaaag

SEQ ID NO: 42913 - DNA, 22 bp, Homo sapiens
aagaataagaggatttagaaca

SEQ ID NO: 42914 - DNA, 22 bp, Homo sapiens
cgttttcatgggtagaggttct

SEQ ID NO: 42915 - DNA, 22 bp, Homo sapiens
atgccactgcactccagcctag

SEQ ID NO: 42916 - DNA, 23 bp, Homo sapiens
ttaaacactagttcgagtagcat

SEQ ID NO: 42917 - DNA, 22 bp, Homo sapiens
tgttcttgagcctttagaccta

SEQ ID NO: 42918 - DNA, 22 bp, Homo sapiens
tctgttgcaatgtgcatggtga

SEQ ID NO: 42919 - DNA, 22 bp, Homo sapiens
taaatgttgtaagtacatctaa

SEQ ID NO: 42920 - DNA, 22 bp, Homo sapiens
aaagaaatagatggcatttaaa

SEQ ID NO: 42921 - DNA, 22 bp, Homo sapiens
tttgtcttatccaatctctcag

SEQ ID NO: 42922 - DNA, 22 bp, Homo sapiens
ttcttctttccaattacatggt

SEQ ID NO: 42923 - DNA, 22 bp, Homo sapiens
ctggagagaatgtggaatgatt

SEQ ID NO: 42924 - DNA, 22 bp, Homo sapiens
tttaaaaaactagtctgagtct

SEQ ID NO: 42925 - DNA, 22 bp, Homo sapiens
gcaaagaatgcagatttgcctc

SEQ ID NO: 42926 - DNA, 22 bp, Homo sapiens
gcggggttccgtgccccagagt

SEQ ID NO: 42927 - DNA, 21 bp, Homo sapiens
gtggttctagagaaacagaat

SEQ ID NO: 42928 - DNA, 22 bp, Homo sapiens
ttcagagaattggataattcgt

SEQ ID NO: 42929 - DNA, 22 bp, Homo sapiens
agttttcattaccatgctgcaa

SEQ ID NO: 42930 - DNA, 23 bp, Homo sapiens
tctctgcatgtcctgagcacatc

SEQ ID NO: 42931 - DNA, 22 bp, Homo sapiens
gctgggttttcttccgggccta

SEQ ID NO: 42932 - DNA, 22 bp, Homo sapiens
tgatatgtccctcgacatcagg

SEQ ID NO: 42933 - DNA, 22 bp, Homo sapiens
atgccactgcgctccagcctgg

SEQ ID NO: 42934 - DNA, 20 bp, Homo sapiens
gttaggaggttggacatgga

SEQ ID NO: 42935 - DNA, 22 bp, Homo sapiens
ggttttcacctccagaatgtgc

SEQ ID NO: 42936 - DNA, 22 bp, Homo sapiens
tcaaatgaagacagttgacttg

SEQ ID NO: 42937 - DNA, 22 bp, Homo sapiens
ccagctttatagcttcaaagga

SEQ ID NO: 42938 - DNA, 22 bp, Homo sapiens
actatagatgctggcgaggctg

SEQ ID NO: 42939 - DNA, 19 bp, Homo sapiens
ggagccgccgcccttcatt

SEQ ID NO: 42940 - DNA, 22 bp, Homo sapiens
ttgtcttttgtgggaaatatgg

SEQ ID NO: 42941 - DNA, 22 bp, Homo sapiens
atttaagggatttggagaccaa

SEQ ID NO: 42942 - DNA, 22 bp, Homo sapiens
actccacatttgaacacagttc

SEQ ID NO: 42943 - DNA, 22 bp, Homo sapiens
gagaaatgcatgcatgtcatca

SEQ ID NO: 42944 - DNA, 22 bp, Homo sapiens
tcagggctgcagaagaggcagg

SEQ ID NO: 42945 - DNA, 22 bp, Homo sapiens
gataccagacagggagggagaa

SEQ ID NO: 42946 - DNA, 22 bp, Homo sapiens
agttggcactgagctgtgattg

SEQ ID NO: 42947 - DNA, 22 bp, Homo sapiens
tgcacgtgggctctctgctctt

SEQ ID NO: 42948 - DNA, 22 bp, Homo sapiens
ctcaggacggccgggggagcct

SEQ ID NO: 42949 - DNA, 22 bp, Homo sapiens
accatgttggccaagctggtct

SEQ ID NO: 42950 - DNA, 22 bp, Homo sapiens
gaggttggggctgcagtgagct

SEQ ID NO: 42951 - DNA, 22 bp, Homo sapiens
ggatgttctggggttctcttgt

SEQ ID NO: 42952 - DNA, 22 bp, Homo sapiens
ttctcttacattttctcagcct

SEQ ID NO: 42953 - DNA, 22 bp, Homo sapiens
catccaccgcgtgcacctctac

SEQ ID NO: 42954 - DNA, 22 bp, Homo sapiens
aggaaataggaccagacaaagc

SEQ ID NO: 42955 - DNA, 22 bp, Homo sapiens
gggttcagtccctcttgctact

SEQ ID NO: 42956 - DNA, 22 bp, Homo sapiens
ttctggaaggatgtttctatct

SEQ ID NO: 42957 - DNA, 22 bp, Homo sapiens
cagcagcattgctctggattcc

SEQ ID NO: 42958 - DNA, 21 bp, Homo sapiens
tcacgtggtcacatgagcttt

SEQ ID NO: 42959 - DNA, 22 bp, Homo sapiens
atgattagttaccttgatttaa

SEQ ID NO: 42960 - DNA, 22 bp, Homo sapiens
agcttgtagaaggccacgagca

SEQ ID NO: 42961 - DNA, 17 bp, Homo sapiens
ggcctgcacctcctgct

SEQ ID NO: 42962 - DNA, 22 bp, Homo sapiens
gcgccccatctacagtactttt

SEQ ID NO: 42963 - DNA, 22 bp, Homo sapiens
gaggcctcagcctgccctgaac

SEQ ID NO: 42964 - DNA, 22 bp, Homo sapiens
gggaggaggaatgttttgtgta

SEQ ID NO: 42965 - DNA, 22 bp, Homo sapiens
ctccaggccatggctgcggagg

SEQ ID NO: 42966 - DNA, 22 bp, Homo sapiens
accctcaagatggaagcagttt

SEQ ID NO: 42967 - DNA, 23 bp, Homo sapiens
gggggccgtcctggggattatag

SEQ ID NO: 42968 - DNA, 22 bp, Homo sapiens
actgttgaagtgccagcttgat

SEQ ID NO: 42969 - DNA, 22 bp, Homo sapiens
caggaggttgagggtgcagtga

SEQ ID NO: 42970 - DNA, 21 bp, Homo sapiens
ggccagtggaattttatgtca

SEQ ID NO: 42971 - DNA, 21 bp, Homo sapiens
ccaccaggtcttctgctcggg

SEQ ID NO: 42972 - DNA, 22 bp, Homo sapiens
ctgctctgctgatcagtgtctc

SEQ ID NO: 42973 - DNA, 22 bp, Homo sapiens
caaatgtataaatgtactttct

SEQ ID NO: 42974 - DNA, 16 bp, Homo sapiens
ccacctgcagctctca

SEQ ID NO: 42975 - DNA, 22 bp, Homo sapiens
tgaggaaacttacaaggcagaa

SEQ ID NO: 42976 - DNA, 19 bp, Homo sapiens
aggattccagaacagtgtt

SEQ ID NO: 42977 - DNA, 21 bp, Homo sapiens
cggaaaggactagggctcaga

SEQ ID NO: 42978 - DNA, 22 bp, Homo sapiens
tcgttaatcagcaccagaattc

SEQ ID NO: 42979 - DNA, 22 bp, Homo sapiens
caagcttgtttctcctgggggt

SEQ ID NO: 42980 - DNA, 22 bp, Homo sapiens
agagttgctccattagaactta

SEQ ID NO: 42981 - DNA, 19 bp, Homo sapiens
ttactatgtgacaagcact

SEQ ID NO: 42982 - DNA, 20 bp, Homo sapiens
gggcagagccagccagtccc

SEQ ID NO: 42983 - DNA, 22 bp, Homo sapiens
ggggtggatttcaggcggtgtc

SEQ ID NO: 42984 - DNA, 22 bp, Homo sapiens
cagagggttgatgtgaggctta

SEQ ID NO: 42985 - DNA, 22 bp, Homo sapiens
gaccttgtgatctgcccacctt

SEQ ID NO: 42986 - DNA, 22 bp, Homo sapiens
tcacttagatggggatcatcac

SEQ ID NO: 42987 - DNA, 20 bp, Homo sapiens
atggggtgagtgacgccctc

SEQ ID NO: 42988 - DNA, 17 bp, Homo sapiens
tggtccaggtggagcca

SEQ ID NO: 42989 - DNA, 22 bp, Homo sapiens
ttgtgctctgtgttatttaagg

SEQ ID NO: 42990 - DNA, 22 bp, Homo sapiens
gtgtatgttctacttaatatta

SEQ ID NO: 42991 - DNA, 22 bp, Homo sapiens
ctggtaggggtgactgttatcg

SEQ ID NO: 42992 - DNA, 23 bp, Homo sapiens
tgaatgtttattctcggtgcaga

SEQ ID NO: 42993 - DNA, 22 bp, Homo sapiens
gctgacccctacaggttgtgtt

SEQ ID NO: 42994 - DNA, 22 bp, Homo sapiens
aggcaggaggatcatggatgca

SEQ ID NO: 42995 - DNA, 22 bp, Homo sapiens
gagcccaggagtttgatgctgc

SEQ ID NO: 42996 - DNA, 22 bp, Homo sapiens
agcattccacactgaagtctgc

SEQ ID NO: 42997 - DNA, 22 bp, Homo sapiens
atttattcctttatggctggag

SEQ ID NO: 42998 - DNA, 22 bp, Homo sapiens
ggcagggagtggagactcccta

SEQ ID NO: 42999 - DNA, 22 bp, Homo sapiens
ttatcacttatgagctttttgc

SEQ ID NO: 43000 - DNA, 22 bp, Homo sapiens
gtgattttctcctcctagaagt

SEQ ID NO: 43001 - DNA, 22 bp, Homo sapiens
gaggtgggcggatcacaaggtc

SEQ ID NO: 43002 - DNA, 15 bp, Homo sapiens
tctagttttgaagac

SEQ ID NO: 43003 - DNA, 22 bp, Homo sapiens
ctcagcagtatactctgaagat

SEQ ID NO: 43004 - DNA, 22 bp, Homo sapiens
tccagggagagccgctgctcca

SEQ ID NO: 43005 - DNA, 22 bp, Homo sapiens
ggagaagaggagctggaagcct

SEQ ID NO: 43006 - DNA, 23 bp, Homo sapiens
tgctggagaagcaaagttctgag

SEQ ID NO: 43007 - DNA, 22 bp, Homo sapiens
gggacaatggaggcctctctcc

SEQ ID NO: 43008 - DNA, 22 bp, Homo sapiens
tcctttaaacaaccagctctca

SEQ ID NO: 43009 - DNA, 22 bp, Homo sapiens
ttaccaaatgaaatagagattt

SEQ ID NO: 43010 - DNA, 21 bp, Homo sapiens
gttctacagttttagaattcc

SEQ ID NO: 43011 - DNA, 22 bp, Homo sapiens
ctgggcacagcgttgggctctt

SEQ ID NO: 43012 - DNA, 22 bp, Homo sapiens
tgggctgcaggggttgagagct

SEQ ID NO: 43013 - DNA, 22 bp, Homo sapiens
ggagagtggattccagctgtat

SEQ ID NO: 43014 - DNA, 22 bp, Homo sapiens
agtgcactggcaccatctcagc

SEQ ID NO: 43015 - DNA, 22 bp, Homo sapiens
ctcattgcccagatccccacag

SEQ ID NO: 43016 - DNA, 22 bp, Homo sapiens
aacccgggaggcggaggttgtg

SEQ ID NO: 43017 - DNA, 22 bp, Homo sapiens
ctcactgcaagctctgcctccc

SEQ ID NO: 43018 - DNA, 20 bp, Homo sapiens
gttaggaggttggacatgga

SEQ ID NO: 43019 - DNA, 22 bp, Homo sapiens
ctgggaggcggagcttgcagtg

SEQ ID NO: 43020 - DNA, 22 bp, Homo sapiens
tcactggaaagacagcactctt

SEQ ID NO: 43021 - DNA, 22 bp, Homo sapiens
cctccctgccggctggactagt

SEQ ID NO: 43022 - DNA, 22 bp, Homo sapiens
ccttcattcattaatttagccc

SEQ ID NO: 43023 - DNA, 22 bp, Homo sapiens
gagcacagtaaagcagtgtcac

SEQ ID NO: 43024 - DNA, 22 bp, Homo sapiens
gagcagtgtttgtggacctgga

SEQ ID NO: 43025 - DNA, 22 bp, Homo sapiens
acctagaatttaaaacattgct

SEQ ID NO: 43026 - DNA, 22 bp, Homo sapiens
gaggctgaggttgcagtgagcc

SEQ ID NO: 43027 - DNA, 22 bp, Homo sapiens
cctggaggcggaggttgcagtg

SEQ ID NO: 43028 - DNA, 22 bp, Homo sapiens
aagaggtttaactgactcacag

SEQ ID NO: 43029 - DNA, 22 bp, Homo sapiens
tggctgtgtccctgtccagagt

SEQ ID NO: 43030 - DNA, 22 bp, Homo sapiens
caggctggagtacaattgtgtg

SEQ ID NO: 43031 - DNA, 22 bp, Homo sapiens
ctctctgggcccagttggcacc

SEQ ID NO: 43032 - DNA, 22 bp, Homo sapiens
tacccaaggccctttcaatttc

SEQ ID NO: 43033 - DNA, 22 bp, Homo sapiens
tgcaagctgacatccagagaga

SEQ ID NO: 43034 - DNA, 22 bp, Homo sapiens
atggggagctcaccacctgttt

SEQ ID NO: 43035 - DNA, 22 bp, Homo sapiens
ttggagaggcagtcttgctctg

SEQ ID NO: 43036 - DNA, 22 bp, Homo sapiens
gtgggttcgtggtctcgctggc

SEQ ID NO: 43037 - DNA, 22 bp, Homo sapiens
aagtgctgggattataggcatg

SEQ ID NO: 43038 - DNA, 22 bp, Homo sapiens
gaaggtggcgagcggattgctg

SEQ ID NO: 43039 - DNA, 22 bp, Homo sapiens
cttagagatgggttttacttag

SEQ ID NO: 43040 - DNA, 22 bp, Homo sapiens
cagtgcttttaaaacaacatca

SEQ ID NO: 43041 - DNA, 22 bp, Homo sapiens
tctgtgcctgcttccccaccca

SEQ ID NO: 43042 - DNA, 22 bp, Homo sapiens
ctgggtggcagagcctgcagtg

SEQ ID NO: 43043 - DNA, 22 bp, Homo sapiens
tcaagcaaagtttagctggtta

SEQ ID NO: 43044 - DNA, 22 bp, Homo sapiens
taaatcttctacatcatcataa

SEQ ID NO: 43045 - DNA, 22 bp, Homo sapiens
cattgcaacttcaaactcctgg

SEQ ID NO: 43046 - DNA, 22 bp, Homo sapiens
agccggccatgtggtcttgtgc

SEQ ID NO: 43047 - DNA, 22 bp, Homo sapiens
ctcgggcaccctggttctggtg

SEQ ID NO: 43048 - DNA, 22 bp, Homo sapiens
cccagcaggtcggtgctgcctg

SEQ ID NO: 43049 - DNA, 23 bp, Homo sapiens
ttgcatagacatcctcatagatt

SEQ ID NO: 43050 - DNA, 22 bp, Homo sapiens
gtccaggcctgcctctgaggag

SEQ ID NO: 43051 - DNA, 22 bp, Homo sapiens
aaggctccagtgaatgctggca

SEQ ID NO: 43052 - DNA, 22 bp, Homo sapiens
caggtgttggaagggcagtggg

SEQ ID NO: 43053 - DNA, 22 bp, Homo sapiens
tcggggtctttgacacgctctg

SEQ ID NO: 43054 - DNA, 22 bp, Homo sapiens
gtgtaagtatctttgtatcttt

SEQ ID NO: 43055 - DNA, 22 bp, Homo sapiens
gaggcagaagttgcagtgagca

SEQ ID NO: 43056 - DNA, 22 bp, Homo sapiens
gctcactgcctgggcaacaaga

SEQ ID NO: 43057 - DNA, 22 bp, Homo sapiens
ctgctccccagcctgcgccttt

SEQ ID NO: 43058 - DNA, 22 bp, Homo sapiens
agggaattcactggaacgccct

SEQ ID NO: 43059 - DNA, 22 bp, Homo sapiens
gtcacctcgctgtcttcctgag

SEQ ID NO: 43060 - DNA, 19 bp, Homo sapiens
gttctttcatagtaagagc

SEQ ID NO: 43061 - DNA, 22 bp, Homo sapiens
gctgcaagtgcatgttgcaact

SEQ ID NO: 43062 - DNA, 22 bp, Homo sapiens
ctctgcaacttctagcagtgtc

SEQ ID NO: 43063 - DNA, 22 bp, Homo sapiens
atttttctctttccactgagat

SEQ ID NO: 43064 - DNA, 22 bp, Homo sapiens
gccaggacctcagatgcagggc

SEQ ID NO: 43065 - DNA, 22 bp, Homo sapiens
actgcaacacctcctgggttca

SEQ ID NO: 43066 - DNA, 18 bp, Homo sapiens
ggtgagggagctggaagc

SEQ ID NO: 43067 - DNA, 22 bp, Homo sapiens
cacggcctgtaaggacccagga

SEQ ID NO: 43068 - DNA, 22 bp, Homo sapiens
gacaattagatcattcctttga

SEQ ID NO: 43069 - DNA, 22 bp, Homo sapiens
tgtgacaagcattgtatattgg

SEQ ID NO: 43070 - DNA, 22 bp, Homo sapiens
ccaggctggagtatagtggcgc

SEQ ID NO: 43071 - DNA, 22 bp, Homo sapiens
ccaggctagagtgcaatggcat

SEQ ID NO: 43072 - DNA, 22 bp, Homo sapiens
gtgcacttgatctagacagatt

SEQ ID NO: 43073 - DNA, 22 bp, Homo sapiens
tggcactgagcagccgcggcag

SEQ ID NO: 43074 - DNA, 22 bp, Homo sapiens
tgggggtgtcctggtgcacaca

SEQ ID NO: 43075 - DNA, 18 bp, Homo sapiens
agcctgtcccttctcctg

SEQ ID NO: 43076 - DNA, 22 bp, Homo sapiens
ggaggggatttagtagatgcta

SEQ ID NO: 43077 - DNA, 22 bp, Homo sapiens
gtgagcagagatcgcgtgattg

SEQ ID NO: 43078 - DNA, 22 bp, Homo sapiens
gctcactgcaacctctgcctcc

SEQ ID NO: 43079 - DNA, 22 bp, Homo sapiens
aatggccagacagatggctgct

SEQ ID NO: 43080 - DNA, 22 bp, Homo sapiens
tccgaggccaaagctgtgaata

SEQ ID NO: 43081 - DNA, 22 bp, Homo sapiens
tgttcttgagcctttagaccta

SEQ ID NO: 43082 - DNA, 22 bp, Homo sapiens
ccctggctggctctgcccggac

SEQ ID NO: 43083 - DNA, 22 bp, Homo sapiens
cgctgataaacgtcacgttccc

SEQ ID NO: 43084 - DNA, 22 bp, Homo sapiens
ctcactgcaagctctgcctcca

SEQ ID NO: 43085 - DNA, 22 bp, Homo sapiens
caggaggacatactggctcaca

SEQ ID NO: 43086 - DNA, 22 bp, Homo sapiens
actttatttcctattgcatcca

SEQ ID NO: 43087 - DNA, 22 bp, Homo sapiens
cacagtcctgccagagggcctt

SEQ ID NO: 43088 - DNA, 21 bp, Homo sapiens
gttcttgcaggatttccttcc

SEQ ID NO: 43089 - DNA, 22 bp, Homo sapiens
ggctgatgggcatgagctgtca

SEQ ID NO: 43090 - DNA, 22 bp, Homo sapiens
aagacacaatgtagcccagcac

SEQ ID NO: 43091 - DNA, 22 bp, Homo sapiens
aagagggctgcaatcttattgc

SEQ ID NO: 43092 - DNA, 22 bp, Homo sapiens
aaagtgctaggattacaagcgt

SEQ ID NO: 43093 - DNA, 22 bp, Homo sapiens
ctctgtagaaagagcccaggtg

SEQ ID NO: 43094 - DNA, 22 bp, Homo sapiens
ttgctaccattgataccagcac

SEQ ID NO: 43095 - DNA, 22 bp, Homo sapiens
atcagagtgtaagttctttcct

SEQ ID NO: 43096 - DNA, 22 bp, Homo sapiens
actgggcagcagctcgagccgc

SEQ ID NO: 43097 - DNA, 20 bp, Homo sapiens
gccactgggcaccagcaggg

SEQ ID NO: 43098 - DNA, 22 bp, Homo sapiens
cactgcactccagcactccagc

SEQ ID NO: 43099 - DNA, 22 bp, Homo sapiens
ggattgcaacaagctagtttag

SEQ ID NO: 43100 - DNA, 22 bp, Homo sapiens
tggctaacaaggtgaaaccccg

SEQ ID NO: 43101 - DNA, 22 bp, Homo sapiens
aaggctcggcaatgtgcggctc

SEQ ID NO: 43102 - DNA, 22 bp, Homo sapiens
tcattccctcattgttcactgg

SEQ ID NO: 43103 - DNA, 23 bp, Homo sapiens
gtgcgccaggacaacctgacgga

SEQ ID NO: 43104 - DNA, 22 bp, Homo sapiens
aacccaggaggcagatgttgtg

SEQ ID NO: 43105 - DNA, 22 bp, Homo sapiens
tgtacttgaacttgactgtaga

SEQ ID NO: 43106 - DNA, 22 bp, Homo sapiens
ttgagatggagtcttgctctct

SEQ ID NO: 43107 - DNA, 22 bp, Homo sapiens
ctggccagatgttacgtccaat

SEQ ID NO: 43108 - DNA, 22 bp, Homo sapiens
ctttggcaatgtcattttcaat

SEQ ID NO: 43109 - DNA, 22 bp, Homo sapiens
gcgtctcaaggcccccaggcca

SEQ ID NO: 43110 - DNA, 22 bp, Homo sapiens
ctggtctgccacccacacccct

SEQ ID NO: 43111 - DNA, 22 bp, Homo sapiens
gatgctgagaggtggagggaac

SEQ ID NO: 43112 - DNA, 22 bp, Homo sapiens
tcactgcaagctccacctcccg

SEQ ID NO: 43113 - DNA, 22 bp, Homo sapiens
aagagggctcgatttggcaaaa

SEQ ID NO: 43114 - DNA, 22 bp, Homo sapiens
cagtcaccttgaggactcagac

SEQ ID NO: 43115 - DNA, 22 bp, Homo sapiens
gcctcactgcagccccaggaag

SEQ ID NO: 43116 - DNA, 21 bp, Homo sapiens
ggcctcccggaccgcagcgcc

SEQ ID NO: 43117 - DNA, 22 bp, Homo sapiens
aagtgtgtgagcctgtcaggct

SEQ ID NO: 43118 - DNA, 22 bp, Homo sapiens
aaggcggggggatcacgaggtc

SEQ ID NO: 43119 - DNA, 22 bp, Homo sapiens
tcactgcaacctctgcctgcca

SEQ ID NO: 43120 - DNA, 22 bp, Homo sapiens
agggaaatctcagctctaaaat

SEQ ID NO: 43121 - DNA, 22 bp, Homo sapiens
ggctgtgtggccgtgggctcta

SEQ ID NO: 43122 - DNA, 22 bp, Homo sapiens
ggcatcgtcctgggcataggga

SEQ ID NO: 43123 - DNA, 22 bp, Homo sapiens
tcccccaggctggagtgcagtg

SEQ ID NO: 43124 - DNA, 22 bp, Homo sapiens
gagcccaggcagaggttgcagt

SEQ ID NO: 43125 - DNA, 22 bp, Homo sapiens
gcgctaggcaagtcctttcaac

SEQ ID NO: 43126 - DNA, 22 bp, Homo sapiens
aggaattcaagaccagctgggc

SEQ ID NO: 43127 - DNA, 22 bp, Homo sapiens
ggccctggtcctaggggtggaa

SEQ ID NO: 43128 - DNA, 22 bp, Homo sapiens
ttagggttacaccagcctcctg

SEQ ID NO: 43129 - DNA, 19 bp, Homo sapiens
gagcagtgaggaccaccag

SEQ ID NO: 43130 - DNA, 22 bp, Homo sapiens
atgtatacgtgcaggtcacagg

SEQ ID NO: 43131 - DNA, 22 bp, Homo sapiens
ttcaccatgttggccaggctgg

SEQ ID NO: 43132 - DNA, 22 bp, Homo sapiens
cgcggtggcggcctccagcgcc

SEQ ID NO: 43133 - DNA, 22 bp, Homo sapiens
cagagcccctcgtctccaccac

SEQ ID NO: 43134 - DNA, 22 bp, Homo sapiens
gagagtctagtgcacctagttt

SEQ ID NO: 43135 - DNA, 22 bp, Homo sapiens
tgagtccgaagttgcagtgagc

SEQ ID NO: 43136 - DNA, 22 bp, Homo sapiens
acagatgttgcttgtcattctc

SEQ ID NO: 43137 - DNA, 22 bp, Homo sapiens
tatgaggtaggtattatactta

SEQ ID NO: 43138 - DNA, 22 bp, Homo sapiens
ttctatttttgtggaactgtag

SEQ ID NO: 43139 - DNA, 22 bp, Homo sapiens
aggtggggaggagtgtctcttt

SEQ ID NO: 43140 - DNA, 18 bp, Homo sapiens
cttttcccctttggactc

SEQ ID NO: 43141 - DNA, 22 bp, Homo sapiens
gttgcagatgtggaactcgtgc

SEQ ID NO: 43142 - DNA, 22 bp, Homo sapiens
agccacacagcttaatgacaga

SEQ ID NO: 43143 - DNA, 22 bp, Homo sapiens
ctgagcagatgaccagccccag

SEQ ID NO: 43144 - DNA, 22 bp, Homo sapiens
ccagggtggcgtagatgctggg

SEQ ID NO: 43145 - DNA, 22 bp, Homo sapiens
caacatggtaaaaccccgtctc

SEQ ID NO: 43146 - DNA, 22 bp, Homo sapiens
ttgtggttaaccgcacattttt

SEQ ID NO: 43147 - DNA, 22 bp, Homo sapiens
actcccagaacatgctcttctt

SEQ ID NO: 43148 - DNA, 22 bp, Homo sapiens
tgggggagctcagtccagccca

SEQ ID NO: 43149 - DNA, 22 bp, Homo sapiens
gcagaagcacaggtgacgggcc

SEQ ID NO: 43150 - DNA, 22 bp, Homo sapiens
cagggcctcctaaggcatctaa

SEQ ID NO: 43151 - DNA, 22 bp, Homo sapiens
tgtgagttcttagaaagtcagt

SEQ ID NO: 43152 - DNA, 22 bp, Homo sapiens
tgaggcaggtggattacaaggt

SEQ ID NO: 43153 - DNA, 22 bp, Homo sapiens
ccccatgaagtagggtctctga

SEQ ID NO: 43154 - DNA, 22 bp, Homo sapiens
tcagtgccatgggcagacaggc

SEQ ID NO: 43155 - DNA, 22 bp, Homo sapiens
gttccaggtggtcacagagctc

SEQ ID NO: 43156 - DNA, 22 bp, Homo sapiens
gttaaggatcttgagatgagga

SEQ ID NO: 43157 - DNA, 22 bp, Homo sapiens
gtgcaggacagcacatctcctg

SEQ ID NO: 43158 - DNA, 22 bp, Homo sapiens
ggaactgaatgtctcggtataa

SEQ ID NO: 43159 - DNA, 22 bp, Homo sapiens
tgcccagggtggagtgcagtgg

SEQ ID NO: 43160 - DNA, 22 bp, Homo sapiens
gcttagtcaattataaataggc

SEQ ID NO: 43161 - DNA, 22 bp, Homo sapiens
cgtgggtcgggactccgcctcg

SEQ ID NO: 43162 - DNA, 22 bp, Homo sapiens
cactgcactccagctgggtgac

SEQ ID NO: 43163 - DNA, 22 bp, Homo sapiens
cctgtggcgggggccagtgcct

SEQ ID NO: 43164 - DNA, 22 bp, Homo sapiens
tggtagtcggcctcggtggctc

SEQ ID NO: 43165 - DNA, 18 bp, Homo sapiens
ggctcaagtgatcctcct

SEQ ID NO: 43166 - DNA, 22 bp, Homo sapiens
gcagggaggtttgctgacctgg

SEQ ID NO: 43167 - DNA, 22 bp, Homo sapiens
ttttcctggagatggagttgtt

SEQ ID NO: 43168 - DNA, 22 bp, Homo sapiens
tgtgtcccttggaacctcagct

SEQ ID NO: 43169 - DNA, 22 bp, Homo sapiens
tggcacaggatctcagcggcca

SEQ ID NO: 43170 - DNA, 22 bp, Homo sapiens
agggctggagccacagctggga

SEQ ID NO: 43171 - DNA, 22 bp, Homo sapiens
aagtgctgggattacaggtgtc

SEQ ID NO: 43172 - DNA, 22 bp, Homo sapiens
aataaacaaaggacaaggaggt

SEQ ID NO: 43173 - DNA, 22 bp, Homo sapiens
aggctctcaccctctgaccaga

SEQ ID NO: 43174 - DNA, 22 bp, Homo sapiens
tttgaagggcacgacaatagtt

SEQ ID NO: 43175 - DNA, 22 bp, Homo sapiens
gaggggcacagtaaagggtccc

SEQ ID NO: 43176 - DNA, 22 bp, Homo sapiens
tctaccctgcggtcttggggca

SEQ ID NO: 43177 - DNA, 22 bp, Homo sapiens
tgtggcacatacacaggagggc

SEQ ID NO: 43178 - DNA, 22 bp, Homo sapiens
tcactgcagcctctgcctcccg

SEQ ID NO: 43179 - DNA, 22 bp, Homo sapiens
taggctaggctgaaggttttgg

SEQ ID NO: 43180 - DNA, 22 bp, Homo sapiens
tcagtgatttctggggtgaggg

SEQ ID NO: 43181 - DNA, 22 bp, Homo sapiens
aacccaggagacaggttgcagt

SEQ ID NO: 43182 - DNA, 22 bp, Homo sapiens
tggggtacacgtggggcaggat

SEQ ID NO: 43183 - DNA, 22 bp, Homo sapiens
cataatttctaccagggccata

SEQ ID NO: 43184 - DNA, 22 bp, Homo sapiens
gggcttcagttctgaccatctt

SEQ ID NO: 43185 - DNA, 22 bp, Homo sapiens
atgaattgtccgatgttgtgca

SEQ ID NO: 43186 - DNA, 22 bp, Homo sapiens
gctatgggatgtgctgtggatg

SEQ ID NO: 43187 - DNA, 22 bp, Homo sapiens
gagccaagattgtgtccctgca

SEQ ID NO: 43188 - DNA, 22 bp, Homo sapiens
tctttggtttctgtctctgtaa

SEQ ID NO: 43189 - DNA, 22 bp, Homo sapiens
ggaggcggaggttgcagtgagc

SEQ ID NO: 43190 - DNA, 22 bp, Homo sapiens
taggcctggatctctgggagca

SEQ ID NO: 43191 - DNA, 22 bp, Homo sapiens
agcccggcttccccggttgcta

SEQ ID NO: 43192 - DNA, 22 bp, Homo sapiens
catgatctggtcctactgtggg

SEQ ID NO: 43193 - DNA, 22 bp, Homo sapiens
aggatgagccgcgcaagctgac

SEQ ID NO: 43194 - DNA, 22 bp, Homo sapiens
tatgacagtttcgtaggggttg

SEQ ID NO: 43195 - DNA, 22 bp, Homo sapiens
tgaaatgtgttctagtgttttg

SEQ ID NO: 43196 - DNA, 22 bp, Homo sapiens
ttattgaaggaactgaaataaa

SEQ ID NO: 43197 - DNA, 22 bp, Homo sapiens
tggtgcaaaactaattgcggtt

SEQ ID NO: 43198 - DNA, 22 bp, Homo sapiens
ttcttttaattgtgggggagtg

SEQ ID NO: 43199 - DNA, 22 bp, Homo sapiens
ggcgggaagttcttgcccactt

SEQ ID NO: 43200 - DNA, 23 bp, Homo sapiens
cagggccctgctcaatttctcca

SEQ ID NO: 43201 - DNA, 22 bp, Homo sapiens
tcagcctggcaggatggcctgg

SEQ ID NO: 43202 - DNA, 19 bp, Homo sapiens
tgaaggacagtgcacatca

SEQ ID NO: 43203 - DNA, 22 bp, Homo sapiens
tgtgaaagatactaggcagagg

SEQ ID NO: 43204 - DNA, 22 bp, Homo sapiens
cctcagctcccatgagatctgc

SEQ ID NO: 43205 - DNA, 22 bp, Homo sapiens
gccaggaaagggaattccctga

SEQ ID NO: 43206 - DNA, 22 bp, Homo sapiens
gcaaacaaggacatacatcctg

SEQ ID NO: 43207 - DNA, 22 bp, Homo sapiens
tggaatggaaacaaactgagga

SEQ ID NO: 43208 - DNA, 22 bp, Homo sapiens
ggagctcctggcagtgacagag

SEQ ID NO: 43209 - DNA, 22 bp, Homo sapiens
agcatttatcttttgtttgagt

SEQ ID NO: 43210 - DNA, 22 bp, Homo sapiens
tcaggaggcggaggttgcagtg

SEQ ID NO: 43211 - DNA, 22 bp, Homo sapiens
ctatggtgatagaaatcagaat

SEQ ID NO: 43212 - DNA, 22 bp, Homo sapiens
tgaagaaacgcagagaggtagg

SEQ ID NO: 43213 - DNA, 22 bp, Homo sapiens
tccacagtggttgaactagttt

SEQ ID NO: 43214 - DNA, 22 bp, Homo sapiens
tgggcgacagagcaagactccg

SEQ ID NO: 43215 - DNA, 22 bp, Homo sapiens
tgtgacgttgttctggattccc

SEQ ID NO: 43216 - DNA, 22 bp, Homo sapiens
ttgtgaatggtgccgcaataaa

SEQ ID NO: 43217 - DNA, 22 bp, Homo sapiens
tagcagaagttgcaaactaggg

SEQ ID NO: 43218 - DNA, 22 bp, Homo sapiens
ccaggaggcggaggttgcagcg

SEQ ID NO: 43219 - DNA, 22 bp, Homo sapiens
gccggggctggggagagacatg

SEQ ID NO: 43220 - DNA, 22 bp, Homo sapiens
caggcactgtgctgagctctgc

SEQ ID NO: 43221 - DNA, 22 bp, Homo sapiens
gctgctctcagagctcatgctg

SEQ ID NO: 43222 - DNA, 22 bp, Homo sapiens
tccttgtaaaggagctctaaca

SEQ ID NO: 43223 - DNA, 22 bp, Homo sapiens
aaagtgctgaaattacaggtgt

SEQ ID NO: 43224 - DNA, 22 bp, Homo sapiens
tcactgcgcttcagcctgggtg

SEQ ID NO: 43225 - DNA, 23 bp, Homo sapiens
cagtgtgacaaaacttattactt

SEQ ID NO: 43226 - DNA, 22 bp, Homo sapiens
ggcctcttatctggctcctgca

SEQ ID NO: 43227 - DNA, 22 bp, Homo sapiens
tgctgggggtagctctgcgtag

SEQ ID NO: 43228 - DNA, 22 bp, Homo sapiens
tgcctgataccctctgtctctc

SEQ ID NO: 43229 - DNA, 22 bp, Homo sapiens
ggaggcccagaaggaagcccag

SEQ ID NO: 43230 - DNA, 18 bp, Homo sapiens
ggagactaaactgttgac

SEQ ID NO: 43231 - DNA, 22 bp, Homo sapiens
cggccgcagcagtgtcggccca

SEQ ID NO: 43232 - DNA, 22 bp, Homo sapiens
accatgtcatttattggccaaa

SEQ ID NO: 43233 - DNA, 22 bp, Homo sapiens
ttattaggaactcaggattttt

SEQ ID NO: 43234 - DNA, 22 bp, Homo sapiens
agcggcgccggagggaggtgcg

SEQ ID NO: 43235 - DNA, 21 bp, Homo sapiens
tagcccttctccacctcgccc

SEQ ID NO: 43236 - DNA, 22 bp, Homo sapiens
ttgtgtgtactggttatgggca

SEQ ID NO: 43237 - DNA, 22 bp, Homo sapiens
caaagctggaaaaggaggctgg

SEQ ID NO: 43238 - DNA, 22 bp, Homo sapiens
ctggcaggtggaggttgcagtg

SEQ ID NO: 43239 - DNA, 22 bp, Homo sapiens
gtgctccctccttcctcaagga

SEQ ID NO: 43240 - DNA, 22 bp, Homo sapiens
ctgcagggagaggggacagcct

SEQ ID NO: 43241 - DNA, 22 bp, Homo sapiens
gcaggatgagtgagtacattta

SEQ ID NO: 43242 - DNA, 22 bp, Homo sapiens
gcagagtgctgtcgtacgcccc

SEQ ID NO: 43243 - DNA, 22 bp, Homo sapiens
gctcccaccttaaccttcacat

SEQ ID NO: 43244 - DNA, 22 bp, Homo sapiens
tttcccagcctcagctcagcag

SEQ ID NO: 43245 - DNA, 22 bp, Homo sapiens
tccgtggggcctgtggcttccg

SEQ ID NO: 43246 - DNA, 21 bp, Homo sapiens
tgcttgttctctgtccttgca

SEQ ID NO: 43247 - DNA, 22 bp, Homo sapiens
ggaagaaaggtggacaacaggt

SEQ ID NO: 43248 - DNA, 22 bp, Homo sapiens
atctgggagcggaggttgcagt

SEQ ID NO: 43249 - DNA, 21 bp, Homo sapiens
aggcatgagccctgcatggac

SEQ ID NO: 43250 - DNA, 19 bp, Homo sapiens
ccacagcctgctgtcttcc

SEQ ID NO: 43251 - DNA, 22 bp, Homo sapiens
agtaatcaatttttcggtggat

SEQ ID NO: 43252 - DNA, 20 bp, Homo sapiens
attagctcaggtgaggtcat

SEQ ID NO: 43253 - DNA, 22 bp, Homo sapiens
cactgcactccagcctgcgcaa

SEQ ID NO: 43254 - DNA, 22 bp, Homo sapiens
ctgcttctagcaccaagtccct

SEQ ID NO: 43255 - DNA, 22 bp, Homo sapiens
tgtgacctcatcttaactggaa

SEQ ID NO: 43256 - DNA, 22 bp, Homo sapiens
ccgaggctggagtgcagtggcg

SEQ ID NO: 43257 - DNA, 22 bp, Homo sapiens
tatcacatttggagatttatga

SEQ ID NO: 43258 - DNA, 22 bp, Homo sapiens
tcgaactcatagtcgtagctgt

SEQ ID NO: 43259 - DNA, 22 bp, Homo sapiens
aatttcggttcaaggcccagtt

SEQ ID NO: 43260 - DNA, 22 bp, Homo sapiens
agctgattccactttttcccca

SEQ ID NO: 43261 - DNA, 22 bp, Homo sapiens
aagtgctgggattacaggtgtg

SEQ ID NO: 43262 - DNA, 21 bp, Homo sapiens
gaccccagaccagcagacaca

SEQ ID NO: 43263 - DNA, 22 bp, Homo sapiens
tggacaggcaagcaagacatac

SEQ ID NO: 43264 - DNA, 18 bp, Homo sapiens
gctctgcaggtgctcggt

SEQ ID NO: 43265 - DNA, 22 bp, Homo sapiens
agaggtgagtcattacctagtg

SEQ ID NO: 43266 - DNA, 22 bp, Homo sapiens
ccctctacagggaagcgctttc

SEQ ID NO: 43267 - DNA, 22 bp, Homo sapiens
ccagaggagttgaggctttggg

SEQ ID NO: 43268 - DNA, 22 bp, Homo sapiens
ggcggaggttgcagtaagccga

SEQ ID NO: 43269 - DNA, 22 bp, Homo sapiens
ccaaagtgctgggattacaggc

SEQ ID NO: 43270 - DNA, 22 bp, Homo sapiens
tctggtgtcagtattctttgaa

SEQ ID NO: 43271 - DNA, 19 bp, Homo sapiens
ttctctgctacattctcag

SEQ ID NO: 43272 - DNA, 22 bp, Homo sapiens
gcttccgcgatgtcctaggtgg

SEQ ID NO: 43273 - DNA, 22 bp, Homo sapiens
gatatcattgagcccaggagtt

SEQ ID NO: 43274 - DNA, 22 bp, Homo sapiens
ccagcagccaccttctcgaaat

SEQ ID NO: 43275 - DNA, 22 bp, Homo sapiens
attttctatgttgtaattgtta

SEQ ID NO: 43276 - DNA, 22 bp, Homo sapiens
ggccttggttccaaagcaggca

SEQ ID NO: 43277 - DNA, 22 bp, Homo sapiens
tttgcttgttcaagatttctgt

SEQ ID NO: 43278 - DNA, 22 bp, Homo sapiens
cagagagaatcttggcagctga

SEQ ID NO: 43279 - DNA, 22 bp, Homo sapiens
ggtggttcacgcctataatccc

SEQ ID NO: 43280 - DNA, 22 bp, Homo sapiens
tggtattctttctgtagatcat

SEQ ID NO: 43281 - DNA, 22 bp, Homo sapiens
gggcgccgtgggaaacagccgg

SEQ ID NO: 43282 - DNA, 22 bp, Homo sapiens
tattccatttgggtcaggatga

SEQ ID NO: 43283 - DNA, 22 bp, Homo sapiens
tctcagaacctcagtttgctct

SEQ ID NO: 43284 - DNA, 22 bp, Homo sapiens
gtaatagtctcaaactcctgga

SEQ ID NO: 43285 - DNA, 22 bp, Homo sapiens
tccttttgagctcctatgtggg

SEQ ID NO: 43286 - DNA, 22 bp, Homo sapiens
ccgggttgaggttcccatagat

SEQ ID NO: 43287 - DNA, 22 bp, Homo sapiens
cagtagccaactccaggaacta

SEQ ID NO: 43288 - DNA, 22 bp, Homo sapiens
cggtctcccgtgtgtgtgcgct

SEQ ID NO: 43289 - DNA, 22 bp, Homo sapiens
caggaaggcgcggctgtgcctg

SEQ ID NO: 43290 - DNA, 18 bp, Homo sapiens
tccctcagaattatagaa

SEQ ID NO: 43291 - DNA, 22 bp, Homo sapiens
tatttcttttcgtgacttattg

SEQ ID NO: 43292 - DNA, 22 bp, Homo sapiens
agagcagctcgctacctctcta

SEQ ID NO: 43293 - DNA, 22 bp, Homo sapiens
ctgccaggattctgtgaacccc

SEQ ID NO: 43294 - DNA, 18 bp, Homo sapiens
ttcacaagggcttggttt

SEQ ID NO: 43295 - DNA, 20 bp, Homo sapiens
tgtcattcttctttcacagg

SEQ ID NO: 43296 - DNA, 22 bp, Homo sapiens
gggagctgagctggaagagaat

SEQ ID NO: 43297 - DNA, 22 bp, Homo sapiens
gcctccagggatgattccttcc

SEQ ID NO: 43298 - DNA, 18 bp, Homo sapiens
cttgttcttctcttggcg

SEQ ID NO: 43299 - DNA, 22 bp, Homo sapiens
tgaatgtgatgctaaacatatg

SEQ ID NO: 43300 - DNA, 22 bp, Homo sapiens
cagccccacacggtctagctct

SEQ ID NO: 43301 - DNA, 22 bp, Homo sapiens
gtccctgataagagccatcgat

SEQ ID NO: 43302 - DNA, 21 bp, Homo sapiens
cccgcacagcggtaggccgcc

SEQ ID NO: 43303 - DNA, 22 bp, Homo sapiens
tccaccatgtaacaagctctgt

SEQ ID NO: 43304 - DNA, 22 bp, Homo sapiens
gaggagggagctggaagctctt

SEQ ID NO: 43305 - DNA, 22 bp, Homo sapiens
agggtcctgggtgcagttgctt

SEQ ID NO: 43306 - DNA, 22 bp, Homo sapiens
caggaagaccagggctgtggct

SEQ ID NO: 43307 - DNA, 22 bp, Homo sapiens
gttgagtgggttaggatgctga

SEQ ID NO: 43308 - DNA, 22 bp, Homo sapiens
tgagctgacacccaatcatact

SEQ ID NO: 43309 - DNA, 22 bp, Homo sapiens
cagggtgctgcaccatccctca

SEQ ID NO: 43310 - DNA, 22 bp, Homo sapiens
tggggtacttgtatcaaagcac

SEQ ID NO: 43311 - DNA, 22 bp, Homo sapiens
atgcacctgaactccatcagct

SEQ ID NO: 43312 - DNA, 22 bp, Homo sapiens
tccaggtgggctgcacccaggc

SEQ ID NO: 43313 - DNA, 22 bp, Homo sapiens
gacaagctcccggtggccctcc

SEQ ID NO: 43314 - DNA, 22 bp, Homo sapiens
tgtgtggattcatctcaaagag

SEQ ID NO: 43315 - DNA, 22 bp, Homo sapiens
gatgtagacacttggaggctta

SEQ ID NO: 43316 - DNA, 22 bp, Homo sapiens
tctcttgagctcagttctgatg

SEQ ID NO: 43317 - DNA, 22 bp, Homo sapiens
tatctatgtgctctgacctctc

SEQ ID NO: 43318 - DNA, 22 bp, Homo sapiens
gctggagaggatcccaaagcca

SEQ ID NO: 43319 - DNA, 22 bp, Homo sapiens
ctaggaccactgtaacaaagta

SEQ ID NO: 43320 - DNA, 22 bp, Homo sapiens
gagcccaggaagtggaggctga

SEQ ID NO: 43321 - DNA, 22 bp, Homo sapiens
tgcctgttgcccacctgataaa

SEQ ID NO: 43322 - DNA, 22 bp, Homo sapiens
ctgaggcaggcagatcacttga

SEQ ID NO: 43323 - DNA, 22 bp, Homo sapiens
ttaaatattatgttgtctgcaa

SEQ ID NO: 43324 - DNA, 22 bp, Homo sapiens
ccaaagaaacccaagctcaggg

SEQ ID NO: 43325 - DNA, 22 bp, Homo sapiens
tcttcctggatgggggttgatg

SEQ ID NO: 43326 - DNA, 22 bp, Homo sapiens
taatttcagtgcaagctcacgg

SEQ ID NO: 43327 - DNA, 22 bp, Homo sapiens
tatctcattttattgcaaatgt

SEQ ID NO: 43328 - DNA, 20 bp, Homo sapiens
tttcttgtcggctgttgctg

SEQ ID NO: 43329 - DNA, 22 bp, Homo sapiens
actttaaaactgatcatcagag

SEQ ID NO: 43330 - DNA, 22 bp, Homo sapiens
gggcatggtggcaggcacctgt

SEQ ID NO: 43331 - DNA, 22 bp, Homo sapiens
ctgagatggagttttgctcttg

SEQ ID NO: 43332 - DNA, 22 bp, Homo sapiens
ggagaggcttccagagtcgtgc

SEQ ID NO: 43333 - DNA, 17 bp, Homo sapiens
tgtagcttctccttctc

SEQ ID NO: 43334 - DNA, 22 bp, Homo sapiens
tgagcacatgccagcccttctc

SEQ ID NO: 43335 - DNA, 22 bp, Homo sapiens
aggtgacaggacaggagctggt

SEQ ID NO: 43336 - DNA, 22 bp, Homo sapiens
acgggctgggacggggaagctc

SEQ ID NO: 43337 - DNA, 21 bp, Homo sapiens
tccctgagcccaaggggctcc

SEQ ID NO: 43338 - DNA, 18 bp, Homo sapiens
tgggaatgctcaaggccc

SEQ ID NO: 43339 - DNA, 22 bp, Homo sapiens
aataaaatggtcagttttctca

SEQ ID NO: 43340 - DNA, 22 bp, Homo sapiens
actggggctgatgcgttcgtgt

SEQ ID NO: 43341 - DNA, 21 bp, Homo sapiens
gggcctggctgcgcaggacgg

SEQ ID NO: 43342 - DNA, 22 bp, Homo sapiens
atggcctgcagtgctgccacag

SEQ ID NO: 43343 - DNA, 22 bp, Homo sapiens
ggaagggcaaaagagatgaact

SEQ ID NO: 43344 - DNA, 22 bp, Homo sapiens
cagcacatgctcatcagggaag

SEQ ID NO: 43345 - DNA, 22 bp, Homo sapiens
cgtggggcgggtggacacttgc

SEQ ID NO: 43346 - DNA, 22 bp, Homo sapiens
tatccaattcaccattgatggg

SEQ ID NO: 43347 - DNA, 22 bp, Homo sapiens
acaagaagtaaaggtcggatgc

SEQ ID NO: 43348 - DNA, 22 bp, Homo sapiens
cagcctgccgtcagccaggtag

SEQ ID NO: 43349 - DNA, 22 bp, Homo sapiens
agctagtatttcattgaggatt

SEQ ID NO: 43350 - DNA, 22 bp, Homo sapiens
ggagtgcagtggcgtgatctca

SEQ ID NO: 43351 - DNA, 22 bp, Homo sapiens
cacctgccaaatggggatgctg

SEQ ID NO: 43352 - DNA, 22 bp, Homo sapiens
gcgagaaactaagtgccctttg

SEQ ID NO: 43353 - DNA, 22 bp, Homo sapiens
tccccaagcaggcaatctcccg

SEQ ID NO: 43354 - DNA, 22 bp, Homo sapiens
tcactgcaagctcagcctcccg

SEQ ID NO: 43355 - DNA, 22 bp, Homo sapiens
ctgaccaacatggtgaaacctt

SEQ ID NO: 43356 - DNA, 22 bp, Homo sapiens
attaatgaaactttggttaagc

SEQ ID NO: 43357 - DNA, 22 bp, Homo sapiens
atggcagaatatctgcatcgca

SEQ ID NO: 43358 - DNA, 22 bp, Homo sapiens
tttccctttagcctgagaatcc

SEQ ID NO: 43359 - DNA, 22 bp, Homo sapiens
cagtgccagctgcttggcctac

SEQ ID NO: 43360 - DNA, 22 bp, Homo sapiens
tgggtactcctattagttcagt

SEQ ID NO: 43361 - DNA, 22 bp, Homo sapiens
tctgagctgggtcttgacagct

SEQ ID NO: 43362 - DNA, 22 bp, Homo sapiens
ttttaagttggattgctaagta

SEQ ID NO: 43363 - DNA, 20 bp, Homo sapiens
ggcagagggcctgggagaag

SEQ ID NO: 43364 - DNA, 22 bp, Homo sapiens
tggaggctggagtgcagtggcg

SEQ ID NO: 43365 - DNA, 22 bp, Homo sapiens
attgattttcagactatgcgag

SEQ ID NO: 43366 - DNA, 22 bp, Homo sapiens
taggtttcagaggtgccgggaa

SEQ ID NO: 43367 - DNA, 22 bp, Homo sapiens
accgggaagtcctgcactgggc

SEQ ID NO: 43368 - DNA, 22 bp, Homo sapiens
tcatcagggatattggcctgaa

SEQ ID NO: 43369 - DNA, 22 bp, Homo sapiens
gatcctgggcccttctgggtca

SEQ ID NO: 43370 - DNA, 22 bp, Homo sapiens
cctcggtttccacatctgtaca

SEQ ID NO: 43371 - DNA, 22 bp, Homo sapiens
gcagggtctgaggccacagagg

SEQ ID NO: 43372 - DNA, 22 bp, Homo sapiens
atacaaaaattagccgggagta

SEQ ID NO: 43373 - DNA, 22 bp, Homo sapiens
gcgagtgccgagagggcagggc

SEQ ID NO: 43374 - DNA, 22 bp, Homo sapiens
aagtcgtcgaagatggaggttg

SEQ ID NO: 43375 - DNA, 22 bp, Homo sapiens
ctgccgttgtgaagctcttaga

SEQ ID NO: 43376 - DNA, 22 bp, Homo sapiens
accctcaacaaattcactctat

SEQ ID NO: 43377 - DNA, 22 bp, Homo sapiens
tgcctaggctggagtgtagtgg

SEQ ID NO: 43378 - DNA, 22 bp, Homo sapiens
aacagctttgtatacagtaact

SEQ ID NO: 43379 - DNA, 22 bp, Homo sapiens
aaagtgctgggattacaagcgt

SEQ ID NO: 43380 - DNA, 22 bp, Homo sapiens
gacaggtgctaagggacctggc

SEQ ID NO: 43381 - DNA, 22 bp, Homo sapiens
tgtctggatagagcctaggccc

SEQ ID NO: 43382 - DNA, 22 bp, Homo sapiens
gctcactgcaacctccgccttc

SEQ ID NO: 43383 - DNA, 22 bp, Homo sapiens
tgccttgtccttcgtcagggct

SEQ ID NO: 43384 - DNA, 22 bp, Homo sapiens
ataaaatttgctactgttaaat

SEQ ID NO: 43385 - DNA, 22 bp, Homo sapiens
actattagcatatcatgaatgg

SEQ ID NO: 43386 - DNA, 22 bp, Homo sapiens
gcgctgaggctggaggcgcacg

SEQ ID NO: 43387 - DNA, 22 bp, Homo sapiens
atcatcatgcccacttgagact

SEQ ID NO: 43388 - DNA, 22 bp, Homo sapiens
ctcagctgcagcctggctggca

SEQ ID NO: 43389 - DNA, 22 bp, Homo sapiens
attcatcagctaatggacattt

SEQ ID NO: 43390 - DNA, 22 bp, Homo sapiens
ttcaatttgtgctaaggcaccg

SEQ ID NO: 43391 - DNA, 22 bp, Homo sapiens
cccagggagagcgcggaggcgg

SEQ ID NO: 43392 - DNA, 22 bp, Homo sapiens
cttccttctcactagcagcgcc

SEQ ID NO: 43393 - DNA, 22 bp, Homo sapiens
acccaggctggagtgcagtggg

SEQ ID NO: 43394 - DNA, 22 bp, Homo sapiens
caggctggagtgcagtggggcg

SEQ ID NO: 43395 - DNA, 22 bp, Homo sapiens
cacatgaaggctggggtcgtga

SEQ ID NO: 43396 - DNA, 18 bp, Homo sapiens
tgctgatggtccattagt

SEQ ID NO: 43397 - DNA, 22 bp, Homo sapiens
gcttctggtgaggcctcaggaa

SEQ ID NO: 43398 - DNA, 22 bp, Homo sapiens
taggctgggggtaggaattgag

SEQ ID NO: 43399 - DNA, 22 bp, Homo sapiens
tgtaggagtccaatcaggagac

SEQ ID NO: 43400 - DNA, 22 bp, Homo sapiens
ctgcgttctgcctggcggccta

SEQ ID NO: 43401 - DNA, 22 bp, Homo sapiens
aagtgattctccctacgcggga

SEQ ID NO: 43402 - DNA, 22 bp, Homo sapiens
ggatgctctgtctcttgctgtt

SEQ ID NO: 43403 - DNA, 22 bp, Homo sapiens
aaattctgatttaataagtgta

SEQ ID NO: 43404 - DNA, 22 bp, Homo sapiens
tccataaattttatgaacatat

SEQ ID NO: 43405 - DNA, 22 bp, Homo sapiens
cctgagtagctggaattaaagg

SEQ ID NO: 43406 - DNA, 22 bp, Homo sapiens
gctgatagactgaatgttggga

SEQ ID NO: 43407 - DNA, 22 bp, Homo sapiens
gcgagggcacgcggttgaaggc

SEQ ID NO: 43408 - DNA, 22 bp, Homo sapiens
agggaagaggaccagagtctct

SEQ ID NO: 43409 - DNA, 22 bp, Homo sapiens
aaaagtcttggggaaggccagg

SEQ ID NO: 43410 - DNA, 22 bp, Homo sapiens
tacttttagcctatttgattct

SEQ ID NO: 43411 - DNA, 22 bp, Homo sapiens
caccaggctggagtgcagtggc

SEQ ID NO: 43412 - DNA, 22 bp, Homo sapiens
ctttttcactgtgtcctcacac

SEQ ID NO: 43413 - DNA, 21 bp, Homo sapiens
acctgagctccacctcctgcc

SEQ ID NO: 43414 - DNA, 22 bp, Homo sapiens
acatttatataactcactagga

SEQ ID NO: 43415 - DNA, 22 bp, Homo sapiens
cccaggaggtcaaggctgcagt

SEQ ID NO: 43416 - DNA, 22 bp, Homo sapiens
caggctgctgcctagaatgaca

SEQ ID NO: 43417 - DNA, 22 bp, Homo sapiens
tgggaatgcaaggaaagctgtt

SEQ ID NO: 43418 - DNA, 22 bp, Homo sapiens
aagccggctgggccgaggctgc

SEQ ID NO: 43419 - DNA, 22 bp, Homo sapiens
ttgtgaatagtgccgcaataaa

SEQ ID NO: 43420 - DNA, 21 bp, Homo sapiens
ccaggccaggcctacggggat

SEQ ID NO: 43421 - DNA, 22 bp, Homo sapiens
atgttggagtcgtaaggcatgg

SEQ ID NO: 43422 - DNA, 22 bp, Homo sapiens
cttttgattgagcagtttcaaa

SEQ ID NO: 43423 - DNA, 20 bp, Homo sapiens
ctcttccggaggggcgctcc

SEQ ID NO: 43424 - DNA, 23 bp, Homo sapiens
aatggtcttcctccacccctctg

SEQ ID NO: 43425 - DNA, 22 bp, Homo sapiens
agtggcacaactgtttagctac

SEQ ID NO: 43426 - DNA, 22 bp, Homo sapiens
tgctgtgaggttgagaaggaag

SEQ ID NO: 43427 - DNA, 22 bp, Homo sapiens
attataggcttgagccaccgtg

SEQ ID NO: 43428 - DNA, 22 bp, Homo sapiens
gcttaattctggctcagtttcc

SEQ ID NO: 43429 - DNA, 19 bp, Homo sapiens
gatttaaacgtggctctat

SEQ ID NO: 43430 - DNA, 22 bp, Homo sapiens
gttgcctaggctggtcttgaac

SEQ ID NO: 43431 - DNA, 22 bp, Homo sapiens
tggttgtggtcctccacatcgc

SEQ ID NO: 43432 - DNA, 22 bp, Homo sapiens
ttggagagtgatattcagatgc

SEQ ID NO: 43433 - DNA, 22 bp, Homo sapiens
gagcagtgccaaagaatttgcg

SEQ ID NO: 43434 - DNA, 22 bp, Homo sapiens
tttgaagccatgtcaatagttt

SEQ ID NO: 43435 - DNA, 22 bp, Homo sapiens
agaacagaggccttatgtttca

SEQ ID NO: 43436 - DNA, 22 bp, Homo sapiens
gttactcttccccggggtctgg

SEQ ID NO: 43437 - DNA, 22 bp, Homo sapiens
atctggttcttcttaggcatca

SEQ ID NO: 43438 - DNA, 23 bp, Homo sapiens
tctacaaagctgtgtcaggaccc

SEQ ID NO: 43439 - DNA, 22 bp, Homo sapiens
cccattcatcctcgcttccttc

SEQ ID NO: 43440 - DNA, 22 bp, Homo sapiens
ggctcactgcaacttccgcctc

SEQ ID NO: 43441 - DNA, 22 bp, Homo sapiens
gcagcgaggtgatgaaatagct

SEQ ID NO: 43442 - DNA, 22 bp, Homo sapiens
tgtatgaggcatacatcaggca

SEQ ID NO: 43443 - DNA, 22 bp, Homo sapiens
gaggcaggcagattgcttgagg

SEQ ID NO: 43444 - DNA, 22 bp, Homo sapiens
attgttcaatgtaataattttg

SEQ ID NO: 43445 - DNA, 22 bp, Homo sapiens
gggcaggggtcagtggccccaa

SEQ ID NO: 43446 - DNA, 22 bp, Homo sapiens
tttctggcagcgggacaggggt

SEQ ID NO: 43447 - DNA, 22 bp, Homo sapiens
gggtacagttcttccagtgtca

SEQ ID NO: 43448 - DNA, 22 bp, Homo sapiens
tcagacattattttcaagataa

SEQ ID NO: 43449 - DNA, 20 bp, Homo sapiens
tatttctgggcaaccattta

SEQ ID NO: 43450 - DNA, 22 bp, Homo sapiens
caccttactccctctggatgcc

SEQ ID NO: 43451 - DNA, 22 bp, Homo sapiens
aagaagcattctttcattggtt

SEQ ID NO: 43452 - DNA, 22 bp, Homo sapiens
tgctccagcaccaagagctcca

SEQ ID NO: 43453 - DNA, 22 bp, Homo sapiens
gcttggccagcagccgggatgc

SEQ ID NO: 43454 - DNA, 22 bp, Homo sapiens
aggaggggttctcgggtgctga

SEQ ID NO: 43455 - DNA, 22 bp, Homo sapiens
tcttgggcatgtgtttgatttc

SEQ ID NO: 43456 - DNA, 22 bp, Homo sapiens
agtgaatgtccccgcgggtcag

SEQ ID NO: 43457 - DNA, 22 bp, Homo sapiens
atgggtgcagcatggtgggaac

SEQ ID NO: 43458 - DNA, 22 bp, Homo sapiens
tcaaagatcagatggttgtagg

SEQ ID NO: 43459 - DNA, 22 bp, Homo sapiens
aagtgattgttccgttgagtgt

SEQ ID NO: 43460 - DNA, 22 bp, Homo sapiens
tgagaacggatactaagggctg

SEQ ID NO: 43461 - DNA, 22 bp, Homo sapiens
cctctgtgtctccaagaggcct

SEQ ID NO: 43462 - DNA, 22 bp, Homo sapiens
atgccactgcacttcagcttgg

SEQ ID NO: 43463 - DNA, 22 bp, Homo sapiens
gctgtgtatcagatgccacggg

SEQ ID NO: 43464 - DNA, 22 bp, Homo sapiens
gctcggtggccagcctgaggcc

SEQ ID NO: 43465 - DNA, 22 bp, Homo sapiens
tcattacaagatttccaatttg

SEQ ID NO: 43466 - DNA, 22 bp, Homo sapiens
tcctgggacaagccgtggaagt

SEQ ID NO: 43467 - DNA, 22 bp, Homo sapiens
gggtaaatctcttttcatggct

SEQ ID NO: 43468 - DNA, 22 bp, Homo sapiens
cgtgaggggggtaaggcgtccg

SEQ ID NO: 43469 - DNA, 22 bp, Homo sapiens
gcacggctaatttttgtatttt

SEQ ID NO: 43470 - DNA, 19 bp, Homo sapiens
gcagacaggtccagagagg

SEQ ID NO: 43471 - DNA, 19 bp, Homo sapiens
gggaatgatggaagacttc

SEQ ID NO: 43472 - DNA, 22 bp, Homo sapiens
aacccgggaggtggaggttatg

SEQ ID NO: 43473 - DNA, 22 bp, Homo sapiens
gcatggcttcggggtgctgcct

SEQ ID NO: 43474 - DNA, 22 bp, Homo sapiens
tacaggcatgtagcatggtgat

SEQ ID NO: 43475 - DNA, 21 bp, Homo sapiens
ctggccactgcacctcttcct

SEQ ID NO: 43476 - DNA, 22 bp, Homo sapiens
atagttttaaaacctcaggaag

SEQ ID NO: 43477 - DNA, 22 bp, Homo sapiens
gccagggttcgaatccgtatgg

SEQ ID NO: 43478 - DNA, 23 bp, Homo sapiens
tgcatggggctatactgctgttc

SEQ ID NO: 43479 - DNA, 22 bp, Homo sapiens
ccaggctagaaactgaggcaca

SEQ ID NO: 43480 - DNA, 20 bp, Homo sapiens
atcctctcctgattaattca

SEQ ID NO: 43481 - DNA, 17 bp, Homo sapiens
tactgaggggtctggag

SEQ ID NO: 43482 - DNA, 22 bp, Homo sapiens
agctcaagctacacacagagtc

SEQ ID NO: 43483 - DNA, 22 bp, Homo sapiens
cattctctctacttgttttcaa

SEQ ID NO: 43484 - DNA, 22 bp, Homo sapiens
gggaggctctgctcagcccccg

SEQ ID NO: 43485 - DNA, 22 bp, Homo sapiens
ggctgcaggttggttggcagct

SEQ ID NO: 43486 - DNA, 22 bp, Homo sapiens
tctcagctcatggcagccttga

SEQ ID NO: 43487 - DNA, 22 bp, Homo sapiens
aacccaggagccggaggttgtg

SEQ ID NO: 43488 - DNA, 22 bp, Homo sapiens
agaggacagagtgctggattta

SEQ ID NO: 43489 - DNA, 21 bp, Homo sapiens
gggcactgaaagggaatagca

SEQ ID NO: 43490 - DNA, 22 bp, Homo sapiens
ttaatgaaaggcagtttggaac

SEQ ID NO: 43491 - DNA, 22 bp, Homo sapiens
aagaggagaaaggctggctttg

SEQ ID NO: 43492 - DNA, 22 bp, Homo sapiens
cccgacctcgcaaagcgcactc

SEQ ID NO: 43493 - DNA, 22 bp, Homo sapiens
gtgggccactgggaggcaaggg

SEQ ID NO: 43494 - DNA, 22 bp, Homo sapiens
atggctgcctgggcgctggccg

SEQ ID NO: 43495 - DNA, 22 bp, Homo sapiens
agtgctatcgagttctaatgct

SEQ ID NO: 43496 - DNA, 22 bp, Homo sapiens
gctctgccagcccaaggcgcag

SEQ ID NO: 43497 - DNA, 22 bp, Homo sapiens
tcactgcaacctctgcctcttg

SEQ ID NO: 43498 - DNA, 22 bp, Homo sapiens
cgtaggtggctcagcacctggg

SEQ ID NO: 43499 - DNA, 22 bp, Homo sapiens
cccagggaggcccaggctctgc

SEQ ID NO: 43500 - DNA, 22 bp, Homo sapiens
ctggagagaatgtggaatgatt

SEQ ID NO: 43501 - DNA, 22 bp, Homo sapiens
gtgaaatatttaacgtccaggt

SEQ ID NO: 43502 - DNA, 22 bp, Homo sapiens
cctggcaggtggcgccctcggc

SEQ ID NO: 43503 - DNA, 22 bp, Homo sapiens
aaaaaattatcatagttcctga

SEQ ID NO: 43504 - DNA, 22 bp, Homo sapiens
agtgactggtgtgaagttaaat

SEQ ID NO: 43505 - DNA, 22 bp, Homo sapiens
atatacacatctttttaaatat

SEQ ID NO: 43506 - DNA, 22 bp, Homo sapiens
aggcgagaggcttgggctagta

SEQ ID NO: 43507 - DNA, 22 bp, Homo sapiens
actagaaagaagttttttgaga

SEQ ID NO: 43508 - DNA, 22 bp, Homo sapiens
gttgaaatcctaaccccctagt

SEQ ID NO: 43509 - DNA, 22 bp, Homo sapiens
agtgctgtctccttcccccggg

SEQ ID NO: 43510 - DNA, 22 bp, Homo sapiens
caattcccagctgccgggctgc

SEQ ID NO: 43511 - DNA, 22 bp, Homo sapiens
ctcactgcaagttccacctacc

SEQ ID NO: 43512 - DNA, 22 bp, Homo sapiens
ttgtatgtggcaaatgggggag

SEQ ID NO: 43513 - DNA, 22 bp, Homo sapiens
attgcactccagcctgggggac

SEQ ID NO: 43514 - DNA, 22 bp, Homo sapiens
tgggaagggtcaacagctggaa

SEQ ID NO: 43515 - DNA, 22 bp, Homo sapiens
cctgggcctctcaaagtgctgg

SEQ ID NO: 43516 - DNA, 22 bp, Homo sapiens
cacgaatggaagggtcttggct

SEQ ID NO: 43517 - DNA, 22 bp, Homo sapiens
tttgaacagtagcttaggtgtg

SEQ ID NO: 43518 - DNA, 22 bp, Homo sapiens
cgtctaggccgtgccctgaggt

SEQ ID NO: 43519 - DNA, 22 bp, Homo sapiens
gggcggatcatttgaggtcagg

SEQ ID NO: 43520 - DNA, 20 bp, Homo sapiens
ttctccagtgcggtagccat

SEQ ID NO: 43521 - DNA, 22 bp, Homo sapiens
acccaggagacggaggtgcagt

SEQ ID NO: 43522 - DNA, 22 bp, Homo sapiens
tgggtgagcggctgcacacccg

SEQ ID NO: 43523 - DNA, 22 bp, Homo sapiens
ccaagggcgcctccgttccccc

SEQ ID NO: 43524 - DNA, 22 bp, Homo sapiens
acctcctggcctcaagcaatcc

SEQ ID NO: 43525 - DNA, 22 bp, Homo sapiens
gaggtgctgctgtacttcttgc

SEQ ID NO: 43526 - DNA, 22 bp, Homo sapiens
tccacatggctgggaggcctca

SEQ ID NO: 43527 - DNA, 22 bp, Homo sapiens
taagtcgtggatgattcttcgg

SEQ ID NO: 43528 - DNA, 22 bp, Homo sapiens
gctcccagtctgatggaggaga

SEQ ID NO: 43529 - DNA, 22 bp, Homo sapiens
tttggaaattttcatccagaca

SEQ ID NO: 43530 - DNA, 20 bp, Homo sapiens
atcggcttgcctggaaacaa

SEQ ID NO: 43531 - DNA, 21 bp, Homo sapiens
gttgtggttggggctgcagct

SEQ ID NO: 43532 - DNA, 22 bp, Homo sapiens
agtccgtcctgtcaagcagctg

SEQ ID NO: 43533 - DNA, 22 bp, Homo sapiens
gcttccacctactaaatgccac

SEQ ID NO: 43534 - DNA, 22 bp, Homo sapiens
accttcaggtgagcacacagat

SEQ ID NO: 43535 - DNA, 22 bp, Homo sapiens
aggtgggcggattcatgaggtc

SEQ ID NO: 43536 - DNA, 22 bp, Homo sapiens
tttctttatcatagcatctttg

SEQ ID NO: 43537 - DNA, 22 bp, Homo sapiens
atggctagcaccgcgttgctgg

SEQ ID NO: 43538 - DNA, 20 bp, Homo sapiens
tttcaccatcttggccaggc

SEQ ID NO: 43539 - DNA, 22 bp, Homo sapiens
tacaaaggaggtgcatagaaca

SEQ ID NO: 43540 - DNA, 19 bp, Homo sapiens
aggtggctgaaactacaga

SEQ ID NO: 43541 - DNA, 22 bp, Homo sapiens
aatggcactttataaatgttaa

SEQ ID NO: 43542 - DNA, 22 bp, Homo sapiens
tcccaatagcctaagagcctgg

SEQ ID NO: 43543 - DNA, 22 bp, Homo sapiens
gccatcatatcccctgtgacct

SEQ ID NO: 43544 - DNA, 22 bp, Homo sapiens
acagacaagtagttcagacaag

SEQ ID NO: 43545 - DNA, 19 bp, Homo sapiens
aggctaaagagtcttgcgt

SEQ ID NO: 43546 - DNA, 22 bp, Homo sapiens
tggggttttaacatgttgccag

SEQ ID NO: 43547 - DNA, 22 bp, Homo sapiens
ctgggcgcgtcccctgaggcgg

SEQ ID NO: 43548 - DNA, 22 bp, Homo sapiens
ttactttaagggtgtcttatta

SEQ ID NO: 43549 - DNA, 22 bp, Homo sapiens
gggacatctttctagtcagggt

SEQ ID NO: 43550 - DNA, 22 bp, Homo sapiens
cttgtagaattgaaatggtctc

SEQ ID NO: 43551 - DNA, 22 bp, Homo sapiens
tttaagaagttatgttataaat

SEQ ID NO: 43552 - DNA, 23 bp, Homo sapiens
gacagagtgagaccttgtcttac

SEQ ID NO: 43553 - DNA, 22 bp, Homo sapiens
tggctcactgtagccttgacct

SEQ ID NO: 43554 - DNA, 22 bp, Homo sapiens
ctgtgctccctctggcgccccg

SEQ ID NO: 43555 - DNA, 22 bp, Homo sapiens
gtagctctgtttaaagttcttt

SEQ ID NO: 43556 - DNA, 22 bp, Homo sapiens
acattaaacttgcttggctgta

SEQ ID NO: 43557 - DNA, 22 bp, Homo sapiens
gggccggagctgggtcccgcgc

SEQ ID NO: 43558 - DNA, 22 bp, Homo sapiens
aggtgtctggacttgtgaagca

SEQ ID NO: 43559 - DNA, 22 bp, Homo sapiens
cctaggagttcgaagctgcagt

SEQ ID NO: 43560 - DNA, 22 bp, Homo sapiens
aggagatggagctcagtgggca

SEQ ID NO: 43561 - DNA, 22 bp, Homo sapiens
atacctgtgtatccacaagcgt

SEQ ID NO: 43562 - DNA, 22 bp, Homo sapiens
ctgggagtggtgacagctctcg

SEQ ID NO: 43563 - DNA, 22 bp, Homo sapiens
agtgagagtattaatgtgaact

SEQ ID NO: 43564 - DNA, 22 bp, Homo sapiens
ctgtggctctcagaggctgctg

SEQ ID NO: 43565 - DNA, 22 bp, Homo sapiens
agggtgaatctcacaactctta

SEQ ID NO: 43566 - DNA, 22 bp, Homo sapiens
ctgtaatcccagctactcggga

SEQ ID NO: 43567 - DNA, 22 bp, Homo sapiens
tgagtgtggggaatgtcatgag

SEQ ID NO: 43568 - DNA, 22 bp, Homo sapiens
aagactgtgtctatggctactc

SEQ ID NO: 43569 - DNA, 22 bp, Homo sapiens
ctagggtcaggggcctgcgtcg

SEQ ID NO: 43570 - DNA, 22 bp, Homo sapiens
atgaagctactgaatatttggt

SEQ ID NO: 43571 - DNA, 21 bp, Homo sapiens
tgttttccaccttgaggcaag

SEQ ID NO: 43572 - DNA, 22 bp, Homo sapiens
gtaggccatggtggttgtctct

SEQ ID NO: 43573 - DNA, 22 bp, Homo sapiens
agcgctgtgggcgtgcgaggag

SEQ ID NO: 43574 - DNA, 22 bp, Homo sapiens
acacttggagcaacacttatgg

SEQ ID NO: 43575 - DNA, 22 bp, Homo sapiens
gacccggctccaggcccagcag

SEQ ID NO: 43576 - DNA, 22 bp, Homo sapiens
cagctgcccctccagggctggg

SEQ ID NO: 43577 - DNA, 22 bp, Homo sapiens
tacagtgcttggtatctagtaa

SEQ ID NO: 43578 - DNA, 22 bp, Homo sapiens
ctcaggagttggaggctacagt

SEQ ID NO: 43579 - DNA, 22 bp, Homo sapiens
tgggaaggggagctggaaagga

SEQ ID NO: 43580 - DNA, 22 bp, Homo sapiens
tggatgctgtaggacacgctct

SEQ ID NO: 43581 - DNA, 22 bp, Homo sapiens
gcagtggggcaatcatagctca

SEQ ID NO: 43582 - DNA, 22 bp, Homo sapiens
tggcaggcgggagccatagagg

SEQ ID NO: 43583 - DNA, 22 bp, Homo sapiens
ggttcccggatctccgagtccc

SEQ ID NO: 43584 - DNA, 21 bp, Homo sapiens
gctgttcggcggccctcgcgc

SEQ ID NO: 43585 - DNA, 22 bp, Homo sapiens
ggctgagtctgtgacccatgcg

SEQ ID NO: 43586 - DNA, 22 bp, Homo sapiens
cttggggcagcccaggctgagc

SEQ ID NO: 43587 - DNA, 22 bp, Homo sapiens
tctccccagtatggattctctg

SEQ ID NO: 43588 - DNA, 22 bp, Homo sapiens
tgccacagacaggacagaacag

SEQ ID NO: 43589 - DNA, 22 bp, Homo sapiens
gggacgtgagtgaagaaggtct

SEQ ID NO: 43590 - DNA, 22 bp, Homo sapiens
tgtgactgaggctccaagctag

SEQ ID NO: 43591 - DNA, 22 bp, Homo sapiens
cgagagttagctaggagtcaca

SEQ ID NO: 43592 - DNA, 22 bp, Homo sapiens
cagcccaggactgcaggtgttt

SEQ ID NO: 43593 - DNA, 22 bp, Homo sapiens
ggcagccccatcagagacgctg

SEQ ID NO: 43594 - DNA, 22 bp, Homo sapiens
tggggcagttaataaacattct

SEQ ID NO: 43595 - DNA, 22 bp, Homo sapiens
aagccctggacggcccttcccc

SEQ ID NO: 43596 - DNA, 22 bp, Homo sapiens
ttccgctgtttagttgaagttt

SEQ ID NO: 43597 - DNA, 22 bp, Homo sapiens
ttggcgcccaggacgccgccgc

SEQ ID NO: 43598 - DNA, 22 bp, Homo sapiens
ctagggtgtgcagattttgcct

SEQ ID NO: 43599 - DNA, 22 bp, Homo sapiens
tactgtgtgcccagccgagctg

SEQ ID NO: 43600 - DNA, 22 bp, Homo sapiens
ataaaagatcccttctgagctc

SEQ ID NO: 43601 - DNA, 22 bp, Homo sapiens
ctctccattccctacagttttc

SEQ ID NO: 43602 - DNA, 22 bp, Homo sapiens
tccttcagcctcccagctcaaa

SEQ ID NO: 43603 - DNA, 22 bp, Homo sapiens
gctctctgcagcctccttggag

SEQ ID NO: 43604 - DNA, 18 bp, Homo sapiens
cccaggttggcctacaga

SEQ ID NO: 43605 - DNA, 22 bp, Homo sapiens
acagagcaataacagggagagg

SEQ ID NO: 43606 - DNA, 22 bp, Homo sapiens
tgtggtgccgagagtctggacg

SEQ ID NO: 43607 - DNA, 22 bp, Homo sapiens
cagggagtgtacaccatgtgta

SEQ ID NO: 43608 - DNA, 22 bp, Homo sapiens
cgccaggcttggtagctcatgc

SEQ ID NO: 43609 - DNA, 22 bp, Homo sapiens
aagcagaatagaggcccttccc

SEQ ID NO: 43610 - DNA, 22 bp, Homo sapiens
ttcctggtcactgctgttccct

SEQ ID NO: 43611 - DNA, 22 bp, Homo sapiens
atatatttgagaatattcatga

SEQ ID NO: 43612 - DNA, 22 bp, Homo sapiens
ctggctgggagcgagctgctca

SEQ ID NO: 43613 - DNA, 22 bp, Homo sapiens
tgaggcaggacttgcataaagt

SEQ ID NO: 43614 - DNA, 22 bp, Homo sapiens
ttgtgaatagtgccgctataaa

SEQ ID NO: 43615 - DNA, 22 bp, Homo sapiens
cattcattacactcataaggtt

SEQ ID NO: 43616 - DNA, 22 bp, Homo sapiens
ctcgcgttccagctgcgggccg

SEQ ID NO: 43617 - DNA, 22 bp, Homo sapiens
ctgctaaacctctctgagagct

SEQ ID NO: 43618 - DNA, 19 bp, Homo sapiens
tccaggggctccacctcct

SEQ ID NO: 43619 - DNA, 22 bp, Homo sapiens
cattacagaatatgtaatgatc

SEQ ID NO: 43620 - DNA, 22 bp, Homo sapiens
ggcctttgcgtccacgccgctt

SEQ ID NO: 43621 - DNA, 22 bp, Homo sapiens
atattgttagtaatatttcgaa

SEQ ID NO: 43622 - DNA, 22 bp, Homo sapiens
ctcctccacccgctggggccca

SEQ ID NO: 43623 - DNA, 22 bp, Homo sapiens
gggctgtaggagctggaatggg

SEQ ID NO: 43624 - DNA, 22 bp, Homo sapiens
tgagcttccctcctgcactaca

SEQ ID NO: 43625 - DNA, 22 bp, Homo sapiens
gctggtgagcaaaggagaagga

SEQ ID NO: 43626 - DNA, 22 bp, Homo sapiens
tcgttaccatagccttgtccct

SEQ ID NO: 43627 - DNA, 22 bp, Homo sapiens
ctctggcaattgctgctgactc

SEQ ID NO: 43628 - DNA, 22 bp, Homo sapiens
agccacacttgccaggggaagg

SEQ ID NO: 43629 - DNA, 22 bp, Homo sapiens
gccaggctgaggctctggaaga

SEQ ID NO: 43630 - DNA, 22 bp, Homo sapiens
aggctatttccactcttctcat

SEQ ID NO: 43631 - DNA, 22 bp, Homo sapiens
tttgatccgttgctggtgagga

SEQ ID NO: 43632 - DNA, 22 bp, Homo sapiens
aattacagtcggagcagcactg

SEQ ID NO: 43633 - DNA, 23 bp, Homo sapiens
ctggggctttcaaatctgggcag

SEQ ID NO: 43634 - DNA, 22 bp, Homo sapiens
ccaaagtgctaggattacaggt

SEQ ID NO: 43635 - DNA, 22 bp, Homo sapiens
gaagaaagatcaaatagtttcc

SEQ ID NO: 43636 - DNA, 22 bp, Homo sapiens
gcctccggagttgcagtgtctt

SEQ ID NO: 43637 - DNA, 22 bp, Homo sapiens
ttggggccgggataaggttgtt

SEQ ID NO: 43638 - DNA, 22 bp, Homo sapiens
ctcactgcaagctccgcctccc

SEQ ID NO: 43639 - DNA, 22 bp, Homo sapiens
tgtgaagaattaatgtgaatca

SEQ ID NO: 43640 - DNA, 22 bp, Homo sapiens
gtacagaggttgctggaggctc

SEQ ID NO: 43641 - DNA, 22 bp, Homo sapiens
caggctgaagtgcagtggtgtg

SEQ ID NO: 43642 - DNA, 22 bp, Homo sapiens
atacaccaccttggatctttca

SEQ ID NO: 43643 - DNA, 22 bp, Homo sapiens
agtgcaggccccaggccaggcc

SEQ ID NO: 43644 - DNA, 22 bp, Homo sapiens
caggccggggcggcgccatctt

SEQ ID NO: 43645 - DNA, 22 bp, Homo sapiens
actgcaacctccgcctgccagg

SEQ ID NO: 43646 - DNA, 22 bp, Homo sapiens
agggctctgagtgggaaagagg

SEQ ID NO: 43647 - DNA, 22 bp, Homo sapiens
ttctggaaggatgtttctatct

SEQ ID NO: 43648 - DNA, 22 bp, Homo sapiens
taacaatacccattctaattac

SEQ ID NO: 43649 - DNA, 22 bp, Homo sapiens
tccccatgtctgcagggagggt

SEQ ID NO: 43650 - DNA, 22 bp, Homo sapiens
gctagtgcagggaaatctttgg

SEQ ID NO: 43651 - DNA, 22 bp, Homo sapiens
gtgcaattcactgttatgtctg

SEQ ID NO: 43652 - DNA, 22 bp, Homo sapiens
cccacgtcgaacttgctccaga

SEQ ID NO: 43653 - DNA, 22 bp, Homo sapiens
tcgtgaggctctgcatcgcaca

SEQ ID NO: 43654 - DNA, 22 bp, Homo sapiens
agcttgtgtttttctaagtatc

SEQ ID NO: 43655 - DNA, 22 bp, Homo sapiens
agaaatgggccttgggacacaa

SEQ ID NO: 43656 - DNA, 22 bp, Homo sapiens
gtcctggggattatagagtgtt

SEQ ID NO: 43657 - DNA, 22 bp, Homo sapiens
atgccacttcattccagcctcg

SEQ ID NO: 43658 - DNA, 23 bp, Homo sapiens
cttcacaggttcaggggattaag

SEQ ID NO: 43659 - DNA, 22 bp, Homo sapiens
agctggtgtgccagttccagtt

SEQ ID NO: 43660 - DNA, 22 bp, Homo sapiens
ttcacagcttaataaggctcag

SEQ ID NO: 43661 - DNA, 22 bp, Homo sapiens
tcagcctccgaaagtgctggga

SEQ ID NO: 43662 - DNA, 22 bp, Homo sapiens
aactaatacattaatacatgtg

SEQ ID NO: 43663 - DNA, 22 bp, Homo sapiens
cacactgtctttcagaatggtt

SEQ ID NO: 43664 - DNA, 22 bp, Homo sapiens
cccagttttctgattgaagagc

SEQ ID NO: 43665 - DNA, 21 bp, Homo sapiens
gcccacagtgaggaggatccc

SEQ ID NO: 43666 - DNA, 22 bp, Homo sapiens
atttcatactaaggctcaaaaa

SEQ ID NO: 43667 - DNA, 22 bp, Homo sapiens
agagggcattaactctgtcttg

SEQ ID NO: 43668 - DNA, 22 bp, Homo sapiens
tctgaaaactccatgagctcgt

SEQ ID NO: 43669 - DNA, 22 bp, Homo sapiens
ctcctgaattgtccctcacagc

SEQ ID NO: 43670 - DNA, 22 bp, Homo sapiens
ttatttgtggcatatgagacga

SEQ ID NO: 43671 - DNA, 20 bp, Homo sapiens
ttcatgggagcaaagaggcc

SEQ ID NO: 43672 - DNA, 22 bp, Homo sapiens
ggggaaggaaagttattagcag

SEQ ID NO: 43673 - DNA, 22 bp, Homo sapiens
cgggcgcactccgggcagctgt

SEQ ID NO: 43674 - DNA, 22 bp, Homo sapiens
ataatggtagatgtccacgcag

SEQ ID NO: 43675 - DNA, 22 bp, Homo sapiens
tgacctattagatttccttgcc

SEQ ID NO: 43676 - DNA, 22 bp, Homo sapiens
aaggaggttatcccagtggact

SEQ ID NO: 43677 - DNA, 16 bp, Homo sapiens
gcgcctcctcggcctc

SEQ ID NO: 43678 - DNA, 22 bp, Homo sapiens
ctgcatccatgttgctgcaaag

SEQ ID NO: 43679 - DNA, 21 bp, Homo sapiens
ctggaggcaggtggtgccagg

SEQ ID NO: 43680 - DNA, 22 bp, Homo sapiens
cacgcacgctgggtggaggcgc

SEQ ID NO: 43681 - DNA, 22 bp, Homo sapiens
ggctgggctccgggagcatgcg

SEQ ID NO: 43682 - DNA, 22 bp, Homo sapiens
accaggttggtgtccttctggc

SEQ ID NO: 43683 - DNA, 21 bp, Homo sapiens
ggccgccgccttgtgctctgc

SEQ ID NO: 43684 - DNA, 22 bp, Homo sapiens
gctgaggtggaggaaggagacc

SEQ ID NO: 43685 - DNA, 22 bp, Homo sapiens
tggtaaggttccagatctagaa

SEQ ID NO: 43686 - DNA, 22 bp, Homo sapiens
ttgaagactaatttagataatg

SEQ ID NO: 43687 - DNA, 22 bp, Homo sapiens
cctggagagctcgggccaggca

SEQ ID NO: 43688 - DNA, 22 bp, Homo sapiens
atttagaactttgtttgccaat

SEQ ID NO: 43689 - DNA, 22 bp, Homo sapiens
tggaaatgtttcttgagctcag

SEQ ID NO: 43690 - DNA, 22 bp, Homo sapiens
gccctcctggcaggcagtgatg

SEQ ID NO: 43691 - DNA, 19 bp, Homo sapiens
ccagagagctaggtacaga

SEQ ID NO: 43692 - DNA, 16 bp, Homo sapiens
tgggtgggaggagcgg

SEQ ID NO: 43693 - DNA, 22 bp, Homo sapiens
tgtttctgtatgatcaatattg

SEQ ID NO: 43694 - DNA, 22 bp, Homo sapiens
gctggccacagatccccaggga

SEQ ID NO: 43695 - DNA, 22 bp, Homo sapiens
gtggctgcagcggctgtggaga

SEQ ID NO: 43696 - DNA, 22 bp, Homo sapiens
tggagccagagcgcagcctggg

SEQ ID NO: 43697 - DNA, 22 bp, Homo sapiens
tcttcctgtcaatgagaattaa

SEQ ID NO: 43698 - DNA, 22 bp, Homo sapiens
ttggatccatctcaggcatagg

SEQ ID NO: 43699 - DNA, 22 bp, Homo sapiens
ctgagctcaagcgatcctccca

SEQ ID NO: 43700 - DNA, 22 bp, Homo sapiens
agctgctgagccaggctgatgt

SEQ ID NO: 43701 - DNA, 17 bp, Homo sapiens
aggtgggtggatcacct

SEQ ID NO: 43702 - DNA, 22 bp, Homo sapiens
ggagaagcagcttcttgatgaa

SEQ ID NO: 43703 - DNA, 22 bp, Homo sapiens
gggtcgggcaggcgccctcgtc

SEQ ID NO: 43704 - DNA, 22 bp, Homo sapiens
tgcgccatgtgctctcggccct

SEQ ID NO: 43705 - DNA, 22 bp, Homo sapiens
taatggtgtttttctgtaattt

SEQ ID NO: 43706 - DNA, 22 bp, Homo sapiens
gtgtggtcgaagttctcccgga

SEQ ID NO: 43707 - DNA, 22 bp, Homo sapiens
gtagggttggagagcacaacca

SEQ ID NO: 43708 - DNA, 22 bp, Homo sapiens
ggtgtctatgattcagtttatg

SEQ ID NO: 43709 - DNA, 23 bp, Homo sapiens
aatgggtgcaactatccatgaca

SEQ ID NO: 43710 - DNA, 23 bp, Homo sapiens
agaaagtcatggccaggtttgat

SEQ ID NO: 43711 - DNA, 22 bp, Homo sapiens
attgtaaatagtgccacaataa

SEQ ID NO: 43712 - DNA, 22 bp, Homo sapiens
gagcctggagctggaacgaagc

SEQ ID NO: 43713 - DNA, 22 bp, Homo sapiens
gaccttgtgatccccctgcctt

SEQ ID NO: 43714 - DNA, 22 bp, Homo sapiens
ggaggctgagaggtcgcagtgg

SEQ ID NO: 43715 - DNA, 22 bp, Homo sapiens
tgtatgtatgaataagcaagat

SEQ ID NO: 43716 - DNA, 22 bp, Homo sapiens
tctagcaagctcgtgctcaagg

SEQ ID NO: 43717 - DNA, 22 bp, Homo sapiens
aacactgctgctgggttctgtg

SEQ ID NO: 43718 - DNA, 22 bp, Homo sapiens
gaggccactgtccctgccttcc

SEQ ID NO: 43719 - DNA, 22 bp, Homo sapiens
cccaggcttttctcttgcccca

SEQ ID NO: 43720 - DNA, 22 bp, Homo sapiens
tgtttgagttctagcgcattta

SEQ ID NO: 43721 - DNA, 22 bp, Homo sapiens
cccccagctctgctgggtcccg

SEQ ID NO: 43722 - DNA, 22 bp, Homo sapiens
tgaaatctttagtttctgtccc

SEQ ID NO: 43723 - DNA, 22 bp, Homo sapiens
cggcatccccacttcctcctgc

SEQ ID NO: 43724 - DNA, 22 bp, Homo sapiens
ggtgccagatgaggcccgcgat

SEQ ID NO: 43725 - DNA, 22 bp, Homo sapiens
agccaccaccactgaaaggtta

SEQ ID NO: 43726 - DNA, 22 bp, Homo sapiens
ccaggttggagttcagtggcgc

SEQ ID NO: 43727 - DNA, 22 bp, Homo sapiens
tactggacacgtatatatagat

SEQ ID NO: 43728 - DNA, 22 bp, Homo sapiens
caggcacggtggctcatgcctg

SEQ ID NO: 43729 - DNA, 22 bp, Homo sapiens
taagaaatttagttatagaatg

SEQ ID NO: 43730 - DNA, 22 bp, Homo sapiens
tctacatgcagcgaggggactt

SEQ ID NO: 43731 - DNA, 18 bp, Homo sapiens
cccggctaatttttggta

SEQ ID NO: 43732 - DNA, 22 bp, Homo sapiens
tcactgcaacctctgcctcccg

SEQ ID NO: 43733 - DNA, 22 bp, Homo sapiens
tggcagttcaggttggactctt

SEQ ID NO: 43734 - DNA, 22 bp, Homo sapiens
cgccggcttgaggcaggcggca

SEQ ID NO: 43735 - DNA, 22 bp, Homo sapiens
ggcctcgcggcttctggtggct

SEQ ID NO: 43736 - DNA, 23 bp, Homo sapiens
tcctcgcaggagggagatgatgc

SEQ ID NO: 43737 - DNA, 23 bp, Homo sapiens
agcagccagagatcctcggccct

SEQ ID NO: 43738 - DNA, 22 bp, Homo sapiens
ttttaatactgctattgtagga

SEQ ID NO: 43739 - DNA, 18 bp, Homo sapiens
atggtctcatactgggag

SEQ ID NO: 43740 - DNA, 23 bp, Homo sapiens
aagtggttttgaacccggaccct

SEQ ID NO: 43741 - DNA, 22 bp, Homo sapiens
acattaaaattgggtggggtaa

SEQ ID NO: 43742 - DNA, 22 bp, Homo sapiens
gatgtgtttccaggatttgttt

SEQ ID NO: 43743 - DNA, 22 bp, Homo sapiens
tgagtggacacctgcttcttta

SEQ ID NO: 43744 - DNA, 20 bp, Homo sapiens
gctctgtggtttgagtctcc

SEQ ID NO: 43745 - DNA, 22 bp, Homo sapiens
gctcactgcaagctccgcctcc

SEQ ID NO: 43746 - DNA, 22 bp, Homo sapiens
atgtcactgttgttattgttat

SEQ ID NO: 43747 - DNA, 22 bp, Homo sapiens
gtgcgcaccctcccggcatccc

SEQ ID NO: 43748 - DNA, 22 bp, Homo sapiens
ggcagggcaggaaagtcaggaa

SEQ ID NO: 43749 - DNA, 22 bp, Homo sapiens
atatccagcagcaggtgagtat

SEQ ID NO: 43750 - DNA, 22 bp, Homo sapiens
gtcaccagtgctaagaggtgga

SEQ ID NO: 43751 - DNA, 22 bp, Homo sapiens
gaagattgaaggctgggaatta

SEQ ID NO: 43752 - DNA, 22 bp, Homo sapiens
atcctagaatcagcccttgctg

SEQ ID NO: 43753 - DNA, 22 bp, Homo sapiens
aggggatggagctggaaggcag

SEQ ID NO: 43754 - DNA, 22 bp, Homo sapiens
cctacagttatattcttgattg

SEQ ID NO: 43755 - DNA, 22 bp, Homo sapiens
atcagagtagttgttgcccaga

SEQ ID NO: 43756 - DNA, 22 bp, Homo sapiens
ttccaactttgtcatatattat

SEQ ID NO: 43757 - DNA, 22 bp, Homo sapiens
gactacaggccggcatcagaga

SEQ ID NO: 43758 - DNA, 22 bp, Homo sapiens
ggaggaggggtgactgaatgct

SEQ ID NO: 43759 - DNA, 22 bp, Homo sapiens
gagctgagaagcagcgcttgat

SEQ ID NO: 43760 - DNA, 22 bp, Homo sapiens
acaattctgatggtttcccagt

SEQ ID NO: 43761 - DNA, 22 bp, Homo sapiens
ccctcccaggagtggccagaga

SEQ ID NO: 43762 - DNA, 22 bp, Homo sapiens
ccggtcccaggtgccccggtga

SEQ ID NO: 43763 - DNA, 23 bp, Homo sapiens
catgatgttaactttgttatgct

SEQ ID NO: 43764 - DNA, 22 bp, Homo sapiens
catgtgaattccaaagctaggt

SEQ ID NO: 43765 - DNA, 22 bp, Homo sapiens
ggagtgtcccgattttccaggt

SEQ ID NO: 43766 - DNA, 22 bp, Homo sapiens
gccctgccctctcggcactcgc

SEQ ID NO: 43767 - DNA, 22 bp, Homo sapiens
cagtggaggccttgggaccttt

SEQ ID NO: 43768 - DNA, 22 bp, Homo sapiens
cagccacttgtgatgctgggga

SEQ ID NO: 43769 - DNA, 22 bp, Homo sapiens
tcactgcaagctcctcctcctg

SEQ ID NO: 43770 - DNA, 22 bp, Homo sapiens
agcctagggttctgatgtcact

SEQ ID NO: 43771 - DNA, 17 bp, Homo sapiens
ttcttttctgagccttg

SEQ ID NO: 43772 - DNA, 22 bp, Homo sapiens
ggagtgaatcactagatgcaga

SEQ ID NO: 43773 - DNA, 22 bp, Homo sapiens
attgcactccagcctgggtgac

SEQ ID NO: 43774 - DNA, 22 bp, Homo sapiens
gagcagtaggagaaccctgagc

SEQ ID NO: 43775 - DNA, 22 bp, Homo sapiens
ccactgcactccagccttggca

SEQ ID NO: 43776 - DNA, 22 bp, Homo sapiens
cacccaggctggagtgcagtgg

SEQ ID NO: 43777 - DNA, 23 bp, Homo sapiens
ttgcttagagacctcctcatcag

SEQ ID NO: 43778 - DNA, 22 bp, Homo sapiens
ccaaagtgctaggattacaggc

SEQ ID NO: 43779 - DNA, 22 bp, Homo sapiens
aatgttacgatcaacaacacat

SEQ ID NO: 43780 - DNA, 22 bp, Homo sapiens
gcccagtggtaaaagcaggcct

SEQ ID NO: 43781 - DNA, 22 bp, Homo sapiens
gcggggttccgtgccccagagt

SEQ ID NO: 43782 - DNA, 22 bp, Homo sapiens
tgggctgtggagcacctttgca

SEQ ID NO: 43783 - DNA, 22 bp, Homo sapiens
accgcagtgacgtgggacttcc

SEQ ID NO: 43784 - DNA, 22 bp, Homo sapiens
cgttaataggtgcaaggtaagg

SEQ ID NO: 43785 - DNA, 22 bp, Homo sapiens
acacggcactttaggaaggggc

SEQ ID NO: 43786 - DNA, 22 bp, Homo sapiens
atgtgtcaggtacactcattag

SEQ ID NO: 43787 - DNA, 22 bp, Homo sapiens
tataaactcctcttgcattcct

SEQ ID NO: 43788 - DNA, 22 bp, Homo sapiens
ggtggctgcaatggctaacttc

SEQ ID NO: 43789 - DNA, 22 bp, Homo sapiens
gcaggtctatcaggctgcaggt

SEQ ID NO: 43790 - DNA, 22 bp, Homo sapiens
tctgcaggaagctggcggctga

SEQ ID NO: 43791 - DNA, 22 bp, Homo sapiens
agaggctgcacttgctcatgat

SEQ ID NO: 43792 - DNA, 22 bp, Homo sapiens
aggggttggacataagacagaa

SEQ ID NO: 43793 - DNA, 22 bp, Homo sapiens
agccttacataaacagccttat

SEQ ID NO: 43794 - DNA, 22 bp, Homo sapiens
tccttaggcaatttgggagagt

SEQ ID NO: 43795 - DNA, 22 bp, Homo sapiens
ggtgaggggctcctctgcccgg

SEQ ID NO: 43796 - DNA, 22 bp, Homo sapiens
ggaggcagaatagagtgtgggt

SEQ ID NO: 43797 - DNA, 22 bp, Homo sapiens
cagggatggcgctggctgcccg

SEQ ID NO: 43798 - DNA, 22 bp, Homo sapiens
gagctctgactgctgggtgaca

SEQ ID NO: 43799 - DNA, 22 bp, Homo sapiens
aagtggcagttcaggaagcaga

SEQ ID NO: 43800 - DNA, 22 bp, Homo sapiens
cctgattcagtggtgcccagag

SEQ ID NO: 43801 - DNA, 22 bp, Homo sapiens
gacaatatagttgaatgagcaa

SEQ ID NO: 43802 - DNA, 22 bp, Homo sapiens
gaagaaggtggcccaggggtag

SEQ ID NO: 43803 - DNA, 22 bp, Homo sapiens
cgggcaaggcgagactaggccc

SEQ ID NO: 43804 - DNA, 22 bp, Homo sapiens
atgtatatgcatgcattcaaag

SEQ ID NO: 43805 - DNA, 22 bp, Homo sapiens
attaagtgactaaagtaatgct

SEQ ID NO: 43806 - DNA, 22 bp, Homo sapiens
ttgtgctcctatgagaatctaa

SEQ ID NO: 43807 - DNA, 22 bp, Homo sapiens
tcactgcaacctccacctcctg

SEQ ID NO: 43808 - DNA, 22 bp, Homo sapiens
agcccgcatctcgctaaagata

SEQ ID NO: 43809 - DNA, 22 bp, Homo sapiens
catcatcaaaagtgacagagaa

SEQ ID NO: 43810 - DNA, 22 bp, Homo sapiens
ccagcccgaatccctggccagg

SEQ ID NO: 43811 - DNA, 22 bp, Homo sapiens
ctcgggcttgaggctgtttacc

SEQ ID NO: 43812 - DNA, 22 bp, Homo sapiens
cactgcactccagcttgggtga

SEQ ID NO: 43813 - DNA, 22 bp, Homo sapiens
taggattccagaacagtgctgc

SEQ ID NO: 43814 - DNA, 22 bp, Homo sapiens
aggatttctgtgcctggaaaat

SEQ ID NO: 43815 - DNA, 22 bp, Homo sapiens
gaccttgtgatctgcctgcctt

SEQ ID NO: 43816 - DNA, 22 bp, Homo sapiens
aggcgaagggaccagacggtag

SEQ ID NO: 43817 - DNA, 22 bp, Homo sapiens
cttctgagatgttgttttacag

SEQ ID NO: 43818 - DNA, 22 bp, Homo sapiens
tggtctgctgaacagccgtatc

SEQ ID NO: 43819 - DNA, 22 bp, Homo sapiens
tggcacttttcccagttttggt

SEQ ID NO: 43820 - DNA, 22 bp, Homo sapiens
aagtgctgagactacaggcatg

SEQ ID NO: 43821 - DNA, 22 bp, Homo sapiens
ggtgagttctcagcttattgca

SEQ ID NO: 43822 - DNA, 22 bp, Homo sapiens
aatgagatggaattcccgccta

SEQ ID NO: 43823 - DNA, 22 bp, Homo sapiens
ggaggtggagctggaagttcca

SEQ ID NO: 43824 - DNA, 22 bp, Homo sapiens
ttccacggggctccccgctctt

SEQ ID NO: 43825 - DNA, 22 bp, Homo sapiens
tttattggatatttacaagata

SEQ ID NO: 43826 - DNA, 22 bp, Homo sapiens
agccagggtctctcgctctgtt

SEQ ID NO: 43827 - DNA, 22 bp, Homo sapiens
aagcatttcaggtagagatatt

SEQ ID NO: 43828 - DNA, 22 bp, Homo sapiens
aaagtgctcggattacaggtat

SEQ ID NO: 43829 - DNA, 22 bp, Homo sapiens
aggaatgacagatgtccgcacc

SEQ ID NO: 43830 - DNA, 22 bp, Homo sapiens
gagatatgttggcagctggtat

SEQ ID NO: 43831 - DNA, 22 bp, Homo sapiens
atgccactgcactccagcctag

SEQ ID NO: 43832 - DNA, 22 bp, Homo sapiens
ggcagagcttgcagtgagccga

SEQ ID NO: 43833 - DNA, 22 bp, Homo sapiens
cgtgccactgcactctagcctg

SEQ ID NO: 43834 - DNA, 22 bp, Homo sapiens
ttgaggtcttcaggatcaggct

SEQ ID NO: 43835 - DNA, 22 bp, Homo sapiens
gttggctatgagagctttagtg

SEQ ID NO: 43836 - DNA, 22 bp, Homo sapiens
tgacttcctgcactcaggtgat

SEQ ID NO: 43837 - DNA, 22 bp, Homo sapiens
cactgcaagcaagctccgcctc

SEQ ID NO: 43838 - DNA, 22 bp, Homo sapiens
tctcattcttcagtggctttgt

SEQ ID NO: 43839 - DNA, 22 bp, Homo sapiens
ggcaatcattggcattctctgg

SEQ ID NO: 43840 - DNA, 22 bp, Homo sapiens
ttggccatctaagcccagccac

SEQ ID NO: 43841 - DNA, 22 bp, Homo sapiens
agagagcccgggccagggcaca

SEQ ID NO: 43842 - DNA, 17 bp, Homo sapiens
ctggagcagacaaaagg

SEQ ID NO: 43843 - DNA, 22 bp, Homo sapiens
tcaccttgtgatccgcccacct

SEQ ID NO: 43844 - DNA, 22 bp, Homo sapiens
tctcatttacttccacaggctg

SEQ ID NO: 43845 - DNA, 22 bp, Homo sapiens
aggtcaagagtaaatttgggta

SEQ ID NO: 43846 - DNA, 22 bp, Homo sapiens
tagccgggtgttgtgtcatgca

SEQ ID NO: 43847 - DNA, 22 bp, Homo sapiens
atgggctgtccattgctggctg

SEQ ID NO: 43848 - DNA, 21 bp, Homo sapiens
tgctccaggagggggcagtcc

SEQ ID NO: 43849 - DNA, 22 bp, Homo sapiens
cccaagaggtggaggttgcagt

SEQ ID NO: 43850 - DNA, 22 bp, Homo sapiens
tgttatatctaaatagccacat

SEQ ID NO: 43851 - DNA, 22 bp, Homo sapiens
atggcaccttccccagagctca

SEQ ID NO: 43852 - DNA, 22 bp, Homo sapiens
ctacttgttcactgtaggtcgc

SEQ ID NO: 43853 - DNA, 22 bp, Homo sapiens
tggaatgtcagctacaagaggg

SEQ ID NO: 43854 - DNA, 19 bp, Homo sapiens
actggcacacaggggctgc

SEQ ID NO: 43855 - DNA, 22 bp, Homo sapiens
tctgggtccgggactgtggatg

SEQ ID NO: 43856 - DNA, 22 bp, Homo sapiens
atattacacacggtatcacggg

SEQ ID NO: 43857 - DNA, 22 bp, Homo sapiens
ttgcttcttagatattcctctc

SEQ ID NO: 43858 - DNA, 22 bp, Homo sapiens
gggcggggggagctggaatgaa

SEQ ID NO: 43859 - DNA, 20 bp, Homo sapiens
agagtgagactccatctcag

SEQ ID NO: 43860 - DNA, 22 bp, Homo sapiens
ttcttctttccaattacatggt

SEQ ID NO: 43861 - DNA, 17 bp, Homo sapiens
tgtatttatcatgtcag

SEQ ID NO: 43862 - DNA, 22 bp, Homo sapiens
ttgtgctgtgagaatgctcatt

SEQ ID NO: 43863 - DNA, 22 bp, Homo sapiens
ccgccaggatattgtggctttt

SEQ ID NO: 43864 - DNA, 22 bp, Homo sapiens
tcttctatcctcagcccctgcc

SEQ ID NO: 43865 - DNA, 22 bp, Homo sapiens
acagcacttgggttttcctgtt

SEQ ID NO: 43866 - DNA, 18 bp, Homo sapiens
tctgccccagccgcactg

SEQ ID NO: 43867 - DNA, 22 bp, Homo sapiens
ctgctttgcatagctgccagag

SEQ ID NO: 43868 - DNA, 22 bp, Homo sapiens
caagcaccatgtgctccatgtt

SEQ ID NO: 43869 - DNA, 22 bp, Homo sapiens
acggggctagagaaggtttctt

SEQ ID NO: 43870 - DNA, 22 bp, Homo sapiens
aaaggctttaaaatgtacatat

SEQ ID NO: 43871 - DNA, 23 bp, Homo sapiens
aggtaggttattgctgctacctg

SEQ ID NO: 43872 - DNA, 22 bp, Homo sapiens
cctgtctctgcagggccctgcc

SEQ ID NO: 43873 - DNA, 22 bp, Homo sapiens
ggtggcagtagcactgggcctg

SEQ ID NO: 43874 - DNA, 22 bp, Homo sapiens
aggacagagggaccagagccca

SEQ ID NO: 43875 - DNA, 22 bp, Homo sapiens
ttataagactgtagtgagtatt

SEQ ID NO: 43876 - DNA, 22 bp, Homo sapiens
gttgtgaatagtgccgcaataa

SEQ ID NO: 43877 - DNA, 22 bp, Homo sapiens
ctgagctcacgccattctcctt

SEQ ID NO: 43878 - DNA, 22 bp, Homo sapiens
gatgccctggcctgtccccgca

SEQ ID NO: 43879 - DNA, 20 bp, Homo sapiens
ttggatgtgcatggccgtgc

SEQ ID NO: 43880 - DNA, 22 bp, Homo sapiens
tgatctggtcctactgtgggca

SEQ ID NO: 43881 - DNA, 22 bp, Homo sapiens
ctttatgaaaacctgaattatg

SEQ ID NO: 43882 - DNA, 22 bp, Homo sapiens
tagattatccctgatttgtcca

SEQ ID NO: 43883 - DNA, 22 bp, Homo sapiens
ctcagactagcctgtaccgaca

SEQ ID NO: 43884 - DNA, 22 bp, Homo sapiens
tcccttatctggtattttttag

SEQ ID NO: 43885 - DNA, 22 bp, Homo sapiens
cctgtcacctaggtactgagca

SEQ ID NO: 43886 - DNA, 22 bp, Homo sapiens
ctggtagtttgcaaaatggtgt

SEQ ID NO: 43887 - DNA, 22 bp, Homo sapiens
tctggctctggagtccacctgc

SEQ ID NO: 43888 - DNA, 18 bp, Homo sapiens
actctttctgcccacagg

SEQ ID NO: 43889 - DNA, 22 bp, Homo sapiens
aaaagagcttggttgattttgc

SEQ ID NO: 43890 - DNA, 22 bp, Homo sapiens
tgagatcatgtgtggaccccag

SEQ ID NO: 43891 - DNA, 19 bp, Homo sapiens
agggaatccggctgaggga

SEQ ID NO: 43892 - DNA, 19 bp, Homo sapiens
ttcacattggaagaagtag

SEQ ID NO: 43893 - DNA, 22 bp, Homo sapiens
agcaagattgaggcttcctcag

SEQ ID NO: 43894 - DNA, 22 bp, Homo sapiens
cagcctgtcggctccttcattc

SEQ ID NO: 43895 - DNA, 22 bp, Homo sapiens
tgggttagattccgcgaagcag

SEQ ID NO: 43896 - DNA, 19 bp, Homo sapiens
gcctcatttccacctcccc

SEQ ID NO: 43897 - DNA, 22 bp, Homo sapiens
ggagagcagggaggctgctctg

SEQ ID NO: 43898 - DNA, 22 bp, Homo sapiens
tgccgcaagtactgctgcctgt

SEQ ID NO: 43899 - DNA, 22 bp, Homo sapiens
cccgggaggcagaggttgcagt

SEQ ID NO: 43900 - DNA, 21 bp, Homo sapiens
agtagtttagcacagggtttg

SEQ ID NO: 43901 - DNA, 22 bp, Homo sapiens
tagatagattctcctatagagt

SEQ ID NO: 43902 - DNA, 22 bp, Homo sapiens
gctgcgccggatcccacgttcc

SEQ ID NO: 43903 - DNA, 22 bp, Homo sapiens
tacatagctcctagtgatgcat

SEQ ID NO: 43904 - DNA, 22 bp, Homo sapiens
tggcggcgtgtggactgaggac

SEQ ID NO: 43905 - DNA, 22 bp, Homo sapiens
accctccccaagaggtcgtgcc

SEQ ID NO: 43906 - DNA, 22 bp, Homo sapiens
tcaggggcttgaggtgcatgtc

SEQ ID NO: 43907 - DNA, 22 bp, Homo sapiens
ggcatagatttctttaggttta

SEQ ID NO: 43908 - DNA, 22 bp, Homo sapiens
gctggggaggcagcagagaaca

SEQ ID NO: 43909 - DNA, 22 bp, Homo sapiens
agattgtcattgacgatgagca

SEQ ID NO: 43910 - DNA, 22 bp, Homo sapiens
ggaatgaatttccagctgggtc

SEQ ID NO: 43911 - DNA, 22 bp, Homo sapiens
cctactctgagcgcctccgcat

SEQ ID NO: 43912 - DNA, 22 bp, Homo sapiens
tgcaggcctggactgatgtggt

SEQ ID NO: 43913 - DNA, 22 bp, Homo sapiens
ggacaagcctgtgagtgggttt

SEQ ID NO: 43914 - DNA, 22 bp, Homo sapiens
tgctgctgaggctaaagtatag

SEQ ID NO: 43915 - DNA, 22 bp, Homo sapiens
tggggtgagattcagatattca

SEQ ID NO: 43916 - DNA, 22 bp, Homo sapiens
tccgcccgcacgtatggagtgg

SEQ ID NO: 43917 - DNA, 22 bp, Homo sapiens
tgttatctgagcaacgtcgacg

SEQ ID NO: 43918 - DNA, 20 bp, Homo sapiens
aaactaaaggtgtttggttt

SEQ ID NO: 43919 - DNA, 17 bp, Homo sapiens
gggcagggactcctggg

SEQ ID NO: 43920 - DNA, 22 bp, Homo sapiens
gcccagcccagaaaggttcgga

SEQ ID NO: 43921 - DNA, 22 bp, Homo sapiens
ccaggctggagtgcaatggcgt

SEQ ID NO: 43922 - DNA, 22 bp, Homo sapiens
atggggctgttctctgccctgc

SEQ ID NO: 43923 - DNA, 22 bp, Homo sapiens
cggagtcttgctatgttgccca

SEQ ID NO: 43924 - DNA, 22 bp, Homo sapiens
ctacccttaagtttctgtgggg

SEQ ID NO: 43925 - DNA, 22 bp, Homo sapiens
tgacatttcctagtgctttgtg

SEQ ID NO: 43926 - DNA, 22 bp, Homo sapiens
aaaatatgtataactcttctgc

SEQ ID NO: 43927 - DNA, 22 bp, Homo sapiens
gcctggagaaaggaaggtggga

SEQ ID NO: 43928 - DNA, 22 bp, Homo sapiens
tgggaaatctttccgtatttat

SEQ ID NO: 43929 - DNA, 22 bp, Homo sapiens
cacagacagtgtccctttgttg

SEQ ID NO: 43930 - DNA, 22 bp, Homo sapiens
ttcactggtcctttataggaac

SEQ ID NO: 43931 - DNA, 22 bp, Homo sapiens
aaacatggccattcagactgtg

SEQ ID NO: 43932 - DNA, 22 bp, Homo sapiens
tcagcctgctccaagtgctgcc

SEQ ID NO: 43933 - DNA, 22 bp, Homo sapiens
tgactacaacctccacctcccg

SEQ ID NO: 43934 - DNA, 22 bp, Homo sapiens
atgcacacgtaccctacaaggc

SEQ ID NO: 43935 - DNA, 22 bp, Homo sapiens
ggcctctcttgggacagctgtc

SEQ ID NO: 43936 - DNA, 22 bp, Homo sapiens
ttcctggaaattatgctcacct

SEQ ID NO: 43937 - DNA, 22 bp, Homo sapiens
agcctgggcaacagagcaaaac

SEQ ID NO: 43938 - DNA, 22 bp, Homo sapiens
tccctgatgccttgatccgtgg

SEQ ID NO: 43939 - DNA, 22 bp, Homo sapiens
ttccatttggcacttcactgag

SEQ ID NO: 43940 - DNA, 22 bp, Homo sapiens
cagcagcattgctctggattcc

SEQ ID NO: 43941 - DNA, 20 bp, Homo sapiens
gggtgtgtgcagggcctggt

SEQ ID NO: 43942 - DNA, 22 bp, Homo sapiens
aggctcagatccttgtgtcctg

SEQ ID NO: 43943 - DNA, 22 bp, Homo sapiens
gtctccccagggccctcttcat

SEQ ID NO: 43944 - DNA, 22 bp, Homo sapiens
gcgaatctcagctggtgctgcg

SEQ ID NO: 43945 - DNA, 22 bp, Homo sapiens
ttgtgttaaggtgcatctagtg

SEQ ID NO: 43946 - DNA, 22 bp, Homo sapiens
tctcctggagcccagatgctgg

SEQ ID NO: 43947 - DNA, 22 bp, Homo sapiens
ttttctaacatctagtaatttg

SEQ ID NO: 43948 - DNA, 22 bp, Homo sapiens
tagcataacaggtaagagtgag

SEQ ID NO: 43949 - DNA, 22 bp, Homo sapiens
tgatatgtaactactccttata

SEQ ID NO: 43950 - DNA, 22 bp, Homo sapiens
ccctctctgctgcatagaggaa

SEQ ID NO: 43951 - DNA, 22 bp, Homo sapiens
acccatggtctggtggggccct

SEQ ID NO: 43952 - DNA, 22 bp, Homo sapiens
agtggagacaggacagtcgata

SEQ ID NO: 43953 - DNA, 22 bp, Homo sapiens
cttgtcagccaattgtggattt

SEQ ID NO: 43954 - DNA, 22 bp, Homo sapiens
gtggtgagattgctggatcaaa

SEQ ID NO: 43955 - DNA, 21 bp, Homo sapiens
ctgtggtacagctgggacgga

SEQ ID NO: 43956 - DNA, 22 bp, Homo sapiens
cactgcactccagcctgggtga

SEQ ID NO: 43957 - DNA, 22 bp, Homo sapiens
aggccaggaatccttgtcccag

SEQ ID NO: 43958 - DNA, 22 bp, Homo sapiens
taggcaagtggaccagaggttt

SEQ ID NO: 43959 - DNA, 22 bp, Homo sapiens
gtcagtaggaacctagggtcaa

SEQ ID NO: 43960 - DNA, 22 bp, Homo sapiens
acaaagccagattctggagcac

SEQ ID NO: 43961 - DNA, 22 bp, Homo sapiens
cggaagagggacagcgccagcc

SEQ ID NO: 43962 - DNA, 22 bp, Homo sapiens
acccatccagtgtccctgctag

SEQ ID NO: 43963 - DNA, 22 bp, Homo sapiens
gctccctggtagccatgctctc

SEQ ID NO: 43964 - DNA, 22 bp, Homo sapiens
ctgatagacaatcaccatggga

SEQ ID NO: 43965 - DNA, 22 bp, Homo sapiens
aaggagaaatggtagatgtgca

SEQ ID NO: 43966 - DNA, 17 bp, Homo sapiens
tggctctgtcctcagct

SEQ ID NO: 43967 - DNA, 22 bp, Homo sapiens
ctaaatgccccttctggcacag

SEQ ID NO: 43968 - DNA, 22 bp, Homo sapiens
ctgggaggcggaggttgtagtg

SEQ ID NO: 43969 - DNA, 22 bp, Homo sapiens
tgcagattcaaatgaaatgcaa

SEQ ID NO: 43970 - DNA, 22 bp, Homo sapiens
aaattagtgcaccaggttgaag

SEQ ID NO: 43971 - DNA, 22 bp, Homo sapiens
cagcgtctcgttgtgggcctcg

SEQ ID NO: 43972 - DNA, 22 bp, Homo sapiens
aaagcagaactgagagagctgg

SEQ ID NO: 43973 - DNA, 21 bp, Homo sapiens
tcgtgcagcagctgaggcttg

SEQ ID NO: 43974 - DNA, 21 bp, Homo sapiens
ctacttaagtaggggattagg

SEQ ID NO: 43975 - DNA, 21 bp, Homo sapiens
tggacttatggagtgtttctt

SEQ ID NO: 43976 - DNA, 22 bp, Homo sapiens
tctgccgtgcgaggtcccacca

SEQ ID NO: 43977 - DNA, 22 bp, Homo sapiens
ttgatcaaatcagctactgagg

SEQ ID NO: 43978 - DNA, 22 bp, Homo sapiens
gggctgggattgcttgctgtga

SEQ ID NO: 43979 - DNA, 21 bp, Homo sapiens
atgtagggtttgccttctcta

SEQ ID NO: 43980 - DNA, 22 bp, Homo sapiens
tcgggctcgctctcctagcgga

SEQ ID NO: 43981 - DNA, 22 bp, Homo sapiens
agaaagagatgaatgctttaag

SEQ ID NO: 43982 - DNA, 22 bp, Homo sapiens
agcaggaaggggatgatgggca

SEQ ID NO: 43983 - DNA, 22 bp, Homo sapiens
ctccaccccgtgccggtgctgg

SEQ ID NO: 43984 - DNA, 22 bp, Homo sapiens
gatgaaggggctggtgccctct

SEQ ID NO: 43985 - DNA, 22 bp, Homo sapiens
actgggctcaagtgattgtcct

SEQ ID NO: 43986 - DNA, 22 bp, Homo sapiens
tccaggctttggggcaggagcg

SEQ ID NO: 43987 - DNA, 22 bp, Homo sapiens
gaccatcctggccaacgtggta

SEQ ID NO: 43988 - DNA, 22 bp, Homo sapiens
gaggcaggaggattgcttgagc

SEQ ID NO: 43989 - DNA, 22 bp, Homo sapiens
gctgctttggaaagcatggaaa

SEQ ID NO: 43990 - DNA, 22 bp, Homo sapiens
gcagaggacacaggagggcaag

SEQ ID NO: 43991 - DNA, 22 bp, Homo sapiens
gcagctattgtctcctgggccc

SEQ ID NO: 43992 - DNA, 22 bp, Homo sapiens
agacaaagaaaccgtagaagca

SEQ ID NO: 43993 - DNA, 22 bp, Homo sapiens
atgaaatgctattttggctaga

SEQ ID NO: 43994 - DNA, 19 bp, Homo sapiens
atgtacccagtgtcaatcc

SEQ ID NO: 43995 - DNA, 22 bp, Homo sapiens
ttctccacccactcttttgttg

SEQ ID NO: 43996 - DNA, 22 bp, Homo sapiens
ttggttttgaaatagcttattg

SEQ ID NO: 43997 - DNA, 22 bp, Homo sapiens
tcataaattctggtgctgtgag

SEQ ID NO: 43998 - DNA, 22 bp, Homo sapiens
cagcaggaggtgagtagcaggt

SEQ ID NO: 43999 - DNA, 22 bp, Homo sapiens
ggagtgctttgaagccttcatt

SEQ ID NO: 44000 - DNA, 22 bp, Homo sapiens
ccagcctggttcagaattggct

SEQ ID NO: 44001 - DNA, 22 bp, Homo sapiens
aagaaatgtgaatattgaatag

SEQ ID NO: 44002 - DNA, 22 bp, Homo sapiens
cccaggatggggctgcagttat

SEQ ID NO: 44003 - DNA, 22 bp, Homo sapiens
ggcagcactgcagcttgttggg

SEQ ID NO: 44004 - DNA, 22 bp, Homo sapiens
tgcccagagcctgagaggatta

SEQ ID NO: 44005 - DNA, 22 bp, Homo sapiens
tggagagttctgtagatatcta

SEQ ID NO: 44006 - DNA, 22 bp, Homo sapiens
ctcctgcttcacgggcaccgcc

SEQ ID NO: 44007 - DNA, 22 bp, Homo sapiens
ccactgcacttcagcctgggtg

SEQ ID NO: 44008 - DNA, 22 bp, Homo sapiens
ctccttctgggcctggcagtgg

SEQ ID NO: 44009 - DNA, 22 bp, Homo sapiens
ttggtttccttaacagcctaaa

SEQ ID NO: 44010 - DNA, 22 bp, Homo sapiens
gaccagtcattactcatgccct

SEQ ID NO: 44011 - DNA, 22 bp, Homo sapiens
caatagtaaattacggaggaga

SEQ ID NO: 44012 - DNA, 22 bp, Homo sapiens
ctgattgagaaggaaggggatc

SEQ ID NO: 44013 - DNA, 22 bp, Homo sapiens
ctgctttggacaactattcttg

SEQ ID NO: 44014 - DNA, 22 bp, Homo sapiens
ggttccccaggcggcccttgga

SEQ ID NO: 44015 - DNA, 22 bp, Homo sapiens
tgtgtgagtaaggctgagagag

SEQ ID NO: 44016 - DNA, 22 bp, Homo sapiens
aacagtgctgttataaatgtac

SEQ ID NO: 44017 - DNA, 20 bp, Homo sapiens
tcacatcctctcccaacatg

SEQ ID NO: 44018 - DNA, 22 bp, Homo sapiens
tcacgtgagggacctgtgtctg

SEQ ID NO: 44019 - DNA, 23 bp, Homo sapiens
actgagccagggcctgggtcagc

SEQ ID NO: 44020 - DNA, 21 bp, Homo sapiens
tctctttctggaagcttccct

SEQ ID NO: 44021 - DNA, 21 bp, Homo sapiens
gtgcggatgccgtcattgtca

SEQ ID NO: 44022 - DNA, 22 bp, Homo sapiens
cacagctgtgagaagggagcct

SEQ ID NO: 44023 - DNA, 22 bp, Homo sapiens
tcactgcaacctccacctcccg

SEQ ID NO: 44024 - DNA, 22 bp, Homo sapiens
ccatgtggtgggaaggagaatg

SEQ ID NO: 44025 - DNA, 22 bp, Homo sapiens
cctcccctcagacagagactgg

SEQ ID NO: 44026 - DNA, 23 bp, Homo sapiens
tctctgcatgtcctgagcacatc

SEQ ID NO: 44027 - DNA, 22 bp, Homo sapiens
ccggcgtctcttccacttccta

SEQ ID NO: 44028 - DNA, 22 bp, Homo sapiens
cttggaggtggaagttgcagtg

SEQ ID NO: 44029 - DNA, 22 bp, Homo sapiens
tcttcccccgtgctccagtgca

SEQ ID NO: 44030 - DNA, 22 bp, Homo sapiens
tggtatgaccgtggtgcaagca

SEQ ID NO: 44031 - DNA, 22 bp, Homo sapiens
tctggcttcgcagctcccagcc

SEQ ID NO: 44032 - DNA, 23 bp, Homo sapiens
tcatgcccaggctccagatgtca

SEQ ID NO: 44033 - DNA, 22 bp, Homo sapiens
tccagtgtttttcttcacaggt

SEQ ID NO: 44034 - DNA, 19 bp, Homo sapiens
ccttgtctggtgaaggact

SEQ ID NO: 44035 - DNA, 22 bp, Homo sapiens
gcttggaagtaggattgggaga

SEQ ID NO: 44036 - DNA, 22 bp, Homo sapiens
tatcttaaaaatcgaagcagat

SEQ ID NO: 44037 - DNA, 22 bp, Homo sapiens
aatccaggtggcggaggttgtg

SEQ ID NO: 44038 - DNA, 23 bp, Homo sapiens
acagtcgtaggtatccttttcct

SEQ ID NO: 44039 - DNA, 22 bp, Homo sapiens
gcaggtggatcaccacgtcagg

SEQ ID NO: 44040 - DNA, 22 bp, Homo sapiens
agatggggtttcatcatgttgg

SEQ ID NO: 44041 - DNA, 22 bp, Homo sapiens
gaaagacatagttgcaagatgg

SEQ ID NO: 44042 - DNA, 22 bp, Homo sapiens
gggaaggccttgtcagcggatt

SEQ ID NO: 44043 - DNA, 22 bp, Homo sapiens
gtgaccatcatctcagctagtt

SEQ ID NO: 44044 - DNA, 22 bp, Homo sapiens
tctgtagtaggttgtagttctt

SEQ ID NO: 44045 - DNA, 22 bp, Homo sapiens
cttatagtatgatgttgagaat

SEQ ID NO: 44046 - DNA, 22 bp, Homo sapiens
ttcaatatgatattagctgtgg

SEQ ID NO: 44047 - DNA, 22 bp, Homo sapiens
agccaggatggtctcgatcggc

SEQ ID NO: 44048 - DNA, 22 bp, Homo sapiens
gaccttcttgctgtgtcctaac

SEQ ID NO: 44049 - DNA, 22 bp, Homo sapiens
ggctccccaggtccaggagctg

SEQ ID NO: 44050 - DNA, 22 bp, Homo sapiens
tgctcattggcgatctgaggga

SEQ ID NO: 44051 - DNA, 22 bp, Homo sapiens
gagacacaggcacagaagaggc

SEQ ID NO: 44052 - DNA, 22 bp, Homo sapiens
agggcgctgaaatactaacatg

SEQ ID NO: 44053 - DNA, 22 bp, Homo sapiens
atacatgcgccatgttggtgtg

SEQ ID NO: 44054 - DNA, 21 bp, Homo sapiens
cgcagagcgaacttgcggcgc

SEQ ID NO: 44055 - DNA, 22 bp, Homo sapiens
ttggcctggcgcggtggctcac

SEQ ID NO: 44056 - DNA, 22 bp, Homo sapiens
gagaaatgcatgcatgtcatca

SEQ ID NO: 44057 - DNA, 22 bp, Homo sapiens
gggggaagaaagaacatggcat

SEQ ID NO: 44058 - DNA, 22 bp, Homo sapiens
atgtttttggaaatgggaacat

SEQ ID NO: 44059 - DNA, 18 bp, Homo sapiens
tctgtgggatcagtgagg

SEQ ID NO: 44060 - DNA, 20 bp, Homo sapiens
tgtttactctagagggtaga

SEQ ID NO: 44061 - DNA, 22 bp, Homo sapiens
ccagaagcagagcctgaggcag

SEQ ID NO: 44062 - DNA, 22 bp, Homo sapiens
taggtcagaacaagcagtatcg

SEQ ID NO: 44063 - DNA, 23 bp, Homo sapiens
tgtgggcgcattgtaagggtagc

SEQ ID NO: 44064 - DNA, 22 bp, Homo sapiens
tgaggcaggagaatcacatgaa

SEQ ID NO: 44065 - DNA, 22 bp, Homo sapiens
tttcttctatgtgtgatatttt

SEQ ID NO: 44066 - DNA, 22 bp, Homo sapiens
tggtgccatcatagctcactgc

SEQ ID NO: 44067 - DNA, 22 bp, Homo sapiens
ggtcgagtcacttgttgccttt

SEQ ID NO: 44068 - DNA, 21 bp, Homo sapiens
agtggctctcagcttgctaag

SEQ ID NO: 44069 - DNA, 22 bp, Homo sapiens
gtggcagagccaaggctggagc

SEQ ID NO: 44070 - DNA, 22 bp, Homo sapiens
tttttccacataccctaggcca

SEQ ID NO: 44071 - DNA, 22 bp, Homo sapiens
gcagtgagttatgatcatgcca

SEQ ID NO: 44072 - DNA, 22 bp, Homo sapiens
ttacttaaacagaaatgcagaa

SEQ ID NO: 44073 - DNA, 22 bp, Homo sapiens
aagattttcagtgcctaaaaca

SEQ ID NO: 44074 - DNA, 22 bp, Homo sapiens
ggttcagagcctgcccagtata

SEQ ID NO: 44075 - DNA, 22 bp, Homo sapiens
ctggagggtggagagaagtctc

SEQ ID NO: 44076 - DNA, 22 bp, Homo sapiens
gactacaggtgtgtgccaccat

SEQ ID NO: 44077 - DNA, 22 bp, Homo sapiens
ttaccacagtgcctgtctaatg

SEQ ID NO: 44078 - DNA, 22 bp, Homo sapiens
ttgggctgaaccctgcagctga

SEQ ID NO: 44079 - DNA, 22 bp, Homo sapiens
cctgcctatgagacgttttgcc

SEQ ID NO: 44080 - DNA, 22 bp, Homo sapiens
atccccctcttggatggcggca

SEQ ID NO: 44081 - DNA, 22 bp, Homo sapiens
tgtccagctcgagacactatct

SEQ ID NO: 44082 - DNA, 22 bp, Homo sapiens
gagggtggtggcttaaggtgct

SEQ ID NO: 44083 - DNA, 22 bp, Homo sapiens
tgtaagtagtaatggaaggaca

SEQ ID NO: 44084 - DNA, 22 bp, Homo sapiens
tgaggctccttgtagagagtgg

SEQ ID NO: 44085 - DNA, 22 bp, Homo sapiens
ggtttattgttaataagtttga

SEQ ID NO: 44086 - DNA, 22 bp, Homo sapiens
tttgtcctaacagtggtaaagg

SEQ ID NO: 44087 - DNA, 22 bp, Homo sapiens
tcctgagataaatctcatgtga

SEQ ID NO: 44088 - DNA, 22 bp, Homo sapiens
catcccctgatgctcttgagta

SEQ ID NO: 44089 - DNA, 21 bp, Homo sapiens
gccatttcacacagacatttg

SEQ ID NO: 44090 - DNA, 22 bp, Homo sapiens
tgggaaagtctttatttctctt

SEQ ID NO: 44091 - DNA, 22 bp, Homo sapiens
cccaggaggcagagcttgcagt

SEQ ID NO: 44092 - DNA, 22 bp, Homo sapiens
tctctggttatgtcattaagca

SEQ ID NO: 44093 - DNA, 22 bp, Homo sapiens
gcagggcacaaggacgcacagg

SEQ ID NO: 44094 - DNA, 22 bp, Homo sapiens
acatgagatttgggtggtgata

SEQ ID NO: 44095 - DNA, 21 bp, Homo sapiens
gttcaaatcctgacactacac

SEQ ID NO: 44096 - DNA, 22 bp, Homo sapiens
aggagcagaccgtagtcctgca

SEQ ID NO: 44097 - DNA, 16 bp, Homo sapiens
aggctcagaggctgga

SEQ ID NO: 44098 - DNA, 22 bp, Homo sapiens
agtacccttttcactgtcacaa

SEQ ID NO: 44099 - DNA, 22 bp, Homo sapiens
tccacagtggttgaactagtaa

SEQ ID NO: 44100 - DNA, 22 bp, Homo sapiens
agaaaatgtgaacttgtgaatt

SEQ ID NO: 44101 - DNA, 22 bp, Homo sapiens
ttagtttataattcatttctgt

SEQ ID NO: 44102 - DNA, 22 bp, Homo sapiens
tcgccatggaagtccttgcgga

SEQ ID NO: 44103 - DNA, 22 bp, Homo sapiens
gtgtgtcccttggaacctcagc

SEQ ID NO: 44104 - DNA, 22 bp, Homo sapiens
gaaaattattgaaaatggctct

SEQ ID NO: 44105 - DNA, 22 bp, Homo sapiens
tcctcctgtctaccagttcctg

SEQ ID NO: 44106 - DNA, 22 bp, Homo sapiens
ttatatgtttctgtttggaggc

SEQ ID NO: 44107 - DNA, 22 bp, Homo sapiens
taggaatggtgctcagcagaaa

SEQ ID NO: 44108 - DNA, 22 bp, Homo sapiens
ggagttcacgatgttggccagg

SEQ ID NO: 44109 - DNA, 22 bp, Homo sapiens
tactcttttagccccacagaga

SEQ ID NO: 44110 - DNA, 22 bp, Homo sapiens
caggagtgttgattgctcagga

SEQ ID NO: 44111 - DNA, 22 bp, Homo sapiens
actgcacttcagcctgggtgac

SEQ ID NO: 44112 - DNA, 22 bp, Homo sapiens
aacccagggtggaggttgcagt

SEQ ID NO: 44113 - DNA, 22 bp, Homo sapiens
tgcgatgcaacagcttggcgga

SEQ ID NO: 44114 - DNA, 22 bp, Homo sapiens
cacccaggctggagtgcagtga

SEQ ID NO: 44115 - DNA, 20 bp, Homo sapiens
agcagagtgcccatcccgga

SEQ ID NO: 44116 - DNA, 22 bp, Homo sapiens
aactcaaagatgcatgacgctt

SEQ ID NO: 44117 - DNA, 22 bp, Homo sapiens
gaacgggtgcagccatgggccc

SEQ ID NO: 44118 - DNA, 22 bp, Homo sapiens
taatcctgtcttgaccatcagg

SEQ ID NO: 44119 - DNA, 22 bp, Homo sapiens
cccaggctggagtgcagtggcg

SEQ ID NO: 44120 - DNA, 22 bp, Homo sapiens
cactgcaacctccacctcctgg

SEQ ID NO: 44121 - DNA, 22 bp, Homo sapiens
tgagatggagtctcgctctgtt

SEQ ID NO: 44122 - DNA, 22 bp, Homo sapiens
tacaacaatttccacattagaa

SEQ ID NO: 44123 - DNA, 22 bp, Homo sapiens
ggggcccctcggacacgtgcgg

SEQ ID NO: 44124 - DNA, 22 bp, Homo sapiens
tcagtggagagcttccaggatt

SEQ ID NO: 44125 - DNA, 22 bp, Homo sapiens
tataactacttgaagagttcag

SEQ ID NO: 44126 - DNA, 22 bp, Homo sapiens
gggtaattggggccttgcagtg

SEQ ID NO: 44127 - DNA, 21 bp, Homo sapiens
cttccccaggctggtctgtat

SEQ ID NO: 44128 - DNA, 22 bp, Homo sapiens
tggaggcagccgtgaaccacct

SEQ ID NO: 44129 - DNA, 22 bp, Homo sapiens
agggagatcgaccgtgttatat

SEQ ID NO: 44130 - DNA, 22 bp, Homo sapiens
tgtagatattaattattccttt

SEQ ID NO: 44131 - DNA, 22 bp, Homo sapiens
gtcagtgtcttaacagagatta

SEQ ID NO: 44132 - DNA, 19 bp, Homo sapiens
taggaccctggtggccccc

SEQ ID NO: 44133 - DNA, 22 bp, Homo sapiens
tattagttgcaaaacattgact

SEQ ID NO: 44134 - DNA, 22 bp, Homo sapiens
gggcatttcttgtcaatgtagg

SEQ ID NO: 44135 - DNA, 22 bp, Homo sapiens
ggggatggaggcgtgtggtcct

SEQ ID NO: 44136 - DNA, 22 bp, Homo sapiens
ccaagcagagcagcctctctgg

SEQ ID NO: 44137 - DNA, 22 bp, Homo sapiens
ctttgcttgacactgtgattgt

SEQ ID NO: 44138 - DNA, 22 bp, Homo sapiens
ttaaacatttatggaggcagca

SEQ ID NO: 44139 - DNA, 22 bp, Homo sapiens
gggtccagtagttggtggccgt

SEQ ID NO: 44140 - DNA, 22 bp, Homo sapiens
ccaggcaggcgatggtgcagtg

SEQ ID NO: 44141 - DNA, 22 bp, Homo sapiens
gtgcaaaagtaattgtggtttt

SEQ ID NO: 44142 - DNA, 22 bp, Homo sapiens
catgtgtccacccttgaacaca

SEQ ID NO: 44143 - DNA, 22 bp, Homo sapiens
atgccactgcacttcagcctgg

SEQ ID NO: 44144 - DNA, 22 bp, Homo sapiens
tgaaatgtgtaatgtggatgcc

SEQ ID NO: 44145 - DNA, 20 bp, Homo sapiens
acctcctggcgggcatcctc

SEQ ID NO: 44146 - DNA, 22 bp, Homo sapiens
cggggccctggggctgaaggtc

SEQ ID NO: 44147 - DNA, 22 bp, Homo sapiens
tctcatggagtcaggagcagaa

SEQ ID NO: 44148 - DNA, 22 bp, Homo sapiens
ccctgccttgtctgggctaggt

SEQ ID NO: 44149 - DNA, 22 bp, Homo sapiens
tctgactcccatattccacttc

SEQ ID NO: 44150 - DNA, 22 bp, Homo sapiens
cactcagctgagccctcagccc

SEQ ID NO: 44151 - DNA, 22 bp, Homo sapiens
cagcctggtccccggctcaccc

SEQ ID NO: 44152 - DNA, 21 bp, Homo sapiens
gctcctggtgctgcgtggcgc

SEQ ID NO: 44153 - DNA, 22 bp, Homo sapiens
atcttgccagtctccaaatcaa

SEQ ID NO: 44154 - DNA, 22 bp, Homo sapiens
tgggccacacacagaagaatca

SEQ ID NO: 44155 - DNA, 22 bp, Homo sapiens
actgcactcctgcctgggtaac

SEQ ID NO: 44156 - DNA, 22 bp, Homo sapiens
acaggggacctaggaccctcgg

SEQ ID NO: 44157 - DNA, 22 bp, Homo sapiens
ggggtgtggacggctgtgccag

SEQ ID NO: 44158 - DNA, 22 bp, Homo sapiens
atggccctaatgagttggtgtt

SEQ ID NO: 44159 - DNA, 22 bp, Homo sapiens
ccaaagtgctgggattacaggt

SEQ ID NO: 44160 - DNA, 22 bp, Homo sapiens
caggaaggggctcactctggcc

SEQ ID NO: 44161 - DNA, 22 bp, Homo sapiens
gggggctccaggcgagaatgtg

SEQ ID NO: 44162 - DNA, 22 bp, Homo sapiens
tggacaacatagtgagacctca

SEQ ID NO: 44163 - DNA, 22 bp, Homo sapiens
tcactgcaagctctgccttccg

SEQ ID NO: 44164 - DNA, 22 bp, Homo sapiens
gtgtggctgaaatcaaggcagg

SEQ ID NO: 44165 - DNA, 22 bp, Homo sapiens
gggccccaagaacctcctcctg

SEQ ID NO: 44166 - DNA, 22 bp, Homo sapiens
aatgccttggagagcctagagg

SEQ ID NO: 44167 - DNA, 22 bp, Homo sapiens
aagacttgaccaggttgaaggc

SEQ ID NO: 44168 - DNA, 22 bp, Homo sapiens
aggaattgtgttgtagtggaga

SEQ ID NO: 44169 - DNA, 22 bp, Homo sapiens
gcccaggctggagttcagtggt

SEQ ID NO: 44170 - DNA, 22 bp, Homo sapiens
tttgtggcaggagcggagaccg

SEQ ID NO: 44171 - DNA, 22 bp, Homo sapiens
gtctgctcatgctaccgcgggc

SEQ ID NO: 44172 - DNA, 22 bp, Homo sapiens
tgcaatttttccatgacctaga

SEQ ID NO: 44173 - DNA, 22 bp, Homo sapiens
tgctgagcgcatccggcggccg

SEQ ID NO: 44174 - DNA, 22 bp, Homo sapiens
tgggaagaggggtataaagaag

SEQ ID NO: 44175 - DNA, 19 bp, Homo sapiens
tgagggtgagctttggaga

SEQ ID NO: 44176 - DNA, 22 bp, Homo sapiens
gccctgtgcaggtgtgcagcag

SEQ ID NO: 44177 - DNA, 22 bp, Homo sapiens
ctgagatggagtttcgctcttc

SEQ ID NO: 44178 - DNA, 22 bp, Homo sapiens
atagcagggatgtcagcaagta

SEQ ID NO: 44179 - DNA, 22 bp, Homo sapiens
tcctgccgtcctccggggcctc

SEQ ID NO: 44180 - DNA, 22 bp, Homo sapiens
tgctggaagggtcggcgtgggc

SEQ ID NO: 44181 - DNA, 22 bp, Homo sapiens
tccaggtgacagagacaggata

SEQ ID NO: 44182 - DNA, 22 bp, Homo sapiens
tttcataatactgtacatgaaa

SEQ ID NO: 44183 - DNA, 22 bp, Homo sapiens
ctgatcctcctttaagtagctg

SEQ ID NO: 44184 - DNA, 22 bp, Homo sapiens
tgagtgaggctgggcagtccct

SEQ ID NO: 44185 - DNA, 22 bp, Homo sapiens
cagcagcagtgttctagaatct

SEQ ID NO: 44186 - DNA, 22 bp, Homo sapiens
tacgggcacgcaccacgatgcc

SEQ ID NO: 44187 - DNA, 22 bp, Homo sapiens
ttctgggtttacatctgacttc

SEQ ID NO: 44188 - DNA, 22 bp, Homo sapiens
gctcatgactgtaatcccagca

SEQ ID NO: 44189 - DNA, 22 bp, Homo sapiens
ttttcatttttgtagatgcaag

SEQ ID NO: 44190 - DNA, 22 bp, Homo sapiens
tctcctggtacccttcctagca

SEQ ID NO: 44191 - DNA, 22 bp, Homo sapiens
tgtgtctcaagtcagagcatca

SEQ ID NO: 44192 - DNA, 22 bp, Homo sapiens
tcgcccaggctggaagtgcagt

SEQ ID NO: 44193 - DNA, 22 bp, Homo sapiens
gccctagcgccagctcagcacc

SEQ ID NO: 44194 - DNA, 22 bp, Homo sapiens
atggccaggcacctctggctga

SEQ ID NO: 44195 - DNA, 15 bp, Homo sapiens
gcaggcaggtcacct

SEQ ID NO: 44196 - DNA, 22 bp, Homo sapiens
ttggaagacaatgctgattctc

SEQ ID NO: 44197 - DNA, 22 bp, Homo sapiens
gggactggagtagaggccggtg

SEQ ID NO: 44198 - DNA, 22 bp, Homo sapiens
acacagagccaaaccatatcac

SEQ ID NO: 44199 - DNA, 22 bp, Homo sapiens
tctttcttgtgggtgccctttt

SEQ ID NO: 44200 - DNA, 22 bp, Homo sapiens
ccagggatgcagaggttgcagt

SEQ ID NO: 44201 - DNA, 22 bp, Homo sapiens
cacggtggcccacaggtgcaag

SEQ ID NO: 44202 - DNA, 22 bp, Homo sapiens
gtgggggctggaaatcttgcca

SEQ ID NO: 44203 - DNA, 22 bp, Homo sapiens
tggtcgaccagttggaaagtaa

SEQ ID NO: 44204 - DNA, 22 bp, Homo sapiens
tcgcgctgtagccgcgcagagt

SEQ ID NO: 44205 - DNA, 22 bp, Homo sapiens
gccaggttgctgacgacgatct

SEQ ID NO: 44206 - DNA, 19 bp, Homo sapiens
ggagccgccgcccttcatt

SEQ ID NO: 44207 - DNA, 22 bp, Homo sapiens
tcccttgggagtggtgaccaca

SEQ ID NO: 44208 - DNA, 22 bp, Homo sapiens
cttcctttgctgttcggaggtt

SEQ ID NO: 44209 - DNA, 22 bp, Homo sapiens
gggcaggaacaaatcaaatgat

SEQ ID NO: 44210 - DNA, 22 bp, Homo sapiens
atacagggacatccagtttttc

SEQ ID NO: 44211 - DNA, 21 bp, Homo sapiens
tgactgaggcttcttcacaca

SEQ ID NO: 44212 - DNA, 22 bp, Homo sapiens
gaggcacagagtaggtgcacac

SEQ ID NO: 44213 - DNA, 22 bp, Homo sapiens
ggttgcaaactcctgggatcaa

SEQ ID NO: 44214 - DNA, 22 bp, Homo sapiens
acagagacacggaagctaaaga

SEQ ID NO: 44215 - DNA, 22 bp, Homo sapiens
ttattttaccttcctctgagct

SEQ ID NO: 44216 - DNA, 17 bp, Homo sapiens
aggaggccctggcgttt

SEQ ID NO: 44217 - DNA, 22 bp, Homo sapiens
cttagatgaagtcacagaaccc

SEQ ID NO: 44218 - DNA, 22 bp, Homo sapiens
gggttggcatcagggttctgtg

SEQ ID NO: 44219 - DNA, 22 bp, Homo sapiens
gagggggctagcgcagtgccca

SEQ ID NO: 44220 - DNA, 22 bp, Homo sapiens
ttctccctgtcctatcaagact

SEQ ID NO: 44221 - DNA, 22 bp, Homo sapiens
gatggtgcaggtgaagtgctgg

SEQ ID NO: 44222 - DNA, 22 bp, Homo sapiens
ttctttgcccatgtttcctaag

SEQ ID NO: 44223 - DNA, 22 bp, Homo sapiens
atttcagtattatacaactgct

SEQ ID NO: 44224 - DNA, 22 bp, Homo sapiens
gggaagtgatggagccaggatt

SEQ ID NO: 44225 - DNA, 22 bp, Homo sapiens
ctggagggctgcagcgaggctg

SEQ ID NO: 44226 - DNA, 22 bp, Homo sapiens
aggtcaccatggcatgctccac

SEQ ID NO: 44227 - DNA, 22 bp, Homo sapiens
tttcccaggctggaatgcagtg

SEQ ID NO: 44228 - DNA, 22 bp, Homo sapiens
ggtgtcagactttgcatatcct

SEQ ID NO: 44229 - DNA, 22 bp, Homo sapiens
gaggccacggaagggagctgtg

SEQ ID NO: 44230 - DNA, 22 bp, Homo sapiens
gcaactgaacatgtgtgtggcc

SEQ ID NO: 44231 - DNA, 22 bp, Homo sapiens
aatatgcactctgatttagcag

SEQ ID NO: 44232 - DNA, 22 bp, Homo sapiens
tgagatggagtctcactctgtt

SEQ ID NO: 44233 - DNA, 22 bp, Homo sapiens
tgtgttgtgacattcttggatg

SEQ ID NO: 44234 - DNA, 23 bp, Homo sapiens
cagagctggcttcatgggtgtgc

SEQ ID NO: 44235 - DNA, 22 bp, Homo sapiens
actcttgattgatttagtcttt

SEQ ID NO: 44236 - DNA, 22 bp, Homo sapiens
ggctggtgttgagtgcctgtag

SEQ ID NO: 44237 - DNA, 22 bp, Homo sapiens
cagtgacgtaaactgcatgtgc

SEQ ID NO: 44238 - DNA, 22 bp, Homo sapiens
atttacaggtagaattttaagt

SEQ ID NO: 44239 - DNA, 22 bp, Homo sapiens
ttacatgtggtgtgaagaagag

SEQ ID NO: 44240 - DNA, 22 bp, Homo sapiens
ttgagacacagtttcactctgt

SEQ ID NO: 44241 - DNA, 22 bp, Homo sapiens
cctccccacagcccaggagact

SEQ ID NO: 44242 - DNA, 22 bp, Homo sapiens
tagaagaaagtgaagctgggga

SEQ ID NO: 44243 - DNA, 22 bp, Homo sapiens
gtggcatgtgcctgtaatctca

SEQ ID NO: 44244 - DNA, 22 bp, Homo sapiens
gtaggtcagacataagaggaca

SEQ ID NO: 44245 - DNA, 22 bp, Homo sapiens
ctgtccccacccaaatctcatc

SEQ ID NO: 44246 - DNA, 22 bp, Homo sapiens
gacttctgaattcctatcaggt

SEQ ID NO: 44247 - DNA, 22 bp, Homo sapiens
tcccaggccacacttggggaac

SEQ ID NO: 44248 - DNA, 22 bp, Homo sapiens
actgcaacctccacctcctggg

SEQ ID NO: 44249 - DNA, 22 bp, Homo sapiens
acaggggattgattggaagtct

SEQ ID NO: 44250 - DNA, 22 bp, Homo sapiens
aggggaggtgtccccaaatctc

SEQ ID NO: 44251 - DNA, 22 bp, Homo sapiens
tggcactgaagctggaaagcct

SEQ ID NO: 44252 - DNA, 22 bp, Homo sapiens
ttacactttaaatccagcttgt

SEQ ID NO: 44253 - DNA, 22 bp, Homo sapiens
aacttgccaagagctttgctag

SEQ ID NO: 44254 - DNA, 22 bp, Homo sapiens
tggcaccatcaaggctgagaac

SEQ ID NO: 44255 - DNA, 22 bp, Homo sapiens
tgatatgtccctcgacatcagg

SEQ ID NO: 44256 - DNA, 22 bp, Homo sapiens
ggtgtgattatgacatgtgact

SEQ ID NO: 44257 - DNA, 22 bp, Homo sapiens
tttggtgttccggtcattgctg

SEQ ID NO: 44258 - DNA, 22 bp, Homo sapiens
acactgcagatgaaagcataag

SEQ ID NO: 44259 - DNA, 22 bp, Homo sapiens
ttctcccctttagggcctacgg

SEQ ID NO: 44260 - DNA, 22 bp, Homo sapiens
aacccaggaggcggaggttgtg

SEQ ID NO: 44261 - DNA, 22 bp, Homo sapiens
tctgcggtccccttctcgccct

SEQ ID NO: 44262 - DNA, 20 bp, Homo sapiens
aatgctgcttctttttgcat

SEQ ID NO: 44263 - DNA, 22 bp, Homo sapiens
ggaaaagtgttaaggtgttgat

SEQ ID NO: 44264 - DNA, 22 bp, Homo sapiens
gtagatgagctcacatgacctt

SEQ ID NO: 44265 - DNA, 20 bp, Homo sapiens
cagcagtggatgagagtttt

SEQ ID NO: 44266 - DNA, 22 bp, Homo sapiens
gtggtgtaggtcacagttagga

SEQ ID NO: 44267 - DNA, 20 bp, Homo sapiens
aaattactgccacacatttc

SEQ ID NO: 44268 - DNA, 22 bp, Homo sapiens
ctccccattatgcagtcattat

SEQ ID NO: 44269 - DNA, 22 bp, Homo sapiens
tctcgacagcctggcacagtgg

SEQ ID NO: 44270 - DNA, 18 bp, Homo sapiens
gcagtgaagaaagagctt

SEQ ID NO: 44271 - DNA, 20 bp, Homo sapiens
gggcaaggaaacagccccca

SEQ ID NO: 44272 - DNA, 22 bp, Homo sapiens
tttgagatggagtcttgctctg

SEQ ID NO: 44273 - DNA, 20 bp, Homo sapiens
caggtccagcacgtgcacgg

SEQ ID NO: 44274 - DNA, 22 bp, Homo sapiens
tgttttaagggtcaactgtcac

SEQ ID NO: 44275 - DNA, 22 bp, Homo sapiens
cctgggctctgtcagaattggg

SEQ ID NO: 44276 - DNA, 22 bp, Homo sapiens
cggtcaggtgcagcgttggcac

SEQ ID NO: 44277 - DNA, 21 bp, Homo sapiens
tttcttaggctctaaaatgac

SEQ ID NO: 44278 - DNA, 22 bp, Homo sapiens
tttggggatgtctgagttgttg

SEQ ID NO: 44279 - DNA, 19 bp, Homo sapiens
tctgaagaattagagagca

SEQ ID NO: 44280 - DNA, 22 bp, Homo sapiens
agtgagtttagggtgcaggtgt

SEQ ID NO: 44281 - DNA, 22 bp, Homo sapiens
tcagtttttctatactttgtag

SEQ ID NO: 44282 - DNA, 22 bp, Homo sapiens
aacccaggagatggaggttgtg

SEQ ID NO: 44283 - DNA, 21 bp, Homo sapiens
caatggcgagatcttggctca

SEQ ID NO: 44284 - DNA, 22 bp, Homo sapiens
gcgggccaccttggagagcgct

SEQ ID NO: 44285 - DNA, 22 bp, Homo sapiens
ctcctgagctctgaggaagctt

SEQ ID NO: 44286 - DNA, 22 bp, Homo sapiens
ggctcagatggtttgttctaga

SEQ ID NO: 44287 - DNA, 19 bp, Homo sapiens
tcctggggaggggcatggc

SEQ ID NO: 44288 - DNA, 22 bp, Homo sapiens
cccaggccctggcagagcttgt

SEQ ID NO: 44289 - DNA, 22 bp, Homo sapiens
tattgggtaaagatccagtttt

SEQ ID NO: 44290 - DNA, 22 bp, Homo sapiens
gcctcctggggtgccatcatct

SEQ ID NO: 44291 - DNA, 22 bp, Homo sapiens
aagtgctgggattacaggggtg

SEQ ID NO: 44292 - DNA, 23 bp, Homo sapiens
caccactttctccttctccttgg

SEQ ID NO: 44293 - DNA, 22 bp, Homo sapiens
cagatgtacatgaagggcaatg

SEQ ID NO: 44294 - DNA, 22 bp, Homo sapiens
ggaggtggaggttgcagtgagc

SEQ ID NO: 44295 - DNA, 22 bp, Homo sapiens
ggaggcggaggttgcagtgagt

SEQ ID NO: 44296 - DNA, 22 bp, Homo sapiens
cacttgttggtggtgaaatcac

SEQ ID NO: 44297 - DNA, 22 bp, Homo sapiens
gagctactgaaatattgatttt

SEQ ID NO: 44298 - DNA, 22 bp, Homo sapiens
tgccatagcaatggtaagctga

SEQ ID NO: 44299 - DNA, 22 bp, Homo sapiens
tacgcctgtaatcccagcactt

SEQ ID NO: 44300 - DNA, 22 bp, Homo sapiens
ccaggagttggaagctgccatg

SEQ ID NO: 44301 - DNA, 22 bp, Homo sapiens
cagctggttgaagaggagctgg

SEQ ID NO: 44302 - DNA, 22 bp, Homo sapiens
ggtgacagtggttaaaatttgt

SEQ ID NO: 44303 - DNA, 22 bp, Homo sapiens
ggtgtagctctgtgtcccactg

SEQ ID NO: 44304 - DNA, 22 bp, Homo sapiens
gagagtctaggaacctcatata

SEQ ID NO: 44305 - DNA, 22 bp, Homo sapiens
cgggttcacgccattctcctgc

SEQ ID NO: 44306 - DNA, 21 bp, Homo sapiens
tcttttctcagctttgtggtt

SEQ ID NO: 44307 - DNA, 22 bp, Homo sapiens
cagtggcctctggctttgctgt

SEQ ID NO: 44308 - DNA, 22 bp, Homo sapiens
ttgcaattgctatggagagcgt

SEQ ID NO: 44309 - DNA, 22 bp, Homo sapiens
gaaaagagacagggtgggtgat

SEQ ID NO: 44310 - DNA, 17 bp, Homo sapiens
gtaaggcttgcagatgc

SEQ ID NO: 44311 - DNA, 22 bp, Homo sapiens
atgccaggaacaaacagtggtg

SEQ ID NO: 44312 - DNA, 22 bp, Homo sapiens
tggagccagcggcctgctgagg

SEQ ID NO: 44313 - DNA, 22 bp, Homo sapiens
tgcgcctgtaagtccagagtcc

SEQ ID NO: 44314 - DNA, 22 bp, Homo sapiens
aggctgtagtgcatgtgctatg

SEQ ID NO: 44315 - DNA, 22 bp, Homo sapiens
caggagctcaagaccaccctgg

SEQ ID NO: 44316 - DNA, 22 bp, Homo sapiens
ccgggccccacggtgacctcag

SEQ ID NO: 44317 - DNA, 22 bp, Homo sapiens
gaagggaactgggtctccttgt

SEQ ID NO: 44318 - DNA, 22 bp, Homo sapiens
tgtctcttttcaagctaccctt

SEQ ID NO: 44319 - DNA, 22 bp, Homo sapiens
tgtccccacccaaatctcatct

SEQ ID NO: 44320 - DNA, 22 bp, Homo sapiens
ggctcaatgcaacttctgcctc

SEQ ID NO: 44321 - DNA, 22 bp, Homo sapiens
ttgagatgtcttttggcattat

SEQ ID NO: 44322 - DNA, 22 bp, Homo sapiens
agctcaatgcaacctccgcctc

SEQ ID NO: 44323 - DNA, 20 bp, Homo sapiens
tcagccattccttacctttc

SEQ ID NO: 44324 - DNA, 22 bp, Homo sapiens
aggcaggaaaatcgcttgaacc

SEQ ID NO: 44325 - DNA, 22 bp, Homo sapiens
aaagaggcaatcaatgtagcaa

SEQ ID NO: 44326 - DNA, 22 bp, Homo sapiens
tcaccgaggctggagtgcagtg

SEQ ID NO: 44327 - DNA, 22 bp, Homo sapiens
agaaacgcctgtgaaattatct

SEQ ID NO: 44328 - DNA, 22 bp, Homo sapiens
gcccaggaggcagaggttgtgg

SEQ ID NO: 44329 - DNA, 22 bp, Homo sapiens
ttgagatggagcctcagtcttg

SEQ ID NO: 44330 - DNA, 22 bp, Homo sapiens
gcagtggcatgatgtgggctca

SEQ ID NO: 44331 - DNA, 22 bp, Homo sapiens
catctcccacttccttgggggt

SEQ ID NO: 44332 - DNA, 22 bp, Homo sapiens
ccaggagttggaggctgcagtg

SEQ ID NO: 44333 - DNA, 22 bp, Homo sapiens
ttgtcacagcagcaaaggctct

SEQ ID NO: 44334 - DNA, 22 bp, Homo sapiens
ctgcgtgagcgtgcccgtcttg

SEQ ID NO: 44335 - DNA, 22 bp, Homo sapiens
ctgtccctgagcaactcctgtt

SEQ ID NO: 44336 - DNA, 22 bp, Homo sapiens
ggtctcttgtccaaggtcacac

SEQ ID NO: 44337 - DNA, 22 bp, Homo sapiens
tgaggcaggaggattgcaggat

SEQ ID NO: 44338 - DNA, 22 bp, Homo sapiens
cagggaaagtcccaccccacac

SEQ ID NO: 44339 - DNA, 22 bp, Homo sapiens
atacagttatagtcagggctaa

SEQ ID NO: 44340 - DNA, 22 bp, Homo sapiens
ttacctctagctctttgcttgt

SEQ ID NO: 44341 - DNA, 22 bp, Homo sapiens
aattgcaaattcagacttaaga

SEQ ID NO: 44342 - DNA, 22 bp, Homo sapiens
tggtcttagctggaaggaggga

SEQ ID NO: 44343 - DNA, 22 bp, Homo sapiens
ttggaaacgtcaccttttcctt

SEQ ID NO: 44344 - DNA, 22 bp, Homo sapiens
cgtcatcacggcaagcatctcc

SEQ ID NO: 44345 - DNA, 22 bp, Homo sapiens
actgcaagaatggtaatatttg

SEQ ID NO: 44346 - DNA, 22 bp, Homo sapiens
tgggtagtttcccctgccctgc

SEQ ID NO: 44347 - DNA, 22 bp, Homo sapiens
gtgtgggctgcagaggcacagc

SEQ ID NO: 44348 - DNA, 22 bp, Homo sapiens
tcacaactgggtgtcttcatca

SEQ ID NO: 44349 - DNA, 22 bp, Homo sapiens
tctctagtctcctttaacctga

SEQ ID NO: 44350 - DNA, 22 bp, Homo sapiens
ggagtagctgcattccgagcac

SEQ ID NO: 44351 - DNA, 22 bp, Homo sapiens
cgccgcctgctgcagcagctgt

SEQ ID NO: 44352 - DNA, 22 bp, Homo sapiens
agcctattccaggatgagctca

SEQ ID NO: 44353 - DNA, 22 bp, Homo sapiens
aagccaatgctagcccacatgc

SEQ ID NO: 44354 - DNA, 22 bp, Homo sapiens
ttgcatagtgctgaggttcggg

SEQ ID NO: 44355 - DNA, 22 bp, Homo sapiens
gtatggcactatcctctctgat

SEQ ID NO: 44356 - DNA, 22 bp, Homo sapiens
ggccctggcagccacgaaagcc

SEQ ID NO: 44357 - DNA, 23 bp, Homo sapiens
ggactgcaatggcgccgtctcag

SEQ ID NO: 44358 - DNA, 22 bp, Homo sapiens
cagcctttgggtcagaagattc

SEQ ID NO: 44359 - DNA, 22 bp, Homo sapiens
aggaatgacatagaaaggggag

SEQ ID NO: 44360 - DNA, 22 bp, Homo sapiens
gatggaggagatggcagggtgc

SEQ ID NO: 44361 - DNA, 22 bp, Homo sapiens
agggggctccttggtgtgcaga

SEQ ID NO: 44362 - DNA, 22 bp, Homo sapiens
ctattattagataatctacttg

SEQ ID NO: 44363 - DNA, 22 bp, Homo sapiens
cctcctgcacctccaggaactc

SEQ ID NO: 44364 - DNA, 22 bp, Homo sapiens
tcttgccacttcatcccctttc

SEQ ID NO: 44365 - DNA, 22 bp, Homo sapiens
tctgacattagattaattggaa

SEQ ID NO: 44366 - DNA, 22 bp, Homo sapiens
aagatacagacagagccaaaat

SEQ ID NO: 44367 - DNA, 22 bp, Homo sapiens
tcccctttgtcttcctgtgggt

SEQ ID NO: 44368 - DNA, 22 bp, Homo sapiens
gaggcaaagcatgtggctcagg

SEQ ID NO: 44369 - DNA, 22 bp, Homo sapiens
tgtgagttattttcaggagttt

SEQ ID NO: 44370 - DNA, 22 bp, Homo sapiens
tttacacagaggacactgggct

SEQ ID NO: 44371 - DNA, 22 bp, Homo sapiens
ggagtgactcacagctgggaca

SEQ ID NO: 44372 - DNA, 22 bp, Homo sapiens
tcttcacgccaagtgcccctca

SEQ ID NO: 44373 - DNA, 22 bp, Homo sapiens
atgaattgaggaaaacagtcgt

SEQ ID NO: 44374 - DNA, 22 bp, Homo sapiens
tcactgcaatctcagcctcctg

SEQ ID NO: 44375 - DNA, 22 bp, Homo sapiens
aggtaaagacagtgaaagaggg

SEQ ID NO: 44376 - DNA, 22 bp, Homo sapiens
gggtgtagaaagaaccctctgg

SEQ ID NO: 44377 - DNA, 22 bp, Homo sapiens
ccggctactcgggaggctgacg

SEQ ID NO: 44378 - DNA, 22 bp, Homo sapiens
ggcatgcatgttgttttaggtg

SEQ ID NO: 44379 - DNA, 22 bp, Homo sapiens
ctgggggtcttgaaagggagag

SEQ ID NO: 44380 - DNA, 22 bp, Homo sapiens
ggcaggaggtgagtggcgggtg

SEQ ID NO: 44381 - DNA, 18 bp, Homo sapiens
taggttacagccagccag

SEQ ID NO: 44382 - DNA, 22 bp, Homo sapiens
tcacagagttaaaagtttcttt

SEQ ID NO: 44383 - DNA, 22 bp, Homo sapiens
tgggaggccgaggcaggtggat

SEQ ID NO: 44384 - DNA, 22 bp, Homo sapiens
ccagcagagcatggggaggaag

SEQ ID NO: 44385 - DNA, 22 bp, Homo sapiens
gggagaggttacccgagcaact

SEQ ID NO: 44386 - DNA, 22 bp, Homo sapiens
tagtgccctcccctttgggata

SEQ ID NO: 44387 - DNA, 22 bp, Homo sapiens
tctgacattttgagaatgacat

SEQ ID NO: 44388 - DNA, 22 bp, Homo sapiens
ggcttctctccagtatgcattc

SEQ ID NO: 44389 - DNA, 22 bp, Homo sapiens
agggagcaaaggtttcagggtt

SEQ ID NO: 44390 - DNA, 19 bp, Homo sapiens
ttctggtctggaatcaagg

SEQ ID NO: 44391 - DNA, 22 bp, Homo sapiens
gggaagagggagctggaatgat

SEQ ID NO: 44392 - DNA, 22 bp, Homo sapiens
gggtggtggccagcagtgggca

SEQ ID NO: 44393 - DNA, 22 bp, Homo sapiens
tggattcacaccattctcctgc

SEQ ID NO: 44394 - DNA, 22 bp, Homo sapiens
aagggctctgtgcttgtcccat

SEQ ID NO: 44395 - DNA, 22 bp, Homo sapiens
gcccccgtagtagatgaggcgc

SEQ ID NO: 44396 - DNA, 22 bp, Homo sapiens
actgcacttcagcctgggtgtc

SEQ ID NO: 44397 - DNA, 22 bp, Homo sapiens
gcctgtgtctgggtggccagag

SEQ ID NO: 44398 - DNA, 22 bp, Homo sapiens
gagtggctattgatccgtgatg

SEQ ID NO: 44399 - DNA, 21 bp, Homo sapiens
ggtgacacgtggccccgctct

SEQ ID NO: 44400 - DNA, 22 bp, Homo sapiens
tgaggcaggagttcaggctgcg

SEQ ID NO: 44401 - DNA, 22 bp, Homo sapiens
tactgtactgcagttctgcaaa

SEQ ID NO: 44402 - DNA, 22 bp, Homo sapiens
tgatatgcatgtaagggagaca

SEQ ID NO: 44403 - DNA, 22 bp, Homo sapiens
tgtttcttacgtttttagaggc

SEQ ID NO: 44404 - DNA, 22 bp, Homo sapiens
ggcggctactcctcctggtgag

SEQ ID NO: 44405 - DNA, 23 bp, Homo sapiens
cctgcctccccatcagttataca

SEQ ID NO: 44406 - DNA, 22 bp, Homo sapiens
tgggattcaccatgggcttcag

SEQ ID NO: 44407 - DNA, 22 bp, Homo sapiens
gatttttatataaagtgagaaa

SEQ ID NO: 44408 - DNA, 22 bp, Homo sapiens
ttccggacgcccgtcttccagc

SEQ ID NO: 44409 - DNA, 22 bp, Homo sapiens
tgttcagaacaaaggtaaatga

SEQ ID NO: 44410 - DNA, 22 bp, Homo sapiens
gctcactgcaacctccacctcc

SEQ ID NO: 44411 - DNA, 22 bp, Homo sapiens
gaaaggagagggttaaggagct

SEQ ID NO: 44412 - DNA, 22 bp, Homo sapiens
tcccaccttccgtggaacccgt

SEQ ID NO: 44413 - DNA, 23 bp, Homo sapiens
tcctgtcaagtgcttgttcctgc

SEQ ID NO: 44414 - DNA, 22 bp, Homo sapiens
gctaggttggggaagttctcct

SEQ ID NO: 44415 - DNA, 23 bp, Homo sapiens
actcgtggaattctctgcgatcg

SEQ ID NO: 44416 - DNA, 19 bp, Homo sapiens
acacagggatcagagggtt

SEQ ID NO: 44417 - DNA, 22 bp, Homo sapiens
gggcttggcacatgggctcagc

SEQ ID NO: 44418 - DNA, 22 bp, Homo sapiens
agcccagaggctgggcgtgcat

SEQ ID NO: 44419 - DNA, 22 bp, Homo sapiens
gaggtgtcatcaggcagctctg

SEQ ID NO: 44420 - DNA, 22 bp, Homo sapiens
cccagacccagagggaggcagg

SEQ ID NO: 44421 - DNA, 22 bp, Homo sapiens
ttttggccacatccttttgagt

SEQ ID NO: 44422 - DNA, 17 bp, Homo sapiens
tccttcagtgcctctgc

SEQ ID NO: 44423 - DNA, 22 bp, Homo sapiens
tctgctctgtggcttcagctaa

SEQ ID NO: 44424 - DNA, 22 bp, Homo sapiens
gcaggcagatcacctgtcagga

SEQ ID NO: 44425 - DNA, 22 bp, Homo sapiens
tttctgagaaattaaacacttt

SEQ ID NO: 44426 - DNA, 22 bp, Homo sapiens
taaatacttagttttgtgtcta

SEQ ID NO: 44427 - DNA, 23 bp, Homo sapiens
ccagtgattgcctggaaggaggt

SEQ ID NO: 44428 - DNA, 22 bp, Homo sapiens
gatggcacacagacatccccgc

SEQ ID NO: 44429 - DNA, 22 bp, Homo sapiens
tgaggtgccacccaagagcctt

SEQ ID NO: 44430 - DNA, 22 bp, Homo sapiens
cacctgtacagggccgggctgg

SEQ ID NO: 44431 - DNA, 22 bp, Homo sapiens
cagcccgccctgaactttcggg

SEQ ID NO: 44432 - DNA, 22 bp, Homo sapiens
gatctggaatctgaaggctgag

SEQ ID NO: 44433 - DNA, 22 bp, Homo sapiens
tattattgacatttacttggtg

SEQ ID NO: 44434 - DNA, 22 bp, Homo sapiens
caaagtggaggctctggggcca

SEQ ID NO: 44435 - DNA, 22 bp, Homo sapiens
ttttctagggtgctaaatgaac

SEQ ID NO: 44436 - DNA, 22 bp, Homo sapiens
caggctgatcagggctgggatg

SEQ ID NO: 44437 - DNA, 22 bp, Homo sapiens
atggagttctgccagcgctgct

SEQ ID NO: 44438 - DNA, 22 bp, Homo sapiens
gggtacttaatatttacggggt

SEQ ID NO: 44439 - DNA, 22 bp, Homo sapiens
gggaggcacgaggcgcgcagtg

SEQ ID NO: 44440 - DNA, 22 bp, Homo sapiens
gaataatcatgaaattcagtga

SEQ ID NO: 44441 - DNA, 22 bp, Homo sapiens
ttgagtgtactttagtcatctg

SEQ ID NO: 44442 - DNA, 22 bp, Homo sapiens
tactttgtccatttgcaggcag

SEQ ID NO: 44443 - DNA, 18 bp, Homo sapiens
tggcgatggtcatttttc

SEQ ID NO: 44444 - DNA, 18 bp, Homo sapiens
agtgtcagctgcagctca

SEQ ID NO: 44445 - DNA, 22 bp, Homo sapiens
tcctggcaaagatgttggtgtt

SEQ ID NO: 44446 - DNA, 22 bp, Homo sapiens
ccacaccatcgtttttacctta

SEQ ID NO: 44447 - DNA, 22 bp, Homo sapiens
tgcccaggctggagtgcagtgg

SEQ ID NO: 44448 - DNA, 22 bp, Homo sapiens
tcttgaattgtactcccataag

SEQ ID NO: 44449 - DNA, 22 bp, Homo sapiens
ggaggacaggggctgcagcaca

SEQ ID NO: 44450 - DNA, 22 bp, Homo sapiens
gtcatcatcaggcagatgctgc

SEQ ID NO: 44451 - DNA, 22 bp, Homo sapiens
catgcggctctttccaaaccgg

SEQ ID NO: 44452 - DNA, 22 bp, Homo sapiens
tgaggcaggagaatcaccggaa

SEQ ID NO: 44453 - DNA, 22 bp, Homo sapiens
gttgaggagcaagcatgtgtct

SEQ ID NO: 44454 - DNA, 22 bp, Homo sapiens
tgcttacgagctattttcactt

SEQ ID NO: 44455 - DNA, 22 bp, Homo sapiens
cccagcgagtttgccggtgaac

SEQ ID NO: 44456 - DNA, 22 bp, Homo sapiens
tgtgcctactgatagagccaag

SEQ ID NO: 44457 - DNA, 22 bp, Homo sapiens
cagggtttcaccatgttagcag

SEQ ID NO: 44458 - DNA, 22 bp, Homo sapiens
cccactgtttccctgaggctct

SEQ ID NO: 44459 - DNA, 22 bp, Homo sapiens
taggctgggaagaaagattctc

SEQ ID NO: 44460 - DNA, 22 bp, Homo sapiens
acttttcttatcagaaaggcca

SEQ ID NO: 44461 - DNA, 22 bp, Homo sapiens
cactgcagcctcgctctcctga

SEQ ID NO: 44462 - DNA, 22 bp, Homo sapiens
ggttccacctggcgaggggtat

SEQ ID NO: 44463 - DNA, 22 bp, Homo sapiens
catgagatttgggaggggccag

SEQ ID NO: 44464 - DNA, 22 bp, Homo sapiens
aaggagtctgggccattcagag

SEQ ID NO: 44465 - DNA, 22 bp, Homo sapiens
taaattgagattattagggtaa

SEQ ID NO: 44466 - DNA, 22 bp, Homo sapiens
cgggcagcggcgtggccatggt

SEQ ID NO: 44467 - DNA, 22 bp, Homo sapiens
ttttccttcatatcccttatgt

SEQ ID NO: 44468 - DNA, 22 bp, Homo sapiens
atgaggcaggtggaggctgcca

SEQ ID NO: 44469 - DNA, 22 bp, Homo sapiens
acgatgatgaaagagaacattc

SEQ ID NO: 44470 - DNA, 22 bp, Homo sapiens
tgagatgtaaggtatgcttact

SEQ ID NO: 44471 - DNA, 19 bp, Homo sapiens
aggcttcaggccacatgct

SEQ ID NO: 44472 - DNA, 22 bp, Homo sapiens
ttcattcttttacatgtgaata

SEQ ID NO: 44473 - DNA, 22 bp, Homo sapiens
ttgggctcaggagtttgagacc

SEQ ID NO: 44474 - DNA, 22 bp, Homo sapiens
caagctgaacactgtcttcaag

SEQ ID NO: 44475 - DNA, 22 bp, Homo sapiens
agagtactgcctcagttatgaa

SEQ ID NO: 44476 - DNA, 22 bp, Homo sapiens
gaggcctgggcaagggggtctg

SEQ ID NO: 44477 - DNA, 22 bp, Homo sapiens
gagccaggtcgggccgcggcga

SEQ ID NO: 44478 - DNA, 22 bp, Homo sapiens
gggttgaggcggatgtcggcgg

SEQ ID NO: 44479 - DNA, 22 bp, Homo sapiens
aagtgctgggattacaggcatg

SEQ ID NO: 44480 - DNA, 22 bp, Homo sapiens
ctacaccggagcctggaaggta

SEQ ID NO: 44481 - DNA, 22 bp, Homo sapiens
acctggaggcagaggttgcagt

SEQ ID NO: 44482 - DNA, 22 bp, Homo sapiens
tggtggggccagacttcagctc

SEQ ID NO: 44483 - DNA, 20 bp, Homo sapiens
atggatgaccttggccaggg

SEQ ID NO: 44484 - DNA, 22 bp, Homo sapiens
atcaaatacaaagggcataagg

SEQ ID NO: 44485 - DNA, 22 bp, Homo sapiens
ttgtatagcccagagagtgaga

SEQ ID NO: 44486 - DNA, 22 bp, Homo sapiens
atgccactgcactccagcctgg

SEQ ID NO: 44487 - DNA, 22 bp, Homo sapiens
ggaaggggtgggtgagcctcag

SEQ ID NO: 44488 - DNA, 22 bp, Homo sapiens
catggcggtcaggatgtaggtg

SEQ ID NO: 44489 - DNA, 22 bp, Homo sapiens
acttgccccagaattgctgctg

SEQ ID NO: 44490 - DNA, 22 bp, Homo sapiens
aggtcacccgtttgactatcca

SEQ ID NO: 44491 - DNA, 22 bp, Homo sapiens
ttgtcttttgtgggaaatatgg

SEQ ID NO: 44492 - DNA, 22 bp, Homo sapiens
agcttgacagacagatggtagc

SEQ ID NO: 44493 - DNA, 22 bp, Homo sapiens
tcgaaataatttagaatataga

SEQ ID NO: 44494 - DNA, 22 bp, Homo sapiens
attctacatgatagaagggaga

SEQ ID NO: 44495 - DNA, 22 bp, Homo sapiens
ctgccgtgtttttcatgttaaa

SEQ ID NO: 44496 - DNA, 22 bp, Homo sapiens
tgatctaggttggcttcaactg

SEQ ID NO: 44497 - DNA, 22 bp, Homo sapiens
gtatcacttttgagagtgagaa

SEQ ID NO: 44498 - DNA, 22 bp, Homo sapiens
aggccccctccacccattctgg

SEQ ID NO: 44499 - DNA, 22 bp, Homo sapiens
accaggcccgctgctatggtgg

SEQ ID NO: 44500 - DNA, 18 bp, Homo sapiens
tgagaggctattttttgc

SEQ ID NO: 44501 - DNA, 22 bp, Homo sapiens
cccacacacatttatgatagga

SEQ ID NO: 44502 - DNA, 21 bp, Homo sapiens
agcctcaggttgttggttctt

SEQ ID NO: 44503 - DNA, 22 bp, Homo sapiens
atagaataatggttgtcaggag

SEQ ID NO: 44504 - DNA, 23 bp, Homo sapiens
agctctgctcgggcatgccctgc

SEQ ID NO: 44505 - DNA, 22 bp, Homo sapiens
agtgaggggcagctgagtgggc

SEQ ID NO: 44506 - DNA, 22 bp, Homo sapiens
ataatacatggttgatcttttc

SEQ ID NO: 44507 - DNA, 22 bp, Homo sapiens
aacccgggaggcagaggttgtg

SEQ ID NO: 44508 - DNA, 21 bp, Homo sapiens
cctcaagtgcctcctgctgct

SEQ ID NO: 44509 - DNA, 22 bp, Homo sapiens
tgaaatgattatatggtgtttg

SEQ ID NO: 44510 - DNA, 21 bp, Homo sapiens
agctgcctccacttctgaggc

SEQ ID NO: 44511 - DNA, 22 bp, Homo sapiens
ggctcacgcaattatcccggcc

SEQ ID NO: 44512 - DNA, 22 bp, Homo sapiens
tagcacagggctcctcaaccca

SEQ ID NO: 44513 - DNA, 22 bp, Homo sapiens
tcgctgaggctgcacggctgcc

SEQ ID NO: 44514 - DNA, 22 bp, Homo sapiens
tgagatgaataactcctgctaa

SEQ ID NO: 44515 - DNA, 22 bp, Homo sapiens
cagcagtgtacaaggtgtcaga

SEQ ID NO: 44516 - DNA, 22 bp, Homo sapiens
ctcactgcaagctcagcctccc

SEQ ID NO: 44517 - DNA, 19 bp, Homo sapiens
tggctctgtcgaaggcaca

SEQ ID NO: 44518 - DNA, 18 bp, Homo sapiens
tcttccaacactgacacc

SEQ ID NO: 44519 - DNA, 22 bp, Homo sapiens
tgccgtggggctgaggctggag

SEQ ID NO: 44520 - DNA, 22 bp, Homo sapiens
tcccgcatgccgccggtgaaca

SEQ ID NO: 44521 - DNA, 22 bp, Homo sapiens
agttacagaatgtacagaggtt

SEQ ID NO: 44522 - DNA, 22 bp, Homo sapiens
aatctgagggaacttgaactcc

SEQ ID NO: 44523 - DNA, 22 bp, Homo sapiens
cagaggtagcatgctgtggctt

SEQ ID NO: 44524 - DNA, 22 bp, Homo sapiens
tttgtagcagcatgatttataa

SEQ ID NO: 44525 - DNA, 17 bp, Homo sapiens
aagtgattcagccctca

SEQ ID NO: 44526 - DNA, 22 bp, Homo sapiens
gtgccccagacacgcatgtggg

SEQ ID NO: 44527 - DNA, 22 bp, Homo sapiens
tctgctggaaaaccagggaatt

SEQ ID NO: 44528 - DNA, 21 bp, Homo sapiens
cactccacttagaacagggtt

SEQ ID NO: 44529 - DNA, 18 bp, Homo sapiens
tttctcagactctctttc

SEQ ID NO: 44530 - DNA, 22 bp, Homo sapiens
gttgcctaggctggagtgcagt

SEQ ID NO: 44531 - DNA, 22 bp, Homo sapiens
ctggaaggcggaggttgtagtg

SEQ ID NO: 44532 - DNA, 22 bp, Homo sapiens
tacataggtacagcctttttta

SEQ ID NO: 44533 - DNA, 22 bp, Homo sapiens
caacatggcgaaaccccatctc

SEQ ID NO: 44534 - DNA, 22 bp, Homo sapiens
cgaggaggaaacgcggagaact

SEQ ID NO: 44535 - DNA, 22 bp, Homo sapiens
gtcggccacgcaggtgcggtag

SEQ ID NO: 44536 - DNA, 22 bp, Homo sapiens
tcagtgttaatcagtggtacct

SEQ ID NO: 44537 - DNA, 20 bp, Homo sapiens
catgtgtcagttctcaccca

SEQ ID NO: 44538 - DNA, 22 bp, Homo sapiens
gcacagccacgtaatgtggtca

SEQ ID NO: 44539 - DNA, 22 bp, Homo sapiens
ctgaggcctctcccactccagc

SEQ ID NO: 44540 - DNA, 22 bp, Homo sapiens
tacctcaagttccaggaaagcg

SEQ ID NO: 44541 - DNA, 22 bp, Homo sapiens
tgaaggtgggaattcaccaggt

SEQ ID NO: 44542 - DNA, 22 bp, Homo sapiens
agccagggacgctgcaggctac

SEQ ID NO: 44543 - DNA, 22 bp, Homo sapiens
ttgtacatttgttcagttctga

SEQ ID NO: 44544 - DNA, 22 bp, Homo sapiens
ctagcctgggatttgaacttat

SEQ ID NO: 44545 - DNA, 23 bp, Homo sapiens
ggagtgcaatggcgccatctcgg

SEQ ID NO: 44546 - DNA, 22 bp, Homo sapiens
accactgcccatggtgaaaact

SEQ ID NO: 44547 - DNA, 22 bp, Homo sapiens
ctgagatctttatacgaggcac

SEQ ID NO: 44548 - DNA, 22 bp, Homo sapiens
ggcaatatggtgaaaccccatc

SEQ ID NO: 44549 - DNA, 22 bp, Homo sapiens
gcatgtgtctttatagcagcat

SEQ ID NO: 44550 - DNA, 22 bp, Homo sapiens
tgagcacatttcacatgacagg

SEQ ID NO: 44551 - DNA, 22 bp, Homo sapiens
agacactgttctcacatgcttg

SEQ ID NO: 44552 - DNA, 22 bp, Homo sapiens
cctcgcggcactcgggccggat

SEQ ID NO: 44553 - DNA, 22 bp, Homo sapiens
caggaaagggatgggctgccac

SEQ ID NO: 44554 - DNA, 22 bp, Homo sapiens
tgagatgtcatagttcagttca

SEQ ID NO: 44555 - DNA, 20 bp, Homo sapiens
aactcctagcctcaagtgat

SEQ ID NO: 44556 - DNA, 22 bp, Homo sapiens
gcctccccaagcagcagggatt

SEQ ID NO: 44557 - DNA, 22 bp, Homo sapiens
tctctcaggctggagtgcagtg

SEQ ID NO: 44558 - DNA, 22 bp, Homo sapiens
gatgatcatctgtaaagttaga

SEQ ID NO: 44559 - DNA, 22 bp, Homo sapiens
gccaggcgggtctcaaactcct

SEQ ID NO: 44560 - DNA, 22 bp, Homo sapiens
ggccaggcgatgacccctccac

SEQ ID NO: 44561 - DNA, 22 bp, Homo sapiens
ttccctgtgtgcagatgggtgt

SEQ ID NO: 44562 - DNA, 22 bp, Homo sapiens
tattttgtgccatgcactgcct

SEQ ID NO: 44563 - DNA, 21 bp, Homo sapiens
agatcctggggtctggggagg

SEQ ID NO: 44564 - DNA, 22 bp, Homo sapiens
gtccacttctgcctttctggat

SEQ ID NO: 44565 - DNA, 22 bp, Homo sapiens
ttgttgtcattgtagaggattt

SEQ ID NO: 44566 - DNA, 22 bp, Homo sapiens
ctgtcaggtttcccggctcacg

SEQ ID NO: 44567 - DNA, 22 bp, Homo sapiens
tccctgaggatggttgtattta

SEQ ID NO: 44568 - DNA, 22 bp, Homo sapiens
aggtaggcctgacgctggggtg

SEQ ID NO: 44569 - DNA, 22 bp, Homo sapiens
aagttgttgttgaggtgggtaa

SEQ ID NO: 44570 - DNA, 22 bp, Homo sapiens
ttcatatttctttaaggacttt

SEQ ID NO: 44571 - DNA, 22 bp, Homo sapiens
agcctctctgttagtcactggg

SEQ ID NO: 44572 - DNA, 22 bp, Homo sapiens
ggcgctcagtgttgccccagag

SEQ ID NO: 44573 - DNA, 22 bp, Homo sapiens
cgtgtacagtctatcttttttc

SEQ ID NO: 44574 - DNA, 22 bp, Homo sapiens
gccctccagcctgtggaaccgg

SEQ ID NO: 44575 - DNA, 22 bp, Homo sapiens
cttgcctttgtcttcaaaggct

SEQ ID NO: 44576 - DNA, 22 bp, Homo sapiens
tctgtggcccaagtgatggctg

SEQ ID NO: 44577 - DNA, 22 bp, Homo sapiens
catgtctgagtcatggtacttc

SEQ ID NO: 44578 - DNA, 22 bp, Homo sapiens
gggctagcctcttccctgctcc

SEQ ID NO: 44579 - DNA, 22 bp, Homo sapiens
ttaaattttagaaacagactct

SEQ ID NO: 44580 - DNA, 22 bp, Homo sapiens
gctggtagacctcactgcactc

SEQ ID NO: 44581 - DNA, 22 bp, Homo sapiens
aggaggcagtctgtcccttagc

SEQ ID NO: 44582 - DNA, 22 bp, Homo sapiens
gaggactgaaacttacaggaaa

SEQ ID NO: 44583 - DNA, 22 bp, Homo sapiens
tcctgggccctccggatcaggt

SEQ ID NO: 44584 - DNA, 19 bp, Homo sapiens
gactcacaccttccgctgt

SEQ ID NO: 44585 - DNA, 22 bp, Homo sapiens
tgtcagtgtctatgaagaattt

SEQ ID NO: 44586 - DNA, 22 bp, Homo sapiens
gaggcagaggttgttgcagtga

SEQ ID NO: 44587 - DNA, 22 bp, Homo sapiens
tgcatattatgtgtatctgtct

SEQ ID NO: 44588 - DNA, 22 bp, Homo sapiens
tgaccaatactgtggatgccag

SEQ ID NO: 44589 - DNA, 22 bp, Homo sapiens
tgcaccctcatcagtcaaatgg

SEQ ID NO: 44590 - DNA, 22 bp, Homo sapiens
ccctgcctacagggttttcttt

SEQ ID NO: 44591 - DNA, 22 bp, Homo sapiens
cacactgtctttatgagctgta

SEQ ID NO: 44592 - DNA, 22 bp, Homo sapiens
gaggtggccaagcgaggaaggg

SEQ ID NO: 44593 - DNA, 22 bp, Homo sapiens
gtggattacaagacagttgaga

SEQ ID NO: 44594 - DNA, 22 bp, Homo sapiens
gtgctggggagataggaagaga

SEQ ID NO: 44595 - DNA, 22 bp, Homo sapiens
gttcaagaccagcctggccaac

SEQ ID NO: 44596 - DNA, 22 bp, Homo sapiens
agacagggtgatcgcttgagcc

SEQ ID NO: 44597 - DNA, 22 bp, Homo sapiens
tccccagcttgctacttctgct

SEQ ID NO: 44598 - DNA, 22 bp, Homo sapiens
tccagcccaggctggagtgtag

SEQ ID NO: 44599 - DNA, 22 bp, Homo sapiens
tcttgggcaatttctctagagg

SEQ ID NO: 44600 - DNA, 22 bp, Homo sapiens
tggccttggccgtgctggggtc

SEQ ID NO: 44601 - DNA, 22 bp, Homo sapiens
aggtattattagcatctctatt

SEQ ID NO: 44602 - DNA, 22 bp, Homo sapiens
aatggctctgatgttgttgtga

SEQ ID NO: 44603 - DNA, 22 bp, Homo sapiens
gagctgggcctgcgagtgctgc

SEQ ID NO: 44604 - DNA, 20 bp, Homo sapiens
aggccccaggtggacactag

SEQ ID NO: 44605 - DNA, 22 bp, Homo sapiens
tggaaagaaagtaaaggcgtat

SEQ ID NO: 44606 - DNA, 22 bp, Homo sapiens
atgagaaagttaatcatcatga

SEQ ID NO: 44607 - DNA, 22 bp, Homo sapiens
atccaccctgtggtggctttct

SEQ ID NO: 44608 - DNA, 22 bp, Homo sapiens
atgattgaaaatgacattgcca

SEQ ID NO: 44609 - DNA, 22 bp, Homo sapiens
acacagggctgcgcctgacccc

SEQ ID NO: 44610 - DNA, 19 bp, Homo sapiens
atcccaaggagctgggact

SEQ ID NO: 44611 - DNA, 22 bp, Homo sapiens
gctgtctcatacaaggccctgc

SEQ ID NO: 44612 - DNA, 22 bp, Homo sapiens
agcttagtggttgtatgagtta

SEQ ID NO: 44613 - DNA, 22 bp, Homo sapiens
gggacttcatagctaggcactt

SEQ ID NO: 44614 - DNA, 22 bp, Homo sapiens
tgaactcctgacctcatgatcc

SEQ ID NO: 44615 - DNA, 22 bp, Homo sapiens
atccccctgtatctggaagaat

SEQ ID NO: 44616 - DNA, 22 bp, Homo sapiens
ctgaagagaaagggagctcttc

SEQ ID NO: 44617 - DNA, 22 bp, Homo sapiens
tgggcagggagctggaaccaca

SEQ ID NO: 44618 - DNA, 22 bp, Homo sapiens
ctttttcctcgtagagcctaat

SEQ ID NO: 44619 - DNA, 22 bp, Homo sapiens
atgtatgtctaaaacggggagg

SEQ ID NO: 44620 - DNA, 22 bp, Homo sapiens
tgctggtaccgcgcctccgcca

SEQ ID NO: 44621 - DNA, 22 bp, Homo sapiens
ctgtaatcccagctacctggga

SEQ ID NO: 44622 - DNA, 22 bp, Homo sapiens
ctgggaggcagaggttgcagtg

SEQ ID NO: 44623 - DNA, 22 bp, Homo sapiens
gagatgggcgagaaggtggact

SEQ ID NO: 44624 - DNA, 22 bp, Homo sapiens
ggctctgtaagtgttgcaggta

SEQ ID NO: 44625 - DNA, 22 bp, Homo sapiens
gcaccgccttggaccgcccgct

SEQ ID NO: 44626 - DNA, 22 bp, Homo sapiens
ccagatatcactgccgtgttgt

SEQ ID NO: 44627 - DNA, 20 bp, Homo sapiens
gctgaggggtctatggcata

SEQ ID NO: 44628 - DNA, 23 bp, Homo sapiens
agcctcttgtggatggtcagcga

SEQ ID NO: 44629 - DNA, 22 bp, Homo sapiens
agctgccgatgcccagctgcat

SEQ ID NO: 44630 - DNA, 22 bp, Homo sapiens
ccaggagtgcagggatggtatc

SEQ ID NO: 44631 - DNA, 20 bp, Homo sapiens
gtctccactgggggttaacc

SEQ ID NO: 44632 - DNA, 22 bp, Homo sapiens
ggtccccgtggaggctggagcg

SEQ ID NO: 44633 - DNA, 22 bp, Homo sapiens
ctcagcttttcccggataggtg

SEQ ID NO: 44634 - DNA, 22 bp, Homo sapiens
tcccgtaggttgctgtagtcgg

SEQ ID NO: 44635 - DNA, 22 bp, Homo sapiens
actgtctagttctcttttctaa

SEQ ID NO: 44636 - DNA, 22 bp, Homo sapiens
atggactgggaggtcatcttct

SEQ ID NO: 44637 - DNA, 22 bp, Homo sapiens
ttatttttaaaagttcacacag

SEQ ID NO: 44638 - DNA, 22 bp, Homo sapiens
gaagctgagctgaggcatgttg

SEQ ID NO: 44639 - DNA, 22 bp, Homo sapiens
cgctccttgagcgtgtcggcct

SEQ ID NO: 44640 - DNA, 22 bp, Homo sapiens
agcactgatttaaactggattt

SEQ ID NO: 44641 - DNA, 22 bp, Homo sapiens
ttggagtgacagatgaggaaac

SEQ ID NO: 44642 - DNA, 22 bp, Homo sapiens
tgatattttatgagctttcata

SEQ ID NO: 44643 - DNA, 22 bp, Homo sapiens
gcagcaacgcggccctactgct

SEQ ID NO: 44644 - DNA, 22 bp, Homo sapiens
attggtagttttgtatttctct

SEQ ID NO: 44645 - DNA, 22 bp, Homo sapiens
gagaaagcttctttcccacagg

SEQ ID NO: 44646 - DNA, 22 bp, Homo sapiens
cctcggctgggccttggccact

SEQ ID NO: 44647 - DNA, 22 bp, Homo sapiens
tgagccgtggtctctgagggtg

SEQ ID NO: 44648 - DNA, 22 bp, Homo sapiens
ccagactgcttgcttcccagcc

SEQ ID NO: 44649 - DNA, 22 bp, Homo sapiens
ggagatatttgtattctgtctc

SEQ ID NO: 44650 - DNA, 19 bp, Homo sapiens
atcttcattttacaggcag

SEQ ID NO: 44651 - DNA, 22 bp, Homo sapiens
agcctctttttcaaggtccaca

SEQ ID NO: 44652 - DNA, 22 bp, Homo sapiens
gtggagaggaacccagctctgt

SEQ ID NO: 44653 - DNA, 22 bp, Homo sapiens
cttgggaggcagaggttgcagt

SEQ ID NO: 44654 - DNA, 22 bp, Homo sapiens
caaggtgccatgctgggcgggg

SEQ ID NO: 44655 - DNA, 22 bp, Homo sapiens
tctgttttgcataatgttcttt

SEQ ID NO: 44656 - DNA, 22 bp, Homo sapiens
gagccaggggtcagctccgagg

SEQ ID NO: 44657 - DNA, 22 bp, Homo sapiens
taattagtgtccagcttctgct

SEQ ID NO: 44658 - DNA, 22 bp, Homo sapiens
aggctggagtgcagttgcatga

SEQ ID NO: 44659 - DNA, 19 bp, Homo sapiens
atctgccttagtgctgctg

SEQ ID NO: 44660 - DNA, 22 bp, Homo sapiens
gcggcggagacagcaggaagcc

SEQ ID NO: 44661 - DNA, 22 bp, Homo sapiens
atagagtgatgtaaggtatgtg

SEQ ID NO: 44662 - DNA, 22 bp, Homo sapiens
gagagaagggggatatgagcct

SEQ ID NO: 44663 - DNA, 22 bp, Homo sapiens
atcttcccaggctggggagagg

SEQ ID NO: 44664 - DNA, 22 bp, Homo sapiens
aaaaatcacttttataggcagc

SEQ ID NO: 44665 - DNA, 22 bp, Homo sapiens
cagtctctaaatcaatctgaat

SEQ ID NO: 44666 - DNA, 22 bp, Homo sapiens
gttctgggagatcttgagcttc

SEQ ID NO: 44667 - DNA, 22 bp, Homo sapiens
catataaatacaacatgtgtta

SEQ ID NO: 44668 - DNA, 22 bp, Homo sapiens
ggctcctgggggtgctcctgcc

SEQ ID NO: 44669 - DNA, 22 bp, Homo sapiens
ctctgtggtggagtgggtcacc

SEQ ID NO: 44670 - DNA, 22 bp, Homo sapiens
actatagatgctggcgaggctg

SEQ ID NO: 44671 - DNA, 22 bp, Homo sapiens
agcagctttcacctccccgcct

SEQ ID NO: 44672 - DNA, 22 bp, Homo sapiens
ttatgatttgccacagattggt

SEQ ID NO: 44673 - DNA, 22 bp, Homo sapiens
gggcagagagctggaactcctt

SEQ ID NO: 44674 - DNA, 22 bp, Homo sapiens
ttttcctttgattcccagatgt

SEQ ID NO: 44675 - DNA, 22 bp, Homo sapiens
ttctaggcctggcttgggccca

SEQ ID NO: 44676 - DNA, 22 bp, Homo sapiens
ctgtccatattcaaggggtagg

SEQ ID NO: 44677 - DNA, 20 bp, Homo sapiens
caaatccctgctctgtgctg

SEQ ID NO: 44678 - DNA, 22 bp, Homo sapiens
aggctagaggcttctggcttca

SEQ ID NO: 44679 - DNA, 22 bp, Homo sapiens
caagcgtggctgctctgatgga

SEQ ID NO: 44680 - DNA, 23 bp, Homo sapiens
tgttccagatacgccttttcctc

SEQ ID NO: 44681 - DNA, 22 bp, Homo sapiens
tggagttggccgcccggaccga

SEQ ID NO: 44682 - DNA, 22 bp, Homo sapiens
cacccaggctggagagcagtgg

SEQ ID NO: 44683 - DNA, 22 bp, Homo sapiens
actgcactccagcctgggtaac

SEQ ID NO: 44684 - DNA, 22 bp, Homo sapiens
actgcactccaacctgggtgac

SEQ ID NO: 44685 - DNA, 22 bp, Homo sapiens
ggggcaggagcccttcttcagc

SEQ ID NO: 44686 - DNA, 22 bp, Homo sapiens
ctctggagtgtctggccagggt

SEQ ID NO: 44687 - DNA, 17 bp, Homo sapiens
catccgtgagctcggca

SEQ ID NO: 44688 - DNA, 22 bp, Homo sapiens
tgatgggaggtgctgcaggacc

SEQ ID NO: 44689 - DNA, 19 bp, Homo sapiens
caccaagatggctctagtc

SEQ ID NO: 44690 - DNA, 22 bp, Homo sapiens
gctcgtacaccagcgtggaggt

SEQ ID NO: 44691 - DNA, 18 bp, Homo sapiens
agagtatacagacaacaa

SEQ ID NO: 44692 - DNA, 22 bp, Homo sapiens
gttggggtgctataaaaatgat

SEQ ID NO: 44693 - DNA, 23 bp, Homo sapiens
aaataggagtatctggatcatga

SEQ ID NO: 44694 - DNA, 23 bp, Homo sapiens
ttaaacactagttcgagtagcat

SEQ ID NO: 44695 - DNA, 22 bp, Homo sapiens
ttaggatttgaaaaggggcaga

SEQ ID NO: 44696 - DNA, 22 bp, Homo sapiens
tgatttatgcattatactgttg

SEQ ID NO: 44697 - DNA, 22 bp, Homo sapiens
cgggaaggtggaggttgcagtg

SEQ ID NO: 44698 - DNA, 22 bp, Homo sapiens
agaaatatgctgattagatgaa

SEQ ID NO: 44699 - DNA, 22 bp, Homo sapiens
aagtataatcaaagcagggcta

SEQ ID NO: 44700 - DNA, 22 bp, Homo sapiens
ttcaggcccagcacagcgcgtg

SEQ ID NO: 44701 - DNA, 22 bp, Homo sapiens
agtccggggtctggacacctgg

SEQ ID NO: 44702 - DNA, 21 bp, Homo sapiens
cagaggcctatcacagactcc

SEQ ID NO: 44703 - DNA, 22 bp, Homo sapiens
tctgaggctgaatggactccgt

SEQ ID NO: 44704 - DNA, 22 bp, Homo sapiens
tcatcataatatggaatcttgt

SEQ ID NO: 44705 - DNA, 22 bp, Homo sapiens
aaagtaattgtggttcttgcca

SEQ ID NO: 44706 - DNA, 22 bp, Homo sapiens
ttacaattacttgatctcagct

SEQ ID NO: 44707 - DNA, 22 bp, Homo sapiens
cggccaagccggggccccgaag

SEQ ID NO: 44708 - DNA, 22 bp, Homo sapiens
aatggaatacctaggtggccca

SEQ ID NO: 44709 - DNA, 22 bp, Homo sapiens
caggccctgtgctgggtgatgt

SEQ ID NO: 44710 - DNA, 22 bp, Homo sapiens
acatagtgttttgagagacagc

SEQ ID NO: 44711 - DNA, 22 bp, Homo sapiens
caagagtgaaactctgtctcaa

SEQ ID NO: 44712 - DNA, 22 bp, Homo sapiens
ccaaagtgctgagattacaggt

SEQ ID NO: 44713 - DNA, 22 bp, Homo sapiens
atcccaggcggcacaggttgca

SEQ ID NO: 44714 - DNA, 17 bp, Homo sapiens
cgggcatggagggcagg

SEQ ID NO: 44715 - DNA, 22 bp, Homo sapiens
tacactgtttgaactgtggtcg

SEQ ID NO: 44716 - DNA, 22 bp, Homo sapiens
tcttcatgtcatggtatattga

SEQ ID NO: 44717 - DNA, 22 bp, Homo sapiens
ggaggagcatgagagggtagtg

SEQ ID NO: 44718 - DNA, 19 bp, Homo sapiens
ttcagcattatattctagc

SEQ ID NO: 44719 - DNA, 22 bp, Homo sapiens
ccagtggctacaggggggttga

SEQ ID NO: 44720 - DNA, 22 bp, Homo sapiens
cacatttttactgccaacttaa

SEQ ID NO: 44721 - DNA, 22 bp, Homo sapiens
tggaagctcaaggcagggtgag

SEQ ID NO: 44722 - DNA, 22 bp, Homo sapiens
ggaatcctgccagctctgcccc

SEQ ID NO: 44723 - DNA, 22 bp, Homo sapiens
aaggtgggtggatcacgaggtc

SEQ ID NO: 44724 - DNA, 20 bp, Homo sapiens
ccagagctgatggctgcccg

SEQ ID NO: 44725 - DNA, 20 bp, Homo sapiens
tttctgtgagaaacactgtt

SEQ ID NO: 44726 - DNA, 22 bp, Homo sapiens
tcagggattgcaaaattcatcc

SEQ ID NO: 44727 - DNA, 22 bp, Homo sapiens
gaattcttttctttctgaaagt

SEQ ID NO: 44728 - DNA, 22 bp, Homo sapiens
ttatttaaaagtggtaagattc

SEQ ID NO: 44729 - DNA, 22 bp, Homo sapiens
tcacccaggctggagtgcagtg

SEQ ID NO: 44730 - DNA, 22 bp, Homo sapiens
tctcccaggcaggagtgcagtg

SEQ ID NO: 44731 - DNA, 23 bp, Homo sapiens
tatgaactgcattgctggtgtgt

SEQ ID NO: 44732 - DNA, 22 bp, Homo sapiens
agcagcagtgttctggaattct

SEQ ID NO: 44733 - DNA, 22 bp, Homo sapiens
gcctcctgagtagctgggattg

SEQ ID NO: 44734 - DNA, 23 bp, Homo sapiens
gtctctagagtgtggagcaaaga

SEQ ID NO: 44735 - DNA, 22 bp, Homo sapiens
aagtggactaatacaaggacta

SEQ ID NO: 44736 - DNA, 22 bp, Homo sapiens
aatgttgcagagtgattgtcca

SEQ ID NO: 44737 - DNA, 22 bp, Homo sapiens
tggtggctcacacctgtaatcc

SEQ ID NO: 44738 - DNA, 22 bp, Homo sapiens
tgctggaggccagaagtctgag

SEQ ID NO: 44739 - DNA, 20 bp, Homo sapiens
gctgaggtggaggaaggaga

SEQ ID NO: 44740 - DNA, 22 bp, Homo sapiens
tctgctttcttactaaaaatga

SEQ ID NO: 44741 - DNA, 22 bp, Homo sapiens
ccaggcagcctgctccattctg

SEQ ID NO: 44742 - DNA, 22 bp, Homo sapiens
tgctcccaaacctgacaggctc

SEQ ID NO: 44743 - DNA, 22 bp, Homo sapiens
acaggatcgccctgttgcccag

SEQ ID NO: 44744 - DNA, 22 bp, Homo sapiens
gggagctggagctggaagactc

SEQ ID NO: 44745 - DNA, 22 bp, Homo sapiens
gctcagacctgtaatcttagca

SEQ ID NO: 44746 - DNA, 22 bp, Homo sapiens
aaagcactgcacatatatttgc

SEQ ID NO: 44747 - DNA, 22 bp, Homo sapiens
atcctccagctcctgcttctgc

SEQ ID NO: 44748 - DNA, 22 bp, Homo sapiens
cactgctacctctgcctcccgg

SEQ ID NO: 44749 - DNA, 22 bp, Homo sapiens
ttaataaagtatgaattggaaa

SEQ ID NO: 44750 - DNA, 22 bp, Homo sapiens
ggtaccaccaattcagctgcca

SEQ ID NO: 44751 - DNA, 22 bp, Homo sapiens
caggagctcagatgacatctca

SEQ ID NO: 44752 - DNA, 22 bp, Homo sapiens
tgactggattgtcattacgacg

SEQ ID NO: 44753 - DNA, 22 bp, Homo sapiens
ctgtcctgccagtcctggactc

SEQ ID NO: 44754 - DNA, 22 bp, Homo sapiens
cactgggcgtgtcctgggtgag

SEQ ID NO: 44755 - DNA, 22 bp, Homo sapiens
tcctccactttgtctagcaaca

SEQ ID NO: 44756 - DNA, 22 bp, Homo sapiens
tgctcgccccacatgccctcat

SEQ ID NO: 44757 - DNA, 22 bp, Homo sapiens
cactgcccaccaagtggctggt

SEQ ID NO: 44758 - DNA, 22 bp, Homo sapiens
ggaggctgaggcaggcggatca

SEQ ID NO: 44759 - DNA, 22 bp, Homo sapiens
gcccagctgcaccctggtgggt

SEQ ID NO: 44760 - DNA, 22 bp, Homo sapiens
gcctcctgtcccaggctgagga

SEQ ID NO: 44761 - DNA, 22 bp, Homo sapiens
cgtgccctgcgcaagtgctgct

SEQ ID NO: 44762 - DNA, 22 bp, Homo sapiens
tcacttcccagacggggtggca

SEQ ID NO: 44763 - DNA, 22 bp, Homo sapiens
tctttgctattgtgagtagtgc

SEQ ID NO: 44764 - DNA, 22 bp, Homo sapiens
atgggtcagttcagtggccaac

SEQ ID NO: 44765 - DNA, 22 bp, Homo sapiens
agcccaggctggagtgcagtgg

SEQ ID NO: 44766 - DNA, 22 bp, Homo sapiens
gctgatcacatttccaaaaccc

SEQ ID NO: 44767 - DNA, 22 bp, Homo sapiens
gaggctgcagctatcagacatt

SEQ ID NO: 44768 - DNA, 22 bp, Homo sapiens
tcctgggtccatggcagccgaa

SEQ ID NO: 44769 - DNA, 22 bp, Homo sapiens
tgtgcctgttcccactttgcct

SEQ ID NO: 44770 - DNA, 19 bp, Homo sapiens
tgtgactggttgtctcgct

SEQ ID NO: 44771 - DNA, 22 bp, Homo sapiens
cctcgacctccccaggctcagg

SEQ ID NO: 44772 - DNA, 18 bp, Homo sapiens
gaggtagataagattttc

SEQ ID NO: 44773 - DNA, 19 bp, Homo sapiens
ctgctgccggagactcgtc

SEQ ID NO: 44774 - DNA, 18 bp, Homo sapiens
gctgtggaagtctttata

SEQ ID NO: 44775 - DNA, 22 bp, Homo sapiens
ggagtgaagtggcgcgatctcg

SEQ ID NO: 44776 - DNA, 22 bp, Homo sapiens
tgagccagaggaggctgtgtgg

SEQ ID NO: 44777 - DNA, 23 bp, Homo sapiens
tgtcttcgactcctgcgtgcttc

SEQ ID NO: 44778 - DNA, 22 bp, Homo sapiens
ccatccttgtcatcttcatgtt

SEQ ID NO: 44779 - DNA, 22 bp, Homo sapiens
gctcagaggcacgacctcttgg

SEQ ID NO: 44780 - DNA, 22 bp, Homo sapiens
tttcctcttctggcaggcaggg

SEQ ID NO: 44781 - DNA, 22 bp, Homo sapiens
agatgctgctccacaggccagg

SEQ ID NO: 44782 - DNA, 22 bp, Homo sapiens
agctggtgctcggggagctggc

SEQ ID NO: 44783 - DNA, 22 bp, Homo sapiens
gctgtcttgctcactcttgcag

SEQ ID NO: 44784 - DNA, 22 bp, Homo sapiens
gggatttcaccatgttggttgg

SEQ ID NO: 44785 - DNA, 22 bp, Homo sapiens
ttgtagtctaggatagattttt

SEQ ID NO: 44786 - DNA, 21 bp, Homo sapiens
accaccctgtttatccagagg

SEQ ID NO: 44787 - DNA, 22 bp, Homo sapiens
ctcgttgctgaagccaaagtca

SEQ ID NO: 44788 - DNA, 22 bp, Homo sapiens
atgctttctcttagttcattga

SEQ ID NO: 44789 - DNA, 22 bp, Homo sapiens
ccagaagtcaagtaagatgaag

SEQ ID NO: 44790 - DNA, 21 bp, Homo sapiens
cagtggcacgatttcggctca

SEQ ID NO: 44791 - DNA, 22 bp, Homo sapiens
gaactttataactgtaaatgtc

SEQ ID NO: 44792 - DNA, 22 bp, Homo sapiens
gggttggatcctggtggctgcc

SEQ ID NO: 44793 - DNA, 22 bp, Homo sapiens
ggtgtccgcgctgtagaaggtc

SEQ ID NO: 44794 - DNA, 23 bp, Homo sapiens
tcaactgctctgggaaggtcccc

SEQ ID NO: 44795 - DNA, 22 bp, Homo sapiens
tgttattctagtggatcacgtc

SEQ ID NO: 44796 - DNA, 22 bp, Homo sapiens
cactgcactccatcctgggaaa

SEQ ID NO: 44797 - DNA, 22 bp, Homo sapiens
gggccctgggattcagagcaag

SEQ ID NO: 44798 - DNA, 19 bp, Homo sapiens
tcctgcccaccagccaggg

SEQ ID NO: 44799 - DNA, 22 bp, Homo sapiens
gctggaggatggactggaagaa

SEQ ID NO: 44800 - DNA, 22 bp, Homo sapiens
tacaccattcccaggtggattt

SEQ ID NO: 44801 - DNA, 22 bp, Homo sapiens
tatactctgagaaacgtgtcac

SEQ ID NO: 44802 - DNA, 22 bp, Homo sapiens
gggaagatagtgttgagggccc

SEQ ID NO: 44803 - DNA, 22 bp, Homo sapiens
atcttctcatgtgtaatgaggt

SEQ ID NO: 44804 - DNA, 19 bp, Homo sapiens
ttccatctatcttcttact

SEQ ID NO: 44805 - DNA, 22 bp, Homo sapiens
gctgcagacttctcatctcatt

SEQ ID NO: 44806 - DNA, 22 bp, Homo sapiens
cctcgggctgaggctcccaggc

SEQ ID NO: 44807 - DNA, 22 bp, Homo sapiens
aactcagatgtttggctacctt

SEQ ID NO: 44808 - DNA, 22 bp, Homo sapiens
tctttctacatcatttgcttct

SEQ ID NO: 44809 - DNA, 22 bp, Homo sapiens
ggaagtcctcatacctgattct

SEQ ID NO: 44810 - DNA, 22 bp, Homo sapiens
tcccagaaccctgccaggtcct

SEQ ID NO: 44811 - DNA, 22 bp, Homo sapiens
aaagctaaggtagcattggaga

SEQ ID NO: 44812 - DNA, 20 bp, Homo sapiens
aagcagtgaggtgaggagtg

SEQ ID NO: 44813 - DNA, 22 bp, Homo sapiens
actgccctccagcctgggtgac

SEQ ID NO: 44814 - DNA, 21 bp, Homo sapiens
aggtgctggcgccccaggaga

SEQ ID NO: 44815 - DNA, 22 bp, Homo sapiens
ggagaggggaacttgttgcttg

SEQ ID NO: 44816 - DNA, 22 bp, Homo sapiens
tgcactactgtgatacacagcc

SEQ ID NO: 44817 - DNA, 22 bp, Homo sapiens
ctggaaggcagaggttgcagtg

SEQ ID NO: 44818 - DNA, 22 bp, Homo sapiens
gccccagcctcccgagtagctg

SEQ ID NO: 44819 - DNA, 22 bp, Homo sapiens
gaggggctgccctggtgtcagg

SEQ ID NO: 44820 - DNA, 22 bp, Homo sapiens
atagggcctaaaaagtattgct

SEQ ID NO: 44821 - DNA, 22 bp, Homo sapiens
acagcagcaatagcagtgacat

SEQ ID NO: 44822 - DNA, 22 bp, Homo sapiens
agcgccactgcactccagcctg

SEQ ID NO: 44823 - DNA, 22 bp, Homo sapiens
cctgcgcgtctgggtctgtctc

SEQ ID NO: 44824 - DNA, 22 bp, Homo sapiens
tctcgatctcctgaccttgtga

SEQ ID NO: 44825 - DNA, 22 bp, Homo sapiens
ggccctgggccctctagcttgt

SEQ ID NO: 44826 - DNA, 22 bp, Homo sapiens
cctgggaggctgaggctgcagt

SEQ ID NO: 44827 - DNA, 22 bp, Homo sapiens
tgcaatctcggcactttgggag

SEQ ID NO: 44828 - DNA, 22 bp, Homo sapiens
tggtggcactgacatcagacac

SEQ ID NO: 44829 - DNA, 22 bp, Homo sapiens
ccagaccctccattcaagctcc

SEQ ID NO: 44830 - DNA, 22 bp, Homo sapiens
catggggcccatgtgctccaag

SEQ ID NO: 44831 - DNA, 22 bp, Homo sapiens
ctgctgtttctcaaaattaagt

SEQ ID NO: 44832 - DNA, 22 bp, Homo sapiens
aggtacatggggtgtgtgcacg

SEQ ID NO: 44833 - DNA, 22 bp, Homo sapiens
ttgtgaatagtgctgcaataaa

SEQ ID NO: 44834 - DNA, 22 bp, Homo sapiens
tcactgcactccagcctgggca

SEQ ID NO: 44835 - DNA, 22 bp, Homo sapiens
ttcctagggcagagccgctggg

SEQ ID NO: 44836 - DNA, 22 bp, Homo sapiens
tccgggcaactgaagggaggtt

SEQ ID NO: 44837 - DNA, 22 bp, Homo sapiens
ccacgtccagctaattttcgta

SEQ ID NO: 44838 - DNA, 22 bp, Homo sapiens
gacggagctggttgctgcggct

SEQ ID NO: 44839 - DNA, 22 bp, Homo sapiens
ctggaggccactgtacagattg

SEQ ID NO: 44840 - DNA, 22 bp, Homo sapiens
tgagccatgggactccaaggga

SEQ ID NO: 44841 - DNA, 22 bp, Homo sapiens
gtggcttggaccagtcacagtg

SEQ ID NO: 44842 - DNA, 22 bp, Homo sapiens
cccaggaggcagaagttgcagt

SEQ ID NO: 44843 - DNA, 19 bp, Homo sapiens
ggggcctgtgatggtcaca

SEQ ID NO: 44844 - DNA, 22 bp, Homo sapiens
gctgtagtgaatggccgcgttc

SEQ ID NO: 44845 - DNA, 22 bp, Homo sapiens
tcacagagaaatgtggcacaaa

SEQ ID NO: 44846 - DNA, 22 bp, Homo sapiens
cccgggttgtccgcgcgtccgg

SEQ ID NO: 44847 - DNA, 22 bp, Homo sapiens
ggagtgcagtggtgggatctca

SEQ ID NO: 44848 - DNA, 22 bp, Homo sapiens
aacccaggagttggaggctgtg

SEQ ID NO: 44849 - DNA, 22 bp, Homo sapiens
tgtgctctgactttctcctggt

SEQ ID NO: 44850 - DNA, 22 bp, Homo sapiens
tgagacgaagtcttgctctgtt

SEQ ID NO: 44851 - DNA, 22 bp, Homo sapiens
gcaggaggttgagccaggactg

SEQ ID NO: 44852 - DNA, 22 bp, Homo sapiens
cgccccggacgtctgaccaaac

SEQ ID NO: 44853 - DNA, 22 bp, Homo sapiens
gaggtggctgcttgctgggaaa

SEQ ID NO: 44854 - DNA, 21 bp, Homo sapiens
ggccccgcagacccagcacgt

SEQ ID NO: 44855 - DNA, 14 bp, Homo sapiens
gcaggcggatcact

SEQ ID NO: 44856 - DNA, 19 bp, Homo sapiens
catggtgaaaccccgtctc

SEQ ID NO: 44857 - DNA, 22 bp, Homo sapiens
agaggccggccgagcccatggg

SEQ ID NO: 44858 - DNA, 22 bp, Homo sapiens
ggaaggcagaggtgtcgtgggg

SEQ ID NO: 44859 - DNA, 22 bp, Homo sapiens
gtacaaatgcaggtttgttaca

SEQ ID NO: 44860 - DNA, 22 bp, Homo sapiens
tctgcaacattcctctccccac

SEQ ID NO: 44861 - DNA, 22 bp, Homo sapiens
tagcagcatttttgtagagtat

SEQ ID NO: 44862 - DNA, 22 bp, Homo sapiens
acccaataatgcaactccactt

SEQ ID NO: 44863 - DNA, 22 bp, Homo sapiens
gaagagctgacagtgtcatcct

SEQ ID NO: 44864 - DNA, 22 bp, Homo sapiens
ccaggaggcggaggttgcagtg

SEQ ID NO: 44865 - DNA, 19 bp, Homo sapiens
caggcctcttaccctctct

SEQ ID NO: 44866 - DNA, 22 bp, Homo sapiens
atatgggggggcgtgcagagga

SEQ ID NO: 44867 - DNA, 22 bp, Homo sapiens
ttctgattgctgatgaggccca

SEQ ID NO: 44868 - DNA, 22 bp, Homo sapiens
cagtcacaagcgtacctaattt

SEQ ID NO: 44869 - DNA, 22 bp, Homo sapiens
gggtaggcaaagcaatgacgtt

SEQ ID NO: 44870 - DNA, 22 bp, Homo sapiens
gaaacactcaatttagtaattc

SEQ ID NO: 44871 - DNA, 22 bp, Homo sapiens
acagaagcctttggccatttga

SEQ ID NO: 44872 - DNA, 22 bp, Homo sapiens
agggaacatttgcactgttggt

SEQ ID NO: 44873 - DNA, 22 bp, Homo sapiens
gaggctgaggcaggaggatcac

SEQ ID NO: 44874 - DNA, 23 bp, Homo sapiens
caggagatggctgctgtgtcagc

SEQ ID NO: 44875 - DNA, 21 bp, Homo sapiens
tgtaagtttcatctgaattgg

SEQ ID NO: 44876 - DNA, 22 bp, Homo sapiens
tttgattgtcacctaccttgca

SEQ ID NO: 44877 - DNA, 22 bp, Homo sapiens
gcctccagcccacgcaggcctg

SEQ ID NO: 44878 - DNA, 22 bp, Homo sapiens
caaagtaattacggttttggcc

SEQ ID NO: 44879 - DNA, 22 bp, Homo sapiens
ctgaaatgacggtttggggcaa

SEQ ID NO: 44880 - DNA, 22 bp, Homo sapiens
ccaggctgctgttggtgtccgc

SEQ ID NO: 44881 - DNA, 22 bp, Homo sapiens
ccaaagtgctgggattcaggca

SEQ ID NO: 44882 - DNA, 22 bp, Homo sapiens
taggcatgcaaataaatgtgca

SEQ ID NO: 44883 - DNA, 22 bp, Homo sapiens
tgttgcccaggttctctcctgc

SEQ ID NO: 44884 - DNA, 22 bp, Homo sapiens
ctgctgggatagaagtatctca

SEQ ID NO: 44885 - DNA, 22 bp, Homo sapiens
cgtcagtttactgttgccatgg

SEQ ID NO: 44886 - DNA, 22 bp, Homo sapiens
ggtttgttggggtccaggccca

SEQ ID NO: 44887 - DNA, 22 bp, Homo sapiens
atcacaaaggtctcagagcaca

SEQ ID NO: 44888 - DNA, 22 bp, Homo sapiens
tggctaggctggtgtcaagctc

SEQ ID NO: 44889 - DNA, 22 bp, Homo sapiens
tctgtgagaaccagtgccaggg

SEQ ID NO: 44890 - DNA, 22 bp, Homo sapiens
taattataacagttacatctta

SEQ ID NO: 44891 - DNA, 22 bp, Homo sapiens
ccaggtgtgctctgcagtggat

SEQ ID NO: 44892 - DNA, 23 bp, Homo sapiens
ggcctcagtgatgatgggttaaa

SEQ ID NO: 44893 - DNA, 22 bp, Homo sapiens
tggaagggagctggaatttgga

SEQ ID NO: 44894 - DNA, 23 bp, Homo sapiens
tgaggcaggcggatcacgaggtc

SEQ ID NO: 44895 - DNA, 22 bp, Homo sapiens
cctgtcataatgtccgatgtca

SEQ ID NO: 44896 - DNA, 22 bp, Homo sapiens
tgcactccaggctgggtgacag

SEQ ID NO: 44897 - DNA, 22 bp, Homo sapiens
ctgcagtctacctggattttta

SEQ ID NO: 44898 - DNA, 22 bp, Homo sapiens
gagaagtcatttgaccacctag

SEQ ID NO: 44899 - DNA, 22 bp, Homo sapiens
aatttgttataacttgggctga

SEQ ID NO: 44900 - DNA, 22 bp, Homo sapiens
tgattcatcagaataggagttt

SEQ ID NO: 44901 - DNA, 22 bp, Homo sapiens
gaccctgtttctacaaataatt

SEQ ID NO: 44902 - DNA, 22 bp, Homo sapiens
acccagggctcaagcgtaggca

SEQ ID NO: 44903 - DNA, 22 bp, Homo sapiens
agggtggcactggtggctctat

SEQ ID NO: 44904 - DNA, 22 bp, Homo sapiens
caggctggagtgcaatgacgcc

SEQ ID NO: 44905 - DNA, 22 bp, Homo sapiens
agtggctgagtgactgtgactc

SEQ ID NO: 44906 - DNA, 22 bp, Homo sapiens
taatgtaaacacagagacagaa

SEQ ID NO: 44907 - DNA, 22 bp, Homo sapiens
ccagctttatagcttcaaagga

SEQ ID NO: 44908 - DNA, 22 bp, Homo sapiens
tcacccaggctggactgcagtg

SEQ ID NO: 44909 - DNA, 22 bp, Homo sapiens
atgtgggccgtgcgggtgtcct

SEQ ID NO: 44910 - DNA, 22 bp, Homo sapiens
atagaatatgacttttagatcc

SEQ ID NO: 44911 - DNA, 22 bp, Homo sapiens
cgcgctgcagacagcggaggcc

SEQ ID NO: 44912 - DNA, 22 bp, Homo sapiens
catagagtgatgtaaggtatgt

SEQ ID NO: 44913 - DNA, 22 bp, Homo sapiens
gctggctgacagatttggggtg

SEQ ID NO: 44914 - DNA, 22 bp, Homo sapiens
tcccgcccttgtacttgccgag

SEQ ID NO: 44915 - DNA, 22 bp, Homo sapiens
ctggctggagtgcaggtgagtg

SEQ ID NO: 44916 - DNA, 22 bp, Homo sapiens
gtggcccaggttggagtgcagt

SEQ ID NO: 44917 - DNA, 22 bp, Homo sapiens
ccgggagcaggcgccaccgcca

SEQ ID NO: 44918 - DNA, 22 bp, Homo sapiens
aagtaaatatctgtagtcttta

SEQ ID NO: 44919 - DNA, 22 bp, Homo sapiens
gtgagagattgattgtagcggc

SEQ ID NO: 44920 - DNA, 22 bp, Homo sapiens
ttggcataccttagtggtggag

SEQ ID NO: 44921 - DNA, 22 bp, Homo sapiens
tgtagctctccagccagcaagg

SEQ ID NO: 44922 - DNA, 22 bp, Homo sapiens
agtggtcttagcttgctgggct

SEQ ID NO: 44923 - DNA, 22 bp, Homo sapiens
tgcgggttggtggcatatgcag

SEQ ID NO: 44924 - DNA, 22 bp, Homo sapiens
atgccactgcgctctagcctgg

SEQ ID NO: 44925 - DNA, 22 bp, Homo sapiens
ggcttggaaactagagtgtgca

SEQ ID NO: 44926 - DNA, 22 bp, Homo sapiens
tgttgattagtgtttagactta

SEQ ID NO: 44927 - DNA, 22 bp, Homo sapiens
tagagatggggtcttgctatga

SEQ ID NO: 44928 - DNA, 22 bp, Homo sapiens
catagcggtattccacgtggtt

SEQ ID NO: 44929 - DNA, 22 bp, Homo sapiens
atgtttttaaatagacttacag

SEQ ID NO: 44930 - DNA, 22 bp, Homo sapiens
agctcttacatttaggtctatg

SEQ ID NO: 44931 - DNA, 22 bp, Homo sapiens
tccagggccatctccatgaggc

SEQ ID NO: 44932 - DNA, 22 bp, Homo sapiens
tccagcagtccatgtgagacac

SEQ ID NO: 44933 - DNA, 22 bp, Homo sapiens
tgccagattgtggcatggcact

SEQ ID NO: 44934 - DNA, 22 bp, Homo sapiens
ccaggggggcgtagatgctggg

SEQ ID NO: 44935 - DNA, 22 bp, Homo sapiens
acgcctgtaatcccagcacttt

SEQ ID NO: 44936 - DNA, 19 bp, Homo sapiens
tcctgcctggggccgcctg

SEQ ID NO: 44937 - DNA, 22 bp, Homo sapiens
caggagtgtctccacacagcaa

SEQ ID NO: 44938 - DNA, 17 bp, Homo sapiens
cttcccaccatctcctg

SEQ ID NO: 44939 - DNA, 22 bp, Homo sapiens
cccaggaggcggaggttgcagt

SEQ ID NO: 44940 - DNA, 22 bp, Homo sapiens
aagaggtagcagtcacaaaaga

SEQ ID NO: 44941 - DNA, 22 bp, Homo sapiens
agtccgcctgctgccgtggcag

SEQ ID NO: 44942 - DNA, 22 bp, Homo sapiens
tgagtgaccagaagtccccctc

SEQ ID NO: 44943 - DNA, 20 bp, Homo sapiens
acgtggccaccagtggctta

SEQ ID NO: 44944 - DNA, 22 bp, Homo sapiens
aaattagtcatgttgtattact

SEQ ID NO: 44945 - DNA, 22 bp, Homo sapiens
agcctgcgatcccacctggcct

SEQ ID NO: 44946 - DNA, 22 bp, Homo sapiens
ctgctcttgagggactgcggtc

SEQ ID NO: 44947 - DNA, 22 bp, Homo sapiens
gatttctctgcacccactcagg

SEQ ID NO: 44948 - DNA, 22 bp, Homo sapiens
cctggaagttggaggttgcagt

SEQ ID NO: 44949 - DNA, 22 bp, Homo sapiens
tgtcatagtgtggtagcagtgg

SEQ ID NO: 44950 - DNA, 22 bp, Homo sapiens
ggtgacggggcccaggtttcct

SEQ ID NO: 44951 - DNA, 22 bp, Homo sapiens
gcctgtgtggatgcgccggtgc

SEQ ID NO: 44952 - DNA, 22 bp, Homo sapiens
actgggaagtcagagagaggct

SEQ ID NO: 44953 - DNA, 22 bp, Homo sapiens
cgcccaggctggagagcagtgg

SEQ ID NO: 44954 - DNA, 22 bp, Homo sapiens
ggcagacctctccagccccaca

SEQ ID NO: 44955 - DNA, 20 bp, Homo sapiens
tgatatggtttggctgtgtt

SEQ ID NO: 44956 - DNA, 19 bp, Homo sapiens
aatgctgcttctttttgca

SEQ ID NO: 44957 - DNA, 22 bp, Homo sapiens
gggctgcatcagcaggacccgg

SEQ ID NO: 44958 - DNA, 22 bp, Homo sapiens
aatgttgtgcatgtattttgta

SEQ ID NO: 44959 - DNA, 22 bp, Homo sapiens
agaagccaccagctgaggaaga

SEQ ID NO: 44960 - DNA, 22 bp, Homo sapiens
agcaggagtttgatgcttttat

SEQ ID NO: 44961 - DNA, 22 bp, Homo sapiens
attcacagggggagaagggtat

SEQ ID NO: 44962 - DNA, 20 bp, Homo sapiens
gggcagtggcgctatctcag

SEQ ID NO: 44963 - DNA, 22 bp, Homo sapiens
agtgctgggctatctactgcta

SEQ ID NO: 44964 - DNA, 22 bp, Homo sapiens
caggctggagtgcagtggcgcc

SEQ ID NO: 44965 - DNA, 22 bp, Homo sapiens
ttcattttctttcacgctgctg

SEQ ID NO: 44966 - DNA, 22 bp, Homo sapiens
ttatgggagcaattggggaggt

SEQ ID NO: 44967 - DNA, 22 bp, Homo sapiens
ggttcagggctaccagtgggtg

SEQ ID NO: 44968 - DNA, 22 bp, Homo sapiens
ttcctgggattattgtcaagca

SEQ ID NO: 44969 - DNA, 22 bp, Homo sapiens
cagtcactggaatagctgagga

SEQ ID NO: 44970 - DNA, 22 bp, Homo sapiens
tagatacctgctggacctcatt

SEQ ID NO: 44971 - DNA, 22 bp, Homo sapiens
gatagtcacctcccttaacttt

SEQ ID NO: 44972 - DNA, 22 bp, Homo sapiens
gtagggctcagtaaatactttg

SEQ ID NO: 44973 - DNA, 22 bp, Homo sapiens
gaggaggcttccgggaggcacg

SEQ ID NO: 44974 - DNA, 22 bp, Homo sapiens
ggcccaggctggagtgcagtgg

SEQ ID NO: 44975 - DNA, 22 bp, Homo sapiens
gccagatttacagatttgccct

SEQ ID NO: 44976 - DNA, 22 bp, Homo sapiens
gcccagcacctctctcagggtt

SEQ ID NO: 44977 - DNA, 22 bp, Homo sapiens
ttgggacagctgtggtagtgag

SEQ ID NO: 44978 - DNA, 22 bp, Homo sapiens
tcagaattgtggagaaagggga

SEQ ID NO: 44979 - DNA, 22 bp, Homo sapiens
ttctagtgtccttggacttgct

SEQ ID NO: 44980 - DNA, 20 bp, Homo sapiens
aggggcacctgcgacggggc

SEQ ID NO: 44981 - DNA, 22 bp, Homo sapiens
gagaaatatggctcagttccac

SEQ ID NO: 44982 - DNA, 22 bp, Homo sapiens
catggcactgagcaggtatgca

SEQ ID NO: 44983 - DNA, 22 bp, Homo sapiens
actcatgtcctaggagtaaagc

SEQ ID NO: 44984 - DNA, 22 bp, Homo sapiens
agccaagcactcaactcctgga

SEQ ID NO: 44985 - DNA, 22 bp, Homo sapiens
ctctggaccctcctgctgagag

SEQ ID NO: 44986 - DNA, 19 bp, Homo sapiens
gctggatggatcctggagt

SEQ ID NO: 44987 - DNA, 22 bp, Homo sapiens
gcaggcagaggtggaggagaca

SEQ ID NO: 44988 - DNA, 22 bp, Homo sapiens
cgcaggtgaaagaggctgggca

SEQ ID NO: 44989 - DNA, 22 bp, Homo sapiens
aggtggcagatgggggtgctcg

SEQ ID NO: 44990 - DNA, 17 bp, Homo sapiens
tggtagaatgacaggcc

SEQ ID NO: 44991 - DNA, 22 bp, Homo sapiens
agcctggtttaagcattttata

SEQ ID NO: 44992 - DNA, 22 bp, Homo sapiens
tttgaagactactgggagtgaa

SEQ ID NO: 44993 - DNA, 22 bp, Homo sapiens
aaggctgaggcagtgaggcaga

SEQ ID NO: 44994 - DNA, 22 bp, Homo sapiens
ccaggagttggaggttgcagtg

SEQ ID NO: 44995 - DNA, 22 bp, Homo sapiens
aacaattactaccaaggcctgt

SEQ ID NO: 44996 - DNA, 22 bp, Homo sapiens
attaagactgcccatgttttta

SEQ ID NO: 44997 - DNA, 22 bp, Homo sapiens
aggcaagggggcgccaccttcc

SEQ ID NO: 44998 - DNA, 22 bp, Homo sapiens
ctgaaggatgtgtggtgggagt

SEQ ID NO: 44999 - DNA, 22 bp, Homo sapiens
tctagttctagatccctgagga

SEQ ID NO: 45000 - DNA, 22 bp, Homo sapiens
tgtagtagcattcacgaagtgt

SEQ ID NO: 45001 - DNA, 20 bp, Homo sapiens
tgtccccaccaaaatttcat

SEQ ID NO: 45002 - DNA, 22 bp, Homo sapiens
gctcccaccgccgctatgggta

SEQ ID NO: 45003 - DNA, 23 bp, Homo sapiens
tactatggttattatccctctcc

SEQ ID NO: 45004 - DNA, 22 bp, Homo sapiens
gctgaggctcctcgggaggaca

SEQ ID NO: 45005 - DNA, 22 bp, Homo sapiens
atacaaaatatatactggagac

SEQ ID NO: 45006 - DNA, 22 bp, Homo sapiens
gtgcccagcagcagcgtccccg

SEQ ID NO: 45007 - DNA, 22 bp, Homo sapiens
tcgtctgtgaaattgggataag

SEQ ID NO: 45008 - DNA, 22 bp, Homo sapiens
acaccatactcatgttggttcc

SEQ ID NO: 45009 - DNA, 22 bp, Homo sapiens
tctgttgcaatgtgcatggtga

SEQ ID NO: 45010 - DNA, 19 bp, Homo sapiens
catctggatgattctcctg

SEQ ID NO: 45011 - DNA, 22 bp, Homo sapiens
gacttttgaataaggtaggata

SEQ ID NO: 45012 - DNA, 22 bp, Homo sapiens
gccctgggcaaggttctggcca

SEQ ID NO: 45013 - DNA, 22 bp, Homo sapiens
tcaggagtgccagtaccttttg

SEQ ID NO: 45014 - DNA, 22 bp, Homo sapiens
tgggagcagcctcagcttcggg

SEQ ID NO: 45015 - DNA, 22 bp, Homo sapiens
tgaacgcaggtccacatggctc

SEQ ID NO: 45016 - DNA, 22 bp, Homo sapiens
cacctcaggcagcaaagtctca

SEQ ID NO: 45017 - DNA, 20 bp, Homo sapiens
ctgggtggcaagcaaggggg

SEQ ID NO: 45018 - DNA, 22 bp, Homo sapiens
actcagtacatctggagttggc

SEQ ID NO: 45019 - DNA, 22 bp, Homo sapiens
aaacactcatgtgttactctcc

SEQ ID NO: 45020 - DNA, 22 bp, Homo sapiens
ggccactgctctccagcctggg

SEQ ID NO: 45021 - DNA, 22 bp, Homo sapiens
agagtggagagaaacaactctg

SEQ ID NO: 45022 - DNA, 22 bp, Homo sapiens
caagtgatcctcccatcttggc

SEQ ID NO: 45023 - DNA, 22 bp, Homo sapiens
gtgagactcgcctttgtgtagc

SEQ ID NO: 45024 - DNA, 22 bp, Homo sapiens
tgagcaggcgcagcaggaggtc

SEQ ID NO: 45025 - DNA, 17 bp, Homo sapiens
tctgagaatgctggagg

SEQ ID NO: 45026 - DNA, 22 bp, Homo sapiens
tcctgagccctactctagacga

SEQ ID NO: 45027 - DNA, 22 bp, Homo sapiens
tatactacgcaccaaacaaagg

SEQ ID NO: 45028 - DNA, 22 bp, Homo sapiens
actacagtgtgataagaggggc

SEQ ID NO: 45029 - DNA, 22 bp, Homo sapiens
cctgtgatattgttcataatat

SEQ ID NO: 45030 - DNA, 22 bp, Homo sapiens
acactccagggagggagggaat

SEQ ID NO: 45031 - DNA, 22 bp, Homo sapiens
ttgagggtctggatctgctgct

SEQ ID NO: 45032 - DNA, 22 bp, Homo sapiens
tgggtggcagcttcagcatgtt

SEQ ID NO: 45033 - DNA, 22 bp, Homo sapiens
ggatgttgattgaatggccatt

SEQ ID NO: 45034 - DNA, 22 bp, Homo sapiens
ggtaacttagctcatggctgtg

SEQ ID NO: 45035 - DNA, 17 bp, Homo sapiens
catcaaagaaatttcca

SEQ ID NO: 45036 - DNA, 22 bp, Homo sapiens
gtgttgatgacattttagaaac

SEQ ID NO: 45037 - DNA, 23 bp, Homo sapiens
cagtacaatgtggaaaaggagtg

SEQ ID NO: 45038 - DNA, 22 bp, Homo sapiens
gcaagtgaatgaggttgagatt

SEQ ID NO: 45039 - DNA, 20 bp, Homo sapiens
tttgagaccagtctgcccaa

SEQ ID NO: 45040 - DNA, 22 bp, Homo sapiens
tgatcaaaacattactccacca

SEQ ID NO: 45041 - DNA, 22 bp, Homo sapiens
ttgaggtcatctgaagtactag

SEQ ID NO: 45042 - DNA, 22 bp, Homo sapiens
ctgctcctgtccagcagggcca

SEQ ID NO: 45043 - DNA, 22 bp, Homo sapiens
acccaggctggagtgcagtggc

SEQ ID NO: 45044 - DNA, 22 bp, Homo sapiens
cctcgtccacaatccttgcaca

SEQ ID NO: 45045 - DNA, 22 bp, Homo sapiens
gcgtggcttagagtggggtacc

SEQ ID NO: 45046 - DNA, 22 bp, Homo sapiens
acatacttctttacattccata

SEQ ID NO: 45047 - DNA, 22 bp, Homo sapiens
gacgcatcaggaggcgaggagc

SEQ ID NO: 45048 - DNA, 22 bp, Homo sapiens
catgtgtgtctccaccagctgc

SEQ ID NO: 45049 - DNA, 22 bp, Homo sapiens
gtagcccacctggggagggcga

SEQ ID NO: 45050 - DNA, 22 bp, Homo sapiens
attttctctttgtatatgctag

SEQ ID NO: 45051 - DNA, 22 bp, Homo sapiens
aagcagcacagcaatgactcta

SEQ ID NO: 45052 - DNA, 23 bp, Homo sapiens
ctcaccaagcgccgccgctgtgt

SEQ ID NO: 45053 - DNA, 21 bp, Homo sapiens
acataggcgaatgttcgggag

SEQ ID NO: 45054 - DNA, 22 bp, Homo sapiens
ggtgcagaggagccagctgggg

SEQ ID NO: 45055 - DNA, 22 bp, Homo sapiens
agacggattacctgaggtcagg

SEQ ID NO: 45056 - DNA, 22 bp, Homo sapiens
attgttgggtctcactcctaga

SEQ ID NO: 45057 - DNA, 22 bp, Homo sapiens
agggccagcactcctggcagga

SEQ ID NO: 45058 - DNA, 22 bp, Homo sapiens
accacctcatcaagctggattg

SEQ ID NO: 45059 - DNA, 22 bp, Homo sapiens
cagccctcctaccctgccaggc

SEQ ID NO: 45060 - DNA, 22 bp, Homo sapiens
gcccgcagagatctttaacaaa

SEQ ID NO: 45061 - DNA, 22 bp, Homo sapiens
aggtgactggtttatctggcag

SEQ ID NO: 45062 - DNA, 22 bp, Homo sapiens
agaaaacataggagacaggaaa

SEQ ID NO: 45063 - DNA, 22 bp, Homo sapiens
gggttcagtccctcttgctact

SEQ ID NO: 45064 - DNA, 22 bp, Homo sapiens
gcaggtccagtcaccagagaga

SEQ ID NO: 45065 - DNA, 22 bp, Homo sapiens
ggtgggagagctctgtctccag

SEQ ID NO: 45066 - DNA, 22 bp, Homo sapiens
tagatgaccttgtgttaggcaa

SEQ ID NO: 45067 - DNA, 22 bp, Homo sapiens
cccagagcatgtgctgcctttg

SEQ ID NO: 45068 - DNA, 22 bp, Homo sapiens
ctggggtcagggatcagagagc

SEQ ID NO: 45069 - DNA, 22 bp, Homo sapiens
gcaggctgtctaaagttagagt

SEQ ID NO: 45070 - DNA, 22 bp, Homo sapiens
ggcaagagggcagatggagtgc

SEQ ID NO: 45071 - DNA, 22 bp, Homo sapiens
tggcacagcctccatgtcgtcc

SEQ ID NO: 45072 - DNA, 22 bp, Homo sapiens
gcccaggagttcaagtctagtg

SEQ ID NO: 45073 - DNA, 22 bp, Homo sapiens
agcttgggcaacacagcaagac

SEQ ID NO: 45074 - DNA, 22 bp, Homo sapiens
ctgctcatcagccgagcagggc

SEQ ID NO: 45075 - DNA, 22 bp, Homo sapiens
agagctgggtggacttgtagtt

SEQ ID NO: 45076 - DNA, 22 bp, Homo sapiens
ggctctgcgcctgcggggactt

SEQ ID NO: 45077 - DNA, 22 bp, Homo sapiens
atgtacataaaatgtataatga

SEQ ID NO: 45078 - DNA, 22 bp, Homo sapiens
ctcactgcaacctccgcctcct

SEQ ID NO: 45079 - DNA, 22 bp, Homo sapiens
gtggatggagctggaagccatt

SEQ ID NO: 45080 - DNA, 22 bp, Homo sapiens
ttgtgaaacattcatggatttg

SEQ ID NO: 45081 - DNA, 22 bp, Homo sapiens
cctggcctttgaacgctagact

SEQ ID NO: 45082 - DNA, 22 bp, Homo sapiens
tttacagcagcatgatttataa

SEQ ID NO: 45083 - DNA, 22 bp, Homo sapiens
tgtgggagaaggaagcaagctg

SEQ ID NO: 45084 - DNA, 22 bp, Homo sapiens
tgcagtggcgccatctcagctc

SEQ ID NO: 45085 - DNA, 22 bp, Homo sapiens
cggcccgctgcgagtgcaccgt

SEQ ID NO: 45086 - DNA, 22 bp, Homo sapiens
tggtccttctgtcttccgcacc

SEQ ID NO: 45087 - DNA, 22 bp, Homo sapiens
taaagggtaggttttactgtaa

SEQ ID NO: 45088 - DNA, 22 bp, Homo sapiens
agtggcctggagccccgcctgg

SEQ ID NO: 45089 - DNA, 19 bp, Homo sapiens
gactccaactttaagcatg

SEQ ID NO: 45090 - DNA, 22 bp, Homo sapiens
cataaaaggtagcagtttgaaa

SEQ ID NO: 45091 - DNA, 22 bp, Homo sapiens
ttctttcagaacacaagtgatt

SEQ ID NO: 45092 - DNA, 22 bp, Homo sapiens
ttctcaagaacatatgtagggt

SEQ ID NO: 45093 - DNA, 22 bp, Homo sapiens
acgtagcactgagagatgcagg

SEQ ID NO: 45094 - DNA, 22 bp, Homo sapiens
tagaaaagccccagctggaggg

SEQ ID NO: 45095 - DNA, 22 bp, Homo sapiens
tggcatctttgtcccagaagct

SEQ ID NO: 45096 - DNA, 22 bp, Homo sapiens
ttggaatgcacactgagcctgc

SEQ ID NO: 45097 - DNA, 22 bp, Homo sapiens
ggcctctgccccgcggggctcg

SEQ ID NO: 45098 - DNA, 22 bp, Homo sapiens
ccagaggtgctctttggaagtg

SEQ ID NO: 45099 - DNA, 22 bp, Homo sapiens
tggtacacatgtccaaggtcag

SEQ ID NO: 45100 - DNA, 22 bp, Homo sapiens
aaattgcaaaagtacttttagg

SEQ ID NO: 45101 - DNA, 17 bp, Homo sapiens
cccgttctcttcgctgg

SEQ ID NO: 45102 - DNA, 21 bp, Homo sapiens
tctgatggtagatgagatgtg

SEQ ID NO: 45103 - DNA, 22 bp, Homo sapiens
ctgggttggggttacatgactg

SEQ ID NO: 45104 - DNA, 22 bp, Homo sapiens
cagtggcaggatttcagctcag

SEQ ID NO: 45105 - DNA, 22 bp, Homo sapiens
tagaggctttcagcggtaggtc

SEQ ID NO: 45106 - DNA, 22 bp, Homo sapiens
aggagctgtcagagtgccagag

SEQ ID NO: 45107 - DNA, 22 bp, Homo sapiens
cacagggcttctcatggggtgc

SEQ ID NO: 45108 - DNA, 22 bp, Homo sapiens
gtgattttcatgccctgctagg

SEQ ID NO: 45109 - DNA, 22 bp, Homo sapiens
gctactgattgaccttggagag

SEQ ID NO: 45110 - DNA, 22 bp, Homo sapiens
aaaatcttgtgacttaggaagg

SEQ ID NO: 45111 - DNA, 22 bp, Homo sapiens
tgatggctgtagggtccggggc

SEQ ID NO: 45112 - DNA, 19 bp, Homo sapiens
tctagttttgagagacttc

SEQ ID NO: 45113 - DNA, 22 bp, Homo sapiens
attggtggtgaggacatgccag

SEQ ID NO: 45114 - DNA, 22 bp, Homo sapiens
ctggcagatagtaagtgatcaa

SEQ ID NO: 45115 - DNA, 22 bp, Homo sapiens
tcacaaatgtttgcatgtgtct

SEQ ID NO: 45116 - DNA, 22 bp, Homo sapiens
agggactatttacccatctcac

SEQ ID NO: 45117 - DNA, 22 bp, Homo sapiens
acagattcactgcactggccat

SEQ ID NO: 45118 - DNA, 22 bp, Homo sapiens
tcctgggatcaagtgatcctcc

SEQ ID NO: 45119 - DNA, 22 bp, Homo sapiens
ctggcaggttatagagctgccc

SEQ ID NO: 45120 - DNA, 21 bp, Homo sapiens
accctgctttatgccgtcctc

SEQ ID NO: 45121 - DNA, 22 bp, Homo sapiens
aaagtgctgagattacaagcgt

SEQ ID NO: 45122 - DNA, 22 bp, Homo sapiens
tgccgctccaggtctcgcggtg

SEQ ID NO: 45123 - DNA, 22 bp, Homo sapiens
gaggcctcatgaggtgagcatt

SEQ ID NO: 45124 - DNA, 22 bp, Homo sapiens
acgcagtttgtggacatttttt

SEQ ID NO: 45125 - DNA, 22 bp, Homo sapiens
agtgaaaacctaatcatgcagt

SEQ ID NO: 45126 - DNA, 22 bp, Homo sapiens
agcccttagtacatttctcaag

SEQ ID NO: 45127 - DNA, 22 bp, Homo sapiens
ctggcaagaaatatatatctta

SEQ ID NO: 45128 - DNA, 22 bp, Homo sapiens
tcacagtgttaaacctttcttt

SEQ ID NO: 45129 - DNA, 22 bp, Homo sapiens
caatagtgtctgcttgtttcta

SEQ ID NO: 45130 - DNA, 18 bp, Homo sapiens
gaggatggaaggagatgc

SEQ ID NO: 45131 - DNA, 22 bp, Homo sapiens
aaacttttttaggttcataggc

SEQ ID NO: 45132 - DNA, 20 bp, Homo sapiens
aagacaccagtggcagcccc

SEQ ID NO: 45133 - DNA, 22 bp, Homo sapiens
ggggtctgggcttagctggaat

SEQ ID NO: 45134 - DNA, 22 bp, Homo sapiens
tcagtgcagggtgggagagaga

SEQ ID NO: 45135 - DNA, 22 bp, Homo sapiens
tttgcattgcattaagtattct

SEQ ID NO: 45136 - DNA, 22 bp, Homo sapiens
ctgaggaggctaatttgaggat

SEQ ID NO: 45137 - DNA, 22 bp, Homo sapiens
ggaggcggaggctgcagtgagc

SEQ ID NO: 45138 - DNA, 23 bp, Homo sapiens
tcagaacagttcttggtgcatag

SEQ ID NO: 45139 - DNA, 22 bp, Homo sapiens
agggctgcccagtgtgagagct

SEQ ID NO: 45140 - DNA, 22 bp, Homo sapiens
ttccagctaactcacatccctt

SEQ ID NO: 45141 - DNA, 22 bp, Homo sapiens
tctatgcttgagacagatgggg

SEQ ID NO: 45142 - DNA, 22 bp, Homo sapiens
tccaagatctacagcagtttag

SEQ ID NO: 45143 - DNA, 22 bp, Homo sapiens
ttccccttgataagcagggttg

SEQ ID NO: 45144 - DNA, 22 bp, Homo sapiens
aatgtgagccaatgcccgtggg

SEQ ID NO: 45145 - DNA, 22 bp, Homo sapiens
tatgaagtgatgttgaattttg

SEQ ID NO: 45146 - DNA, 22 bp, Homo sapiens
ttccatacgactgaggtctcgg

SEQ ID NO: 45147 - DNA, 22 bp, Homo sapiens
gaggctggacgtgcatttctac

SEQ ID NO: 45148 - DNA, 22 bp, Homo sapiens
ctgctgaggtggagattgcagt

SEQ ID NO: 45149 - DNA, 22 bp, Homo sapiens
acaagcgggccacagtgctggt

SEQ ID NO: 45150 - DNA, 22 bp, Homo sapiens
caggaggagggcagccgcctcc

SEQ ID NO: 45151 - DNA, 22 bp, Homo sapiens
ttgatgagaccattgccgcgtc

SEQ ID NO: 45152 - DNA, 22 bp, Homo sapiens
aagaggtaaccatagcaaccac

SEQ ID NO: 45153 - DNA, 22 bp, Homo sapiens
ttttcagaattagcataccatt

SEQ ID NO: 45154 - DNA, 22 bp, Homo sapiens
gtctgaatacgtacttgtgaag

SEQ ID NO: 45155 - DNA, 22 bp, Homo sapiens
caggctggagtgcagtggcgct

SEQ ID NO: 45156 - DNA, 22 bp, Homo sapiens
ttcgactctgtgcctgaagagc

SEQ ID NO: 45157 - DNA, 22 bp, Homo sapiens
caaccgcggggcccagcggttc

SEQ ID NO: 45158 - DNA, 22 bp, Homo sapiens
gccttgccgctcagcagtgggg

SEQ ID NO: 45159 - DNA, 22 bp, Homo sapiens
catgaaattgtattggcctcaa

SEQ ID NO: 45160 - DNA, 22 bp, Homo sapiens
aggacaaaggaccagatctgga

SEQ ID NO: 45161 - DNA, 22 bp, Homo sapiens
gaccaagatacagcatcataga

SEQ ID NO: 45162 - DNA, 22 bp, Homo sapiens
tatcagtccagggttttgtgac

SEQ ID NO: 45163 - DNA, 19 bp, Homo sapiens
cccaggaagcggaggttgc

SEQ ID NO: 45164 - DNA, 22 bp, Homo sapiens
tgcctcagctgaggccgctcca

SEQ ID NO: 45165 - DNA, 22 bp, Homo sapiens
ttgggtgctgtcatggggcacg

SEQ ID NO: 45166 - DNA, 22 bp, Homo sapiens
cctgggtttggagcctgcagaa

SEQ ID NO: 45167 - DNA, 19 bp, Homo sapiens
aggaatggaattaattctg

SEQ ID NO: 45168 - DNA, 22 bp, Homo sapiens
tgtcttcaggagtaaatatcat

SEQ ID NO: 45169 - DNA, 22 bp, Homo sapiens
aaccccgctcaggctgggtgag

SEQ ID NO: 45170 - DNA, 22 bp, Homo sapiens
gtggcagaccttcccttctcct

SEQ ID NO: 45171 - DNA, 22 bp, Homo sapiens
gagagagctctgtgcctgggat

SEQ ID NO: 45172 - DNA, 22 bp, Homo sapiens
cgtcccgggttcacgccattct

SEQ ID NO: 45173 - DNA, 22 bp, Homo sapiens
tcccacaggtggagcttgcagt

SEQ ID NO: 45174 - DNA, 22 bp, Homo sapiens
atgaaatatcttgaagaaattc

SEQ ID NO: 45175 - DNA, 21 bp, Homo sapiens
ccgccgctgatagctctgggc

SEQ ID NO: 45176 - DNA, 22 bp, Homo sapiens
acatgtttaagtttgttatatg

SEQ ID NO: 45177 - DNA, 22 bp, Homo sapiens
accccagaggcggaggctgcag

SEQ ID NO: 45178 - DNA, 22 bp, Homo sapiens
ttccagttcactccatttctgg

SEQ ID NO: 45179 - DNA, 22 bp, Homo sapiens
ccacaggggcccacgagccgct

SEQ ID NO: 45180 - DNA, 22 bp, Homo sapiens
gagtagaactggttatctaata

SEQ ID NO: 45181 - DNA, 22 bp, Homo sapiens
ccaccgccatggcgttgtacag

SEQ ID NO: 45182 - DNA, 22 bp, Homo sapiens
tcgaatggcaaggaaagaggct

SEQ ID NO: 45183 - DNA, 22 bp, Homo sapiens
atggcagcggagctggaaatga

SEQ ID NO: 45184 - DNA, 22 bp, Homo sapiens
caggctgctgacaggcttggag

SEQ ID NO: 45185 - DNA, 19 bp, Homo sapiens
gctgaaggaggtgcctgca

SEQ ID NO: 45186 - DNA, 22 bp, Homo sapiens
aggaagatgtgcaaagttggaa

SEQ ID NO: 45187 - DNA, 22 bp, Homo sapiens
ccggagtgtctggcctgctggg

SEQ ID NO: 45188 - DNA, 22 bp, Homo sapiens
aggtctcttgctgtctctgggc

SEQ ID NO: 45189 - DNA, 22 bp, Homo sapiens
ctggcctggcgcagtggctcac

SEQ ID NO: 45190 - DNA, 22 bp, Homo sapiens
cacagctgaagtagccatgtgg

SEQ ID NO: 45191 - DNA, 22 bp, Homo sapiens
gtcctgtgagattcatgctcaa

SEQ ID NO: 45192 - DNA, 20 bp, Homo sapiens
aaacgagccatcattctggt

SEQ ID NO: 45193 - DNA, 22 bp, Homo sapiens
tcaggaggtccgcccgggaggg

SEQ ID NO: 45194 - DNA, 22 bp, Homo sapiens
agatcacagtggcaactccctt

SEQ ID NO: 45195 - DNA, 22 bp, Homo sapiens
ggagacagggttgaaccacgca

SEQ ID NO: 45196 - DNA, 22 bp, Homo sapiens
tttgattgcaatagttttatga

SEQ ID NO: 45197 - DNA, 22 bp, Homo sapiens
aggccttaccatagctgtagca

SEQ ID NO: 45198 - DNA, 22 bp, Homo sapiens
tcagccagccagctacaggctt

SEQ ID NO: 45199 - DNA, 22 bp, Homo sapiens
gtcaggactctgacccgtcccg

SEQ ID NO: 45200 - DNA, 22 bp, Homo sapiens
aactcactttgtggcttctgaa

SEQ ID NO: 45201 - DNA, 22 bp, Homo sapiens
atacttctttagcatattgaac

SEQ ID NO: 45202 - DNA, 22 bp, Homo sapiens
agatgtgagaatcaagtgacca

SEQ ID NO: 45203 - DNA, 22 bp, Homo sapiens
aaggctgagacagcacaggtcc

SEQ ID NO: 45204 - DNA, 22 bp, Homo sapiens
cttcagctgcagttatgtttag

SEQ ID NO: 45205 - DNA, 22 bp, Homo sapiens
agtccaggcattccagccattc

SEQ ID NO: 45206 - DNA, 22 bp, Homo sapiens
agcagcagtatccttccccggc

SEQ ID NO: 45207 - DNA, 22 bp, Homo sapiens
tgactcagtacatctggagttg

SEQ ID NO: 45208 - DNA, 22 bp, Homo sapiens
aatgcaatgcagcacctccttg

SEQ ID NO: 45209 - DNA, 22 bp, Homo sapiens
tttaggttttttcacgtggcta

SEQ ID NO: 45210 - DNA, 22 bp, Homo sapiens
tgctgctccccagcacacagca

SEQ ID NO: 45211 - DNA, 22 bp, Homo sapiens
tacaaaaaattgatactgacga

SEQ ID NO: 45212 - DNA, 22 bp, Homo sapiens
gactttctgatgtaaacattta

SEQ ID NO: 45213 - DNA, 22 bp, Homo sapiens
gccagcagcttcttctcatcct

SEQ ID NO: 45214 - DNA, 22 bp, Homo sapiens
tgcgaccctagccccctcactt

SEQ ID NO: 45215 - DNA, 22 bp, Homo sapiens
gcacatccaatgattgttttga

SEQ ID NO: 45216 - DNA, 22 bp, Homo sapiens
taacaactgctgaggtatttga

SEQ ID NO: 45217 - DNA, 22 bp, Homo sapiens
cactgcaacctccatcttctgg

SEQ ID NO: 45218 - DNA, 20 bp, Homo sapiens
ttgagcttttagtacagaca

SEQ ID NO: 45219 - DNA, 22 bp, Homo sapiens
gcagagctcatgcctgcacctc

SEQ ID NO: 45220 - DNA, 22 bp, Homo sapiens
aggtggaaatggctttcctagg

SEQ ID NO: 45221 - DNA, 22 bp, Homo sapiens
tttggactgcatgatgatctgg

SEQ ID NO: 45222 - DNA, 22 bp, Homo sapiens
ggctgagctccaagtattccat

SEQ ID NO: 45223 - DNA, 22 bp, Homo sapiens
cccgggaggcggaggttgcagt

SEQ ID NO: 45224 - DNA, 22 bp, Homo sapiens
agcctctcagagtgctgggatt

SEQ ID NO: 45225 - DNA, 22 bp, Homo sapiens
ggtagaaataatcttcaggctg

SEQ ID NO: 45226 - DNA, 22 bp, Homo sapiens
ccctgtgggaactcctgagttg

SEQ ID NO: 45227 - DNA, 22 bp, Homo sapiens
tggtggctcacgtctgtaatct

SEQ ID NO: 45228 - DNA, 22 bp, Homo sapiens
gttaggtagaagtttactttga

SEQ ID NO: 45229 - DNA, 22 bp, Homo sapiens
tcccgttgatgacggtgcatcc

SEQ ID NO: 45230 - DNA, 22 bp, Homo sapiens
gggaacagcttgggctctgcca

SEQ ID NO: 45231 - DNA, 22 bp, Homo sapiens
cccgtgtgtgcgaggctcccgc

SEQ ID NO: 45232 - DNA, 22 bp, Homo sapiens
tcagtgtgaattcaggagccta

SEQ ID NO: 45233 - DNA, 22 bp, Homo sapiens
tgcctccctggcaagtctctcc

SEQ ID NO: 45234 - DNA, 21 bp, Homo sapiens
ggtgctcgctgatgaggagtg

SEQ ID NO: 45235 - DNA, 18 bp, Homo sapiens
cagctgccagctcatgga

SEQ ID NO: 45236 - DNA, 23 bp, Homo sapiens
ggatggacgtgatgccttagcca

SEQ ID NO: 45237 - DNA, 22 bp, Homo sapiens
tgaagctttaggatgggttcat

SEQ ID NO: 45238 - DNA, 22 bp, Homo sapiens
ttgtggttgactaaatttgtaa

SEQ ID NO: 45239 - DNA, 22 bp, Homo sapiens
ggtgacctcacctggtcccacc

SEQ ID NO: 45240 - DNA, 21 bp, Homo sapiens
acgctgcaccacgttctgcgg

SEQ ID NO: 45241 - DNA, 22 bp, Homo sapiens
aaggaaagctgtggttctgaga

SEQ ID NO: 45242 - DNA, 21 bp, Homo sapiens
acagcctccatctcctgggct

SEQ ID NO: 45243 - DNA, 22 bp, Homo sapiens
atctttgattgaagggaccctg

SEQ ID NO: 45244 - DNA, 22 bp, Homo sapiens
tggcaagaactgcaattgcttt

SEQ ID NO: 45245 - DNA, 22 bp, Homo sapiens
gttctgagtcctcctttgaagg

SEQ ID NO: 45246 - DNA, 22 bp, Homo sapiens
gctggcagacttcctctggaac

SEQ ID NO: 45247 - DNA, 22 bp, Homo sapiens
tctcaagcttgttggtatgttt

SEQ ID NO: 45248 - DNA, 22 bp, Homo sapiens
aggagaagccaagttgtgagca

SEQ ID NO: 45249 - DNA, 22 bp, Homo sapiens
tcatcagcaccctatgtccttt

SEQ ID NO: 45250 - DNA, 22 bp, Homo sapiens
ccaggaggcagaagttgcagtg

SEQ ID NO: 45251 - DNA, 22 bp, Homo sapiens
ctatacagcagcttactagtta

SEQ ID NO: 45252 - DNA, 22 bp, Homo sapiens
ctcggcaggtggaggttgtagt

SEQ ID NO: 45253 - DNA, 22 bp, Homo sapiens
gagaggtggaggttgcagtgag

SEQ ID NO: 45254 - DNA, 22 bp, Homo sapiens
agccctcttccagccagcacag

SEQ ID NO: 45255 - DNA, 22 bp, Homo sapiens
ctgggaggcagaggttgtagtg

SEQ ID NO: 45256 - DNA, 22 bp, Homo sapiens
aggtttctttatgctgctagaa

SEQ ID NO: 45257 - DNA, 22 bp, Homo sapiens
tagatgtgttgcctggagttgt

SEQ ID NO: 45258 - DNA, 22 bp, Homo sapiens
gccatgggcaaatgcagagctg

SEQ ID NO: 45259 - DNA, 22 bp, Homo sapiens
aaactagctcttagtttagagg

SEQ ID NO: 45260 - DNA, 22 bp, Homo sapiens
cagctggcgactctcctcgatg

SEQ ID NO: 45261 - DNA, 22 bp, Homo sapiens
gctcccaggatgaggagccagg

SEQ ID NO: 45262 - DNA, 22 bp, Homo sapiens
actgcactccagcctgggtgac

SEQ ID NO: 45263 - DNA, 22 bp, Homo sapiens
tgggttcgatgtatatgtagcc

SEQ ID NO: 45264 - DNA, 22 bp, Homo sapiens
cagagctggtgtgtcctggcat

SEQ ID NO: 45265 - DNA, 22 bp, Homo sapiens
ctggggaacgcagcgagcagcg

SEQ ID NO: 45266 - DNA, 22 bp, Homo sapiens
tacatgctccttatgagaatct

SEQ ID NO: 45267 - DNA, 18 bp, Homo sapiens
tggtcactgtggatagtg

SEQ ID NO: 45268 - DNA, 22 bp, Homo sapiens
tccttagacaaagagtgggctt

SEQ ID NO: 45269 - DNA, 22 bp, Homo sapiens
attgtgaatagtgccgcagtaa

SEQ ID NO: 45270 - DNA, 22 bp, Homo sapiens
gggaaatctcgtcctctattta

SEQ ID NO: 45271 - DNA, 22 bp, Homo sapiens
cccaggggttcaaggctgcagt

SEQ ID NO: 45272 - DNA, 22 bp, Homo sapiens
aaagttctctatggtgtaaaaa

SEQ ID NO: 45273 - DNA, 22 bp, Homo sapiens
atatcactagagaagttgttaa

SEQ ID NO: 45274 - DNA, 22 bp, Homo sapiens
caggcagggagctggaaaggat

SEQ ID NO: 45275 - DNA, 22 bp, Homo sapiens
tcagggctgcagaagaggcagg

SEQ ID NO: 45276 - DNA, 23 bp, Homo sapiens
gcctgccgcctggctgagaactg

SEQ ID NO: 45277 - DNA, 22 bp, Homo sapiens
cagaccagaaggaagccgacaa

SEQ ID NO: 45278 - DNA, 19 bp, Homo sapiens
ggctgccttctgctcatct

SEQ ID NO: 45279 - DNA, 22 bp, Homo sapiens
gaatttcctctaaacccctgag

SEQ ID NO: 45280 - DNA, 22 bp, Homo sapiens
caaatgaatatttccatgggtt

SEQ ID NO: 45281 - DNA, 22 bp, Homo sapiens
tgtgactaggcctgagctcttg

SEQ ID NO: 45282 - DNA, 22 bp, Homo sapiens
actccacaccacgggggccgcc

SEQ ID NO: 45283 - DNA, 22 bp, Homo sapiens
cccgactagctgggattacagg

SEQ ID NO: 45284 - DNA, 22 bp, Homo sapiens
ttgtaacaggtactaaataact

SEQ ID NO: 45285 - DNA, 22 bp, Homo sapiens
aacctcaaactcttgggcttaa

SEQ ID NO: 45286 - DNA, 22 bp, Homo sapiens
aactatgttaataagtttcatt

SEQ ID NO: 45287 - DNA, 22 bp, Homo sapiens
aaagtgcttctctttggtgggt

SEQ ID NO: 45288 - DNA, 22 bp, Homo sapiens
ctaggtgatccactgctctctt

SEQ ID NO: 45289 - DNA, 22 bp, Homo sapiens
tacagggattgttttaatcacc

SEQ ID NO: 45290 - DNA, 22 bp, Homo sapiens
ccagagctgattcctgggactt

SEQ ID NO: 45291 - DNA, 22 bp, Homo sapiens
tccagctgttccatcagctctt

SEQ ID NO: 45292 - DNA, 22 bp, Homo sapiens
tgggaagctgcattttaacaag

SEQ ID NO: 45293 - DNA, 22 bp, Homo sapiens
cagtggctggttagggacagga

SEQ ID NO: 45294 - DNA, 22 bp, Homo sapiens
catcagaacgtgagctccttgt

SEQ ID NO: 45295 - DNA, 22 bp, Homo sapiens
cactgcaatatctgcatcctgg

SEQ ID NO: 45296 - DNA, 22 bp, Homo sapiens
catttacatttaaggttaatat

SEQ ID NO: 45297 - DNA, 22 bp, Homo sapiens
tcccgcttcttccgaatcgcga

SEQ ID NO: 45298 - DNA, 22 bp, Homo sapiens
atgaggcaggagtgcagtggca

SEQ ID NO: 45299 - DNA, 22 bp, Homo sapiens
tcgtgatctgtccacctcggcc

SEQ ID NO: 45300 - DNA, 22 bp, Homo sapiens
cgctgcgaggcgcccttgttgc

SEQ ID NO: 45301 - DNA, 22 bp, Homo sapiens
aagatattcaaagatttattag

SEQ ID NO: 45302 - DNA, 22 bp, Homo sapiens
aagagaattctggttttcctat

SEQ ID NO: 45303 - DNA, 22 bp, Homo sapiens
agcccttggtattttccgatcc

SEQ ID NO: 45304 - DNA, 22 bp, Homo sapiens
ttgcatcttctggttgagcccc

SEQ ID NO: 45305 - DNA, 22 bp, Homo sapiens
gttactcttgagaggctgaggt

SEQ ID NO: 45306 - DNA, 22 bp, Homo sapiens
caacaacatgggattcatttct

SEQ ID NO: 45307 - DNA, 22 bp, Homo sapiens
tctagctctgcttatcatggct

SEQ ID NO: 45308 - DNA, 22 bp, Homo sapiens
ctgagcctcctgcttctatttc

SEQ ID NO: 45309 - DNA, 21 bp, Homo sapiens
aaggacgaggttttgattaca

SEQ ID NO: 45310 - DNA, 22 bp, Homo sapiens
gggcctgtgtgttcaggagcct

SEQ ID NO: 45311 - DNA, 22 bp, Homo sapiens
tgagcctgagttcaaggctgca

SEQ ID NO: 45312 - DNA, 22 bp, Homo sapiens
ttctaattaaatctacgctagg

SEQ ID NO: 45313 - DNA, 22 bp, Homo sapiens
gaccttgtgatccgcccgcctt

SEQ ID NO: 45314 - DNA, 22 bp, Homo sapiens
tctaatccttgctacctgggtg

SEQ ID NO: 45315 - DNA, 22 bp, Homo sapiens
ttcctggcttgtcacatctacg

SEQ ID NO: 45316 - DNA, 22 bp, Homo sapiens
gacccaggggcagggagaaagt

SEQ ID NO: 45317 - DNA, 22 bp, Homo sapiens
ggatgttctggggttctcttgt

SEQ ID NO: 45318 - DNA, 22 bp, Homo sapiens
gaagatacaaatttcttagatg

SEQ ID NO: 45319 - DNA, 22 bp, Homo sapiens
actggacagaggaaatatggag

SEQ ID NO: 45320 - DNA, 22 bp, Homo sapiens
tggggaaaatgcttgtagtcag

SEQ ID NO: 45321 - DNA, 22 bp, Homo sapiens
gtgcacatcgtgcaggtttgtt

SEQ ID NO: 45322 - DNA, 22 bp, Homo sapiens
gtgcatgtcggggtgcatgtca

SEQ ID NO: 45323 - DNA, 22 bp, Homo sapiens
gtccctgagcctggcatttccc

SEQ ID NO: 45324 - DNA, 22 bp, Homo sapiens
ttgtttccataattaagtgtga

SEQ ID NO: 45325 - DNA, 22 bp, Homo sapiens
gaggggtccaggaggcacttac

SEQ ID NO: 45326 - DNA, 22 bp, Homo sapiens
tacccagtgccaccctctgagg

SEQ ID NO: 45327 - DNA, 22 bp, Homo sapiens
aaagcagggaaatctatttgca

SEQ ID NO: 45328 - DNA, 22 bp, Homo sapiens
tgctcgaggtccccaccggctc

SEQ ID NO: 45329 - DNA, 22 bp, Homo sapiens
tgtctgttattggtgtataaga

SEQ ID NO: 45330 - DNA, 22 bp, Homo sapiens
cactgcactccagcctgggcaa

SEQ ID NO: 45331 - DNA, 22 bp, Homo sapiens
tatttcacatctatgaagtgag

SEQ ID NO: 45332 - DNA, 22 bp, Homo sapiens
acaggggaatttactgtcatta

SEQ ID NO: 45333 - DNA, 22 bp, Homo sapiens
tctcgctctgtcgcccaggctg

SEQ ID NO: 45334 - DNA, 22 bp, Homo sapiens
gacagacacaattgatccatga

SEQ ID NO: 45335 - DNA, 22 bp, Homo sapiens
gcccaggaggagaggctgcagt

SEQ ID NO: 45336 - DNA, 22 bp, Homo sapiens
gctgcagctgtaggacacaatt

SEQ ID NO: 45337 - DNA, 22 bp, Homo sapiens
ggcgtttcaccatgttgaccag

SEQ ID NO: 45338 - DNA, 23 bp, Homo sapiens
aaacttgctatggctgaaatcat

SEQ ID NO: 45339 - DNA, 22 bp, Homo sapiens
tgcctaggctggagtgcaatgg

SEQ ID NO: 45340 - DNA, 22 bp, Homo sapiens
agagcacagccaccatttacaa

SEQ ID NO: 45341 - DNA, 22 bp, Homo sapiens
tggcaagaaccgcaattacttt

SEQ ID NO: 45342 - DNA, 22 bp, Homo sapiens
aggggatgcctagtggagtctc

SEQ ID NO: 45343 - DNA, 22 bp, Homo sapiens
tgttatcctcagctcacctcta

SEQ ID NO: 45344 - DNA, 22 bp, Homo sapiens
aaagagccgctgatgtcagccc

SEQ ID NO: 45345 - DNA, 22 bp, Homo sapiens
taaatgttgtaagtacatctaa

SEQ ID NO: 45346 - DNA, 22 bp, Homo sapiens
gtcgtggtcagacaccagaaaa

SEQ ID NO: 45347 - DNA, 22 bp, Homo sapiens
cccaggaggtggagttcacagt

SEQ ID NO: 45348 - DNA, 22 bp, Homo sapiens
tttaatcaggcaaagcataata

SEQ ID NO: 45349 - DNA, 22 bp, Homo sapiens
ccaggaggcggaaggtacagtg

SEQ ID NO: 45350 - DNA, 22 bp, Homo sapiens
ctggcctaggaatggttttccg

SEQ ID NO: 45351 - DNA, 22 bp, Homo sapiens
ccccaggacgtggccctcatag

SEQ ID NO: 45352 - DNA, 22 bp, Homo sapiens
gcccagagttcaaggctgcagt

SEQ ID NO: 45353 - DNA, 22 bp, Homo sapiens
agacattttcgttggagaggtt

SEQ ID NO: 45354 - DNA, 22 bp, Homo sapiens
tacttttctataggtttgaaat

SEQ ID NO: 45355 - DNA, 22 bp, Homo sapiens
tggggccatctcacccactgtt

SEQ ID NO: 45356 - DNA, 22 bp, Homo sapiens
ctacaaaagtaattgtggtttt

SEQ ID NO: 45357 - DNA, 22 bp, Homo sapiens
tagagctggccgggacagctgg

SEQ ID NO: 45358 - DNA, 22 bp, Homo sapiens
tgctcttcacagtttcagcatc

SEQ ID NO: 45359 - DNA, 22 bp, Homo sapiens
ggggctgaacctggaggtggtc

SEQ ID NO: 45360 - DNA, 22 bp, Homo sapiens
cggctcactgcagctccgcctc

SEQ ID NO: 45361 - DNA, 22 bp, Homo sapiens
aggaattggcacggccttctca

SEQ ID NO: 45362 - DNA, 22 bp, Homo sapiens
tgtgcatgtgtctttatagtag

SEQ ID NO: 45363 - DNA, 22 bp, Homo sapiens
aaattgtaatgacttcacttga

SEQ ID NO: 45364 - DNA, 23 bp, Homo sapiens
gcagaggagcaagctggacacca

SEQ ID NO: 45365 - DNA, 22 bp, Homo sapiens
gggaggttctgttcgcacttga

SEQ ID NO: 45366 - DNA, 22 bp, Homo sapiens
atgatactctaggtgatttaca

SEQ ID NO: 45367 - DNA, 22 bp, Homo sapiens
tgggcttggtttctaggtaggt

SEQ ID NO: 45368 - DNA, 22 bp, Homo sapiens
ggcatggacgtctctgaggcca

SEQ ID NO: 45369 - DNA, 22 bp, Homo sapiens
accttgatggggctgttggagt

SEQ ID NO: 45370 - DNA, 22 bp, Homo sapiens
tccaactttctcctccggcttg

SEQ ID NO: 45371 - DNA, 20 bp, Homo sapiens
gaaatgtacacattaccaca

SEQ ID NO: 45372 - DNA, 23 bp, Homo sapiens
gaggtggcaatgagggcagttgg

SEQ ID NO: 45373 - DNA, 22 bp, Homo sapiens
tttgaaatgtatcagtataggt

SEQ ID NO: 45374 - DNA, 22 bp, Homo sapiens
gcagcctgggcaacagagtgag

SEQ ID NO: 45375 - DNA, 22 bp, Homo sapiens
tgcctactagtactattttgtg

SEQ ID NO: 45376 - DNA, 23 bp, Homo sapiens
gtgcatgtgtctttacagtagca

SEQ ID NO: 45377 - DNA, 22 bp, Homo sapiens
tcagtcttgaacagccccctgt

SEQ ID NO: 45378 - DNA, 22 bp, Homo sapiens
gctgctttgtctgtaaaatgga

SEQ ID NO: 45379 - DNA, 22 bp, Homo sapiens
atggtactggggtcccggagtt

SEQ ID NO: 45380 - DNA, 22 bp, Homo sapiens
gtgttaaccagctaaactttgc

SEQ ID NO: 45381 - DNA, 22 bp, Homo sapiens
agatggtagactatggaacgta

SEQ ID NO: 45382 - DNA, 22 bp, Homo sapiens
gctccccaaaagctccaggaaa

SEQ ID NO: 45383 - DNA, 22 bp, Homo sapiens
gggaaggaaagttattagcaga

SEQ ID NO: 45384 - DNA, 22 bp, Homo sapiens
aaacaacctaaagttactgatc

SEQ ID NO: 45385 - DNA, 23 bp, Homo sapiens
tcaaatcccagctctaccacttc

SEQ ID NO: 45386 - DNA, 22 bp, Homo sapiens
ggacagaaaccatatgagtgta

SEQ ID NO: 45387 - DNA, 22 bp, Homo sapiens
taggtgcctgcacgacccaaac

SEQ ID NO: 45388 - DNA, 22 bp, Homo sapiens
tatgtgtttgacaccctgcaag

SEQ ID NO: 45389 - DNA, 22 bp, Homo sapiens
caggctggagtgcagtggtgcc

SEQ ID NO: 45390 - DNA, 22 bp, Homo sapiens
caggtgcctcaggatgagacaa

SEQ ID NO: 45391 - DNA, 22 bp, Homo sapiens
gggacgacaggctctgtggtag

SEQ ID NO: 45392 - DNA, 22 bp, Homo sapiens
cggagcctgcttgttgcagctg

SEQ ID NO: 45393 - DNA, 22 bp, Homo sapiens
cttcaggggtgttagttttgtg

SEQ ID NO: 45394 - DNA, 22 bp, Homo sapiens
gctttatccgcttgacccttac

SEQ ID NO: 45395 - DNA, 22 bp, Homo sapiens
atgaccagccgagataaacaga

SEQ ID NO: 45396 - DNA, 17 bp, Homo sapiens
ttaaggtggatcagcac

SEQ ID NO: 45397 - DNA, 22 bp, Homo sapiens
gaccttgtgatccacctgcctt

SEQ ID NO: 45398 - DNA, 22 bp, Homo sapiens
gctcaagacccctctgtgactg

SEQ ID NO: 45399 - DNA, 22 bp, Homo sapiens
aggcgcctgcgggatccttgcc

SEQ ID NO: 45400 - DNA, 18 bp, Homo sapiens
actctgcggaggccccag

SEQ ID NO: 45401 - DNA, 22 bp, Homo sapiens
taattctgacaacagtggcgtt

SEQ ID NO: 45402 - DNA, 22 bp, Homo sapiens
acagtgcttagcacagagtaga

SEQ ID NO: 45403 - DNA, 22 bp, Homo sapiens
aaagtgctggtattacaggtgt

SEQ ID NO: 45404 - DNA, 22 bp, Homo sapiens
cttcctctgtggccagagtgta

SEQ ID NO: 45405 - DNA, 22 bp, Homo sapiens
tcactcaggctggagtgcagtg

SEQ ID NO: 45406 - DNA, 22 bp, Homo sapiens
tgaagactcagaagctaagata

SEQ ID NO: 45407 - DNA, 22 bp, Homo sapiens
ccatgtacatgaacacggcggc

SEQ ID NO: 45408 - DNA, 22 bp, Homo sapiens
gcgtccccatcatccagccgta

SEQ ID NO: 45409 - DNA, 22 bp, Homo sapiens
cagccagtgtgaccgaggagga

SEQ ID NO: 45410 - DNA, 22 bp, Homo sapiens
cttctggcgttggaggtctgag

SEQ ID NO: 45411 - DNA, 22 bp, Homo sapiens
acgggccttctcttcaggcgag

SEQ ID NO: 45412 - DNA, 22 bp, Homo sapiens
ggaactgaggaacgaactggga

SEQ ID NO: 45413 - DNA, 22 bp, Homo sapiens
aagtcagacagctgagctgcct

SEQ ID NO: 45414 - DNA, 22 bp, Homo sapiens
agaagcagaaactgggcttgtg

SEQ ID NO: 45415 - DNA, 22 bp, Homo sapiens
tagggcaatatttcccagaaaa

SEQ ID NO: 45416 - DNA, 22 bp, Homo sapiens
ttattagagtgctttgagaaag

SEQ ID NO: 45417 - DNA, 22 bp, Homo sapiens
aggaaataggaccagacaaagc

SEQ ID NO: 45418 - DNA, 22 bp, Homo sapiens
cgcgaggtggaggttgcagtga

SEQ ID NO: 45419 - DNA, 22 bp, Homo sapiens
gcgctgcgcctcctcttccgca

SEQ ID NO: 45420 - DNA, 22 bp, Homo sapiens
ggctagggatctagaccaggac

SEQ ID NO: 45421 - DNA, 22 bp, Homo sapiens
ttaggtattttgttatgtcagc

SEQ ID NO: 45422 - DNA, 22 bp, Homo sapiens
aggtgcccatgagctccatggc

SEQ ID NO: 45423 - DNA, 22 bp, Homo sapiens
gtgacaggccactgcggctctg

SEQ ID NO: 45424 - DNA, 22 bp, Homo sapiens
ctggtgtggactccgcgcggag

SEQ ID NO: 45425 - DNA, 22 bp, Homo sapiens
cactctgcagctgaagggctgg

SEQ ID NO: 45426 - DNA, 22 bp, Homo sapiens
ctcctgggaaaggctggacaca

SEQ ID NO: 45427 - DNA, 22 bp, Homo sapiens
ttgaaaagttttgaaacactct

SEQ ID NO: 45428 - DNA, 19 bp, Homo sapiens
agggagtttatatttgcac

SEQ ID NO: 45429 - DNA, 22 bp, Homo sapiens
gggtattaaaatgaaggagaaa

SEQ ID NO: 45430 - DNA, 22 bp, Homo sapiens
gcctccggagtcacagtgtctt

SEQ ID NO: 45431 - DNA, 22 bp, Homo sapiens
acagagcaatgcgtgttctcta

SEQ ID NO: 45432 - DNA, 22 bp, Homo sapiens
aggggaatgggtagactgttga

SEQ ID NO: 45433 - DNA, 22 bp, Homo sapiens
ggccgtgctccaaagtcatcgt

SEQ ID NO: 45434 - DNA, 22 bp, Homo sapiens
ctcctctttagccccagctgga

SEQ ID NO: 45435 - DNA, 22 bp, Homo sapiens
atattgaaccctacagactgta

SEQ ID NO: 45436 - DNA, 22 bp, Homo sapiens
gaatttaagaggatgaatctgt

SEQ ID NO: 45437 - DNA, 22 bp, Homo sapiens
ccctggcagtgctcctttagac

SEQ ID NO: 45438 - DNA, 22 bp, Homo sapiens
tccggtccgggtactcctctct

SEQ ID NO: 45439 - DNA, 22 bp, Homo sapiens
ggcaaggtgctacagacagtga

SEQ ID NO: 45440 - DNA, 22 bp, Homo sapiens
ctgggctcaagtgatccaccca

SEQ ID NO: 45441 - DNA, 22 bp, Homo sapiens
gagtggggggtccgtctcagtg

SEQ ID NO: 45442 - DNA, 22 bp, Homo sapiens
tcggagctgtagatgaaaccct

SEQ ID NO: 45443 - DNA, 21 bp, Homo sapiens
tggtaggtactggcttcaggc

SEQ ID NO: 45444 - DNA, 22 bp, Homo sapiens
aggactgggtgcagagggcatc

SEQ ID NO: 45445 - DNA, 22 bp, Homo sapiens
ggccagcctggggctcccagac

SEQ ID NO: 45446 - DNA, 22 bp, Homo sapiens
aaccaccattctctcctcttcc

SEQ ID NO: 45447 - DNA, 22 bp, Homo sapiens
gggtccctggaattacttgaca

SEQ ID NO: 45448 - DNA, 22 bp, Homo sapiens
tctttggatggaaattggagtc

SEQ ID NO: 45449 - DNA, 22 bp, Homo sapiens
ggggccgaccgcggttcaggcc

SEQ ID NO: 45450 - DNA, 22 bp, Homo sapiens
tggcacgacaattggcaccaat

SEQ ID NO: 45451 - DNA, 22 bp, Homo sapiens
acttcttcttcagctgggggat

SEQ ID NO: 45452 - DNA, 22 bp, Homo sapiens
ggaacagttgcgtcatgggcct

SEQ ID NO: 45453 - DNA, 22 bp, Homo sapiens
atgagttgaagctacaagaggc

SEQ ID NO: 45454 - DNA, 22 bp, Homo sapiens
gagcctcgtggcggccactgcg

SEQ ID NO: 45455 - DNA, 22 bp, Homo sapiens
ttgccgccgtctgctcgccccg

SEQ ID NO: 45456 - DNA, 22 bp, Homo sapiens
acacccaggctggcgtgcagtg

SEQ ID NO: 45457 - DNA, 22 bp, Homo sapiens
ttctgggcacacaggccctggt

SEQ ID NO: 45458 - DNA, 21 bp, Homo sapiens
ggtgtgggatggactgaacca

SEQ ID NO: 45459 - DNA, 22 bp, Homo sapiens
tttaaaaaactagtctgagtct

SEQ ID NO: 45460 - DNA, 22 bp, Homo sapiens
ggaggtgggctaaggactctct

SEQ ID NO: 45461 - DNA, 22 bp, Homo sapiens
ttacatgtttatgggggtacat

SEQ ID NO: 45462 - DNA, 22 bp, Homo sapiens
gcagctgacatctggctgggcc

SEQ ID NO: 45463 - DNA, 22 bp, Homo sapiens
acgcccagactcccatactttg

SEQ ID NO: 45464 - DNA, 22 bp, Homo sapiens
catgagataatttttctccagt

SEQ ID NO: 45465 - DNA, 22 bp, Homo sapiens
gaactttgcgcagttcccgggg

SEQ ID NO: 45466 - DNA, 20 bp, Homo sapiens
gccaacgcgctggggctgcc

SEQ ID NO: 45467 - DNA, 22 bp, Homo sapiens
gatgcgggcccgctccactgcc

SEQ ID NO: 45468 - DNA, 22 bp, Homo sapiens
tgagcctgggtggtcgaggctg

SEQ ID NO: 45469 - DNA, 22 bp, Homo sapiens
tcttgcacttcatgaatatgtt

SEQ ID NO: 45470 - DNA, 22 bp, Homo sapiens
ggatgacagatgcaggctttga

SEQ ID NO: 45471 - DNA, 21 bp, Homo sapiens
ttaaagcctccctcataagga

SEQ ID NO: 45472 - DNA, 22 bp, Homo sapiens
gcagctggaagtgacactctgt

SEQ ID NO: 45473 - DNA, 22 bp, Homo sapiens
tgccaggcgtggtggtgcgcac

SEQ ID NO: 45474 - DNA, 21 bp, Homo sapiens
gggcagaggggcctcctgggt

SEQ ID NO: 45475 - DNA, 22 bp, Homo sapiens
actcaagtcataggcttctttc

SEQ ID NO: 45476 - DNA, 20 bp, Homo sapiens
ataaaataactgccacaaga

SEQ ID NO: 45477 - DNA, 21 bp, Homo sapiens
cagggccaatcctgacctcta

SEQ ID NO: 45478 - DNA, 22 bp, Homo sapiens
cttccccaggacctctgctaaa

SEQ ID NO: 45479 - DNA, 22 bp, Homo sapiens
tgttttaagctctagaagggga

SEQ ID NO: 45480 - DNA, 22 bp, Homo sapiens
tcctgccaggagatggtagcca

SEQ ID NO: 45481 - DNA, 22 bp, Homo sapiens
cttgacactgtcactcaggcca

SEQ ID NO: 45482 - DNA, 22 bp, Homo sapiens
aagccaggttccatggaggagc

SEQ ID NO: 45483 - DNA, 22 bp, Homo sapiens
ggccaattccaggagccggcgg

SEQ ID NO: 45484 - DNA, 22 bp, Homo sapiens
agtcaaagatgaccgagttcct

SEQ ID NO: 45485 - DNA, 22 bp, Homo sapiens
tgaggcaggaggttgagaactg

SEQ ID NO: 45486 - DNA, 22 bp, Homo sapiens
tatgccactgctctccatccta

SEQ ID NO: 45487 - DNA, 22 bp, Homo sapiens
gcggcaggagtaaaggaggaag

SEQ ID NO: 45488 - DNA, 22 bp, Homo sapiens
atgttatgtctgggaaggggta

SEQ ID NO: 45489 - DNA, 22 bp, Homo sapiens
gcaaatacatgttgagcaccta

SEQ ID NO: 45490 - DNA, 22 bp, Homo sapiens
ccttctagcaaatcaacataaa

SEQ ID NO: 45491 - DNA, 22 bp, Homo sapiens
cctggggtcacttgcagccgca

SEQ ID NO: 45492 - DNA, 23 bp, Homo sapiens
atcattaacagtgcaggggtagg

SEQ ID NO: 45493 - DNA, 22 bp, Homo sapiens
cctgcagacacttgtccagcaa

SEQ ID NO: 45494 - DNA, 19 bp, Homo sapiens
ggtatatgggcctcacttg

SEQ ID NO: 45495 - DNA, 22 bp, Homo sapiens
gagtgcagtggcgtgatctctg

SEQ ID NO: 45496 - DNA, 22 bp, Homo sapiens
tggaatgcagtgggagcttacc

SEQ ID NO: 45497 - DNA, 22 bp, Homo sapiens
ctgaggcaggagagttgcttga

SEQ ID NO: 45498 - DNA, 22 bp, Homo sapiens
cagtgcacgggccagtcctgcc

SEQ ID NO: 45499 - DNA, 22 bp, Homo sapiens
ccgtggtcacctgagctccttg

SEQ ID NO: 45500 - DNA, 22 bp, Homo sapiens
tggttgcctctcagagattccg

SEQ ID NO: 45501 - DNA, 22 bp, Homo sapiens
aggaatgtgaaacaggtggctg

SEQ ID NO: 45502 - DNA, 22 bp, Homo sapiens
agttgcagacgcagagatgttg

SEQ ID NO: 45503 - DNA, 22 bp, Homo sapiens
tgacttgtctctttgggagaca

SEQ ID NO: 45504 - DNA, 22 bp, Homo sapiens
tgtcctcgtccgcctcgaactc

SEQ ID NO: 45505 - DNA, 22 bp, Homo sapiens
actggggtttaggcctgggcaa

SEQ ID NO: 45506 - DNA, 22 bp, Homo sapiens
attgcacttcagcctgggtgac

SEQ ID NO: 45507 - DNA, 22 bp, Homo sapiens
aatcagaccgttctggctgtcc

SEQ ID NO: 45508 - DNA, 22 bp, Homo sapiens
gtctcgtcaatggcaggttccc

SEQ ID NO: 45509 - DNA, 22 bp, Homo sapiens
gcaggagaacaaagcaagctgc

SEQ ID NO: 45510 - DNA, 22 bp, Homo sapiens
cttctacacgtggctgtgccaa

SEQ ID NO: 45511 - DNA, 22 bp, Homo sapiens
aggggcacgagtagagctctag

SEQ ID NO: 45512 - DNA, 22 bp, Homo sapiens
aacccacaaaggatttcagctc

SEQ ID NO: 45513 - DNA, 21 bp, Homo sapiens
ttgctgttttcccaatgcagt

SEQ ID NO: 45514 - DNA, 22 bp, Homo sapiens
tctcgtgcaggccttgctcgga

SEQ ID NO: 45515 - DNA, 22 bp, Homo sapiens
tagtgtctcttcctgtttgaaa

SEQ ID NO: 45516 - DNA, 22 bp, Homo sapiens
catctgtaaagtaggaatattg

SEQ ID NO: 45517 - DNA, 19 bp, Homo sapiens
agcggttctcaaagtcagg

SEQ ID NO: 45518 - DNA, 22 bp, Homo sapiens
ctgaatccacacaaggtgatgg

SEQ ID NO: 45519 - DNA, 22 bp, Homo sapiens
ctgtatctgtgttggatgagtt

SEQ ID NO: 45520 - DNA, 22 bp, Homo sapiens
tcttagaaattccccagtggct

SEQ ID NO: 45521 - DNA, 22 bp, Homo sapiens
gctcaggtagatggggttgtcc

SEQ ID NO: 45522 - DNA, 22 bp, Homo sapiens
cacagagatggtctggcaggtg

SEQ ID NO: 45523 - DNA, 22 bp, Homo sapiens
aagtgatgctacgactttgaca

SEQ ID NO: 45524 - DNA, 22 bp, Homo sapiens
tggttttagggaatcaatctat

SEQ ID NO: 45525 - DNA, 22 bp, Homo sapiens
agagtgtaccaaatatcctaca

SEQ ID NO: 45526 - DNA, 22 bp, Homo sapiens
ccagatgtccctctcaggtttg

SEQ ID NO: 45527 - DNA, 22 bp, Homo sapiens
cagctggtgtcaggcactgcag

SEQ ID NO: 45528 - DNA, 22 bp, Homo sapiens
ggggaaagccagccctgcttcc

SEQ ID NO: 45529 - DNA, 22 bp, Homo sapiens
gccgccgctgtgcaatttagca

SEQ ID NO: 45530 - DNA, 22 bp, Homo sapiens
cacttcattgggaccagggctg

SEQ ID NO: 45531 - DNA, 22 bp, Homo sapiens
gtctatgatattttgttatagc

SEQ ID NO: 45532 - DNA, 22 bp, Homo sapiens
gtgggggagatgcttaggtccg

SEQ ID NO: 45533 - DNA, 22 bp, Homo sapiens
aggaggaagggaagacaagtaa

SEQ ID NO: 45534 - DNA, 22 bp, Homo sapiens
aaaagcaattgcgggttttgcc

SEQ ID NO: 45535 - DNA, 21 bp, Homo sapiens
ggcaagaaacacaatcaagta

SEQ ID NO: 45536 - DNA, 22 bp, Homo sapiens
agcccaggtccagttcactgca

SEQ ID NO: 45537 - DNA, 22 bp, Homo sapiens
ttggaacatgccggggtccagg

SEQ ID NO: 45538 - DNA, 22 bp, Homo sapiens
tatgtcactcggctcggcccac

SEQ ID NO: 45539 - DNA, 22 bp, Homo sapiens
caggaacagggtgtcctggcag

SEQ ID NO: 45540 - DNA, 22 bp, Homo sapiens
gtctcttgttatcatttctgag

SEQ ID NO: 45541 - DNA, 22 bp, Homo sapiens
ggagcagggaattacagcgcag

SEQ ID NO: 45542 - DNA, 22 bp, Homo sapiens
tcctgggaggcggaggttgcag

SEQ ID NO: 45543 - DNA, 23 bp, Homo sapiens
ggctgggagctccgggtgcacgt

SEQ ID NO: 45544 - DNA, 22 bp, Homo sapiens
tgagcccagagatctgagctat

SEQ ID NO: 45545 - DNA, 22 bp, Homo sapiens
aaagtgctgggattacaggtgt

SEQ ID NO: 45546 - DNA, 22 bp, Homo sapiens
tgctagtgtgtgagatgttcaa

SEQ ID NO: 45547 - DNA, 23 bp, Homo sapiens
ccatcccttggaagctggtttta

SEQ ID NO: 45548 - DNA, 22 bp, Homo sapiens
ccctggaggttgaggctgcagt

SEQ ID NO: 45549 - DNA, 22 bp, Homo sapiens
gccagttttctgaggattaagt

SEQ ID NO: 45550 - DNA, 22 bp, Homo sapiens
gagcactgagctggaattggag

SEQ ID NO: 45551 - DNA, 19 bp, Homo sapiens
agtcctggcctgggggacc

SEQ ID NO: 45552 - DNA, 22 bp, Homo sapiens
ttatttaatgtgatctgaagag

SEQ ID NO: 45553 - DNA, 22 bp, Homo sapiens
aggtcaagggagctgagggcca

SEQ ID NO: 45554 - DNA, 22 bp, Homo sapiens
tgccctggctcttcttgttcca

SEQ ID NO: 45555 - DNA, 22 bp, Homo sapiens
aggggagagttaatgtgaatgt

SEQ ID NO: 45556 - DNA, 20 bp, Homo sapiens
tgagacccgctgacaagttc

SEQ ID NO: 45557 - DNA, 22 bp, Homo sapiens
cgagagatgggttggcaggggc

SEQ ID NO: 45558 - DNA, 22 bp, Homo sapiens
tgatcagcatcttcccagctcg

SEQ ID NO: 45559 - DNA, 22 bp, Homo sapiens
tgagaaacacaggcatgaatag

SEQ ID NO: 45560 - DNA, 22 bp, Homo sapiens
ggctcaggcctgtaatcctagc

SEQ ID NO: 45561 - DNA, 22 bp, Homo sapiens
tagactggtgaattagggggaa

SEQ ID NO: 45562 - DNA, 22 bp, Homo sapiens
gcgggttgaagggcgcatcgaa

SEQ ID NO: 45563 - DNA, 22 bp, Homo sapiens
tgagtagagaattcagctaagg

SEQ ID NO: 45564 - DNA, 22 bp, Homo sapiens
ctcactgcaacctctgcctccc

SEQ ID NO: 45565 - DNA, 22 bp, Homo sapiens
accctgctttatgccgtcctct

SEQ ID NO: 45566 - DNA, 22 bp, Homo sapiens
taagggttcagaatgcagtggt

SEQ ID NO: 45567 - DNA, 22 bp, Homo sapiens
agggaaattaatgtgagcaatg

SEQ ID NO: 45568 - DNA, 22 bp, Homo sapiens
actgtgtgtttgtctagcacag

SEQ ID NO: 45569 - DNA, 22 bp, Homo sapiens
taactaggattacaagcgtgcg

SEQ ID NO: 45570 - DNA, 19 bp, Homo sapiens
gcataaatacactattgtc

SEQ ID NO: 45571 - DNA, 22 bp, Homo sapiens
cagaggctggcggccgccccga

SEQ ID NO: 45572 - DNA, 22 bp, Homo sapiens
acggcaggctcagagctggaat

SEQ ID NO: 45573 - DNA, 22 bp, Homo sapiens
attctcaaaacataacttcact

SEQ ID NO: 45574 - DNA, 22 bp, Homo sapiens
ccaaggtgggaggattgcttga

SEQ ID NO: 45575 - DNA, 22 bp, Homo sapiens
cccaggaggtcgaagctgcagt

SEQ ID NO: 45576 - DNA, 22 bp, Homo sapiens
cccagaaggtcgaggctgcagt

SEQ ID NO: 45577 - DNA, 22 bp, Homo sapiens
ctctgctgtgccgccagggcct

SEQ ID NO: 45578 - DNA, 22 bp, Homo sapiens
ggagtgactctcggggccacta

SEQ ID NO: 45579 - DNA, 22 bp, Homo sapiens
cattaaacaaccttgaatcaat

SEQ ID NO: 45580 - DNA, 22 bp, Homo sapiens
agtggcacaattttgactcccc

SEQ ID NO: 45581 - DNA, 22 bp, Homo sapiens
tgagacaggcttccttcttggg

SEQ ID NO: 45582 - DNA, 22 bp, Homo sapiens
cagtgcagccaaggacaggcac

SEQ ID NO: 45583 - DNA, 22 bp, Homo sapiens
gctgaaggcccggaggacaggg

SEQ ID NO: 45584 - DNA, 22 bp, Homo sapiens
gccaccctggacgcactgttcg

SEQ ID NO: 45585 - DNA, 22 bp, Homo sapiens
ctgggcagctgtatcagggagt

SEQ ID NO: 45586 - DNA, 22 bp, Homo sapiens
gtggcgtgatctcggctcactg

SEQ ID NO: 45587 - DNA, 22 bp, Homo sapiens
ctgaggagaggtggcctgtgtt

SEQ ID NO: 45588 - DNA, 22 bp, Homo sapiens
ggttgtagttggaggttgtata

SEQ ID NO: 45589 - DNA, 22 bp, Homo sapiens
cccagcaggaggaggttgcagt

SEQ ID NO: 45590 - DNA, 22 bp, Homo sapiens
cagtggccaacttcctgcctct

SEQ ID NO: 45591 - DNA, 22 bp, Homo sapiens
aggattgtgcctccagtcagaa

SEQ ID NO: 45592 - DNA, 22 bp, Homo sapiens
gctgggctgcgtcggggaagcc

SEQ ID NO: 45593 - DNA, 22 bp, Homo sapiens
tcctcagaatcacctggcagct

SEQ ID NO: 45594 - DNA, 22 bp, Homo sapiens
ttctcccatctcagtcttacat

SEQ ID NO: 45595 - DNA, 22 bp, Homo sapiens
cgagcatgatgacggctgtggc

SEQ ID NO: 45596 - DNA, 22 bp, Homo sapiens
tcgaaggaggcactcagacatg

SEQ ID NO: 45597 - DNA, 22 bp, Homo sapiens
agcagcttgaggctggattcca

SEQ ID NO: 45598 - DNA, 22 bp, Homo sapiens
tagtttcatctccaccctgccc

SEQ ID NO: 45599 - DNA, 18 bp, Homo sapiens
gaaagatgaacttttttc

SEQ ID NO: 45600 - DNA, 22 bp, Homo sapiens
ggggtgggcgtgcagggacacc

SEQ ID NO: 45601 - DNA, 21 bp, Homo sapiens
gctgctcgagatccagtgctt

SEQ ID NO: 45602 - DNA, 22 bp, Homo sapiens
tgggaagaggagcactggaatg

SEQ ID NO: 45603 - DNA, 22 bp, Homo sapiens
atacataattacttccgatgtt

SEQ ID NO: 45604 - DNA, 22 bp, Homo sapiens
tattgagaccagtgcttgctta

SEQ ID NO: 45605 - DNA, 22 bp, Homo sapiens
tcccggcgctgggaggtgggtc

SEQ ID NO: 45606 - DNA, 22 bp, Homo sapiens
tggagggcatgctgtccatggg

SEQ ID NO: 45607 - DNA, 22 bp, Homo sapiens
aactagaaaaagactttctgag

SEQ ID NO: 45608 - DNA, 22 bp, Homo sapiens
tggcacagactgggccaaggaa

SEQ ID NO: 45609 - DNA, 22 bp, Homo sapiens
gaggcagaggttgcagtgagct

SEQ ID NO: 45610 - DNA, 22 bp, Homo sapiens
tcacattttcaaaagctggtgc

SEQ ID NO: 45611 - DNA, 22 bp, Homo sapiens
ggtagtcggccttgccctgggc

SEQ ID NO: 45612 - DNA, 22 bp, Homo sapiens
caggtgtcggtcaggcggtttt

SEQ ID NO: 45613 - DNA, 22 bp, Homo sapiens
tgaccctgagagctgaatggct

SEQ ID NO: 45614 - DNA, 22 bp, Homo sapiens
cggctggtgtcgggcacagcaa

SEQ ID NO: 45615 - DNA, 22 bp, Homo sapiens
tgtgtcattgccatgaaaaggc

SEQ ID NO: 45616 - DNA, 22 bp, Homo sapiens
acccacgaagatgagcggcatg

SEQ ID NO: 45617 - DNA, 22 bp, Homo sapiens
gcaaaagtacagccggatttct

SEQ ID NO: 45618 - DNA, 22 bp, Homo sapiens
gcaggtggatcacctgaggtca

SEQ ID NO: 45619 - DNA, 14 bp, Homo sapiens
gcaggcagatcacc

SEQ ID NO: 45620 - DNA, 22 bp, Homo sapiens
accatgttggccaagctggtct

SEQ ID NO: 45621 - DNA, 22 bp, Homo sapiens
gggccagtgaacaatgagggaa

SEQ ID NO: 45622 - DNA, 22 bp, Homo sapiens
gtttacttgtgccttggcttaa

SEQ ID NO: 45623 - DNA, 22 bp, Homo sapiens
ctgaggcaggatggcctggctg

SEQ ID NO: 45624 - DNA, 22 bp, Homo sapiens
agaggaggctctgggatcgtcc

SEQ ID NO: 45625 - DNA, 22 bp, Homo sapiens
gtggagagagataagcctggtc

SEQ ID NO: 45626 - DNA, 22 bp, Homo sapiens
agcaacctgccagtcactcagt

SEQ ID NO: 45627 - DNA, 22 bp, Homo sapiens
gggagaagaatgtgtcaattgt

SEQ ID NO: 45628 - DNA, 22 bp, Homo sapiens
tgggcaggggccctgcttccgt

SEQ ID NO: 45629 - DNA, 22 bp, Homo sapiens
tccgggttttacactcacatca

SEQ ID NO: 45630 - DNA, 22 bp, Homo sapiens
gcctgcagggcctgggcctacc

SEQ ID NO: 45631 - DNA, 22 bp, Homo sapiens
gaaagagaacctgggcctagat

SEQ ID NO: 45632 - DNA, 21 bp, Homo sapiens
ttagaagctaatgcagctggt

SEQ ID NO: 45633 - DNA, 22 bp, Homo sapiens
tctgtcttagccatctcaggct

SEQ ID NO: 45634 - DNA, 22 bp, Homo sapiens
aaagaaggtagggctggtgact

SEQ ID NO: 45635 - DNA, 22 bp, Homo sapiens
ggctttgacatgctgaattaaa

SEQ ID NO: 45636 - DNA, 22 bp, Homo sapiens
acagcagagcctggtacttact

SEQ ID NO: 45637 - DNA, 22 bp, Homo sapiens
atgaagtggttctattggtttt

SEQ ID NO: 45638 - DNA, 18 bp, Homo sapiens
ccctcttgcacaaagcaa

SEQ ID NO: 45639 - DNA, 22 bp, Homo sapiens
cccaggaggtggagcttgcagt

SEQ ID NO: 45640 - DNA, 22 bp, Homo sapiens
agctacctgatccttcttctga

SEQ ID NO: 45641 - DNA, 22 bp, Homo sapiens
gggtgctttggctcacgcctgt

SEQ ID NO: 45642 - DNA, 22 bp, Homo sapiens
gagcaggaaggccagaagggtc

SEQ ID NO: 45643 - DNA, 22 bp, Homo sapiens
atatattttttgagacagagtc

SEQ ID NO: 45644 - DNA, 22 bp, Homo sapiens
tgctttgtgacagattagtttt

SEQ ID NO: 45645 - DNA, 22 bp, Homo sapiens
ggcatcttgttgctcaaatcta

SEQ ID NO: 45646 - DNA, 22 bp, Homo sapiens
tgtgttcagaatttgctgcttt

SEQ ID NO: 45647 - DNA, 22 bp, Homo sapiens
ctcactgcaagctccacctctt

SEQ ID NO: 45648 - DNA, 22 bp, Homo sapiens
agcggcgccgagcttggccagg

SEQ ID NO: 45649 - DNA, 22 bp, Homo sapiens
ggactgggaatcagggagatgc

SEQ ID NO: 45650 - DNA, 22 bp, Homo sapiens
ctcattgcaacctccgcctccc

SEQ ID NO: 45651 - DNA, 22 bp, Homo sapiens
acatcatttgtctgtagctgaa

SEQ ID NO: 45652 - DNA, 18 bp, Homo sapiens
tcctttctccctcatctt

SEQ ID NO: 45653 - DNA, 18 bp, Homo sapiens
ccctgccagctcccagca

SEQ ID NO: 45654 - DNA, 22 bp, Homo sapiens
tggtggctaccaggtcctgggg

SEQ ID NO: 45655 - DNA, 22 bp, Homo sapiens
ggcccagacccaagagtggtgg

SEQ ID NO: 45656 - DNA, 23 bp, Homo sapiens
ggaagctcacgtagtcctgcact

SEQ ID NO: 45657 - DNA, 22 bp, Homo sapiens
cgtgccactgcactccagtctg

SEQ ID NO: 45658 - DNA, 22 bp, Homo sapiens
tcattgagttgcacttttacta

SEQ ID NO: 45659 - DNA, 22 bp, Homo sapiens
ccactgtggaaagcagttcaga

SEQ ID NO: 45660 - DNA, 22 bp, Homo sapiens
gattgagtctgaggatgctgca

SEQ ID NO: 45661 - DNA, 19 bp, Homo sapiens
gttggcactgaaaatggct

SEQ ID NO: 45662 - DNA, 22 bp, Homo sapiens
tgagactcagcacttgtgtgtc

SEQ ID NO: 45663 - DNA, 22 bp, Homo sapiens
tttctcggcagagatgatgggc

SEQ ID NO: 45664 - DNA, 22 bp, Homo sapiens
ggagagcttggagtgcgatttt

SEQ ID NO: 45665 - DNA, 22 bp, Homo sapiens
cttaatctcacctgcaaagtcc

SEQ ID NO: 45666 - DNA, 22 bp, Homo sapiens
acctcctccaaggagccatagg

SEQ ID NO: 45667 - DNA, 22 bp, Homo sapiens
ctccaggctcgtccaagatcga

SEQ ID NO: 45668 - DNA, 22 bp, Homo sapiens
ttacatgtttatgtggtacatg

SEQ ID NO: 45669 - DNA, 18 bp, Homo sapiens
ggcgggtgttttattcac

SEQ ID NO: 45670 - DNA, 22 bp, Homo sapiens
tgtctgatcatgaggcagggct

SEQ ID NO: 45671 - DNA, 22 bp, Homo sapiens
gaccctctagatggaagcactg

SEQ ID NO: 45672 - DNA, 22 bp, Homo sapiens
catgctgtgtgttttagctcca

SEQ ID NO: 45673 - DNA, 22 bp, Homo sapiens
cagtcctgaatactggacggtg

SEQ ID NO: 45674 - DNA, 22 bp, Homo sapiens
tcctccccaaagcccagcctgg

SEQ ID NO: 45675 - DNA, 22 bp, Homo sapiens
ttcatagtgtttccttccagtg

SEQ ID NO: 45676 - DNA, 22 bp, Homo sapiens
cctcagacccctgctgagcttc

SEQ ID NO: 45677 - DNA, 23 bp, Homo sapiens
atgacactcctgtgcgcaccctg

SEQ ID NO: 45678 - DNA, 22 bp, Homo sapiens
cccttggggtggaggttgcagt

SEQ ID NO: 45679 - DNA, 22 bp, Homo sapiens
tagtggatgttcagagatttga

SEQ ID NO: 45680 - DNA, 22 bp, Homo sapiens
gtcctgacggctgattggcctg

SEQ ID NO: 45681 - DNA, 22 bp, Homo sapiens
ctcagcactttggaaggctgat

SEQ ID NO: 45682 - DNA, 22 bp, Homo sapiens
agcctgggccctgcctcttctc

SEQ ID NO: 45683 - DNA, 22 bp, Homo sapiens
caggagttcaaggttgcagtga

SEQ ID NO: 45684 - DNA, 22 bp, Homo sapiens
tcaggcagtagaattgcttgaa

SEQ ID NO: 45685 - DNA, 22 bp, Homo sapiens
gggctgcactagggcaaggtga

SEQ ID NO: 45686 - DNA, 22 bp, Homo sapiens
attgcactccggcctgggtgac

SEQ ID NO: 45687 - DNA, 22 bp, Homo sapiens
tgcacgtgggctctctgctctt

SEQ ID NO: 45688 - DNA, 22 bp, Homo sapiens
ttacaaagtttaaggtggcact

SEQ ID NO: 45689 - DNA, 22 bp, Homo sapiens
catgcctgtaatcccagcactt

SEQ ID NO: 45690 - DNA, 22 bp, Homo sapiens
agagaagagtcttgtcaaatta

SEQ ID NO: 45691 - DNA, 22 bp, Homo sapiens
cgggcagtgtggctccagagtc

SEQ ID NO: 45692 - DNA, 22 bp, Homo sapiens
accagcacttccagaggtcagg

SEQ ID NO: 45693 - DNA, 23 bp, Homo sapiens
attttttgtctttgtaactagat

SEQ ID NO: 45694 - DNA, 22 bp, Homo sapiens
ggggcattgtgtctgggttcct

SEQ ID NO: 45695 - DNA, 22 bp, Homo sapiens
agaggccgggtgcctgctcaga

SEQ ID NO: 45696 - DNA, 22 bp, Homo sapiens
gtgggcggggcctctcaagctg

SEQ ID NO: 45697 - DNA, 22 bp, Homo sapiens
cctgaggatgccagcatgggtg

SEQ ID NO: 45698 - DNA, 19 bp, Homo sapiens
gggcttggggctgaagcct

SEQ ID NO: 45699 - DNA, 22 bp, Homo sapiens
tctaattttggcattttaacct

SEQ ID NO: 45700 - DNA, 22 bp, Homo sapiens
ctgggaggcggaggttgcagtg

SEQ ID NO: 45701 - DNA, 22 bp, Homo sapiens
tcaccttgtgatctccctgcct

SEQ ID NO: 45702 - DNA, 22 bp, Homo sapiens
tctctatttgcctaggcttgtg

SEQ ID NO: 45703 - DNA, 22 bp, Homo sapiens
ctgagccaaggggacagtgaca

SEQ ID NO: 45704 - DNA, 22 bp, Homo sapiens
ccgaggtcctggacttggccct

SEQ ID NO: 45705 - DNA, 22 bp, Homo sapiens
taagtcttcatagtctaatgtc

SEQ ID NO: 45706 - DNA, 22 bp, Homo sapiens
tcgcttgaacccaggaagtgga

SEQ ID NO: 45707 - DNA, 20 bp, Homo sapiens
agcggctggcggaggacacg

SEQ ID NO: 45708 - DNA, 22 bp, Homo sapiens
caatttctaacattccatggat

SEQ ID NO: 45709 - DNA, 22 bp, Homo sapiens
tcttgggggactttggcatgga

SEQ ID NO: 45710 - DNA, 22 bp, Homo sapiens
tgcagaaacaagccatcattca

SEQ ID NO: 45711 - DNA, 22 bp, Homo sapiens
caagtctgacctctgggtgaag

SEQ ID NO: 45712 - DNA, 22 bp, Homo sapiens
gtgtcaggccctgcattatgtg

SEQ ID NO: 45713 - DNA, 22 bp, Homo sapiens
tgtgtgattgcaggagatgtgg

SEQ ID NO: 45714 - DNA, 22 bp, Homo sapiens
cttgtgcatttcattcctcagg

SEQ ID NO: 45715 - DNA, 17 bp, Homo sapiens
caggtgttctgtttttc

SEQ ID NO: 45716 - DNA, 22 bp, Homo sapiens
tttcaccatcttggccaggctg

SEQ ID NO: 45717 - DNA, 22 bp, Homo sapiens
tggtgctgccaggctcctgcca

SEQ ID NO: 45718 - DNA, 22 bp, Homo sapiens
atgaggtgggagaatcacttga

SEQ ID NO: 45719 - DNA, 19 bp, Homo sapiens
gttttgcaggcagagggga

SEQ ID NO: 45720 - DNA, 22 bp, Homo sapiens
aactctatttaccctactaaac

SEQ ID NO: 45721 - DNA, 22 bp, Homo sapiens
attgtgtcctcattgaccttca

SEQ ID NO: 45722 - DNA, 22 bp, Homo sapiens
tgtctcatctcttaaccccact

SEQ ID NO: 45723 - DNA, 22 bp, Homo sapiens
aactgaggtatctgctgtgttt

SEQ ID NO: 45724 - DNA, 22 bp, Homo sapiens
acagtatagggcttatattgta

SEQ ID NO: 45725 - DNA, 22 bp, Homo sapiens
aggagccagtggagttcctgcc

SEQ ID NO: 45726 - DNA, 22 bp, Homo sapiens
ggggaccctcaggactgcgtct

SEQ ID NO: 45727 - DNA, 22 bp, Homo sapiens
aaggatgattggtaatgacact

SEQ ID NO: 45728 - DNA, 22 bp, Homo sapiens
tgagagcaacacgcagtagtat

SEQ ID NO: 45729 - DNA, 22 bp, Homo sapiens
ccctggaggcggagcttgcagt

SEQ ID NO: 45730 - DNA, 22 bp, Homo sapiens
gcagtatctatgtgatgggttg

SEQ ID NO: 45731 - DNA, 22 bp, Homo sapiens
tactaattgttcacacttgttt

SEQ ID NO: 45732 - DNA, 22 bp, Homo sapiens
gaagccagtgtttgaagaattt

SEQ ID NO: 45733 - DNA, 22 bp, Homo sapiens
tggagaattctatgttgagggg

SEQ ID NO: 45734 - DNA, 22 bp, Homo sapiens
aggtcacgtcctgtgatgtcat

SEQ ID NO: 45735 - DNA, 22 bp, Homo sapiens
caaccccactacacgttggaga

SEQ ID NO: 45736 - DNA, 23 bp, Homo sapiens
tcatcttcctcatttctccaggg

SEQ ID NO: 45737 - DNA, 22 bp, Homo sapiens
tgagggaatattgatagatccg

SEQ ID NO: 45738 - DNA, 22 bp, Homo sapiens
tgtatatacacactcccatgtt

SEQ ID NO: 45739 - DNA, 22 bp, Homo sapiens
cactctcagcataatgaatgtg

SEQ ID NO: 45740 - DNA, 22 bp, Homo sapiens
gttacagtcaggagatattttg

SEQ ID NO: 45741 - DNA, 22 bp, Homo sapiens
gggcggatcacctgaggtcagg

SEQ ID NO: 45742 - DNA, 22 bp, Homo sapiens
tgagatcattgacttgttcctg

SEQ ID NO: 45743 - DNA, 22 bp, Homo sapiens
tctctcttttttgaacccgctc

SEQ ID NO: 45744 - DNA, 22 bp, Homo sapiens
cagaagactgcagggaagggac

SEQ ID NO: 45745 - DNA, 22 bp, Homo sapiens
aggccctattcaatggggccca

SEQ ID NO: 45746 - DNA, 22 bp, Homo sapiens
tccctagtcgcatctgtggaga

SEQ ID NO: 45747 - DNA, 22 bp, Homo sapiens
tcaatcacgtgttccatgttct

SEQ ID NO: 45748 - DNA, 22 bp, Homo sapiens
ttgcactccagcccgagcaaca

SEQ ID NO: 45749 - DNA, 22 bp, Homo sapiens
ccactgtgcccagcctcatggg

SEQ ID NO: 45750 - DNA, 22 bp, Homo sapiens
catggcagctcctccagtgtga

SEQ ID NO: 45751 - DNA, 22 bp, Homo sapiens
ctggaggtgcttcgctggccac

SEQ ID NO: 45752 - DNA, 22 bp, Homo sapiens
ttctgcagtgttaacaatgtca

SEQ ID NO: 45753 - DNA, 22 bp, Homo sapiens
tataaagagtctcaaagaagtt

SEQ ID NO: 45754 - DNA, 22 bp, Homo sapiens
gggctgagacgatggggtcttc

SEQ ID NO: 45755 - DNA, 22 bp, Homo sapiens
tgtgggtggcatcgtcctggcc

SEQ ID NO: 45756 - DNA, 22 bp, Homo sapiens
gtgagaaatgacaaatgtgtcg

SEQ ID NO: 45757 - DNA, 22 bp, Homo sapiens
cgctgcagaagcgtgttcagga

SEQ ID NO: 45758 - DNA, 22 bp, Homo sapiens
gtcttgtcccagctctgccact

SEQ ID NO: 45759 - DNA, 22 bp, Homo sapiens
agtcacagggggcccctgcaac

SEQ ID NO: 45760 - DNA, 22 bp, Homo sapiens
agagtggctctgctgggcacag

SEQ ID NO: 45761 - DNA, 22 bp, Homo sapiens
ctgcattgatcaggcagaatct

SEQ ID NO: 45762 - DNA, 22 bp, Homo sapiens
gtcatggtgctagcgggaatgt

SEQ ID NO: 45763 - DNA, 22 bp, Homo sapiens
cccaggaggcctgcctggccgg

SEQ ID NO: 45764 - DNA, 22 bp, Homo sapiens
gagtcgagcagaaagccgtcgg

SEQ ID NO: 45765 - DNA, 22 bp, Homo sapiens
aggctgagataggtggatcatt

SEQ ID NO: 45766 - DNA, 22 bp, Homo sapiens
atcatgttttaattagcaaact

SEQ ID NO: 45767 - DNA, 22 bp, Homo sapiens
cggctgggttcggctgcaggcc

SEQ ID NO: 45768 - DNA, 22 bp, Homo sapiens
ttgtcgggcttacgcagggcca

SEQ ID NO: 45769 - DNA, 22 bp, Homo sapiens
gaatgcagatggctggtgtatg

SEQ ID NO: 45770 - DNA, 22 bp, Homo sapiens
ctgtggctctttagttgagcac

SEQ ID NO: 45771 - DNA, 22 bp, Homo sapiens
ggtcagaggtcccagaagaagc

SEQ ID NO: 45772 - DNA, 22 bp, Homo sapiens
ctgaggtgtgaaatggtggcaa

SEQ ID NO: 45773 - DNA, 22 bp, Homo sapiens
taccagggaacagggatattaa

SEQ ID NO: 45774 - DNA, 22 bp, Homo sapiens
ccgggcgggggctctcgtcacc

SEQ ID NO: 45775 - DNA, 22 bp, Homo sapiens
agtgttgtcaaacggctcagca

SEQ ID NO: 45776 - DNA, 20 bp, Homo sapiens
cttctggctggtcaaggact

SEQ ID NO: 45777 - DNA, 22 bp, Homo sapiens
gaggggagcccccatcctccag

SEQ ID NO: 45778 - DNA, 22 bp, Homo sapiens
acaaacagagttgaaaaatagg

SEQ ID NO: 45779 - DNA, 22 bp, Homo sapiens
cagagctgtccaaaccctgaca

SEQ ID NO: 45780 - DNA, 22 bp, Homo sapiens
tattcatagtaaacaaaagtgg

SEQ ID NO: 45781 - DNA, 22 bp, Homo sapiens
tcatctaagagtcttacattta

SEQ ID NO: 45782 - DNA, 22 bp, Homo sapiens
tgatgaccgccaacgtttaggt

SEQ ID NO: 45783 - DNA, 22 bp, Homo sapiens
tccagcttataggtagatttaa

SEQ ID NO: 45784 - DNA, 22 bp, Homo sapiens
aaactgctttccacagtggcta

SEQ ID NO: 45785 - DNA, 22 bp, Homo sapiens
agaggcaggaggttgacttgag

SEQ ID NO: 45786 - DNA, 23 bp, Homo sapiens
cagagctggctcagagctgcctg

SEQ ID NO: 45787 - DNA, 22 bp, Homo sapiens
ttcttctccgaggagggctggt

SEQ ID NO: 45788 - DNA, 22 bp, Homo sapiens
caggcagaagaagtggaaggac

SEQ ID NO: 45789 - DNA, 22 bp, Homo sapiens
cagcgtgggatttggaaaccag

SEQ ID NO: 45790 - DNA, 22 bp, Homo sapiens
ttgtccgtggtgagttcgcatt

SEQ ID NO: 45791 - DNA, 22 bp, Homo sapiens
tctggagataagcagcaatgaa

SEQ ID NO: 45792 - DNA, 22 bp, Homo sapiens
tcgagctctggagccaaggatg

SEQ ID NO: 45793 - DNA, 22 bp, Homo sapiens
gtagtcccagctaccccggagg

SEQ ID NO: 45794 - DNA, 22 bp, Homo sapiens
acatatgcgatcataggatgca

SEQ ID NO: 45795 - DNA, 22 bp, Homo sapiens
tagtcccggaactccttcaggt

SEQ ID NO: 45796 - DNA, 22 bp, Homo sapiens
agagtgcaaccgaaacaagcag

SEQ ID NO: 45797 - DNA, 22 bp, Homo sapiens
tacttttcctggaaccactgct

SEQ ID NO: 45798 - DNA, 22 bp, Homo sapiens
acccagtgttgggcagaactgt

SEQ ID NO: 45799 - DNA, 22 bp, Homo sapiens
atggatttgcttatacacatgt

SEQ ID NO: 45800 - DNA, 23 bp, Homo sapiens
aggttatgattatagagcgagga

SEQ ID NO: 45801 - DNA, 22 bp, Homo sapiens
tggaagactcaaggtggtgaat

SEQ ID NO: 45802 - DNA, 22 bp, Homo sapiens
ttcagcttgctgactgcggcag

SEQ ID NO: 45803 - DNA, 22 bp, Homo sapiens
agcatggccatctgggccgtcc

SEQ ID NO: 45804 - DNA, 22 bp, Homo sapiens
tttgctattgtgaatagtgcca

SEQ ID NO: 45805 - DNA, 18 bp, Homo sapiens
tcaaatactttgggcagt

SEQ ID NO: 45806 - DNA, 16 bp, Homo sapiens
tggggatggggaagag

SEQ ID NO: 45807 - DNA, 21 bp, Homo sapiens
taaacataaccttgtatggct

SEQ ID NO: 45808 - DNA, 22 bp, Homo sapiens
gttgctcaggcaggagtacagt

SEQ ID NO: 45809 - DNA, 22 bp, Homo sapiens
cggggttcatccatgctgtggc

SEQ ID NO: 45810 - DNA, 22 bp, Homo sapiens
gtggagggtgattgccggctgt

SEQ ID NO: 45811 - DNA, 22 bp, Homo sapiens
cttctcggggttcccgcgccct

SEQ ID NO: 45812 - DNA, 22 bp, Homo sapiens
tgtgtcagaaggcaatggggat

SEQ ID NO: 45813 - DNA, 22 bp, Homo sapiens
ctccagattccgtttattcagg

SEQ ID NO: 45814 - DNA, 22 bp, Homo sapiens
tcactgcactccagcactcagg

SEQ ID NO: 45815 - DNA, 22 bp, Homo sapiens
ttgagcaggatggctatgcaca

SEQ ID NO: 45816 - DNA, 19 bp, Homo sapiens
ggagtttccaatgggtaaa

SEQ ID NO: 45817 - DNA, 22 bp, Homo sapiens
caaaatgcatctgagaccaggc

SEQ ID NO: 45818 - DNA, 22 bp, Homo sapiens
tagccgggtgtggtggaactcc

SEQ ID NO: 45819 - DNA, 22 bp, Homo sapiens
gggcaccttgggtctcaggcaa

SEQ ID NO: 45820 - DNA, 22 bp, Homo sapiens
tagattcagatatttaggacaa

SEQ ID NO: 45821 - DNA, 22 bp, Homo sapiens
catctgctgttccttggactca

SEQ ID NO: 45822 - DNA, 22 bp, Homo sapiens
agctgaacgtgcttctgcagca

SEQ ID NO: 45823 - DNA, 19 bp, Homo sapiens
gctgaggtggaggaaggag

SEQ ID NO: 45824 - DNA, 22 bp, Homo sapiens
aggcactgtgcagtcccaagca

SEQ ID NO: 45825 - DNA, 22 bp, Homo sapiens
gaggtaggtgtaggaggcctgc

SEQ ID NO: 45826 - DNA, 21 bp, Homo sapiens
ccagagcctgagaggattatg

SEQ ID NO: 45827 - DNA, 22 bp, Homo sapiens
cactccagcctcagtgacagag

SEQ ID NO: 45828 - DNA, 22 bp, Homo sapiens
gctccgtgggcattgctaggtg

SEQ ID NO: 45829 - DNA, 22 bp, Homo sapiens
ttgtggaactcatctgcctggt

SEQ ID NO: 45830 - DNA, 22 bp, Homo sapiens
ggccagaagttggaaaagagcc

SEQ ID NO: 45831 - DNA, 22 bp, Homo sapiens
attctggacaaggcaagctcct

SEQ ID NO: 45832 - DNA, 22 bp, Homo sapiens
aagagggaaattgttggctgct

SEQ ID NO: 45833 - DNA, 22 bp, Homo sapiens
tttttgggtccaggctgtatct

SEQ ID NO: 45834 - DNA, 22 bp, Homo sapiens
agaaaatttaaagagacacaca

SEQ ID NO: 45835 - DNA, 22 bp, Homo sapiens
aagcctggcacattggagtctg

SEQ ID NO: 45836 - DNA, 22 bp, Homo sapiens
tctgctcagccgatctgctccg

SEQ ID NO: 45837 - DNA, 22 bp, Homo sapiens
acgcctctgcagctgccgggcc

SEQ ID NO: 45838 - DNA, 22 bp, Homo sapiens
tttaatgtagcgtgaaatgatt

SEQ ID NO: 45839 - DNA, 22 bp, Homo sapiens
ctctggactttttgtggattct

SEQ ID NO: 45840 - DNA, 22 bp, Homo sapiens
ttgtgggggctgccctgtacgg

SEQ ID NO: 45841 - DNA, 22 bp, Homo sapiens
gaagagtggttatccctgctgt

SEQ ID NO: 45842 - DNA, 22 bp, Homo sapiens
cactgcactccagcccgggcaa

SEQ ID NO: 45843 - DNA, 22 bp, Homo sapiens
gagatggagtctttttctgtca

SEQ ID NO: 45844 - DNA, 22 bp, Homo sapiens
cctctgtgtgatgcgcaaagta

SEQ ID NO: 45845 - DNA, 22 bp, Homo sapiens
aggccacggcgggtggattact

SEQ ID NO: 45846 - DNA, 22 bp, Homo sapiens
tgtccagcttttcccaccaagt

SEQ ID NO: 45847 - DNA, 22 bp, Homo sapiens
gaggtgggtgtatcacaggtca

SEQ ID NO: 45848 - DNA, 22 bp, Homo sapiens
tgatctcctgaccttgtaatcc

SEQ ID NO: 45849 - DNA, 22 bp, Homo sapiens
gacccttagaatgtgatcttat

SEQ ID NO: 45850 - DNA, 22 bp, Homo sapiens
tatttaataaaactatggcatg

SEQ ID NO: 45851 - DNA, 22 bp, Homo sapiens
taacatttaaatttttcacata

SEQ ID NO: 45852 - DNA, 22 bp, Homo sapiens
agtggcgtcctaggaaaggagg

SEQ ID NO: 45853 - DNA, 22 bp, Homo sapiens
tatgaagtctctgatgttgagt

SEQ ID NO: 45854 - DNA, 22 bp, Homo sapiens
gtctcccagcctacatctttct

SEQ ID NO: 45855 - DNA, 22 bp, Homo sapiens
ggatggtgacggcggcccgctt

SEQ ID NO: 45856 - DNA, 22 bp, Homo sapiens
tagcccctgcctttgaacctgg

SEQ ID NO: 45857 - DNA, 22 bp, Homo sapiens
gctgtggcctggcgcagagctg

SEQ ID NO: 45858 - DNA, 22 bp, Homo sapiens
gcccttggcctctttggcccgg

SEQ ID NO: 45859 - DNA, 22 bp, Homo sapiens
cctacggaggacaggttagcca

SEQ ID NO: 45860 - DNA, 21 bp, Homo sapiens
aaactgaccttgcctgagaca

SEQ ID NO: 45861 - DNA, 22 bp, Homo sapiens
cactgcactccagcctcggtga

SEQ ID NO: 45862 - DNA, 22 bp, Homo sapiens
cccaactactctcaggcagctt

SEQ ID NO: 45863 - DNA, 22 bp, Homo sapiens
gggcactcagctgtagagcagg

SEQ ID NO: 45864 - DNA, 22 bp, Homo sapiens
tttctaatctgattctcctacc

SEQ ID NO: 45865 - DNA, 22 bp, Homo sapiens
caggccagggttgagaagagaa

SEQ ID NO: 45866 - DNA, 22 bp, Homo sapiens
tggggacttgccttgttgctca

SEQ ID NO: 45867 - DNA, 22 bp, Homo sapiens
ctgcaagctacccctagcatca

SEQ ID NO: 45868 - DNA, 22 bp, Homo sapiens
taggtttaggagtgaaggtgaa

SEQ ID NO: 45869 - DNA, 22 bp, Homo sapiens
gagagcaggaggcagcgggacg

SEQ ID NO: 45870 - DNA, 22 bp, Homo sapiens
gacctcatgatccacctgcctt

SEQ ID NO: 45871 - DNA, 22 bp, Homo sapiens
tttgcttcacaagtatggttct

SEQ ID NO: 45872 - DNA, 22 bp, Homo sapiens
ccgcggggcgtgggctcttacc

SEQ ID NO: 45873 - DNA, 22 bp, Homo sapiens
gtgctgacaggagcctggcggt

SEQ ID NO: 45874 - DNA, 22 bp, Homo sapiens
tccagctgaggtggcctctgtg

SEQ ID NO: 45875 - DNA, 22 bp, Homo sapiens
gacctccgtgtacacctcccag

SEQ ID NO: 45876 - DNA, 22 bp, Homo sapiens
agatcggctttgcagacctcat

SEQ ID NO: 45877 - DNA, 22 bp, Homo sapiens
gatgggcgtggcgcgtttggtg

SEQ ID NO: 45878 - DNA, 22 bp, Homo sapiens
ggggtcggggcatagccactta

SEQ ID NO: 45879 - DNA, 22 bp, Homo sapiens
agatgtgtttctagttcctgca

SEQ ID NO: 45880 - DNA, 22 bp, Homo sapiens
cctgggggccaggaaggtgtga

SEQ ID NO: 45881 - DNA, 22 bp, Homo sapiens
gattcactcatattttacgttt

SEQ ID NO: 45882 - DNA, 22 bp, Homo sapiens
gccccaagtccctatgtttcca

SEQ ID NO: 45883 - DNA, 22 bp, Homo sapiens
tcaccggcagacgtggcctgat

SEQ ID NO: 45884 - DNA, 22 bp, Homo sapiens
acttttaaatgagtttcagttg

SEQ ID NO: 45885 - DNA, 22 bp, Homo sapiens
agttattgagtgcagagcaggg

SEQ ID NO: 45886 - DNA, 22 bp, Homo sapiens
gggaaactttcacaatgtccag

SEQ ID NO: 45887 - DNA, 22 bp, Homo sapiens
cccaggggttctgagcagcagc

SEQ ID NO: 45888 - DNA, 22 bp, Homo sapiens
gagctcattcattcattgcctg

SEQ ID NO: 45889 - DNA, 22 bp, Homo sapiens
cagccccatggtgtgctccagc

SEQ ID NO: 45890 - DNA, 22 bp, Homo sapiens
gcctgtcccgcaccggagcccg

SEQ ID NO: 45891 - DNA, 22 bp, Homo sapiens
tctgcgttgctcacgctgggag

SEQ ID NO: 45892 - DNA, 22 bp, Homo sapiens
aaagcagaggttgcagtgagct

SEQ ID NO: 45893 - DNA, 22 bp, Homo sapiens
gccctcctgagctagcacgtgt

SEQ ID NO: 45894 - DNA, 22 bp, Homo sapiens
tcgcaccattgcactccagcca

SEQ ID NO: 45895 - DNA, 22 bp, Homo sapiens
aacactctctgttggtaaggct

SEQ ID NO: 45896 - DNA, 22 bp, Homo sapiens
ttctcatgaaactcgcttcctc

SEQ ID NO: 45897 - DNA, 22 bp, Homo sapiens
tgtccccacctaaatcttatct

SEQ ID NO: 45898 - DNA, 22 bp, Homo sapiens
ggtgggagagcttgctttgatg

SEQ ID NO: 45899 - DNA, 22 bp, Homo sapiens
ctgcactgagcatctaacctta

SEQ ID NO: 45900 - DNA, 22 bp, Homo sapiens
ctctggaggtggaggttgcagt

SEQ ID NO: 45901 - DNA, 22 bp, Homo sapiens
gtggttgtttccaggtttgaaa

SEQ ID NO: 45902 - DNA, 22 bp, Homo sapiens
tgaagttgttaaggttgccatt

SEQ ID NO: 45903 - DNA, 22 bp, Homo sapiens
atggaaggctttatgactcaaa

SEQ ID NO: 45904 - DNA, 22 bp, Homo sapiens
gctgcagggagctggaaggctc

SEQ ID NO: 45905 - DNA, 22 bp, Homo sapiens
acccgggaggcaggagtcatag

SEQ ID NO: 45906 - DNA, 22 bp, Homo sapiens
ggaactcctgctccaagcagct

SEQ ID NO: 45907 - DNA, 22 bp, Homo sapiens
tggttcctcaagcgctggcggc

SEQ ID NO: 45908 - DNA, 21 bp, Homo sapiens
ttgatggtgggtgatgctctg

SEQ ID NO: 45909 - DNA, 22 bp, Homo sapiens
ccgagctgtggtctcttttacg

SEQ ID NO: 45910 - DNA, 22 bp, Homo sapiens
ctgtcctggggaaagccagccc

SEQ ID NO: 45911 - DNA, 22 bp, Homo sapiens
ggctgggcaggtctgcacaggg

SEQ ID NO: 45912 - DNA, 22 bp, Homo sapiens
tgtctgcctgcgggccggcaca

SEQ ID NO: 45913 - DNA, 22 bp, Homo sapiens
catgtgtcttgctgccctccat

SEQ ID NO: 45914 - DNA, 22 bp, Homo sapiens
caggtgagaggcggtcctgcat

SEQ ID NO: 45915 - DNA, 16 bp, Homo sapiens
gcagaggaaaggggag

SEQ ID NO: 45916 - DNA, 22 bp, Homo sapiens
cccagttgttgccggctctgga

SEQ ID NO: 45917 - DNA, 22 bp, Homo sapiens
cactgcacttcagcctgggtga

SEQ ID NO: 45918 - DNA, 22 bp, Homo sapiens
aagaatgagctcaaagatctta

SEQ ID NO: 45919 - DNA, 22 bp, Homo sapiens
ggcctgcctcacagtcagcacc

SEQ ID NO: 45920 - DNA, 22 bp, Homo sapiens
ccggctcggcgaccaggctgaa

SEQ ID NO: 45921 - DNA, 22 bp, Homo sapiens
ctgctgagagccccagctgaga

SEQ ID NO: 45922 - DNA, 22 bp, Homo sapiens
caggtagaggctgccatcagct

SEQ ID NO: 45923 - DNA, 21 bp, Homo sapiens
cagagctgtccaaaccctgac

SEQ ID NO: 45924 - DNA, 22 bp, Homo sapiens
tgccgcagtgcggggagggccc

SEQ ID NO: 45925 - DNA, 23 bp, Homo sapiens
acagcaagaggaccagatgtgag

SEQ ID NO: 45926 - DNA, 22 bp, Homo sapiens
cttgtagacccctggactcacg

SEQ ID NO: 45927 - DNA, 22 bp, Homo sapiens
gctgccttgccctcttcccata

SEQ ID NO: 45928 - DNA, 22 bp, Homo sapiens
gagcactgatttatttttgtct

SEQ ID NO: 45929 - DNA, 22 bp, Homo sapiens
gtgcgcttcttcctgagccagg

SEQ ID NO: 45930 - DNA, 22 bp, Homo sapiens
accattgccccctagtgtctgt

SEQ ID NO: 45931 - DNA, 22 bp, Homo sapiens
ctcctggaggatagtgactggg

SEQ ID NO: 45932 - DNA, 19 bp, Homo sapiens
gccttcccaccacccgtcc

SEQ ID NO: 45933 - DNA, 22 bp, Homo sapiens
ctgggatccacgggctcccaag

SEQ ID NO: 45934 - DNA, 22 bp, Homo sapiens
tctgtcacccagagtgcagtgg

SEQ ID NO: 45935 - DNA, 22 bp, Homo sapiens
tcttaagcagagaagaagttga

SEQ ID NO: 45936 - DNA, 22 bp, Homo sapiens
caggtgtgccgggagcagtttg

SEQ ID NO: 45937 - DNA, 22 bp, Homo sapiens
gggccgtagaccacgtccgggc

SEQ ID NO: 45938 - DNA, 22 bp, Homo sapiens
ctcgcatccaggataccctgag

SEQ ID NO: 45939 - DNA, 22 bp, Homo sapiens
tagtatagattgaagcagatca

SEQ ID NO: 45940 - DNA, 22 bp, Homo sapiens
cagtggcgtgatctctgctcac

SEQ ID NO: 45941 - DNA, 22 bp, Homo sapiens
acatcctcccgatctactggct

SEQ ID NO: 45942 - DNA, 22 bp, Homo sapiens
agtccaaagcagatgagggcca

SEQ ID NO: 45943 - DNA, 22 bp, Homo sapiens
aagtcattggtagcttgatagg

SEQ ID NO: 45944 - DNA, 22 bp, Homo sapiens
tagctgggactactggccctgc

SEQ ID NO: 45945 - DNA, 22 bp, Homo sapiens
ggctgagttgagaggattactt

SEQ ID NO: 45946 - DNA, 22 bp, Homo sapiens
agaggaagtaatcaggacctgc

SEQ ID NO: 45947 - DNA, 22 bp, Homo sapiens
tggcctcggcatccagcaagag

SEQ ID NO: 45948 - DNA, 22 bp, Homo sapiens
aggctggagtgcagtggtgtga

SEQ ID NO: 45949 - DNA, 22 bp, Homo sapiens
aggacgctctcgctgaacttct

SEQ ID NO: 45950 - DNA, 22 bp, Homo sapiens
tggttcgtctcttttacagttc

SEQ ID NO: 45951 - DNA, 22 bp, Homo sapiens
ctcttcctagtgtgcagcgtgg

SEQ ID NO: 45952 - DNA, 22 bp, Homo sapiens
gatattcctgaaggacagggtt

SEQ ID NO: 45953 - DNA, 22 bp, Homo sapiens
ctggtctggctacccagcgaat

SEQ ID NO: 45954 - DNA, 22 bp, Homo sapiens
attgcagatgatccccaagtta

SEQ ID NO: 45955 - DNA, 22 bp, Homo sapiens
agtggaccagaagactgaagct

SEQ ID NO: 45956 - DNA, 20 bp, Homo sapiens
tgaggcccagcagagtcggg

SEQ ID NO: 45957 - DNA, 17 bp, Homo sapiens
ggcccggtgacgtcact

SEQ ID NO: 45958 - DNA, 22 bp, Homo sapiens
taggcccctagtgccacgtggc

SEQ ID NO: 45959 - DNA, 22 bp, Homo sapiens
tgtcaccatgcgaggctaattt

SEQ ID NO: 45960 - DNA, 22 bp, Homo sapiens
atgaaaacggaccagagctatt

SEQ ID NO: 45961 - DNA, 22 bp, Homo sapiens
gaaggaagtcattagtgcagac

SEQ ID NO: 45962 - DNA, 22 bp, Homo sapiens
agcccaggagtttgaggctgtg

SEQ ID NO: 45963 - DNA, 22 bp, Homo sapiens
gacaattgcttttgccgaataa

SEQ ID NO: 45964 - DNA, 22 bp, Homo sapiens
cactgcaagctccgcctcccgg

SEQ ID NO: 45965 - DNA, 22 bp, Homo sapiens
ctacattaaattggcttactta

SEQ ID NO: 45966 - DNA, 22 bp, Homo sapiens
aggctctgtcaggcggagcagc

SEQ ID NO: 45967 - DNA, 22 bp, Homo sapiens
tggcagtggcgggactcagggc

SEQ ID NO: 45968 - DNA, 22 bp, Homo sapiens
aaggtggaggttgcagtgagct

SEQ ID NO: 45969 - DNA, 22 bp, Homo sapiens
ttgtaagtcacaccagggcagg

SEQ ID NO: 45970 - DNA, 22 bp, Homo sapiens
caggtggcagtgcctgcattct

SEQ ID NO: 45971 - DNA, 21 bp, Homo sapiens
gaacccagcagcagtgctctg

SEQ ID NO: 45972 - DNA, 22 bp, Homo sapiens
acagtctgtcccccaggtgcta

SEQ ID NO: 45973 - DNA, 22 bp, Homo sapiens
cagctgctgttcagttttgttt

SEQ ID NO: 45974 - DNA, 22 bp, Homo sapiens
aatggggtagtgggcagcctgg

SEQ ID NO: 45975 - DNA, 22 bp, Homo sapiens
cagcagcagtggctgcagaaca

SEQ ID NO: 45976 - DNA, 22 bp, Homo sapiens
atctccgaaagtcttgtcaccc

SEQ ID NO: 45977 - DNA, 22 bp, Homo sapiens
ggacctgaacataaaacgaggc

SEQ ID NO: 45978 - DNA, 20 bp, Homo sapiens
caagggtttgcattggcttt

SEQ ID NO: 45979 - DNA, 22 bp, Homo sapiens
ttgcatgttccaaagaattttg

SEQ ID NO: 45980 - DNA, 22 bp, Homo sapiens
tgggaaagctgcagaaattctc

SEQ ID NO: 45981 - DNA, 22 bp, Homo sapiens
cgtcacttcttagtctattttc

SEQ ID NO: 45982 - DNA, 17 bp, Homo sapiens
tgcatgtcctttgttcc

SEQ ID NO: 45983 - DNA, 22 bp, Homo sapiens
tgtgaagatagctgttacatct

SEQ ID NO: 45984 - DNA, 22 bp, Homo sapiens
gaagccttgaactgcaaacccc

SEQ ID NO: 45985 - DNA, 22 bp, Homo sapiens
gtgcggatcggtgtcctccaaa

SEQ ID NO: 45986 - DNA, 22 bp, Homo sapiens
gcgaggaggggtgctgggcccc

SEQ ID NO: 45987 - DNA, 20 bp, Homo sapiens
cagcctgcatcatctgcagc

SEQ ID NO: 45988 - DNA, 22 bp, Homo sapiens
gggagcaagccggaggtactgt

SEQ ID NO: 45989 - DNA, 22 bp, Homo sapiens
tcctttgcttctgtcattctcc

SEQ ID NO: 45990 - DNA, 22 bp, Homo sapiens
tgcctgatgcaggagtatcaga

SEQ ID NO: 45991 - DNA, 22 bp, Homo sapiens
aacagtgtttttcttcagcact

SEQ ID NO: 45992 - DNA, 22 bp, Homo sapiens
aggggctcctttgtgctgcgtc

SEQ ID NO: 45993 - DNA, 22 bp, Homo sapiens
gggcagagactcagaaacagaa

SEQ ID NO: 45994 - DNA, 19 bp, Homo sapiens
ggcttgtctcggcagccgc

SEQ ID NO: 45995 - DNA, 22 bp, Homo sapiens
aaccaggtgactcatggtgagc

SEQ ID NO: 45996 - DNA, 22 bp, Homo sapiens
aaatcccatcggagaggaggat

SEQ ID NO: 45997 - DNA, 22 bp, Homo sapiens
aaagaaatagatggcatttaaa

SEQ ID NO: 45998 - DNA, 18 bp, Homo sapiens
catgggtgacaggtggat

SEQ ID NO: 45999 - DNA, 23 bp, Homo sapiens
aaactacaacgccaggcactgag

SEQ ID NO: 46000 - DNA, 22 bp, Homo sapiens
agtgggtgacagtgaacacgta

SEQ ID NO: 46001 - DNA, 22 bp, Homo sapiens
agatttctgggcttcaccacct

SEQ ID NO: 46002 - DNA, 22 bp, Homo sapiens
ggatgtcgaggatggggtagca

SEQ ID NO: 46003 - DNA, 22 bp, Homo sapiens
gggcagccgcgtgacctgccag

SEQ ID NO: 46004 - DNA, 23 bp, Homo sapiens
ttgtcctctggatcggtttggtt

SEQ ID NO: 46005 - DNA, 22 bp, Homo sapiens
ggagtgcaatggcgtgatctca

SEQ ID NO: 46006 - DNA, 22 bp, Homo sapiens
ttcccttaaattatggcatcta

SEQ ID NO: 46007 - DNA, 22 bp, Homo sapiens
tgagccaggagtttgaggctgt

SEQ ID NO: 46008 - DNA, 22 bp, Homo sapiens
ggcctgggctccgggagttact

SEQ ID NO: 46009 - DNA, 22 bp, Homo sapiens
tgtcacagtttgtactttatag

SEQ ID NO: 46010 - DNA, 22 bp, Homo sapiens
actcatgtaagcggaatgtagt

SEQ ID NO: 46011 - DNA, 22 bp, Homo sapiens
ggagaccagaaggaagcttcga

SEQ ID NO: 46012 - DNA, 22 bp, Homo sapiens
cccaggccccagggcttgtcag

SEQ ID NO: 46013 - DNA, 22 bp, Homo sapiens
cagggtgacaagtggcaaggag

SEQ ID NO: 46014 - DNA, 22 bp, Homo sapiens
gtggcccaggctggagtgcagt

SEQ ID NO: 46015 - DNA, 22 bp, Homo sapiens
tcctcagcttttatttcacttg

SEQ ID NO: 46016 - DNA, 22 bp, Homo sapiens
ccaggaggtggagattgcagtg

SEQ ID NO: 46017 - DNA, 22 bp, Homo sapiens
gatcagagccagagatgataac

SEQ ID NO: 46018 - DNA, 22 bp, Homo sapiens
gcatctaaataaacgtgggagt

SEQ ID NO: 46019 - DNA, 22 bp, Homo sapiens
ttcagcccaggagttggaggct

SEQ ID NO: 46020 - DNA, 22 bp, Homo sapiens
agtgcattcctggggaagaagc

SEQ ID NO: 46021 - DNA, 22 bp, Homo sapiens
tgggtgctctgcgaccgtaggg

SEQ ID NO: 46022 - DNA, 22 bp, Homo sapiens
actgcacttcaccctgggtgac

SEQ ID NO: 46023 - DNA, 22 bp, Homo sapiens
tgcttttagctagtaactagta

SEQ ID NO: 46024 - DNA, 22 bp, Homo sapiens
aggctcgcatgccctgcaccac

SEQ ID NO: 46025 - DNA, 22 bp, Homo sapiens
caggcaggtcagtgaagaagga

SEQ ID NO: 46026 - DNA, 22 bp, Homo sapiens
gcccgcgccagcctctccatct

SEQ ID NO: 46027 - DNA, 22 bp, Homo sapiens
attgaaaataaggccagaaaca

SEQ ID NO: 46028 - DNA, 22 bp, Homo sapiens
ctatggtctggaccgaggtcct

SEQ ID NO: 46029 - DNA, 22 bp, Homo sapiens
catccatagcttgatctgttcc

SEQ ID NO: 46030 - DNA, 22 bp, Homo sapiens
ggatctgggctgcagtctaggc

SEQ ID NO: 46031 - DNA, 22 bp, Homo sapiens
accctactaaatgtggtatgtc

SEQ ID NO: 46032 - DNA, 22 bp, Homo sapiens
ccgttggaaagctccgagttga

SEQ ID NO: 46033 - DNA, 23 bp, Homo sapiens
cggcagcgtccggctacgggagg

SEQ ID NO: 46034 - DNA, 22 bp, Homo sapiens
gagagtgagatcctcctgggga

SEQ ID NO: 46035 - DNA, 22 bp, Homo sapiens
agctggggctgtggttgtgatt

SEQ ID NO: 46036 - DNA, 22 bp, Homo sapiens
ctttaattgtagctcccataat

SEQ ID NO: 46037 - DNA, 22 bp, Homo sapiens
gctgcagctcgccttccggcct

SEQ ID NO: 46038 - DNA, 19 bp, Homo sapiens
gggtcccaaaagatgtgct

SEQ ID NO: 46039 - DNA, 22 bp, Homo sapiens
ggctgtggcagctggaagtggt

SEQ ID NO: 46040 - DNA, 23 bp, Homo sapiens
ggggcctgcaccggtctgcgcgg

SEQ ID NO: 46041 - DNA, 22 bp, Homo sapiens
tggctgagttacgaacagagca

SEQ ID NO: 46042 - DNA, 22 bp, Homo sapiens
acaggcttacaggctgcaagta

SEQ ID NO: 46043 - DNA, 22 bp, Homo sapiens
tgcacgtgtgagcattcacatg

SEQ ID NO: 46044 - DNA, 22 bp, Homo sapiens
tctgcaggtaagcgttcttgga

SEQ ID NO: 46045 - DNA, 22 bp, Homo sapiens
aagaaggcggaccagaagggag

SEQ ID NO: 46046 - DNA, 22 bp, Homo sapiens
ggagagggtaggggtcctgccc

SEQ ID NO: 46047 - DNA, 22 bp, Homo sapiens
ttccagagagttattcccctgg

SEQ ID NO: 46048 - DNA, 22 bp, Homo sapiens
gcagcctcaaactccccagctc

SEQ ID NO: 46049 - DNA, 22 bp, Homo sapiens
taaaggtagtgtgacatattgt

SEQ ID NO: 46050 - DNA, 22 bp, Homo sapiens
ggcaaggggtcaggctgagaca

SEQ ID NO: 46051 - DNA, 23 bp, Homo sapiens
gtcacagtgggtggtgcctacat

SEQ ID NO: 46052 - DNA, 18 bp, Homo sapiens
gatcgggggcgccccaag

SEQ ID NO: 46053 - DNA, 22 bp, Homo sapiens
tacatttataaggcttctctgt

SEQ ID NO: 46054 - DNA, 18 bp, Homo sapiens
gcctggcttcggagccgc

SEQ ID NO: 46055 - DNA, 22 bp, Homo sapiens
ttgaggtccccagtacccactg

SEQ ID NO: 46056 - DNA, 22 bp, Homo sapiens
tccttaggaaaatgatgagggg

SEQ ID NO: 46057 - DNA, 22 bp, Homo sapiens
ggcgccagcactgcagcgcctc

SEQ ID NO: 46058 - DNA, 22 bp, Homo sapiens
ctccccagccctggtattctga

SEQ ID NO: 46059 - DNA, 22 bp, Homo sapiens
caggagatgacagggaagaacc

SEQ ID NO: 46060 - DNA, 22 bp, Homo sapiens
taggtttactgaattagtggaa

SEQ ID NO: 46061 - DNA, 22 bp, Homo sapiens
tagcagtgtctaggtaggccat

SEQ ID NO: 46062 - DNA, 22 bp, Homo sapiens
tggctcctcacgtcctcagagc

SEQ ID NO: 46063 - DNA, 22 bp, Homo sapiens
cctgccagagcagcttgtcctc

SEQ ID NO: 46064 - DNA, 22 bp, Homo sapiens
acgtgcaggatctggttggcga

SEQ ID NO: 46065 - DNA, 22 bp, Homo sapiens
cttgatgagtcagaactgaagg

SEQ ID NO: 46066 - DNA, 22 bp, Homo sapiens
agggcgacaatggagagcgttt

SEQ ID NO: 46067 - DNA, 22 bp, Homo sapiens
ctgccctggggggcctccttgc

SEQ ID NO: 46068 - DNA, 22 bp, Homo sapiens
cgtgatttctggctttctatat

SEQ ID NO: 46069 - DNA, 22 bp, Homo sapiens
caacatggtgaaaccccgtctc

SEQ ID NO: 46070 - DNA, 22 bp, Homo sapiens
atccctgtctcaaagccagcaa

SEQ ID NO: 46071 - DNA, 22 bp, Homo sapiens
gcggtagctcaagcttgtaatc

SEQ ID NO: 46072 - DNA, 22 bp, Homo sapiens
agtgctgtcagttttatagata

SEQ ID NO: 46073 - DNA, 22 bp, Homo sapiens
agcgccgcccctgctggtgttg

SEQ ID NO: 46074 - DNA, 22 bp, Homo sapiens
ttcttctaaatgtgcttattaa

SEQ ID NO: 46075 - DNA, 22 bp, Homo sapiens
ctttaaggtgatgagagatgct

SEQ ID NO: 46076 - DNA, 22 bp, Homo sapiens
gcccagtagttcaaggttgcag

SEQ ID NO: 46077 - DNA, 22 bp, Homo sapiens
gcagactgtatcaatgtcagta

SEQ ID NO: 46078 - DNA, 22 bp, Homo sapiens
cagaggaacgtttggattgatt

SEQ ID NO: 46079 - DNA, 22 bp, Homo sapiens
ctgaggctggagtgcagtggtg

SEQ ID NO: 46080 - DNA, 22 bp, Homo sapiens
gtgcttccatctagagggtcac

SEQ ID NO: 46081 - DNA, 22 bp, Homo sapiens
ggaggcggaagttgcagtgagc

SEQ ID NO: 46082 - DNA, 22 bp, Homo sapiens
ttgaggcaggtccgggtccttc

SEQ ID NO: 46083 - DNA, 22 bp, Homo sapiens
ccaaagtgctggggttacaggc

SEQ ID NO: 46084 - DNA, 22 bp, Homo sapiens
gcaggcaggcttccttgaactg

SEQ ID NO: 46085 - DNA, 22 bp, Homo sapiens
tccattatacttctgattcaaa

SEQ ID NO: 46086 - DNA, 22 bp, Homo sapiens
acccaggctggagtgcagtgat

SEQ ID NO: 46087 - DNA, 22 bp, Homo sapiens
cgcagggccgcgagcgggacca

SEQ ID NO: 46088 - DNA, 22 bp, Homo sapiens
aggcaaggtgctacagacagtg

SEQ ID NO: 46089 - DNA, 22 bp, Homo sapiens
gccacctcggctttctctgctc

SEQ ID NO: 46090 - DNA, 22 bp, Homo sapiens
agccagtgcagctggaaattca

SEQ ID NO: 46091 - DNA, 20 bp, Homo sapiens
tgcagcacgggccctttcca

SEQ ID NO: 46092 - DNA, 22 bp, Homo sapiens
taattataacatgctttctggc

SEQ ID NO: 46093 - DNA, 22 bp, Homo sapiens
taggttttcctaaaattctggt

SEQ ID NO: 46094 - DNA, 22 bp, Homo sapiens
gaaatcatattctcagtccttc

SEQ ID NO: 46095 - DNA, 20 bp, Homo sapiens
tgttgattggtgtcatctca

SEQ ID NO: 46096 - DNA, 22 bp, Homo sapiens
cagtgggtcctgcgtctgccag

SEQ ID NO: 46097 - DNA, 22 bp, Homo sapiens
ttgtgctcctgtgagaatctag

SEQ ID NO: 46098 - DNA, 23 bp, Homo sapiens
gctcatcaggcttagagtcaagg

SEQ ID NO: 46099 - DNA, 22 bp, Homo sapiens
acccaggctggcgtgcagtggc

SEQ ID NO: 46100 - DNA, 22 bp, Homo sapiens
aaggggaagagaccgcagagtc

SEQ ID NO: 46101 - DNA, 22 bp, Homo sapiens
tctgccttttactagctggatg

SEQ ID NO: 46102 - DNA, 22 bp, Homo sapiens
ggaaatgacttggtgcttcgtt

SEQ ID NO: 46103 - DNA, 22 bp, Homo sapiens
attaaagctatccagtcatgaa

SEQ ID NO: 46104 - DNA, 22 bp, Homo sapiens
ttgtggaatgtggctgtcaatt

SEQ ID NO: 46105 - DNA, 21 bp, Homo sapiens
tctgcaccccagcctgagtga

SEQ ID NO: 46106 - DNA, 22 bp, Homo sapiens
attgtcgtcaatggacacatag

SEQ ID NO: 46107 - DNA, 22 bp, Homo sapiens
gtgtttggtcagacgtccgggg

SEQ ID NO: 46108 - DNA, 22 bp, Homo sapiens
ggtcagccttggatttggtagc

SEQ ID NO: 46109 - DNA, 22 bp, Homo sapiens
gctcaagccttctgcccacctc

SEQ ID NO: 46110 - DNA, 22 bp, Homo sapiens
ggggccttttctgaatgtggaa

SEQ ID NO: 46111 - DNA, 22 bp, Homo sapiens
gcccaggctggagtgcagtggc

SEQ ID NO: 46112 - DNA, 22 bp, Homo sapiens
ccccagtggaggtgagggtcct

SEQ ID NO: 46113 - DNA, 22 bp, Homo sapiens
cttgcctacttgtcaaccagca

SEQ ID NO: 46114 - DNA, 16 bp, Homo sapiens
atgctgctattagagg

SEQ ID NO: 46115 - DNA, 22 bp, Homo sapiens
tcttggattttaatggatcaaa

SEQ ID NO: 46116 - DNA, 22 bp, Homo sapiens
ctgaacttattgagtgcttgct

SEQ ID NO: 46117 - DNA, 21 bp, Homo sapiens
acatggactgtgaatggggac

SEQ ID NO: 46118 - DNA, 22 bp, Homo sapiens
tctcatctgccatttgcaggag

SEQ ID NO: 46119 - DNA, 22 bp, Homo sapiens
aacagcttgctgcaccttaata

SEQ ID NO: 46120 - DNA, 22 bp, Homo sapiens
aagttactggcaagggctgcag

SEQ ID NO: 46121 - DNA, 22 bp, Homo sapiens
aagaagcaggtcacagacaggg

SEQ ID NO: 46122 - DNA, 22 bp, Homo sapiens
gtccaaaagagccagccgggcg

SEQ ID NO: 46123 - DNA, 22 bp, Homo sapiens
cttggattcctcatatgcacag

SEQ ID NO: 46124 - DNA, 22 bp, Homo sapiens
agctcagggccaggcgcgtttc

SEQ ID NO: 46125 - DNA, 22 bp, Homo sapiens
tttgaggttagctagcagatca

SEQ ID NO: 46126 - DNA, 23 bp, Homo sapiens
tcggtgggcgtggaggccgaggc

SEQ ID NO: 46127 - DNA, 22 bp, Homo sapiens
gaggctgaggttgcagtgagct

SEQ ID NO: 46128 - DNA, 22 bp, Homo sapiens
ggtgttgcagttgaagactggt

SEQ ID NO: 46129 - DNA, 22 bp, Homo sapiens
gctgctgggatcctgggtctca

SEQ ID NO: 46130 - DNA, 22 bp, Homo sapiens
caggctggagttcagtggtgtg

SEQ ID NO: 46131 - DNA, 22 bp, Homo sapiens
gctcactgcaagctctgcctcc

SEQ ID NO: 46132 - DNA, 22 bp, Homo sapiens
agagctaagaaacagaattgct

SEQ ID NO: 46133 - DNA, 22 bp, Homo sapiens
ggctccctgcaacctccgcctc

SEQ ID NO: 46134 - DNA, 22 bp, Homo sapiens
gggaggttgaggctgcagtgag

SEQ ID NO: 46135 - DNA, 20 bp, Homo sapiens
atgctttcttgtgtgctgct

SEQ ID NO: 46136 - DNA, 22 bp, Homo sapiens
acaggggcaagggctcacggcc

SEQ ID NO: 46137 - DNA, 22 bp, Homo sapiens
tcaacgcatgctccaagaaaga

SEQ ID NO: 46138 - DNA, 22 bp, Homo sapiens
ctagttctagatccctgaggaa

SEQ ID NO: 46139 - DNA, 22 bp, Homo sapiens
aaaatcctgctgactcgagatg

SEQ ID NO: 46140 - DNA, 22 bp, Homo sapiens
gtgagatggagttggtgtcttt

SEQ ID NO: 46141 - DNA, 22 bp, Homo sapiens
agcaggcctgccacctcggggt

SEQ ID NO: 46142 - DNA, 22 bp, Homo sapiens
ggagaacatatctcccacattg

SEQ ID NO: 46143 - DNA, 22 bp, Homo sapiens
cattccttaacgtggggagtct

SEQ ID NO: 46144 - DNA, 22 bp, Homo sapiens
tgagcctgtcattattcagaga

SEQ ID NO: 46145 - DNA, 22 bp, Homo sapiens
tgccaccccggaccccgaagtg

SEQ ID NO: 46146 - DNA, 22 bp, Homo sapiens
gtggcaggagggcatcacttgg

SEQ ID NO: 46147 - DNA, 21 bp, Homo sapiens
cccagaagttccatggggggc

SEQ ID NO: 46148 - DNA, 22 bp, Homo sapiens
gggcagccccagcgcgttggct

SEQ ID NO: 46149 - DNA, 22 bp, Homo sapiens
tgtctttgttattgtggacagg

SEQ ID NO: 46150 - DNA, 22 bp, Homo sapiens
ggaggtgactggatcatgggca

SEQ ID NO: 46151 - DNA, 22 bp, Homo sapiens
gtcactcaggctggagttcagt

SEQ ID NO: 46152 - DNA, 22 bp, Homo sapiens
tctgccttctatcttttgtctg

SEQ ID NO: 46153 - DNA, 22 bp, Homo sapiens
ctctgcctgtctcatcctgcaa

SEQ ID NO: 46154 - DNA, 22 bp, Homo sapiens
gaagcctcaacatctctgcgtc

SEQ ID NO: 46155 - DNA, 22 bp, Homo sapiens
aaagtaattgcagtttctgcca

SEQ ID NO: 46156 - DNA, 22 bp, Homo sapiens
atgccactgcgctccagcctgg

SEQ ID NO: 46157 - DNA, 22 bp, Homo sapiens
acccggagtcggaggttgcagt

SEQ ID NO: 46158 - DNA, 22 bp, Homo sapiens
agtggccagcagcctagcctag

SEQ ID NO: 46159 - DNA, 22 bp, Homo sapiens
ctgtcctgtgctttttactgtc

SEQ ID NO: 46160 - DNA, 22 bp, Homo sapiens
gtgggctgcccttgaggtcagc

SEQ ID NO: 46161 - DNA, 22 bp, Homo sapiens
tgatttacagtagtgtctaaac

SEQ ID NO: 46162 - DNA, 22 bp, Homo sapiens
agctcctgaaaatccagactgg

SEQ ID NO: 46163 - DNA, 22 bp, Homo sapiens
ttggaagttgatttaaaaagga

SEQ ID NO: 46164 - DNA, 22 bp, Homo sapiens
gaggtggatgttgcagtgagct

SEQ ID NO: 46165 - DNA, 22 bp, Homo sapiens
agcaacctcatgagagtgaaat

SEQ ID NO: 46166 - DNA, 22 bp, Homo sapiens
ccttttatagatcagtgtgtta

SEQ ID NO: 46167 - DNA, 22 bp, Homo sapiens
ctcttagtaatgccatgaagca

SEQ ID NO: 46168 - DNA, 22 bp, Homo sapiens
ttaggctgttcttgtgttgtta

SEQ ID NO: 46169 - DNA, 22 bp, Homo sapiens
tggcccgaagatccgagggtca

SEQ ID NO: 46170 - DNA, 22 bp, Homo sapiens
ggtcccaggttgacagggagac

SEQ ID NO: 46171 - DNA, 22 bp, Homo sapiens
aacccaggaggtggaggttgtg

SEQ ID NO: 46172 - DNA, 22 bp, Homo sapiens
ccaggctggagtgcaatggcat

SEQ ID NO: 46173 - DNA, 22 bp, Homo sapiens
gcatatgatcacgtgtgtcggt

SEQ ID NO: 46174 - DNA, 22 bp, Homo sapiens
ggcttcagtggccagagatgat

SEQ ID NO: 46175 - DNA, 22 bp, Homo sapiens
ccattgtaaattctgtggaagt

SEQ ID NO: 46176 - DNA, 22 bp, Homo sapiens
ggctcttccgccaccagccaca

SEQ ID NO: 46177 - DNA, 22 bp, Homo sapiens
ccttacctgattgctggcatcc

SEQ ID NO: 46178 - DNA, 22 bp, Homo sapiens
acctggacacctgctgtcatct

SEQ ID NO: 46179 - DNA, 22 bp, Homo sapiens
ccaggctggagtgcagtggcac

SEQ ID NO: 46180 - DNA, 22 bp, Homo sapiens
agggcactgcaagggttgaagg

SEQ ID NO: 46181 - DNA, 20 bp, Homo sapiens
agagatggggtatcaccgta

SEQ ID NO: 46182 - DNA, 22 bp, Homo sapiens
gcactgcaggtgggtggagagg

SEQ ID NO: 46183 - DNA, 22 bp, Homo sapiens
cagcagagaaattacatatttg

SEQ ID NO: 46184 - DNA, 22 bp, Homo sapiens
tcagggattaaggtcaaaggtg

SEQ ID NO: 46185 - DNA, 22 bp, Homo sapiens
gtcagatctttggggatgctgt

SEQ ID NO: 46186 - DNA, 22 bp, Homo sapiens
tgtgagcagagacatgaaaagc

SEQ ID NO: 46187 - DNA, 22 bp, Homo sapiens
tggggtcagcaggcctggcctg

SEQ ID NO: 46188 - DNA, 22 bp, Homo sapiens
aatttaagaacatttcaggact

SEQ ID NO: 46189 - DNA, 22 bp, Homo sapiens
tgagctgtagcagatgctgttg

SEQ ID NO: 46190 - DNA, 22 bp, Homo sapiens
gctgctctccaagcctccttga

SEQ ID NO: 46191 - DNA, 22 bp, Homo sapiens
taagcctgcatgaaccatgaga

SEQ ID NO: 46192 - DNA, 22 bp, Homo sapiens
ggagcatgcgctctgtgaccga

SEQ ID NO: 46193 - DNA, 22 bp, Homo sapiens
tcaccaggctagagtgcagtgg

SEQ ID NO: 46194 - DNA, 22 bp, Homo sapiens
tttgggcaggcttttccctaga

SEQ ID NO: 46195 - DNA, 22 bp, Homo sapiens
atttagtagagaaattaagaaa

SEQ ID NO: 46196 - DNA, 22 bp, Homo sapiens
gtgcatgtgtctttatagtagc

SEQ ID NO: 46197 - DNA, 22 bp, Homo sapiens
aagccgggcctgagaaatgaca

SEQ ID NO: 46198 - DNA, 22 bp, Homo sapiens
tgagcctgggagatggaggctg

SEQ ID NO: 46199 - DNA, 22 bp, Homo sapiens
tttgtgaataggttggcttcca

SEQ ID NO: 46200 - DNA, 22 bp, Homo sapiens
cagcagcccacgcgtgctgtcc

SEQ ID NO: 46201 - DNA, 21 bp, Homo sapiens
tcacgtggtcacatgagcttt

SEQ ID NO: 46202 - DNA, 22 bp, Homo sapiens
tctgccttgtttgagctttgac

SEQ ID NO: 46203 - DNA, 18 bp, Homo sapiens
gatatggaaggccatgcc

SEQ ID NO: 46204 - DNA, 22 bp, Homo sapiens
ggccgccctttccacggtttct

SEQ ID NO: 46205 - DNA, 22 bp, Homo sapiens
ttccctccatttcattttataa

SEQ ID NO: 46206 - DNA, 22 bp, Homo sapiens
ccacccttgggttcggaggccg

SEQ ID NO: 46207 - DNA, 22 bp, Homo sapiens
tatattgagatttgagcattgt

SEQ ID NO: 46208 - DNA, 22 bp, Homo sapiens
ggccgctctccggtgtggatct

SEQ ID NO: 46209 - DNA, 22 bp, Homo sapiens
ttcatgggtccagagccctggg

SEQ ID NO: 46210 - DNA, 22 bp, Homo sapiens
gaatatcccgctatgcaaagta

SEQ ID NO: 46211 - DNA, 22 bp, Homo sapiens
gatgcagtgcttaaatcatttg

SEQ ID NO: 46212 - DNA, 22 bp, Homo sapiens
gagcatcgctgagatcccagac

SEQ ID NO: 46213 - DNA, 22 bp, Homo sapiens
gcttggcccattgatcagctgg

SEQ ID NO: 46214 - DNA, 22 bp, Homo sapiens
ggaggactcaggtctggccatg

SEQ ID NO: 46215 - DNA, 22 bp, Homo sapiens
agttattactctttaacatatt

SEQ ID NO: 46216 - DNA, 22 bp, Homo sapiens
gtacacaaagtgagacttgata

SEQ ID NO: 46217 - DNA, 22 bp, Homo sapiens
ggaggagacagtaaaaagcacg

SEQ ID NO: 46218 - DNA, 22 bp, Homo sapiens
ctgcattaagttgcctgtaaga

SEQ ID NO: 46219 - DNA, 23 bp, Homo sapiens
ctatttctcatagttcaggtctt

SEQ ID NO: 46220 - DNA, 22 bp, Homo sapiens
atgattgaccatctgctgggct

SEQ ID NO: 46221 - DNA, 22 bp, Homo sapiens
gcggggggaggaacatcttgca

SEQ ID NO: 46222 - DNA, 22 bp, Homo sapiens
tcacaatatttatcttccaatt

SEQ ID NO: 46223 - DNA, 19 bp, Homo sapiens
ggcttcgaggctggggaag

SEQ ID NO: 46224 - DNA, 22 bp, Homo sapiens
ccgggcctcgggacaccgggta

SEQ ID NO: 46225 - DNA, 22 bp, Homo sapiens
tcactacaacctccgcctcctg

SEQ ID NO: 46226 - DNA, 22 bp, Homo sapiens
attacctatttcattttctgtc

SEQ ID NO: 46227 - DNA, 22 bp, Homo sapiens
gagatttccatattttgtaaca

SEQ ID NO: 46228 - DNA, 22 bp, Homo sapiens
cttggtgccacagcagcttgcg

SEQ ID NO: 46229 - DNA, 22 bp, Homo sapiens
tctgagaatggtggatgtggtg

SEQ ID NO: 46230 - DNA, 22 bp, Homo sapiens
ttcccagtcaaacgaaggactt

SEQ ID NO: 46231 - DNA, 22 bp, Homo sapiens
tatcactacacctggctaatta

SEQ ID NO: 46232 - DNA, 22 bp, Homo sapiens
aggagggagcttaagccaggca

SEQ ID NO: 46233 - DNA, 22 bp, Homo sapiens
tagcagcaaagcaggatctgct

SEQ ID NO: 46234 - DNA, 22 bp, Homo sapiens
catccctgtcgtcaagtctctg

SEQ ID NO: 46235 - DNA, 22 bp, Homo sapiens
cctgacaggcggaggctgcagt

SEQ ID NO: 46236 - DNA, 22 bp, Homo sapiens
gcgagcctctggagtcctctgg

SEQ ID NO: 46237 - DNA, 21 bp, Homo sapiens
tgcaatccagcctgggcgaca

SEQ ID NO: 46238 - DNA, 22 bp, Homo sapiens
aagatgcggttgaccatggtgt

SEQ ID NO: 46239 - DNA, 22 bp, Homo sapiens
aatgtgaggccttggtagttat

SEQ ID NO: 46240 - DNA, 22 bp, Homo sapiens
tgtctggtgggttgacaggcag

SEQ ID NO: 46241 - DNA, 22 bp, Homo sapiens
attgataaattgcaatggggct

SEQ ID NO: 46242 - DNA, 22 bp, Homo sapiens
gctgggttttcttccgggccta

SEQ ID NO: 46243 - DNA, 22 bp, Homo sapiens
ggttttatcctacccacacagc

SEQ ID NO: 46244 - DNA, 22 bp, Homo sapiens
atgtgtattacctcgattgtga

SEQ ID NO: 46245 - DNA, 22 bp, Homo sapiens
ggctccaccctgcttccagaag

SEQ ID NO: 46246 - DNA, 22 bp, Homo sapiens
gctgggtgattcatttccataa

SEQ ID NO: 46247 - DNA, 22 bp, Homo sapiens
tggatatccttgttaactttct

SEQ ID NO: 46248 - DNA, 22 bp, Homo sapiens
aagtgcttccatgtttgagtgt

SEQ ID NO: 46249 - DNA, 19 bp, Homo sapiens
ctgtccttggctgcactgt

SEQ ID NO: 46250 - DNA, 22 bp, Homo sapiens
agcccaggttgaggctgcagtg

SEQ ID NO: 46251 - DNA, 22 bp, Homo sapiens
gcagccagagggggtgtgatca

SEQ ID NO: 46252 - DNA, 22 bp, Homo sapiens
gcttcaggctgaattcctccta

SEQ ID NO: 46253 - DNA, 22 bp, Homo sapiens
gaacactgctgttgggttctga

SEQ ID NO: 46254 - DNA, 22 bp, Homo sapiens
tggtattacttctagacacaag

SEQ ID NO: 46255 - DNA, 22 bp, Homo sapiens
cttatcttacttccccttcatg

SEQ ID NO: 46256 - DNA, 22 bp, Homo sapiens
gtggcattgccttctgcaggaa

SEQ ID NO: 46257 - DNA, 22 bp, Homo sapiens
gtgtcaataaatagcggtgtgg

SEQ ID NO: 46258 - DNA, 22 bp, Homo sapiens
cactaggctggagtgcagtggc

SEQ ID NO: 46259 - DNA, 22 bp, Homo sapiens
aggatcagggtggtggaagtca

SEQ ID NO: 46260 - DNA, 22 bp, Homo sapiens
tcactgcaacctccgcctgctg

SEQ ID NO: 46261 - DNA, 22 bp, Homo sapiens
ctgagggtcaacttgattgtat

SEQ ID NO: 46262 - DNA, 22 bp, Homo sapiens
accctaataatcacagactagt

SEQ ID NO: 46263 - DNA, 22 bp, Homo sapiens
aggacttagaacattatgtact

SEQ ID NO: 46264 - DNA, 22 bp, Homo sapiens
tgcctcaagccctccactgcac

SEQ ID NO: 46265 - DNA, 22 bp, Homo sapiens
cagagatgtgatccagctgtct

SEQ ID NO: 46266 - DNA, 22 bp, Homo sapiens
ttcgctgggagtggccaggcac

SEQ ID NO: 46267 - DNA, 22 bp, Homo sapiens
gaatgctaagcatgtgggagtt

SEQ ID NO: 46268 - DNA, 22 bp, Homo sapiens
gtgtgtccaaggcacggatgac

SEQ ID NO: 46269 - DNA, 22 bp, Homo sapiens
cccaggctggagtgtaatggtg

SEQ ID NO: 46270 - DNA, 22 bp, Homo sapiens
aggttatcatcagttgagcact

SEQ ID NO: 46271 - DNA, 22 bp, Homo sapiens
aagtcgtggcaggcttgcacga

SEQ ID NO: 46272 - DNA, 22 bp, Homo sapiens
ctgcgggctgtcaggcgtgcca

SEQ ID NO: 46273 - DNA, 22 bp, Homo sapiens
ggtgtccacattccctggcagg

SEQ ID NO: 46274 - DNA, 22 bp, Homo sapiens
tcaaattgtcatcttgataatg

SEQ ID NO: 46275 - DNA, 22 bp, Homo sapiens
agctggagatgagtgacgtgcc

SEQ ID NO: 46276 - DNA, 22 bp, Homo sapiens
tttattctgtgctacatgaaga

SEQ ID NO: 46277 - DNA, 22 bp, Homo sapiens
aggaatggtgctcagcagaaat

SEQ ID NO: 46278 - DNA, 22 bp, Homo sapiens
gcccttacagggtggtcagcca

SEQ ID NO: 46279 - DNA, 22 bp, Homo sapiens
gatccgaatcattgctctttta

SEQ ID NO: 46280 - DNA, 22 bp, Homo sapiens
actgaataaggtgaatgctctg

SEQ ID NO: 46281 - DNA, 22 bp, Homo sapiens
cactgcaagctctgccacctgg

SEQ ID NO: 46282 - DNA, 22 bp, Homo sapiens
tcctgccttgcctgggacatca

SEQ ID NO: 46283 - DNA, 22 bp, Homo sapiens
tagagtgtcataacagtgccca

SEQ ID NO: 46284 - DNA, 22 bp, Homo sapiens
actgcactccagcctgggtgat

SEQ ID NO: 46285 - DNA, 23 bp, Homo sapiens
aaaacagcttcctccagtggctc

SEQ ID NO: 46286 - DNA, 22 bp, Homo sapiens
tagaataatctgaggaaatgct

SEQ ID NO: 46287 - DNA, 22 bp, Homo sapiens
cactgcactccagcctgggtca

SEQ ID NO: 46288 - DNA, 22 bp, Homo sapiens
ctcagcactgacccaggagatg

SEQ ID NO: 46289 - DNA, 22 bp, Homo sapiens
tggccaccaccaatacttgcct

SEQ ID NO: 46290 - DNA, 22 bp, Homo sapiens
tatacgtgcaggtcacagggga

SEQ ID NO: 46291 - DNA, 22 bp, Homo sapiens
actgtgtgccaggcgctggtct

SEQ ID NO: 46292 - DNA, 22 bp, Homo sapiens
agatttatgtggtcacactcag

SEQ ID NO: 46293 - DNA, 22 bp, Homo sapiens
caggaattcatagcattgttct

SEQ ID NO: 46294 - DNA, 22 bp, Homo sapiens
tctccgatcacaggttttcaat

SEQ ID NO: 46295 - DNA, 22 bp, Homo sapiens
tcacatctaattccatttctgc

SEQ ID NO: 46296 - DNA, 22 bp, Homo sapiens
ctgtggctcaggcctgtaagcc

SEQ ID NO: 46297 - DNA, 22 bp, Homo sapiens
ctcagccccagcccagatagca

SEQ ID NO: 46298 - DNA, 22 bp, Homo sapiens
tgtggccattcttgaggtcgac

SEQ ID NO: 46299 - DNA, 22 bp, Homo sapiens
atccatttgacataatttcagc

SEQ ID NO: 46300 - DNA, 22 bp, Homo sapiens
tatttccttgagacggagtctc

SEQ ID NO: 46301 - DNA, 22 bp, Homo sapiens
gcacagagagggaaggtaactt

SEQ ID NO: 46302 - DNA, 22 bp, Homo sapiens
tgttgactcaacactgtgggca

SEQ ID NO: 46303 - DNA, 22 bp, Homo sapiens
aattatggtcactgttcctggg

SEQ ID NO: 46304 - DNA, 22 bp, Homo sapiens
acaggcacctgccaccacatct

SEQ ID NO: 46305 - DNA, 22 bp, Homo sapiens
cccacaggtgtgagcttgctgg

SEQ ID NO: 46306 - DNA, 22 bp, Homo sapiens
atgcaggcagacactgtgggca

SEQ ID NO: 46307 - DNA, 22 bp, Homo sapiens
cttatcagattatctgggctgt

SEQ ID NO: 46308 - DNA, 22 bp, Homo sapiens
ccgcccacactaaatatgagcg

SEQ ID NO: 46309 - DNA, 22 bp, Homo sapiens
ctattgtttctatgctctgagg

SEQ ID NO: 46310 - DNA, 22 bp, Homo sapiens
gactggaaagcctgtcctcaga

SEQ ID NO: 46311 - DNA, 22 bp, Homo sapiens
cccaggaggttgaggctgcagt

SEQ ID NO: 46312 - DNA, 22 bp, Homo sapiens
gtgagtaaaggttcattgaatt

SEQ ID NO: 46313 - DNA, 22 bp, Homo sapiens
acaactccttcttgggtcctgg

SEQ ID NO: 46314 - DNA, 22 bp, Homo sapiens
ccaagctacttaggagtctgag

SEQ ID NO: 46315 - DNA, 22 bp, Homo sapiens
ctcccagccttcgccagtctga

SEQ ID NO: 46316 - DNA, 22 bp, Homo sapiens
ccggtgttcaaagtctggtatg

SEQ ID NO: 46317 - DNA, 22 bp, Homo sapiens
agtgccttcagatttgccccag

SEQ ID NO: 46318 - DNA, 22 bp, Homo sapiens
ctctcgccagcggggctgcgct

SEQ ID NO: 46319 - DNA, 22 bp, Homo sapiens
ccttcccatgcagcctgtctga

SEQ ID NO: 46320 - DNA, 22 bp, Homo sapiens
agaatgggggctacaggccaca

SEQ ID NO: 46321 - DNA, 22 bp, Homo sapiens
ctgggaggtggaggttgcattg

SEQ ID NO: 46322 - DNA, 22 bp, Homo sapiens
cctgcgggctgtgctgaagcct

SEQ ID NO: 46323 - DNA, 20 bp, Homo sapiens
tgggatcgaatcaagtctgt

SEQ ID NO: 46324 - DNA, 22 bp, Homo sapiens
gaggctgaggcggatggatcac

SEQ ID NO: 46325 - DNA, 22 bp, Homo sapiens
atgtgagtgctatgatagacag

SEQ ID NO: 46326 - DNA, 22 bp, Homo sapiens
gtagttctgcagtgtcacctga

SEQ ID NO: 46327 - DNA, 20 bp, Homo sapiens
taagcatagttgtcagggtc

SEQ ID NO: 46328 - DNA, 22 bp, Homo sapiens
tgtctcctcggctgtccagcca

SEQ ID NO: 46329 - DNA, 22 bp, Homo sapiens
ttgagaaccactgagttagata

SEQ ID NO: 46330 - DNA, 22 bp, Homo sapiens
aggaaaatggaccagagttgtt

SEQ ID NO: 46331 - DNA, 22 bp, Homo sapiens
ggctgtggagctgcagagttgg

SEQ ID NO: 46332 - DNA, 22 bp, Homo sapiens
aaggtccttttgcagtgtgatc

SEQ ID NO: 46333 - DNA, 22 bp, Homo sapiens
actgcaaagggaagccctttct

SEQ ID NO: 46334 - DNA, 22 bp, Homo sapiens
aagcagagaatctgggagcgag

SEQ ID NO: 46335 - DNA, 22 bp, Homo sapiens
tttctcttcactgtgtgcctca

SEQ ID NO: 46336 - DNA, 22 bp, Homo sapiens
ggcgcccccttcaaacagagca

SEQ ID NO: 46337 - DNA, 20 bp, Homo sapiens
gacatgtctttctcacacaa

SEQ ID NO: 46338 - DNA, 22 bp, Homo sapiens
ggctgccttccctgagccccgg

SEQ ID NO: 46339 - DNA, 22 bp, Homo sapiens
cctagagctctgctttatctaa

SEQ ID NO: 46340 - DNA, 18 bp, Homo sapiens
tcaagtgattctcctgcc

SEQ ID NO: 46341 - DNA, 22 bp, Homo sapiens
tcagccccacggggtcagccaa

SEQ ID NO: 46342 - DNA, 22 bp, Homo sapiens
cacccaggttggagtgcagtgg

SEQ ID NO: 46343 - DNA, 22 bp, Homo sapiens
agggatggagtgcggcccggac

SEQ ID NO: 46344 - DNA, 22 bp, Homo sapiens
gtctttatttgagattgtcatt

SEQ ID NO: 46345 - DNA, 22 bp, Homo sapiens
gcaagacctatctagttgctgt

SEQ ID NO: 46346 - DNA, 22 bp, Homo sapiens
cctggctgacagcttaattcca

SEQ ID NO: 46347 - DNA, 22 bp, Homo sapiens
tcccagagctctggaggttgga

SEQ ID NO: 46348 - DNA, 17 bp, Homo sapiens
ggctgcagtccaggagg

SEQ ID NO: 46349 - DNA, 22 bp, Homo sapiens
atgttgtgtttgactgttaccc

SEQ ID NO: 46350 - DNA, 22 bp, Homo sapiens
gccagccagaaacgtcacactg

SEQ ID NO: 46351 - DNA, 22 bp, Homo sapiens
gctcttgtcaaaaattagttga

SEQ ID NO: 46352 - DNA, 22 bp, Homo sapiens
tgttccagatttagccaaccga

SEQ ID NO: 46353 - DNA, 22 bp, Homo sapiens
ccaggaggtggaggttgcggtg

SEQ ID NO: 46354 - DNA, 22 bp, Homo sapiens
cctgggccctcaccgccggtgg

SEQ ID NO: 46355 - DNA, 22 bp, Homo sapiens
tgatatgggaaaagggctcgga

SEQ ID NO: 46356 - DNA, 22 bp, Homo sapiens
ctgggatgcggaggttgcggtg

SEQ ID NO: 46357 - DNA, 22 bp, Homo sapiens
cggaggttgaggctgcagtgag

SEQ ID NO: 46358 - DNA, 22 bp, Homo sapiens
gtccaagagtcaagaagggggc

SEQ ID NO: 46359 - DNA, 22 bp, Homo sapiens
gtcgtggagctcacagtgtgcc

SEQ ID NO: 46360 - DNA, 22 bp, Homo sapiens
tggcgcgacgtgccccctgctt

SEQ ID NO: 46361 - DNA, 23 bp, Homo sapiens
aggatgtaggatgtatggcagag

SEQ ID NO: 46362 - DNA, 22 bp, Homo sapiens
tgctgggattacagtcatgagc

SEQ ID NO: 46363 - DNA, 22 bp, Homo sapiens
gtatgtgaggttggtttccagg

SEQ ID NO: 46364 - DNA, 22 bp, Homo sapiens
atgcattgtcaggcaatttcat

SEQ ID NO: 46365 - DNA, 22 bp, Homo sapiens
cactgcactccagcctgggaga

SEQ ID NO: 46366 - DNA, 20 bp, Homo sapiens
ttcgctgggagtggccaggc

SEQ ID NO: 46367 - DNA, 22 bp, Homo sapiens
caaagttgcagttatgtgatta

SEQ ID NO: 46368 - DNA, 22 bp, Homo sapiens
tgctccatgcgctcggccggcg

SEQ ID NO: 46369 - DNA, 22 bp, Homo sapiens
tttgttttcaatgtgtcattca

SEQ ID NO: 46370 - DNA, 22 bp, Homo sapiens
tcactgcactccagcctgggtg

SEQ ID NO: 46371 - DNA, 22 bp, Homo sapiens
aagctgcagcacagagaggtgg

SEQ ID NO: 46372 - DNA, 22 bp, Homo sapiens
gtggggtagatctttctcagga

SEQ ID NO: 46373 - DNA, 22 bp, Homo sapiens
cagcctgtagtctggtccaggt

SEQ ID NO: 46374 - DNA, 22 bp, Homo sapiens
tgttgagtatatacctacaagt

SEQ ID NO: 46375 - DNA, 22 bp, Homo sapiens
atgcccaatgtcacaatttttg

SEQ ID NO: 46376 - DNA, 22 bp, Homo sapiens
agccccttgtgggcgcacagca

SEQ ID NO: 46377 - DNA, 22 bp, Homo sapiens
agagggtgggcacgtgatggat

SEQ ID NO: 46378 - DNA, 22 bp, Homo sapiens
ggcctgtaatcccagctactca

SEQ ID NO: 46379 - DNA, 22 bp, Homo sapiens
gctgcagtgagccaagatcgtg

SEQ ID NO: 46380 - DNA, 22 bp, Homo sapiens
gccagtggtcactgaggaagaa

SEQ ID NO: 46381 - DNA, 21 bp, Homo sapiens
aggcttggatctagacaggcc

SEQ ID NO: 46382 - DNA, 22 bp, Homo sapiens
aaacccagggttttgtcttccc

SEQ ID NO: 46383 - DNA, 22 bp, Homo sapiens
aaagatcacgtcccaggactcg

SEQ ID NO: 46384 - DNA, 22 bp, Homo sapiens
gggaatgtagcaaatctgcaat

SEQ ID NO: 46385 - DNA, 22 bp, Homo sapiens
ccagtgtgcattatcatgtgtc

SEQ ID NO: 46386 - DNA, 22 bp, Homo sapiens
gggagctgaaggagccggcggg

SEQ ID NO: 46387 - DNA, 22 bp, Homo sapiens
aggtgtcccggcctgcggggct

SEQ ID NO: 46388 - DNA, 18 bp, Homo sapiens
cagggctgtggggtcact

SEQ ID NO: 46389 - DNA, 21 bp, Homo sapiens
tctcttcctccgcgccgccgc

SEQ ID NO: 46390 - DNA, 22 bp, Homo sapiens
gtcactgtatccaggttccagc

SEQ ID NO: 46391 - DNA, 22 bp, Homo sapiens
tggagaagattggtcaccattc

SEQ ID NO: 46392 - DNA, 22 bp, Homo sapiens
cctggcactgctgaagtcctgg

SEQ ID NO: 46393 - DNA, 22 bp, Homo sapiens
tgggaggccaaggcaggcggat

SEQ ID NO: 46394 - DNA, 22 bp, Homo sapiens
tggaagacaatttgaaaacatt

SEQ ID NO: 46395 - DNA, 22 bp, Homo sapiens
gtcaccttgaacaggctactca

SEQ ID NO: 46396 - DNA, 23 bp, Homo sapiens
ccaagactgttaggagtggggag

SEQ ID NO: 46397 - DNA, 22 bp, Homo sapiens
tacgttttaaacacggagccag

SEQ ID NO: 46398 - DNA, 22 bp, Homo sapiens
acaaagtgctgacattacaggc

SEQ ID NO: 46399 - DNA, 22 bp, Homo sapiens
aattttctggtgtgtaatgaag

SEQ ID NO: 46400 - DNA, 22 bp, Homo sapiens
tgtgactggttgtcccgctttc

SEQ ID NO: 46401 - DNA, 22 bp, Homo sapiens
tgtacacatggtgtacactccc

SEQ ID NO: 46402 - DNA, 22 bp, Homo sapiens
ccatgaattcactccatgctag

SEQ ID NO: 46403 - DNA, 22 bp, Homo sapiens
agccctggtttgcagcatttgc

SEQ ID NO: 46404 - DNA, 22 bp, Homo sapiens
gataccagacagggagggagaa

SEQ ID NO: 46405 - DNA, 22 bp, Homo sapiens
aagaaatgctgatgttggatgg

SEQ ID NO: 46406 - DNA, 21 bp, Homo sapiens
ctcccagggtgactgttcaac

SEQ ID NO: 46407 - DNA, 22 bp, Homo sapiens
ctggcaggagcattcacagagg

SEQ ID NO: 46408 - DNA, 22 bp, Homo sapiens
gcccatgcactttctgtgatgg

SEQ ID NO: 46409 - DNA, 22 bp, Homo sapiens
ccaggaggttgaggctgcagtg

SEQ ID NO: 46410 - DNA, 22 bp, Homo sapiens
aggccagcctcaggcagggacc

SEQ ID NO: 46411 - DNA, 22 bp, Homo sapiens
gattgtggaagtcagtggttct

SEQ ID NO: 46412 - DNA, 22 bp, Homo sapiens
tcatcttcctcatttctccagg

SEQ ID NO: 46413 - DNA, 22 bp, Homo sapiens
tggaaacacccacgcatgcata

SEQ ID NO: 46414 - DNA, 22 bp, Homo sapiens
ctgaggaaggctgggggcatcc

SEQ ID NO: 46415 - DNA, 22 bp, Homo sapiens
actgccaatggtagtttgatgg

SEQ ID NO: 46416 - DNA, 22 bp, Homo sapiens
tctcagggctcagagctcaggc

SEQ ID NO: 46417 - DNA, 22 bp, Homo sapiens
gttattgaggtggagtctcact

SEQ ID NO: 46418 - DNA, 22 bp, Homo sapiens
tcaccaggctggagtgcagtgg

SEQ ID NO: 46419 - DNA, 18 bp, Homo sapiens
acacttcctggtggtgtg

SEQ ID NO: 46420 - DNA, 22 bp, Homo sapiens
gtgaggtggtacaatattaact

SEQ ID NO: 46421 - DNA, 22 bp, Homo sapiens
atgttctacagatggaaagggg

SEQ ID NO: 46422 - DNA, 22 bp, Homo sapiens
cacgggagacgtgatcttggac

SEQ ID NO: 46423 - DNA, 23 bp, Homo sapiens
tgagctgggcctgcaggggtctc

SEQ ID NO: 46424 - DNA, 22 bp, Homo sapiens
gcccagccacagtcactttcat

SEQ ID NO: 46425 - DNA, 22 bp, Homo sapiens
actttcttggtcccatgtttga

SEQ ID NO: 46426 - DNA, 22 bp, Homo sapiens
acctggccagtggggccgcgct

SEQ ID NO: 46427 - DNA, 22 bp, Homo sapiens
aaggcaggatgggaaaagattt

SEQ ID NO: 46428 - DNA, 22 bp, Homo sapiens
gctgccaatccagctgtgggag

SEQ ID NO: 46429 - DNA, 22 bp, Homo sapiens
aggggtgaaagagggccctcaa

SEQ ID NO: 46430 - DNA, 22 bp, Homo sapiens
taattcttcaggccttttgtct

SEQ ID NO: 46431 - DNA, 22 bp, Homo sapiens
aaagcctcccaggttatgagta

SEQ ID NO: 46432 - DNA, 22 bp, Homo sapiens
ccctggctgataccggaaaggc

SEQ ID NO: 46433 - DNA, 23 bp, Homo sapiens
actctcaggttctttccagcagg

SEQ ID NO: 46434 - DNA, 22 bp, Homo sapiens
aagaggttgtctgtgatgagtt

SEQ ID NO: 46435 - DNA, 18 bp, Homo sapiens
tgtccctgcaaataacat

SEQ ID NO: 46436 - DNA, 22 bp, Homo sapiens
acccaggccattggcaagagtc

SEQ ID NO: 46437 - DNA, 19 bp, Homo sapiens
tgcctgctgtattccagag

SEQ ID NO: 46438 - DNA, 22 bp, Homo sapiens
tatggctaattctttactgacc

SEQ ID NO: 46439 - DNA, 22 bp, Homo sapiens
ggttggtaactccctgtgcagt

SEQ ID NO: 46440 - DNA, 22 bp, Homo sapiens
gccgtccacctcgatggccact

SEQ ID NO: 46441 - DNA, 23 bp, Homo sapiens
gcctgggagttgcgatctgcccg

SEQ ID NO: 46442 - DNA, 22 bp, Homo sapiens
ggtgccaggctgtagtcagggt

SEQ ID NO: 46443 - DNA, 22 bp, Homo sapiens
aatactgcctgtgaggtaactc

SEQ ID NO: 46444 - DNA, 22 bp, Homo sapiens
cgtgtggtcccggcaaggcaag

SEQ ID NO: 46445 - DNA, 22 bp, Homo sapiens
taaaatttgtccctgagtgttg

SEQ ID NO: 46446 - DNA, 22 bp, Homo sapiens
tgtcctcatcctccagtctgtc

SEQ ID NO: 46447 - DNA, 22 bp, Homo sapiens
gaggacaagctgtgagtggggt

SEQ ID NO: 46448 - DNA, 22 bp, Homo sapiens
ttcacagtggtagtgcatttag

SEQ ID NO: 46449 - DNA, 22 bp, Homo sapiens
gggagtgggtttggcctaggcc

SEQ ID NO: 46450 - DNA, 22 bp, Homo sapiens
ttctccgctaagttctctgcag

SEQ ID NO: 46451 - DNA, 22 bp, Homo sapiens
ttactttgcttcaggaagagga

SEQ ID NO: 46452 - DNA, 19 bp, Homo sapiens
ccctcttgcacaaagcaaa

SEQ ID NO: 46453 - DNA, 20 bp, Homo sapiens
aaaatatgtataactcttct

SEQ ID NO: 46454 - DNA, 20 bp, Homo sapiens
tgacatagctcttggggtgc

SEQ ID NO: 46455 - DNA, 22 bp, Homo sapiens
tgagagttctctcttcaggtgg

SEQ ID NO: 46456 - DNA, 22 bp, Homo sapiens
tcaggctcaggttaggggccaa

SEQ ID NO: 46457 - DNA, 22 bp, Homo sapiens
cccagctcttcaagtcaccccc

SEQ ID NO: 46458 - DNA, 22 bp, Homo sapiens
cgcaccactgaattccagcctg

SEQ ID NO: 46459 - DNA, 22 bp, Homo sapiens
tcttgaacttctgcacactcag

SEQ ID NO: 46460 - DNA, 22 bp, Homo sapiens
cccgggaggtggaggttgcagt

SEQ ID NO: 46461 - DNA, 22 bp, Homo sapiens
cactctcacatgccctgtcagt

SEQ ID NO: 46462 - DNA, 22 bp, Homo sapiens
ccagtgtgcaatctctggctta

SEQ ID NO: 46463 - DNA, 22 bp, Homo sapiens
gacaggaggcagagctcaggtg

SEQ ID NO: 46464 - DNA, 22 bp, Homo sapiens
cccaggagttggaggctgcagt

SEQ ID NO: 46465 - DNA, 22 bp, Homo sapiens
gtcccctgtccagggccagcca

SEQ ID NO: 46466 - DNA, 22 bp, Homo sapiens
tgacatgtatatcttacgctat

SEQ ID NO: 46467 - DNA, 22 bp, Homo sapiens
cctggggccccgagccagaagc

SEQ ID NO: 46468 - DNA, 22 bp, Homo sapiens
ggcgagaagttgttagtggctt

SEQ ID NO: 46469 - DNA, 22 bp, Homo sapiens
gcaggcattagcccccatggct

SEQ ID NO: 46470 - DNA, 22 bp, Homo sapiens
aatttaagagcatagctccaac

SEQ ID NO: 46471 - DNA, 22 bp, Homo sapiens
actctgctctgtatttcactgt

SEQ ID NO: 46472 - DNA, 22 bp, Homo sapiens
ttccacattccttacattcata

SEQ ID NO: 46473 - DNA, 22 bp, Homo sapiens
gagccaggaggcagagactgca

SEQ ID NO: 46474 - DNA, 22 bp, Homo sapiens
acagtcttcagaagggattggg

SEQ ID NO: 46475 - DNA, 22 bp, Homo sapiens
agaaatcctgatggagtctgaa

SEQ ID NO: 46476 - DNA, 22 bp, Homo sapiens
aaactgaggctcccgagggtgt

SEQ ID NO: 46477 - DNA, 22 bp, Homo sapiens
agaatagaattctcatagaatt

SEQ ID NO: 46478 - DNA, 22 bp, Homo sapiens
actcaaatagcaacggtgagaa

SEQ ID NO: 46479 - DNA, 22 bp, Homo sapiens
ttttctcttccctctggacctg

SEQ ID NO: 46480 - DNA, 22 bp, Homo sapiens
tctgcgcgctgctggtaccgaa

SEQ ID NO: 46481 - DNA, 22 bp, Homo sapiens
tcgtggaatatggatgcttgtc

SEQ ID NO: 46482 - DNA, 22 bp, Homo sapiens
gccgggttcaagccattctcct

SEQ ID NO: 46483 - DNA, 19 bp, Homo sapiens
tctcacagctctactatgt

SEQ ID NO: 46484 - DNA, 22 bp, Homo sapiens
aggcaacttttggggatgatgg

SEQ ID NO: 46485 - DNA, 22 bp, Homo sapiens
gtaatctcagctacttgggagg

SEQ ID NO: 46486 - DNA, 18 bp, Homo sapiens
tccatgcacatagccccc

SEQ ID NO: 46487 - DNA, 22 bp, Homo sapiens
aggtggagaagagatgggcagt

SEQ ID NO: 46488 - DNA, 22 bp, Homo sapiens
gagaggaagccttctgtacttg

SEQ ID NO: 46489 - DNA, 22 bp, Homo sapiens
atcatccaagcgtagttcttct

SEQ ID NO: 46490 - DNA, 22 bp, Homo sapiens
gccttgtttctctcccagataa

SEQ ID NO: 46491 - DNA, 22 bp, Homo sapiens
tggaggttgggatgcttgtgat

SEQ ID NO: 46492 - DNA, 22 bp, Homo sapiens
gcacatgcatgcatattcctgg

SEQ ID NO: 46493 - DNA, 22 bp, Homo sapiens
ggaatcgttaggtaagcaggga

SEQ ID NO: 46494 - DNA, 20 bp, Homo sapiens
ttgttagaggaatgccatag

SEQ ID NO: 46495 - DNA, 22 bp, Homo sapiens
agcataagttggtacagccact

SEQ ID NO: 46496 - DNA, 22 bp, Homo sapiens
tgtgcccaacgtgcaggtttgt

SEQ ID NO: 46497 - DNA, 22 bp, Homo sapiens
atgatggctaggctggttttga

SEQ ID NO: 46498 - DNA, 22 bp, Homo sapiens
agatggagtctcactcttgttg

SEQ ID NO: 46499 - DNA, 23 bp, Homo sapiens
gttttacaggtgagaaaatggag

SEQ ID NO: 46500 - DNA, 22 bp, Homo sapiens
gcctgggtccaccgctcgcgct

SEQ ID NO: 46501 - DNA, 22 bp, Homo sapiens
aaattacagccttgggtagctt

SEQ ID NO: 46502 - DNA, 22 bp, Homo sapiens
ggctcactgcaacctctgcctc

SEQ ID NO: 46503 - DNA, 22 bp, Homo sapiens
cacagcctcctctggctcacgg

SEQ ID NO: 46504 - DNA, 22 bp, Homo sapiens
gagggagggactagcattctct

SEQ ID NO: 46505 - DNA, 22 bp, Homo sapiens
ttggagatatcacaccttcaca

SEQ ID NO: 46506 - DNA, 22 bp, Homo sapiens
gtggttttattcgttcctctgt

SEQ ID NO: 46507 - DNA, 22 bp, Homo sapiens
acaaggcactttatgaagagga

SEQ ID NO: 46508 - DNA, 22 bp, Homo sapiens
gagccaagctcttctccatgag

SEQ ID NO: 46509 - DNA, 22 bp, Homo sapiens
gaagtgtagtcttgagccccca

SEQ ID NO: 46510 - DNA, 22 bp, Homo sapiens
tcacagctcactgtagcctcga

SEQ ID NO: 46511 - DNA, 22 bp, Homo sapiens
caggtggtcaggcaaggacacg

SEQ ID NO: 46512 - DNA, 22 bp, Homo sapiens
aaatgtaagtctttgtttctta

SEQ ID NO: 46513 - DNA, 22 bp, Homo sapiens
gcgactgtacagaattgcccct

SEQ ID NO: 46514 - DNA, 22 bp, Homo sapiens
ctgctcttcacactacacccgt

SEQ ID NO: 46515 - DNA, 22 bp, Homo sapiens
tgaacatgctgttgatggcctg

SEQ ID NO: 46516 - DNA, 22 bp, Homo sapiens
agcatgcgcttgatcagctcca

SEQ ID NO: 46517 - DNA, 18 bp, Homo sapiens
tgtagagccaggtttgcc

SEQ ID NO: 46518 - DNA, 22 bp, Homo sapiens
gggccatgagaggttcatcaac

SEQ ID NO: 46519 - DNA, 22 bp, Homo sapiens
gtttggggagttcctttaggcc

SEQ ID NO: 46520 - DNA, 22 bp, Homo sapiens
ctactttaacatggaggcactt

SEQ ID NO: 46521 - DNA, 22 bp, Homo sapiens
gcctggccgggtcttggatttt

SEQ ID NO: 46522 - DNA, 22 bp, Homo sapiens
gtgggtggacggtgcttttgtt

SEQ ID NO: 46523 - DNA, 22 bp, Homo sapiens
taatatctacttcatagagttt

SEQ ID NO: 46524 - DNA, 22 bp, Homo sapiens
ccaggagctggagggtgcagtg

SEQ ID NO: 46525 - DNA, 22 bp, Homo sapiens
gggaggcagtgctggaggctgg

SEQ ID NO: 46526 - DNA, 22 bp, Homo sapiens
tcccagattcctgctcttatat

SEQ ID NO: 46527 - DNA, 22 bp, Homo sapiens
tcctagttctctgccagtcgct

SEQ ID NO: 46528 - DNA, 22 bp, Homo sapiens
cccaggaggtggaggctgcagt

SEQ ID NO: 46529 - DNA, 22 bp, Homo sapiens
tcattgccatggcatttgcaga

SEQ ID NO: 46530 - DNA, 22 bp, Homo sapiens
gcccaggctggagtgcagtggt

SEQ ID NO: 46531 - DNA, 22 bp, Homo sapiens
gtggcctggctggcaccacctc

SEQ ID NO: 46532 - DNA, 22 bp, Homo sapiens
attttttgttaactcaggatag

SEQ ID NO: 46533 - DNA, 22 bp, Homo sapiens
gccagggtcctgaagaccaagt

SEQ ID NO: 46534 - DNA, 22 bp, Homo sapiens
caggaggattgcttgaggccag

SEQ ID NO: 46535 - DNA, 22 bp, Homo sapiens
aagcccttggcgcacaccgggc

SEQ ID NO: 46536 - DNA, 22 bp, Homo sapiens
tgagcttgcagtgccagccttg

SEQ ID NO: 46537 - DNA, 22 bp, Homo sapiens
caggaagctgtgaaggagacgg

SEQ ID NO: 46538 - DNA, 22 bp, Homo sapiens
tctgcaacagtgccctgtaaat

SEQ ID NO: 46539 - DNA, 19 bp, Homo sapiens
ttttggaaatgtgaacagc

SEQ ID NO: 46540 - DNA, 22 bp, Homo sapiens
tgtgaatggacaattaaatcta

SEQ ID NO: 46541 - DNA, 22 bp, Homo sapiens
actaggggctcaggcccaggga

SEQ ID NO: 46542 - DNA, 22 bp, Homo sapiens
acctgcaggcacaggtgtgcgc

SEQ ID NO: 46543 - DNA, 22 bp, Homo sapiens
aaagtgctgggattccaggcgt

SEQ ID NO: 46544 - DNA, 23 bp, Homo sapiens
gtgccgacgctccagcaccatcc

SEQ ID NO: 46545 - DNA, 22 bp, Homo sapiens
aagacactcattatcactggtt

SEQ ID NO: 46546 - DNA, 22 bp, Homo sapiens
cccaggaattggaggctgcagt

SEQ ID NO: 46547 - DNA, 20 bp, Homo sapiens
ctgtggaattttaccatgcg

SEQ ID NO: 46548 - DNA, 22 bp, Homo sapiens
ggagtgcagtggcgtgatctcg

SEQ ID NO: 46549 - DNA, 22 bp, Homo sapiens
tgcagcaccgtcccactggcta

SEQ ID NO: 46550 - DNA, 22 bp, Homo sapiens
atgctaaggcccaggagaaaat

SEQ ID NO: 46551 - DNA, 16 bp, Homo sapiens
gcaggcagatcacatg

SEQ ID NO: 46552 - DNA, 22 bp, Homo sapiens
tccacaggtccggcatgaacag

SEQ ID NO: 46553 - DNA, 22 bp, Homo sapiens
cctcttctaggacgtccttgtg

SEQ ID NO: 46554 - DNA, 22 bp, Homo sapiens
gctgctaagcgtttctgttcca

SEQ ID NO: 46555 - DNA, 22 bp, Homo sapiens
ataaaaactgacccatcctttg

SEQ ID NO: 46556 - DNA, 22 bp, Homo sapiens
tccacgtgagcttcgtgtgcag

SEQ ID NO: 46557 - DNA, 22 bp, Homo sapiens
tttctcctcatgactggttgtg

SEQ ID NO: 46558 - DNA, 21 bp, Homo sapiens
ctctgaatcctgcttctcagt

SEQ ID NO: 46559 - DNA, 22 bp, Homo sapiens
cttctcttcctttgtcaactga

SEQ ID NO: 46560 - DNA, 22 bp, Homo sapiens
catgctgggtaaaggtggtgaa

SEQ ID NO: 46561 - DNA, 22 bp, Homo sapiens
atcttgttaaaaagcagattct

SEQ ID NO: 46562 - DNA, 22 bp, Homo sapiens
taatggttttttggagactgct

SEQ ID NO: 46563 - DNA, 22 bp, Homo sapiens
aggctgaggcaagaggatcact

SEQ ID NO: 46564 - DNA, 22 bp, Homo sapiens
ggtttgtggagctggaaacact

SEQ ID NO: 46565 - DNA, 22 bp, Homo sapiens
agcctggcctgggcaggcacat

SEQ ID NO: 46566 - DNA, 22 bp, Homo sapiens
taactctgaatcctcacagcag

SEQ ID NO: 46567 - DNA, 22 bp, Homo sapiens
gccgggaccaaggccacggagc

SEQ ID NO: 46568 - DNA, 22 bp, Homo sapiens
ctccagttggccccagttggtt

SEQ ID NO: 46569 - DNA, 22 bp, Homo sapiens
gagctcatccccatggtccgtc

SEQ ID NO: 46570 - DNA, 22 bp, Homo sapiens
ggggttaacagtattgctcatg

SEQ ID NO: 46571 - DNA, 22 bp, Homo sapiens
tcactgcacttcagcttgggca

SEQ ID NO: 46572 - DNA, 22 bp, Homo sapiens
ggggccttggatctgtgccccg

SEQ ID NO: 46573 - DNA, 22 bp, Homo sapiens
tgcctctgaggaagattgtgtt

SEQ ID NO: 46574 - DNA, 22 bp, Homo sapiens
actgatcaagggtttaatttta

SEQ ID NO: 46575 - DNA, 22 bp, Homo sapiens
aggtgcttggctcgtgcacaca

SEQ ID NO: 46576 - DNA, 22 bp, Homo sapiens
gcggcccgagcaggacgggtgg

SEQ ID NO: 46577 - DNA, 18 bp, Homo sapiens
agctccatctgtcagcat

SEQ ID NO: 46578 - DNA, 22 bp, Homo sapiens
ttcttctcagggtcccacatgg

SEQ ID NO: 46579 - DNA, 22 bp, Homo sapiens
tgtctccaccatcatcttacca

SEQ ID NO: 46580 - DNA, 22 bp, Homo sapiens
gagccaggttggaggctgcagt

SEQ ID NO: 46581 - DNA, 22 bp, Homo sapiens
gaggagctgcccgtgtgtctgc

SEQ ID NO: 46582 - DNA, 22 bp, Homo sapiens
ctgtatttcttggacagttgct

SEQ ID NO: 46583 - DNA, 22 bp, Homo sapiens
gtgggccagcttttctcctggg

SEQ ID NO: 46584 - DNA, 22 bp, Homo sapiens
aataaacaaatccttccttccc

SEQ ID NO: 46585 - DNA, 22 bp, Homo sapiens
ttacgcagctgctccaggaagc

SEQ ID NO: 46586 - DNA, 22 bp, Homo sapiens
gcccatgaggtggaggctgcag

SEQ ID NO: 46587 - DNA, 20 bp, Homo sapiens
ggtcactgtggctgcaggat

SEQ ID NO: 46588 - DNA, 17 bp, Homo sapiens
ccctcactcctgccggg

SEQ ID NO: 46589 - DNA, 22 bp, Homo sapiens
ggagtgcagtggcgtgagctcg

SEQ ID NO: 46590 - DNA, 22 bp, Homo sapiens
tttcagatggaggtttaggaca

SEQ ID NO: 46591 - DNA, 22 bp, Homo sapiens
caggaggagggcagccgcctcc

SEQ ID NO: 46592 - DNA, 20 bp, Homo sapiens
gggcagagccagccagtccc

SEQ ID NO: 46593 - DNA, 22 bp, Homo sapiens
gctgccaatccagctgtgggag

SEQ ID NO: 46594 - DNA, 22 bp, Homo sapiens
aggggaatgggtagactgttga

SEQ ID NO: 46595 - DNA, 22 bp, Homo sapiens
ggaggcggaggttgcagtgagc

SEQ ID NO: 46596 - DNA, 22 bp, Homo sapiens
ctgggaggcggagcttgcagtg

SEQ ID NO: 46597 - DNA, 22 bp, Homo sapiens
aggaagatgtgcaaagttggaa

SEQ ID NO: 46598 - DNA, 22 bp, Homo sapiens
aggtgcttggctcgtgcacaca

SEQ ID NO: 46599 - DNA, 22 bp, Homo sapiens
gccagcagcttcttctcatcct

SEQ ID NO: 46600 - DNA, 22 bp, Homo sapiens
atggccctaatgagttggtgtt

SEQ ID NO: 46601 - DNA, 22 bp, Homo sapiens
agaggcagtatacaatccgagc

SEQ ID NO: 46602 - DNA, 22 bp, Homo sapiens
tgtgggagaaggaagcaagctg

SEQ ID NO: 46603 - DNA, 22 bp, Homo sapiens
ttccagctaactcacatccctt

SEQ ID NO: 46604 - DNA, 22 bp, Homo sapiens
tgggagtgtaaattagttcaac

SEQ ID NO: 46605 - DNA, 22 bp, Homo sapiens
ggaggaggggtgactgaatgct

SEQ ID NO: 46606 - DNA, 21 bp, Homo sapiens
gcccacagtgaggaggatccc

SEQ ID NO: 46607 - DNA, 22 bp, Homo sapiens
gggaaggccttgtcagcggatt

SEQ ID NO: 46608 - DNA, 22 bp, Homo sapiens
tggggagtgatgcctcggataa

SEQ ID NO: 46609 - DNA, 22 bp, Homo sapiens
tgaacatgctgttgatggcctg

SEQ ID NO: 46610 - DNA, 22 bp, Homo sapiens
cagtcactggaatagctgagga

SEQ ID NO: 46611 - DNA, 22 bp, Homo sapiens
catggggcccatgtgctccaag

SEQ ID NO: 46612 - DNA, 22 bp, Homo sapiens
ctgtatttcttggacagttgct

SEQ ID NO: 46613 - DNA, 23 bp, Homo sapiens
ggagtgcaatggcgccatctcgg

SEQ ID NO: 46614 - DNA, 22 bp, Homo sapiens
catgttggtgtgctgcacccgt

SEQ ID NO: 46615 - DNA, 22 bp, Homo sapiens
ttggagaggcagtcttgctctg

SEQ ID NO: 46616 - DNA, 22 bp, Homo sapiens
aggtgcatctcgtagctcttct

SEQ ID NO: 46617 - DNA, 22 bp, Homo sapiens
acccagccatgttcagttctct

SEQ ID NO: 46618 - DNA, 22 bp, Homo sapiens
tacagtgcttggtatctagtaa

SEQ ID NO: 46619 - DNA, 22 bp, Homo sapiens
ccaggaggttgaggctgcagtg

SEQ ID NO: 46620 - DNA, 22 bp, Homo sapiens
aaacccagggttttgtcttccc

SEQ ID NO: 46621 - DNA, 22 bp, Homo sapiens
cagccccacacggtctagctct

SEQ ID NO: 46622 - DNA, 22 bp, Homo sapiens
ccaggaggcagaagttgcagtg

SEQ ID NO: 46623 - DNA, 22 bp, Homo sapiens
ctgaggagaggtggcctgtgtt

SEQ ID NO: 46624 - DNA, 22 bp, Homo sapiens
cggctggtgtcgggcacagcaa

SEQ ID NO: 46625 - DNA, 22 bp, Homo sapiens
gggtggtggccagcagtgggca

SEQ ID NO: 46626 - DNA, 22 bp, Homo sapiens
tccttaggaaaatgatgagggg

SEQ ID NO: 46627 - DNA, 22 bp, Homo sapiens
cgtgccactgcactccagtctg

SEQ ID NO: 46628 - DNA, 22 bp, Homo sapiens
agggatggagtgcggcccggac

SEQ ID NO: 46629 - DNA, 22 bp, Homo sapiens
ggctgggcctctccctcagctg

SEQ ID NO: 46630 - DNA, 21 bp, Homo sapiens
gggcagaggggcctcctgggt

SEQ ID NO: 46631 - DNA, 22 bp, Homo sapiens
agaggaggctctgggatcgtcc

SEQ ID NO: 46632 - DNA, 20 bp, Homo sapiens
aggccccaggtggacactag

SEQ ID NO: 46633 - DNA, 22 bp, Homo sapiens
gcgaggaggggtgctgggcccc

SEQ ID NO: 46634 - DNA, 22 bp, Homo sapiens
gaggtggccaagcgaggaaggg

SEQ ID NO: 46635 - DNA, 22 bp, Homo sapiens
aggagcaccattgtgctggtgt

SEQ ID NO: 46636 - DNA, 22 bp, Homo sapiens
cccaggggttctgagcagcagc

SEQ ID NO: 46637 - DNA, 22 bp, Homo sapiens
tggcccagtatgtataatctta

SEQ ID NO: 46638 - DNA, 22 bp, Homo sapiens
caggaggattgcttgaggccag

SEQ ID NO: 46639 - DNA, 22 bp, Homo sapiens
tggctccacaggccagggtgtg

SEQ ID NO: 46640 - DNA, 22 bp, Homo sapiens
ccaggaggcggaggttgcagtg

SEQ ID NO: 46641 - DNA, 20 bp, Homo sapiens
ggggaagtcactgcagtcag

SEQ ID NO: 46642 - DNA, 22 bp, Homo sapiens
gaggttggggctgcagtgagct

SEQ ID NO: 46643 - DNA, 22 bp, Homo sapiens
ttggagagtgatattcagatgc

SEQ ID NO: 46644 - DNA, 22 bp, Homo sapiens
aagtgtgtgagcctgtcaggct

SEQ ID NO: 46645 - DNA, 22 bp, Homo sapiens
caggaagaccagggctgtggct

SEQ ID NO: 46646 - DNA, 22 bp, Homo sapiens
gcagcctgggcaacagagtgag

SEQ ID NO: 46647 - DNA, 22 bp, Homo sapiens
gcttagtcaattataaataggc

SEQ ID NO: 46648 - DNA, 22 bp, Homo sapiens
tgggcagggagctggaaccaca

SEQ ID NO: 46649 - DNA, 22 bp, Homo sapiens
gctctgagtcacactgccctgt

SEQ ID NO: 46650 - DNA, 22 bp, Homo sapiens
ggggctgaacctggaggtggtc

SEQ ID NO: 46651 - DNA, 20 bp, Homo sapiens
gttaggaggttggacatgga

SEQ ID NO: 46652 - DNA, 22 bp, Homo sapiens
gccgtggggagagagggtgcgt

SEQ ID NO: 46653 - DNA, 22 bp, Homo sapiens
gaggggcacagtaaagggtccc

SEQ ID NO: 46654 - DNA, 21 bp, Homo sapiens
ctctgaatcctgcttctcagt

SEQ ID NO: 46655 - DNA, 22 bp, Homo sapiens
acaggggcaagggctcacggcc

SEQ ID NO: 46656 - DNA, 22 bp, Homo sapiens
tgtaggagtccaatcaggagac

SEQ ID NO: 46657 - DNA, 22 bp, Homo sapiens
tgagatcattgacttgttcctg

SEQ ID NO: 46658 - DNA, 22 bp, Homo sapiens
caagctgaacactgtcttcaag

SEQ ID NO: 46659 - DNA, 22 bp, Homo sapiens
tattctcatcatcactggagct

SEQ ID NO: 46660 - DNA, 22 bp, Homo sapiens
ggcagggcaggaaagtcaggaa

SEQ ID NO: 46661 - DNA, 22 bp, Homo sapiens
gctgtgtatcagatgccacggg

SEQ ID NO: 46662 - DNA, 22 bp, Homo sapiens
tgaggcaggagttcaggctgcg

SEQ ID NO: 46663 - DNA, 22 bp, Homo sapiens
ctgggaggcggaggttgcagtg

SEQ ID NO: 46664 - DNA, 22 bp, Homo sapiens
cccagcaggaggaggttgcagt

SEQ ID NO: 46665 - DNA, 22 bp, Homo sapiens
tgcctcagctgaggccgctcca

SEQ ID NO: 46666 - DNA, 23 bp, Homo sapiens
atgggccaagcaagacccatgac

SEQ ID NO: 46667 - DNA, 22 bp, Homo sapiens
ggggtgggcgtgcagggacacc

SEQ ID NO: 46668 - DNA, 22 bp, Homo sapiens
gatggtgcaggtgaagtgctgg

SEQ ID NO: 46669 - DNA, 22 bp, Homo sapiens
cacagctgtgagaagggagcct

SEQ ID NO: 46670 - DNA, 22 bp, Homo sapiens
actgaataaggtgaatgctctg

SEQ ID NO: 46671 - DNA, 22 bp, Homo sapiens
ccaggagttggaagctgccatg

SEQ ID NO: 46672 - DNA, 22 bp, Homo sapiens
tcttaattctgtgtcttcacta

SEQ ID NO: 46673 - DNA, 22 bp, Homo sapiens
tgaggcaggaggttgagaactg

SEQ ID NO: 46674 - DNA, 22 bp, Homo sapiens
gcccaggctggagtgcagtggc

SEQ ID NO: 46675 - DNA, 22 bp, Homo sapiens
tttcctcttctggcaggcaggg

SEQ ID NO: 46676 - DNA, 22 bp, Homo sapiens
agtgggccggacagcccaggcc

SEQ ID NO: 46677 - DNA, 22 bp, Homo sapiens
agtgagagtattaatgtgaact

SEQ ID NO: 46678 - DNA, 23 bp, Homo sapiens
tgctggagaagcaaagttctgag

SEQ ID NO: 46679 - DNA, 22 bp, Homo sapiens
catgagatttgggaggggccag

SEQ ID NO: 46680 - DNA, 22 bp, Homo sapiens
cctgggaggctgaggctgcagt

SEQ ID NO: 46681 - DNA, 22 bp, Homo sapiens
gggcggggggagctggaatgaa

SEQ ID NO: 46682 - DNA, 22 bp, Homo sapiens
caggcgggcaggtgcggcccct

SEQ ID NO: 46683 - DNA, 22 bp, Homo sapiens
agctcttacatttaggtctatg

SEQ ID NO: 46684 - DNA, 22 bp, Homo sapiens
tgaggcaggtggattacaaggt

SEQ ID NO: 46685 - DNA, 22 bp, Homo sapiens
gcgagggcacgcggttgaaggc

SEQ ID NO: 46686 - DNA, 22 bp, Homo sapiens
gtggggtagatctttctcagga

SEQ ID NO: 46687 - DNA, 22 bp, Homo sapiens
gagcaggaaggccagaagggtc

SEQ ID NO: 46688 - DNA, 22 bp, Homo sapiens
tccagcagtccatgtgagacac

SEQ ID NO: 46689 - DNA, 22 bp, Homo sapiens
cgaggaggaaacgcggagaact

SEQ ID NO: 46690 - DNA, 22 bp, Homo sapiens
tcaggagtgccagtaccttttg

SEQ ID NO: 46691 - DNA, 22 bp, Homo sapiens
cagccctcctaccctgccaggc

SEQ ID NO: 46692 - DNA, 22 bp, Homo sapiens
gtggtgagattgctggatcaaa

SEQ ID NO: 46693 - DNA, 22 bp, Homo sapiens
aggccgaggcgggcggatcacc

SEQ ID NO: 46694 - DNA, 22 bp, Homo sapiens
atgtcactgttgttattgttat

SEQ ID NO: 46695 - DNA, 22 bp, Homo sapiens
acagagcaataacagggagagg

SEQ ID NO: 46696 - DNA, 21 bp, Homo sapiens
cactccacttagaacagggtt

SEQ ID NO: 46697 - DNA, 22 bp, Homo sapiens
gcagctctatgtgatggtaaat

SEQ ID NO: 46698 - DNA, 23 bp, Homo sapiens
ggatggacgtgatgccttagcca

SEQ ID NO: 46699 - DNA, 22 bp, Homo sapiens
tgtccagctcgagacactatct

SEQ ID NO: 46700 - DNA, 22 bp, Homo sapiens
ccatgtggtgggaaggagaatg

SEQ ID NO: 46701 - DNA, 22 bp, Homo sapiens
ctctgagtagatagggaacctg

SEQ ID NO: 46702 - DNA, 22 bp, Homo sapiens
aggggatggagctggaaggcag

SEQ ID NO: 46703 - DNA, 22 bp, Homo sapiens
aggcaggaggatcatggatgca

SEQ ID NO: 46704 - DNA, 22 bp, Homo sapiens
tccttaggcaatttgggagagt

SEQ ID NO: 46705 - DNA, 22 bp, Homo sapiens
cccccagctctgctgggtcccg

SEQ ID NO: 46706 - DNA, 22 bp, Homo sapiens
actagaaagaagttttttgaga

SEQ ID NO: 46707 - DNA, 22 bp, Homo sapiens
tgaggcaggaggattgcaggat

SEQ ID NO: 46708 - DNA, 22 bp, Homo sapiens
caggcagggagctggaaaggat

SEQ ID NO: 46709 - DNA, 22 bp, Homo sapiens
cttgcctttgtcttcaaaggct

SEQ ID NO: 46710 - DNA, 22 bp, Homo sapiens
aggagggagcttaagccaggca

SEQ ID NO: 46711 - DNA, 22 bp, Homo sapiens
cccaggccctggcagagcttgt

SEQ ID NO: 46712 - DNA, 22 bp, Homo sapiens
ggaggtggaggttgcagtgagc

SEQ ID NO: 46713 - DNA, 22 bp, Homo sapiens
ggaggcggaggttgcagtgagt

SEQ ID NO: 46714 - DNA, 22 bp, Homo sapiens
tgacaggcaggacagaggtgtg

SEQ ID NO: 46715 - DNA, 22 bp, Homo sapiens
gtgacaggccactgcggctctg

SEQ ID NO: 46716 - DNA, 22 bp, Homo sapiens
acatacttctttacattccata

SEQ ID NO: 46717 - DNA, 22 bp, Homo sapiens
atagggcctaaaaagtattgct

SEQ ID NO: 46718 - DNA, 22 bp, Homo sapiens
aggaggggttctcgggtgctga

SEQ ID NO: 46719 - DNA, 22 bp, Homo sapiens
tgagatgtcatagttcagttca

SEQ ID NO: 46720 - DNA, 22 bp, Homo sapiens
accaggcccgctgctatggtgg

SEQ ID NO: 46721 - DNA, 22 bp, Homo sapiens
ggaaggggtgggtgagcctcag

SEQ ID NO: 46722 - DNA, 22 bp, Homo sapiens
ccaggagctggagggtgcagtg

SEQ ID NO: 46723 - DNA, 22 bp, Homo sapiens
attgcactccagcctgggggac

SEQ ID NO: 46724 - DNA, 22 bp, Homo sapiens
gcagagatctgagaaggctgcc

SEQ ID NO: 46725 - DNA, 22 bp, Homo sapiens
tgtgtctcaagtcagagcatca

SEQ ID NO: 46726 - DNA, 22 bp, Homo sapiens
tgaggcaggagaatcacatgaa

SEQ ID NO: 46727 - DNA, 22 bp, Homo sapiens
ctggggtaggaggcagctgtgc

SEQ ID NO: 46728 - DNA, 22 bp, Homo sapiens
gagtgtgtcggtcagcgtggcg

SEQ ID NO: 46729 - DNA, 18 bp, Homo sapiens
cagggctgtggggtcact

SEQ ID NO: 46730 - DNA, 22 bp, Homo sapiens
caggaggacatactggctcaca

SEQ ID NO: 46731 - DNA, 22 bp, Homo sapiens
atgtatacgtgcaggtcacagg

SEQ ID NO: 46732 - DNA, 22 bp, Homo sapiens
gacaagctcccggtggccctcc

SEQ ID NO: 46733 - DNA, 22 bp, Homo sapiens
aggagatggagctcagtgggca

SEQ ID NO: 46734 - DNA, 22 bp, Homo sapiens
ccaggaggcggaggttgcagcg

SEQ ID NO: 46735 - DNA, 22 bp, Homo sapiens
tgggtggcagcttcagcatgtt

SEQ ID NO: 46736 - DNA, 22 bp, Homo sapiens
ggggcaggagcccttcttcagc

SEQ ID NO: 46737 - DNA, 22 bp, Homo sapiens
ctctgctgtgccgccagggcct

SEQ ID NO: 46738 - DNA, 22 bp, Homo sapiens
ggaggagcatgagagggtagtg

SEQ ID NO: 46739 - DNA, 22 bp, Homo sapiens
gcaaaagtacagccggatttct

SEQ ID NO: 46740 - DNA, 22 bp, Homo sapiens
tattgtgaataatgccgcaata

SEQ ID NO: 46741 - DNA, 22 bp, Homo sapiens
tatccaattcaccattgatggg

SEQ ID NO: 46742 - DNA, 22 bp, Homo sapiens
ccagcagagcatggggaggaag

SEQ ID NO: 46743 - DNA, 22 bp, Homo sapiens
tgggaagggtcaacagctggaa

SEQ ID NO: 46744 - DNA, 22 bp, Homo sapiens
cttgtagacccctggactcacg

SEQ ID NO: 46745 - DNA, 22 bp, Homo sapiens
aggacagagggaccagagccca

SEQ ID NO: 46746 - DNA, 22 bp, Homo sapiens
atatacacatctttttaaatat

SEQ ID NO: 46747 - DNA, 22 bp, Homo sapiens
aatttgttataacttgggctga

SEQ ID NO: 46748 - DNA, 22 bp, Homo sapiens
gcaggcagaggtggaggagaca

SEQ ID NO: 46749 - DNA, 22 bp, Homo sapiens
tgtgaagaattaatgtgaatca

SEQ ID NO: 46750 - DNA, 22 bp, Homo sapiens
acaggggacctaggaccctcgg

SEQ ID NO: 46751 - DNA, 22 bp, Homo sapiens
agggtgaatctcacaactctta

SEQ ID NO: 46752 - DNA, 22 bp, Homo sapiens
ttcgggaggcggagcttgcagt

SEQ ID NO: 46753 - DNA, 22 bp, Homo sapiens
attcacagggggagaagggtat

SEQ ID NO: 46754 - DNA, 22 bp, Homo sapiens
tccagtgtttttcttcacaggt

SEQ ID NO: 46755 - DNA, 22 bp, Homo sapiens
gattgggggtcaggctcaggtc

SEQ ID NO: 46756 - DNA, 22 bp, Homo sapiens
ctggagggtggagagaagtctc

SEQ ID NO: 46757 - DNA, 22 bp, Homo sapiens
ctcccagccttcgccagtctga

SEQ ID NO: 46758 - DNA, 22 bp, Homo sapiens
actttatttcctattgcatcca

SEQ ID NO: 46759 - DNA, 22 bp, Homo sapiens
gggcagagagctggaactcctt

SEQ ID NO: 46760 - DNA, 22 bp, Homo sapiens
gtgggggcaggcagtgctagga

SEQ ID NO: 46761 - DNA, 22 bp, Homo sapiens
ggtgggagagctctgtctccag

SEQ ID NO: 46762 - DNA, 22 bp, Homo sapiens
gctgctgggatcctgggtctca

SEQ ID NO: 46763 - DNA, 22 bp, Homo sapiens
agcttagtggttgtatgagtta

SEQ ID NO: 46764 - DNA, 22 bp, Homo sapiens
ccagaggtgctctttggaagtg

SEQ ID NO: 46765 - DNA, 22 bp, Homo sapiens
acagcagcaatagcagtgacat

SEQ ID NO: 46766 - DNA, 22 bp, Homo sapiens
gggcaggggtcagtggccccaa

SEQ ID NO: 46767 - DNA, 22 bp, Homo sapiens
ccctgctgtgtagcggaggaac

SEQ ID NO: 46768 - DNA, 22 bp, Homo sapiens
tacctcaagttccaggaaagcg

SEQ ID NO: 46769 - DNA, 22 bp, Homo sapiens
ccaggcaggcgatggtgcagtg

SEQ ID NO: 46770 - DNA, 18 bp, Homo sapiens
gaggatggaaggagatgc

SEQ ID NO: 46771 - DNA, 22 bp, Homo sapiens
tgctcattggcgatctgaggga

SEQ ID NO: 46772 - DNA, 22 bp, Homo sapiens
gcccagcacctctctcagggtt

SEQ ID NO: 46773 - DNA, 22 bp, Homo sapiens
tgtgggacctcagagggtcccc

SEQ ID NO: 46774 - DNA, 22 bp, Homo sapiens
gagagagctctgtgcctgggat

SEQ ID NO: 46775 - DNA, 20 bp, Homo sapiens
gggcaaggaaacagccccca

SEQ ID NO: 46776 - DNA, 22 bp, Homo sapiens
aggcaaggtgctacagacagtg

SEQ ID NO: 46777 - DNA, 22 bp, Homo sapiens
ttgagcccaggaggcctgggtg

SEQ ID NO: 46778 - DNA, 22 bp, Homo sapiens
tgctggtaccgcgcctccgcca

SEQ ID NO: 46779 - DNA, 22 bp, Homo sapiens
ggtgggagagcttgctttgatg

SEQ ID NO: 46780 - DNA, 22 bp, Homo sapiens
agctggggctgtggttgtgatt

SEQ ID NO: 46781 - DNA, 22 bp, Homo sapiens
tatcacagccttttggtgaggg

SEQ ID NO: 46782 - DNA, 22 bp, Homo sapiens
accatgtcatttattggccaaa

SEQ ID NO: 46783 - DNA, 22 bp, Homo sapiens
tattgtgaatagtgccgcaata

SEQ ID NO: 46784 - DNA, 22 bp, Homo sapiens
ctggcaggttatagagctgccc

SEQ ID NO: 46785 - DNA, 22 bp, Homo sapiens
cccaggaggcctgcctggccgg

SEQ ID NO: 46786 - DNA, 18 bp, Homo sapiens
cagctgccagctcatgga

SEQ ID NO: 46787 - DNA, 22 bp, Homo sapiens
tacaaaaaattgatactgacga

SEQ ID NO: 46788 - DNA, 22 bp, Homo sapiens
agacaaagaaaccgtagaagca

SEQ ID NO: 46789 - DNA, 22 bp, Homo sapiens
ctgatccctccatagggcacag

SEQ ID NO: 46790 - DNA, 22 bp, Homo sapiens
atggggagctcaccacctgttt

SEQ ID NO: 46791 - DNA, 22 bp, Homo sapiens
gcccaggctggagtgcagtggt

SEQ ID NO: 46792 - DNA, 22 bp, Homo sapiens
ggagagtggattccagctgtat

SEQ ID NO: 46793 - DNA, 22 bp, Homo sapiens
ctgatcccaggcactgtcgcaa

SEQ ID NO: 46794 - DNA, 22 bp, Homo sapiens
gagcacagtaaagcagtgtcac

SEQ ID NO: 46795 - DNA, 22 bp, Homo sapiens
ggtcccaggttgacagggagac

SEQ ID NO: 46796 - DNA, 23 bp, Homo sapiens
agagcaaggaaatgaggtgtgat

SEQ ID NO: 46797 - DNA, 16 bp, Homo sapiens
aggctcagaggctgga

SEQ ID NO: 46798 - DNA, 16 bp, Homo sapiens
gcagaggaaaggggag

SEQ ID NO: 46799 - DNA, 22 bp, Homo sapiens
gagtggggggtccgtctcagtg

SEQ ID NO: 46800 - DNA, 22 bp, Homo sapiens
gcctggattccttgtttctcag

SEQ ID NO: 46801 - DNA, 22 bp, Homo sapiens
aaattgtaatgacttcacttga

SEQ ID NO: 46802 - DNA, 22 bp, Homo sapiens
agaatgggggctacaggccaca

SEQ ID NO: 46803 - DNA, 22 bp, Homo sapiens
cagccacttgtgatgctgggga

SEQ ID NO: 46804 - DNA, 22 bp, Homo sapiens
gtggcaagatgactactcactg

SEQ ID NO: 46805 - DNA, 22 bp, Homo sapiens
tttgttttcaatgtgtcattca

SEQ ID NO: 46806 - DNA, 22 bp, Homo sapiens
gccccagcctcccgagtagctg

SEQ ID NO: 46807 - DNA, 22 bp, Homo sapiens
gagtccctgctgtcaggtgctg

SEQ ID NO: 46808 - DNA, 22 bp, Homo sapiens
cccaggccccagggcttgtcag

SEQ ID NO: 46809 - DNA, 22 bp, Homo sapiens
ggctgtggcagctggaagtggt

SEQ ID NO: 46810 - DNA, 22 bp, Homo sapiens
gggaagtgatggagccaggatt

SEQ ID NO: 46811 - DNA, 22 bp, Homo sapiens
aaaatcctgctgactcgagatg

SEQ ID NO: 46812 - DNA, 22 bp, Homo sapiens
tgagccaggagtttgaggctgt

SEQ ID NO: 46813 - DNA, 22 bp, Homo sapiens
ttatatgtttctgtttggaggc

SEQ ID NO: 46814 - DNA, 19 bp, Homo sapiens
ggagccgccgcccttcatt

SEQ ID NO: 46815 - DNA, 22 bp, Homo sapiens
aggggaggtgtccccaaatctc

SEQ ID NO: 46816 - DNA, 20 bp, Homo sapiens
ggggcccaagccctcttgcc

SEQ ID NO: 46817 - DNA, 22 bp, Homo sapiens
atggagttctgccagcgctgct

SEQ ID NO: 46818 - DNA, 22 bp, Homo sapiens
agcaggcctgccacctcggggt

SEQ ID NO: 46819 - DNA, 22 bp, Homo sapiens
ctgggcagctgtatcagggagt

SEQ ID NO: 46820 - DNA, 22 bp, Homo sapiens
ctggcaggagcattcacagagg

SEQ ID NO: 46821 - DNA, 22 bp, Homo sapiens
cccgggaggaggaagttgcagt

SEQ ID NO: 46822 - DNA, 22 bp, Homo sapiens
tgtgacagcaataactacttaa

SEQ ID NO: 46823 - DNA, 22 bp, Homo sapiens
tgtctccaccatcatcttacca

SEQ ID NO: 46824 - DNA, 23 bp, Homo sapiens
gatgaggacctacaggtggccag

SEQ ID NO: 46825 - DNA, 22 bp, Homo sapiens
agtgagtttagggtgcaggtgt

SEQ ID NO: 46826 - DNA, 22 bp, Homo sapiens
attctggacaaggcaagctcct

SEQ ID NO: 46827 - DNA, 22 bp, Homo sapiens
ggtgaggggctcctctgcccgg

SEQ ID NO: 46828 - DNA, 22 bp, Homo sapiens
gcaagtgaatgaggttgagatt

SEQ ID NO: 46829 - DNA, 23 bp, Homo sapiens
cgcccagcctcagtgacctgggc

SEQ ID NO: 46830 - DNA, 22 bp, Homo sapiens
cggctgggttcggctgcaggcc

SEQ ID NO: 46831 - DNA, 22 bp, Homo sapiens
gagggccctggctggctccagc

SEQ ID NO: 46832 - DNA, 22 bp, Homo sapiens
ggagatatttgtattctgtctc

SEQ ID NO: 46833 - DNA, 22 bp, Homo sapiens
cacagggcttctcatggggtgc

SEQ ID NO: 46834 - DNA, 22 bp, Homo sapiens
gggctgagacgatggggtcttc

SEQ ID NO: 46835 - DNA, 22 bp, Homo sapiens
actggacagaggaaatatggag

SEQ ID NO: 46836 - DNA, 22 bp, Homo sapiens
ggcaggaggtgagtggcgggtg

SEQ ID NO: 46837 - DNA, 22 bp, Homo sapiens
ggggatggaggcgtgtggtcct

SEQ ID NO: 46838 - DNA, 22 bp, Homo sapiens
gggaggcacgaggcgcgcagtg

SEQ ID NO: 46839 - DNA, 22 bp, Homo sapiens
cctgaggatgccagcatgggtg

SEQ ID NO: 46840 - DNA, 22 bp, Homo sapiens
tccagcccaggctggagtgtag

SEQ ID NO: 46841 - DNA, 22 bp, Homo sapiens
aagcagagaatctgggagcgag

SEQ ID NO: 46842 - DNA, 22 bp, Homo sapiens
gtggcagagccaaggctggagc

SEQ ID NO: 46843 - DNA, 22 bp, Homo sapiens
ggcaaggggtcaggctgagaca

SEQ ID NO: 46844 - DNA, 22 bp, Homo sapiens
ctttaattgtagctcccataat

SEQ ID NO: 46845 - DNA, 22 bp, Homo sapiens
gaggggagcccccatcctccag

SEQ ID NO: 46846 - DNA, 22 bp, Homo sapiens
ggaggcggaagttgcagtgagc

SEQ ID NO: 46847 - DNA, 22 bp, Homo sapiens
ctgaggaggctaatttgaggat

SEQ ID NO: 46848 - DNA, 22 bp, Homo sapiens
ccaggctggagtatagtggcgc

SEQ ID NO: 46849 - DNA, 22 bp, Homo sapiens
agtgcaggccccaggccaggcc

SEQ ID NO: 46850 - DNA, 22 bp, Homo sapiens
gacggagctggttgctgcggct

SEQ ID NO: 46851 - DNA, 22 bp, Homo sapiens
ccctcccagatgggcttgaggt

SEQ ID NO: 46852 - DNA, 22 bp, Homo sapiens
gctgctgcttgaaggctcggag

SEQ ID NO: 46853 - DNA, 22 bp, Homo sapiens
agaggaagtaatcaggacctgc

SEQ ID NO: 46854 - DNA, 22 bp, Homo sapiens
gtgagcagagatcgcgtgattg

SEQ ID NO: 46855 - DNA, 22 bp, Homo sapiens
ctctgagctgccttttgagctt

SEQ ID NO: 46856 - DNA, 23 bp, Homo sapiens
aagtggttttgaacccggaccct

SEQ ID NO: 46857 - DNA, 22 bp, Homo sapiens
aggaaggactccatggtccgtc

SEQ ID NO: 46858 - DNA, 21 bp, Homo sapiens
agatcctggggtctggggagg

SEQ ID NO: 46859 - DNA, 22 bp, Homo sapiens
ccagactgcttgcttcccagcc

SEQ ID NO: 46860 - DNA, 22 bp, Homo sapiens
agctgctgagccaggctgatgt

SEQ ID NO: 46861 - DNA, 22 bp, Homo sapiens
acaaagccagattctggagcac

SEQ ID NO: 46862 - DNA, 22 bp, Homo sapiens
ggtggcagtagcactgggcctg

SEQ ID NO: 46863 - DNA, 22 bp, Homo sapiens
gcagaggacacaggagggcaag

SEQ ID NO: 46864 - DNA, 22 bp, Homo sapiens
agggagcaaaggtttcagggtt

SEQ ID NO: 46865 - DNA, 19 bp, Homo sapiens
ccctcttgcacaaagcaaa

SEQ ID NO: 46866 - DNA, 22 bp, Homo sapiens
tataaactcctcttgcattcct

SEQ ID NO: 46867 - DNA, 18 bp, Homo sapiens
cttgttcttctcttggcg

SEQ ID NO: 46868 - DNA, 22 bp, Homo sapiens
cagagatgtgatccagctgtct

SEQ ID NO: 46869 - DNA, 18 bp, Homo sapiens
tccctcagaattatagaa

SEQ ID NO: 46870 - DNA, 22 bp, Homo sapiens
tgcatggacgtgacttggccaa

SEQ ID NO: 46871 - DNA, 22 bp, Homo sapiens
tgctgctgaggctaaagtatag

SEQ ID NO: 46872 - DNA, 21 bp, Homo sapiens
gaccccagaccagcagacaca

SEQ ID NO: 46873 - DNA, 22 bp, Homo sapiens
ggaggcggaggctgcagtgagc

SEQ ID NO: 46874 - DNA, 22 bp, Homo sapiens
ccaggagttggaggctgcagtg

SEQ ID NO: 46875 - DNA, 22 bp, Homo sapiens
gggagtgggtttggcctaggcc

SEQ ID NO: 46876 - DNA, 22 bp, Homo sapiens
tagtgtctcttcctgtttgaaa

SEQ ID NO: 46877 - DNA, 22 bp, Homo sapiens
gccgtgcgtgcgcaggtgctgt

SEQ ID NO: 46878 - DNA, 22 bp, Homo sapiens
gaggtaggtgtaggaggcctgc

SEQ ID NO: 46879 - DNA, 22 bp, Homo sapiens
tgcttacgagctattttcactt

SEQ ID NO: 46880 - DNA, 22 bp, Homo sapiens
tgtgacagcacggttcaactgc

SEQ ID NO: 46881 - DNA, 22 bp, Homo sapiens
ccctgctgtcaggtgctgggag

SEQ ID NO: 46882 - DNA, 22 bp, Homo sapiens
ggcagagcttgcagtgagccga

SEQ ID NO: 46883 - DNA, 22 bp, Homo sapiens
cccaggaggcagagatagcagt

SEQ ID NO: 46884 - DNA, 22 bp, Homo sapiens
tgtagatattaattattccttt

SEQ ID NO: 46885 - DNA, 22 bp, Homo sapiens
cacagagatggtctggcaggtg

SEQ ID NO: 46886 - DNA, 22 bp, Homo sapiens
tcaggaggcggaggttgcagtg

SEQ ID NO: 46887 - DNA, 22 bp, Homo sapiens
gctggtagacctcactgcactc

SEQ ID NO: 46888 - DNA, 22 bp, Homo sapiens
ccaggaggtggaggttgcggtg

SEQ ID NO: 46889 - DNA, 22 bp, Homo sapiens
tagagtgtcataacagtgccca

SEQ ID NO: 46890 - DNA, 22 bp, Homo sapiens
cacagtggtccccgaagcccct

SEQ ID NO: 46891 - DNA, 22 bp, Homo sapiens
tttggggatgtctgagttgttg

SEQ ID NO: 46892 - DNA, 22 bp, Homo sapiens
ctccaccccgtgccggtgctgg

SEQ ID NO: 46893 - DNA, 22 bp, Homo sapiens
gagggggctagcgcagtgccca

SEQ ID NO: 46894 - DNA, 22 bp, Homo sapiens
gagcccaggagtttgatgctgc

SEQ ID NO: 46895 - DNA, 20 bp, Homo sapiens
atggatgaccttggccaggg

SEQ ID NO: 46896 - DNA, 22 bp, Homo sapiens
ccaggagttggaggttgcagtg

SEQ ID NO: 46897 - DNA, 22 bp, Homo sapiens
agcataagttggtacagccact

SEQ ID NO: 46898 - DNA, 22 bp, Homo sapiens
cagagagaatcttggcagctga

SEQ ID NO: 46899 - DNA, 22 bp, Homo sapiens
atgtggcaccgatctttagcca

SEQ ID NO: 46900 - DNA, 22 bp, Homo sapiens
tttgaaatgtatcagtataggt

SEQ ID NO: 46901 - DNA, 22 bp, Homo sapiens
agtggctgagtgactgtgactc

SEQ ID NO: 46902 - DNA, 22 bp, Homo sapiens
gaggcagaggttgcagtgagct

SEQ ID NO: 46903 - DNA, 22 bp, Homo sapiens
tcacagagaaatgtggcacaaa

SEQ ID NO: 46904 - DNA, 22 bp, Homo sapiens
tgaaatctttagtttctgtccc

SEQ ID NO: 46905 - DNA, 22 bp, Homo sapiens
cactcagctgagccctcagccc

SEQ ID NO: 46906 - DNA, 21 bp, Homo sapiens
gttcttgcaggatttccttcc

SEQ ID NO: 46907 - DNA, 22 bp, Homo sapiens
taattgtaaagtagtagtacag

SEQ ID NO: 46908 - DNA, 22 bp, Homo sapiens
ggctagggatctagaccaggac

SEQ ID NO: 46909 - DNA, 22 bp, Homo sapiens
ctggagggctgcagcgaggctg

SEQ ID NO: 46910 - DNA, 22 bp, Homo sapiens
gacgcatcaggaggcgaggagc

SEQ ID NO: 46911 - DNA, 22 bp, Homo sapiens
gagctctgactgctgggtgaca

SEQ ID NO: 46912 - DNA, 22 bp, Homo sapiens
ggagaggcttccagagtcgtgc

SEQ ID NO: 46913 - DNA, 22 bp, Homo sapiens
gcaggcagatcacctgtcagga

SEQ ID NO: 46914 - DNA, 22 bp, Homo sapiens
gtctgaatacgtacttgtgaag

SEQ ID NO: 46915 - DNA, 22 bp, Homo sapiens
tcacagagatgaacttttgata

SEQ ID NO: 46916 - DNA, 22 bp, Homo sapiens
ggcgctcagtgttgccccagag

SEQ ID NO: 46917 - DNA, 22 bp, Homo sapiens
ggggccgaccgcggttcaggcc

SEQ ID NO: 46918 - DNA, 22 bp, Homo sapiens
ggactgggaatcagggagatgc

SEQ ID NO: 46919 - DNA, 22 bp, Homo sapiens
tgctcgccccacatgccctcat

SEQ ID NO: 46920 - DNA, 22 bp, Homo sapiens
tgggaggccgaggcaggtggat

SEQ ID NO: 46921 - DNA, 22 bp, Homo sapiens
cagcagtgtacaaggtgtcaga

SEQ ID NO: 46922 - DNA, 17 bp, Homo sapiens
gggcagggactcctggg

SEQ ID NO: 46923 - DNA, 22 bp, Homo sapiens
agggctggagccacagctggga

SEQ ID NO: 46924 - DNA, 22 bp, Homo sapiens
ctctctgggcccagttggcacc

SEQ ID NO: 46925 - DNA, 22 bp, Homo sapiens
gagcccaggaagtggaggctga

SEQ ID NO: 46926 - DNA, 22 bp, Homo sapiens
ggcctcgcggcttctggtggct

SEQ ID NO: 46927 - DNA, 20 bp, Homo sapiens
aaattactgccacacatttc

SEQ ID NO: 46928 - DNA, 22 bp, Homo sapiens
ctgaggggtcgtgggagcccag

SEQ ID NO: 46929 - DNA, 22 bp, Homo sapiens
aactagaaaaagactttctgag

SEQ ID NO: 46930 - DNA, 22 bp, Homo sapiens
ggtgggaggactgtttgaggca

SEQ ID NO: 46931 - DNA, 17 bp, Homo sapiens
tgtatttatcatgtcag

SEQ ID NO: 46932 - DNA, 22 bp, Homo sapiens
atcttgttaaaaagcagattct

SEQ ID NO: 46933 - DNA, 22 bp, Homo sapiens
agcagctcctgtttttgggata

SEQ ID NO: 46934 - DNA, 22 bp, Homo sapiens
agaggcaggaggttgacttgag

SEQ ID NO: 46935 - DNA, 22 bp, Homo sapiens
aaggcaggatgggaaaagattt

SEQ ID NO: 46936 - DNA, 22 bp, Homo sapiens
aatgccttggagagcctagagg

SEQ ID NO: 46937 - DNA, 22 bp, Homo sapiens
atatatttgagaatattcatga

SEQ ID NO: 46938 - DNA, 22 bp, Homo sapiens
agtccctctgggagcaggactg

SEQ ID NO: 46939 - DNA, 22 bp, Homo sapiens
tccgggaggcagaggttgcagt

SEQ ID NO: 46940 - DNA, 22 bp, Homo sapiens
ctctggagtgtctggccagggt

SEQ ID NO: 46941 - DNA, 22 bp, Homo sapiens
atcaagggcgcgtggttcggcg

SEQ ID NO: 46942 - DNA, 23 bp, Homo sapiens
tgttccagatacgccttttcctc

SEQ ID NO: 46943 - DNA, 22 bp, Homo sapiens
caggcaggtcagtgaagaagga

SEQ ID NO: 46944 - DNA, 22 bp, Homo sapiens
ccattgcactccatcctgggca

SEQ ID NO: 46945 - DNA, 20 bp, Homo sapiens
agcggctggcggaggacacg

SEQ ID NO: 46946 - DNA, 22 bp, Homo sapiens
cagagctggtgtgtcctggcat

SEQ ID NO: 46947 - DNA, 22 bp, Homo sapiens
gaggaggcttccgggaggcacg

SEQ ID NO: 46948 - DNA, 22 bp, Homo sapiens
gccttgccgctcagcagtgggg

SEQ ID NO: 46949 - DNA, 22 bp, Homo sapiens
ccaggaggcggaaggtacagtg

SEQ ID NO: 46950 - DNA, 22 bp, Homo sapiens
ttccctccatttcattttataa

SEQ ID NO: 46951 - DNA, 22 bp, Homo sapiens
gtggagaggaacccagctctgt

SEQ ID NO: 46952 - DNA, 22 bp, Homo sapiens
gtgtatgttctacttaatatta

SEQ ID NO: 46953 - DNA, 22 bp, Homo sapiens
ggaggcagaatagagtgtgggt

SEQ ID NO: 46954 - DNA, 22 bp, Homo sapiens
gagggagggactagcattctct

SEQ ID NO: 46955 - DNA, 22 bp, Homo sapiens
ccaggagtgcagggatggtatc

SEQ ID NO: 46956 - DNA, 22 bp, Homo sapiens
cacagctgaagtagccatgtgg

SEQ ID NO: 46957 - DNA, 22 bp, Homo sapiens
ctgggaggcagaggttgcagtg

SEQ ID NO: 46958 - DNA, 22 bp, Homo sapiens
gaggcagaagttgcagtgagca

SEQ ID NO: 46959 - DNA, 22 bp, Homo sapiens
agagcactttcgagagccggag

SEQ ID NO: 46960 - DNA, 20 bp, Homo sapiens
ggcagagggcctgggagaag

SEQ ID NO: 46961 - DNA, 22 bp, Homo sapiens
tgactggattgtcattacgacg

SEQ ID NO: 46962 - DNA, 22 bp, Homo sapiens
gagctgggcctgcgagtgctgc

SEQ ID NO: 46963 - DNA, 22 bp, Homo sapiens
gatggaggagatggcagggtgc

SEQ ID NO: 46964 - DNA, 22 bp, Homo sapiens
gttgcagatgtggaactcgtgc

SEQ ID NO: 46965 - DNA, 22 bp, Homo sapiens
cagccccatggtgtgctccagc

SEQ ID NO: 46966 - DNA, 22 bp, Homo sapiens
tggtggctaccaggtcctgggg

SEQ ID NO: 46967 - DNA, 22 bp, Homo sapiens
tccccagcttgctacttctgct

SEQ ID NO: 46968 - DNA, 22 bp, Homo sapiens
gtgctggggagataggaagaga

SEQ ID NO: 46969 - DNA, 20 bp, Homo sapiens
gtctccactgggggttaacc

SEQ ID NO: 46970 - DNA, 22 bp, Homo sapiens
ttgcttcttagatattcctctc

SEQ ID NO: 46971 - DNA, 22 bp, Homo sapiens
cccagcagtagagctcatatgg

SEQ ID NO: 46972 - DNA, 22 bp, Homo sapiens
taagcctgcatgaaccatgaga

SEQ ID NO: 46973 - DNA, 22 bp, Homo sapiens
ctgggctagaaggaccaggatg

SEQ ID NO: 46974 - DNA, 22 bp, Homo sapiens
taagtcgtggatgattcttcgg

SEQ ID NO: 46975 - DNA, 22 bp, Homo sapiens
ttatttgtggcatatgagacga

SEQ ID NO: 46976 - DNA, 22 bp, Homo sapiens
tgaggcaggagaatcaccggaa

SEQ ID NO: 46977 - DNA, 22 bp, Homo sapiens
gggaggcagtgctggaggctgg

SEQ ID NO: 46978 - DNA, 22 bp, Homo sapiens
gggcagagactcagaaacagaa

SEQ ID NO: 46979 - DNA, 22 bp, Homo sapiens
cagcccaggactgcaggtgttt

SEQ ID NO: 46980 - DNA, 22 bp, Homo sapiens
acccagggctcaagcgtaggca

SEQ ID NO: 46981 - DNA, 18 bp, Homo sapiens
ccctcttgcacaaagcaa

SEQ ID NO: 46982 - DNA, 22 bp, Homo sapiens
tgggcaggggccctgcttccgt

SEQ ID NO: 46983 - DNA, 22 bp, Homo sapiens
ccctcccaggagtggccagaga

SEQ ID NO: 46984 - DNA, 22 bp, Homo sapiens
cgggaaggtggaggttgcagtg

SEQ ID NO: 46985 - DNA, 22 bp, Homo sapiens
gcccagctgcaccctggtgggt

SEQ ID NO: 46986 - DNA, 22 bp, Homo sapiens
ggctccaccctgcttccagaag

SEQ ID NO: 46987 - DNA, 22 bp, Homo sapiens
gcccaggaggagaggctgcagt

SEQ ID NO: 46988 - DNA, 22 bp, Homo sapiens
ggaggtagcctcaaaagcagct

SEQ ID NO: 46989 - DNA, 22 bp, Homo sapiens
atagaatatgacttttagatcc

SEQ ID NO: 46990 - DNA, 22 bp, Homo sapiens
gaggcctgggcaagggggtctg

SEQ ID NO: 46991 - DNA, 21 bp, Homo sapiens
ctgtggtacagctgggacgga

SEQ ID NO: 46992 - DNA, 22 bp, Homo sapiens
gcctggagaaaggaaggtggga

SEQ ID NO: 46993 - DNA, 22 bp, Homo sapiens
aaagcagggaaatctatttgca

SEQ ID NO: 46994 - DNA, 22 bp, Homo sapiens
ctgctgagagccccagctgaga

SEQ ID NO: 46995 - DNA, 22 bp, Homo sapiens
tcctcctgtctaccagttcctg

SEQ ID NO: 46996 - DNA, 22 bp, Homo sapiens
gggctgggattgcttgctgtga

SEQ ID NO: 46997 - DNA, 22 bp, Homo sapiens
tcacagagttaaaagtttcttt

SEQ ID NO: 46998 - DNA, 22 bp, Homo sapiens
catttacatttaaggttaatat

SEQ ID NO: 46999 - DNA, 22 bp, Homo sapiens
acacggcactttaggaaggggc

SEQ ID NO: 47000 - DNA, 22 bp, Homo sapiens
cgggcagtgtggctccagagtc

SEQ ID NO: 47001 - DNA, 22 bp, Homo sapiens
ttggaaacgtcaccttttcctt

SEQ ID NO: 47002 - DNA, 22 bp, Homo sapiens
cagagactggagtgcagtggcg

SEQ ID NO: 47003 - DNA, 22 bp, Homo sapiens
caggccggggcggcgccatctt

SEQ ID NO: 47004 - DNA, 22 bp, Homo sapiens
tgggaggccaaggcaggcggat

SEQ ID NO: 47005 - DNA, 22 bp, Homo sapiens
ataatacatggttgatcttttc

SEQ ID NO: 47006 - DNA, 22 bp, Homo sapiens
tctgagccagggtctcctccct

SEQ ID NO: 47007 - DNA, 22 bp, Homo sapiens
agctctgaaagttatgtcgccg

SEQ ID NO: 47008 - DNA, 22 bp, Homo sapiens
gacaggaggcagagctcaggtg

SEQ ID NO: 47009 - DNA, 22 bp, Homo sapiens
cccaggggttcaaggctgcagt

SEQ ID NO: 47010 - DNA, 22 bp, Homo sapiens
ggtgggagccaacacccttctg

SEQ ID NO: 47011 - DNA, 19 bp, Homo sapiens
aggaatggaattaattctg

SEQ ID NO: 47012 - DNA, 22 bp, Homo sapiens
cccagcaggtcggtgctgcctg

SEQ ID NO: 47013 - DNA, 22 bp, Homo sapiens
ccagcagccaccttctcgaaat

SEQ ID NO: 47014 - DNA, 22 bp, Homo sapiens
ctggagagaatgtggaatgatt

SEQ ID NO: 47015 - DNA, 22 bp, Homo sapiens
gtcccctgtccagggccagcca

SEQ ID NO: 47016 - DNA, 23 bp, Homo sapiens
tgaggcaggcggatcacgaggtc

SEQ ID NO: 47017 - DNA, 22 bp, Homo sapiens
tgaggcaggacttgcataaagt

SEQ ID NO: 47018 - DNA, 22 bp, Homo sapiens
gtgggctgcccttgaggtcagc

SEQ ID NO: 47019 - DNA, 22 bp, Homo sapiens
aggcaaggtgctacagacagtg

SEQ ID NO: 47020 - DNA, 18 bp, Homo sapiens
tcaaatactttgggcagt

SEQ ID NO: 47021 - DNA, 22 bp, Homo sapiens
atgaggcaggagtgcagtggca

SEQ ID NO: 47022 - DNA, 22 bp, Homo sapiens
tacatttataaggcttctctgt

SEQ ID NO: 47023 - DNA, 22 bp, Homo sapiens
ttgaggcaggtccgggtccttc

SEQ ID NO: 47024 - DNA, 22 bp, Homo sapiens
tttgaggttagctagcagatca

SEQ ID NO: 47025 - DNA, 22 bp, Homo sapiens
aggcgaagggaccagacggtag

SEQ ID NO: 47026 - DNA, 22 bp, Homo sapiens
ctgaggcaggcagatcacttga

SEQ ID NO: 47027 - DNA, 22 bp, Homo sapiens
acgtagcactgagagatgcagg

SEQ ID NO: 47028 - DNA, 22 bp, Homo sapiens
atgaggcaggtggaggctgcca

SEQ ID NO: 47029 - DNA, 19 bp, Homo sapiens
aggctaaagagtcttgcgt

SEQ ID NO: 47030 - DNA, 22 bp, Homo sapiens
aagaagcattctttcattggtt

SEQ ID NO: 47031 - DNA, 22 bp, Homo sapiens
ggaagaaaggtggacaacaggt

SEQ ID NO: 47032 - DNA, 22 bp, Homo sapiens
tgaggcaggaggttgagaactg

SEQ ID NO: 47033 - DNA, 22 bp, Homo sapiens
atatattttttgagacagagtc

SEQ ID NO: 47034 - DNA, 22 bp, Homo sapiens
aggacaaaggaccagatctgga

SEQ ID NO: 47035 - DNA, 22 bp, Homo sapiens
atttagaactttgtttgccaat

SEQ ID NO: 47036 - DNA, 22 bp, Homo sapiens
tttgtgaataggttggcttcca

SEQ ID NO: 47037 - DNA, 22 bp, Homo sapiens
agcatttatcttttgtttgagt

SEQ ID NO: 47038 - DNA, 22 bp, Homo sapiens
attggtagttttgtatttctct

SEQ ID NO: 47039 - DNA, 22 bp, Homo sapiens
tttgaagggcacgacaatagtt

SEQ ID NO: 47040 - DNA, 22 bp, Homo sapiens
agtggcacaattttgactcccc

SEQ ID NO: 47041 - DNA, 22 bp, Homo sapiens
tgagagcaacacgcagtagtat

SEQ ID NO: 47042 - DNA, 22 bp, Homo sapiens
ggtagaaataatcttcaggctg

SEQ ID NO: 47043 - DNA, 22 bp, Homo sapiens
tgcctactagtactattttgtg

SEQ ID NO: 47044 - DNA, 22 bp, Homo sapiens
tgatattttatgagctttcata

SEQ ID NO: 47045 - DNA, 22 bp, Homo sapiens
ctgaggcaggatggcctggctg

SEQ ID NO: 47046 - DNA, 22 bp, Homo sapiens
cttggattcctcatatgcacag

SEQ ID NO: 47047 - DNA, 22 bp, Homo sapiens
catttacatttaaggttaatat

SEQ ID NO: 47048 - DNA, 22 bp, Homo sapiens
tgaggcaggagttcaggctgcg

SEQ ID NO: 47049 - DNA, 22 bp, Homo sapiens
ctgaggcaggagagttgcttga

SEQ ID NO: 47050 - DNA, 22 bp, Homo sapiens
aagtggcagttcaggaagcaga

SEQ ID NO: 47051 - DNA, 22 bp, Homo sapiens
aaagcactgcacatatatttgc

SEQ ID NO: 47052 - DNA, 22 bp, Homo sapiens
tgcagaaacaagccatcattca

SEQ ID NO: 47053 - DNA, 22 bp, Homo sapiens
ctgtaatcccagctactcggga

SEQ ID NO: 47054 - DNA, 22 bp, Homo sapiens
ctgtaatcccagctacctggga

SEQ ID NO: 47055 - DNA, 22 bp, Homo sapiens
tggattcacaccattctcctgc

SEQ ID NO: 47056 - DNA, 22 bp, Homo sapiens
ggctcatatcccggccatcatt

SEQ ID NO: 47057 - DNA, 22 bp, Homo sapiens
tggggtacttgtatcaaagcac

SEQ ID NO: 47058 - DNA, 22 bp, Homo sapiens
tgggttttatatgtggtggaca

SEQ ID NO: 47059 - DNA, 22 bp, Homo sapiens
aactcaaagatgcatgacgctt

SEQ ID NO: 47060 - DNA, 22 bp, Homo sapiens
aataaaatggtcagttttctca

SEQ ID NO: 47061 - DNA, 22 bp, Homo sapiens
ggaggtgggctaaggactctct

SEQ ID NO: 47062 - DNA, 22 bp, Homo sapiens
tgggttttgtcctgatccatca

SEQ ID NO: 47063 - DNA, 22 bp, Homo sapiens
actggggctgatgcgttcgtgt

SEQ ID NO: 47064 - DNA, 21 bp, Homo sapiens
gggcagaggggcctcctgggt

SEQ ID NO: 47065 - DNA, 22 bp, Homo sapiens
atagggcctaaaaagtattgct

SEQ ID NO: 47066 - DNA, 21 bp, Homo sapiens
tgactgaggcttcttcacaca

SEQ ID NO: 47067 - DNA, 22 bp, Homo sapiens
gcgagcctctggagtcctctgg

SEQ ID NO: 47068 - DNA, 22 bp, Homo sapiens
tggggcagttaataaacattct

SEQ ID NO: 47069 - DNA, 22 bp, Homo sapiens
gtagaggggtgattctgtgaga

SEQ ID NO: 47070 - DNA, 22 bp, Homo sapiens
ttgagggtctggatctgctgct

SEQ ID NO: 47071 - DNA, 22 bp, Homo sapiens
attgtgtcctcattgaccttca

SEQ ID NO: 47072 - DNA, 23 bp, Homo sapiens
gctcatcaggcttagagtcaagg

SEQ ID NO: 47073 - DNA, 22 bp, Homo sapiens
attttttgttaactcaggatag

SEQ ID NO: 47074 - DNA, 22 bp, Homo sapiens
caccttactccctctggatgcc

SEQ ID NO: 47075 - DNA, 22 bp, Homo sapiens
ttatttttaaaagttcacacag

SEQ ID NO: 47076 - DNA, 22 bp, Homo sapiens
catgagataatttttctccagt

SEQ ID NO: 47077 - DNA, 22 bp, Homo sapiens
tgagtagagaattcagctaagg

SEQ ID NO: 47078 - DNA, 22 bp, Homo sapiens
tacttttcctggaaccactgct

SEQ ID NO: 47079 - DNA, 22 bp, Homo sapiens
atgtttttggaaatgggaacat

SEQ ID NO: 47080 - DNA, 22 bp, Homo sapiens
ctgggaggcggaggttgcagtg

SEQ ID NO: 47081 - DNA, 22 bp, Homo sapiens
gggggctccaggcgagaatgtg

SEQ ID NO: 47082 - DNA, 22 bp, Homo sapiens
gctgctaagcgtttctgttcca

SEQ ID NO: 47083 - DNA, 22 bp, Homo sapiens
ggagaagttggacagtttggga

SEQ ID NO: 47084 - DNA, 22 bp, Homo sapiens
agccttacataaacagccttat

SEQ ID NO: 47085 - DNA, 22 bp, Homo sapiens
gggacatctttctagtcagggt

SEQ ID NO: 47086 - DNA, 22 bp, Homo sapiens
catctgctgttccttggactca

SEQ ID NO: 47087 - DNA, 22 bp, Homo sapiens
ctttgcttgacactgtgattgt

SEQ ID NO: 47088 - DNA, 22 bp, Homo sapiens
tttttgggtccaggctgtatct

SEQ ID NO: 47089 - DNA, 22 bp, Homo sapiens
ccttctagcaaatcaacataaa

SEQ ID NO: 47090 - DNA, 22 bp, Homo sapiens
acacagagccaaaccatatcac

SEQ ID NO: 47091 - DNA, 22 bp, Homo sapiens
gcccagccacagtcactttcat

SEQ ID NO: 47092 - DNA, 22 bp, Homo sapiens
ctgcagtctacctggattttta

SEQ ID NO: 47093 - DNA, 21 bp, Homo sapiens
agggttttatagatctcttcc

SEQ ID NO: 47094 - DNA, 22 bp, Homo sapiens
caaattccattcatgctccctt

SEQ ID NO: 47095 - DNA, 22 bp, Homo sapiens
ttcccacattctttacattcat

SEQ ID NO: 47096 - DNA, 22 bp, Homo sapiens
taaagggtaggttttactgtaa

SEQ ID NO: 47097 - DNA, 22 bp, Homo sapiens
aggaggggttctcgggtgctga

SEQ ID NO: 47098 - DNA, 22 bp, Homo sapiens
agtccaaagcagatgagggcca

SEQ ID NO: 47099 - DNA, 22 bp, Homo sapiens
actgccaatggtagtttgatgg

SEQ ID NO: 47100 - DNA, 22 bp, Homo sapiens
aagctctttccactaaaccact

SEQ ID NO: 47101 - DNA, 22 bp, Homo sapiens
ttccacattccttacattcata

SEQ ID NO: 47102 - DNA, 22 bp, Homo sapiens
gacccggctccaggcccagcag

SEQ ID NO: 47103 - DNA, 22 bp, Homo sapiens
ccttgctcaagctagtgacggg

SEQ ID NO: 47104 - DNA, 22 bp, Homo sapiens
gttgaaatcctaaccccctagt

SEQ ID NO: 47105 - DNA, 18 bp, Homo sapiens
tgtagagccaggtttgcc

SEQ ID NO: 47106 - DNA, 22 bp, Homo sapiens
tctttcttgtgggtgccctttt

SEQ ID NO: 47107 - DNA, 22 bp, Homo sapiens
tacttttctataggtttgaaat

SEQ ID NO: 47108 - DNA, 22 bp, Homo sapiens
gggacaatggaggcctctctcc

SEQ ID NO: 47109 - DNA, 22 bp, Homo sapiens
agccttcggccagagggtggcc

SEQ ID NO: 47110 - DNA, 22 bp, Homo sapiens
cttttgattgagcagtttcaaa

SEQ ID NO: 47111 - DNA, 22 bp, Homo sapiens
tttaaaaaactagtctgagtct

SEQ ID NO: 47112 - DNA, 17 bp, Homo sapiens
catccgtgagctcggca

SEQ ID NO: 47113 - DNA, 22 bp, Homo sapiens
ttcttttaattgtgggggagtg

SEQ ID NO: 47114 - DNA, 22 bp, Homo sapiens
caaatactacgattcttgcagt

SEQ ID NO: 47115 - DNA, 23 bp, Homo sapiens
attttttgtctttgtaactagat

SEQ ID NO: 47116 - DNA, 22 bp, Homo sapiens
cgctgataaacgtcacgttccc

SEQ ID NO: 47117 - DNA, 22 bp, Homo sapiens
tgctgtgaggttgagaaggaag

SEQ ID NO: 47118 - DNA, 22 bp, Homo sapiens
tgagatgtaaggtatgcttact

SEQ ID NO: 47119 - DNA, 22 bp, Homo sapiens
aaaacctcagttctgctcttaa

SEQ ID NO: 47120 - DNA, 21 bp, Homo sapiens
tcctgtaagcttgggtggctc

SEQ ID NO: 47121 - DNA, 22 bp, Homo sapiens
gctgctttggaaagcatggaaa

SEQ ID NO: 47122 - DNA, 22 bp, Homo sapiens
ctgggaggcagaggttgcagtg

SEQ ID NO: 47123 - DNA, 20 bp, Homo sapiens
tgtttactctagagggtaga

SEQ ID NO: 47124 - DNA, 22 bp, Homo sapiens
atgccactgcactccagcctgg

SEQ ID NO: 47125 - DNA, 22 bp, Homo sapiens
tgatattttatgagctttcata

SEQ ID NO: 47126 - DNA, 22 bp, Homo sapiens
ccatcacagtccccatcgtgat

SEQ ID NO: 47127 - DNA, 22 bp, Homo sapiens
aatttaagagcatagctccaac

SEQ ID NO: 47128 - DNA, 22 bp, Homo sapiens
atctgggagcggaggttgcagt

SEQ ID NO: 47129 - DNA, 22 bp, Homo sapiens
ctgagggtcaacttgattgtat

SEQ ID NO: 47130 - DNA, 22 bp, Homo sapiens
taaagctctgggtttctagatc

SEQ ID NO: 47131 - DNA, 22 bp, Homo sapiens
ttcattcttttacatgtgaata

SEQ ID NO: 47132 - DNA, 22 bp, Homo sapiens
tgagggaatattgatagatccg

SEQ ID NO: 47133 - DNA, 17 bp, Homo sapiens
cttcccaccatctcctg

SEQ ID NO: 47134 - DNA, 22 bp, Homo sapiens
ggagaggggaacttgttgcttg

SEQ ID NO: 47135 - DNA, 22 bp, Homo sapiens
aaggaggttatcccagtggact

SEQ ID NO: 47136 - DNA, 22 bp, Homo sapiens
tccattatacttctgattcaaa

SEQ ID NO: 47137 - DNA, 22 bp, Homo sapiens
agaggccggccgagcccatggg

SEQ ID NO: 47138 - DNA, 22 bp, Homo sapiens
ccttttatagatcagtgtgtta

SEQ ID NO: 47139 - DNA, 22 bp, Homo sapiens
acaggtcctcaagtcagctggg

SEQ ID NO: 47140 - DNA, 22 bp, Homo sapiens
agaaaatttaaagagacacaca

SEQ ID NO: 47141 - DNA, 22 bp, Homo sapiens
gagacctcttggtatcgctagg

SEQ ID NO: 47142 - DNA, 22 bp, Homo sapiens
gcacatgcatgcatattcctgg

SEQ ID NO: 47143 - DNA, 22 bp, Homo sapiens
caggaacagggtgtcctggcag

SEQ ID NO: 47144 - DNA, 22 bp, Homo sapiens
acagattcactgcactggccat

SEQ ID NO: 47145 - DNA, 22 bp, Homo sapiens
tcccacacagcccgctcaccgg

SEQ ID NO: 47146 - DNA, 22 bp, Homo sapiens
gactttctgatgtaaacattta

SEQ ID NO: 47147 - DNA, 20 bp, Homo sapiens
ttcatgggagcaaagaggcc

SEQ ID NO: 47148 - DNA, 22 bp, Homo sapiens
atacagggacatccagtttttc

SEQ ID NO: 47149 - DNA, 22 bp, Homo sapiens
cccccaaagtttgcacggataa

SEQ ID NO: 47150 - DNA, 22 bp, Homo sapiens
atgttggagtcgtaaggcatgg

SEQ ID NO: 47151 - DNA, 22 bp, Homo sapiens
gtttacttgtgccttggcttaa

SEQ ID NO: 47152 - DNA, 22 bp, Homo sapiens
atgccactgcactccagcctag

SEQ ID NO: 47153 - DNA, 20 bp, Homo sapiens
caaatccctgctctgtgctg

SEQ ID NO: 47154 - DNA, 22 bp, Homo sapiens
tgcagattcaaatgaaatgcaa

SEQ ID NO: 47155 - DNA, 22 bp, Homo sapiens
cccacacacatttatgatagga

SEQ ID NO: 47156 - DNA, 22 bp, Homo sapiens
ataaagctattcctctcttttt

SEQ ID NO: 47157 - DNA, 22 bp, Homo sapiens
cgggttttccacaggagtcttt

SEQ ID NO: 47158 - DNA, 22 bp, Homo sapiens
acaattctgatggtttcccagt

SEQ ID NO: 47159 - DNA, 22 bp, Homo sapiens
gtggcatctcagaggccaagaa

SEQ ID NO: 47160 - DNA, 22 bp, Homo sapiens
atgtcttctctgtaggtaaatt

SEQ ID NO: 47161 - DNA, 22 bp, Homo sapiens
ggaggtggagctggaagttcca

SEQ ID NO: 47162 - DNA, 22 bp, Homo sapiens
tgtggcacatacacaggagggc

SEQ ID NO: 47163 - DNA, 22 bp, Homo sapiens
ctggcaggttatagagctgccc

SEQ ID NO: 47164 - DNA, 22 bp, Homo sapiens
gtagcagagggcccaggtaact

SEQ ID NO: 47165 - DNA, 22 bp, Homo sapiens
gggcatggtggcaggcacctgt

SEQ ID NO: 47166 - DNA, 22 bp, Homo sapiens
ccttttgctctcccatccagaa

SEQ ID NO: 47167 - DNA, 22 bp, Homo sapiens
atgaaatatcttgaagaaattc

SEQ ID NO: 47168 - DNA, 22 bp, Homo sapiens
acctctgtacctcctctgacag

SEQ ID NO: 47169 - DNA, 22 bp, Homo sapiens
acagtcaaatgtctatcttctt

SEQ ID NO: 47170 - DNA, 22 bp, Homo sapiens
gaggtggatgttgcagtgagct

SEQ ID NO: 47171 - DNA, 18 bp, Homo sapiens
tttctcagactctctttc

SEQ ID NO: 47172 - DNA, 22 bp, Homo sapiens
aatggcactttataaatgttaa

SEQ ID NO: 47173 - DNA, 17 bp, Homo sapiens
aatctgtttacagtcag

SEQ ID NO: 47174 - DNA, 22 bp, Homo sapiens
acaaacagagttgaaaaatagg

SEQ ID NO: 47175 - DNA, 22 bp, Homo sapiens
tcccctctttctggaaacacaa

SEQ ID NO: 47176 - DNA, 22 bp, Homo sapiens
tcctcagcttttatttcacttg

SEQ ID NO: 47177 - DNA, 22 bp, Homo sapiens
tcctgaagaaggcagatatttg

SEQ ID NO: 47178 - DNA, 22 bp, Homo sapiens
atgaccagccgagataaacaga

SEQ ID NO: 47179 - DNA, 22 bp, Homo sapiens
ccaaagaaacccaagctcaggg

SEQ ID NO: 47180 - DNA, 22 bp, Homo sapiens
gcttctgagttcttgcttaata

SEQ ID NO: 47181 - DNA, 22 bp, Homo sapiens
tgaaatgtgttctagtgttttg

SEQ ID NO: 47182 - DNA, 22 bp, Homo sapiens
cttcatcagctggcttactgtt

SEQ ID NO: 47183 - DNA, 22 bp, Homo sapiens
gaccaagatacagcatcataga

SEQ ID NO: 47184 - DNA, 22 bp, Homo sapiens
cttccccaggacctctgctaaa

SEQ ID NO: 47185 - DNA, 22 bp, Homo sapiens
tggcacttttcccagttttggt

SEQ ID NO: 47186 - DNA, 22 bp, Homo sapiens
tatgtttggcctggcaatttca

SEQ ID NO: 47187 - DNA, 22 bp, Homo sapiens
tggcatctttgtcccagaagct

SEQ ID NO: 47188 - DNA, 22 bp, Homo sapiens
tggtatttctgtgcccagctca

SEQ ID NO: 47189 - DNA, 19 bp, Homo sapiens
ctccttgccatttcttttc

SEQ ID NO: 47190 - DNA, 22 bp, Homo sapiens
atataatttttggttagctcaa

SEQ ID NO: 47191 - DNA, 22 bp, Homo sapiens
ggagcagggaattacagcgcag

SEQ ID NO: 47192 - DNA, 22 bp, Homo sapiens
agttcaacaccagcctgaccaa

SEQ ID NO: 47193 - DNA, 22 bp, Homo sapiens
gaccttcttgctgtgtcctaac

SEQ ID NO: 47194 - DNA, 22 bp, Homo sapiens
cagtggctggttagggacagga

SEQ ID NO: 47195 - DNA, 22 bp, Homo sapiens
cctagatgggatggcggccggg

SEQ ID NO: 47196 - DNA, 22 bp, Homo sapiens
acagtatagggcttatattgta

SEQ ID NO: 47197 - DNA, 22 bp, Homo sapiens
agtcccaacagcttacaaggaa

SEQ ID NO: 47198 - DNA, 22 bp, Homo sapiens
ctttggcaatgtcattttcaat

SEQ ID NO: 47199 - DNA, 22 bp, Homo sapiens
atattgttagtaatatttcgaa

SEQ ID NO: 47200 - DNA, 22 bp, Homo sapiens
agaaatatgctgattagatgaa

SEQ ID NO: 47201 - DNA, 22 bp, Homo sapiens
gtcccgcattgggcattcctgg

SEQ ID NO: 47202 - DNA, 20 bp, Homo sapiens
atgctttcttgtgtgctgct

SEQ ID NO: 47203 - DNA, 22 bp, Homo sapiens
catagagtgatgtaaggtatgt

SEQ ID NO: 47204 - DNA, 22 bp, Homo sapiens
atttggcagtataaattctggc

SEQ ID NO: 47205 - DNA, 22 bp, Homo sapiens
gaaatctttgccttagctgtgt

SEQ ID NO: 47206 - DNA, 22 bp, Homo sapiens
ttgccttcctgcccagcttctg

SEQ ID NO: 47207 - DNA, 22 bp, Homo sapiens
gctggaggatggactggaagaa

SEQ ID NO: 47208 - DNA, 22 bp, Homo sapiens
ttttcctttgattcccagatgt

SEQ ID NO: 47209 - DNA, 23 bp, Homo sapiens
aacgacagctacaggcatcccac

SEQ ID NO: 47210 - DNA, 22 bp, Homo sapiens
tgctccatgcgctcggccggcg

SEQ ID NO: 47211 - DNA, 22 bp, Homo sapiens
aggctatttccactcttctcat

SEQ ID NO: 47212 - DNA, 22 bp, Homo sapiens
ggagaagaggagctggaagcct

SEQ ID NO: 47213 - DNA, 20 bp, Homo sapiens
agacagtgtggagattcctt

SEQ ID NO: 47214 - DNA, 22 bp, Homo sapiens
caattcccagctgccgggctgc

SEQ ID NO: 47215 - DNA, 22 bp, Homo sapiens
agtggcctggagccccgcctgg

SEQ ID NO: 47216 - DNA, 22 bp, Homo sapiens
cttgatctacatagtgaaaccc

SEQ ID NO: 47217 - DNA, 22 bp, Homo sapiens
agaccactaaaactttctctat

SEQ ID NO: 47218 - DNA, 22 bp, Homo sapiens
gacagacacaattgatccatga

SEQ ID NO: 47219 - DNA, 22 bp, Homo sapiens
tttctcatggaacatcgtttag

SEQ ID NO: 47220 - DNA, 22 bp, Homo sapiens
cttagagatgggttttacttag

SEQ ID NO: 47221 - DNA, 22 bp, Homo sapiens
ttttctcttccctctggacctg

SEQ ID NO: 47222 - DNA, 22 bp, Homo sapiens
gtgctccctccttcctcaagga

SEQ ID NO: 47223 - DNA, 22 bp, Homo sapiens
aacctcaaactcttgggcttaa

SEQ ID NO: 47224 - DNA, 22 bp, Homo sapiens
attgagaagaaaatctaatata

SEQ ID NO: 47225 - DNA, 22 bp, Homo sapiens
cagtttcttcctcccccagaga

SEQ ID NO: 47226 - DNA, 19 bp, Homo sapiens
catggtgaaaccccgtctc

SEQ ID NO: 47227 - DNA, 22 bp, Homo sapiens
gagaacagaagcattcctaatt

SEQ ID NO: 47228 - DNA, 22 bp, Homo sapiens
atggggagctcaccacctgttt

SEQ ID NO: 47229 - DNA, 22 bp, Homo sapiens
aatgtgaggccttggtagttat

SEQ ID NO: 47230 - DNA, 22 bp, Homo sapiens
catgaaattgtattggcctcaa

SEQ ID NO: 47231 - DNA, 22 bp, Homo sapiens
cttgtcagccaattgtggattt

SEQ ID NO: 47232 - DNA, 22 bp, Homo sapiens
tctcttgagctcagttctgatg

SEQ ID NO: 47233 - DNA, 22 bp, Homo sapiens
taaagggtaggttttactgtaa

SEQ ID NO: 47234 - DNA, 22 bp, Homo sapiens
gaaagagaacctgggcctagat

SEQ ID NO: 47235 - DNA, 22 bp, Homo sapiens
tcaaaccagccttgcatcccag

SEQ ID NO: 47236 - DNA, 22 bp, Homo sapiens
ggaagaaaggtggacaacaggt

SEQ ID NO: 47237 - DNA, 23 bp, Homo sapiens
aatgggtgcaactatccatgaca

SEQ ID NO: 47238 - DNA, 22 bp, Homo sapiens
gtttctctgtctgttacattgg

SEQ ID NO: 47239 - DNA, 22 bp, Homo sapiens
gaaagacatagttgcaagatgg

SEQ ID NO: 47240 - DNA, 22 bp, Homo sapiens
gagagtctaggaacctcatata

SEQ ID NO: 47241 - DNA, 22 bp, Homo sapiens
tcgggctcgctctcctagcgga

SEQ ID NO: 47242 - DNA, 22 bp, Homo sapiens
tattgtccaataggatgttcct

SEQ ID NO: 47243 - DNA, 22 bp, Homo sapiens
tgggtggcagcttcagcatgtt

SEQ ID NO: 47244 - DNA, 22 bp, Homo sapiens
gagatggagtctttttctgtca

SEQ ID NO: 47245 - DNA, 22 bp, Homo sapiens
gttgggttaaccaggatgtcaa

SEQ ID NO: 47246 - DNA, 22 bp, Homo sapiens
acaccatactcatgttggttcc

SEQ ID NO: 47247 - DNA, 22 bp, Homo sapiens
atttctctgcagtgttcggaat

SEQ ID NO: 47248 - DNA, 22 bp, Homo sapiens
gaccatcctggccaacgtggta

SEQ ID NO: 47249 - DNA, 22 bp, Homo sapiens
tttgagatggagtcttgctctg

SEQ ID NO: 47250 - DNA, 22 bp, Homo sapiens
agagaagagtcttgtcaaatta

SEQ ID NO: 47251 - DNA, 22 bp, Homo sapiens
agcaccgttcaaacccaggtta

SEQ ID NO: 47252 - DNA, 22 bp, Homo sapiens
gtggtgtttgagctgccaggga

SEQ ID NO: 47253 - DNA, 22 bp, Homo sapiens
gaccttgtgctccgaggcgggc

SEQ ID NO: 47254 - DNA, 22 bp, Homo sapiens
cagcctttgggtcagaagattc

SEQ ID NO: 47255 - DNA, 22 bp, Homo sapiens
cttgtagaattgaaatggtctc

SEQ ID NO: 47256 - DNA, 22 bp, Homo sapiens
caggagatgacagggaagaacc

SEQ ID NO: 47257 - DNA, 22 bp, Homo sapiens
gagagaagggggatatgagcct

SEQ ID NO: 47258 - DNA, 22 bp, Homo sapiens
accctcaacaaattcactctat

SEQ ID NO: 47259 - DNA, 22 bp, Homo sapiens
agatgtttataactcatgagtg

SEQ ID NO: 47260 - DNA, 22 bp, Homo sapiens
caggaggattgcttgaggccag

SEQ ID NO: 47261 - DNA, 21 bp, Homo sapiens
taggtgggagccccagtatgc

SEQ ID NO: 47262 - DNA, 22 bp, Homo sapiens
cggtctcccgtgtgtgtgcgct

SEQ ID NO: 47263 - DNA, 22 bp, Homo sapiens
actcttgattgatttagtcttt

SEQ ID NO: 47264 - DNA, 22 bp, Homo sapiens
gcttccggagccaaaaggcccc

SEQ ID NO: 47265 - DNA, 22 bp, Homo sapiens
tatcagcgtgcaaatctttgga

SEQ ID NO: 47266 - DNA, 22 bp, Homo sapiens
gaggtggccaagcgaggaaggg

SEQ ID NO: 47267 - DNA, 22 bp, Homo sapiens
aatgtgagccaatgcccgtggg

SEQ ID NO: 47268 - DNA, 22 bp, Homo sapiens
tggtggggccagacttcagctc

SEQ ID NO: 47269 - DNA, 22 bp, Homo sapiens
cttctgagatgttgttttacag

SEQ ID NO: 47270 - DNA, 22 bp, Homo sapiens
tgagatcattgacttgttcctg

SEQ ID NO: 47271 - DNA, 22 bp, Homo sapiens
aggtggggaggagtgtctcttt

SEQ ID NO: 47272 - DNA, 22 bp, Homo sapiens
gtcttgatctcctgaccttgtg

SEQ ID NO: 47273 - DNA, 22 bp, Homo sapiens
cgtggggcgggtggacacttgc

SEQ ID NO: 47274 - DNA, 22 bp, Homo sapiens
agccaggatggtctcgatcggc

SEQ ID NO: 47275 - DNA, 22 bp, Homo sapiens
tattgagaccagtgcttgctta

SEQ ID NO: 47276 - DNA, 22 bp, Homo sapiens
aggggctcctttgtgctgcgtc

SEQ ID NO: 47277 - DNA, 22 bp, Homo sapiens
ctcgggcaccctggttctggtg

SEQ ID NO: 47278 - DNA, 22 bp, Homo sapiens
ctcgggcttgaggctgtttacc

SEQ ID NO: 47279 - DNA, 22 bp, Homo sapiens
agggtgaatctcacaactctta

SEQ ID NO: 47280 - DNA, 22 bp, Homo sapiens
gtgaagttggccagtttagttt

SEQ ID NO: 47281 - DNA, 22 bp, Homo sapiens
cggctggtgtcgggcacagcaa

SEQ ID NO: 47282 - DNA, 22 bp, Homo sapiens
gtagtcccagctaccccggagg

SEQ ID NO: 47283 - DNA, 22 bp, Homo sapiens
aatgccttggagagcctagagg

SEQ ID NO: 47284 - DNA, 19 bp, Homo sapiens
taccatccaagctggtttg

SEQ ID NO: 47285 - DNA, 22 bp, Homo sapiens
gagtttcttcatggtgcagagg

SEQ ID NO: 47286 - DNA, 22 bp, Homo sapiens
ggctggtgttgagtgcctgtag

SEQ ID NO: 47287 - DNA, 22 bp, Homo sapiens
cttttcattgtttgtacatgca

SEQ ID NO: 47288 - DNA, 22 bp, Homo sapiens
actgttttctgtaaagggccag

SEQ ID NO: 47289 - DNA, 22 bp, Homo sapiens
gccccagcctcccgagtagctg

SEQ ID NO: 47290 - DNA, 22 bp, Homo sapiens
ccaggaggcggaggttgcagtg

SEQ ID NO: 47291 - DNA, 22 bp, Homo sapiens
tcaagggcaaatgctacctata

SEQ ID NO: 47292 - DNA, 22 bp, Homo sapiens
acacccaggctggcgtgcagtg

SEQ ID NO: 47293 - DNA, 22 bp, Homo sapiens
gagccaggttggaggctgcagt

SEQ ID NO: 47294 - DNA, 23 bp, Homo sapiens
ccactagcacctgttcaacttct

SEQ ID NO: 47295 - DNA, 22 bp, Homo sapiens
ttccagagagttattcccctgg

SEQ ID NO: 47296 - DNA, 22 bp, Homo sapiens
ctggatcatgggaaagggatca

SEQ ID NO: 47297 - DNA, 22 bp, Homo sapiens
gttcagatttgactggtttctc

SEQ ID NO: 47298 - DNA, 22 bp, Homo sapiens
tccaagatctacagcagtttag

SEQ ID NO: 47299 - DNA, 22 bp, Homo sapiens
gtcatggtgctagcgggaatgt

SEQ ID NO: 47300 - DNA, 22 bp, Homo sapiens
gaccatcctggccaacgtggta

SEQ ID NO: 47301 - DNA, 22 bp, Homo sapiens
cccagctcttcaagtcaccccc

SEQ ID NO: 47302 - DNA, 22 bp, Homo sapiens
ttgatcatttttctggtaaaat

SEQ ID NO: 47303 - DNA, 22 bp, Homo sapiens
atggcaatgaatgactttatgt

SEQ ID NO: 47304 - DNA, 23 bp, Homo sapiens
ggctgggagctccgggtgcacgt

SEQ ID NO: 47305 - DNA, 16 bp, Homo sapiens
cttggtgttggcagag

SEQ ID NO: 47306 - DNA, 22 bp, Homo sapiens
gtcccataagtagtgcaacttg

SEQ ID NO: 47307 - DNA, 22 bp, Homo sapiens
gcagtggcatgatgtgggctca

SEQ ID NO: 47308 - DNA, 22 bp, Homo sapiens
attataggcttgagccaccgtg

SEQ ID NO: 47309 - DNA, 22 bp, Homo sapiens
accacctcatcaagctggattg

SEQ ID NO: 47310 - DNA, 22 bp, Homo sapiens
cccagcagtagagctcatatgg

SEQ ID NO: 47311 - DNA, 22 bp, Homo sapiens
gggcggatcatttgaggtcagg

SEQ ID NO: 47312 - DNA, 22 bp, Homo sapiens
ttcctggaaattatgctcacct

SEQ ID NO: 47313 - DNA, 22 bp, Homo sapiens
ttgtgaatagtgccgcaataaa

SEQ ID NO: 47314 - DNA, 22 bp, Homo sapiens
tagctttgtttatcaaggggca

SEQ ID NO: 47315 - DNA, 22 bp, Homo sapiens
ggctcctgggggtgctcctgcc

SEQ ID NO: 47316 - DNA, 22 bp, Homo sapiens
gggcggatcacctgaggtcagg

SEQ ID NO: 47317 - DNA, 22 bp, Homo sapiens
tgggtgagcggctgcacacccg

SEQ ID NO: 47318 - DNA, 22 bp, Homo sapiens
atgtacataaaatgtataatga

SEQ ID NO: 47319 - DNA, 22 bp, Homo sapiens
tttctttatcatagcatctttg

SEQ ID NO: 47320 - DNA, 22 bp, Homo sapiens
gttactcttccccggggtctgg

SEQ ID NO: 47321 - DNA, 22 bp, Homo sapiens
aagaggtttaactgactcacag

SEQ ID NO: 47322 - DNA, 22 bp, Homo sapiens
gccatcatatcccctgtgacct

SEQ ID NO: 47323 - DNA, 22 bp, Homo sapiens
aacttgccaagagctttgctag

SEQ ID NO: 47324 - DNA, 22 bp, Homo sapiens
cggccaagccggggccccgaag

SEQ ID NO: 47325 - DNA, 22 bp, Homo sapiens
gggctgagacgatggggtcttc

SEQ ID NO: 47326 - DNA, 22 bp, Homo sapiens
tgggggtgtcctggtgcacaca

SEQ ID NO: 47327 - DNA, 22 bp, Homo sapiens
gctgcagtgagccaagatcgtg

SEQ ID NO: 47328 - DNA, 22 bp, Homo sapiens
ggctcactgcaacctctgcctc

SEQ ID NO: 47329 - DNA, 22 bp, Homo sapiens
agaggccggccgagcccatggg

SEQ ID NO: 47330 - DNA, 22 bp, Homo sapiens
taacaatacccattctaattac

SEQ ID NO: 47331 - DNA, 22 bp, Homo sapiens
ggacagccgagtggccttctcc

SEQ ID NO: 47332 - DNA, 22 bp, Homo sapiens
atacagggacatccagtttttc

SEQ ID NO: 47333 - DNA, 22 bp, Homo sapiens
aggtctcttgctgtctctgggc

SEQ ID NO: 47334 - DNA, 22 bp, Homo sapiens
ccctcccaggagtggccagaga

SEQ ID NO: 47335 - DNA, 22 bp, Homo sapiens
gaggcctcatgaggtgagcatt

SEQ ID NO: 47336 - DNA, 22 bp, Homo sapiens
tcaccagatctctctgtaatgg

SEQ ID NO: 47337 - DNA, 22 bp, Homo sapiens
ctgggcacagcgttgggctctt

SEQ ID NO: 47338 - DNA, 22 bp, Homo sapiens
ctgcttctccctgagatagtgt

SEQ ID NO: 47339 - DNA, 22 bp, Homo sapiens
gctgacccctacaggttgtgtt

SEQ ID NO: 47340 - DNA, 22 bp, Homo sapiens
tagcccctgcctttgaacctgg

SEQ ID NO: 47341 - DNA, 22 bp, Homo sapiens
aggggagagttaatgtgaatgt

SEQ ID NO: 47342 - DNA, 22 bp, Homo sapiens
tggtaaggttccagatctagaa

SEQ ID NO: 47343 - DNA, 22 bp, Homo sapiens
ctctgcctgtctcatcctgcaa

SEQ ID NO: 47344 - DNA, 22 bp, Homo sapiens
ctgtatctgtgttggatgagtt

SEQ ID NO: 47345 - DNA, 22 bp, Homo sapiens
agagaagagtcttgtcaaatta

SEQ ID NO: 47346 - DNA, 22 bp, Homo sapiens
acgaggttggagagttgtttgg

SEQ ID NO: 47347 - DNA, 20 bp, Homo sapiens
aaactaaaggtgtttggttt

SEQ ID NO: 47348 - DNA, 22 bp, Homo sapiens
cacagagatggtctggcaggtg

SEQ ID NO: 47349 - DNA, 22 bp, Homo sapiens
aagcagcacagcaatgactcta

SEQ ID NO: 47350 - DNA, 22 bp, Homo sapiens
tgctagtgtgtgagatgttcaa

SEQ ID NO: 47351 - DNA, 22 bp, Homo sapiens
cactgcactccagcctgggtga

SEQ ID NO: 47352 - DNA, 22 bp, Homo sapiens
tgttgattagtgtttagactta

SEQ ID NO: 47353 - DNA, 22 bp, Homo sapiens
atttaagggatttggagaccaa

SEQ ID NO: 47354 - DNA, 22 bp, Homo sapiens
caggaaggcgcggctgtgcctg

SEQ ID NO: 47355 - DNA, 22 bp, Homo sapiens
atatatttgagaatattcatga

SEQ ID NO: 47356 - DNA, 22 bp, Homo sapiens
agtgtgttgtaggctcaaatgg

SEQ ID NO: 47357 - DNA, 22 bp, Homo sapiens
ggctcactgcaacttccgcctc

SEQ ID NO: 47358 - DNA, 22 bp, Homo sapiens
cagggccagcgtctcgggctat

SEQ ID NO: 47359 - DNA, 21 bp, Homo sapiens
tggttcagttcgttacgtgtg

SEQ ID NO: 47360 - DNA, 22 bp, Homo sapiens
caggaaggggctcactctggcc

SEQ ID NO: 47361 - DNA, 22 bp, Homo sapiens
gtgtggctgaaatcaaggcagg

SEQ ID NO: 47362 - DNA, 22 bp, Homo sapiens
attgtgtcctcattgaccttca

SEQ ID NO: 47363 - DNA, 22 bp, Homo sapiens
cagtggctggttagggacagga

SEQ ID NO: 47364 - DNA, 22 bp, Homo sapiens
cgtgagcaaaatggacactccc

SEQ ID NO: 47365 - DNA, 22 bp, Homo sapiens
ctagttgaagaggctgtcatca

SEQ ID NO: 47366 - DNA, 22 bp, Homo sapiens
tccctgcaggtgtgcaagctga

SEQ ID NO: 47367 - DNA, 22 bp, Homo sapiens
tgcagtggcgccatctcagctc

SEQ ID NO: 47368 - DNA, 22 bp, Homo sapiens
gatccgaatcattgctctttta

SEQ ID NO: 47369 - DNA, 22 bp, Homo sapiens
gagccaggggtcagctccgagg

SEQ ID NO: 47370 - DNA, 22 bp, Homo sapiens
gctgtatgtgaggccacagtga

SEQ ID NO: 47371 - DNA, 22 bp, Homo sapiens
taagtcccccacttgccacagg

SEQ ID NO: 47372 - DNA, 22 bp, Homo sapiens
ttccacattccttacattcata

SEQ ID NO: 47373 - DNA, 22 bp, Homo sapiens
ctggagggctgcagcgaggctg

SEQ ID NO: 47374 - DNA, 22 bp, Homo sapiens
atgcaggcagacactgtgggca

SEQ ID NO: 47375 - DNA, 22 bp, Homo sapiens
ccagctttatagcttcaaagga

SEQ ID NO: 47376 - DNA, 22 bp, Homo sapiens
ttgcttcttagatattcctctc

SEQ ID NO: 47377 - DNA, 22 bp, Homo sapiens
tagcaaaggatgactatgtacc

SEQ ID NO: 47378 - DNA, 22 bp, Homo sapiens
tgttcttaggtatttgacagtc

SEQ ID NO: 47379 - DNA, 22 bp, Homo sapiens
ggctctgcgcctgcggggactt

SEQ ID NO: 47380 - DNA, 22 bp, Homo sapiens
aggctctgtcaggcggagcagc

SEQ ID NO: 47381 - DNA, 22 bp, Homo sapiens
gtaatctcagctacttgggagg

SEQ ID NO: 47382 - DNA, 22 bp, Homo sapiens
tgggaggccgaggcaggtggat

SEQ ID NO: 47383 - DNA, 22 bp, Homo sapiens
cgtcatcacggcaagcatctcc

SEQ ID NO: 47384 - DNA, 22 bp, Homo sapiens
tgtgacctcatcttaactggaa

SEQ ID NO: 47385 - DNA, 22 bp, Homo sapiens
caggaacagggtgtcctggcag

SEQ ID NO: 47386 - DNA, 22 bp, Homo sapiens
acacggcactttaggaaggggc

SEQ ID NO: 47387 - DNA, 22 bp, Homo sapiens
ggccctggcagccacgaaagcc

SEQ ID NO: 47388 - DNA, 22 bp, Homo sapiens
gctgcagggagctggaaggctc

SEQ ID NO: 47389 - DNA, 21 bp, Homo sapiens
agcgtcaatatcgtcaacagg

SEQ ID NO: 47390 - DNA, 22 bp, Homo sapiens
attgggatgccggctgataaga

SEQ ID NO: 47391 - DNA, 22 bp, Homo sapiens
tgtcatagtgtggtagcagtgg

SEQ ID NO: 47392 - DNA, 22 bp, Homo sapiens
tacctcaagttccaggaaagcg

SEQ ID NO: 47393 - DNA, 22 bp, Homo sapiens
ccgcaaggcagaggttgcagtg

SEQ ID NO: 47394 - DNA, 22 bp, Homo sapiens
ttgctcttgaaaattgatgctg

SEQ ID NO: 47395 - DNA, 22 bp, Homo sapiens
tccagcccaggctggagtgtag

SEQ ID NO: 47396 - DNA, 22 bp, Homo sapiens
agcccaggagtttgaggctgtg

SEQ ID NO: 47397 - DNA, 22 bp, Homo sapiens
cagcttggaggaggatctaaga

SEQ ID NO: 47398 - DNA, 23 bp, Homo sapiens
tgggttcattcttgaagtcagtg

SEQ ID NO: 47399 - DNA, 22 bp, Homo sapiens
catctttgcccatccacttcca

SEQ ID NO: 47400 - DNA, 22 bp, Homo sapiens
cccgtgtgtgcgaggctcccgc

SEQ ID NO: 47401 - DNA, 22 bp, Homo sapiens
tcagccagccagctacaggctt

SEQ ID NO: 47402 - DNA, 22 bp, Homo sapiens
tttgaggttagctagcagatca

SEQ ID NO: 47403 - DNA, 22 bp, Homo sapiens
gttgaagtaaggcagccacagg

SEQ ID NO: 47404 - DNA, 22 bp, Homo sapiens
tccccagcttgctacttctgct

SEQ ID NO: 47405 - DNA, 22 bp, Homo sapiens
tctaatcctatggtggggaggg

SEQ ID NO: 47406 - DNA, 22 bp, Homo sapiens
aaaaatcacttttataggcagc

SEQ ID NO: 47407 - DNA, 22 bp, Homo sapiens
agtgctatcgagttctaatgct

SEQ ID NO: 47408 - DNA, 22 bp, Homo sapiens
gtccaaaagagccagccgggcg

SEQ ID NO: 47409 - DNA, 22 bp, Homo sapiens
aacactgcctacactttatgaa

SEQ ID NO: 47410 - DNA, 22 bp, Homo sapiens
tgagatggagtctcactctgtt

SEQ ID NO: 47411 - DNA, 22 bp, Homo sapiens
ttgagcccaggaggcctgggtg

SEQ ID NO: 47412 - DNA, 22 bp, Homo sapiens
gccaggttgctgacgacgatct

SEQ ID NO: 47413 - DNA, 22 bp, Homo sapiens
gcaggcagatcacctgtcagga

SEQ ID NO: 47414 - DNA, 22 bp, Homo sapiens
gtagcccacctggggagggcga

SEQ ID NO: 47415 - DNA, 22 bp, Homo sapiens
tgactggattgtcattacgacg

SEQ ID NO: 47416 - DNA, 22 bp, Homo sapiens
acgcctgtaatcccagcacttt

SEQ ID NO: 47417 - DNA, 22 bp, Homo sapiens
ccactgcacttcagcctgggtg

SEQ ID NO: 47418 - DNA, 22 bp, Homo sapiens
ccacccttgggttcggaggccg

SEQ ID NO: 47419 - DNA, 22 bp, Homo sapiens
cccaggggttctgagcagcagc

SEQ ID NO: 47420 - DNA, 22 bp, Homo sapiens
gggctctcccacaacgtgccag

SEQ ID NO: 47421 - DNA, 22 bp, Homo sapiens
ctcagcagtatactctgaagat

SEQ ID NO: 47422 - DNA, 22 bp, Homo sapiens
ggggatggaggcgtgtggtcct

SEQ ID NO: 47423 - DNA, 22 bp, Homo sapiens
atggccgcctgtccttcccgcc

SEQ ID NO: 47424 - DNA, 22 bp, Homo sapiens
aggagaagccaagttgtgagca

SEQ ID NO: 47425 - DNA, 22 bp, Homo sapiens
gggttgaggcggatgtcggcgg

SEQ ID NO: 47426 - DNA, 22 bp, Homo sapiens
ggccttggttccaaagcaggca

SEQ ID NO: 47427 - DNA, 21 bp, Homo sapiens
tgactgaggcttcttcacaca

SEQ ID NO: 47428 - DNA, 22 bp, Homo sapiens
gttcaagaccagcctggccaac

SEQ ID NO: 47429 - DNA, 22 bp, Homo sapiens
ggctgcaggttggttggcagct

SEQ ID NO: 47430 - DNA, 22 bp, Homo sapiens
ggtgacctcacctggtcccacc

SEQ ID NO: 47431 - DNA, 22 bp, Homo sapiens
aagatattcaaagatttattag

SEQ ID NO: 47432 - DNA, 22 bp, Homo sapiens
ttcagcagtgcagacacccagt

SEQ ID NO: 47433 - DNA, 22 bp, Homo sapiens
cctgtaactccttggctcaagt

SEQ ID NO: 47434 - DNA, 22 bp, Homo sapiens
ttgttcttgtctttgccttcac

SEQ ID NO: 47435 - DNA, 22 bp, Homo sapiens
ataatggaaaagatcatttcct

SEQ ID NO: 47436 - DNA, 22 bp, Homo sapiens
atgaattgaggaaaacagtcgt

SEQ ID NO: 47437 - DNA, 22 bp, Homo sapiens
ggccctggtcctaggggtggaa

SEQ ID NO: 47438 - DNA, 22 bp, Homo sapiens
ggagaggggaacttgttgcttg

SEQ ID NO: 47439 - DNA, 22 bp, Homo sapiens
cacagggcttctcatggggtgc

SEQ ID NO: 47440 - DNA, 22 bp, Homo sapiens
ggtgacagtggttaaaatttgt

SEQ ID NO: 47441 - DNA, 21 bp, Homo sapiens
gggcagaggggcctcctgggt

SEQ ID NO: 47442 - DNA, 22 bp, Homo sapiens
caccagcagcggtgtgagggtg

SEQ ID NO: 47443 - DNA, 22 bp, Homo sapiens
tacaacaatttccacattagaa

SEQ ID NO: 47444 - DNA, 22 bp, Homo sapiens
cagtgcatgcacacacatggta

SEQ ID NO: 47445 - DNA, 22 bp, Homo sapiens
actgattgcattcatagggttt

SEQ ID NO: 47446 - DNA, 22 bp, Homo sapiens
tgtctttgttattgtggacagg

SEQ ID NO: 47447 - DNA, 22 bp, Homo sapiens
tttattctgtgctacatgaaga

SEQ ID NO: 47448 - DNA, 22 bp, Homo sapiens
ggagcagggaattacagcgcag

SEQ ID NO: 47449 - DNA, 22 bp, Homo sapiens
gggaaatctcgtcctctattta

SEQ ID NO: 47450 - DNA, 23 bp, Homo sapiens
ggaagctcacgtagtcctgcact

SEQ ID NO: 47451 - DNA, 22 bp, Homo sapiens
ggtgacgaatccatagcatcga

SEQ ID NO: 47452 - DNA, 22 bp, Homo sapiens
tggctaaaccctagtaaattaa

SEQ ID NO: 47453 - DNA, 22 bp, Homo sapiens
ctgtaatcccagctactcggga

SEQ ID NO: 47454 - DNA, 22 bp, Homo sapiens
gtggcttggaccagtcacagtg

SEQ ID NO: 47455 - DNA, 22 bp, Homo sapiens
cactgcactccagcactccagc

SEQ ID NO: 47456 - DNA, 22 bp, Homo sapiens
tcttttgtgattctttagttac

SEQ ID NO: 47457 - DNA, 22 bp, Homo sapiens
gctggtagacctcactgcactc

SEQ ID NO: 47458 - DNA, 22 bp, Homo sapiens
tcagcagtgagaattaatgttg

SEQ ID NO: 47459 - DNA, 22 bp, Homo sapiens
ttcctttctctggactgcagcc

SEQ ID NO: 47460 - DNA, 22 bp, Homo sapiens
attgagaagaaaatctaatata

SEQ ID NO: 47461 - DNA, 22 bp, Homo sapiens
tgacagagtgacactcttgtct

SEQ ID NO: 47462 - DNA, 22 bp, Homo sapiens
tccaggctttggggcaggagcg

SEQ ID NO: 47463 - DNA, 22 bp, Homo sapiens
ttctccctgtcctatcaagact

SEQ ID NO: 47464 - DNA, 22 bp, Homo sapiens
agcccttggtattttccgatcc

SEQ ID NO: 47465 - DNA, 22 bp, Homo sapiens
tgtgtcattgccatgaaaaggc

SEQ ID NO: 47466 - DNA, 22 bp, Homo sapiens
actgtgaacggactgaagccca

SEQ ID NO: 47467 - DNA, 22 bp, Homo sapiens
tagaaaagccccagctggaggg

SEQ ID NO: 47468 - DNA, 22 bp, Homo sapiens
ttcctagggcagagccgctggg

SEQ ID NO: 47469 - DNA, 22 bp, Homo sapiens
gggaagatagtgttgagggccc

SEQ ID NO: 47470 - DNA, 22 bp, Homo sapiens
gcagaagcacaggtgacgggcc

SEQ ID NO: 47471 - DNA, 22 bp, Homo sapiens
ggcgctcagtgttgccccagag

SEQ ID NO: 47472 - DNA, 22 bp, Homo sapiens
tgctgtgaggttgagaaggaag

SEQ ID NO: 47473 - DNA, 22 bp, Homo sapiens
ccaggcaggcgatggtgcagtg

SEQ ID NO: 47474 - DNA, 22 bp, Homo sapiens
aggagcagaccgtagtcctgca

SEQ ID NO: 47475 - DNA, 22 bp, Homo sapiens
ggaggaggggtgactgaatgct

SEQ ID NO: 47476 - DNA, 22 bp, Homo sapiens
gccagcagcttcttctcatcct

SEQ ID NO: 47477 - DNA, 22 bp, Homo sapiens
ggtcgagtcacttgttgccttt

SEQ ID NO: 47478 - DNA, 22 bp, Homo sapiens
gaagccttgaactgcaaacccc

SEQ ID NO: 47479 - DNA, 22 bp, Homo sapiens
tgtctcttttcaagctaccctt

SEQ ID NO: 47480 - DNA, 22 bp, Homo sapiens
cactgcaacctccacctcctgg

SEQ ID NO: 47481 - DNA, 22 bp, Homo sapiens
ttattttaccttcctctgagct

SEQ ID NO: 47482 - DNA, 22 bp, Homo sapiens
tttaaaaaactagtctgagtct

SEQ ID NO: 47483 - DNA, 20 bp, Homo sapiens
ctttaactggaaggctgctt

SEQ ID NO: 47484 - DNA, 22 bp, Homo sapiens
ctggctgggagcgagctgctca

SEQ ID NO: 47485 - DNA, 22 bp, Homo sapiens
tgaggcaggagttcaggctgcg

SEQ ID NO: 47486 - DNA, 22 bp, Homo sapiens
gtccaggagctcagggcttatt

SEQ ID NO: 47487 - DNA, 22 bp, Homo sapiens
aaaaagtattggccatggttga

SEQ ID NO: 47488 - DNA, 20 bp, Homo sapiens
ggcagagggcctgggagaag

SEQ ID NO: 47489 - DNA, 22 bp, Homo sapiens
gtggatggagctggaagccatt

SEQ ID NO: 47490 - DNA, 22 bp, Homo sapiens
cccagaaggtcgaggctgcagt

SEQ ID NO: 47491 - DNA, 22 bp, Homo sapiens
cccaggaggtcgaagctgcagt

SEQ ID NO: 47492 - DNA, 22 bp, Homo sapiens
tgggaagggtcaacagctggaa

SEQ ID NO: 47493 - DNA, 22 bp, Homo sapiens
tgatcaaaacattactccacca

SEQ ID NO: 47494 - DNA, 22 bp, Homo sapiens
ggctttgacatgctgaattaaa

SEQ ID NO: 47495 - DNA, 22 bp, Homo sapiens
tcttcctggatgggggttgatg

SEQ ID NO: 47496 - DNA, 22 bp, Homo sapiens
tttcataatactgtacatgaaa

SEQ ID NO: 47497 - DNA, 22 bp, Homo sapiens
aacccgggaggcggaggttgtg

SEQ ID NO: 47498 - DNA, 22 bp, Homo sapiens
tgcaaatgtgttttaaaccaaa

SEQ ID NO: 47499 - DNA, 22 bp, Homo sapiens
gccaccccataggtgttaggtg

SEQ ID NO: 47500 - DNA, 22 bp, Homo sapiens
gaggcagaggttgcagtgagct

SEQ ID NO: 47501 - DNA, 22 bp, Homo sapiens
ttcatcttgatggcttcctaat

SEQ ID NO: 47502 - DNA, 22 bp, Homo sapiens
acatgtttaagtttgttatatg

SEQ ID NO: 47503 - DNA, 22 bp, Homo sapiens
cactgcactccagcccgggcaa

SEQ ID NO: 47504 - DNA, 22 bp, Homo sapiens
ccttcccatgcagcctgtctga

SEQ ID NO: 47505 - DNA, 22 bp, Homo sapiens
gggctagcctcttccctgctcc

SEQ ID NO: 47506 - DNA, 22 bp, Homo sapiens
gttccagtatgattccacccat

SEQ ID NO: 47507 - DNA, 22 bp, Homo sapiens
aaattagtcatgttgtattact

SEQ ID NO: 47508 - DNA, 22 bp, Homo sapiens
ggggccttggatctgtgccccg

SEQ ID NO: 47509 - DNA, 22 bp, Homo sapiens
gtgttgatgacattttagaaac

SEQ ID NO: 47510 - DNA, 22 bp, Homo sapiens
tttggaaattttcatccagaca

SEQ ID NO: 47511 - DNA, 22 bp, Homo sapiens
tagggcaatatttcccagaaaa

SEQ ID NO: 47512 - DNA, 22 bp, Homo sapiens
gaagtgtagtcttgagccccca

SEQ ID NO: 47513 - DNA, 22 bp, Homo sapiens
ttgtgaatggtgccgcaataaa

SEQ ID NO: 47514 - DNA, 22 bp, Homo sapiens
cggggttcatccatgctgtggc

SEQ ID NO: 47515 - DNA, 22 bp, Homo sapiens
aaggccctggcaggaagcagga

SEQ ID NO: 47516 - DNA, 22 bp, Homo sapiens
gtccacagctctgaggtctccc

SEQ ID NO: 47517 - DNA, 22 bp, Homo sapiens
ttcttgggaatttttccaacac

SEQ ID NO: 47518 - DNA, 22 bp, Homo sapiens
ggcctcttatctggctcctgca

SEQ ID NO: 47519 - DNA, 22 bp, Homo sapiens
tccttaggcaatttgggagagt

SEQ ID NO: 47520 - DNA, 22 bp, Homo sapiens
tcactgcaacctccacctcctg

SEQ ID NO: 47521 - DNA, 17 bp, Homo sapiens
ccctcactcctgccggg

SEQ ID NO: 47522 - DNA, 22 bp, Homo sapiens
tttctgagaaattaaacacttt

SEQ ID NO: 47523 - DNA, 22 bp, Homo sapiens
gttgagtgggttaggatgctga

SEQ ID NO: 47524 - DNA, 22 bp, Homo sapiens
tgcctgtggaaaggctggtgct

SEQ ID NO: 47525 - DNA, 22 bp, Homo sapiens
cacctgtacagggccgggctgg

SEQ ID NO: 47526 - DNA, 22 bp, Homo sapiens
ggggcaggagcccttcttcagc

SEQ ID NO: 47527 - DNA, 22 bp, Homo sapiens
atatattttttgagacagagtc

SEQ ID NO: 47528 - DNA, 22 bp, Homo sapiens
atacaaaaattagccgggagta

SEQ ID NO: 47529 - DNA, 19 bp, Homo sapiens
catggtgaaaccccgtctc

SEQ ID NO: 47530 - DNA, 22 bp, Homo sapiens
ggccagaagttggaaaagagcc

SEQ ID NO: 47531 - DNA, 22 bp, Homo sapiens
ctgcatccatgttgctgcaaag

SEQ ID NO: 47532 - DNA, 22 bp, Homo sapiens
cacactgtctttcagaatggtt

SEQ ID NO: 47533 - DNA, 22 bp, Homo sapiens
tggcacagcctccatgtcgtcc

SEQ ID NO: 47534 - DNA, 22 bp, Homo sapiens
cacatgaaggctggggtcgtga

SEQ ID NO: 47535 - DNA, 22 bp, Homo sapiens
cccaggaggcctgcctggccgg

SEQ ID NO: 47536 - DNA, 22 bp, Homo sapiens
ttattgaaggaactgaaataaa

SEQ ID NO: 47537 - DNA, 22 bp, Homo sapiens
actgcactccagcctgggtaac

SEQ ID NO: 47538 - DNA, 17 bp, Homo sapiens
tggctctgtcctcagct

SEQ ID NO: 47539 - DNA, 22 bp, Homo sapiens
gacaggtgctaagggacctggc

SEQ ID NO: 47540 - DNA, 22 bp, Homo sapiens
aggaaataggaccagacaaagc

SEQ ID NO: 47541 - DNA, 22 bp, Homo sapiens
tctgtggcccaagtgatggctg

SEQ ID NO: 47542 - DNA, 22 bp, Homo sapiens
aaaggacacacaggaggtgtct

SEQ ID NO: 47543 - DNA, 23 bp, Homo sapiens
aggtaggttattgctgctacctg

SEQ ID NO: 47544 - DNA, 22 bp, Homo sapiens
ataaaatttgctactgttaaat

SEQ ID NO: 47545 - DNA, 22 bp, Homo sapiens
tttgattgcaatagttttatga

SEQ ID NO: 47546 - DNA, 23 bp, Homo sapiens
tgtgggcgcattgtaagggtagc

SEQ ID NO: 47547 - DNA, 22 bp, Homo sapiens
tgcacgtgggctctctgctctt

SEQ ID NO: 47548 - DNA, 22 bp, Homo sapiens
gctcttgtcaaaaattagttga

SEQ ID NO: 47549 - DNA, 22 bp, Homo sapiens
agtcaaagatgaccgagttcct

SEQ ID NO: 47550 - DNA, 22 bp, Homo sapiens
gtggggacgggatggctcactg

SEQ ID NO: 47551 - DNA, 23 bp, Homo sapiens
gcagccatgttcccgtctcagct

SEQ ID NO: 47552 - DNA, 22 bp, Homo sapiens
attgtactacaccatagtactg

SEQ ID NO: 47553 - DNA, 22 bp, Homo sapiens
gaccctgtttctacaaataatt

SEQ ID NO: 47554 - DNA, 22 bp, Homo sapiens
attgtactccagcctgggtgac

SEQ ID NO: 47555 - DNA, 22 bp, Homo sapiens
tgagcaggcgcagcaggaggtc

SEQ ID NO: 47556 - DNA, 22 bp, Homo sapiens
cagagagaatcttggcagctga

SEQ ID NO: 47557 - DNA, 22 bp, Homo sapiens
aaagaaatagatggcatttaaa

SEQ ID NO: 47558 - DNA, 22 bp, Homo sapiens
tcactacaacctccgcctcctg

SEQ ID NO: 47559 - DNA, 22 bp, Homo sapiens
tttttgggtccaggctgtatct

SEQ ID NO: 47560 - DNA, 22 bp, Homo sapiens
tctctagtctcctttaacctga

SEQ ID NO: 47561 - DNA, 22 bp, Homo sapiens
agagggcattaactctgtcttg

SEQ ID NO: 47562 - DNA, 22 bp, Homo sapiens
agggctggagccacagctggga

SEQ ID NO: 47563 - DNA, 23 bp, Homo sapiens
cctgcctccccatcagttataca

SEQ ID NO: 47564 - DNA, 22 bp, Homo sapiens
agagtccctcttcccaggaggc

SEQ ID NO: 47565 - DNA, 22 bp, Homo sapiens
aggtggaaatggctttcctagg

SEQ ID NO: 47566 - DNA, 22 bp, Homo sapiens
tcacccaggctggagtgcagtg

SEQ ID NO: 47567 - DNA, 22 bp, Homo sapiens
tctcccaggcaggagtgcagtg

SEQ ID NO: 47568 - DNA, 22 bp, Homo sapiens
ccggctactcgggaggctgacg

SEQ ID NO: 47569 - DNA, 22 bp, Homo sapiens
aattttctggtgtgtaatgaag

SEQ ID NO: 47570 - DNA, 22 bp, Homo sapiens
caaagctggaaaaggaggctgg

SEQ ID NO: 47571 - DNA, 22 bp, Homo sapiens
gttcagtcacgtgcccaagttc

SEQ ID NO: 47572 - DNA, 22 bp, Homo sapiens
gggcagccgcgtgacctgccag

SEQ ID NO: 47573 - DNA, 22 bp, Homo sapiens
gcagaggacacaggagggcaag

SEQ ID NO: 47574 - DNA, 22 bp, Homo sapiens
gggtacagttcttccagtgtca

SEQ ID NO: 47575 - DNA, 22 bp, Homo sapiens
tgaaatgtgtaatgtggatgcc

SEQ ID NO: 47576 - DNA, 19 bp, Homo sapiens
ttccatctatcttcttact

SEQ ID NO: 47577 - DNA, 22 bp, Homo sapiens
gccatgcttggtatgctgtgag

SEQ ID NO: 47578 - DNA, 22 bp, Homo sapiens
ccaggaggttgaggctgcagtg

SEQ ID NO: 47579 - DNA, 17 bp, Homo sapiens
cccgttctcttcgctgg

SEQ ID NO: 47580 - DNA, 22 bp, Homo sapiens
gaggtgggcggatcacaaggtc

SEQ ID NO: 47581 - DNA, 22 bp, Homo sapiens
ggctttctgtctgcgtctgtgt

SEQ ID NO: 47582 - DNA, 22 bp, Homo sapiens
ggacattgaagctggaaaggga

SEQ ID NO: 47583 - DNA, 22 bp, Homo sapiens
gtgcagagaggaccttggggag

SEQ ID NO: 47584 - DNA, 22 bp, Homo sapiens
cccaggaattggaggctgcagt

SEQ ID NO: 47585 - DNA, 22 bp, Homo sapiens
acccaggagacggaggtgcagt

SEQ ID NO: 47586 - DNA, 22 bp, Homo sapiens
ggtcccaggttgacagggagac

SEQ ID NO: 47587 - DNA, 22 bp, Homo sapiens
aatatcatctctcttttctgca

SEQ ID NO: 47588 - DNA, 22 bp, Homo sapiens
agagcagctcgctacctctcta

SEQ ID NO: 47589 - DNA, 23 bp, Homo sapiens
atgtttgcagtaacccatcctgg

SEQ ID NO: 47590 - DNA, 22 bp, Homo sapiens
ttgtgttaaggtgcatctagtg

SEQ ID NO: 47591 - DNA, 22 bp, Homo sapiens
gcctcctgtcccaggctgagga

SEQ ID NO: 47592 - DNA, 22 bp, Homo sapiens
gacaattagatcattcctttga

SEQ ID NO: 47593 - DNA, 22 bp, Homo sapiens
ttaataaagtatgaattggaaa

SEQ ID NO: 47594 - DNA, 21 bp, Homo sapiens
aggcttggatctagacaggcc

SEQ ID NO: 47595 - DNA, 22 bp, Homo sapiens
agaggaggctctgggatcgtcc

SEQ ID NO: 47596 - DNA, 22 bp, Homo sapiens
cagccagtgtgaccgaggagga

SEQ ID NO: 47597 - DNA, 22 bp, Homo sapiens
ttttcatttttgtagatgcaag

SEQ ID NO: 47598 - DNA, 22 bp, Homo sapiens
atgccactgcgctccagcctgg

SEQ ID NO: 47599 - DNA, 22 bp, Homo sapiens
ttctcatgaaactcgcttcctc

SEQ ID NO: 47600 - DNA, 22 bp, Homo sapiens
ccaggaggcagaagttgcagtg

SEQ ID NO: 47601 - DNA, 22 bp, Homo sapiens
tctgcaggaagctggcggctga

SEQ ID NO: 47602 - DNA, 22 bp, Homo sapiens
gtcttgatctcctgaccttgtg

SEQ ID NO: 47603 - DNA, 22 bp, Homo sapiens
tctctcaggctggagtgcagtg

SEQ ID NO: 47604 - DNA, 22 bp, Homo sapiens
cttgtcttgcacacggttgcca

SEQ ID NO: 47605 - DNA, 22 bp, Homo sapiens
ttatgatttgccacagattggt

SEQ ID NO: 47606 - DNA, 22 bp, Homo sapiens
caggtgtgccgggagcagtttg

SEQ ID NO: 47607 - DNA, 22 bp, Homo sapiens
ctctcagtcctgcgcgcctctg

SEQ ID NO: 47608 - DNA, 22 bp, Homo sapiens
cccagcaggaggaggttgcagt

SEQ ID NO: 47609 - DNA, 22 bp, Homo sapiens
agggtggcactggtggctctat

SEQ ID NO: 47610 - DNA, 22 bp, Homo sapiens
tcatctaagagtcttacattta

SEQ ID NO: 47611 - DNA, 22 bp, Homo sapiens
tttggaaatgaccccgtctaag

SEQ ID NO: 47612 - DNA, 17 bp, Homo sapiens
ggcctgcacctcctgct

SEQ ID NO: 47613 - DNA, 22 bp, Homo sapiens
aactctatttaccctactaaac

SEQ ID NO: 47614 - DNA, 22 bp, Homo sapiens
atttggcagtataaattctggc

SEQ ID NO: 47615 - DNA, 22 bp, Homo sapiens
tggcatctttgtcccagaagct

SEQ ID NO: 47616 - DNA, 22 bp, Homo sapiens
gggctgggattgcttgctgtga

SEQ ID NO: 47617 - DNA, 22 bp, Homo sapiens
aaggccctgtctccaaatacag

SEQ ID NO: 47618 - DNA, 22 bp, Homo sapiens
gctccgccacgcccactcctac

SEQ ID NO: 47619 - DNA, 22 bp, Homo sapiens
ccacactccccgcaggcgtagg

SEQ ID NO: 47620 - DNA, 22 bp, Homo sapiens
tcggggtctttgacacgctctg

SEQ ID NO: 47621 - DNA, 22 bp, Homo sapiens
ctggagggtggagagaagtctc

SEQ ID NO: 47622 - DNA, 22 bp, Homo sapiens
gccggggctggggagagacatg

SEQ ID NO: 47623 - DNA, 22 bp, Homo sapiens
aatgttgcagagtgattgtcca

SEQ ID NO: 47624 - DNA, 22 bp, Homo sapiens
taacatttaaatttttcacata

SEQ ID NO: 47625 - DNA, 22 bp, Homo sapiens
tgcctctgaggaagattgtgtt

SEQ ID NO: 47626 - DNA, 22 bp, Homo sapiens
ccagaagcagagcctgaggcag

SEQ ID NO: 47627 - DNA, 22 bp, Homo sapiens
cctggcaggtggcgccctcggc

SEQ ID NO: 47628 - DNA, 17 bp, Homo sapiens
tgtatttatcatgtcag

SEQ ID NO: 47629 - DNA, 22 bp, Homo sapiens
ccgggcgggggctctcgtcacc

SEQ ID NO: 47630 - DNA, 22 bp, Homo sapiens
ttaggctgttcttgtgttgtta

SEQ ID NO: 47631 - DNA, 22 bp, Homo sapiens
actgcaacctccacctcctggg

SEQ ID NO: 47632 - DNA, 22 bp, Homo sapiens
tggctccacaggccagggtgtg

SEQ ID NO: 47633 - DNA, 22 bp, Homo sapiens
tgggcgacagagcaagactccg

SEQ ID NO: 47634 - DNA, 20 bp, Homo sapiens
aagacaccagtggcagcccc

SEQ ID NO: 47635 - DNA, 22 bp, Homo sapiens
cacttgttggtggtgaaatcac

SEQ ID NO: 47636 - DNA, 22 bp, Homo sapiens
ggctcactgcaaactgtgcctc

SEQ ID NO: 47637 - DNA, 22 bp, Homo sapiens
cagtaatagaggctttgagtct

SEQ ID NO: 47638 - DNA, 22 bp, Homo sapiens
aggctctcaccctctgaccaga

SEQ ID NO: 47639 - DNA, 22 bp, Homo sapiens
gagcccaggagtttgatgctgc

SEQ ID NO: 47640 - DNA, 22 bp, Homo sapiens
agagcggggatagttaatattc

SEQ ID NO: 47641 - DNA, 22 bp, Homo sapiens
aggctagaggcttctggcttca

SEQ ID NO: 47642 - DNA, 22 bp, Homo sapiens
tcccacaggtggagcttgcagt

SEQ ID NO: 47643 - DNA, 22 bp, Homo sapiens
tcaccggcagacgtggcctgat

SEQ ID NO: 47644 - DNA, 22 bp, Homo sapiens
tgggaaggggagctggaaagga

SEQ ID NO: 47645 - DNA, 22 bp, Homo sapiens
gtctcccagcctacatctttct

SEQ ID NO: 47646 - DNA, 22 bp, Homo sapiens
ggaatcctgccagctctgcccc

SEQ ID NO: 47647 - DNA, 22 bp, Homo sapiens
catcactgtccaaagttcagtt

SEQ ID NO: 47648 - DNA, 22 bp, Homo sapiens
cacccaggctggagagcagtgg

SEQ ID NO: 47649 - DNA, 22 bp, Homo sapiens
tccaaagtgttgggattatagg

SEQ ID NO: 47650 - DNA, 22 bp, Homo sapiens
actcagtacatctggagttggc

SEQ ID NO: 47651 - DNA, 20 bp, Homo sapiens
acgtggccaccagtggctta

SEQ ID NO: 47652 - DNA, 22 bp, Homo sapiens
ctgcaccgtgtctcgggctgcc

SEQ ID NO: 47653 - DNA, 22 bp, Homo sapiens
gctgatggaaggacaggcgccg

SEQ ID NO: 47654 - DNA, 18 bp, Homo sapiens
agaggatgcatctaagag

SEQ ID NO: 47655 - DNA, 22 bp, Homo sapiens
aggcaagggggcgccaccttcc

SEQ ID NO: 47656 - DNA, 19 bp, Homo sapiens
taggaccctggtggccccc

SEQ ID NO: 47657 - DNA, 22 bp, Homo sapiens
tcctagttctctgccagtcgct

SEQ ID NO: 47658 - DNA, 22 bp, Homo sapiens
atgagtatatgatatggtttgg

SEQ ID NO: 47659 - DNA, 22 bp, Homo sapiens
agatcacagtggcaactccctt

SEQ ID NO: 47660 - DNA, 20 bp, Homo sapiens
ttgttagaggaatgccatag

SEQ ID NO: 47661 - DNA, 22 bp, Homo sapiens
tgtgggagaaggaagcaagctg

SEQ ID NO: 47662 - DNA, 22 bp, Homo sapiens
ctgccctggggggcctccttgc

SEQ ID NO: 47663 - DNA, 22 bp, Homo sapiens
cccaggaggtggaggctgcagt

SEQ ID NO: 47664 - DNA, 22 bp, Homo sapiens
tgagaaattacttcagtgatgg

SEQ ID NO: 47665 - DNA, 22 bp, Homo sapiens
aggaaggactccatggtccgtc

SEQ ID NO: 47666 - DNA, 22 bp, Homo sapiens
cagcagcagtggctgcagaaca

SEQ ID NO: 47667 - DNA, 22 bp, Homo sapiens
atgcccctggcctggggaacat

SEQ ID NO: 47668 - DNA, 22 bp, Homo sapiens
ggtgagcagctgtctgtatgga

SEQ ID NO: 47669 - DNA, 22 bp, Homo sapiens
ctcaggacccggtccaggtggg

SEQ ID NO: 47670 - DNA, 22 bp, Homo sapiens
ctgggaggcggaggttgcagtg

SEQ ID NO: 47671 - DNA, 22 bp, Homo sapiens
aagagggctgcaatcttattgc

SEQ ID NO: 47672 - DNA, 22 bp, Homo sapiens
aagcccttggcgcacaccgggc

SEQ ID NO: 47673 - DNA, 22 bp, Homo sapiens
atgccactgcacttcagcttgg

SEQ ID NO: 47674 - DNA, 22 bp, Homo sapiens
ccactgcactccagccttggca

SEQ ID NO: 47675 - DNA, 22 bp, Homo sapiens
gtgacaatattagctcaggggc

SEQ ID NO: 47676 - DNA, 22 bp, Homo sapiens
ttccctaatgtctaacgctatt

SEQ ID NO: 47677 - DNA, 22 bp, Homo sapiens
agtggccagcagcctagcctag

SEQ ID NO: 47678 - DNA, 22 bp, Homo sapiens
ccttttatagatcagtgtgtta

SEQ ID NO: 47679 - DNA, 22 bp, Homo sapiens
gagctgggcctgcgagtgctgc

SEQ ID NO: 47680 - DNA, 22 bp, Homo sapiens
tccacaaggcagctcctccagg

SEQ ID NO: 47681 - DNA, 22 bp, Homo sapiens
gatctggaatctgaaggctgag

SEQ ID NO: 47682 - DNA, 22 bp, Homo sapiens
tcaatcacgtgttccatgttct

SEQ ID NO: 47683 - DNA, 22 bp, Homo sapiens
ctgcttctagcaccaagtccct

SEQ ID NO: 47684 - DNA, 22 bp, Homo sapiens
gcctgcagggcctgggcctacc

SEQ ID NO: 47685 - DNA, 22 bp, Homo sapiens
tcctccagttccttggtttcag

SEQ ID NO: 47686 - DNA, 22 bp, Homo sapiens
acatttatataactcactagga

SEQ ID NO: 47687 - DNA, 22 bp, Homo sapiens
tggtggaattgtaaaatagtgt

SEQ ID NO: 47688 - DNA, 22 bp, Homo sapiens
tttgttttcaatgtgtcattca

SEQ ID NO: 47689 - DNA, 22 bp, Homo sapiens
aaagggaagttgcacatgttcc

SEQ ID NO: 47690 - DNA, 22 bp, Homo sapiens
tcctggtgctgacacccatagc

SEQ ID NO: 47691 - DNA, 22 bp, Homo sapiens
cagggccagggacacgctgtca

SEQ ID NO: 47692 - DNA, 21 bp, Homo sapiens
tggctaaaccctagtaaatta

SEQ ID NO: 47693 - DNA, 22 bp, Homo sapiens
gggtaaatctcttttcatggct

SEQ ID NO: 47694 - DNA, 19 bp, Homo sapiens
agtcctggcctgggggacc

SEQ ID NO: 47695 - DNA, 22 bp, Homo sapiens
cttgcctttgtcttcaaaggct

SEQ ID NO: 47696 - DNA, 22 bp, Homo sapiens
ggccactgctctccagcctggg

SEQ ID NO: 47697 - DNA, 22 bp, Homo sapiens
caggcaggtcagtgaagaagga

SEQ ID NO: 47698 - DNA, 22 bp, Homo sapiens
atgccactgcgctctagcctgg

SEQ ID NO: 47699 - DNA, 22 bp, Homo sapiens
gcccccgtagtagatgaggcgc

SEQ ID NO: 47700 - DNA, 22 bp, Homo sapiens
attgtactctagcctctgggca

SEQ ID NO: 47701 - DNA, 22 bp, Homo sapiens
gagcaggaaggccagaagggtc

SEQ ID NO: 47702 - DNA, 22 bp, Homo sapiens
tttgaaatgtatcagtataggt

SEQ ID NO: 47703 - DNA, 22 bp, Homo sapiens
agctcaatgcaacctccgcctc

SEQ ID NO: 47704 - DNA, 22 bp, Homo sapiens
ggctgagttgagaggattactt

SEQ ID NO: 47705 - DNA, 22 bp, Homo sapiens
gttgctcaggcaggagtacagt

SEQ ID NO: 47706 - DNA, 22 bp, Homo sapiens
tttaggttttttcacgtggcta

SEQ ID NO: 47707 - DNA, 22 bp, Homo sapiens
ccttttgctctcccatccagaa

SEQ ID NO: 47708 - DNA, 22 bp, Homo sapiens
cattctctctacttgttttcaa

SEQ ID NO: 47709 - DNA, 22 bp, Homo sapiens
tgtgtggattcatctcaaagag

SEQ ID NO: 47710 - DNA, 22 bp, Homo sapiens
gagccaggaggcagagactgca

SEQ ID NO: 47711 - DNA, 22 bp, Homo sapiens
agtgggccggacagcccaggcc

SEQ ID NO: 47712 - DNA, 22 bp, Homo sapiens
tcacagagaaatgtggcacaaa

SEQ ID NO: 47713 - DNA, 22 bp, Homo sapiens
gttactcttgagaggctgaggt

SEQ ID NO: 47714 - DNA, 22 bp, Homo sapiens
agattctaccagagctagtttg

SEQ ID NO: 47715 - DNA, 22 bp, Homo sapiens
cgcaccactgaattccagcctg

SEQ ID NO: 47716 - DNA, 22 bp, Homo sapiens
ggtagaaggggaagaggtccat

SEQ ID NO: 47717 - DNA, 22 bp, Homo sapiens
tggacaggcaagcaagacatac

SEQ ID NO: 47718 - DNA, 22 bp, Homo sapiens
aacccaggagttggaggctgtg

SEQ ID NO: 47719 - DNA, 22 bp, Homo sapiens
agcccaggttgaggctgcagtg

SEQ ID NO: 47720 - DNA, 20 bp, Homo sapiens
agagatggggtatcaccgta

SEQ ID NO: 47721 - DNA, 22 bp, Homo sapiens
cggggccctggggctgaaggtc

SEQ ID NO: 47722 - DNA, 22 bp, Homo sapiens
aacctcaaactcttgggcttaa

SEQ ID NO: 47723 - DNA, 22 bp, Homo sapiens
agttgcagacgcagagatgttg

SEQ ID NO: 47724 - DNA, 22 bp, Homo sapiens
tcctccccaaagcccagcctgg

SEQ ID NO: 47725 - DNA, 22 bp, Homo sapiens
agccagggtctctcgctctgtt

SEQ ID NO: 47726 - DNA, 22 bp, Homo sapiens
gctcccaggatgaggagccagg

SEQ ID NO: 47727 - DNA, 22 bp, Homo sapiens
gggaggcagtgctggaggctgg

SEQ ID NO: 47728 - DNA, 22 bp, Homo sapiens
ctgtaatcccagctacctggga

SEQ ID NO: 47729 - DNA, 22 bp, Homo sapiens
caattttcaattccttcagata

SEQ ID NO: 47730 - DNA, 22 bp, Homo sapiens
atgtatatgcatgcattcaaag

SEQ ID NO: 47731 - DNA, 21 bp, Homo sapiens
tgcaatccagcctgggcgaca

SEQ ID NO: 47732 - DNA, 22 bp, Homo sapiens
actccacatttgaacacagttc

SEQ ID NO: 47733 - DNA, 22 bp, Homo sapiens
gctgctgcttgaaggctcggag

SEQ ID NO: 47734 - DNA, 22 bp, Homo sapiens
acctcctccaaggagccatagg

SEQ ID NO: 47735 - DNA, 22 bp, Homo sapiens
ttctcccatctcagtcttacat

SEQ ID NO: 47736 - DNA, 22 bp, Homo sapiens
tctcctggagcccagatgctgg

SEQ ID NO: 47737 - DNA, 22 bp, Homo sapiens
aagcactttatgtcaatgtcct

SEQ ID NO: 47738 - DNA, 22 bp, Homo sapiens
ggaaaggcctgggtgtcctggg

SEQ ID NO: 47739 - DNA, 22 bp, Homo sapiens
ctccaggccatggctgcggagg

SEQ ID NO: 47740 - DNA, 23 bp, Homo sapiens
ccaagactgttaggagtggggag

SEQ ID NO: 47741 - DNA, 22 bp, Homo sapiens
tcactgcaacctccacctcccg

SEQ ID NO: 47742 - DNA, 22 bp, Homo sapiens
tttctggcagcgggacaggggt

SEQ ID NO: 47743 - DNA, 18 bp, Homo sapiens
ctgcactcccgcctgggc

SEQ ID NO: 47744 - DNA, 22 bp, Homo sapiens
ctcacctccaggagctgctggc

SEQ ID NO: 47745 - DNA, 21 bp, Homo sapiens
agtagtttagcacagggtttg

SEQ ID NO: 47746 - DNA, 22 bp, Homo sapiens
accctcaacaaattcactctat

SEQ ID NO: 47747 - DNA, 22 bp, Homo sapiens
cactgcactccatcctgggaaa

SEQ ID NO: 47748 - DNA, 22 bp, Homo sapiens
aagaataagaggatttagaaca

SEQ ID NO: 47749 - DNA, 22 bp, Homo sapiens
ctgcactgagcatctaacctta

SEQ ID NO: 47750 - DNA, 22 bp, Homo sapiens
gcagagctgggatatgaaccca

SEQ ID NO: 47751 - DNA, 22 bp, Homo sapiens
gctgtccagcccttgttcacct

SEQ ID NO: 47752 - DNA, 22 bp, Homo sapiens
aagaatgagctcaaagatctta

SEQ ID NO: 47753 - DNA, 22 bp, Homo sapiens
cactgcactccagcctgggaga

SEQ ID NO: 47754 - DNA, 22 bp, Homo sapiens
ggaggtgggctaaggactctct

SEQ ID NO: 47755 - DNA, 22 bp, Homo sapiens
caatttgccctgttaaattttc

SEQ ID NO: 47756 - DNA, 22 bp, Homo sapiens
cccaggaggcagaagttgcagt

SEQ ID NO: 47757 - DNA, 22 bp, Homo sapiens
ggacaagcctgtgagtgggttt

SEQ ID NO: 47758 - DNA, 22 bp, Homo sapiens
ctgccgtgtttttcatgttaaa

SEQ ID NO: 47759 - DNA, 22 bp, Homo sapiens
gctggggaggcagcagagaaca

SEQ ID NO: 47760 - DNA, 22 bp, Homo sapiens
gggagaggttacccgagcaact

SEQ ID NO: 47761 - DNA, 22 bp, Homo sapiens
tgctgagcgcatccggcggccg

SEQ ID NO: 47762 - DNA, 22 bp, Homo sapiens
tggagaattctatgttgagggg

SEQ ID NO: 47763 - DNA, 22 bp, Homo sapiens
aataaaatggtcagttttctca

SEQ ID NO: 47764 - DNA, 22 bp, Homo sapiens
ctcgttgctgaagccaaagtca

SEQ ID NO: 47765 - DNA, 20 bp, Homo sapiens
ttctccagtgcggtagccat

SEQ ID NO: 47766 - DNA, 22 bp, Homo sapiens
cccagcaggtcggtgctgcctg

SEQ ID NO: 47767 - DNA, 22 bp, Homo sapiens
aaccccgctcaggctgggtgag

SEQ ID NO: 47768 - DNA, 22 bp, Homo sapiens
cccactgctgcgccgggcgccg

SEQ ID NO: 47769 - DNA, 22 bp, Homo sapiens
gggcagagagctggaactcctt

SEQ ID NO: 47770 - DNA, 22 bp, Homo sapiens
gcggcggagacagcaggaagcc

SEQ ID NO: 47771 - DNA, 22 bp, Homo sapiens
gcttttgcctacatcttggtct

SEQ ID NO: 47772 - DNA, 22 bp, Homo sapiens
tctcgctctgtcgcccaggctg

SEQ ID NO: 47773 - DNA, 22 bp, Homo sapiens
aagcgccatggttcctgcgcag

SEQ ID NO: 47774 - DNA, 22 bp, Homo sapiens
cccatgcaccctctaagaagga

SEQ ID NO: 47775 - DNA, 22 bp, Homo sapiens
ggctagggatctagaccaggac

SEQ ID NO: 47776 - DNA, 22 bp, Homo sapiens
tgggtactcctattagttcagt

SEQ ID NO: 47777 - DNA, 22 bp, Homo sapiens
gaggggtccaggaggcacttac

SEQ ID NO: 47778 - DNA, 22 bp, Homo sapiens
aggcaatcccctgaggatactt

SEQ ID NO: 47779 - DNA, 22 bp, Homo sapiens
agagctccagggttttgtagtg

SEQ ID NO: 47780 - DNA, 21 bp, Homo sapiens
tactgtagccttgcactgtag

SEQ ID NO: 47781 - DNA, 22 bp, Homo sapiens
ctggctggagtgcaggtgagtg

SEQ ID NO: 47782 - DNA, 22 bp, Homo sapiens
ggctgggctccgggagcatgcg

SEQ ID NO: 47783 - DNA, 22 bp, Homo sapiens
ggctgtggcagctggaagtggt

SEQ ID NO: 47784 - DNA, 22 bp, Homo sapiens
ttggcaatgaaagctgcccggg

SEQ ID NO: 47785 - DNA, 22 bp, Homo sapiens
tgagccagaggaggctgtgtgg

SEQ ID NO: 47786 - DNA, 22 bp, Homo sapiens
ataataacaatgccagatgcct

SEQ ID NO: 47787 - DNA, 22 bp, Homo sapiens
cagcagcagtgttctagaatct

SEQ ID NO: 47788 - DNA, 22 bp, Homo sapiens
agaggaagtaatcaggacctgc

SEQ ID NO: 47789 - DNA, 22 bp, Homo sapiens
gggggagagacgagcggctctg

SEQ ID NO: 47790 - DNA, 22 bp, Homo sapiens
attctaaatcagagagctctgt

SEQ ID NO: 47791 - DNA, 22 bp, Homo sapiens
tggcttccccggagtgacatgt

SEQ ID NO: 47792 - DNA, 22 bp, Homo sapiens
tgggaggccaaggcaggcggat

SEQ ID NO: 47793 - DNA, 22 bp, Homo sapiens
agacccaggattggggctgccg

SEQ ID NO: 47794 - DNA, 22 bp, Homo sapiens
gaccttgtgatccagccacctt

SEQ ID NO: 47795 - DNA, 22 bp, Homo sapiens
cagcctggtccccggctcaccc

SEQ ID NO: 47796 - DNA, 22 bp, Homo sapiens
tgccatcagctgactccaaggt

SEQ ID NO: 47797 - DNA, 22 bp, Homo sapiens
aggggatggagctggaaggcag

SEQ ID NO: 47798 - DNA, 19 bp, Homo sapiens
caggcctcttaccctctct

SEQ ID NO: 47799 - DNA, 22 bp, Homo sapiens
ccccatgaagtagggtctctga

SEQ ID NO: 47800 - DNA, 22 bp, Homo sapiens
caattgacaatgacagtgtcaa

SEQ ID NO: 47801 - DNA, 21 bp, Homo sapiens
tcctgtaagcttgggtggctc

SEQ ID NO: 47802 - DNA, 22 bp, Homo sapiens
gatttttatataaagtgagaaa

SEQ ID NO: 47803 - DNA, 22 bp, Homo sapiens
ggtgacggggcccaggtttcct

SEQ ID NO: 47804 - DNA, 22 bp, Homo sapiens
caaggtagttctggtcattgac

SEQ ID NO: 47805 - DNA, 22 bp, Homo sapiens
tgagatggagtctcgctctgtt

SEQ ID NO: 47806 - DNA, 22 bp, Homo sapiens
taattataacatgctttctggc

SEQ ID NO: 47807 - DNA, 22 bp, Homo sapiens
gttgaggtgatgccagccctgc

SEQ ID NO: 47808 - DNA, 22 bp, Homo sapiens
atagtggggacaggatggttgg

SEQ ID NO: 47809 - DNA, 22 bp, Homo sapiens
atcttcccaggctggggagagg

SEQ ID NO: 47810 - DNA, 22 bp, Homo sapiens
tcccacacagcccgctcaccgg

SEQ ID NO: 47811 - DNA, 22 bp, Homo sapiens
tgagccaggagtttgaggctgt

SEQ ID NO: 47812 - DNA, 22 bp, Homo sapiens
tttcctcttctggcaggcaggg

SEQ ID NO: 47813 - DNA, 22 bp, Homo sapiens
gggagcttaagacagttccaat

SEQ ID NO: 47814 - DNA, 22 bp, Homo sapiens
atgccactgcactccagcctag

SEQ ID NO: 47815 - DNA, 18 bp, Homo sapiens
actctttctgcccacagg

SEQ ID NO: 47816 - DNA, 19 bp, Homo sapiens
aaaggtagtaacctctgat

SEQ ID NO: 47817 - DNA, 22 bp, Homo sapiens
agggaagaggaccagagtctct

SEQ ID NO: 47818 - DNA, 22 bp, Homo sapiens
gcaggtggatcacctgaggtca

SEQ ID NO: 47819 - DNA, 22 bp, Homo sapiens
cagctttgccaagtaaggtctt

SEQ ID NO: 47820 - DNA, 22 bp, Homo sapiens
tcttgaattgtactcccataag

SEQ ID NO: 47821 - DNA, 22 bp, Homo sapiens
atttttctctttccactgagat

SEQ ID NO: 47822 - DNA, 22 bp, Homo sapiens
tggcactgaagctggaaagcct

SEQ ID NO: 47823 - DNA, 22 bp, Homo sapiens
gggcagagactcagaaacagaa

SEQ ID NO: 47824 - DNA, 22 bp, Homo sapiens
gtgggctgcccttgaggtcagc

SEQ ID NO: 47825 - DNA, 22 bp, Homo sapiens
tgcactccaggctgggtgacag

SEQ ID NO: 47826 - DNA, 22 bp, Homo sapiens
ttaagtaacttgtccaaatgag

SEQ ID NO: 47827 - DNA, 22 bp, Homo sapiens
atgtttttaaatagacttacag

SEQ ID NO: 47828 - DNA, 22 bp, Homo sapiens
tattactgtcaatatcacagaa

SEQ ID NO: 47829 - DNA, 22 bp, Homo sapiens
tttgagtagtgagactaggcag

SEQ ID NO: 47830 - DNA, 22 bp, Homo sapiens
agcattccacactgaagtctgc

SEQ ID NO: 47831 - DNA, 22 bp, Homo sapiens
tccagcagtccatgtgagacac

SEQ ID NO: 47832 - DNA, 22 bp, Homo sapiens
cccagtttcaactttccagtgg

SEQ ID NO: 47833 - DNA, 22 bp, Homo sapiens
ttgtctaatgagctccacttca

SEQ ID NO: 47834 - DNA, 22 bp, Homo sapiens
gcaaatgctaaagtgtagagac

SEQ ID NO: 47835 - DNA, 22 bp, Homo sapiens
ccaggaggcggaggttgcagcg

SEQ ID NO: 47836 - DNA, 22 bp, Homo sapiens
aggattgtgcctccagtcagaa

SEQ ID NO: 47837 - DNA, 22 bp, Homo sapiens
gaggtggatgttgcagtgagct

SEQ ID NO: 47838 - DNA, 22 bp, Homo sapiens
tgatattttatgagctttcata

SEQ ID NO: 47839 - DNA, 22 bp, Homo sapiens
tttacaacccaagtccagagag

SEQ ID NO: 47840 - DNA, 22 bp, Homo sapiens
acgcggtgcggcaagttcatgg

SEQ ID NO: 47841 - DNA, 22 bp, Homo sapiens
caggagatgacagggaagaacc

SEQ ID NO: 47842 - DNA, 22 bp, Homo sapiens
cactgcactccagcttgggtga

SEQ ID NO: 47843 - DNA, 19 bp, Homo sapiens
ctctgggcaagtcacttaa

SEQ ID NO: 47844 - DNA, 23 bp, Homo sapiens
gcctgccgcctggctgagaactg

SEQ ID NO: 47845 - DNA, 22 bp, Homo sapiens
gcctgtcccgcaccggagcccg

SEQ ID NO: 47846 - DNA, 22 bp, Homo sapiens
tgggaaagctgcagaaattctc

SEQ ID NO: 47847 - DNA, 22 bp, Homo sapiens
cgtctaggccgtgccctgaggt

SEQ ID NO: 47848 - DNA, 22 bp, Homo sapiens
taccagggaacagggatattaa

SEQ ID NO: 47849 - DNA, 22 bp, Homo sapiens
agcccttagtacatttctcaag

SEQ ID NO: 47850 - DNA, 22 bp, Homo sapiens
aaaagcaattgcagttcttgcc

SEQ ID NO: 47851 - DNA, 22 bp, Homo sapiens
aacccgggaggcagaggttgtg

SEQ ID NO: 47852 - DNA, 22 bp, Homo sapiens
agagcgcactgtctgcaggcaa

SEQ ID NO: 47853 - DNA, 22 bp, Homo sapiens
tgccgtggggctgaggctggag

SEQ ID NO: 47854 - DNA, 22 bp, Homo sapiens
gcggtatttgtgtgggtgtcga

SEQ ID NO: 47855 - DNA, 22 bp, Homo sapiens
atgatccaaagccacaggggca

SEQ ID NO: 47856 - DNA, 22 bp, Homo sapiens
ttagcttttgagaatgatttct

SEQ ID NO: 47857 - DNA, 22 bp, Homo sapiens
ttccgctgtttagttgaagttt

SEQ ID NO: 47858 - DNA, 23 bp, Homo sapiens
cagagctggcttcatgggtgtgc

SEQ ID NO: 47859 - DNA, 22 bp, Homo sapiens
ctctcgccagcggggctgcgct

SEQ ID NO: 47860 - DNA, 22 bp, Homo sapiens
tttagcgtagctgacagctaat

SEQ ID NO: 47861 - DNA, 22 bp, Homo sapiens
tggcaccagggaacaagcattt

SEQ ID NO: 47862 - DNA, 21 bp, Homo sapiens
ctcccagggtgactgttcaac

SEQ ID NO: 47863 - DNA, 22 bp, Homo sapiens
gaatttcctctaaacccctgag

SEQ ID NO: 47864 - DNA, 22 bp, Homo sapiens
ggggtgggcgtgcagggacacc

SEQ ID NO: 47865 - DNA, 22 bp, Homo sapiens
tatgtttggcctggcaatttca

SEQ ID NO: 47866 - DNA, 22 bp, Homo sapiens
ctgaggctggagtgcagtggtg

SEQ ID NO: 47867 - DNA, 22 bp, Homo sapiens
tagatctgatacaattcatctg

SEQ ID NO: 47868 - DNA, 22 bp, Homo sapiens
ggtgcagaggagccagctgggg

SEQ ID NO: 47869 - DNA, 20 bp, Homo sapiens
tttgcgaggccaaggcgggc

SEQ ID NO: 47870 - DNA, 22 bp, Homo sapiens
ttccgagtctccaaggggttgt

SEQ ID NO: 47871 - DNA, 22 bp, Homo sapiens
aaaggctttaaaatgtacatat

SEQ ID NO: 47872 - DNA, 22 bp, Homo sapiens
gactggaaagcctgtcctcaga

SEQ ID NO: 47873 - DNA, 22 bp, Homo sapiens
atgttgtgtttgactgttaccc

SEQ ID NO: 47874 - DNA, 23 bp, Homo sapiens
tcggtgggcgtggaggccgaggc

SEQ ID NO: 47875 - DNA, 22 bp, Homo sapiens
taaaatttgtccctgagtgttg

SEQ ID NO: 47876 - DNA, 22 bp, Homo sapiens
tcttgggggactttggcatgga

SEQ ID NO: 47877 - DNA, 22 bp, Homo sapiens
ttgtatagcccagagagtgaga

SEQ ID NO: 47878 - DNA, 22 bp, Homo sapiens
ggggtgtggacggctgtgccag

SEQ ID NO: 47879 - DNA, 22 bp, Homo sapiens
ggtgccctggaagctgctgcat

SEQ ID NO: 47880 - DNA, 22 bp, Homo sapiens
aagccgggcctgagaaatgaca

SEQ ID NO: 47881 - DNA, 22 bp, Homo sapiens
ggatgttctggggttctcttgt

SEQ ID NO: 47882 - DNA, 22 bp, Homo sapiens
catccgcatgcaagtgctgtcc

SEQ ID NO: 47883 - DNA, 22 bp, Homo sapiens
ctcccagccttcgccagtctga

SEQ ID NO: 47884 - DNA, 22 bp, Homo sapiens
agctgctgagccaggctgatgt

SEQ ID NO: 47885 - DNA, 22 bp, Homo sapiens
aggtgggcggattcatgaggtc

SEQ ID NO: 47886 - DNA, 22 bp, Homo sapiens
gtataggtgagggacttgatca

SEQ ID NO: 47887 - DNA, 22 bp, Homo sapiens
tgcctccaacagcccatcctag

SEQ ID NO: 47888 - DNA, 22 bp, Homo sapiens
tgacttgtctctttgggagaca

SEQ ID NO: 47889 - DNA, 22 bp, Homo sapiens
caggaagctgtgaaggagacgg

SEQ ID NO: 47890 - DNA, 22 bp, Homo sapiens
ttcttctcagggtcccacatgg

SEQ ID NO: 47891 - DNA, 22 bp, Homo sapiens
gagacacaggcacagaagaggc

SEQ ID NO: 47892 - DNA, 22 bp, Homo sapiens
gtctcccaaactctgatggtcc

SEQ ID NO: 47893 - DNA, 23 bp, Homo sapiens
aaataggagtatctggatcatga

SEQ ID NO: 47894 - DNA, 22 bp, Homo sapiens
cactgcactccagcctggcctg

SEQ ID NO: 47895 - DNA, 22 bp, Homo sapiens
aggaggaagggaagacaagtaa

SEQ ID NO: 47896 - DNA, 22 bp, Homo sapiens
agttgggtttgtgtcagttgca

SEQ ID NO: 47897 - DNA, 22 bp, Homo sapiens
ggaagaaaggtggacaacaggt

SEQ ID NO: 47898 - DNA, 22 bp, Homo sapiens
acaggatcgccctgttgcccag

SEQ ID NO: 47899 - DNA, 18 bp, Homo sapiens
ccatcaccctaactagtg

SEQ ID NO: 47900 - DNA, 22 bp, Homo sapiens
atgttcatatccccattctgat

SEQ ID NO: 47901 - DNA, 22 bp, Homo sapiens
aggtattattagcatctctatt

SEQ ID NO: 47902 - DNA, 22 bp, Homo sapiens
ttcaatatgatattagctgtgg

SEQ ID NO: 47903 - DNA, 22 bp, Homo sapiens
cccaggaggcagagcttgcagt

SEQ ID NO: 47904 - DNA, 22 bp, Homo sapiens
tttgatccgttgctggtgagga

SEQ ID NO: 47905 - DNA, 22 bp, Homo sapiens
tttgaagactactgggagtgaa

SEQ ID NO: 47906 - DNA, 22 bp, Homo sapiens
gtacccagtgattccttcttca

SEQ ID NO: 47907 - DNA, 22 bp, Homo sapiens
aggcaggaaaatcgcttgaacc

SEQ ID NO: 47908 - DNA, 22 bp, Homo sapiens
ctgcagggagaggggacagcct

SEQ ID NO: 47909 - DNA, 22 bp, Homo sapiens
cctgggaatcggtgcgttgagg

SEQ ID NO: 47910 - DNA, 19 bp, Homo sapiens
ctgctgccggagactcgtc

SEQ ID NO: 47911 - DNA, 22 bp, Homo sapiens
agtggctgagtgactgtgactc

SEQ ID NO: 47912 - DNA, 22 bp, Homo sapiens
acccacgaagatgagcggcatg

SEQ ID NO: 47913 - DNA, 22 bp, Homo sapiens
ttgagggtctggatctgctgct

SEQ ID NO: 47914 - DNA, 22 bp, Homo sapiens
ttgcaattgctatggagagcgt

SEQ ID NO: 47915 - DNA, 22 bp, Homo sapiens
ttaaattttagaaacagactct

SEQ ID NO: 47916 - DNA, 22 bp, Homo sapiens
cgggcaccaccctggtgtgtcc

SEQ ID NO: 47917 - DNA, 22 bp, Homo sapiens
attaagtgactaaagtaatgct

SEQ ID NO: 47918 - DNA, 22 bp, Homo sapiens
cccaggaggtggagcttgcagt

SEQ ID NO: 47919 - DNA, 22 bp, Homo sapiens
acagacaagtagttcagacaag

SEQ ID NO: 47920 - DNA, 22 bp, Homo sapiens
cttgcctacttgtcaaccagca

SEQ ID NO: 47921 - DNA, 22 bp, Homo sapiens
gcccaggaggcagaggttgtgg

SEQ ID NO: 47922 - DNA, 22 bp, Homo sapiens
attggtggtgaggacatgccag

SEQ ID NO: 47923 - DNA, 22 bp, Homo sapiens
tgtatgaggcatacatcaggca

SEQ ID NO: 47924 - DNA, 21 bp, Homo sapiens
ggagcctctggcagggggcca

SEQ ID NO: 47925 - DNA, 22 bp, Homo sapiens
cattaaacaaccttgaatcaat

SEQ ID NO: 47926 - DNA, 22 bp, Homo sapiens
atgtttttggaaatgggaacat

SEQ ID NO: 47927 - DNA, 22 bp, Homo sapiens
ggagagggtaggggtcctgccc

SEQ ID NO: 47928 - DNA, 22 bp, Homo sapiens
agtgcaggccccaggccaggcc

SEQ ID NO: 47929 - DNA, 22 bp, Homo sapiens
ccccacaactcatgttgaaact

SEQ ID NO: 47930 - DNA, 22 bp, Homo sapiens
taccatgctctgcatctcacaa

SEQ ID NO: 47931 - DNA, 22 bp, Homo sapiens
taattataacagttacatctta

SEQ ID NO: 47932 - DNA, 22 bp, Homo sapiens
tgacagaggagctggaatgatt

SEQ ID NO: 47933 - DNA, 18 bp, Homo sapiens
ctgccagtgtgctctccg

SEQ ID NO: 47934 - DNA, 22 bp, Homo sapiens
ggtttgacagcttggggctgtc

SEQ ID NO: 47935 - DNA, 22 bp, Homo sapiens
catggcattgcataacggggct

SEQ ID NO: 47936 - DNA, 22 bp, Homo sapiens
gagacctcttggtatcgctagg

SEQ ID NO: 47937 - DNA, 22 bp, Homo sapiens
actttatttcctattgcatcca

SEQ ID NO: 47938 - DNA, 22 bp, Homo sapiens
cccaggaggtcaaggctgcagt

SEQ ID NO: 47939 - DNA, 22 bp, Homo sapiens
gcaaaagtacagccggatttct

SEQ ID NO: 47940 - DNA, 21 bp, Homo sapiens
ccaccaggtcttctgctcggg

SEQ ID NO: 47941 - DNA, 22 bp, Homo sapiens
aggctgagataggtggatcatt

SEQ ID NO: 47942 - DNA, 22 bp, Homo sapiens
cattgcactccagccttggcaa

SEQ ID NO: 47943 - DNA, 22 bp, Homo sapiens
gaaggaagtcattagtgcagac

SEQ ID NO: 47944 - DNA, 22 bp, Homo sapiens
tggagccagagcgcagcctggg

SEQ ID NO: 47945 - DNA, 19 bp, Homo sapiens
catctggatgattctcctg

SEQ ID NO: 47946 - DNA, 22 bp, Homo sapiens
ccctgccttgtctgggctaggt

SEQ ID NO: 47947 - DNA, 22 bp, Homo sapiens
tgcctaggctggagtgtagtgg

SEQ ID NO: 47948 - DNA, 22 bp, Homo sapiens
gttgaaatcctaaccccctagt

SEQ ID NO: 47949 - DNA, 22 bp, Homo sapiens
aaggagaaatggtagatgtgca

SEQ ID NO: 47950 - DNA, 22 bp, Homo sapiens
gatagtcacctcccttaacttt

SEQ ID NO: 47951 - DNA, 22 bp, Homo sapiens
tgaagaaacgcagagaggtagg

SEQ ID NO: 47952 - DNA, 22 bp, Homo sapiens
gggctcttctggcatgctgctc

SEQ ID NO: 47953 - DNA, 20 bp, Homo sapiens
atcggcttgcctggaaacaa

SEQ ID NO: 47954 - DNA, 22 bp, Homo sapiens
ggttgctgggggtggcagagct

SEQ ID NO: 47955 - DNA, 22 bp, Homo sapiens
ccaggctggagtgcagtggcac

SEQ ID NO: 47956 - DNA, 22 bp, Homo sapiens
tcagggattgcaaaattcatcc

SEQ ID NO: 47957 - DNA, 22 bp, Homo sapiens
agtccaaagcagatgagggcca

SEQ ID NO: 47958 - DNA, 22 bp, Homo sapiens
ggcctcgcggcttctggtggct

SEQ ID NO: 47959 - DNA, 22 bp, Homo sapiens
tcttcccagaggaggtgccagc

SEQ ID NO: 47960 - DNA, 22 bp, Homo sapiens
gagacgtggcctttgcctgagc

SEQ ID NO: 47961 - DNA, 22 bp, Homo sapiens
ctgaggcctctcccactccagc

SEQ ID NO: 47962 - DNA, 22 bp, Homo sapiens
ggcctctcttgggacagctgtc

SEQ ID NO: 47963 - DNA, 22 bp, Homo sapiens
cttgatctacatagtgaaaccc

SEQ ID NO: 47964 - DNA, 22 bp, Homo sapiens
ggctcaatgcaacttctgcctc

SEQ ID NO: 47965 - DNA, 22 bp, Homo sapiens
ttgcaatcagcagtgttttcac

SEQ ID NO: 47966 - DNA, 22 bp, Homo sapiens
ccttcccacattccttacatgc

SEQ ID NO: 47967 - DNA, 22 bp, Homo sapiens
atctgggagcggaggttgcagt

SEQ ID NO: 47968 - DNA, 22 bp, Homo sapiens
cgtgccactgcactctagcctg

SEQ ID NO: 47969 - DNA, 22 bp, Homo sapiens
gaggcagaagttgcagtgagca

SEQ ID NO: 47970 - DNA, 22 bp, Homo sapiens
gctgctctcagagctcatgctg

SEQ ID NO: 47971 - DNA, 22 bp, Homo sapiens
tggctgtgtccctgtccagagt

SEQ ID NO: 47972 - DNA, 22 bp, Homo sapiens
ggggcagagaataaaaacctaa

SEQ ID NO: 47973 - DNA, 22 bp, Homo sapiens
gagcctcgtggcggccactgcg

SEQ ID NO: 47974 - DNA, 22 bp, Homo sapiens
gaagaaagatcaaatagtttcc

SEQ ID NO: 47975 - DNA, 22 bp, Homo sapiens
ttgagatgtcttttggcattat

SEQ ID NO: 47976 - DNA, 22 bp, Homo sapiens
ccaggaggtggagattgcagtg

SEQ ID NO: 47977 - DNA, 22 bp, Homo sapiens
tttgattgtcacctaccttgca

SEQ ID NO: 47978 - DNA, 22 bp, Homo sapiens
agatgtgtttctagttcctgca

SEQ ID NO: 47979 - DNA, 22 bp, Homo sapiens
tcaccttgtgatctccctgcct

SEQ ID NO: 47980 - DNA, 22 bp, Homo sapiens
ttatgggagcaattggggaggt

SEQ ID NO: 47981 - DNA, 22 bp, Homo sapiens
cattgcactccagcctaggcaa

SEQ ID NO: 47982 - DNA, 22 bp, Homo sapiens
tgcccaggctggagtacagtgg

SEQ ID NO: 47983 - DNA, 22 bp, Homo sapiens
tggcaccatcaaggctgagaac

SEQ ID NO: 47984 - DNA, 22 bp, Homo sapiens
atagcagggatgtcagcaagta

SEQ ID NO: 47985 - DNA, 22 bp, Homo sapiens
aatgcaatgcagcacctccttg

SEQ ID NO: 47986 - DNA, 22 bp, Homo sapiens
tatcactacacctggctaatta

SEQ ID NO: 47987 - DNA, 18 bp, Homo sapiens
tcctttctccctcatctt

SEQ ID NO: 47988 - DNA, 22 bp, Homo sapiens
aagaggttgtctgtgatgagtt

SEQ ID NO: 47989 - DNA, 22 bp, Homo sapiens
tctaaacttgtaaacaagcata

SEQ ID NO: 47990 - DNA, 22 bp, Homo sapiens
ctgctttggacaactattcttg

SEQ ID NO: 47991 - DNA, 22 bp, Homo sapiens
gacttctgaattcctatcaggt

SEQ ID NO: 47992 - DNA, 22 bp, Homo sapiens
gtagaggggtgattctgtgaga

SEQ ID NO: 47993 - DNA, 22 bp, Homo sapiens
ttatttaatgtgatctgaagag

SEQ ID NO: 47994 - DNA, 22 bp, Homo sapiens
ggtgaggggctcctctgcccgg

SEQ ID NO: 47995 - DNA, 22 bp, Homo sapiens
aaggtgggtggatcacgaggtc

SEQ ID NO: 47996 - DNA, 22 bp, Homo sapiens
tctgccacttgaggtcattggc

SEQ ID NO: 47997 - DNA, 22 bp, Homo sapiens
tccctagtcgcatctgtggaga

SEQ ID NO: 47998 - DNA, 22 bp, Homo sapiens
gagagcaggaggcagcgggacg

SEQ ID NO: 47999 - DNA, 22 bp, Homo sapiens
gctgaggtggaggaaggagacc

SEQ ID NO: 48000 - DNA, 22 bp, Homo sapiens
caaccgcggggcccagcggttc

SEQ ID NO: 48001 - DNA, 22 bp, Homo sapiens
gaccttcttgctgtgtcctaac

SEQ ID NO: 48002 - DNA, 22 bp, Homo sapiens
acatcccttgctcggggcccct

SEQ ID NO: 48003 - DNA, 22 bp, Homo sapiens
cactgcactccagcctgcgcaa

SEQ ID NO: 48004 - DNA, 22 bp, Homo sapiens
tctggcttcgcagctcccagcc

SEQ ID NO: 48005 - DNA, 22 bp, Homo sapiens
gggtccagtagttggtggccgt

SEQ ID NO: 48006 - DNA, 22 bp, Homo sapiens
acagaactgggaaatgcacata

SEQ ID NO: 48007 - DNA, 22 bp, Homo sapiens
gctgaaggcccggaggacaggg

SEQ ID NO: 48008 - DNA, 22 bp, Homo sapiens
tcaaaattaaaccaacgtccag

SEQ ID NO: 48009 - DNA, 22 bp, Homo sapiens
cagtcaccttgaggactcagac

SEQ ID NO: 48010 - DNA, 22 bp, Homo sapiens
tgacatgtatatcttacgctat

SEQ ID NO: 48011 - DNA, 22 bp, Homo sapiens
gctcaagacccctctgtgactg

SEQ ID NO: 48012 - DNA, 22 bp, Homo sapiens
actctgctctgtatttcactgt

SEQ ID NO: 48013 - DNA, 22 bp, Homo sapiens
gcccagagttcaaggctgcagt

SEQ ID NO: 48014 - DNA, 22 bp, Homo sapiens
tgtaggacatgtacttgtaaca

SEQ ID NO: 48015 - DNA, 22 bp, Homo sapiens
tcgcttgaacccaggaagtgga

SEQ ID NO: 48016 - DNA, 22 bp, Homo sapiens
gcctccagcccacgcaggcctg

SEQ ID NO: 48017 - DNA, 22 bp, Homo sapiens
aggaggggttctcgggtgctga

SEQ ID NO: 48018 - DNA, 22 bp, Homo sapiens
ccaggagctggagggtgcagtg

SEQ ID NO: 48019 - DNA, 22 bp, Homo sapiens
aaggtgggcagatcacaaggtc

SEQ ID NO: 48020 - DNA, 22 bp, Homo sapiens
caggagtgttgattgctcagga

SEQ ID NO: 48021 - DNA, 22 bp, Homo sapiens
aggccagcctcaggcagggacc

SEQ ID NO: 48022 - DNA, 22 bp, Homo sapiens
taaagattgctcaaaactgtga

SEQ ID NO: 48023 - DNA, 22 bp, Homo sapiens
attcagagcactgggtagaatt

SEQ ID NO: 48024 - DNA, 22 bp, Homo sapiens
ggcgggaagttcttgcccactt

SEQ ID NO: 48025 - DNA, 22 bp, Homo sapiens
ttcaccctggaccagaaattgg

SEQ ID NO: 48026 - DNA, 22 bp, Homo sapiens
tctggcttccctctgttctggg

SEQ ID NO: 48027 - DNA, 22 bp, Homo sapiens
actgcactcctgcctgggtaac

SEQ ID NO: 48028 - DNA, 22 bp, Homo sapiens
aaatggaagctatttatgattc

SEQ ID NO: 48029 - DNA, 22 bp, Homo sapiens
acacagggctgcgcctgacccc

SEQ ID NO: 48030 - DNA, 22 bp, Homo sapiens
ggtgtctatgattcagtttatg

SEQ ID NO: 48031 - DNA, 22 bp, Homo sapiens
atggaaggctttatgactcaaa

SEQ ID NO: 48032 - DNA, 22 bp, Homo sapiens
cagagcccctcgtctccaccac

SEQ ID NO: 48033 - DNA, 22 bp, Homo sapiens
gctctgagtcacactgccctgt

SEQ ID NO: 48034 - DNA, 22 bp, Homo sapiens
agggctgcccagtgtgagagct

SEQ ID NO: 48035 - DNA, 23 bp, Homo sapiens
attttttgtctttgtaactagat

SEQ ID NO: 48036 - DNA, 22 bp, Homo sapiens
cccaggaggcagatgttgcagt

SEQ ID NO: 48037 - DNA, 22 bp, Homo sapiens
gcacggctaatttttgtatttt

SEQ ID NO: 48038 - DNA, 22 bp, Homo sapiens
tggaatgcagtgggagcttacc

SEQ ID NO: 48039 - DNA, 22 bp, Homo sapiens
ggaggggatttagtagatgcta

SEQ ID NO: 48040 - DNA, 22 bp, Homo sapiens
gtgctccctccttcctcaagga

SEQ ID NO: 48041 - DNA, 22 bp, Homo sapiens
gctcgttgaacctgtccccgag

SEQ ID NO: 48042 - DNA, 22 bp, Homo sapiens
agaaaatttaaagagacacaca

SEQ ID NO: 48043 - DNA, 22 bp, Homo sapiens
tgcaatctcggcactttgggag

SEQ ID NO: 48044 - DNA, 22 bp, Homo sapiens
gaagattgaaggctgggaatta

SEQ ID NO: 48045 - DNA, 22 bp, Homo sapiens
gtcttgtcccagctctgccact

SEQ ID NO: 48046 - DNA, 22 bp, Homo sapiens
gcagagatctgagaaggctgcc

SEQ ID NO: 48047 - DNA, 22 bp, Homo sapiens
tcgcaccattgcactccagcca

SEQ ID NO: 48048 - DNA, 22 bp, Homo sapiens
ttatttaaaagtggtaagattc

SEQ ID NO: 48049 - DNA, 22 bp, Homo sapiens
aataatctcactttatgtggaa

SEQ ID NO: 48050 - DNA, 22 bp, Homo sapiens
tgagatggagccactgcactct

SEQ ID NO: 48051 - DNA, 22 bp, Homo sapiens
gtatcacttttgagagtgagaa

SEQ ID NO: 48052 - DNA, 22 bp, Homo sapiens
ctgtggccagagcgccgttgac

SEQ ID NO: 48053 - DNA, 22 bp, Homo sapiens
cagcaggaggtgagtagcaggt

SEQ ID NO: 48054 - DNA, 22 bp, Homo sapiens
ggcagggagtggagactcccta

SEQ ID NO: 48055 - DNA, 22 bp, Homo sapiens
actctccttttgatcttcagaa

SEQ ID NO: 48056 - DNA, 22 bp, Homo sapiens
tgggaaagtctttatttctctt

SEQ ID NO: 48057 - DNA, 22 bp, Homo sapiens
gccagtggtcactgaggaagaa

SEQ ID NO: 48058 - DNA, 22 bp, Homo sapiens
atctagattaggtataagagct

SEQ ID NO: 48059 - DNA, 22 bp, Homo sapiens
gcagagctcatgcctgcacctc

SEQ ID NO: 48060 - DNA, 19 bp, Homo sapiens
ctgggatgtctcctcccag

SEQ ID NO: 48061 - DNA, 22 bp, Homo sapiens
ggcttagcaactcctgaggctc

SEQ ID NO: 48062 - DNA, 23 bp, Homo sapiens
atcattaacagtgcaggggtagg

SEQ ID NO: 48063 - DNA, 22 bp, Homo sapiens
tgcagagtgaagacatcacccc

SEQ ID NO: 48064 - DNA, 22 bp, Homo sapiens
agctttgccaggaggcttggtc

SEQ ID NO: 48065 - DNA, 22 bp, Homo sapiens
actccacaccacgggggccgcc

SEQ ID NO: 48066 - DNA, 22 bp, Homo sapiens
cccaggagttggaggctgcagt

SEQ ID NO: 48067 - DNA, 22 bp, Homo sapiens
agatcggctttgcagacctcat

SEQ ID NO: 48068 - DNA, 22 bp, Homo sapiens
ttttgcaacacaggctacttca

SEQ ID NO: 48069 - DNA, 22 bp, Homo sapiens
tcgcgggttgcacatggccatc

SEQ ID NO: 48070 - DNA, 22 bp, Homo sapiens
gcaagacctatctagttgctgt

SEQ ID NO: 48071 - DNA, 20 bp, Homo sapiens
ctgccgaccacagccatgga

SEQ ID NO: 48072 - DNA, 22 bp, Homo sapiens
gctgtcttgctcactcttgcag

SEQ ID NO: 48073 - DNA, 22 bp, Homo sapiens
tgggcaggggccctgcttccgt

SEQ ID NO: 48074 - DNA, 22 bp, Homo sapiens
tagtttcatctccaccctgccc

SEQ ID NO: 48075 - DNA, 17 bp, Homo sapiens
tggtccaggtggagcca

SEQ ID NO: 48076 - DNA, 22 bp, Homo sapiens
tgcagcactgttcacaatagcc

SEQ ID NO: 48077 - DNA, 22 bp, Homo sapiens
agccagggacgctgcaggctac

SEQ ID NO: 48078 - DNA, 22 bp, Homo sapiens
ggggcattgtgtctgggttcct

SEQ ID NO: 48079 - DNA, 22 bp, Homo sapiens
aggttatcatcagttgagcact

SEQ ID NO: 48080 - DNA, 22 bp, Homo sapiens
agggagcaaaggtttcagggtt

SEQ ID NO: 48081 - DNA, 22 bp, Homo sapiens
ggcgccgcactcggtgcagccg

SEQ ID NO: 48082 - DNA, 20 bp, Homo sapiens
gctgaggtggaggaaggaga

SEQ ID NO: 48083 - DNA, 20 bp, Homo sapiens
caaatccctgctctgtgctg

SEQ ID NO: 48084 - DNA, 22 bp, Homo sapiens
cccacaggtgtgagcttgctgg

SEQ ID NO: 48085 - DNA, 22 bp, Homo sapiens
atacaaaatatatactggagac

SEQ ID NO: 48086 - DNA, 22 bp, Homo sapiens
ggggtactggctggagccccac

SEQ ID NO: 48087 - DNA, 22 bp, Homo sapiens
ctgggaggcagaggttgcagtg

SEQ ID NO: 48088 - DNA, 22 bp, Homo sapiens
agagtggctctgctgggcacag

SEQ ID NO: 48089 - DNA, 22 bp, Homo sapiens
taggtttaggagtgaaggtgaa

SEQ ID NO: 48090 - DNA, 22 bp, Homo sapiens
ccagagtcccttgcagctcagt

SEQ ID NO: 48091 - DNA, 22 bp, Homo sapiens
aagacttgaccaggttgaaggc

SEQ ID NO: 48092 - DNA, 22 bp, Homo sapiens
tttaagaagttatgttataaat

SEQ ID NO: 48093 - DNA, 22 bp, Homo sapiens
gcaggagaacaaagcaagctgc

SEQ ID NO: 48094 - DNA, 22 bp, Homo sapiens
gctgtggcctggcgcagagctg

SEQ ID NO: 48095 - DNA, 22 bp, Homo sapiens
cttgtagaattgaaatggtctc

SEQ ID NO: 48096 - DNA, 22 bp, Homo sapiens
gggccgtagaccacgtccgggc

SEQ ID NO: 48097 - DNA, 22 bp, Homo sapiens
gcatacatgggtgcagggacat

SEQ ID NO: 48098 - DNA, 22 bp, Homo sapiens
ggcatctggatctgcttctccc

SEQ ID NO: 48099 - DNA, 22 bp, Homo sapiens
ttggaagttgatttaaaaagga

SEQ ID NO: 48100 - DNA, 22 bp, Homo sapiens
gaaaagagacagggtgggtgat

SEQ ID NO: 48101 - DNA, 22 bp, Homo sapiens
tcacccaggctggagtgtagtg

SEQ ID NO: 48102 - DNA, 22 bp, Homo sapiens
gcttagtcaattataaataggc

SEQ ID NO: 48103 - DNA, 22 bp, Homo sapiens
cactgcactccagcctgggtca

SEQ ID NO: 48104 - DNA, 22 bp, Homo sapiens
aggaattcaagaccagctgggc

SEQ ID NO: 48105 - DNA, 22 bp, Homo sapiens
ggctcacgcaattatcccggcc

SEQ ID NO: 48106 - DNA, 22 bp, Homo sapiens
aagacacaatgtagcccagcac

SEQ ID NO: 48107 - DNA, 23 bp, Homo sapiens
caccactttctccttctccttgg

SEQ ID NO: 48108 - DNA, 22 bp, Homo sapiens
cccaggctggagtgcagtggcg

SEQ ID NO: 48109 - DNA, 22 bp, Homo sapiens
aactcaaagatgcatgacgctt

SEQ ID NO: 48110 - DNA, 22 bp, Homo sapiens
tgtaagtagtaatggaaggaca

SEQ ID NO: 48111 - DNA, 22 bp, Homo sapiens
aacagctttgtatacagtaact

SEQ ID NO: 48112 - DNA, 22 bp, Homo sapiens
tttgaagggcacgacaatagtt

SEQ ID NO: 48113 - DNA, 22 bp, Homo sapiens
gggagtgggtttggcctaggcc

SEQ ID NO: 48114 - DNA, 22 bp, Homo sapiens
tcaccgaggctggagtgcagtg

SEQ ID NO: 48115 - DNA, 22 bp, Homo sapiens
tggggagaaatgtctttgttcc

SEQ ID NO: 48116 - DNA, 22 bp, Homo sapiens
ctgctgagagccccagctgaga

SEQ ID NO: 48117 - DNA, 22 bp, Homo sapiens
cagagctggtgtgtcctggcat

SEQ ID NO: 48118 - DNA, 22 bp, Homo sapiens
ccaggaggtggaggttgcggtg

SEQ ID NO: 48119 - DNA, 22 bp, Homo sapiens
ttctgtgaatcttttttcccac

SEQ ID NO: 48120 - DNA, 22 bp, Homo sapiens
gccagaagcacatgagaggtga

SEQ ID NO: 48121 - DNA, 19 bp, Homo sapiens
gatttaaacgtggctctat

SEQ ID NO: 48122 - DNA, 22 bp, Homo sapiens
tgcaggctcttggtgacgtggg

SEQ ID NO: 48123 - DNA, 22 bp, Homo sapiens
gacaggaggcagagctcaggtg

SEQ ID NO: 48124 - DNA, 22 bp, Homo sapiens
atgccactgcactccagcctgg

SEQ ID NO: 48125 - DNA, 23 bp, Homo sapiens
tctacaaagctgtgtcaggaccc

SEQ ID NO: 48126 - DNA, 17 bp, Homo sapiens
cgggcatggagggcagg

SEQ ID NO: 48127 - DNA, 22 bp, Homo sapiens
cctcttctaggacgtccttgtg

SEQ ID NO: 48128 - DNA, 22 bp, Homo sapiens
caggaaagggatgggctgccac

SEQ ID NO: 48129 - DNA, 22 bp, Homo sapiens
tgcctcaagccctccactgcac

SEQ ID NO: 48130 - DNA, 22 bp, Homo sapiens
ttcctggtctatttagaattgc

SEQ ID NO: 48131 - DNA, 22 bp, Homo sapiens
tcttggtatacgcatggcattg

SEQ ID NO: 48132 - DNA, 22 bp, Homo sapiens
gaggtgggtgtatcacaggtca

SEQ ID NO: 48133 - DNA, 22 bp, Homo sapiens
ggtggctgcaatggctaacttc

SEQ ID NO: 48134 - DNA, 22 bp, Homo sapiens
ctgtatttcttggacagttgct

SEQ ID NO: 48135 - DNA, 22 bp, Homo sapiens
tgggaagctgcattttaacaag

SEQ ID NO: 48136 - DNA, 22 bp, Homo sapiens
gaagaaggtggcccaggggtag

SEQ ID NO: 48137 - DNA, 22 bp, Homo sapiens
attttctatgttgtaattgtta

SEQ ID NO: 48138 - DNA, 22 bp, Homo sapiens
gagccaggtcgggccgcggcga

SEQ ID NO: 48139 - DNA, 22 bp, Homo sapiens
gccttgatctgctgtgtttgag

SEQ ID NO: 48140 - DNA, 22 bp, Homo sapiens
tgttcagaacaaaggtaaatga

SEQ ID NO: 48141 - DNA, 22 bp, Homo sapiens
gagccagactgcctgaagctca

SEQ ID NO: 48142 - DNA, 22 bp, Homo sapiens
cactgcacttcagcctgggtga

SEQ ID NO: 48143 - DNA, 22 bp, Homo sapiens
cctgtggcgggggccagtgcct

SEQ ID NO: 48144 - DNA, 22 bp, Homo sapiens
gtctttcttaaacaacagaaca

SEQ ID NO: 48145 - DNA, 22 bp, Homo sapiens
agacagggtgatcgcttgagcc

SEQ ID NO: 48146 - DNA, 23 bp, Homo sapiens
aaaacagcttcctccagtggctc

SEQ ID NO: 48147 - DNA, 22 bp, Homo sapiens
tgggattcaccatgggcttcag

SEQ ID NO: 48148 - DNA, 22 bp, Homo sapiens
gaggccaactttggagaacagg

SEQ ID NO: 48149 - DNA, 22 bp, Homo sapiens
gagggagggactagcattctct

SEQ ID NO: 48150 - DNA, 22 bp, Homo sapiens
taggtgcagtggctcatgcctg

SEQ ID NO: 48151 - DNA, 22 bp, Homo sapiens
gctgtatgtttatttgggaatt

SEQ ID NO: 48152 - DNA, 22 bp, Homo sapiens
atgttatgtctgggaaggggta

SEQ ID NO: 48153 - DNA, 22 bp, Homo sapiens
tgagagttctctcttcaggtgg

SEQ ID NO: 48154 - DNA, 22 bp, Homo sapiens
ttttaatactgctattgtagga

SEQ ID NO: 48155 - DNA, 22 bp, Homo sapiens
ctttggcaatgtcattttcaat

SEQ ID NO: 48156 - DNA, 22 bp, Homo sapiens
tacaaaaaattgatactgacga

SEQ ID NO: 48157 - DNA, 22 bp, Homo sapiens
tctgcaggtaagcgttcttgga

SEQ ID NO: 48158 - DNA, 22 bp, Homo sapiens
ttgattatagactcactaatct

SEQ ID NO: 48159 - DNA, 22 bp, Homo sapiens
atgttggagtcgtaaggcatgg

SEQ ID NO: 48160 - DNA, 22 bp, Homo sapiens
ttgcatttggttctgcctggta

SEQ ID NO: 48161 - DNA, 22 bp, Homo sapiens
cagaagatctcttagtggaggg

SEQ ID NO: 48162 - DNA, 22 bp, Homo sapiens
gcatggcttcggggtgctgcct

SEQ ID NO: 48163 - DNA, 22 bp, Homo sapiens
gagtggggggtccgtctcagtg

SEQ ID NO: 48164 - DNA, 22 bp, Homo sapiens
cttagatgaagtcacagaaccc

SEQ ID NO: 48165 - DNA, 20 bp, Homo sapiens
ataaaataactgccacaaga

SEQ ID NO: 48166 - DNA, 22 bp, Homo sapiens
tgagccatgggactccaaggga

SEQ ID NO: 48167 - DNA, 16 bp, Homo sapiens
gtagccgtggccgctg

SEQ ID NO: 48168 - DNA, 22 bp, Homo sapiens
tggctaacaaggtgaaaccccg

SEQ ID NO: 48169 - DNA, 21 bp, Homo sapiens
gctgctcgagatccagtgctt

SEQ ID NO: 48170 - DNA, 22 bp, Homo sapiens
tcactcaggctggagtgcagtg

SEQ ID NO: 48171 - DNA, 22 bp, Homo sapiens
tcttcctgtcaatgagaattaa

SEQ ID NO: 48172 - DNA, 22 bp, Homo sapiens
aaaggcttcggatcagaaggta

SEQ ID NO: 48173 - DNA, 22 bp, Homo sapiens
aacgcccagccttgatcaaatg

SEQ ID NO: 48174 - DNA, 23 bp, Homo sapiens
gtgcgccaggacaacctgacgga

SEQ ID NO: 48175 - DNA, 22 bp, Homo sapiens
gtccaggcctgcctctgaggag

SEQ ID NO: 48176 - DNA, 22 bp, Homo sapiens
tcaatgtgaattaagaatactt

SEQ ID NO: 48177 - DNA, 22 bp, Homo sapiens
agggaaattaatgtgagcaatg

SEQ ID NO: 48178 - DNA, 22 bp, Homo sapiens
cccattcatcctcgcttccttc

SEQ ID NO: 48179 - DNA, 22 bp, Homo sapiens
ataaaaactgacccatcctttg

SEQ ID NO: 48180 - DNA, 22 bp, Homo sapiens
aagccaggttccatggaggagc

SEQ ID NO: 48181 - DNA, 22 bp, Homo sapiens
tgtcctcgtccgcctcgaactc

SEQ ID NO: 48182 - DNA, 22 bp, Homo sapiens
ttgtcttttgtgggaaatatgg

SEQ ID NO: 48183 - DNA, 22 bp, Homo sapiens
cccaggaggttgaggctgcagt

SEQ ID NO: 48184 - DNA, 20 bp, Homo sapiens
gggcaaggaaacagccccca

SEQ ID NO: 48185 - DNA, 22 bp, Homo sapiens
ctttaattgtagctcccataat

SEQ ID NO: 48186 - DNA, 22 bp, Homo sapiens
tgggcagggagctggaaccaca

SEQ ID NO: 48187 - DNA, 22 bp, Homo sapiens
gggaggttgaggctgcagtgag

SEQ ID NO: 48188 - DNA, 22 bp, Homo sapiens
ggcttcagtggccagagatgat

SEQ ID NO: 48189 - DNA, 22 bp, Homo sapiens
cccggacagaggggcagagtgt

SEQ ID NO: 48190 - DNA, 22 bp, Homo sapiens
acactgcagatgaaagcataag

SEQ ID NO: 48191 - DNA, 22 bp, Homo sapiens
cagggtttcaccatgttagcag

SEQ ID NO: 48192 - DNA, 19 bp, Homo sapiens
gctgaggtggaggaaggag

SEQ ID NO: 48193 - DNA, 22 bp, Homo sapiens
atgccacttcattccagcctcg

SEQ ID NO: 48194 - DNA, 22 bp, Homo sapiens
ccattgtaaattctgtggaagt

SEQ ID NO: 48195 - DNA, 22 bp, Homo sapiens
atggagttctgccagcgctgct

SEQ ID NO: 48196 - DNA, 22 bp, Homo sapiens
cccaggaggcagagatagcagt

SEQ ID NO: 48197 - DNA, 22 bp, Homo sapiens
gggcaccttgggtctcaggcaa

SEQ ID NO: 48198 - DNA, 22 bp, Homo sapiens
cttcctctgtggccagagtgta

SEQ ID NO: 48199 - DNA, 22 bp, Homo sapiens
atgattgaaaatgacattgcca

SEQ ID NO: 48200 - DNA, 22 bp, Homo sapiens
acaaacagagttgaaaaatagg

SEQ ID NO: 48201 - DNA, 22 bp, Homo sapiens
ggctgtggagctgcagagttgg

SEQ ID NO: 48202 - DNA, 22 bp, Homo sapiens
gtgagagattgattgtagcggc

SEQ ID NO: 48203 - DNA, 22 bp, Homo sapiens
ctgaggtgtgaaatggtggcaa

SEQ ID NO: 48204 - DNA, 22 bp, Homo sapiens
caggagctcagatgacatctca

SEQ ID NO: 48205 - DNA, 22 bp, Homo sapiens
ggacctgaacataaaacgaggc

SEQ ID NO: 48206 - DNA, 22 bp, Homo sapiens
agctcaagctacacacagagtc

SEQ ID NO: 48207 - DNA, 22 bp, Homo sapiens
ggaggcagaatagagtgtgggt

SEQ ID NO: 48208 - DNA, 18 bp, Homo sapiens
agtgtcagctgcagctca

SEQ ID NO: 48209 - DNA, 22 bp, Homo sapiens
ggggaaagccagccctgcttcc

SEQ ID NO: 48210 - DNA, 22 bp, Homo sapiens
ctgggcaaattgtgccagctat

SEQ ID NO: 48211 - DNA, 22 bp, Homo sapiens
ggctgggcaggtctgcacaggg

SEQ ID NO: 48212 - DNA, 20 bp, Homo sapiens
cagcagtggatgagagtttt

SEQ ID NO: 48213 - DNA, 22 bp, Homo sapiens
cccacgtcgaacttgctccaga

SEQ ID NO: 48214 - DNA, 22 bp, Homo sapiens
tgccgcagtgcggggagggccc

SEQ ID NO: 48215 - DNA, 22 bp, Homo sapiens
tcgcccaggatggagtgcagta

SEQ ID NO: 48216 - DNA, 22 bp, Homo sapiens
agctgccgatgcccagctgcat

SEQ ID NO: 48217 - DNA, 22 bp, Homo sapiens
tgaggcaggaggattgcaggat

SEQ ID NO: 48218 - DNA, 22 bp, Homo sapiens
ttcattttctttcacgctgctg

SEQ ID NO: 48219 - DNA, 22 bp, Homo sapiens
gaggagggagctggaagctctt

SEQ ID NO: 48220 - DNA, 22 bp, Homo sapiens
cagccctcctaccctgccaggc

SEQ ID NO: 48221 - DNA, 19 bp, Homo sapiens
gttggcactgaaaatggct

SEQ ID NO: 48222 - DNA, 22 bp, Homo sapiens
ccacgggcagatgtggttggtt

SEQ ID NO: 48223 - DNA, 22 bp, Homo sapiens
cagggtgctgcaccatccctca

SEQ ID NO: 48224 - DNA, 22 bp, Homo sapiens
tgggggagctcagtccagccca

SEQ ID NO: 48225 - DNA, 22 bp, Homo sapiens
aaacttttttaggttcataggc

SEQ ID NO: 48226 - DNA, 17 bp, Homo sapiens
cttcccaccatctcctg

SEQ ID NO: 48227 - DNA, 22 bp, Homo sapiens
acctggacacctgctgtcatct

SEQ ID NO: 48228 - DNA, 22 bp, Homo sapiens
cggaggttgaggctgcagtgag

SEQ ID NO: 48229 - DNA, 22 bp, Homo sapiens
atccccagaaagaccgatgtac

SEQ ID NO: 48230 - DNA, 22 bp, Homo sapiens
ttatttttaaaagttcacacag

SEQ ID NO: 48231 - DNA, 22 bp, Homo sapiens
gctcccagtctgatggaggaga

SEQ ID NO: 48232 - DNA, 22 bp, Homo sapiens
agtggcctggagccccgcctgg

SEQ ID NO: 48233 - DNA, 22 bp, Homo sapiens
ggctctgcttgaggccagcctg

SEQ ID NO: 48234 - DNA, 18 bp, Homo sapiens
ttgcttcttttctctagg

SEQ ID NO: 48235 - DNA, 22 bp, Homo sapiens
tcgcccaggctggagtgcagtg

SEQ ID NO: 48236 - DNA, 22 bp, Homo sapiens
cccaggaagtggaggttgcagt

SEQ ID NO: 48237 - DNA, 22 bp, Homo sapiens
gagatgggcgagaaggtggact

SEQ ID NO: 48238 - DNA, 22 bp, Homo sapiens
tgttttaagctctagaagggga

SEQ ID NO: 48239 - DNA, 19 bp, Homo sapiens
tcctgcccaccagccaggg

SEQ ID NO: 48240 - DNA, 22 bp, Homo sapiens
ctgattgagaaggaaggggatc

SEQ ID NO: 48241 - DNA, 22 bp, Homo sapiens
ccagaaaaatcctcccttgtcc

SEQ ID NO: 48242 - DNA, 22 bp, Homo sapiens
gcagcctgggcaacagagtgag

SEQ ID NO: 48243 - DNA, 22 bp, Homo sapiens
agcctgggccctgcctcttctc

SEQ ID NO: 48244 - DNA, 22 bp, Homo sapiens
ctggtgggagataattgaatca

SEQ ID NO: 48245 - DNA, 22 bp, Homo sapiens
gctcaagccttctgcccacctc

SEQ ID NO: 48246 - DNA, 22 bp, Homo sapiens
gacaattgcttttgccgaataa

SEQ ID NO: 48247 - DNA, 22 bp, Homo sapiens
gatgtgtttccaggatttgttt

SEQ ID NO: 48248 - DNA, 22 bp, Homo sapiens
ggaaatctcagatctcccagat

SEQ ID NO: 48249 - DNA, 22 bp, Homo sapiens
ttgtgaatagtgccgctataaa

SEQ ID NO: 48250 - DNA, 22 bp, Homo sapiens
agaatccctggggagctgcagc

SEQ ID NO: 48251 - DNA, 22 bp, Homo sapiens
tggggagtgatgcctcggataa

SEQ ID NO: 48252 - DNA, 22 bp, Homo sapiens
ttgtgaatggtgccgcaataaa

SEQ ID NO: 48253 - DNA, 22 bp, Homo sapiens
gaatccctaagatttttataaa

SEQ ID NO: 48254 - DNA, 22 bp, Homo sapiens
gtccgtagtggctgatgctttg

SEQ ID NO: 48255 - DNA, 22 bp, Homo sapiens
atgattgaccatctgctgggct

SEQ ID NO: 48256 - DNA, 22 bp, Homo sapiens
tgtgggagaaggaagcaagctg

SEQ ID NO: 48257 - DNA, 22 bp, Homo sapiens
atgcttgcccatgtttctgaag

SEQ ID NO: 48258 - DNA, 22 bp, Homo sapiens
ttgggcctctcaaagtgctggg

SEQ ID NO: 48259 - DNA, 22 bp, Homo sapiens
tggaggctggagtgcagtggcg

SEQ ID NO: 48260 - DNA, 22 bp, Homo sapiens
agaatccctgcttgtcttcaaa

SEQ ID NO: 48261 - DNA, 21 bp, Homo sapiens
atctcgggcttctcgcccagc

SEQ ID NO: 48262 - DNA, 22 bp, Homo sapiens
tgtgaatggacaattaaatcta

SEQ ID NO: 48263 - DNA, 17 bp, Homo sapiens
cgggcatggagggcagg

SEQ ID NO: 48264 - DNA, 22 bp, Homo sapiens
cctccccacagcccaggagact

SEQ ID NO: 48265 - DNA, 22 bp, Homo sapiens
ggaggctctgaccatttaccca

SEQ ID NO: 48266 - DNA, 19 bp, Homo sapiens
gactcacaccttccgctgt

SEQ ID NO: 48267 - DNA, 22 bp, Homo sapiens
agtgagagtattaatgtgaact

SEQ ID NO: 48268 - DNA, 22 bp, Homo sapiens
gggagaggttacccgagcaact

SEQ ID NO: 48269 - DNA, 22 bp, Homo sapiens
ggggccttttctgaatgtggaa

SEQ ID NO: 48270 - DNA, 22 bp, Homo sapiens
ggggccttggatctgtgccccg

SEQ ID NO: 48271 - DNA, 22 bp, Homo sapiens
gggaggctctgctcagcccccg

SEQ ID NO: 48272 - DNA, 22 bp, Homo sapiens
gggacttaatgcagagagggac

SEQ ID NO: 48273 - DNA, 21 bp, Homo sapiens
gggcactgaaagggaatagca

SEQ ID NO: 48274 - DNA, 22 bp, Homo sapiens
aggcactgtgcagtcccaagca

SEQ ID NO: 48275 - DNA, 22 bp, Homo sapiens
cttcccaccaaagcccttgttg

SEQ ID NO: 48276 - DNA, 19 bp, Homo sapiens
agaatcccaggccccactg

SEQ ID NO: 48277 - DNA, 22 bp, Homo sapiens
ttgtgaatagtgccgcaataaa

SEQ ID NO: 48278 - DNA, 22 bp, Homo sapiens
atgattgaaaatgacattgcca

SEQ ID NO: 48279 - DNA, 22 bp, Homo sapiens
tcccagaaccctgccaggtcct

SEQ ID NO: 48280 - DNA, 22 bp, Homo sapiens
agggcactgcaagggttgaagg

SEQ ID NO: 48281 - DNA, 22 bp, Homo sapiens
tttgggcaggcttttccctaga

SEQ ID NO: 48282 - DNA, 22 bp, Homo sapiens
ggggtgggcgtgcagggacacc

SEQ ID NO: 48283 - DNA, 22 bp, Homo sapiens
gaatcccttgcattatcccttt

SEQ ID NO: 48284 - DNA, 22 bp, Homo sapiens
attgtgaatagtgccgcagtaa

SEQ ID NO: 48285 - DNA, 22 bp, Homo sapiens
aatggaatacctaggtggccca

SEQ ID NO: 48286 - DNA, 16 bp, Homo sapiens
atgctgctattagagg

SEQ ID NO: 48287 - DNA, 22 bp, Homo sapiens
tcccagaaacgcatatgttcat

SEQ ID NO: 48288 - DNA, 22 bp, Homo sapiens
tgggactcactcttttggccag

SEQ ID NO: 48289 - DNA, 22 bp, Homo sapiens
ggcaggaggtgagtggcgggtg

SEQ ID NO: 48290 - DNA, 22 bp, Homo sapiens
atgaaatatcttgaagaaattc

SEQ ID NO: 48291 - DNA, 22 bp, Homo sapiens
aggtaaagacagtgaaagaggg

SEQ ID NO: 48292 - DNA, 19 bp, Homo sapiens
cataatacagtggatctga

SEQ ID NO: 48293 - DNA, 22 bp, Homo sapiens
gcaaatgctaaagtgtagagac

SEQ ID NO: 48294 - DNA, 22 bp, Homo sapiens
gatagtcacctcccttaacttt

SEQ ID NO: 48295 - DNA, 22 bp, Homo sapiens
ttttaatactgctattgtagga

SEQ ID NO: 48296 - DNA, 22 bp, Homo sapiens
agaaatatgctgattagatgaa

SEQ ID NO: 48297 - DNA, 22 bp, Homo sapiens
tgcatattatgtgtatctgtct

SEQ ID NO: 48298 - DNA, 22 bp, Homo sapiens
aaagaaatagatggcatttaaa

SEQ ID NO: 48299 - DNA, 22 bp, Homo sapiens
tagcagtgtctaggtaggccat

SEQ ID NO: 48300 - DNA, 22 bp, Homo sapiens
taaaggtagtgtgacatattgt

SEQ ID NO: 48301 - DNA, 22 bp, Homo sapiens
gcaggcaggcttccttgaactg

SEQ ID NO: 48302 - DNA, 22 bp, Homo sapiens
aaattgcaaaagtacttttagg

SEQ ID NO: 48303 - DNA, 22 bp, Homo sapiens
gaatgtgtactgagtgcccctt

SEQ ID NO: 48304 - DNA, 22 bp, Homo sapiens
ctgacttgcctaggtcattgtg

SEQ ID NO: 48305 - DNA, 22 bp, Homo sapiens
cttgcctttgtcttcaaaggct

SEQ ID NO: 48306 - DNA, 19 bp, Homo sapiens
ttcacattggaagaagtag

SEQ ID NO: 48307 - DNA, 22 bp, Homo sapiens
aaaaatcacttttataggcagc

SEQ ID NO: 48308 - DNA, 22 bp, Homo sapiens
tttcttaggctctaaaatgact

SEQ ID NO: 48309 - DNA, 22 bp, Homo sapiens
tgtcatagtgtggtagcagtgg

SEQ ID NO: 48310 - DNA, 22 bp, Homo sapiens
catttctgggagacatgctaga

SEQ ID NO: 48311 - DNA, 22 bp, Homo sapiens
aataaaatggtcagttttctca

SEQ ID NO: 48312 - DNA, 22 bp, Homo sapiens
tcaaatgttccctgtactggcc

SEQ ID NO: 48313 - DNA, 22 bp, Homo sapiens
acttttaaatgagtttcagttg

SEQ ID NO: 48314 - DNA, 22 bp, Homo sapiens
tgtatattctgcctaaaagctt

SEQ ID NO: 48315 - DNA, 22 bp, Homo sapiens
agaacagaggccttatgtttca

SEQ ID NO: 48316 - DNA, 22 bp, Homo sapiens
ataatacatggttgatcttttc

SEQ ID NO: 48317 - DNA, 20 bp, Homo sapiens
tatttctgggcaaccattta

SEQ ID NO: 48318 - DNA, 15 bp, Homo sapiens
gcaggcaggtcacct

SEQ ID NO: 48319 - DNA, 22 bp, Homo sapiens
caggcagggagctggaaaggat

SEQ ID NO: 48320 - DNA, 22 bp, Homo sapiens
attctcaaaacataacttcact

SEQ ID NO: 48321 - DNA, 22 bp, Homo sapiens
taatgcacatagaagtacttag

SEQ ID NO: 48322 - DNA, 22 bp, Homo sapiens
tctgacattagattaattggaa

SEQ ID NO: 48323 - DNA, 22 bp, Homo sapiens
aagtcattggtagcttgatagg

SEQ ID NO: 48324 - DNA, 22 bp, Homo sapiens
gtgaaagcactgaacaaagtaa

SEQ ID NO: 48325 - DNA, 22 bp, Homo sapiens
taagaaatttagttatagaatg

SEQ ID NO: 48326 - DNA, 20 bp, Homo sapiens
aaaatatgtataactcttct

SEQ ID NO: 48327 - DNA, 22 bp, Homo sapiens
atgcccaatgtcacaatttttg

SEQ ID NO: 48328 - DNA, 22 bp, Homo sapiens
taattgtaaagtagtagtacag

SEQ ID NO: 48329 - DNA, 22 bp, Homo sapiens
agtgttagattcttactcagtt

SEQ ID NO: 48330 - DNA, 22 bp, Homo sapiens
atgattgaaaatgacattgcca

SEQ ID NO: 48331 - DNA, 22 bp, Homo sapiens
tttatgtagttacggactatca

SEQ ID NO: 48332 - DNA, 16 bp, Homo sapiens
gcaggcagatcacatg

SEQ ID NO: 48333 - DNA, 20 bp, Homo sapiens
ataaaataactgccacaaga

SEQ ID NO: 48334 - DNA, 22 bp, Homo sapiens
catgtctgtgtacacatgcaca

SEQ ID NO: 48335 - DNA, 22 bp, Homo sapiens
aggtattattagcatctctatt

SEQ ID NO: 48336 - DNA, 22 bp, Homo sapiens
accactgcccatggtgaaaact

SEQ ID NO: 48337 - DNA, 23 bp, Homo sapiens
aagtggttttgaacccggaccct

SEQ ID NO: 48338 - DNA, 22 bp, Homo sapiens
tccccaagcaggcaatctcccg

SEQ ID NO: 48339 - DNA, 22 bp, Homo sapiens
gcagtggcatgatgtgggctca

SEQ ID NO: 48340 - DNA, 22 bp, Homo sapiens
acagaactgggaaatgcacata

SEQ ID NO: 48341 - DNA, 22 bp, Homo sapiens
aaaatggtctcagctggcacca

SEQ ID NO: 48342 - DNA, 22 bp, Homo sapiens
atatatttgagaatattcatga

SEQ ID NO: 48343 - DNA, 22 bp, Homo sapiens
gaatgcagatggctggtgtatg

SEQ ID NO: 48344 - DNA, 22 bp, Homo sapiens
aagaggtaaccatagcaaccac

SEQ ID NO: 48345 - DNA, 22 bp, Homo sapiens
agtatgtcagagtgaaaatggt

SEQ ID NO: 48346 - DNA, 22 bp, Homo sapiens
tgcaataactactttaatgttg

SEQ ID NO: 48347 - DNA, 22 bp, Homo sapiens
atgaaaacggaccagagctatt

SEQ ID NO: 48348 - DNA, 23 bp, Homo sapiens
caccactttctccttctccttgg

SEQ ID NO: 48349 - DNA, 22 bp, Homo sapiens
cttgtgcatttcattcctcagg

SEQ ID NO: 48350 - DNA, 22 bp, Homo sapiens
tctgtagtaggttgtagttctt

SEQ ID NO: 48351 - DNA, 21 bp, Homo sapiens
taaacataaccttgtatggct

SEQ ID NO: 48352 - DNA, 22 bp, Homo sapiens
ttaataaagtatgaattggaaa

SEQ ID NO: 48353 - DNA, 22 bp, Homo sapiens
tagaatgtaaattccaagggca

SEQ ID NO: 48354 - DNA, 22 bp, Homo sapiens
tttaaaaaactagtctgagtct

SEQ ID NO: 48355 - DNA, 22 bp, Homo sapiens
tgtgaaagatactaggcagagg

SEQ ID NO: 48356 - DNA, 22 bp, Homo sapiens
aaaatcctgctgactcgagatg

SEQ ID NO: 48357 - DNA, 22 bp, Homo sapiens
tttattctgtgctacatgaaga

SEQ ID NO: 48358 - DNA, 22 bp, Homo sapiens
agttgcagacgcagagatgttg

SEQ ID NO: 48359 - DNA, 22 bp, Homo sapiens
ttgagggtctggatctgctgct

SEQ ID NO: 48360 - DNA, 22 bp, Homo sapiens
tgtgccatgaggctctgatatg

SEQ ID NO: 48361 - DNA, 22 bp, Homo sapiens
tttaatcaggcaaagcataata

SEQ ID NO: 48362 - DNA, 22 bp, Homo sapiens
aactaatacattaatacatgtg

SEQ ID NO: 48363 - DNA, 22 bp, Homo sapiens
tcccagtttttctccactaagg

SEQ ID NO: 48364 - DNA, 22 bp, Homo sapiens
aaccaccattctctcctcttcc

SEQ ID NO: 48365 - DNA, 22 bp, Homo sapiens
tgcaccctcatcagtcaaatgg

SEQ ID NO: 48366 - DNA, 22 bp, Homo sapiens
gcaggcagaggtggaggagaca

SEQ ID NO: 48367 - DNA, 22 bp, Homo sapiens
tcaaatgctgtattgtagtaat

SEQ ID NO: 48368 - DNA, 22 bp, Homo sapiens
atattgaaccctacagactgta

SEQ ID NO: 48369 - DNA, 22 bp, Homo sapiens
agaacctcaattatttttgcac

SEQ ID NO: 48370 - DNA, 22 bp, Homo sapiens
tagcataacaggtaagagtgag

SEQ ID NO: 48371 - DNA, 22 bp, Homo sapiens
tcttaattctgtgtcttcacta

SEQ ID NO: 48372 - DNA, 22 bp, Homo sapiens
tagtttcatctccaccctgccc

SEQ ID NO: 48373 - DNA, 22 bp, Homo sapiens
ttgtaacaggtactaaataact

SEQ ID NO: 48374 - DNA, 22 bp, Homo sapiens
caggccagggttgagaagagaa

SEQ ID NO: 48375 - DNA, 22 bp, Homo sapiens
tctgacattttgagaatgacat

SEQ ID NO: 48376 - DNA, 22 bp, Homo sapiens
tcaatcacgtgttccatgttct

SEQ ID NO: 48377 - DNA, 22 bp, Homo sapiens
agaacctctggatacagtttaa

SEQ ID NO: 48378 - DNA, 22 bp, Homo sapiens
ggctagggatctagaccaggac

SEQ ID NO: 48379 - DNA, 22 bp, Homo sapiens
ttaaatattatgttgtctgcaa

SEQ ID NO: 48380 - DNA, 22 bp, Homo sapiens
gcttaattctggctcagtttcc

SEQ ID NO: 48381 - DNA, 22 bp, Homo sapiens
ttggtggacctcatcagaaccg

SEQ ID NO: 48382 - DNA, 22 bp, Homo sapiens
agatgtgtttctagttcctgca

SEQ ID NO: 48383 - DNA, 22 bp, Homo sapiens
tgatttatgcattatactgttg

SEQ ID NO: 48384 - DNA, 22 bp, Homo sapiens
ataaaatttgctactgttaaat

SEQ ID NO: 48385 - DNA, 22 bp, Homo sapiens
gcaactgaacatgtgtgtggcc

SEQ ID NO: 48386 - DNA, 22 bp, Homo sapiens
gtctctatcatagctgaaccct

SEQ ID NO: 48387 - DNA, 22 bp, Homo sapiens
ttgtctaatgagctccacttca

SEQ ID NO: 48388 - DNA, 22 bp, Homo sapiens
gtctttatttgagattgtcatt

SEQ ID NO: 48389 - DNA, 22 bp, Homo sapiens
tgaaatgtgtaatgtggatgcc

SEQ ID NO: 48390 - DNA, 22 bp, Homo sapiens
catataaatacaacatgtgtta

SEQ ID NO: 48391 - DNA, 23 bp, Homo sapiens
aaataggagtatctggatcatga

SEQ ID NO: 48392 - DNA, 22 bp, Homo sapiens
gcaggcagatcacctgtcagga

SEQ ID NO: 48393 - DNA, 22 bp, Homo sapiens
ttttcatttttgtagatgcaag

SEQ ID NO: 48394 - DNA, 22 bp, Homo sapiens
aagaggtagcagtcacaaaaga

SEQ ID NO: 48395 - DNA, 22 bp, Homo sapiens
gatgatcatctgtaaagttaga

SEQ ID NO: 48396 - DNA, 22 bp, Homo sapiens
gggccatgagaggttcatcaac

SEQ ID NO: 48397 - DNA, 22 bp, Homo sapiens
aagcacaatgaacatcttagat

SEQ ID NO: 48398 - DNA, 22 bp, Homo sapiens
taatatctacttcatagagttt

SEQ ID NO: 48399 - DNA, 22 bp, Homo sapiens
aaatgcaacgggctttccttat

SEQ ID NO: 48400 - DNA, 22 bp, Homo sapiens
tttcagatggaggtttaggaca

SEQ ID NO: 48401 - DNA, 22 bp, Homo sapiens
cgtcatcacggcaagcatctcc

SEQ ID NO: 48402 - DNA, 22 bp, Homo sapiens
cgtgtacagtctatcttttttc

SEQ ID NO: 48403 - DNA, 22 bp, Homo sapiens
aagctgcagcacagagaggtgg

SEQ ID NO: 48404 - DNA, 14 bp, Homo sapiens
gcaggcagatcacc

SEQ ID NO: 48405 - DNA, 22 bp, Homo sapiens
ccttctagcaaatcaacataaa

SEQ ID NO: 48406 - DNA, 21 bp, Homo sapiens
gttcaaatcctgacactacac

SEQ ID NO: 48407 - DNA, 22 bp, Homo sapiens
gtgcaaaagtaattgtggtttt

SEQ ID NO: 48408 - DNA, 22 bp, Homo sapiens
catttacatttaaggttaatat

SEQ ID NO: 48409 - DNA, 22 bp, Homo sapiens
aacagaatgcaggggatgctgc

SEQ ID NO: 48410 - DNA, 22 bp, Homo sapiens
tgatattttatgagctttcata

SEQ ID NO: 48411 - DNA, 22 bp, Homo sapiens
aggtgactggtttatctggcag

SEQ ID NO: 48412 - DNA, 22 bp, Homo sapiens
tttattggatatttacaagata

SEQ ID NO: 48413 - DNA, 22 bp, Homo sapiens
gtgggctgcccttgaggtcagc

SEQ ID NO: 48414 - DNA, 22 bp, Homo sapiens
gagaactttctgtgtttttatc

SEQ ID NO: 48415 - DNA, 22 bp, Homo sapiens
cagcagcattgctctggattcc

SEQ ID NO: 48416 - DNA, 22 bp, Homo sapiens
atttgtgggactataatgcagg

SEQ ID NO: 48417 - DNA, 22 bp, Homo sapiens
gctgctgggatcctgggtctca

SEQ ID NO: 48418 - DNA, 22 bp, Homo sapiens
aacggctgtggctggcggcagc

SEQ ID NO: 48419 - DNA, 22 bp, Homo sapiens
cttatttgcccatgtttcttta

SEQ ID NO: 48420 - DNA, 22 bp, Homo sapiens
tatcactacacctggctaatta

SEQ ID NO: 48421 - DNA, 22 bp, Homo sapiens
ttttttgttgggtagaacggaa

SEQ ID NO: 48422 - DNA, 22 bp, Homo sapiens
tgagccaggagtttgaggctgt

SEQ ID NO: 48423 - DNA, 22 bp, Homo sapiens
gctgggttttcttccgggccta

SEQ ID NO: 48424 - DNA, 22 bp, Homo sapiens
agatcacagtggcaactccctt

SEQ ID NO: 48425 - DNA, 22 bp, Homo sapiens
tggctccgttgtacaggctgga

SEQ ID NO: 48426 - DNA, 22 bp, Homo sapiens
atgccaggaacaaacagtggtg

SEQ ID NO: 48427 - DNA, 22 bp, Homo sapiens
ggctttagtgtaggtttctgtt

SEQ ID NO: 48428 - DNA, 22 bp, Homo sapiens
gactgtggggaagcagatgcca

SEQ ID NO: 48429 - DNA, 22 bp, Homo sapiens
catctgctgttccttggactca

SEQ ID NO: 48430 - DNA, 22 bp, Homo sapiens
ctgtcctgtgctttttactgtc

SEQ ID NO: 48431 - DNA, 22 bp, Homo sapiens
tcggggtctttgacacgctctg

SEQ ID NO: 48432 - DNA, 22 bp, Homo sapiens
tttgttttcaatgtgtcattca

SEQ ID NO: 48433 - DNA, 22 bp, Homo sapiens
tacttttagcctatttgattct

SEQ ID NO: 48434 - DNA, 22 bp, Homo sapiens
ctggcctggcgcagtggctcac

SEQ ID NO: 48435 - DNA, 22 bp, Homo sapiens
tttaaaaaactagtctgagtct

SEQ ID NO: 48436 - DNA, 21 bp, Homo sapiens
tctgatggtagatgagatgtg

SEQ ID NO: 48437 - DNA, 17 bp, Homo sapiens
gtaaggcttgcagatgc

SEQ ID NO: 48438 - DNA, 22 bp, Homo sapiens
gtgtcaataaatagcggtgtgg

SEQ ID NO: 48439 - DNA, 22 bp, Homo sapiens
catggcactgagcaggtatgca

SEQ ID NO: 48440 - DNA, 22 bp, Homo sapiens
tgcctgttgcccacctgataaa

SEQ ID NO: 48441 - DNA, 20 bp, Homo sapiens
agcagagtgcccatcccgga

SEQ ID NO: 48442 - DNA, 22 bp, Homo sapiens
tcaatcacgtgttccatgttct

SEQ ID NO: 48443 - DNA, 22 bp, Homo sapiens
acacagagccaaaccatatcac

SEQ ID NO: 48444 - DNA, 22 bp, Homo sapiens
tctgtcttagccatctcaggct

SEQ ID NO: 48445 - DNA, 22 bp, Homo sapiens
tttattctgtgctacatgaaga

SEQ ID NO: 48446 - DNA, 22 bp, Homo sapiens
actgggcctacccagattggca

SEQ ID NO: 48447 - DNA, 22 bp, Homo sapiens
ctcagcactgacccaggagatg

SEQ ID NO: 48448 - DNA, 22 bp, Homo sapiens
tgaactcctgacctcatgatcc

SEQ ID NO: 48449 - DNA, 22 bp, Homo sapiens
agcctggtttaagcattttata

SEQ ID NO: 48450 - DNA, 22 bp, Homo sapiens
tgagccatgggactccaaggga

SEQ ID NO: 48451 - DNA, 22 bp, Homo sapiens
ctgcactgacttccccggctgc

SEQ ID NO: 48452 - DNA, 22 bp, Homo sapiens
aagcagatctgatagggccctg

SEQ ID NO: 48453 - DNA, 22 bp, Homo sapiens
ttatcacttatgagctttttgc

SEQ ID NO: 48454 - DNA, 22 bp, Homo sapiens
ctgatattctattttgcttgct

SEQ ID NO: 48455 - DNA, 22 bp, Homo sapiens
tttgaggttagctagcagatca

SEQ ID NO: 48456 - DNA, 22 bp, Homo sapiens
gccagggttcgaatccgtatgg

SEQ ID NO: 48457 - DNA, 22 bp, Homo sapiens
attgtgaatagtgccgcagtaa

SEQ ID NO: 48458 - DNA, 22 bp, Homo sapiens
agggccagcactcctggcagga

SEQ ID NO: 48459 - DNA, 19 bp, Homo sapiens
tgtccgtggccttctggat

SEQ ID NO: 48460 - DNA, 21 bp, Homo sapiens
cccgcacagcggtaggccgcc

SEQ ID NO: 48461 - DNA, 22 bp, Homo sapiens
ttaaattttagaaacagactct

SEQ ID NO: 48462 - DNA, 22 bp, Homo sapiens
gcacagagagggaaggtaactt

SEQ ID NO: 48463 - DNA, 22 bp, Homo sapiens
tacagaagcttttgaaaagatg

SEQ ID NO: 48464 - DNA, 22 bp, Homo sapiens
ttctgggcacacaggccctggt

SEQ ID NO: 48465 - DNA, 22 bp, Homo sapiens
atgaattgaggaaaacagtcgt

SEQ ID NO: 48466 - DNA, 22 bp, Homo sapiens
ctggcaggttatagagctgccc

SEQ ID NO: 48467 - DNA, 22 bp, Homo sapiens
acctagaatttaaaacattgct

SEQ ID NO: 48468 - DNA, 21 bp, Homo sapiens
tcactagtgccttctgtcatt

SEQ ID NO: 48469 - DNA, 22 bp, Homo sapiens
tgttttaagctctagaagggga

SEQ ID NO: 48470 - DNA, 20 bp, Homo sapiens
caggtccagcacgtgcacgg

SEQ ID NO: 48471 - DNA, 22 bp, Homo sapiens
ggctgtgtggccgtgggctcta

SEQ ID NO: 48472 - DNA, 22 bp, Homo sapiens
tgctagtgtgtgagatgttcaa

SEQ ID NO: 48473 - DNA, 22 bp, Homo sapiens
atttagaactttgtttgccaat

SEQ ID NO: 48474 - DNA, 22 bp, Homo sapiens
gagcccgagcgcgtacccggcg

SEQ ID NO: 48475 - DNA, 22 bp, Homo sapiens
aggacttagaacattatgtact

SEQ ID NO: 48476 - DNA, 22 bp, Homo sapiens
ggaaacttggatgccagcactc

SEQ ID NO: 48477 - DNA, 22 bp, Homo sapiens
tgctgaataagacgtggcttgt

SEQ ID NO: 48478 - DNA, 22 bp, Homo sapiens
ggggttaacagtattgctcatg

SEQ ID NO: 48479 - DNA, 22 bp, Homo sapiens
tgttgagtatatacctacaagt

SEQ ID NO: 48480 - DNA, 22 bp, Homo sapiens
ttatttaaaagtggtaagattc

SEQ ID NO: 48481 - DNA, 22 bp, Homo sapiens
ggcctcacccatcggtgccttt

SEQ ID NO: 48482 - DNA, 22 bp, Homo sapiens
ttcagcactgactgagtggtta

SEQ ID NO: 48483 - DNA, 22 bp, Homo sapiens
ttatttgtggcatatgagacga

SEQ ID NO: 48484 - DNA, 22 bp, Homo sapiens
atgaaatatcttgaagaaattc

SEQ ID NO: 48485 - DNA, 22 bp, Homo sapiens
ctcagcactttggaaggctgat

SEQ ID NO: 48486 - DNA, 23 bp, Homo sapiens
ccaagactgttaggagtggggag

SEQ ID NO: 48487 - DNA, 22 bp, Homo sapiens
tgggcaggggccctgcttccgt

SEQ ID NO: 48488 - DNA, 21 bp, Homo sapiens
aaactgaccttgcctgagaca

SEQ ID NO: 48489 - DNA, 22 bp, Homo sapiens
ggctcctgggggtgctcctgcc

SEQ ID NO: 48490 - DNA, 20 bp, Homo sapiens
tcagccttgaatgcttgaaa

SEQ ID NO: 48491 - DNA, 22 bp, Homo sapiens
agcctgcgatcccacctggcct

SEQ ID NO: 48492 - DNA, 19 bp, Homo sapiens
cgcctggcaggccctgcgc

SEQ ID NO: 48493 - DNA, 22 bp, Homo sapiens
gacagacacaattgatccatga

SEQ ID NO: 48494 - DNA, 22 bp, Homo sapiens
gcagttaaaaataaaccttcat

SEQ ID NO: 48495 - DNA, 22 bp, Homo sapiens
gcggcccgagcaggacgggtgg

SEQ ID NO: 48496 - DNA, 22 bp, Homo sapiens
tcctggcttgtcacatctacgt

SEQ ID NO: 48497 - DNA, 22 bp, Homo sapiens
ctgtcctgccagtcctggactc

SEQ ID NO: 48498 - DNA, 22 bp, Homo sapiens
attgataaattgcaatggggct

SEQ ID NO: 48499 - DNA, 22 bp, Homo sapiens
agtcaaagatgaccgagttcct

SEQ ID NO: 48500 - DNA, 22 bp, Homo sapiens
tttgtgaataggttggcttcca

SEQ ID NO: 48501 - DNA, 22 bp, Homo sapiens
tcattaatcccggggtccaggg

SEQ ID NO: 48502 - DNA, 22 bp, Homo sapiens
cggccaagccggggccccgaag

SEQ ID NO: 48503 - DNA, 21 bp, Homo sapiens
gctcctggtgctgcgtggcgc

SEQ ID NO: 48504 - DNA, 22 bp, Homo sapiens
ggaactcctgctccaagcagct

SEQ ID NO: 48505 - DNA, 22 bp, Homo sapiens
aagaatgagctcaaagatctta

SEQ ID NO: 48506 - DNA, 22 bp, Homo sapiens
actgggccaggtgtgggtgagt

SEQ ID NO: 48507 - DNA, 22 bp, Homo sapiens
cattgcaacttcaaactcctgg

SEQ ID NO: 48508 - DNA, 22 bp, Homo sapiens
agggtgaatctcacaactctta

SEQ ID NO: 48509 - DNA, 22 bp, Homo sapiens
actgcgtggggagctgtgacta

SEQ ID NO: 48510 - DNA, 22 bp, Homo sapiens
ctgccctggggggcctccttgc

SEQ ID NO: 48511 - DNA, 22 bp, Homo sapiens
tgccgtggggctgaggctggag

SEQ ID NO: 48512 - DNA, 22 bp, Homo sapiens
attaagtgactaaagtaatgct

SEQ ID NO: 48513 - DNA, 22 bp, Homo sapiens
aaggaggttatcccagtggact

SEQ ID NO: 48514 - DNA, 22 bp, Homo sapiens
acaccatactcatgttggttcc

SEQ ID NO: 48515 - DNA, 22 bp, Homo sapiens
atgtgggccgtgcgggtgtcct

SEQ ID NO: 48516 - DNA, 18 bp, Homo sapiens
agctccatctgtcagcat

SEQ ID NO: 48517 - DNA, 22 bp, Homo sapiens
tactaggaagcagctgcattgg

SEQ ID NO: 48518 - DNA, 22 bp, Homo sapiens
tgtgcctactgatagagccaag

SEQ ID NO: 48519 - DNA, 22 bp, Homo sapiens
gggaaactttcacaatgtccag

SEQ ID NO: 48520 - DNA, 22 bp, Homo sapiens
gcgtggcttagagtggggtacc

SEQ ID NO: 48521 - DNA, 22 bp, Homo sapiens
tgttgattagtgtttagactta

SEQ ID NO: 48522 - DNA, 23 bp, Homo sapiens
aaacttgctatggctgaaatcat

SEQ ID NO: 48523 - DNA, 22 bp, Homo sapiens
tgcagattcaaatgaaatgcaa

SEQ ID NO: 48524 - DNA, 22 bp, Homo sapiens
ctgcatccatgttgctgcaaag

SEQ ID NO: 48525 - DNA, 22 bp, Homo sapiens
tgttttaagggtcaactgtcac

SEQ ID NO: 48526 - DNA, 22 bp, Homo sapiens
gtcactgtatccaggttccagc

SEQ ID NO: 48527 - DNA, 22 bp, Homo sapiens
tgggcagggagctggaaccaca

SEQ ID NO: 48528 - DNA, 22 bp, Homo sapiens
actgggcctgattgggtcggag

SEQ ID NO: 48529 - DNA, 22 bp, Homo sapiens
gatttgtggtgtgaggaagagc

SEQ ID NO: 48530 - DNA, 22 bp, Homo sapiens
ctgtggctctcagaggctgctg

SEQ ID NO: 48531 - DNA, 22 bp, Homo sapiens
agtgcaggccccaggccaggcc

SEQ ID NO: 48532 - DNA, 22 bp, Homo sapiens
aatgcaatgcagcacctccttg

SEQ ID NO: 48533 - DNA, 22 bp, Homo sapiens
agtccgtggccagactcaagag

SEQ ID NO: 48534 - DNA, 22 bp, Homo sapiens
aggagccagtggagttcctgcc

SEQ ID NO: 48535 - DNA, 22 bp, Homo sapiens
gccatcatatcccctgtgacct

SEQ ID NO: 48536 - DNA, 22 bp, Homo sapiens
tgtaccactctactaagggttc

SEQ ID NO: 48537 - DNA, 22 bp, Homo sapiens
gttgtgaatagtgccgcaataa

SEQ ID NO: 48538 - DNA, 22 bp, Homo sapiens
cccgagtgtctactcactccca

SEQ ID NO: 48539 - DNA, 22 bp, Homo sapiens
ctcctggaggatagtgactggg

SEQ ID NO: 48540 - DNA, 22 bp, Homo sapiens
tctcatctgccatttgcaggag

SEQ ID NO: 48541 - DNA, 22 bp, Homo sapiens
cacacctcagccatgtggaggc

SEQ ID NO: 48542 - DNA, 22 bp, Homo sapiens
gctcttgtcaaaaattagttga

SEQ ID NO: 48543 - DNA, 22 bp, Homo sapiens
tgagcttccctcctgcactaca

SEQ ID NO: 48544 - DNA, 22 bp, Homo sapiens
ggggtctgggcttagctggaat

SEQ ID NO: 48545 - DNA, 22 bp, Homo sapiens
tccttagacaaagagtgggctt

SEQ ID NO: 48546 - DNA, 22 bp, Homo sapiens
cagcagcagtggctgcagaaca

SEQ ID NO: 48547 - DNA, 22 bp, Homo sapiens
agcctattccaggatgagctca

SEQ ID NO: 48548 - DNA, 22 bp, Homo sapiens
tccacgtgagcttcgtgtgcag

SEQ ID NO: 48549 - DNA, 20 bp, Homo sapiens
acgtggccaccagtggctta

SEQ ID NO: 48550 - DNA, 22 bp, Homo sapiens
tttgtttgccacacaaaacagt

SEQ ID NO: 48551 - DNA, 22 bp, Homo sapiens
gggaggcagtgctggaggctgg

SEQ ID NO: 48552 - DNA, 22 bp, Homo sapiens
ggaggcagaatagagtgtgggt

SEQ ID NO: 48553 - DNA, 22 bp, Homo sapiens
aggagcagaccgtagtcctgca

SEQ ID NO: 48554 - DNA, 17 bp, Homo sapiens
cgggcatggagggcagg

SEQ ID NO: 48555 - DNA, 22 bp, Homo sapiens
ttatagcagcatgatttacaat

SEQ ID NO: 48556 - DNA, 22 bp, Homo sapiens
gggaggcacgaggcgcgcagtg

SEQ ID NO: 48557 - DNA, 22 bp, Homo sapiens
agtccaggcattccagccattc

SEQ ID NO: 48558 - DNA, 22 bp, Homo sapiens
gccttgtttcattacacgtggt

SEQ ID NO: 48559 - DNA, 22 bp, Homo sapiens
ggtttattgttaataagtttga

SEQ ID NO: 48560 - DNA, 22 bp, Homo sapiens
aatattatcaaaagctttttca

SEQ ID NO: 48561 - DNA, 22 bp, Homo sapiens
aaaccctgagacttggggccag

SEQ ID NO: 48562 - DNA, 22 bp, Homo sapiens
atacacgtgccatgttggtgtg

SEQ ID NO: 48563 - DNA, 22 bp, Homo sapiens
ctcctgagctctgaggaagctt

SEQ ID NO: 48564 - DNA, 22 bp, Homo sapiens
gaagcctcaacatctctgcgtc

SEQ ID NO: 48565 - DNA, 22 bp, Homo sapiens
tacaaaaaattgatactgacga

SEQ ID NO: 48566 - DNA, 22 bp, Homo sapiens
gctgggttttcttccgggccta

SEQ ID NO: 48567 - DNA, 22 bp, Homo sapiens
gagagtctaggaacctcatata

SEQ ID NO: 48568 - DNA, 22 bp, Homo sapiens
tggggagtgatgcctcggataa

SEQ ID NO: 48569 - DNA, 22 bp, Homo sapiens
tctctggactcgagcttactca

SEQ ID NO: 48570 - DNA, 22 bp, Homo sapiens
gagccaggttggaggctgcagt

SEQ ID NO: 48571 - DNA, 22 bp, Homo sapiens
tgggaggccaaggcaggcggat

SEQ ID NO: 48572 - DNA, 22 bp, Homo sapiens
gcaggcagatcacctgtcagga

SEQ ID NO: 48573 - DNA, 22 bp, Homo sapiens
gagtgcagtggcgtgatctctg

SEQ ID NO: 48574 - DNA, 22 bp, Homo sapiens
cacgggagacgtgatcttggac

SEQ ID NO: 48575 - DNA, 22 bp, Homo sapiens
cactgcagcctcaaattcctgg

SEQ ID NO: 48576 - DNA, 22 bp, Homo sapiens
aagctgcagcacagagaggtgg

SEQ ID NO: 48577 - DNA, 22 bp, Homo sapiens
ttcttgggaatttttccaacac

SEQ ID NO: 48578 - DNA, 22 bp, Homo sapiens
ggaggtgggctaaggactctct

SEQ ID NO: 48579 - DNA, 20 bp, Homo sapiens
tgttgattggtgtcatctca

SEQ ID NO: 48580 - DNA, 22 bp, Homo sapiens
cggctgggttcggctgcaggcc

SEQ ID NO: 48581 - DNA, 19 bp, Homo sapiens
gactccaactttaagcatg

SEQ ID NO: 48582 - DNA, 22 bp, Homo sapiens
tggaggcagccgtgaaccacct

SEQ ID NO: 48583 - DNA, 22 bp, Homo sapiens
agccagggacgctgcaggctac

SEQ ID NO: 48584 - DNA, 22 bp, Homo sapiens
gcctccggagttgcagtgtctt

SEQ ID NO: 48585 - DNA, 22 bp, Homo sapiens
ctgggggtcttgaaagggagag

SEQ ID NO: 48586 - DNA, 22 bp, Homo sapiens
tgaggcaggaggattgcaggat

SEQ ID NO: 48587 - DNA, 22 bp, Homo sapiens
aggcgaagggaccagacggtag

SEQ ID NO: 48588 - DNA, 22 bp, Homo sapiens
tccgggcaactgaagggaggtt

SEQ ID NO: 48589 - DNA, 22 bp, Homo sapiens
ctacaaaagtaattgtggtttt

SEQ ID NO: 48590 - DNA, 22 bp, Homo sapiens
aagcctggactatcgcgtgtgc

SEQ ID NO: 48591 - DNA, 20 bp, Homo sapiens
agcagagtgcccatcccgga

SEQ ID NO: 48592 - DNA, 22 bp, Homo sapiens
gtggagggtgattgccggctgt

SEQ ID NO: 48593 - DNA, 23 bp, Homo sapiens
tgtcttcgactcctgcgtgcttc

SEQ ID NO: 48594 - DNA, 22 bp, Homo sapiens
caagccattctcctgcctcagc

SEQ ID NO: 48595 - DNA, 22 bp, Homo sapiens
cctgggtttggagcctgcagaa

SEQ ID NO: 48596 - DNA, 14 bp, Homo sapiens
gcaggcggatcact

SEQ ID NO: 48597 - DNA, 22 bp, Homo sapiens
gcaggtggatcacctgaggtca

SEQ ID NO: 48598 - DNA, 22 bp, Homo sapiens
tccaggattgcaggtgcacaac

SEQ ID NO: 48599 - DNA, 22 bp, Homo sapiens
tctcctggtacccttcctagca

SEQ ID NO: 48600 - DNA, 22 bp, Homo sapiens
atacaaaatatatactggagac

SEQ ID NO: 48601 - DNA, 22 bp, Homo sapiens
ccaaccagctatggaatcttgt

SEQ ID NO: 48602 - DNA, 22 bp, Homo sapiens
gctcatgactgtaatcccagca

SEQ ID NO: 48603 - DNA, 22 bp, Homo sapiens
tgggggtgtcctggtgcacaca

SEQ ID NO: 48604 - DNA, 22 bp, Homo sapiens
aagcactttatgtcaatgtcct

SEQ ID NO: 48605 - DNA, 22 bp, Homo sapiens
atggagttctgccagcgctgct

SEQ ID NO: 48606 - DNA, 19 bp, Homo sapiens
aggctaaagagtcttgcgt

SEQ ID NO: 48607 - DNA, 22 bp, Homo sapiens
atcttcccaggctggggagagg

SEQ ID NO: 48608 - DNA, 22 bp, Homo sapiens
tggggtacttgtatcaaagcac

SEQ ID NO: 48609 - DNA, 22 bp, Homo sapiens
ttgtcgggcttacgcagggcca

SEQ ID NO: 48610 - DNA, 22 bp, Homo sapiens
ttgaagtgagaggggctggggt

SEQ ID NO: 48611 - DNA, 22 bp, Homo sapiens
ctggaaggagcccgggcggatc

SEQ ID NO: 48612 - DNA, 22 bp, Homo sapiens
attcatcagctaatggacattt

SEQ ID NO: 48613 - DNA, 22 bp, Homo sapiens
tcggagctgtagatgaaaccct

SEQ ID NO: 48614 - DNA, 22 bp, Homo sapiens
gcctccggagtcacagtgtctt

SEQ ID NO: 48615 - DNA, 22 bp, Homo sapiens
accgtgtctgacactttgggcg

SEQ ID NO: 48616 - DNA, 22 bp, Homo sapiens
ggaactcctgctccaagcagct

SEQ ID NO: 48617 - DNA, 22 bp, Homo sapiens
aacagcgacgtcctccccaaca

SEQ ID NO: 48618 - DNA, 22 bp, Homo sapiens
agcctgcgatcccacctggcct

SEQ ID NO: 48619 - DNA, 22 bp, Homo sapiens
tgagcaggcgcagcaggaggtc

SEQ ID NO: 48620 - DNA, 22 bp, Homo sapiens
aaagcgcttccctttggagcgt

SEQ ID NO: 48621 - DNA, 22 bp, Homo sapiens
tgaatgtgatgctaaacatatg

SEQ ID NO: 48622 - DNA, 22 bp, Homo sapiens
gagccaggtcgggccgcggcga

SEQ ID NO: 48623 - DNA, 22 bp, Homo sapiens
tgtgtggattcatctcaaagag

SEQ ID NO: 48624 - DNA, 22 bp, Homo sapiens
ttatagcagcatgatttataat

SEQ ID NO: 48625 - DNA, 22 bp, Homo sapiens
cgagcatgatgacggctgtggc

SEQ ID NO: 48626 - DNA, 22 bp, Homo sapiens
tcgtctgtgaaattgggataag

SEQ ID NO: 48627 - DNA, 22 bp, Homo sapiens
atacaaaaattagccgggagta

SEQ ID NO: 48628 - DNA, 22 bp, Homo sapiens
gagaacagaagcattcctaatt

SEQ ID NO: 48629 - DNA, 22 bp, Homo sapiens
ggccagaagttggaaaagagcc

SEQ ID NO: 48630 - DNA, 22 bp, Homo sapiens
tcttcccagaggaggtgccagc

SEQ ID NO: 48631 - DNA, 22 bp, Homo sapiens
tgtggcacatacacaggagggc

SEQ ID NO: 48632 - DNA, 22 bp, Homo sapiens
gcctgggtccaccgctcgcgct

SEQ ID NO: 48633 - DNA, 18 bp, Homo sapiens
tctggaacaacttcatgt

SEQ ID NO: 48634 - DNA, 22 bp, Homo sapiens
ttatagcagcatgatttatagt

SEQ ID NO: 48635 - DNA, 22 bp, Homo sapiens
ctggcaggtggaggttgcagtg

SEQ ID NO: 48636 - DNA, 22 bp, Homo sapiens
tctgtggcccaagtgatggctg

SEQ ID NO: 48637 - DNA, 22 bp, Homo sapiens
agcctctctgttagtcactggg

SEQ ID NO: 48638 - DNA, 22 bp, Homo sapiens
cagccctcctaccctgccaggc

SEQ ID NO: 48639 - DNA, 22 bp, Homo sapiens
tgggcagggagctggaaccaca

SEQ ID NO: 48640 - DNA, 22 bp, Homo sapiens
tcgagctctggagccaaggatg

SEQ ID NO: 48641 - DNA, 19 bp, Homo sapiens
cgtggcctgcactcgcagc

SEQ ID NO: 48642 - DNA, 22 bp, Homo sapiens
ctctgtggtggagtgggtcacc

SEQ ID NO: 48643 - DNA, 22 bp, Homo sapiens
ctcgggcttgaggctgtttacc

SEQ ID NO: 48644 - DNA, 22 bp, Homo sapiens
tgggaggccgaggcaggtggat

SEQ ID NO: 48645 - DNA, 22 bp, Homo sapiens
gggaggttgaggctgcagtgag

SEQ ID NO: 48646 - DNA, 22 bp, Homo sapiens
tgggcaggggccctgcttccgt

SEQ ID NO: 48647 - DNA, 22 bp, Homo sapiens
gggtacagttcttccagtgtca

SEQ ID NO: 48648 - DNA, 22 bp, Homo sapiens
atgggttcaagtgattctcctg

SEQ ID NO: 48649 - DNA, 20 bp, Homo sapiens
caaatccctgctctgtgctg

SEQ ID NO: 48650 - DNA, 22 bp, Homo sapiens
gggatgcagactacagggctta

SEQ ID NO: 48651 - DNA, 22 bp, Homo sapiens
aggggttggacataagacagaa

SEQ ID NO: 48652 - DNA, 22 bp, Homo sapiens
acttcttcttcagctgggggat

SEQ ID NO: 48653 - DNA, 22 bp, Homo sapiens
tcactgcaacctccacctcctg

SEQ ID NO: 48654 - DNA, 22 bp, Homo sapiens
agcgaggtgagtcctccagctc

SEQ ID NO: 48655 - DNA, 22 bp, Homo sapiens
tcactgcaacctccacctcccg

SEQ ID NO: 48656 - DNA, 22 bp, Homo sapiens
atccccctcttggatggcggca

SEQ ID NO: 48657 - DNA, 22 bp, Homo sapiens
agctcttacatttaggtctatg

SEQ ID NO: 48658 - DNA, 22 bp, Homo sapiens
gattgtggaagtcagtggttct

SEQ ID NO: 48659 - DNA, 22 bp, Homo sapiens
ctcctgggaaaggctggacaca

SEQ ID NO: 48660 - DNA, 22 bp, Homo sapiens
tgtcttcgctacaatgaaaagg

SEQ ID NO: 48661 - DNA, 22 bp, Homo sapiens
tgtggacgtcattaaagcagtg

SEQ ID NO: 48662 - DNA, 22 bp, Homo sapiens
taagtcgtggatgattcttcgg

SEQ ID NO: 48663 - DNA, 22 bp, Homo sapiens
gtgttgatgacattttagaaac

SEQ ID NO: 48664 - DNA, 22 bp, Homo sapiens
ggaggctgagaggtcgcagtgg

SEQ ID NO: 48665 - DNA, 21 bp, Homo sapiens
tctgatggtagatgagatgtg

SEQ ID NO: 48666 - DNA, 22 bp, Homo sapiens
taacatttaaatttttcacata

SEQ ID NO: 48667 - DNA, 22 bp, Homo sapiens
gtgcgcaccctcccggcatccc

SEQ ID NO: 48668 - DNA, 22 bp, Homo sapiens
agcataagttggtacagccact

SEQ ID NO: 48669 - DNA, 22 bp, Homo sapiens
gcccagctgcaccctggtgggt

SEQ ID NO: 48670 - DNA, 22 bp, Homo sapiens
tgtggctctcatgcactcccag

SEQ ID NO: 48671 - DNA, 22 bp, Homo sapiens
gaggagggagctggaagctctt

SEQ ID NO: 48672 - DNA, 20 bp, Homo sapiens
tgttgattggtgtcatctca

SEQ ID NO: 48673 - DNA, 22 bp, Homo sapiens
tgttgcccaggttctctcctgc

SEQ ID NO: 48674 - DNA, 22 bp, Homo sapiens
atgccccagtgtgtgcttcctt

SEQ ID NO: 48675 - DNA, 22 bp, Homo sapiens
ctgagccaaggggacagtgaca

SEQ ID NO: 48676 - DNA, 22 bp, Homo sapiens
ccaggaggtggagattgcagtg

SEQ ID NO: 48677 - DNA, 18 bp, Homo sapiens
ccgggctttggtgacaca

SEQ ID NO: 48678 - DNA, 22 bp, Homo sapiens
gggcggatcacctgaggtcagg

SEQ ID NO: 48679 - DNA, 22 bp, Homo sapiens
tcttttgtgattctttagttac

SEQ ID NO: 48680 - DNA, 22 bp, Homo sapiens
cactaggctggagtgcagtggc

SEQ ID NO: 48681 - DNA, 22 bp, Homo sapiens
cacccaggctggagtgcagtgg

SEQ ID NO: 48682 - DNA, 22 bp, Homo sapiens
catctgctgttccttggactca

SEQ ID NO: 48683 - DNA, 22 bp, Homo sapiens
aggctgagataggtggatcatt

SEQ ID NO: 48684 - DNA, 20 bp, Homo sapiens
gggcagtggcgctatctcag

SEQ ID NO: 48685 - DNA, 22 bp, Homo sapiens
aaggagaaatggtagatgtgca

SEQ ID NO: 48686 - DNA, 22 bp, Homo sapiens
cttagagatgggttttacttag

SEQ ID NO: 48687 - DNA, 22 bp, Homo sapiens
ctggcctaaaaatacagaacaa

SEQ ID NO: 48688 - DNA, 22 bp, Homo sapiens
cggaggttgaggctgcagtgag

SEQ ID NO: 48689 - DNA, 22 bp, Homo sapiens
tcagcctgctccaagtgctgcc

SEQ ID NO: 48690 - DNA, 22 bp, Homo sapiens
atgccactgacatggacaattt

SEQ ID NO: 48691 - DNA, 22 bp, Homo sapiens
caggtgcctcaggatgagacaa

SEQ ID NO: 48692 - DNA, 22 bp, Homo sapiens
ggcctgtaatcccagctactca

SEQ ID NO: 48693 - DNA, 22 bp, Homo sapiens
tgctgtgaggttgagaaggaag

SEQ ID NO: 48694 - DNA, 22 bp, Homo sapiens
tctgtcacccagagtgcagtgg

SEQ ID NO: 48695 - DNA, 22 bp, Homo sapiens
aaaaatcacttttataggcagc

SEQ ID NO: 48696 - DNA, 22 bp, Homo sapiens
ggccactgctctccagcctggg

SEQ ID NO: 48697 - DNA, 22 bp, Homo sapiens
tcggagctgtagatgaaaccct

SEQ ID NO: 48698 - DNA, 22 bp, Homo sapiens
ggctgggcaggtctgcacaggg

SEQ ID NO: 48699 - DNA, 22 bp, Homo sapiens
tacttttagcctatttgattct

SEQ ID NO: 48700 - DNA, 22 bp, Homo sapiens
tgagctgtagcagatgctgttg

SEQ ID NO: 48701 - DNA, 22 bp, Homo sapiens
ctctggagtgtctggccagggt

SEQ ID NO: 48702 - DNA, 22 bp, Homo sapiens
cattgcactccagccttggcaa

SEQ ID NO: 48703 - DNA, 22 bp, Homo sapiens
tcaaatgttccctgtactggcc

SEQ ID NO: 48704 - DNA, 22 bp, Homo sapiens
ggcaaaaaccataattactttt

SEQ ID NO: 48705 - DNA, 20 bp, Homo sapiens
atggggtgagtgacgccctc

SEQ ID NO: 48706 - DNA, 22 bp, Homo sapiens
tgggggtgtcctggtgcacaca

SEQ ID NO: 48707 - DNA, 17 bp, Homo sapiens
cttcccaccatctcctg

SEQ ID NO: 48708 - DNA, 22 bp, Homo sapiens
ctctgtagaaagagcccaggtg

SEQ ID NO: 48709 - DNA, 22 bp, Homo sapiens
ccagcagccaccttctcgaaat

SEQ ID NO: 48710 - DNA, 22 bp, Homo sapiens
cccaggaggtcaaggctgcagt

SEQ ID NO: 48711 - DNA, 22 bp, Homo sapiens
tgtaggacatgtacttgtaaca

SEQ ID NO: 48712 - DNA, 22 bp, Homo sapiens
ggcctcgcggcttctggtggct

SEQ ID NO: 48713 - DNA, 22 bp, Homo sapiens
gggtaaatctcttttcatggct

SEQ ID NO: 48714 - DNA, 22 bp, Homo sapiens
tcctgagataaatctcatgtga

SEQ ID NO: 48715 - DNA, 22 bp, Homo sapiens
ttatttttaaaagttcacacag

SEQ ID NO: 48716 - DNA, 22 bp, Homo sapiens
taatgcacatagaagtacttag

SEQ ID NO: 48717 - DNA, 22 bp, Homo sapiens
cacccaggctggagtgcagtga

SEQ ID NO: 48718 - DNA, 22 bp, Homo sapiens
gctcccaccttaaccttcacat

SEQ ID NO: 48719 - DNA, 22 bp, Homo sapiens
ctccaggccatggctgcggagg

SEQ ID NO: 48720 - DNA, 22 bp, Homo sapiens
tcactgcaacctctgcctgcca

SEQ ID NO: 48721 - DNA, 23 bp, Homo sapiens
ggggcctgcaccggtctgcgcgg

SEQ ID NO: 48722 - DNA, 22 bp, Homo sapiens
tttctcctcatgactggttgtg

SEQ ID NO: 48723 - DNA, 22 bp, Homo sapiens
tgctcattggcgatctgaggga

SEQ ID NO: 48724 - DNA, 22 bp, Homo sapiens
gagaggtggaggttgcagtgag

SEQ ID NO: 48725 - DNA, 22 bp, Homo sapiens
ttctagtgtccttggacttgct

SEQ ID NO: 48726 - DNA, 22 bp, Homo sapiens
caaagtgctggaattacaggtg

SEQ ID NO: 48727 - DNA, 22 bp, Homo sapiens
ctggcaggagcattcacagagg

SEQ ID NO: 48728 - DNA, 22 bp, Homo sapiens
tggaggccagaggtactgggac

SEQ ID NO: 48729 - DNA, 22 bp, Homo sapiens
tgtggcttaagaatgcctttaa

SEQ ID NO: 48730 - DNA, 22 bp, Homo sapiens
gagaaagcttctttcccacagg

SEQ ID NO: 48731 - DNA, 22 bp, Homo sapiens
caaagtgctaggattacaggcc

SEQ ID NO: 48732 - DNA, 22 bp, Homo sapiens
cctggcaggtggcgccctcggc

SEQ ID NO: 48733 - DNA, 20 bp, Homo sapiens
tatttctgggcaaccattta

SEQ ID NO: 48734 - DNA, 22 bp, Homo sapiens
gtgctgacaggagcctggcggt

SEQ ID NO: 48735 - DNA, 22 bp, Homo sapiens
ggctgcaggttggttggcagct

SEQ ID NO: 48736 - DNA, 22 bp, Homo sapiens
tactgtgtgcccagccgagctg

SEQ ID NO: 48737 - DNA, 22 bp, Homo sapiens
tcaaatgctgtattgtagtaat

SEQ ID NO: 48738 - DNA, 22 bp, Homo sapiens
ccctcccagatgggcttgaggt

SEQ ID NO: 48739 - DNA, 22 bp, Homo sapiens
cattgcacaccagcctgggcaa

SEQ ID NO: 48740 - DNA, 22 bp, Homo sapiens
gcttggaagtaggattgggaga

SEQ ID NO: 48741 - DNA, 22 bp, Homo sapiens
gaatgcagatggctggtgtatg

SEQ ID NO: 48742 - DNA, 22 bp, Homo sapiens
tctgtagtaggttgtagttctt

SEQ ID NO: 48743 - DNA, 23 bp, Homo sapiens
ctggggctttcaaatctgggcag

SEQ ID NO: 48744 - DNA, 22 bp, Homo sapiens
tcctgccttgcctgggacatca

SEQ ID NO: 48745 - DNA, 22 bp, Homo sapiens
tgaggcaggaggttgagaactg

SEQ ID NO: 48746 - DNA, 23 bp, Homo sapiens
attttttgtctttgtaactagat

SEQ ID NO: 48747 - DNA, 17 bp, Homo sapiens
tggctctgtcctcagct

SEQ ID NO: 48748 - DNA, 22 bp, Homo sapiens
gagggaaaggttaatacatgat

SEQ ID NO: 48749 - DNA, 22 bp, Homo sapiens
tgagaattacaaatgagtcaca

SEQ ID NO: 48750 - DNA, 22 bp, Homo sapiens
taatatctacttcatagagttt

SEQ ID NO: 48751 - DNA, 22 bp, Homo sapiens
cattgcactctagtctgggtga

SEQ ID NO: 48752 - DNA, 18 bp, Homo sapiens
catgggtgacaggtggat

SEQ ID NO: 48753 - DNA, 20 bp, Homo sapiens
caagggtttgcattggcttt

SEQ ID NO: 48754 - DNA, 22 bp, Homo sapiens
ggtgctggacacgtggcactcc

SEQ ID NO: 48755 - DNA, 22 bp, Homo sapiens
cagggtttcaccatgttagcag

SEQ ID NO: 48756 - DNA, 22 bp, Homo sapiens
agtgcagtggttaggagccagg

SEQ ID NO: 48757 - DNA, 22 bp, Homo sapiens
cactgcactccagcctgggaga

SEQ ID NO: 48758 - DNA, 22 bp, Homo sapiens
actgtgtgtttgtctagcacag

SEQ ID NO: 48759 - DNA, 22 bp, Homo sapiens
tctgagccagggtctcctccct

SEQ ID NO: 48760 - DNA, 22 bp, Homo sapiens
tcactgcaagctcagcctcccg

SEQ ID NO: 48761 - DNA, 22 bp, Homo sapiens
aaggcaggatgggaaaagattt

SEQ ID NO: 48762 - DNA, 22 bp, Homo sapiens
attgtggtgtcagttataggca

SEQ ID NO: 48763 - DNA, 22 bp, Homo sapiens
aaggctgagacagcacaggtcc

SEQ ID NO: 48764 - DNA, 22 bp, Homo sapiens
ttgtcccaggacttgcatagat

SEQ ID NO: 48765 - DNA, 22 bp, Homo sapiens
cctcgacctccccaggctcagg

SEQ ID NO: 48766 - DNA, 22 bp, Homo sapiens
tgagcctgggtggtcgaggctg

SEQ ID NO: 48767 - DNA, 22 bp, Homo sapiens
ggtggttcacgcctataatccc

SEQ ID NO: 48768 - DNA, 22 bp, Homo sapiens
gccggggctggggagagacatg

SEQ ID NO: 48769 - DNA, 22 bp, Homo sapiens
ccagaccctccattcaagctcc

SEQ ID NO: 48770 - DNA, 22 bp, Homo sapiens
caggcagaagaagtggaaggac

SEQ ID NO: 48771 - DNA, 22 bp, Homo sapiens
tcactgcagcctctgcctcccg

SEQ ID NO: 48772 - DNA, 22 bp, Homo sapiens
gccaccccataggtgttaggtg

SEQ ID NO: 48773 - DNA, 22 bp, Homo sapiens
ctgtaatcccagctactcggga

SEQ ID NO: 48774 - DNA, 22 bp, Homo sapiens
ccacctgagataagagagctca

SEQ ID NO: 48775 - DNA, 22 bp, Homo sapiens
tgcatattatgtgtatctgtct

SEQ ID NO: 48776 - DNA, 22 bp, Homo sapiens
cagccccatggtgtgctccagc

SEQ ID NO: 48777 - DNA, 22 bp, Homo sapiens
ggctgagttgagaggattactt

SEQ ID NO: 48778 - DNA, 22 bp, Homo sapiens
tctcgtgcaggccttgctcgga

SEQ ID NO: 48779 - DNA, 22 bp, Homo sapiens
cgctgctccgccttgtccatat

SEQ ID NO: 48780 - DNA, 22 bp, Homo sapiens
taaaggtagtgtgacatattgt

SEQ ID NO: 48781 - DNA, 18 bp, Homo sapiens
cccacggtgctgtagggc

SEQ ID NO: 48782 - DNA, 22 bp, Homo sapiens
gcaggctgtctaaagttagagt

SEQ ID NO: 48783 - DNA, 22 bp, Homo sapiens
ccaggaggcggaggttgcagcg

SEQ ID NO: 48784 - DNA, 22 bp, Homo sapiens
gcctgtgtggatgcgccggtgc

SEQ ID NO: 48785 - DNA, 22 bp, Homo sapiens
ctcaggacccggtccaggtggg

SEQ ID NO: 48786 - DNA, 22 bp, Homo sapiens
gcaggtggatcacctgaggtca

SEQ ID NO: 48787 - DNA, 22 bp, Homo sapiens
gtgcatgtgtctttatagtagc

SEQ ID NO: 48788 - DNA, 22 bp, Homo sapiens
tttaaaaaactagtctgagtct

SEQ ID NO: 48789 - DNA, 22 bp, Homo sapiens
agggaagaaaatccatcgctgc

SEQ ID NO: 48790 - DNA, 22 bp, Homo sapiens
acccacgaagatgagcggcatg

SEQ ID NO: 48791 - DNA, 22 bp, Homo sapiens
tagagctggccgggacagctgg

SEQ ID NO: 48792 - DNA, 22 bp, Homo sapiens
cccagggagagcgcggaggcgg

SEQ ID NO: 48793 - DNA, 22 bp, Homo sapiens
aaccaccattctctcctcttcc

SEQ ID NO: 48794 - DNA, 22 bp, Homo sapiens
tgggctgcaggggttgagagct

SEQ ID NO: 48795 - DNA, 22 bp, Homo sapiens
tcactgcaacctctgcctcccg

SEQ ID NO: 48796 - DNA, 22 bp, Homo sapiens
agccagggacgctgcaggctac

SEQ ID NO: 48797 - DNA, 23 bp, Homo sapiens
aggatgtaggatgtatggcagag

SEQ ID NO: 48798 - DNA, 22 bp, Homo sapiens
tcacttagatggggatcatcac

SEQ ID NO: 48799 - DNA, 22 bp, Homo sapiens
gctcagaggcacgacctcttgg

SEQ ID NO: 48800 - DNA, 22 bp, Homo sapiens
tctcgctctgtcgcccaggctg

SEQ ID NO: 48801 - DNA, 22 bp, Homo sapiens
agaaatgggccttgggacacaa

SEQ ID NO: 48802 - DNA, 22 bp, Homo sapiens
gctgtctcatacaaggccctgc

SEQ ID NO: 48803 - DNA, 22 bp, Homo sapiens
ggagtgactcacagctgggaca

SEQ ID NO: 48804 - DNA, 22 bp, Homo sapiens
ggagtgactctcggggccacta

SEQ ID NO: 48805 - DNA, 22 bp, Homo sapiens
ccaggctggagtgcaatggcgt

SEQ ID NO: 48806 - DNA, 22 bp, Homo sapiens
aggactgggtgcagagggcatc

SEQ ID NO: 48807 - DNA, 22 bp, Homo sapiens
ggcaaaaagttcccatcagtgt

SEQ ID NO: 48808 - DNA, 22 bp, Homo sapiens
gcaccacatcaatgaggggagc

SEQ ID NO: 48809 - DNA, 22 bp, Homo sapiens
ggagagcagggaggctgctctg

SEQ ID NO: 48810 - DNA, 19 bp, Homo sapiens
ctgtccttggctgcactgt

SEQ ID NO: 48811 - DNA, 21 bp, Homo sapiens
cagagctgtccaaaccctgac

SEQ ID NO: 48812 - DNA, 20 bp, Homo sapiens
ctgggtggcaagcaaggggg

SEQ ID NO: 48813 - DNA, 22 bp, Homo sapiens
agccaagcactcaactcctgga

SEQ ID NO: 48814 - DNA, 22 bp, Homo sapiens
tcactgcaacctccacctcctg

SEQ ID NO: 48815 - DNA, 22 bp, Homo sapiens
gtaagggatttgaacataggtt

SEQ ID NO: 48816 - DNA, 22 bp, Homo sapiens
ttttaatactgctattgtagga

SEQ ID NO: 48817 - DNA, 22 bp, Homo sapiens
ctggcctggcgcagtggctcac

SEQ ID NO: 48818 - DNA, 22 bp, Homo sapiens
cccaggaggcagagcttgcagt

SEQ ID NO: 48819 - DNA, 22 bp, Homo sapiens
gctcaagccttctgcccacctc

SEQ ID NO: 48820 - DNA, 22 bp, Homo sapiens
tcactgcactccagcctgggca

SEQ ID NO: 48821 - DNA, 22 bp, Homo sapiens
ttttctagggtgctaaatgaac

SEQ ID NO: 48822 - DNA, 22 bp, Homo sapiens
tgagcctgggagatggaggctg

SEQ ID NO: 48823 - DNA, 22 bp, Homo sapiens
caggctgaagtgcagtggtgtg

SEQ ID NO: 48824 - DNA, 22 bp, Homo sapiens
ctgcagtatgagctacccaggt

SEQ ID NO: 48825 - DNA, 22 bp, Homo sapiens
ttgggctgaaccctgcagctga

SEQ ID NO: 48826 - DNA, 22 bp, Homo sapiens
cactgcactccagcccgggcaa

SEQ ID NO: 48827 - DNA, 22 bp, Homo sapiens
ggagagtgggagcaactgttgc

SEQ ID NO: 48828 - DNA, 22 bp, Homo sapiens
ttctctgcctcacaggtctaag

SEQ ID NO: 48829 - DNA, 22 bp, Homo sapiens
gtgatctgccagcctcagcctc

SEQ ID NO: 48830 - DNA, 22 bp, Homo sapiens
tggcactgagcagccgcggcag

SEQ ID NO: 48831 - DNA, 22 bp, Homo sapiens
ggggtactggctggagccccac

SEQ ID NO: 48832 - DNA, 22 bp, Homo sapiens
tgccaggcgtggtggtgcgcac

SEQ ID NO: 48833 - DNA, 22 bp, Homo sapiens
tgtccttcttgtcttgcccaaa

SEQ ID NO: 48834 - DNA, 22 bp, Homo sapiens
tgacttcctgcactcaggtgat

SEQ ID NO: 48835 - DNA, 22 bp, Homo sapiens
cgcaccactgaattccagcctg

SEQ ID NO: 48836 - DNA, 22 bp, Homo sapiens
ggagaccagaaggaagcttcga

SEQ ID NO: 48837 - DNA, 22 bp, Homo sapiens
cacctgtacagggccgggctgg

SEQ ID NO: 48838 - DNA, 22 bp, Homo sapiens
aggcctgaggaccagataaatg

SEQ ID NO: 48839 - DNA, 22 bp, Homo sapiens
ccggctactcgggaggctgacg

SEQ ID NO: 48840 - DNA, 22 bp, Homo sapiens
cattgcactccagcctgggtga

SEQ ID NO: 48841 - DNA, 22 bp, Homo sapiens
tgttctctaagccacccatttt

SEQ ID NO: 48842 - DNA, 22 bp, Homo sapiens
ggggaccctcaggactgcgtct

SEQ ID NO: 48843 - DNA, 19 bp, Homo sapiens
acacagggatcagagggtt

SEQ ID NO: 48844 - DNA, 22 bp, Homo sapiens
ccaggctgctgttggtgtccgc

SEQ ID NO: 48845 - DNA, 22 bp, Homo sapiens
tccacaaggcagctcctccagg

SEQ ID NO: 48846 - DNA, 23 bp, Homo sapiens
ctcctcgtaactctgtggtgggt

SEQ ID NO: 48847 - DNA, 22 bp, Homo sapiens
gctcactgcaacctccgccttc

SEQ ID NO: 48848 - DNA, 22 bp, Homo sapiens
caggaaagggatgggctgccac

SEQ ID NO: 48849 - DNA, 22 bp, Homo sapiens
tcaccgaggctggagtgcagtg

SEQ ID NO: 48850 - DNA, 22 bp, Homo sapiens
tggtggggccagacttcagctc

SEQ ID NO: 48851 - DNA, 22 bp, Homo sapiens
gcagggtctgaggccacagagg

SEQ ID NO: 48852 - DNA, 22 bp, Homo sapiens
acacagggctgcgcctgacccc

SEQ ID NO: 48853 - DNA, 22 bp, Homo sapiens
cccaggaggcggaggttgcagt

SEQ ID NO: 48854 - DNA, 18 bp, Homo sapiens
ggtgagggagctggaagc

SEQ ID NO: 48855 - DNA, 22 bp, Homo sapiens
aaaggtcaaaatcgtgacattg

SEQ ID NO: 48856 - DNA, 22 bp, Homo sapiens
ttgggtgctgtcatggggcacg

SEQ ID NO: 48857 - DNA, 22 bp, Homo sapiens
gcctggccgggtcttggatttt

SEQ ID NO: 48858 - DNA, 22 bp, Homo sapiens
caggctggagtgcagtggtgcc

SEQ ID NO: 48859 - DNA, 22 bp, Homo sapiens
tcactgcaacctctgcctcttg

SEQ ID NO: 48860 - DNA, 19 bp, Homo sapiens
cataatacagtggatctga

SEQ ID NO: 48861 - DNA, 22 bp, Homo sapiens
accaggggatggttggcactgt

SEQ ID NO: 48862 - DNA, 18 bp, Homo sapiens
tgtccctgcaaataacat

SEQ ID NO: 48863 - DNA, 22 bp, Homo sapiens
atgatggttgtcctaggtgcat

SEQ ID NO: 48864 - DNA, 22 bp, Homo sapiens
cccaggaggttgaggctgcagt

SEQ ID NO: 48865 - DNA, 22 bp, Homo sapiens
gttgagtgggttaggatgctga

SEQ ID NO: 48866 - DNA, 22 bp, Homo sapiens
caaagtgctgggattacaggtg

SEQ ID NO: 48867 - DNA, 22 bp, Homo sapiens
ccaaagtgctgagattacaggt

SEQ ID NO: 48868 - DNA, 22 bp, Homo sapiens
tccttgaaaggggctgcagggc

SEQ ID NO: 48869 - DNA, 22 bp, Homo sapiens
ccaggagctggagggtgcagtg

SEQ ID NO: 48870 - DNA, 22 bp, Homo sapiens
acagaactgggaaatgcacata

SEQ ID NO: 48871 - DNA, 22 bp, Homo sapiens
agaggcagtatacaatccgagc

SEQ ID NO: 48872 - DNA, 19 bp, Homo sapiens
ttctctgctacattctcag

SEQ ID NO: 48873 - DNA, 22 bp, Homo sapiens
cacccaggctggagagcagtgg

SEQ ID NO: 48874 - DNA, 22 bp, Homo sapiens
acagagcaataacagggagagg

SEQ ID NO: 48875 - DNA, 22 bp, Homo sapiens
ggcagagcttgcagtgagccga

SEQ ID NO: 48876 - DNA, 22 bp, Homo sapiens
gcagactgtatcaatgtcagta

SEQ ID NO: 48877 - DNA, 22 bp, Homo sapiens
cacccaggttggagtgcagtgg

SEQ ID NO: 48878 - DNA, 22 bp, Homo sapiens
gaggcaggaggattgcttgagc

SEQ ID NO: 48879 - DNA, 22 bp, Homo sapiens
ggggatggaggcgtgtggtcct

SEQ ID NO: 48880 - DNA, 22 bp, Homo sapiens
gggggcttggcccggtctggtt

SEQ ID NO: 48881 - DNA, 22 bp, Homo sapiens
ccgggcgggggctctcgtcacc

SEQ ID NO: 48882 - DNA, 22 bp, Homo sapiens
gtttgtcttaattaggcatcga

SEQ ID NO: 48883 - DNA, 22 bp, Homo sapiens
ttctccacccactcttttgttg

SEQ ID NO: 48884 - DNA, 22 bp, Homo sapiens
gcagctggaagtgacactctgt

SEQ ID NO: 48885 - DNA, 22 bp, Homo sapiens
tggatgctgtaggacacgctct

SEQ ID NO: 48886 - DNA, 22 bp, Homo sapiens
gatggcctcatggctgcaggcc

SEQ ID NO: 48887 - DNA, 22 bp, Homo sapiens
gaatgtgtactgagtgcccctt

SEQ ID NO: 48888 - DNA, 22 bp, Homo sapiens
aaatgcaacgggctttccttat

SEQ ID NO: 48889 - DNA, 22 bp, Homo sapiens
ctgggaggcggaggttgcagtg

SEQ ID NO: 48890 - DNA, 22 bp, Homo sapiens
tgggggacaccagtctctctct

SEQ ID NO: 48891 - DNA, 22 bp, Homo sapiens
cattgctttgtgcatatttaaa

SEQ ID NO: 48892 - DNA, 20 bp, Homo sapiens
ccagagctgatggctgcccg

SEQ ID NO: 48893 - DNA, 22 bp, Homo sapiens
cattgcactccagcctgggtaa

SEQ ID NO: 48894 - DNA, 22 bp, Homo sapiens
cccaggccccagggcttgtcag

SEQ ID NO: 48895 - DNA, 22 bp, Homo sapiens
tcccccaggctggagtgcagtg

SEQ ID NO: 48896 - DNA, 22 bp, Homo sapiens
tttccctgtgaatatttaaaga

SEQ ID NO: 48897 - DNA, 22 bp, Homo sapiens
aagcgccatggttcctgcgcag

SEQ ID NO: 48898 - DNA, 22 bp, Homo sapiens
tgagcctgagttcaaggctgca

SEQ ID NO: 48899 - DNA, 22 bp, Homo sapiens
ggggcattgtgtctgggttcct

SEQ ID NO: 48900 - DNA, 21 bp, Homo sapiens
gctcctggtgctgcgtggcgc

SEQ ID NO: 48901 - DNA, 22 bp, Homo sapiens
ggtgcagaggagccagctgggg

SEQ ID NO: 48902 - DNA, 22 bp, Homo sapiens
ggcaggaggtgagtggcgggtg

SEQ ID NO: 48903 - DNA, 22 bp, Homo sapiens
ataaaaactgacccatcctttg

SEQ ID NO: 48904 - DNA, 22 bp, Homo sapiens
atctggctcccttggaatccgt

SEQ ID NO: 48905 - DNA, 22 bp, Homo sapiens
caggaggattgcttgaggccag

SEQ ID NO: 48906 - DNA, 22 bp, Homo sapiens
tttatgtagttacggactatca

SEQ ID NO: 48907 - DNA, 22 bp, Homo sapiens
gtgctccctccttcctcaagga

SEQ ID NO: 48908 - DNA, 23 bp, Homo sapiens
gtgcatgtgtctttacagtagca

SEQ ID NO: 48909 - DNA, 22 bp, Homo sapiens
tcgcaccattgcactccagcca

SEQ ID NO: 48910 - DNA, 22 bp, Homo sapiens
tccccaagcaggcaatctcccg

SEQ ID NO: 48911 - DNA, 22 bp, Homo sapiens
tacatttataaggcttctctgt

SEQ ID NO: 48912 - DNA, 22 bp, Homo sapiens
ggcctgcctcacagtcagcacc

SEQ ID NO: 48913 - DNA, 22 bp, Homo sapiens
cactgcacttcagcctgggtga

SEQ ID NO: 48914 - DNA, 22 bp, Homo sapiens
gcagggaggtttgctgacctgg

SEQ ID NO: 48915 - DNA, 22 bp, Homo sapiens
acaggggattgattggaagtct

SEQ ID NO: 48916 - DNA, 22 bp, Homo sapiens
cagtggaggccttgggaccttt

SEQ ID NO: 48917 - DNA, 22 bp, Homo sapiens
ggctcactgcaacttccgcctc

SEQ ID NO: 48918 - DNA, 22 bp, Homo sapiens
tcccacacagcccgctcaccgg

SEQ ID NO: 48919 - DNA, 22 bp, Homo sapiens
gcccatgcactttctgtgatgg

SEQ ID NO: 48920 - DNA, 22 bp, Homo sapiens
gatggcacacagacatccccgc

SEQ ID NO: 48921 - DNA, 22 bp, Homo sapiens
ggcagcactgcagcttgttggg

SEQ ID NO: 48922 - DNA, 22 bp, Homo sapiens
tttgcattgcattaagtattct

SEQ ID NO: 48923 - DNA, 21 bp, Homo sapiens
tctcttcctccgcgccgccgc

SEQ ID NO: 48924 - DNA, 22 bp, Homo sapiens
cgaggcctcctcgccgccaccg

SEQ ID NO: 48925 - DNA, 22 bp, Homo sapiens
gaggcaggcagattgcttgagg

SEQ ID NO: 48926 - DNA, 22 bp, Homo sapiens
gcaggcaggcttccttgaactg

SEQ ID NO: 48927 - DNA, 22 bp, Homo sapiens
gaaggaagtcattagtgcagac

SEQ ID NO: 48928 - DNA, 22 bp, Homo sapiens
catttacatttaaggttaatat

SEQ ID NO: 48929 - DNA, 22 bp, Homo sapiens
cattgcactccagctctgggcg

SEQ ID NO: 48930 - DNA, 22 bp, Homo sapiens
gcagctgacatctggctgggcc

SEQ ID NO: 48931 - DNA, 23 bp, Homo sapiens
agcagccagagatcctcggccct

SEQ ID NO: 48932 - DNA, 22 bp, Homo sapiens
cctgagagcattccacactgaa

SEQ ID NO: 48933 - DNA, 22 bp, Homo sapiens
ggacagccgagtggccttctcc

SEQ ID NO: 48934 - DNA, 22 bp, Homo sapiens
tgtaggagtccaatcaggagac

SEQ ID NO: 48935 - DNA, 22 bp, Homo sapiens
ggactgggaatcagggagatgc

SEQ ID NO: 48936 - DNA, 22 bp, Homo sapiens
cttgtagaattgaaatggtctc

SEQ ID NO: 48937 - DNA, 22 bp, Homo sapiens
agctgattccactttttcccca

SEQ ID NO: 48938 - DNA, 22 bp, Homo sapiens
tgtctggtgggttgacaggcag

SEQ ID NO: 48939 - DNA, 22 bp, Homo sapiens
ccagcctggttcagaattggct

SEQ ID NO: 48940 - DNA, 22 bp, Homo sapiens
ggtgggagagctctgtctccag

SEQ ID NO: 48941 - DNA, 22 bp, Homo sapiens
tggcttccccggagtgacatgt

SEQ ID NO: 48942 - DNA, 22 bp, Homo sapiens
gctgctctcagagctcatgctg

SEQ ID NO: 48943 - DNA, 22 bp, Homo sapiens
aagttactggcaagggctgcag

SEQ ID NO: 48944 - DNA, 22 bp, Homo sapiens
ctgtccccacccaaatctcatc

SEQ ID NO: 48945 - DNA, 22 bp, Homo sapiens
gggctgggattgcttgctgtga

SEQ ID NO: 48946 - DNA, 22 bp, Homo sapiens
tgcaccctcatcagtcaaatgg

SEQ ID NO: 48947 - DNA, 22 bp, Homo sapiens
agcctggcctgggcaggcacat

SEQ ID NO: 48948 - DNA, 22 bp, Homo sapiens
agggctggagccacagctggga

SEQ ID NO: 48949 - DNA, 22 bp, Homo sapiens
aagtcacactagacaactgagg

SEQ ID NO: 48950 - DNA, 22 bp, Homo sapiens
taattataacagttacatctta

SEQ ID NO: 48951 - DNA, 22 bp, Homo sapiens
tcctgggtccatggcagccgaa

SEQ ID NO: 48952 - DNA, 22 bp, Homo sapiens
tcagcctggcaggatggcctgg

SEQ ID NO: 48953 - DNA, 22 bp, Homo sapiens
cctagagctctgctttatctaa

SEQ ID NO: 48954 - DNA, 22 bp, Homo sapiens
catttctgggagacatgctaga

SEQ ID NO: 48955 - DNA, 22 bp, Homo sapiens
atgaaatatcttgaagaaattc

SEQ ID NO: 48956 - DNA, 22 bp, Homo sapiens
cactgggcgtgtcctgggtgag

SEQ ID NO: 48957 - DNA, 22 bp, Homo sapiens
agagggcattaactctgtcttg

SEQ ID NO: 48958 - DNA, 22 bp, Homo sapiens
gctgtagtgaatggccgcgttc

SEQ ID NO: 48959 - DNA, 22 bp, Homo sapiens
catgcacttacctgaaattcaa

SEQ ID NO: 48960 - DNA, 22 bp, Homo sapiens
tatccaattcaccattgatggg

SEQ ID NO: 48961 - DNA, 22 bp, Homo sapiens
accactgcccatggtgaaaact

SEQ ID NO: 48962 - DNA, 22 bp, Homo sapiens
agggccagcactcctggcagga

SEQ ID NO: 48963 - DNA, 22 bp, Homo sapiens
catataaatacaacatgtgtta

SEQ ID NO: 48964 - DNA, 22 bp, Homo sapiens
cattgcactccagtctgggcca

SEQ ID NO: 48965 - DNA, 22 bp, Homo sapiens
cccaccagtacagatggtagat

SEQ ID NO: 48966 - DNA, 22 bp, Homo sapiens
ctgaggtgtgaaatggtggcaa

SEQ ID NO: 48967 - DNA, 22 bp, Homo sapiens
gagcctggagctggaacgaagc

SEQ ID NO: 48968 - DNA, 22 bp, Homo sapiens
tggctaacaaggtgaaaccccg

SEQ ID NO: 48969 - DNA, 22 bp, Homo sapiens
gccatcatatcccctgtgacct

SEQ ID NO: 48970 - DNA, 22 bp, Homo sapiens
ccaggctggagtgcagtggcac

SEQ ID NO: 48971 - DNA, 22 bp, Homo sapiens
gcagcctgggcaacagagtgag

SEQ ID NO: 48972 - DNA, 22 bp, Homo sapiens
tgtgtcccttggaacctcagct

SEQ ID NO: 48973 - DNA, 22 bp, Homo sapiens
agggctctgagtgggaaagagg

SEQ ID NO: 48974 - DNA, 22 bp, Homo sapiens
tgcaatctcggcactttgggag

SEQ ID NO: 48975 - DNA, 22 bp, Homo sapiens
accctccccaagaggtcgtgcc

SEQ ID NO: 48976 - DNA, 22 bp, Homo sapiens
aggtggggaggagtgtctcttt

SEQ ID NO: 48977 - DNA, 22 bp, Homo sapiens
aggctcagatccttgtgtcctg

SEQ ID NO: 48978 - DNA, 22 bp, Homo sapiens
tcactgcacttcagcttgggca

SEQ ID NO: 48979 - DNA, 22 bp, Homo sapiens
gtgcgggcctgggggtttctct

SEQ ID NO: 48980 - DNA, 22 bp, Homo sapiens
ccaggcaggcgatggtgcagtg

SEQ ID NO: 48981 - DNA, 22 bp, Homo sapiens
agatgtgtttctagttcctgca

SEQ ID NO: 48982 - DNA, 22 bp, Homo sapiens
gcttagtcaattataaataggc

SEQ ID NO: 48983 - DNA, 22 bp, Homo sapiens
cagcagtgtacaaggtgtcaga

SEQ ID NO: 48984 - DNA, 22 bp, Homo sapiens
atgccacttcattccagcctcg

SEQ ID NO: 48985 - DNA, 22 bp, Homo sapiens
gaattcttttctttctgaaagt

SEQ ID NO: 48986 - DNA, 22 bp, Homo sapiens
ttaataaagtatgaattggaaa

SEQ ID NO: 48987 - DNA, 19 bp, Homo sapiens
tggctctgtcgaaggcaca

SEQ ID NO: 48988 - DNA, 22 bp, Homo sapiens
ggcctgggctccgggagttact

SEQ ID NO: 48989 - DNA, 22 bp, Homo sapiens
ggctcacgcaattatcccggcc

SEQ ID NO: 48990 - DNA, 22 bp, Homo sapiens
tccaagatctacagcagtttag

SEQ ID NO: 48991 - DNA, 22 bp, Homo sapiens
tgaacgcaggtccacatggctc

SEQ ID NO: 48992 - DNA, 22 bp, Homo sapiens
aaggccctggcaggaagcagga

SEQ ID NO: 48993 - DNA, 22 bp, Homo sapiens
gcagtggcatgatgtgggctca

SEQ ID NO: 48994 - DNA, 22 bp, Homo sapiens
caggcagggagctggaaaggat

SEQ ID NO: 48995 - DNA, 22 bp, Homo sapiens
gagagtgagatcctcctgggga

SEQ ID NO: 48996 - DNA, 22 bp, Homo sapiens
tttcagatggaggtttaggaca

SEQ ID NO: 48997 - DNA, 22 bp, Homo sapiens
ggctgggcctctccctcagctg

SEQ ID NO: 48998 - DNA, 22 bp, Homo sapiens
gccctcctggcaggcagtgatg

SEQ ID NO: 48999 - DNA, 22 bp, Homo sapiens
cccaggaggcagaagttgcagt

SEQ ID NO: 49000 - DNA, 22 bp, Homo sapiens
cactgcactccagcctgggtca

SEQ ID NO: 49001 - DNA, 22 bp, Homo sapiens
agcaggagtttgatgcttttat

SEQ ID NO: 49002 - DNA, 22 bp, Homo sapiens
caggctgatcagggctgggatg

SEQ ID NO: 49003 - DNA, 22 bp, Homo sapiens
atttttctctttccactgagat

SEQ ID NO: 49004 - DNA, 22 bp, Homo sapiens
tcactgtatcatgttgcactta

SEQ ID NO: 49005 - DNA, 22 bp, Homo sapiens
ttgagggtctggatctgctgct

SEQ ID NO: 49006 - DNA, 22 bp, Homo sapiens
gctgcagctcgccttccggcct

SEQ ID NO: 49007 - DNA, 22 bp, Homo sapiens
ccaggctggagtgcaatggcat

SEQ ID NO: 49008 - DNA, 22 bp, Homo sapiens
gctcactgcaacctctgcctcc

SEQ ID NO: 49009 - DNA, 22 bp, Homo sapiens
ctgaaggatgtgtggtgggagt

SEQ ID NO: 49010 - DNA, 22 bp, Homo sapiens
tcctttgcttctgtcattctcc

SEQ ID NO: 49011 - DNA, 22 bp, Homo sapiens
ctgctctgctgatcagtgtctc

SEQ ID NO: 49012 - DNA, 22 bp, Homo sapiens
cctgcctatgagacgttttgcc

SEQ ID NO: 49013 - DNA, 22 bp, Homo sapiens
aagcacaatgaacatcttagat

SEQ ID NO: 49014 - DNA, 22 bp, Homo sapiens
gtggagacctcctaggatgtgt

SEQ ID NO: 49015 - DNA, 22 bp, Homo sapiens
tagatctgatacaattcatctg

SEQ ID NO: 49016 - DNA, 22 bp, Homo sapiens
tgtgaaagatactaggcagagg

SEQ ID NO: 49017 - DNA, 22 bp, Homo sapiens
tcactgcaagctcctcctcctg

SEQ ID NO: 49018 - DNA, 22 bp, Homo sapiens
agacaaagaaaccgtagaagca

SEQ ID NO: 49019 - DNA, 22 bp, Homo sapiens
ccctgctgtcaggtgctgggag

SEQ ID NO: 49020 - DNA, 20 bp, Homo sapiens
cagcagtggatgagagtttt

SEQ ID NO: 49021 - DNA, 22 bp, Homo sapiens
agatgctgctccacaggccagg

SEQ ID NO: 49022 - DNA, 22 bp, Homo sapiens
gcccaggctggagtgcagtggt

SEQ ID NO: 49023 - DNA, 21 bp, Homo sapiens
gcagcagtgttctagaatact

SEQ ID NO: 49024 - DNA, 23 bp, Homo sapiens
gacagagtgagaccttgtcttac

SEQ ID NO: 49025 - DNA, 22 bp, Homo sapiens
gaggcagaagttgcagtgagca

SEQ ID NO: 49026 - DNA, 22 bp, Homo sapiens
tgctgctccccagcacacagca

SEQ ID NO: 49027 - DNA, 22 bp, Homo sapiens
ccgggcctcgggacaccgggta

SEQ ID NO: 49028 - DNA, 22 bp, Homo sapiens
gcccaggctggagtgcagtggc

SEQ ID NO: 49029 - DNA, 22 bp, Homo sapiens
gctcactgcaacctccacctcc

SEQ ID NO: 49030 - DNA, 20 bp, Homo sapiens
aaaatatgtataactcttct

SEQ ID NO: 49031 - DNA, 22 bp, Homo sapiens
tcactgcaacctccgcctgctg

SEQ ID NO: 49032 - DNA, 22 bp, Homo sapiens
tcccagagctctggaggttgga

SEQ ID NO: 49033 - DNA, 22 bp, Homo sapiens
tctggctccaggaccgggcaca

SEQ ID NO: 49034 - DNA, 22 bp, Homo sapiens
tggctcctcacgtcctcagagc

SEQ ID NO: 49035 - DNA, 22 bp, Homo sapiens
gagcccaggcagaggttgcagt

SEQ ID NO: 49036 - DNA, 22 bp, Homo sapiens
ggccagaagttggaaaagagcc

SEQ ID NO: 49037 - DNA, 22 bp, Homo sapiens
tttcctcttctggcaggcaggg

SEQ ID NO: 49038 - DNA, 22 bp, Homo sapiens
tgaggcaggagttcaggctgcg

SEQ ID NO: 49039 - DNA, 22 bp, Homo sapiens
tctttcttgtgggtgccctttt

SEQ ID NO: 49040 - DNA, 22 bp, Homo sapiens
gccaggctgaggctctggaaga

SEQ ID NO: 49041 - DNA, 22 bp, Homo sapiens
gttcaagaccagcctggccaac

SEQ ID NO: 49042 - DNA, 22 bp, Homo sapiens
ttgggctcaggagtttgagacc

SEQ ID NO: 49043 - DNA, 22 bp, Homo sapiens
tccgccaggactgagggcccat

SEQ ID NO: 49044 - DNA, 22 bp, Homo sapiens
ttttctaacatctagtaatttg

SEQ ID NO: 49045 - DNA, 22 bp, Homo sapiens
ggaggtggaggttgcagtgagc

SEQ ID NO: 49046 - DNA, 23 bp, Homo sapiens
tcatgcccaggctccagatgtca

SEQ ID NO: 49047 - DNA, 22 bp, Homo sapiens
ctgaggctggagtgcagtggtg

SEQ ID NO: 49048 - DNA, 18 bp, Homo sapiens
cagggctgtggggtcact

SEQ ID NO: 49049 - DNA, 22 bp, Homo sapiens
cattgcactccagcctgggcca

SEQ ID NO: 49050 - DNA, 22 bp, Homo sapiens
cagtgcagccaaggacaggcac

SEQ ID NO: 49051 - DNA, 22 bp, Homo sapiens
tcaggcagtagaattgcttgaa

SEQ ID NO: 49052 - DNA, 22 bp, Homo sapiens
tgcctgttgcccacctgataaa

SEQ ID NO: 49053 - DNA, 22 bp, Homo sapiens
gctcactgcaagctctgcctcc

SEQ ID NO: 49054 - DNA, 22 bp, Homo sapiens
tgttcttgagcctttagaccta

SEQ ID NO: 49055 - DNA, 22 bp, Homo sapiens
cccagcaggtcggtgctgcctg

SEQ ID NO: 49056 - DNA, 22 bp, Homo sapiens
ggcctcacccatcggtgccttt

SEQ ID NO: 49057 - DNA, 22 bp, Homo sapiens
tgcgttgcgctcctgcagcagg

SEQ ID NO: 49058 - DNA, 22 bp, Homo sapiens
ctgggaggtggaggttgcattg

SEQ ID NO: 49059 - DNA, 22 bp, Homo sapiens
gaggtgggtgtatcacaggtca

SEQ ID NO: 49060 - DNA, 22 bp, Homo sapiens
tcctccccaaagcccagcctgg

SEQ ID NO: 49061 - DNA, 22 bp, Homo sapiens
gcaggcagaggtggaggagaca

SEQ ID NO: 49062 - DNA, 20 bp, Homo sapiens
tcacatcctctcccaacatg

SEQ ID NO: 49063 - DNA, 21 bp, Homo sapiens
aaactgaccttgcctgagaca

SEQ ID NO: 49064 - DNA, 22 bp, Homo sapiens
cccaggaggtggagcttgcagt

SEQ ID NO: 49065 - DNA, 22 bp, Homo sapiens
gaggggctgccctggtgtcagg

SEQ ID NO: 49066 - DNA, 22 bp, Homo sapiens
caggagctcagatgacatctca

SEQ ID NO: 49067 - DNA, 22 bp, Homo sapiens
tgtatattctgcctaaaagctt

SEQ ID NO: 49068 - DNA, 22 bp, Homo sapiens
tcactgcaagctccacctcccg

SEQ ID NO: 49069 - DNA, 22 bp, Homo sapiens
ccaggctggagtatagtggcgc

SEQ ID NO: 49070 - DNA, 22 bp, Homo sapiens
gctggggaggcagcagagaaca

SEQ ID NO: 49071 - DNA, 22 bp, Homo sapiens
ggaagggcaaaagagatgaact

SEQ ID NO: 49072 - DNA, 22 bp, Homo sapiens
aggtaaagacagtgaaagaggg

SEQ ID NO: 49073 - DNA, 22 bp, Homo sapiens
cctggaagttggaggttgcagt

SEQ ID NO: 49074 - DNA, 20 bp, Homo sapiens
ataaaataactgccacaaga

SEQ ID NO: 49075 - DNA, 22 bp, Homo sapiens
cagggcctcctaaggcatctaa

SEQ ID NO: 49076 - DNA, 22 bp, Homo sapiens
agccaggatggtctcgatcggc

SEQ ID NO: 49077 - DNA, 22 bp, Homo sapiens
tcactgcaagctctgccttccg

SEQ ID NO: 49078 - DNA, 21 bp, Homo sapiens
gggcagaggggcctcctgggt

SEQ ID NO: 49079 - DNA, 22 bp, Homo sapiens
gagtgttccagaaactggccct

SEQ ID NO: 49080 - DNA, 22 bp, Homo sapiens
cactctgcagctgaagggctgg

SEQ ID NO: 49081 - DNA, 22 bp, Homo sapiens
gaagagctgacagtgtcatcct

SEQ ID NO: 49082 - DNA, 22 bp, Homo sapiens
cagcagcccacgcgtgctgtcc

SEQ ID NO: 49083 - DNA, 22 bp, Homo sapiens
tagccgggtgttgtgtcatgca

SEQ ID NO: 49084 - DNA, 22 bp, Homo sapiens
gtcagaggggcagctgccaggc

SEQ ID NO: 49085 - DNA, 22 bp, Homo sapiens
tcagtttttctatactttgtag

SEQ ID NO: 49086 - DNA, 22 bp, Homo sapiens
gaaagagaacctgggcctagat

SEQ ID NO: 49087 - DNA, 22 bp, Homo sapiens
gccccagcctcccgagtagctg

SEQ ID NO: 49088 - DNA, 22 bp, Homo sapiens
attttttgttaactcaggatag

SEQ ID NO: 49089 - DNA, 22 bp, Homo sapiens
ctgggaggcggagcttgcagtg

SEQ ID NO: 49090 - DNA, 22 bp, Homo sapiens
aggagcagaccgtagtcctgca

SEQ ID NO: 49091 - DNA, 22 bp, Homo sapiens
atgccactgcgctccagcctgg

SEQ ID NO: 49092 - DNA, 22 bp, Homo sapiens
gtcttgatctcctgaccttgtg

SEQ ID NO: 49093 - DNA, 20 bp, Homo sapiens
aggaaaaatggaaactggag

SEQ ID NO: 49094 - DNA, 22 bp, Homo sapiens
ccaggaggcggaggttgcagtg

SEQ ID NO: 49095 - DNA, 22 bp, Homo sapiens
catccaggctgaagtgcagtgg

SEQ ID NO: 49096 - DNA, 22 bp, Homo sapiens
cacgcctggacggcggagggtg

SEQ ID NO: 49097 - DNA, 22 bp, Homo sapiens
agagggatcaccctgtttctgg

SEQ ID NO: 49098 - DNA, 22 bp, Homo sapiens
gtagtcccagctaccccggagg

SEQ ID NO: 49099 - DNA, 22 bp, Homo sapiens
gtggggtctgtcctcttctggg

SEQ ID NO: 49100 - DNA, 22 bp, Homo sapiens
acaaagtgaattgcatcgagtt

SEQ ID NO: 49101 - DNA, 22 bp, Homo sapiens
gaggtgggcggatcacaaggtc

SEQ ID NO: 49102 - DNA, 22 bp, Homo sapiens
ggcctggcagagcgcgcggctg

SEQ ID NO: 49103 - DNA, 22 bp, Homo sapiens
cacagggcttctcatggggtgc

SEQ ID NO: 49104 - DNA, 22 bp, Homo sapiens
ggtcagccttggatttggtagc

SEQ ID NO: 49105 - DNA, 22 bp, Homo sapiens
gaccctgtttctacaaataatt

SEQ ID NO: 49106 - DNA, 22 bp, Homo sapiens
ccagagctgattcctgggactt

SEQ ID NO: 49107 - DNA, 22 bp, Homo sapiens
tgggctgtggagcacctttgca

SEQ ID NO: 49108 - DNA, 22 bp, Homo sapiens
gataccagacagggagggagaa

SEQ ID NO: 49109 - DNA, 22 bp, Homo sapiens
agcccaggagtttgaggctgtg

SEQ ID NO: 49110 - DNA, 22 bp, Homo sapiens
tttgttttcaatgtgtcattca

SEQ ID NO: 49111 - DNA, 22 bp, Homo sapiens
agaggctgcacttgctcatgat

SEQ ID NO: 49112 - DNA, 19 bp, Homo sapiens
ttcacattggaagaagtag

SEQ ID NO: 49113 - DNA, 22 bp, Homo sapiens
atagtatttaatagttagctca

SEQ ID NO: 49114 - DNA, 22 bp, Homo sapiens
cttgtgcatttcattcctcagg

SEQ ID NO: 49115 - DNA, 22 bp, Homo sapiens
cagggccagcgtctcgggctat

SEQ ID NO: 49116 - DNA, 22 bp, Homo sapiens
tggagccagagcgcagcctggg

SEQ ID NO: 49117 - DNA, 22 bp, Homo sapiens
atccccagaaagaccgatgtac

SEQ ID NO: 49118 - DNA, 22 bp, Homo sapiens
tgtgtcagaaggcaatggggat

SEQ ID NO: 49119 - DNA, 22 bp, Homo sapiens
cctgcagacacttgtccagcaa

SEQ ID NO: 49120 - DNA, 22 bp, Homo sapiens
gcctcactgcagccccaggaag

SEQ ID NO: 49121 - DNA, 22 bp, Homo sapiens
ccaaagtgctggggttacaggc

SEQ ID NO: 49122 - DNA, 22 bp, Homo sapiens
cactgcaacctccacctcctgg

SEQ ID NO: 49123 - DNA, 22 bp, Homo sapiens
cctggcctttgaacgctagact

SEQ ID NO: 49124 - DNA, 22 bp, Homo sapiens
tcaaagtccttgctttttctgt

SEQ ID NO: 49125 - DNA, 17 bp, Homo sapiens
aggaggccctggcgttt

SEQ ID NO: 49126 - DNA, 22 bp, Homo sapiens
gccacctcggctttctctgctc

SEQ ID NO: 49127 - DNA, 22 bp, Homo sapiens
gatgctgagaggtggagggaac

SEQ ID NO: 49128 - DNA, 22 bp, Homo sapiens
cagagctggtgtgtcctggcat

SEQ ID NO: 49129 - DNA, 22 bp, Homo sapiens
ctcctgagctctgaggaagctt

SEQ ID NO: 49130 - DNA, 22 bp, Homo sapiens
agggcagagctgtctaaatggc

SEQ ID NO: 49131 - DNA, 22 bp, Homo sapiens
ccctgccttgtctgggctaggt

SEQ ID NO: 49132 - DNA, 22 bp, Homo sapiens
ggctcctgggggtgctcctgcc

SEQ ID NO: 49133 - DNA, 22 bp, Homo sapiens
aggtggagaagagatgggcagt

SEQ ID NO: 49134 - DNA, 22 bp, Homo sapiens
aggtcacccgtttgactatcca

SEQ ID NO: 49135 - DNA, 16 bp, Homo sapiens
tggggatggggaagag

SEQ ID NO: 49136 - DNA, 18 bp, Homo sapiens
atggtctcatactgggag

SEQ ID NO: 49137 - DNA, 22 bp, Homo sapiens
ctcactgcaagttccacctacc

SEQ ID NO: 49138 - DNA, 22 bp, Homo sapiens
gatgcactgcagtatatactgt

SEQ ID NO: 49139 - DNA, 20 bp, Homo sapiens
tttgagaccagtctgcccaa

SEQ ID NO: 49140 - DNA, 22 bp, Homo sapiens
ggcgtggggccttctgcccgct

SEQ ID NO: 49141 - DNA, 22 bp, Homo sapiens
cttcctcctccatctcgaaggc

SEQ ID NO: 49142 - DNA, 22 bp, Homo sapiens
ctgggaggcagaggttgtagtg

SEQ ID NO: 49143 - DNA, 22 bp, Homo sapiens
tggagggcatgctgtccatggg

SEQ ID NO: 49144 - DNA, 22 bp, Homo sapiens
agggaaattaatgtgagcaatg

SEQ ID NO: 49145 - DNA, 22 bp, Homo sapiens
ggctcaatgcaacttctgcctc

SEQ ID NO: 49146 - DNA, 22 bp, Homo sapiens
ccagcttgaagatgtgctggtt

SEQ ID NO: 49147 - DNA, 22 bp, Homo sapiens
ctgggaggcagaggttgcagtg

SEQ ID NO: 49148 - DNA, 22 bp, Homo sapiens
atgcccaatgtcacaatttttg

SEQ ID NO: 49149 - DNA, 16 bp, Homo sapiens
ccacctgcagctctca

SEQ ID NO: 49150 - DNA, 22 bp, Homo sapiens
ccttttgctctcccatccagaa

SEQ ID NO: 49151 - DNA, 22 bp, Homo sapiens
atccttgagccaatgactgatt

SEQ ID NO: 49152 - DNA, 22 bp, Homo sapiens
gagcctcgtggcggccactgcg

SEQ ID NO: 49153 - DNA, 23 bp, Homo sapiens
caccactttctccttctccttgg

SEQ ID NO: 49154 - DNA, 22 bp, Homo sapiens
actggacagaggaaatatggag

SEQ ID NO: 49155 - DNA, 22 bp, Homo sapiens
ccaggagttggaggctgcagtg

SEQ ID NO: 49156 - DNA, 22 bp, Homo sapiens
tttaatcaggcaaagcataata

SEQ ID NO: 49157 - DNA, 22 bp, Homo sapiens
tgctattgtgaacagtgccaca

SEQ ID NO: 49158 - DNA, 22 bp, Homo sapiens
aggctatttccactcttctcat

SEQ ID NO: 49159 - DNA, 22 bp, Homo sapiens
ctgagatggagtttcgctcttc

SEQ ID NO: 49160 - DNA, 22 bp, Homo sapiens
tccagggagagccgctgctcca

SEQ ID NO: 49161 - DNA, 22 bp, Homo sapiens
cattccttaacgtggggagtct

SEQ ID NO: 49162 - DNA, 20 bp, Homo sapiens
cagcctgcatcatctgcagc

SEQ ID NO: 49163 - DNA, 22 bp, Homo sapiens
atggggctgttctctgccctgc

SEQ ID NO: 49164 - DNA, 22 bp, Homo sapiens
gagccaggtcgggccgcggcga

SEQ ID NO: 49165 - DNA, 22 bp, Homo sapiens
gggagctgagctggaagagaat

SEQ ID NO: 49166 - DNA, 22 bp, Homo sapiens
gcctggccaacgtggtgaaacc

SEQ ID NO: 49167 - DNA, 22 bp, Homo sapiens
tgcctctgaggaagattgtgtt

SEQ ID NO: 49168 - DNA, 22 bp, Homo sapiens
ccaggaggcagaagttgcagtg

SEQ ID NO: 49169 - DNA, 20 bp, Homo sapiens
ggggcccaagccctcttgcc

SEQ ID NO: 49170 - DNA, 17 bp, Homo sapiens
tgttccatttgaccacc

SEQ ID NO: 49171 - DNA, 22 bp, Homo sapiens
cggagcctgcttgttgcagctg

SEQ ID NO: 49172 - DNA, 22 bp, Homo sapiens
aaagcctcccaggttatgagta

SEQ ID NO: 49173 - DNA, 22 bp, Homo sapiens
tcaccaggctagagtgcagtgg

SEQ ID NO: 49174 - DNA, 22 bp, Homo sapiens
gggactggagtagaggccggtg

SEQ ID NO: 49175 - DNA, 22 bp, Homo sapiens
tggggagtgatgcctcggataa

SEQ ID NO: 49176 - DNA, 22 bp, Homo sapiens
aaggtgggtggatcacgaggtc

SEQ ID NO: 49177 - DNA, 22 bp, Homo sapiens
gctcccaggatgaggagccagg

SEQ ID NO: 49178 - DNA, 22 bp, Homo sapiens
ccaaagtgctgggattacaggt

SEQ ID NO: 49179 - DNA, 22 bp, Homo sapiens
aggactcatccctgcttgtcag

SEQ ID NO: 49180 - DNA, 22 bp, Homo sapiens
aaggagaggttgtccgtgttgt

SEQ ID NO: 49181 - DNA, 22 bp, Homo sapiens
ttttcatttttgtagatgcaag

SEQ ID NO: 49182 - DNA, 22 bp, Homo sapiens
tgcagattcaaatgaaatgcaa

SEQ ID NO: 49183 - DNA, 22 bp, Homo sapiens
aacagaatgcaggggatgctgc

SEQ ID NO: 49184 - DNA, 22 bp, Homo sapiens
tgtagctctccagccagcaagg

SEQ ID NO: 49185 - DNA, 22 bp, Homo sapiens
tagcagtgtctaggtaggccat

SEQ ID NO: 49186 - DNA, 22 bp, Homo sapiens
acactgcagatgaaagcataag

SEQ ID NO: 49187 - DNA, 22 bp, Homo sapiens
cagcttggaggaggatctaaga

SEQ ID NO: 49188 - DNA, 22 bp, Homo sapiens
ccaaagtgctaggattacaggt

SEQ ID NO: 49189 - DNA, 22 bp, Homo sapiens
cattgcactccagcctgggcaa

SEQ ID NO: 49190 - DNA, 22 bp, Homo sapiens
atatgcagtctcttgcccttct

SEQ ID NO: 49191 - DNA, 22 bp, Homo sapiens
gggcggatcatttgaggtcagg

SEQ ID NO: 49192 - DNA, 22 bp, Homo sapiens
cactgcactccagcctgggtga

SEQ ID NO: 49193 - DNA, 22 bp, Homo sapiens
cattgcactctagcctgggtga

SEQ ID NO: 49194 - DNA, 22 bp, Homo sapiens
ttgcactccagcccgagcaaca

SEQ ID NO: 49195 - DNA, 22 bp, Homo sapiens
atgaaaacggaccagagctatt

SEQ ID NO: 49196 - DNA, 22 bp, Homo sapiens
gtgcatgtcggggtgcatgtca

SEQ ID NO: 49197 - DNA, 22 bp, Homo sapiens
ctgggggtcttgaaagggagag

SEQ ID NO: 49198 - DNA, 22 bp, Homo sapiens
agaaatatgctgattagatgaa

SEQ ID NO: 49199 - DNA, 22 bp, Homo sapiens
ccacaggggcccacgagccgct

SEQ ID NO: 49200 - DNA, 22 bp, Homo sapiens
tgaaatcttcactaagtctctt

SEQ ID NO: 49201 - DNA, 22 bp, Homo sapiens
tcccagcgcggggggaggatcc

SEQ ID NO: 49202 - DNA, 22 bp, Homo sapiens
tcaccaggctggagtgcagtgg

SEQ ID NO: 49203 - DNA, 22 bp, Homo sapiens
caaagtgctgggattacaggct

SEQ ID NO: 49204 - DNA, 22 bp, Homo sapiens
gctcactgcaagctccgcctcc

SEQ ID NO: 49205 - DNA, 22 bp, Homo sapiens
ccaaagtgctaggattacaggc

SEQ ID NO: 49206 - DNA, 22 bp, Homo sapiens
agagctgggtggacttgtagtt

SEQ ID NO: 49207 - DNA, 22 bp, Homo sapiens
gaggtgctgctgtacttcttgc

SEQ ID NO: 49208 - DNA, 22 bp, Homo sapiens
gagccaggttggaggctgcagt

SEQ ID NO: 49209 - DNA, 22 bp, Homo sapiens
ctcactgcaagctccacctctt

SEQ ID NO: 49210 - DNA, 22 bp, Homo sapiens
tcaggggcttgaggtgcatgtc

SEQ ID NO: 49211 - DNA, 22 bp, Homo sapiens
tcatctaagagtcttacattta

SEQ ID NO: 49212 - DNA, 21 bp, Homo sapiens
ccaccaggtcttctgctcggg

SEQ ID NO: 49213 - DNA, 22 bp, Homo sapiens
ctctgctgtgccgccagggcct

SEQ ID NO: 49214 - DNA, 22 bp, Homo sapiens
atgccactgcactccagcctag

SEQ ID NO: 49215 - DNA, 22 bp, Homo sapiens
tgaaatctttagtttctgtccc

SEQ ID NO: 49216 - DNA, 22 bp, Homo sapiens
agaggcaggaggttgacttgag

SEQ ID NO: 49217 - DNA, 22 bp, Homo sapiens
ggtgccaggctgtagtcagggt

SEQ ID NO: 49218 - DNA, 21 bp, Homo sapiens
tgcaatccagcctgggcgaca

SEQ ID NO: 49219 - DNA, 22 bp, Homo sapiens
cagagctgtccaaaccctgaca

SEQ ID NO: 49220 - DNA, 22 bp, Homo sapiens
gcaggcagatcacctgtcagga

SEQ ID NO: 49221 - DNA, 22 bp, Homo sapiens
ctgggcacagcgttgggctctt

SEQ ID NO: 49222 - DNA, 22 bp, Homo sapiens
gggcatggtggcaggcacctgt

SEQ ID NO: 49223 - DNA, 22 bp, Homo sapiens
gtagcccacctggggagggcga

SEQ ID NO: 49224 - DNA, 22 bp, Homo sapiens
aaggtcatggcaaattactttt

SEQ ID NO: 49225 - DNA, 22 bp, Homo sapiens
ctgtcaggttggtctcagagct

SEQ ID NO: 49226 - DNA, 22 bp, Homo sapiens
gctcccaccgccgctatgggta

SEQ ID NO: 49227 - DNA, 22 bp, Homo sapiens
tctagctctgcttatcatggct

SEQ ID NO: 49228 - DNA, 22 bp, Homo sapiens
cttatagtatgatgttgagaat

SEQ ID NO: 49229 - DNA, 22 bp, Homo sapiens
gctgtctgtcttcacatctcgc

SEQ ID NO: 49230 - DNA, 22 bp, Homo sapiens
tttctggcagcgggacaggggt

SEQ ID NO: 49231 - DNA, 22 bp, Homo sapiens
atgccactgcactccagcctgg

SEQ ID NO: 49232 - DNA, 22 bp, Homo sapiens
gagctctgactgctgggtgaca

SEQ ID NO: 49233 - DNA, 22 bp, Homo sapiens
aagtcattggtagcttgatagg

SEQ ID NO: 49234 - DNA, 22 bp, Homo sapiens
aggggaggtgtccccaaatctc

SEQ ID NO: 49235 - DNA, 22 bp, Homo sapiens
ccctcccaggagtggccagaga

SEQ ID NO: 49236 - DNA, 22 bp, Homo sapiens
ctggcaggttatagagctgccc

SEQ ID NO: 49237 - DNA, 22 bp, Homo sapiens
ccctctgcatacaggcgaggag

SEQ ID NO: 49238 - DNA, 22 bp, Homo sapiens
gtctttatttgagattgtcatt

SEQ ID NO: 49239 - DNA, 22 bp, Homo sapiens
tcactgcactccagcctgggtg

SEQ ID NO: 49240 - DNA, 22 bp, Homo sapiens
gagggtggtggcttaaggtgct

SEQ ID NO: 49241 - DNA, 22 bp, Homo sapiens
cggggacacactggcagctcct

SEQ ID NO: 49242 - DNA, 22 bp, Homo sapiens
gagagaagggggatatgagcct

SEQ ID NO: 49243 - DNA, 22 bp, Homo sapiens
ctgagatggagttttgctcttg

SEQ ID NO: 49244 - DNA, 22 bp, Homo sapiens
cactctgcgctgggcgccagcg

SEQ ID NO: 49245 - DNA, 20 bp, Homo sapiens
gggcagagccagccagtccc

SEQ ID NO: 49246 - DNA, 22 bp, Homo sapiens
ggctcaggcctgtaatcctagc

SEQ ID NO: 49247 - DNA, 22 bp, Homo sapiens
gggaggttgaggctgcagtgag

SEQ ID NO: 49248 - DNA, 22 bp, Homo sapiens
agcccaggttgaggctgcagtg

SEQ ID NO: 49249 - DNA, 22 bp, Homo sapiens
ctctggaccctcctgctgagag

SEQ ID NO: 49250 - DNA, 22 bp, Homo sapiens
aagaggttgtctgtgatgagtt

SEQ ID NO: 49251 - DNA, 22 bp, Homo sapiens
agggctgcccagtgtgagagct

SEQ ID NO: 49252 - DNA, 22 bp, Homo sapiens
ccctgcctacagggttttcttt

SEQ ID NO: 49253 - DNA, 22 bp, Homo sapiens
agatacattgttctaagcattg

SEQ ID NO: 49254 - DNA, 22 bp, Homo sapiens
tctgctctgtggcttcagctaa

SEQ ID NO: 49255 - DNA, 22 bp, Homo sapiens
ttgtgaaacattcatggatttg

SEQ ID NO: 49256 - DNA, 22 bp, Homo sapiens
acaggcttacaggctgcaagta

SEQ ID NO: 49257 - DNA, 22 bp, Homo sapiens
ggctgggctccgggagcatgcg

SEQ ID NO: 49258 - DNA, 22 bp, Homo sapiens
ccaggaggcggaaggtacagtg

SEQ ID NO: 49259 - DNA, 22 bp, Homo sapiens
cagctgcccctccagggctggg

SEQ ID NO: 49260 - DNA, 22 bp, Homo sapiens
ccctggaggcggagcttgcagt

SEQ ID NO: 49261 - DNA, 22 bp, Homo sapiens
cctgccagagcagcttgtcctc

SEQ ID NO: 49262 - DNA, 22 bp, Homo sapiens
ggagtgaatcactagatgcaga

SEQ ID NO: 49263 - DNA, 22 bp, Homo sapiens
attataggcttgagccaccgtg

SEQ ID NO: 49264 - DNA, 22 bp, Homo sapiens
agcctgggcaacagagcaaaac

SEQ ID NO: 49265 - DNA, 22 bp, Homo sapiens
tccttcagcctcccagctcaaa

SEQ ID NO: 49266 - DNA, 22 bp, Homo sapiens
acgcctgtaatcccagcacttt

SEQ ID NO: 49267 - DNA, 22 bp, Homo sapiens
ctggctgggagcgagctgctca

SEQ ID NO: 49268 - DNA, 22 bp, Homo sapiens
tgcagtcttccagctgcacaaa

SEQ ID NO: 49269 - DNA, 22 bp, Homo sapiens
ctcaggatattgggctggagca

SEQ ID NO: 49270 - DNA, 22 bp, Homo sapiens
aggggctcctttgtgctgcgtc

SEQ ID NO: 49271 - DNA, 22 bp, Homo sapiens
cccaggctggagtgcagtggcg

SEQ ID NO: 49272 - DNA, 22 bp, Homo sapiens
tagccgggtgtggtggaactcc

SEQ ID NO: 49273 - DNA, 22 bp, Homo sapiens
gctggcagacttcctctggaac

SEQ ID NO: 49274 - DNA, 23 bp, Homo sapiens
ggagtgcaatggcgccatctcgg

SEQ ID NO: 49275 - DNA, 22 bp, Homo sapiens
ccacccttgggttcggaggccg

SEQ ID NO: 49276 - DNA, 22 bp, Homo sapiens
gtcctggggattatagagtgtt

SEQ ID NO: 49277 - DNA, 17 bp, Homo sapiens
tgcatgtcctttgttcc

SEQ ID NO: 49278 - DNA, 22 bp, Homo sapiens
ggggtgggcgtgcagggacacc

SEQ ID NO: 49279 - DNA, 17 bp, Homo sapiens
aggtgggtggatcacct

SEQ ID NO: 49280 - DNA, 17 bp, Homo sapiens
gggcagggactcctggg

SEQ ID NO: 49281 - DNA, 22 bp, Homo sapiens
catgagataatttttctccagt

SEQ ID NO: 49282 - DNA, 22 bp, Homo sapiens
agggatgtaaattcttcttctt

SEQ ID NO: 49283 - DNA, 19 bp, Homo sapiens
ccatggcaatgatctgatg

SEQ ID NO: 49284 - DNA, 22 bp, Homo sapiens
acagcagcaatagcagtgacat

SEQ ID NO: 49285 - DNA, 22 bp, Homo sapiens
aagcctggcacattggagtctg

SEQ ID NO: 49286 - DNA, 22 bp, Homo sapiens
gaggcagaggttgcagtgagct

SEQ ID NO: 49287 - DNA, 22 bp, Homo sapiens
ggggcagagaataaaaacctaa

SEQ ID NO: 49288 - DNA, 22 bp, Homo sapiens
gtcagtgtcttaacagagatta

SEQ ID NO: 49289 - DNA, 16 bp, Homo sapiens
tgggtgggaggagcgg

SEQ ID NO: 49290 - DNA, 22 bp, Homo sapiens
tgttatctgagcaacgtcgacg

SEQ ID NO: 49291 - DNA, 22 bp, Homo sapiens
cttcttgctgggggcctcagtg

SEQ ID NO: 49292 - DNA, 22 bp, Homo sapiens
aaattgcaaaagtacttttagg

SEQ ID NO: 49293 - DNA, 22 bp, Homo sapiens
tgagcccagagatctgagctat

SEQ ID NO: 49294 - DNA, 22 bp, Homo sapiens
aagaggtaaccatagcaaccac

SEQ ID NO: 49295 - DNA, 23 bp, Homo sapiens
gcagaggagcaagctggacacca

SEQ ID NO: 49296 - DNA, 22 bp, Homo sapiens
gtgcttccatctagagggtcac

SEQ ID NO: 49297 - DNA, 22 bp, Homo sapiens
gggcagagactcagaaacagaa

SEQ ID NO: 49298 - DNA, 22 bp, Homo sapiens
aggtcaccatggcatgctccac

SEQ ID NO: 49299 - DNA, 22 bp, Homo sapiens
aggtgcttggctcgtgcacaca

SEQ ID NO: 49300 - DNA, 22 bp, Homo sapiens
aagccgggcctgagaaatgaca

SEQ ID NO: 49301 - DNA, 22 bp, Homo sapiens
ggctgccttccctgagccccgg

SEQ ID NO: 49302 - DNA, 22 bp, Homo sapiens
ccaggagttggaggttgcagtg

SEQ ID NO: 49303 - DNA, 22 bp, Homo sapiens
cccaggaggtggaggctgcagt

SEQ ID NO: 49304 - DNA, 23 bp, Homo sapiens
cagagctggctcagagctgcctg

SEQ ID NO: 49305 - DNA, 22 bp, Homo sapiens
caccaggctggagtgcagtggc

SEQ ID NO: 49306 - DNA, 18 bp, Homo sapiens
cagctgccagctcatgga

SEQ ID NO: 49307 - DNA, 22 bp, Homo sapiens
ttctttcagaacacaagtgatt

SEQ ID NO: 49308 - DNA, 22 bp, Homo sapiens
gggcttggcacatgggctcagc

SEQ ID NO: 49309 - DNA, 22 bp, Homo sapiens
tgcctgatgcaggagtatcaga

SEQ ID NO: 49310 - DNA, 22 bp, Homo sapiens
gctgtcttgctcactcttgcag

SEQ ID NO: 49311 - DNA, 22 bp, Homo sapiens
gcactgcaggtgggtggagagg

SEQ ID NO: 49312 - DNA, 18 bp, Homo sapiens
ccctgccagctcccagca

SEQ ID NO: 49313 - DNA, 22 bp, Homo sapiens
cagccccacacggtctagctct

SEQ ID NO: 49314 - DNA, 22 bp, Homo sapiens
gtgcgccagctcaaggggaggc

SEQ ID NO: 49315 - DNA, 22 bp, Homo sapiens
catgtctgtgtacacatgcaca

SEQ ID NO: 49316 - DNA, 22 bp, Homo sapiens
gggagctggagctggaagactc

SEQ ID NO: 49317 - DNA, 22 bp, Homo sapiens
actttatttcctattgcatcca

SEQ ID NO: 49318 - DNA, 22 bp, Homo sapiens
accccagaggcggaggctgcag

SEQ ID NO: 49319 - DNA, 22 bp, Homo sapiens
cactgcactccagcttgggtga

SEQ ID NO: 49320 - DNA, 20 bp, Homo sapiens
ccaccctgtccggggcggag

SEQ ID NO: 49321 - DNA, 22 bp, Homo sapiens
tgggaaggggagctggaaagga

SEQ ID NO: 49322 - DNA, 22 bp, Homo sapiens
cactgcactccatcctgggaaa

SEQ ID NO: 49323 - DNA, 22 bp, Homo sapiens
ctacattaaattggcttactta

SEQ ID NO: 49324 - DNA, 22 bp, Homo sapiens
aagagggctgcaatcttattgc

SEQ ID NO: 49325 - DNA, 22 bp, Homo sapiens
ctctctgggcccagttggcacc

SEQ ID NO: 49326 - DNA, 22 bp, Homo sapiens
taagaaatttagttatagaatg

SEQ ID NO: 49327 - DNA, 22 bp, Homo sapiens
ctcagggccaaggatgctgttg

SEQ ID NO: 49328 - DNA, 22 bp, Homo sapiens
gggcagagagctggaactcctt

SEQ ID NO: 49329 - DNA, 22 bp, Homo sapiens
aaaatggtctcagctggcacca

SEQ ID NO: 49330 - DNA, 22 bp, Homo sapiens
aggacttagaacattatgtact

SEQ ID NO: 49331 - DNA, 22 bp, Homo sapiens
ccagcagagcatggggaggaag

SEQ ID NO: 49332 - DNA, 18 bp, Homo sapiens
cttgttcttctcttggcg

SEQ ID NO: 49333 - DNA, 22 bp, Homo sapiens
gcaactgaacatgtgtgtggcc

SEQ ID NO: 49334 - DNA, 19 bp, Homo sapiens
gggcttggggctgaagcct

SEQ ID NO: 49335 - DNA, 19 bp, Homo sapiens
taggaccctggtggccccc

SEQ ID NO: 49336 - DNA, 22 bp, Homo sapiens
agtggcctggagccccgcctgg

SEQ ID NO: 49337 - DNA, 18 bp, Homo sapiens
agagtgttctcagtgaaa

SEQ ID NO: 49338 - DNA, 22 bp, Homo sapiens
aagacccacaaggctgaatgtt

SEQ ID NO: 49339 - DNA, 23 bp, Homo sapiens
aatggtcttcctccacccctctg

SEQ ID NO: 49340 - DNA, 19 bp, Homo sapiens
catctggatgattctcctg

SEQ ID NO: 49341 - DNA, 22 bp, Homo sapiens
tctctcaggctggagtgcagtg

SEQ ID NO: 49342 - DNA, 22 bp, Homo sapiens
ccagggtggcgtagatgctggg

SEQ ID NO: 49343 - DNA, 23 bp, Homo sapiens
ggcctcagtgatgatgggttaaa

SEQ ID NO: 49344 - DNA, 22 bp, Homo sapiens
acgttttctagagaatatgcag

SEQ ID NO: 49345 - DNA, 22 bp, Homo sapiens
gcaaatgctaaagtgtagagac

SEQ ID NO: 49346 - DNA, 22 bp, Homo sapiens
ttatgggagcaattggggaggt

SEQ ID NO: 49347 - DNA, 22 bp, Homo sapiens
agaacagaggccttatgtttca

SEQ ID NO: 49348 - DNA, 22 bp, Homo sapiens
agttgcagacgcagagatgttg

SEQ ID NO: 49349 - DNA, 18 bp, Homo sapiens
gaggatggaaggagatgc

SEQ ID NO: 49350 - DNA, 22 bp, Homo sapiens
aggatcctgcgctttgggggag

SEQ ID NO: 49351 - DNA, 22 bp, Homo sapiens
gtcaccagtgctaagaggtgga

SEQ ID NO: 49352 - DNA, 22 bp, Homo sapiens
cccaggagttggaggctgcagt

SEQ ID NO: 49353 - DNA, 22 bp, Homo sapiens
caggagtgtctccacacagcaa

SEQ ID NO: 49354 - DNA, 22 bp, Homo sapiens
gaggctgaggcaggaggatcac

SEQ ID NO: 49355 - DNA, 22 bp, Homo sapiens
agtgttgtcaaacggctcagca

SEQ ID NO: 49356 - DNA, 22 bp, Homo sapiens
ctcactgcaagctcagcctccc

SEQ ID NO: 49357 - DNA, 22 bp, Homo sapiens
cgccaggcttggtagctcatgc

SEQ ID NO: 49358 - DNA, 22 bp, Homo sapiens
tctgtgctaggcagcctggccc

SEQ ID NO: 49359 - DNA, 22 bp, Homo sapiens
agatggggtttcatcatgttgg

SEQ ID NO: 49360 - DNA, 22 bp, Homo sapiens
ggtcccaggttgacagggagac

SEQ ID NO: 49361 - DNA, 22 bp, Homo sapiens
tttcttaggctctaaaatgact

SEQ ID NO: 49362 - DNA, 22 bp, Homo sapiens
caggcactgtgctgagctctgc

SEQ ID NO: 49363 - DNA, 22 bp, Homo sapiens
ccaggaggttgaggctgcagtg

SEQ ID NO: 49364 - DNA, 22 bp, Homo sapiens
ttggaggcaatgggaaggaggc

SEQ ID NO: 49365 - DNA, 22 bp, Homo sapiens
agcctgggccctgcctcttctc

SEQ ID NO: 49366 - DNA, 22 bp, Homo sapiens
gggtaattggggccttgcagtg

SEQ ID NO: 49367 - DNA, 22 bp, Homo sapiens
cacagctgaagtagccatgtgg

SEQ ID NO: 49368 - DNA, 22 bp, Homo sapiens
ggaggtgggctaaggactctct

SEQ ID NO: 49369 - DNA, 22 bp, Homo sapiens
tgtgccatgaggctctgatatg

SEQ ID NO: 49370 - DNA, 22 bp, Homo sapiens
acaggggaatttactgtcatta

SEQ ID NO: 49371 - DNA, 22 bp, Homo sapiens
gggaggttctgttcgcacttga

SEQ ID NO: 49372 - DNA, 22 bp, Homo sapiens
ctctcgccagcggggctgcgct

SEQ ID NO: 49373 - DNA, 22 bp, Homo sapiens
gtgggggcaggcagtgctagga

SEQ ID NO: 49374 - DNA, 22 bp, Homo sapiens
ttgtaacaggtactaaataact

SEQ ID NO: 49375 - DNA, 22 bp, Homo sapiens
aggggagagttaatgtgaatgt

SEQ ID NO: 49376 - DNA, 22 bp, Homo sapiens
gggcctgtgtgttcaggagcct

SEQ ID NO: 49377 - DNA, 22 bp, Homo sapiens
tggaaagaaagtaaaggcgtat

SEQ ID NO: 49378 - DNA, 22 bp, Homo sapiens
tgcaataactactttaatgttg

SEQ ID NO: 49379 - DNA, 22 bp, Homo sapiens
cagtggcgtgatctctgctcac

SEQ ID NO: 49380 - DNA, 22 bp, Homo sapiens
ctgtaatcccagctacctggga

SEQ ID NO: 49381 - DNA, 22 bp, Homo sapiens
aggcactgtgcagtcccaagca

SEQ ID NO: 49382 - DNA, 22 bp, Homo sapiens
tcactgcaacctccacctcccg

SEQ ID NO: 49383 - DNA, 22 bp, Homo sapiens
gctggtgagcaaaggagaagga

SEQ ID NO: 49384 - DNA, 22 bp, Homo sapiens
gcctggagaaaggaaggtggga

SEQ ID NO: 49385 - DNA, 22 bp, Homo sapiens
ctgccctggggggcctccttgc

SEQ ID NO: 49386 - DNA, 22 bp, Homo sapiens
gtgaggtggtacaatattaact

SEQ ID NO: 49387 - DNA, 23 bp, Homo sapiens
actgagccagggcctgggtcagc

SEQ ID NO: 49388 - DNA, 23 bp, Homo sapiens
acagcaagaggaccagatgtgag

SEQ ID NO: 49389 - DNA, 22 bp, Homo sapiens
cggctgggttcggctgcaggcc

SEQ ID NO: 49390 - DNA, 22 bp, Homo sapiens
ccctggaggttgaggctgcagt

SEQ ID NO: 49391 - DNA, 22 bp, Homo sapiens
gcctgatgagcttccagctgag

SEQ ID NO: 49392 - DNA, 22 bp, Homo sapiens
caggctggagttcagtggtgtg

SEQ ID NO: 49393 - DNA, 19 bp, Homo sapiens
tcctgcctggggccgcctg

SEQ ID NO: 49394 - DNA, 22 bp, Homo sapiens
agcccagaggctgggcgtgcat

SEQ ID NO: 49395 - DNA, 22 bp, Homo sapiens
ctggcctcggcagcaggaacag

SEQ ID NO: 49396 - DNA, 22 bp, Homo sapiens
agcccaggctggagtgcagtgg

SEQ ID NO: 49397 - DNA, 22 bp, Homo sapiens
gcagagccatgggaggtttttg

SEQ ID NO: 49398 - DNA, 22 bp, Homo sapiens
aatcggttgaacccaggaagtg

SEQ ID NO: 49399 - DNA, 22 bp, Homo sapiens
tctcaagcttgttggtatgttt

SEQ ID NO: 49400 - DNA, 22 bp, Homo sapiens
gcccagagttcaaggctgcagt

SEQ ID NO: 49401 - DNA, 22 bp, Homo sapiens
actgcaaagggaagccctttct

SEQ ID NO: 49402 - DNA, 22 bp, Homo sapiens
tcaggcaccttcctcttatctg

SEQ ID NO: 49403 - DNA, 22 bp, Homo sapiens
aggagaagccaagttgtgagca

SEQ ID NO: 49404 - DNA, 22 bp, Homo sapiens
gagtgtgtcggtcagcgtggcg

SEQ ID NO: 49405 - DNA, 22 bp, Homo sapiens
ccaaagtgctgggattacaggc

SEQ ID NO: 49406 - DNA, 22 bp, Homo sapiens
ctgctttgcatagctgccagag

SEQ ID NO: 49407 - DNA, 22 bp, Homo sapiens
tgatgggaggtgctgcaggacc

SEQ ID NO: 49408 - DNA, 22 bp, Homo sapiens
tggaggctggagtgcagtggcg

SEQ ID NO: 49409 - DNA, 21 bp, Homo sapiens
gggcctggctgcgcaggacgg

SEQ ID NO: 49410 - DNA, 22 bp, Homo sapiens
cctgtggcgggggccagtgcct

SEQ ID NO: 49411 - DNA, 22 bp, Homo sapiens
catcactgtccaaagttcagtt

SEQ ID NO: 49412 - DNA, 22 bp, Homo sapiens
gacaggaggcagagctcaggtg

SEQ ID NO: 49413 - DNA, 22 bp, Homo sapiens
aggagctgtcagagtgccagag

SEQ ID NO: 49414 - DNA, 22 bp, Homo sapiens
gggcggggtggctcatgcctgt

SEQ ID NO: 49415 - DNA, 18 bp, Homo sapiens
ggaaaaggagtgtctagc

SEQ ID NO: 49416 - DNA, 22 bp, Homo sapiens
gggagtgggtttggcctaggcc

SEQ ID NO: 49417 - DNA, 22 bp, Homo sapiens
aagaggtagcagtcacaaaaga

SEQ ID NO: 49418 - DNA, 22 bp, Homo sapiens
cagggtgccaaagaacaaatat

SEQ ID NO: 49419 - DNA, 22 bp, Homo sapiens
ggagagtggattccagctgtat

SEQ ID NO: 49420 - DNA, 22 bp, Homo sapiens
ctctggaggtggaggttgcagt

SEQ ID NO: 49421 - DNA, 22 bp, Homo sapiens
gcaggatgagtgagtacattta

SEQ ID NO: 49422 - DNA, 22 bp, Homo sapiens
agttggagtgaacatgagattg

SEQ ID NO: 49423 - DNA, 22 bp, Homo sapiens
cctgacgaaaggcgtgctggag

SEQ ID NO: 49424 - DNA, 22 bp, Homo sapiens
gcccagcacctctctcagggtt

SEQ ID NO: 49425 - DNA, 22 bp, Homo sapiens
tgcagtggcgccatctcagctc

SEQ ID NO: 49426 - DNA, 22 bp, Homo sapiens
aggggtgaaagagggccctcaa

SEQ ID NO: 49427 - DNA, 22 bp, Homo sapiens
ggtgactggtttatctggcagt

SEQ ID NO: 49428 - DNA, 22 bp, Homo sapiens
tgagccagaggaggctgtgtgg

SEQ ID NO: 49429 - DNA, 22 bp, Homo sapiens
ctgggtggcagagcctgcagtg

SEQ ID NO: 49430 - DNA, 22 bp, Homo sapiens
ggaggagacagtaaaaagcacg

SEQ ID NO: 49431 - DNA, 22 bp, Homo sapiens
tttctcttcactgtgtgcctca

SEQ ID NO: 49432 - DNA, 22 bp, Homo sapiens
aggcaagggggcgccaccttcc

SEQ ID NO: 49433 - DNA, 22 bp, Homo sapiens
ttcagcagtgcagacacccagt

SEQ ID NO: 49434 - DNA, 22 bp, Homo sapiens
aaagaaatagatggcatttaaa

SEQ ID NO: 49435 - DNA, 22 bp, Homo sapiens
gagctcatccccatggtccgtc

SEQ ID NO: 49436 - DNA, 22 bp, Homo sapiens
cattgcactccagcctaggcaa

SEQ ID NO: 49437 - DNA, 22 bp, Homo sapiens
cgtgtggtcccggcaaggcaag

SEQ ID NO: 49438 - DNA, 22 bp, Homo sapiens
ctgggaggcggaggttgtagtg

SEQ ID NO: 49439 - DNA, 22 bp, Homo sapiens
agctgctgagccaggctgatgt

SEQ ID NO: 49440 - DNA, 22 bp, Homo sapiens
gtccacagctctgaggtctccc

SEQ ID NO: 49441 - DNA, 22 bp, Homo sapiens
cctgggaggctgaggctgcagt

SEQ ID NO: 49442 - DNA, 22 bp, Homo sapiens
tctggctctggagtccacctgc

SEQ ID NO: 49443 - DNA, 22 bp, Homo sapiens
gctccctggtagccatgctctc

SEQ ID NO: 49444 - DNA, 22 bp, Homo sapiens
ttgctctgactggagtgcagtg

SEQ ID NO: 49445 - DNA, 23 bp, Homo sapiens
cagagctggcttcatgggtgtgc

SEQ ID NO: 49446 - DNA, 22 bp, Homo sapiens
gctgccaatccagctgtgggag

SEQ ID NO: 49447 - DNA, 22 bp, Homo sapiens
gaagagtggttatccctgctgt

SEQ ID NO: 49448 - DNA, 22 bp, Homo sapiens
gagctcattcattcattgcctg

SEQ ID NO: 49449 - DNA, 22 bp, Homo sapiens
ctcattgcccagatccccacag

SEQ ID NO: 49450 - DNA, 22 bp, Homo sapiens
aatgccagtgtgttgattccag

SEQ ID NO: 49451 - DNA, 16 bp, Homo sapiens
cattgcactctagcct

SEQ ID NO: 49452 - DNA, 22 bp, Homo sapiens
cccaggaggtcgaagctgcagt

SEQ ID NO: 49453 - DNA, 22 bp, Homo sapiens
cccagaaggtcgaggctgcagt

SEQ ID NO: 49454 - DNA, 22 bp, Homo sapiens
agtcttcccagaggaggtgcca

SEQ ID NO: 49455 - DNA, 22 bp, Homo sapiens
gggcggggggagctggaatgaa

SEQ ID NO: 49456 - DNA, 22 bp, Homo sapiens
tgcctcagctgaggccgctcca

SEQ ID NO: 49457 - DNA, 22 bp, Homo sapiens
ttagctcagaaaatttaaactt

SEQ ID NO: 49458 - DNA, 22 bp, Homo sapiens
tcactgcaatctcagcctcctg

SEQ ID NO: 49459 - DNA, 17 bp, Homo sapiens
tccttcagtgcctctgc

SEQ ID NO: 49460 - DNA, 22 bp, Homo sapiens
tgtcatagtgtggtagcagtgg

SEQ ID NO: 49461 - DNA, 22 bp, Homo sapiens
agcctctctgttagtcactggg

SEQ ID NO: 49462 - DNA, 22 bp, Homo sapiens
ggaggacaggggctgcagcaca

SEQ ID NO: 49463 - DNA, 22 bp, Homo sapiens
aatccaggtggcggaggttgtg

SEQ ID NO: 49464 - DNA, 22 bp, Homo sapiens
agagagcccgggccagggcaca

SEQ ID NO: 49465 - DNA, 22 bp, Homo sapiens
cctggaggcggaggttgcagtg

SEQ ID NO: 49466 - DNA, 22 bp, Homo sapiens
cgtgtacagtctatcttttttc

SEQ ID NO: 49467 - DNA, 22 bp, Homo sapiens
gcctgttctccagcatccaggt

SEQ ID NO: 49468 - DNA, 20 bp, Homo sapiens
agcggctggcggaggacacg

SEQ ID NO: 49469 - DNA, 22 bp, Homo sapiens
atgattgaccatctgctgggct

SEQ ID NO: 49470 - DNA, 22 bp, Homo sapiens
caaagtgctaggattacaggcg

SEQ ID NO: 49471 - DNA, 22 bp, Homo sapiens
gcttccgcgatgtcctaggtgg

SEQ ID NO: 49472 - DNA, 22 bp, Homo sapiens
gaccctctagatggaagcactg

SEQ ID NO: 49473 - DNA, 22 bp, Homo sapiens
gctgcagctgtaggacacaatt

SEQ ID NO: 49474 - DNA, 22 bp, Homo sapiens
ctcagagtcccttccctcgtgg

SEQ ID NO: 49475 - DNA, 22 bp, Homo sapiens
ttctccgctaagttctctgcag

SEQ ID NO: 49476 - DNA, 22 bp, Homo sapiens
cattgcactcctgcctgggcaa

SEQ ID NO: 49477 - DNA, 20 bp, Homo sapiens
agcagagtgcccatcccgga

SEQ ID NO: 49478 - DNA, 22 bp, Homo sapiens
gtggaggagaggcgccttgcgg

SEQ ID NO: 49479 - DNA, 22 bp, Homo sapiens
tcagcaatcctcccacaggtgg

SEQ ID NO: 49480 - DNA, 22 bp, Homo sapiens
cattgcactgcagcccgggcaa

SEQ ID NO: 49481 - DNA, 22 bp, Homo sapiens
aagccaggttccatggaggagc

SEQ ID NO: 49482 - DNA, 22 bp, Homo sapiens
tccccagcttgctacttctgct

SEQ ID NO: 49483 - DNA, 22 bp, Homo sapiens
tgtctctgtgactccttccgcc

SEQ ID NO: 49484 - DNA, 22 bp, Homo sapiens
agttgcagacgcagagatgttg

SEQ ID NO: 49485 - DNA, 22 bp, Homo sapiens
tgtcatagtgtggtagcagtgg

SEQ ID NO: 49486 - DNA, 22 bp, Homo sapiens
gcggcaggagtaaaggaggaag

SEQ ID NO: 49487 - DNA, 22 bp, Homo sapiens
tgccgtggggctgaggctggag

SEQ ID NO: 49488 - DNA, 22 bp, Homo sapiens
ggtgggagagctctgtctccag

SEQ ID NO: 49489 - DNA, 22 bp, Homo sapiens
gcctcctgagtagctgggattg

SEQ ID NO: 49490 - DNA, 22 bp, Homo sapiens
tagtgtctcttcctgtttgaaa

SEQ ID NO: 49491 - DNA, 22 bp, Homo sapiens
actgcacttcagcctgggtgac

SEQ ID NO: 49492 - DNA, 22 bp, Homo sapiens
ggatgtcgaggatggggtagca

SEQ ID NO: 49493 - DNA, 22 bp, Homo sapiens
gaggagggagctggaagctctt

SEQ ID NO: 49494 - DNA, 22 bp, Homo sapiens
tctgagccagggtctcctccct

SEQ ID NO: 49495 - DNA, 22 bp, Homo sapiens
caggctggagtgcagtggtgcc

SEQ ID NO: 49496 - DNA, 22 bp, Homo sapiens
attgtaaatagtgccacaataa

SEQ ID NO: 49497 - DNA, 22 bp, Homo sapiens
gttgagtgggttaggatgctga

SEQ ID NO: 49498 - DNA, 22 bp, Homo sapiens
aaagcactgcacatatatttgc

SEQ ID NO: 49499 - DNA, 22 bp, Homo sapiens
agatgctgctccacaggccagg

SEQ ID NO: 49500 - DNA, 22 bp, Homo sapiens
ggagctcctggcagtgacagag

SEQ ID NO: 49501 - DNA, 21 bp, Homo sapiens
ctggaggcaggtggtgccagg

SEQ ID NO: 49502 - DNA, 22 bp, Homo sapiens
gcttttgcctacatcttggtct

SEQ ID NO: 49503 - DNA, 22 bp, Homo sapiens
tgactcctggtatggatgacag

SEQ ID NO: 49504 - DNA, 17 bp, Homo sapiens
gggcagggactcctggg

SEQ ID NO: 49505 - DNA, 22 bp, Homo sapiens
ctctttggatagaattacaaag

SEQ ID NO: 49506 - DNA, 22 bp, Homo sapiens
aaaaagtattggccatggttga

SEQ ID NO: 49507 - DNA, 22 bp, Homo sapiens
tacaggcatgtagcatggtgat

SEQ ID NO: 49508 - DNA, 22 bp, Homo sapiens
ctggtttgtcttgggaggatgt

SEQ ID NO: 49509 - DNA, 22 bp, Homo sapiens
agaaagtgcttccctttggact

SEQ ID NO: 49510 - DNA, 22 bp, Homo sapiens
tcctgcagctgataaatacagt

SEQ ID NO: 49511 - DNA, 23 bp, Homo sapiens
caccactttctccttctccttgg

SEQ ID NO: 49512 - DNA, 22 bp, Homo sapiens
tcaccgaggctggagtgcagtg

SEQ ID NO: 49513 - DNA, 21 bp, Homo sapiens
gctcctggtgctgcgtggcgc

SEQ ID NO: 49514 - DNA, 22 bp, Homo sapiens
cccaggaggcagaagttgcagt

SEQ ID NO: 49515 - DNA, 22 bp, Homo sapiens
ccacaggggcccacgagccgct

SEQ ID NO: 49516 - DNA, 22 bp, Homo sapiens
tcccgcttcttccgaatcgcga

SEQ ID NO: 49517 - DNA, 22 bp, Homo sapiens
ggtgcagaggagccagctgggg

SEQ ID NO: 49518 - DNA, 22 bp, Homo sapiens
gccaggcgggtctcaaactcct

SEQ ID NO: 49519 - DNA, 22 bp, Homo sapiens
tacttttagcctatttgattct

SEQ ID NO: 49520 - DNA, 19 bp, Homo sapiens
gactccaactttaagcatg

SEQ ID NO: 49521 - DNA, 22 bp, Homo sapiens
tctttggtttctgtctctgtaa

SEQ ID NO: 49522 - DNA, 22 bp, Homo sapiens
aaagtgctgggattacaggtgt

SEQ ID NO: 49523 - DNA, 22 bp, Homo sapiens
aaagaaatagatggcatttaaa

SEQ ID NO: 49524 - DNA, 22 bp, Homo sapiens
aaagtgctgagattacaagcgt

SEQ ID NO: 49525 - DNA, 22 bp, Homo sapiens
aaagtgctgggattacaggcgt

SEQ ID NO: 49526 - DNA, 22 bp, Homo sapiens
aattttctggtgtgtaatgaag

SEQ ID NO: 49527 - DNA, 22 bp, Homo sapiens
tagctcaaaggttaagtgtgga

SEQ ID NO: 49528 - DNA, 23 bp, Homo sapiens
tgctggagaagcaaagttctgag

SEQ ID NO: 49529 - DNA, 22 bp, Homo sapiens
gacaattgcttttgccgaataa

SEQ ID NO: 49530 - DNA, 22 bp, Homo sapiens
atgcattgtcaggcaatttcat

SEQ ID NO: 49531 - DNA, 22 bp, Homo sapiens
ccaggagttggaggctgcagtg

SEQ ID NO: 49532 - DNA, 22 bp, Homo sapiens
cccagtttcaactttccagtgg

SEQ ID NO: 49533 - DNA, 22 bp, Homo sapiens
ggcttagcaactcctgaggctc

SEQ ID NO: 49534 - DNA, 22 bp, Homo sapiens
gctcaagccttctgcccacctc

SEQ ID NO: 49535 - DNA, 22 bp, Homo sapiens
agcattccacactgaagtctgc

SEQ ID NO: 49536 - DNA, 22 bp, Homo sapiens
tcaaattgtcatcttgataatg

SEQ ID NO: 49537 - DNA, 22 bp, Homo sapiens
aagagagtcagtctgagcacca

SEQ ID NO: 49538 - DNA, 22 bp, Homo sapiens
gagagtctaggaacctcatata

SEQ ID NO: 49539 - DNA, 22 bp, Homo sapiens
ctacttgttcactgtaggtcgc

SEQ ID NO: 49540 - DNA, 22 bp, Homo sapiens
atgagttgaagctacaagaggc

SEQ ID NO: 49541 - DNA, 22 bp, Homo sapiens
accatgttggccaagctggtct

SEQ ID NO: 49542 - DNA, 22 bp, Homo sapiens
tacatgctccttatgagaatct

SEQ ID NO: 49543 - DNA, 22 bp, Homo sapiens
ctgggaggcagaggttgtagtg

SEQ ID NO: 49544 - DNA, 22 bp, Homo sapiens
agaggggcccggttctccgtct

SEQ ID NO: 49545 - DNA, 22 bp, Homo sapiens
acatttttcacatttgtagggt

SEQ ID NO: 49546 - DNA, 22 bp, Homo sapiens
gcccagcgagcagaggtggacg

SEQ ID NO: 49547 - DNA, 22 bp, Homo sapiens
cctctgtgtctccaagaggcct

SEQ ID NO: 49548 - DNA, 20 bp, Homo sapiens
tttgagaccagtctgcccaa

SEQ ID NO: 49549 - DNA, 22 bp, Homo sapiens
cctgcgggctgtgctgaagcct

SEQ ID NO: 49550 - DNA, 22 bp, Homo sapiens
aaagtgctaggattacaagcgt

SEQ ID NO: 49551 - DNA, 20 bp, Homo sapiens
tttcttgtcggctgttgctg

SEQ ID NO: 49552 - DNA, 22 bp, Homo sapiens
tgagatgaataactcctgctaa

SEQ ID NO: 49553 - DNA, 22 bp, Homo sapiens
tctgacattttgagaatgacat

SEQ ID NO: 49554 - DNA, 22 bp, Homo sapiens
ctccagattccgtttattcagg

SEQ ID NO: 49555 - DNA, 22 bp, Homo sapiens
aggctcgcatgccctgcaccac

SEQ ID NO: 49556 - DNA, 22 bp, Homo sapiens
gggctgcatcagcaggacccgg

SEQ ID NO: 49557 - DNA, 22 bp, Homo sapiens
agctggggctgtggttgtgatt

SEQ ID NO: 49558 - DNA, 22 bp, Homo sapiens
tccttaggcaatttgggagagt

SEQ ID NO: 49559 - DNA, 22 bp, Homo sapiens
tagatacctgctggacctcatt

SEQ ID NO: 49560 - DNA, 22 bp, Homo sapiens
ggcgggaagttcttgcccactt

SEQ ID NO: 49561 - DNA, 22 bp, Homo sapiens
gagtcacatactatgtaataga

SEQ ID NO: 49562 - DNA, 22 bp, Homo sapiens
gcacttgtggatttgatataca

SEQ ID NO: 49563 - DNA, 22 bp, Homo sapiens
tctttgctattgtgaatagtgc

SEQ ID NO: 49564 - DNA, 22 bp, Homo sapiens
tggtggctaccaggtcctgggg

SEQ ID NO: 49565 - DNA, 22 bp, Homo sapiens
gtggcccatcacgtttcgcctt

SEQ ID NO: 49566 - DNA, 22 bp, Homo sapiens
tgtttacagctgatcaggcatc

SEQ ID NO: 49567 - DNA, 22 bp, Homo sapiens
agagcggggatagttaatattc

SEQ ID NO: 49568 - DNA, 22 bp, Homo sapiens
tccaaacgggagccaaatgagc

SEQ ID NO: 49569 - DNA, 22 bp, Homo sapiens
gggggctaccgtctctggagct

SEQ ID NO: 49570 - DNA, 22 bp, Homo sapiens
gaatgctaagcatgtgggagtt

SEQ ID NO: 49571 - DNA, 18 bp, Homo sapiens
gcactgaggaaaacctct

SEQ ID NO: 49572 - DNA, 22 bp, Homo sapiens
gagcccaggaagtggaggctga

SEQ ID NO: 49573 - DNA, 22 bp, Homo sapiens
ggagaggcttccagagtcgtgc

SEQ ID NO: 49574 - DNA, 22 bp, Homo sapiens
acctggccagtggggccgcgct

SEQ ID NO: 49575 - DNA, 22 bp, Homo sapiens
ctagttctagatccctgaggaa

SEQ ID NO: 49576 - DNA, 22 bp, Homo sapiens
tgccgctccaggtctcgcggtg

SEQ ID NO: 49577 - DNA, 22 bp, Homo sapiens
gctggaggatggactggaagaa

SEQ ID NO: 49578 - DNA, 22 bp, Homo sapiens
cacatttttactgccaacttaa

SEQ ID NO: 49579 - DNA, 22 bp, Homo sapiens
atatatttgagaatattcatga

SEQ ID NO: 49580 - DNA, 18 bp, Homo sapiens
acgtgctgtgccttttgc

SEQ ID NO: 49581 - DNA, 20 bp, Homo sapiens
atggggtgagtgacgccctc

SEQ ID NO: 49582 - DNA, 19 bp, Homo sapiens
tcctggggaggggcatggc

SEQ ID NO: 49583 - DNA, 22 bp, Homo sapiens
gctggggaggcagcagagaaca

SEQ ID NO: 49584 - DNA, 22 bp, Homo sapiens
aaattagtcatgttgtattact

SEQ ID NO: 49585 - DNA, 22 bp, Homo sapiens
tgataaacttagaaagaatgtt

SEQ ID NO: 49586 - DNA, 22 bp, Homo sapiens
ggccctggtcctaggggtggaa

SEQ ID NO: 49587 - DNA, 22 bp, Homo sapiens
cctgcttaacattgccatgaca

SEQ ID NO: 49588 - DNA, 22 bp, Homo sapiens
gggttgaggcggatgtcggcgg

SEQ ID NO: 49589 - DNA, 22 bp, Homo sapiens
tacagaggaggggattttaata

SEQ ID NO: 49590 - DNA, 22 bp, Homo sapiens
gaggcagaagttgcagtgagca

SEQ ID NO: 49591 - DNA, 22 bp, Homo sapiens
gccaggctgaggctctggaaga

SEQ ID NO: 49592 - DNA, 22 bp, Homo sapiens
gctctgccagcccaaggcgcag

SEQ ID NO: 49593 - DNA, 22 bp, Homo sapiens
attgttcaatgtaataattttg

SEQ ID NO: 49594 - DNA, 22 bp, Homo sapiens
gaggcctgggcaagggggtctg

SEQ ID NO: 49595 - DNA, 22 bp, Homo sapiens
acaagcgggccacagtgctggt

SEQ ID NO: 49596 - DNA, 22 bp, Homo sapiens
tgtgggtggcatcgtcctggcc

SEQ ID NO: 49597 - DNA, 19 bp, Homo sapiens
tttgatagggcataatata

SEQ ID NO: 49598 - DNA, 22 bp, Homo sapiens
agtgcattcctggggaagaagc

SEQ ID NO: 49599 - DNA, 22 bp, Homo sapiens
ggggtgtggacggctgtgccag

SEQ ID NO: 49600 - DNA, 22 bp, Homo sapiens
tcactgcaagctcctcctcctg

SEQ ID NO: 49601 - DNA, 22 bp, Homo sapiens
ttggccatctaagcccagccac

SEQ ID NO: 49602 - DNA, 22 bp, Homo sapiens
gatgcgggcccgctccactgcc

SEQ ID NO: 49603 - DNA, 22 bp, Homo sapiens
aatggaatacctaggtggccca

SEQ ID NO: 49604 - DNA, 22 bp, Homo sapiens
ttccgaacccggatctgctgct

SEQ ID NO: 49605 - DNA, 23 bp, Homo sapiens
tgagctgggcctgcaggggtctc

SEQ ID NO: 49606 - DNA, 22 bp, Homo sapiens
ggccagcctggggctcccagac

SEQ ID NO: 49607 - DNA, 22 bp, Homo sapiens
aggggatggagctggaaggcag

SEQ ID NO: 49608 - DNA, 22 bp, Homo sapiens
gggagaggttacccgagcaact

SEQ ID NO: 49609 - DNA, 22 bp, Homo sapiens
atgtttttaaatagacttacag

SEQ ID NO: 49610 - DNA, 22 bp, Homo sapiens
ggatgttctggggttctcttgt

SEQ ID NO: 49611 - DNA, 22 bp, Homo sapiens
agcaagattgaggcttcctcag

SEQ ID NO: 49612 - DNA, 22 bp, Homo sapiens
ctgccatgccactgtgactgca

SEQ ID NO: 49613 - DNA, 22 bp, Homo sapiens
agtctacaaagggaagcccttt

SEQ ID NO: 49614 - DNA, 22 bp, Homo sapiens
tctgttgcaatgtgcatggtga

SEQ ID NO: 49615 - DNA, 22 bp, Homo sapiens
ttacatgtggtgtgaagaagag

SEQ ID NO: 49616 - DNA, 22 bp, Homo sapiens
ctggcccaggtggtcgttgagg

SEQ ID NO: 49617 - DNA, 18 bp, Homo sapiens
cagcctctgattggttgc

SEQ ID NO: 49618 - DNA, 22 bp, Homo sapiens
cccgggaggtggagcttgcagt

SEQ ID NO: 49619 - DNA, 22 bp, Homo sapiens
gcatctaaataaacgtgggagt

SEQ ID NO: 49620 - DNA, 22 bp, Homo sapiens
catggcggtcaggatgtaggtg

SEQ ID NO: 49621 - DNA, 22 bp, Homo sapiens
ccttgtttctctcccagataag

SEQ ID NO: 49622 - DNA, 20 bp, Homo sapiens
gtgtggccaggagctgcgct

SEQ ID NO: 49623 - DNA, 22 bp, Homo sapiens
aggggaggtgtccccaaatctc

SEQ ID NO: 49624 - DNA, 22 bp, Homo sapiens
ttgttgtcattgtagaggattt

SEQ ID NO: 49625 - DNA, 22 bp, Homo sapiens
ggcatcttgttgctcaaatcta

SEQ ID NO: 49626 - DNA, 22 bp, Homo sapiens
gaggctgcagctatcagacatt

SEQ ID NO: 49627 - DNA, 22 bp, Homo sapiens
ttcacagtggtagtgcatttag

SEQ ID NO: 49628 - DNA, 22 bp, Homo sapiens
aatgccttggagagcctagagg

SEQ ID NO: 49629 - DNA, 22 bp, Homo sapiens
agagcacagggttttgtgccgg

SEQ ID NO: 49630 - DNA, 22 bp, Homo sapiens
ggcgccagcactgcagcgcctc

SEQ ID NO: 49631 - DNA, 22 bp, Homo sapiens
ccagcagagcatggggaggaag

SEQ ID NO: 49632 - DNA, 19 bp, Homo sapiens
acccagcccaggagtggca

SEQ ID NO: 49633 - DNA, 22 bp, Homo sapiens
cctggggccccgagccagaagc

SEQ ID NO: 49634 - DNA, 22 bp, Homo sapiens
tctgaggctgaatggactccgt

SEQ ID NO: 49635 - DNA, 22 bp, Homo sapiens
aaagtgctgtgattacaggcat

SEQ ID NO: 49636 - DNA, 22 bp, Homo sapiens
tggggcagttaataaacattct

SEQ ID NO: 49637 - DNA, 22 bp, Homo sapiens
gctctctgcagcctccttggag

SEQ ID NO: 49638 - DNA, 22 bp, Homo sapiens
agagagcagtggatcacctagc

SEQ ID NO: 49639 - DNA, 14 bp, Homo sapiens
gcaggcggatcact

SEQ ID NO: 49640 - DNA, 22 bp, Homo sapiens
tcacatctaattccatttctgc

SEQ ID NO: 49641 - DNA, 22 bp, Homo sapiens
ttgaataatatgcttcgttctc

SEQ ID NO: 49642 - DNA, 22 bp, Homo sapiens
tgtttcttacgtttttagaggc

SEQ ID NO: 49643 - DNA, 22 bp, Homo sapiens
tgggcttaggtcggaggcggcc

SEQ ID NO: 49644 - DNA, 22 bp, Homo sapiens
acccggagtcggaggttgcagt

SEQ ID NO: 49645 - DNA, 22 bp, Homo sapiens
ggaggctgaggcaggcggatca

SEQ ID NO: 49646 - DNA, 22 bp, Homo sapiens
aagacacaatgtagcccagcac

SEQ ID NO: 49647 - DNA, 22 bp, Homo sapiens
ggaggtagcctcaaaagcagct

SEQ ID NO: 49648 - DNA, 22 bp, Homo sapiens
atgttctacagatggaaagggg

SEQ ID NO: 49649 - DNA, 22 bp, Homo sapiens
attcacatttagcctctgacat

SEQ ID NO: 49650 - DNA, 21 bp, Homo sapiens
ctggccactgcacctcttcct

SEQ ID NO: 49651 - DNA, 22 bp, Homo sapiens
ttttaatactgctattgtagga

SEQ ID NO: 49652 - DNA, 22 bp, Homo sapiens
cggggccctggggctgaaggtc

SEQ ID NO: 49653 - DNA, 22 bp, Homo sapiens
gctggcaaggtgctggagggcc

SEQ ID NO: 49654 - DNA, 22 bp, Homo sapiens
ggctgcaggttggttggcagct

SEQ ID NO: 49655 - DNA, 22 bp, Homo sapiens
gagggagggactagcattctct

SEQ ID NO: 49656 - DNA, 22 bp, Homo sapiens
agggcgacaatggagagcgttt

SEQ ID NO: 49657 - DNA, 23 bp, Homo sapiens
cgcccagcctcagtgacctgggc

SEQ ID NO: 49658 - DNA, 22 bp, Homo sapiens
gactacaggtgtgtgccaccat

SEQ ID NO: 49659 - DNA, 22 bp, Homo sapiens
ggggtactggctggagccccac

SEQ ID NO: 49660 - DNA, 22 bp, Homo sapiens
ttttttgttgggtagaacggaa

SEQ ID NO: 49661 - DNA, 22 bp, Homo sapiens
ctgagggtcaacttgattgtat

SEQ ID NO: 49662 - DNA, 22 bp, Homo sapiens
aaagtgctgggattacaggcct

SEQ ID NO: 49663 - DNA, 22 bp, Homo sapiens
gtcccctgtccagggccagcca

SEQ ID NO: 49664 - DNA, 22 bp, Homo sapiens
atggggaagcaattggatttcc

SEQ ID NO: 49665 - DNA, 22 bp, Homo sapiens
cggctggtgtcgggcacagcaa

SEQ ID NO: 49666 - DNA, 22 bp, Homo sapiens
actggggtttaggcctgggcaa

SEQ ID NO: 49667 - DNA, 22 bp, Homo sapiens
tccctagtcgcatctgtggaga

SEQ ID NO: 49668 - DNA, 22 bp, Homo sapiens
tttgccctttctgagcctcatc

SEQ ID NO: 49669 - DNA, 18 bp, Homo sapiens
ggtgagggagctggaagc

SEQ ID NO: 49670 - DNA, 23 bp, Homo sapiens
ccagtgattgcctggaaggaggt

SEQ ID NO: 49671 - DNA, 23 bp, Homo sapiens
tgaatgtttattctcggtgcaga

SEQ ID NO: 49672 - DNA, 22 bp, Homo sapiens
ggtcgctgtgtaggttcagcta

SEQ ID NO: 49673 - DNA, 21 bp, Homo sapiens
gtggttctagagaaacagaat

SEQ ID NO: 49674 - DNA, 22 bp, Homo sapiens
gcgagtgccgagagggcagggc

SEQ ID NO: 49675 - DNA, 22 bp, Homo sapiens
agtcccaacagcttacaaggaa

SEQ ID NO: 49676 - DNA, 22 bp, Homo sapiens
aatgttacgatcaacaacacat

SEQ ID NO: 49677 - DNA, 22 bp, Homo sapiens
actgttgaagtgccagcttgat

SEQ ID NO: 49678 - DNA, 22 bp, Homo sapiens
actctgcctgcggtgggcggga

SEQ ID NO: 49679 - DNA, 22 bp, Homo sapiens
cccaggagttggaggctgcagt

SEQ ID NO: 49680 - DNA, 22 bp, Homo sapiens
gaagaaagatcaaatagtttcc

SEQ ID NO: 49681 - DNA, 22 bp, Homo sapiens
agggcgctgaaatactaacatg

SEQ ID NO: 49682 - DNA, 22 bp, Homo sapiens
ggggtcggggcatagccactta

SEQ ID NO: 49683 - DNA, 22 bp, Homo sapiens
gtcccataagtagtgcaacttg

SEQ ID NO: 49684 - DNA, 22 bp, Homo sapiens
gagacacaggcacagaagaggc

SEQ ID NO: 49685 - DNA, 22 bp, Homo sapiens
ctatgaccccagcatgaataag

SEQ ID NO: 49686 - DNA, 22 bp, Homo sapiens
cacagctgtgagaagggagcct

SEQ ID NO: 49687 - DNA, 22 bp, Homo sapiens
cggggttcatccatgctgtggc

SEQ ID NO: 49688 - DNA, 22 bp, Homo sapiens
atcaaatacaaagggcataagg

SEQ ID NO: 49689 - DNA, 22 bp, Homo sapiens
aacactgctgctgggttctgtg

SEQ ID NO: 49690 - DNA, 22 bp, Homo sapiens
ggggtgggcgtgcagggacacc

SEQ ID NO: 49691 - DNA, 19 bp, Homo sapiens
agggttacccgctgccacc

SEQ ID NO: 49692 - DNA, 22 bp, Homo sapiens
gctgcagtgagccaagatcgtg

SEQ ID NO: 49693 - DNA, 22 bp, Homo sapiens
gcccccgtagtagatgaggcgc

SEQ ID NO: 49694 - DNA, 22 bp, Homo sapiens
ccctgctgtcaggtgctgggag

SEQ ID NO: 49695 - DNA, 22 bp, Homo sapiens
ttctgcagtgttaacaatgtca

SEQ ID NO: 49696 - DNA, 22 bp, Homo sapiens
taaaatttgtccctgagtgttg

SEQ ID NO: 49697 - DNA, 22 bp, Homo sapiens
cgcgaggtggaggttgcagtga

SEQ ID NO: 49698 - DNA, 22 bp, Homo sapiens
taaagggtaggttttactgtaa

SEQ ID NO: 49699 - DNA, 22 bp, Homo sapiens
gaaaattattgaaaatggctct

SEQ ID NO: 49700 - DNA, 22 bp, Homo sapiens
gagagcaggaggcagcgggacg

SEQ ID NO: 49701 - DNA, 22 bp, Homo sapiens
tgaaatgttaaacaagtggctc

SEQ ID NO: 49702 - DNA, 22 bp, Homo sapiens
ggagaggggaacttgttgcttg

SEQ ID NO: 49703 - DNA, 22 bp, Homo sapiens
gagggggctagcgcagtgccca

SEQ ID NO: 49704 - DNA, 22 bp, Homo sapiens
tgacttcctgcactcaggtgat

SEQ ID NO: 49705 - DNA, 22 bp, Homo sapiens
agatacattgttctaagcattg

SEQ ID NO: 49706 - DNA, 22 bp, Homo sapiens
acattaaaattgggtggggtaa

SEQ ID NO: 49707 - DNA, 22 bp, Homo sapiens
cacgcacgctgggtggaggcgc

SEQ ID NO: 49708 - DNA, 18 bp, Homo sapiens
cttgttcttctcttggcg

SEQ ID NO: 49709 - DNA, 22 bp, Homo sapiens
agatggggtttcatcatgttgg

SEQ ID NO: 49710 - DNA, 22 bp, Homo sapiens
agccaggatggtctcgatcggc

SEQ ID NO: 49711 - DNA, 22 bp, Homo sapiens
tttaaaaaactagtctgagtct

SEQ ID NO: 49712 - DNA, 22 bp, Homo sapiens
ctacaaaagtaattgtggtttt

SEQ ID NO: 49713 - DNA, 22 bp, Homo sapiens
catgagataatttttctccagt

SEQ ID NO: 49714 - DNA, 22 bp, Homo sapiens
cttggtgccacagcagcttgcg

SEQ ID NO: 49715 - DNA, 22 bp, Homo sapiens
ttgaccactgaatggttctgaa

SEQ ID NO: 49716 - DNA, 22 bp, Homo sapiens
gtggggtctgtcctcttctggg

SEQ ID NO: 49717 - DNA, 22 bp, Homo sapiens
ggcaaggggtcaggctgagaca

SEQ ID NO: 49718 - DNA, 22 bp, Homo sapiens
ttacctaaaatagctcaattta

SEQ ID NO: 49719 - DNA, 22 bp, Homo sapiens
tgcagagtgaagacatcacccc

SEQ ID NO: 49720 - DNA, 22 bp, Homo sapiens
tgaaatgattatatggtgtttg

SEQ ID NO: 49721 - DNA, 22 bp, Homo sapiens
tgctccagcaccaagagctcca

SEQ ID NO: 49722 - DNA, 22 bp, Homo sapiens
atgcagaagactgaaaagctga

SEQ ID NO: 49723 - DNA, 22 bp, Homo sapiens
aagccgggcctgagaaatgaca

SEQ ID NO: 49724 - DNA, 22 bp, Homo sapiens
ttccgagtctccaaggggttgt

SEQ ID NO: 49725 - DNA, 22 bp, Homo sapiens
aaagtgctggtattacaggtgt

SEQ ID NO: 49726 - DNA, 22 bp, Homo sapiens
tcactgcaacctccacctcccg

SEQ ID NO: 49727 - DNA, 22 bp, Homo sapiens
cccaggctggagtgcagtggcg

SEQ ID NO: 49728 - DNA, 22 bp, Homo sapiens
ggggctgaacctggaggtggtc

SEQ ID NO: 49729 - DNA, 22 bp, Homo sapiens
gctggctgacagatttggggtg

SEQ ID NO: 49730 - DNA, 22 bp, Homo sapiens
ttgcccaggctggagtgcagtg

SEQ ID NO: 49731 - DNA, 22 bp, Homo sapiens
gcgggccaccttggagagcgct

SEQ ID NO: 49732 - DNA, 22 bp, Homo sapiens
gtcttagatttcaccgataatg

SEQ ID NO: 49733 - DNA, 22 bp, Homo sapiens
acagcccagctctttctctgca

SEQ ID NO: 49734 - DNA, 22 bp, Homo sapiens
ccaggaggtggagattgcagtg

SEQ ID NO: 49735 - DNA, 23 bp, Homo sapiens
aatgggtgcaactatccatgaca

SEQ ID NO: 49736 - DNA, 22 bp, Homo sapiens
gagatgggcgagaaggtggact

SEQ ID NO: 49737 - DNA, 22 bp, Homo sapiens
gtgctccctccttcctcaagga

SEQ ID NO: 49738 - DNA, 20 bp, Homo sapiens
tcactgtaacatttgggggg

SEQ ID NO: 49739 - DNA, 22 bp, Homo sapiens
acactgtgtgacttctgagact

SEQ ID NO: 49740 - DNA, 21 bp, Homo sapiens
cactccacttagaacagggtt

SEQ ID NO: 49741 - DNA, 22 bp, Homo sapiens
ttatacagggagtttccctgca

SEQ ID NO: 49742 - DNA, 22 bp, Homo sapiens
cagggggctcaaaggagagtgc

SEQ ID NO: 49743 - DNA, 22 bp, Homo sapiens
tgagccaagatcatgccgttgt

SEQ ID NO: 49744 - DNA, 21 bp, Homo sapiens
ggccgccgccttgtgctctgc

SEQ ID NO: 49745 - DNA, 22 bp, Homo sapiens
tacaaaaaattgatactgacga

SEQ ID NO: 49746 - DNA, 22 bp, Homo sapiens
gctcccaggatgaggagccagg

SEQ ID NO: 49747 - DNA, 22 bp, Homo sapiens
gctggccacagatccccaggga

SEQ ID NO: 49748 - DNA, 22 bp, Homo sapiens
aagaaggcggaccagaagggag

SEQ ID NO: 49749 - DNA, 22 bp, Homo sapiens
acagagcaatgcgtgttctcta

SEQ ID NO: 49750 - DNA, 19 bp, Homo sapiens
gcccagcgaaggggatgac

SEQ ID NO: 49751 - DNA, 22 bp, Homo sapiens
ttaaatattatgttgtctgcaa

SEQ ID NO: 49752 - DNA, 22 bp, Homo sapiens
gcccaggaggcagaggttgtgg

SEQ ID NO: 49753 - DNA, 22 bp, Homo sapiens
aacccgtgatcctgactcccct

SEQ ID NO: 49754 - DNA, 22 bp, Homo sapiens
tctgtagtaggttgtagttctt

SEQ ID NO: 49755 - DNA, 22 bp, Homo sapiens
cccaggagttagaggttgtggt

SEQ ID NO: 49756 - DNA, 22 bp, Homo sapiens
tcccagattcctgctcttatat

SEQ ID NO: 49757 - DNA, 22 bp, Homo sapiens
ttctagtgtccttggacttgct

SEQ ID NO: 49758 - DNA, 22 bp, Homo sapiens
ttccggacgcccgtcttccagc

SEQ ID NO: 49759 - DNA, 22 bp, Homo sapiens
ctgtggctctttagttgagcac

SEQ ID NO: 49760 - DNA, 17 bp, Homo sapiens
tactgaggggtctggag

SEQ ID NO: 49761 - DNA, 22 bp, Homo sapiens
aaaatcctgctgactcgagatg

SEQ ID NO: 49762 - DNA, 22 bp, Homo sapiens
tttgaagactactgggagtgaa

SEQ ID NO: 49763 - DNA, 22 bp, Homo sapiens
tggtggggccagacttcagctc

SEQ ID NO: 49764 - DNA, 22 bp, Homo sapiens
ccttttatagatcagtgtgtta

SEQ ID NO: 49765 - DNA, 22 bp, Homo sapiens
ggctccaccctgcttccagaag

SEQ ID NO: 49766 - DNA, 22 bp, Homo sapiens
tgtggtgccgagagtctggacg

SEQ ID NO: 49767 - DNA, 22 bp, Homo sapiens
gtctgctcatgctaccgcgggc

SEQ ID NO: 49768 - DNA, 22 bp, Homo sapiens
ttctatttttgtggaactgtag

SEQ ID NO: 49769 - DNA, 22 bp, Homo sapiens
cggaggttgaggctgcagtgag

SEQ ID NO: 49770 - DNA, 22 bp, Homo sapiens
agcctggtttaagcattttata

SEQ ID NO: 49771 - DNA, 22 bp, Homo sapiens
tgccgcagtgcggggagggccc

SEQ ID NO: 49772 - DNA, 22 bp, Homo sapiens
gtagatgagctcacatgacctt

SEQ ID NO: 49773 - DNA, 21 bp, Homo sapiens
cgtgactgggtccgtctggct

SEQ ID NO: 49774 - DNA, 22 bp, Homo sapiens
gggctgagacgatggggtcttc

SEQ ID NO: 49775 - DNA, 22 bp, Homo sapiens
agaggaggctctgggatcgtcc

SEQ ID NO: 49776 - DNA, 16 bp, Homo sapiens
tggggatggggaagag

SEQ ID NO: 49777 - DNA, 22 bp, Homo sapiens
atggcatttgaatctgtctttt

SEQ ID NO: 49778 - DNA, 22 bp, Homo sapiens
cggagtcttgctatgttgccca

SEQ ID NO: 49779 - DNA, 22 bp, Homo sapiens
aactcactttgtggcttctgaa

SEQ ID NO: 49780 - DNA, 22 bp, Homo sapiens
tccgccaggactgagggcccat

SEQ ID NO: 49781 - DNA, 21 bp, Homo sapiens
attctttgatgtgcaataagt

SEQ ID NO: 49782 - DNA, 23 bp, Homo sapiens
ccaagactgttaggagtggggag

SEQ ID NO: 49783 - DNA, 22 bp, Homo sapiens
caaagtgctgggattataggca

SEQ ID NO: 49784 - DNA, 22 bp, Homo sapiens
ggggcaggagcccttcttcagc

SEQ ID NO: 49785 - DNA, 22 bp, Homo sapiens
gagcctcgtggcggccactgcg

SEQ ID NO: 49786 - DNA, 22 bp, Homo sapiens
ccttcccatgcagcctgtctga

SEQ ID NO: 49787 - DNA, 22 bp, Homo sapiens
cttttcattgtttgtacatgca

SEQ ID NO: 49788 - DNA, 22 bp, Homo sapiens
gagatggagtctttttctgtca

SEQ ID NO: 49789 - DNA, 22 bp, Homo sapiens
atgcccaatgtcacaatttttg

SEQ ID NO: 49790 - DNA, 22 bp, Homo sapiens
gatattcctgaaggacagggtt

SEQ ID NO: 49791 - DNA, 22 bp, Homo sapiens
cctgtgcttggccagagaggtt

SEQ ID NO: 49792 - DNA, 22 bp, Homo sapiens
ttccaactttgtcatatattat

SEQ ID NO: 49793 - DNA, 22 bp, Homo sapiens
actgcacttcaccctgggtgac

SEQ ID NO: 49794 - DNA, 22 bp, Homo sapiens
gggaggttgaggctgcagtgag

SEQ ID NO: 49795 - DNA, 22 bp, Homo sapiens
tcaagcggactgagatactctg

SEQ ID NO: 49796 - DNA, 22 bp, Homo sapiens
atgtttaaagggttgagaaata

SEQ ID NO: 49797 - DNA, 22 bp, Homo sapiens
caaagtgctgggattacaggct

SEQ ID NO: 49798 - DNA, 22 bp, Homo sapiens
ttttctaacatctagtaatttg

SEQ ID NO: 49799 - DNA, 22 bp, Homo sapiens
taacaatacccattctaattac

SEQ ID NO: 49800 - DNA, 22 bp, Homo sapiens
tttttccacataccctaggcca

SEQ ID NO: 49801 - DNA, 22 bp, Homo sapiens
attgaaaataaggccagaaaca

SEQ ID NO: 49802 - DNA, 22 bp, Homo sapiens
ctgtctgaatcctaagcttcct

SEQ ID NO: 49803 - DNA, 22 bp, Homo sapiens
tgaggctccttgtagagagtgg

SEQ ID NO: 49804 - DNA, 22 bp, Homo sapiens
attctggacaaggcaagctcct

SEQ ID NO: 49805 - DNA, 22 bp, Homo sapiens
aggtggaaatggctttcctagg

SEQ ID NO: 49806 - DNA, 22 bp, Homo sapiens
aaaatcttgtgacttaggaagg

SEQ ID NO: 49807 - DNA, 22 bp, Homo sapiens
tttagattgtgacctcccccca

SEQ ID NO: 49808 - DNA, 22 bp, Homo sapiens
tccagctgaggtggcctctgtg

SEQ ID NO: 49809 - DNA, 22 bp, Homo sapiens
cacagacagtgtccctttgttg

SEQ ID NO: 49810 - DNA, 22 bp, Homo sapiens
aggtggagaagagatgggcagt

SEQ ID NO: 49811 - DNA, 22 bp, Homo sapiens
tgaccaatactgtggatgccag

SEQ ID NO: 49812 - DNA, 22 bp, Homo sapiens
gaccttcttgctgtgtcctaac

SEQ ID NO: 49813 - DNA, 22 bp, Homo sapiens
tattgtccaataggatgttcct

SEQ ID NO: 49814 - DNA, 22 bp, Homo sapiens
ccaggaggtggaggttgcggtg

SEQ ID NO: 49815 - DNA, 22 bp, Homo sapiens
ttaggcctttgattggggtgct

SEQ ID NO: 49816 - DNA, 22 bp, Homo sapiens
taaatcttctacatcatcataa

SEQ ID NO: 49817 - DNA, 22 bp, Homo sapiens
gtggcccaggttggagtgcagt

SEQ ID NO: 49818 - DNA, 22 bp, Homo sapiens
acagtcttcagaagggattggg

SEQ ID NO: 49819 - DNA, 22 bp, Homo sapiens
ctaggtgatccactgctctctt

SEQ ID NO: 49820 - DNA, 22 bp, Homo sapiens
aaagattaaatcaaattggtca

SEQ ID NO: 49821 - DNA, 22 bp, Homo sapiens
ctatacagcagcttactagtta

SEQ ID NO: 49822 - DNA, 22 bp, Homo sapiens
acagattcactgcactggccat

SEQ ID NO: 49823 - DNA, 22 bp, Homo sapiens
ggggccttggatctgtgccccg

SEQ ID NO: 49824 - DNA, 22 bp, Homo sapiens
tcactgcaacctccacctcctg

SEQ ID NO: 49825 - DNA, 22 bp, Homo sapiens
caagcgtggctgctctgatgga

SEQ ID NO: 49826 - DNA, 22 bp, Homo sapiens
gcttctggtgaggcctcaggaa

SEQ ID NO: 49827 - DNA, 22 bp, Homo sapiens
gtgcaaaagtaattgtggtttt

SEQ ID NO: 49828 - DNA, 22 bp, Homo sapiens
ttgtgctctgtgttatttaagg

SEQ ID NO: 49829 - DNA, 22 bp, Homo sapiens
attcgacaaccttgttttgtac

SEQ ID NO: 49830 - DNA, 22 bp, Homo sapiens
ctcccagccttcgccagtctga

SEQ ID NO: 49831 - DNA, 22 bp, Homo sapiens
ggtgacagtggttaaaatttgt

SEQ ID NO: 49832 - DNA, 20 bp, Homo sapiens
gggcagagccagccagtccc

SEQ ID NO: 49833 - DNA, 22 bp, Homo sapiens
ttcaatatgatattagctgtgg

SEQ ID NO: 49834 - DNA, 22 bp, Homo sapiens
cccacgttgaaccgcttacaga

SEQ ID NO: 49835 - DNA, 22 bp, Homo sapiens
aggaggggttctcgggtgctga

SEQ ID NO: 49836 - DNA, 22 bp, Homo sapiens
gaggcacagagtaggtgcacac

SEQ ID NO: 49837 - DNA, 22 bp, Homo sapiens
ctttttcctcgtagagcctaat

SEQ ID NO: 49838 - DNA, 22 bp, Homo sapiens
aacccgggaggcggaggttgtg

SEQ ID NO: 49839 - DNA, 22 bp, Homo sapiens
ctgggaggcagaggttgcagtg

SEQ ID NO: 49840 - DNA, 22 bp, Homo sapiens
gctcagacctgtaatcttagca

SEQ ID NO: 49841 - DNA, 22 bp, Homo sapiens
gggagctggagctggaagactc

SEQ ID NO: 49842 - DNA, 22 bp, Homo sapiens
aacccgggaggcagaggttgtg

SEQ ID NO: 49843 - DNA, 19 bp, Homo sapiens
tctgaagaattagagagca

SEQ ID NO: 49844 - DNA, 22 bp, Homo sapiens
aaagtgctgggattacaggctt

SEQ ID NO: 49845 - DNA, 17 bp, Homo sapiens
tgggatccgtctctgtg

SEQ ID NO: 49846 - DNA, 22 bp, Homo sapiens
gtaggtcagacataagaggaca

SEQ ID NO: 49847 - DNA, 22 bp, Homo sapiens
tcatgctatgagcgagggcctg

SEQ ID NO: 49848 - DNA, 22 bp, Homo sapiens
taggcatgcaaataaatgtgca

SEQ ID NO: 49849 - DNA, 22 bp, Homo sapiens
cgagagttagctaggagtcaca

SEQ ID NO: 49850 - DNA, 22 bp, Homo sapiens
ctgggggtcttgaaagggagag

SEQ ID NO: 49851 - DNA, 17 bp, Homo sapiens
tgcatgtcctttgttcc

SEQ ID NO: 49852 - DNA, 22 bp, Homo sapiens
tcccagtttttctccactaagg

SEQ ID NO: 49853 - DNA, 22 bp, Homo sapiens
aggtcaccatggcatgctccac

SEQ ID NO: 49854 - DNA, 22 bp, Homo sapiens
agccagggtctctcgctctgtt

SEQ ID NO: 49855 - DNA, 22 bp, Homo sapiens
gcctggattccttgtttctcag

SEQ ID NO: 49856 - DNA, 22 bp, Homo sapiens
aaatgtaagtctttgtttctta

SEQ ID NO: 49857 - DNA, 22 bp, Homo sapiens
acgcagtttgtggacatttttt

SEQ ID NO: 49858 - DNA, 22 bp, Homo sapiens
tcctgccgtcctccggggcctc

SEQ ID NO: 49859 - DNA, 22 bp, Homo sapiens
aagagaattctggttttcctat

SEQ ID NO: 49860 - DNA, 22 bp, Homo sapiens
ggaggtgggctaaggactctct

SEQ ID NO: 49861 - DNA, 22 bp, Homo sapiens
tttattggatatttacaagata

SEQ ID NO: 49862 - DNA, 22 bp, Homo sapiens
tctcctggtacccttcctagca

SEQ ID NO: 49863 - DNA, 22 bp, Homo sapiens
gcccagcccagaaaggttcgga

SEQ ID NO: 49864 - DNA, 22 bp, Homo sapiens
caagaatcaacattatttagtg

SEQ ID NO: 49865 - DNA, 22 bp, Homo sapiens
ttcccttaaattatggcatcta

SEQ ID NO: 49866 - DNA, 22 bp, Homo sapiens
aagtaaatatctgtagtcttta

SEQ ID NO: 49867 - DNA, 22 bp, Homo sapiens
tttgaggttagctagcagatca

SEQ ID NO: 49868 - DNA, 22 bp, Homo sapiens
agcctattccaggatgagctca

SEQ ID NO: 49869 - DNA, 22 bp, Homo sapiens
agaaatatgctgattagatgaa

SEQ ID NO: 49870 - DNA, 22 bp, Homo sapiens
ggggaccctcaggactgcgtct

SEQ ID NO: 49871 - DNA, 22 bp, Homo sapiens
agtaatcaatttttcggtggat

SEQ ID NO: 49872 - DNA, 22 bp, Homo sapiens
ttgtctaatgagctccacttca

SEQ ID NO: 49873 - DNA, 22 bp, Homo sapiens
tgattaatatcaccaccattgg

SEQ ID NO: 49874 - DNA, 22 bp, Homo sapiens
gtgctggggagataggaagaga

SEQ ID NO: 49875 - DNA, 22 bp, Homo sapiens
tctttcattctagtctgaggtt

SEQ ID NO: 49876 - DNA, 22 bp, Homo sapiens
gttactcttgagaggctgaggt

SEQ ID NO: 49877 - DNA, 22 bp, Homo sapiens
gtggcccaggctggagtgcagt

SEQ ID NO: 49878 - DNA, 22 bp, Homo sapiens
gtttacttgtgccttggcttaa

SEQ ID NO: 49879 - DNA, 22 bp, Homo sapiens
ttttcatttttgtagatgcaag

SEQ ID NO: 49880 - DNA, 22 bp, Homo sapiens
tttgcattgcattaagtattct

SEQ ID NO: 49881 - DNA, 22 bp, Homo sapiens
gggctgtaggagctggaatggg

SEQ ID NO: 49882 - DNA, 22 bp, Homo sapiens
tgatcaaaacattactccacca

SEQ ID NO: 49883 - DNA, 22 bp, Homo sapiens
cccaggaggtggagcttgcagt

SEQ ID NO: 49884 - DNA, 22 bp, Homo sapiens
acccagccatgttcagttctct

SEQ ID NO: 49885 - DNA, 22 bp, Homo sapiens
ttcagcttgctgactgcggcag

SEQ ID NO: 49886 - DNA, 21 bp, Homo sapiens
ccaccaggtcttctgctcggg

SEQ ID NO: 49887 - DNA, 20 bp, Homo sapiens
aggaaaaatggaaactggag

SEQ ID NO: 49888 - DNA, 22 bp, Homo sapiens
ctcttcatagcaaacatatggg

SEQ ID NO: 49889 - DNA, 22 bp, Homo sapiens
gtggcctggctggcaccacctc

SEQ ID NO: 49890 - DNA, 22 bp, Homo sapiens
cttgatctacatagtgaaaccc

SEQ ID NO: 49891 - DNA, 22 bp, Homo sapiens
ccactgtggaaagcagttcaga

SEQ ID NO: 49892 - DNA, 22 bp, Homo sapiens
ccctggaggttgaggctgcagt

SEQ ID NO: 49893 - DNA, 22 bp, Homo sapiens
ggtgccagatgaggcccgcgat

SEQ ID NO: 49894 - DNA, 22 bp, Homo sapiens
ctttgcttgacactgtgattgt

SEQ ID NO: 49895 - DNA, 18 bp, Homo sapiens
cttttcccctttggactc

SEQ ID NO: 49896 - DNA, 22 bp, Homo sapiens
acggggctagagaaggtttctt

SEQ ID NO: 49897 - DNA, 22 bp, Homo sapiens
gaggtagacttcttggaagtag

SEQ ID NO: 49898 - DNA, 22 bp, Homo sapiens
atatgcagtctcttgcccttct

SEQ ID NO: 49899 - DNA, 22 bp, Homo sapiens
ccaggcaggcgatggtgcagtg

SEQ ID NO: 49900 - DNA, 22 bp, Homo sapiens
actctgctctgtatttcactgt

SEQ ID NO: 49901 - DNA, 19 bp, Homo sapiens
gatttaaacgtggctctat

SEQ ID NO: 49902 - DNA, 22 bp, Homo sapiens
gaattttattactagtcaactg

SEQ ID NO: 49903 - DNA, 22 bp, Homo sapiens
tgcaaatgtgttttaaaccaaa

SEQ ID NO: 49904 - DNA, 22 bp, Homo sapiens
gcctggagaaaggaaggtggga

SEQ ID NO: 49905 - DNA, 20 bp, Homo sapiens
ataaaataactgccacaaga

SEQ ID NO: 49906 - DNA, 22 bp, Homo sapiens
tgtagctctccagccagcaagg

SEQ ID NO: 49907 - DNA, 22 bp, Homo sapiens
ataaaatttgctactgttaaat

SEQ ID NO: 49908 - DNA, 22 bp, Homo sapiens
tggccttgagagatcaaaaggt

SEQ ID NO: 49909 - DNA, 22 bp, Homo sapiens
tctctctgcagcccgggacact

SEQ ID NO: 49910 - DNA, 22 bp, Homo sapiens
ggaccaggactggtggtatctc

SEQ ID NO: 49911 - DNA, 22 bp, Homo sapiens
ccctggaggcggagcttgcagt

SEQ ID NO: 49912 - DNA, 21 bp, Homo sapiens
ggtgctcgctgatgaggagtg

SEQ ID NO: 49913 - DNA, 22 bp, Homo sapiens
gtggagggtgattgccggctgt

SEQ ID NO: 49914 - DNA, 22 bp, Homo sapiens
tagcccctgcctttgaacctgg

SEQ ID NO: 49915 - DNA, 22 bp, Homo sapiens
actgcactccagcctgggtgac

SEQ ID NO: 49916 - DNA, 21 bp, Homo sapiens
ccgtgctcggctatggaccac

SEQ ID NO: 49917 - DNA, 22 bp, Homo sapiens
ctgaaatgacggtttggggcaa

SEQ ID NO: 49918 - DNA, 22 bp, Homo sapiens
cggccaagccggggccccgaag

SEQ ID NO: 49919 - DNA, 15 bp, Homo sapiens
tggcccacccgttga

SEQ ID NO: 49920 - DNA, 22 bp, Homo sapiens
gggaggcagtgctggaggctgg

SEQ ID NO: 49921 - DNA, 22 bp, Homo sapiens
cagggtttcaccatgttagcag

SEQ ID NO: 49922 - DNA, 22 bp, Homo sapiens
gggaagtgatggagccaggatt

SEQ ID NO: 49923 - DNA, 22 bp, Homo sapiens
atcggcaagccccacaccgtcc

SEQ ID NO: 49924 - DNA, 14 bp, Homo sapiens
aagatcaccttcct

SEQ ID NO: 49925 - DNA, 22 bp, Homo sapiens
gttactcttccccggggtctgg

SEQ ID NO: 49926 - DNA, 22 bp, Homo sapiens
gcgtggcttagagtggggtacc

SEQ ID NO: 49927 - DNA, 22 bp, Homo sapiens
aagtggactaatacaaggacta

SEQ ID NO: 49928 - DNA, 22 bp, Homo sapiens
ctgagtttccagataagacctt

SEQ ID NO: 49929 - DNA, 22 bp, Homo sapiens
tagtaagttctcgcattgttat

SEQ ID NO: 49930 - DNA, 22 bp, Homo sapiens
ttgagggtctggatctgctgct

SEQ ID NO: 49931 - DNA, 22 bp, Homo sapiens
gatggaggagatggcagggtgc

SEQ ID NO: 49932 - DNA, 22 bp, Homo sapiens
agcccaggttgaggctgcagtg

SEQ ID NO: 49933 - DNA, 22 bp, Homo sapiens
accactgcccatggtgaaaact

SEQ ID NO: 49934 - DNA, 22 bp, Homo sapiens
cattggccttttatcctagagg

SEQ ID NO: 49935 - DNA, 22 bp, Homo sapiens
ggtggcagtagcactgggcctg

SEQ ID NO: 49936 - DNA, 22 bp, Homo sapiens
tcatggggccacagctgccagc

SEQ ID NO: 49937 - DNA, 22 bp, Homo sapiens
taagggttcagaatgcagtggt

SEQ ID NO: 49938 - DNA, 22 bp, Homo sapiens
cccaggaggtggaggctgcagt

SEQ ID NO: 49939 - DNA, 22 bp, Homo sapiens
tgggaggccgaggcaggtggat

SEQ ID NO: 49940 - DNA, 22 bp, Homo sapiens
ttccaaagaagttcacatttac

SEQ ID NO: 49941 - DNA, 22 bp, Homo sapiens
aagaataagaggatttagaaca

SEQ ID NO: 49942 - DNA, 22 bp, Homo sapiens
ctggccagatgttacgtccaat

SEQ ID NO: 49943 - DNA, 22 bp, Homo sapiens
gaaccattgttgaaaagaatag

SEQ ID NO: 49944 - DNA, 18 bp, Homo sapiens
gatcgggggcgccccaag

SEQ ID NO: 49945 - DNA, 22 bp, Homo sapiens
atatattttttgagacagagtc

SEQ ID NO: 49946 - DNA, 22 bp, Homo sapiens
acctttcagtgccctttctgtc

SEQ ID NO: 49947 - DNA, 22 bp, Homo sapiens
agggctggagccacagctggga

SEQ ID NO: 49948 - DNA, 23 bp, Homo sapiens
ggctgggagctccgggtgcacgt

SEQ ID NO: 49949 - DNA, 22 bp, Homo sapiens
ggtgacggggcccaggtttcct

SEQ ID NO: 49950 - DNA, 22 bp, Homo sapiens
gaagtgtagtcttgagccccca

SEQ ID NO: 49951 - DNA, 20 bp, Homo sapiens
ggcagagggcctgggagaag

SEQ ID NO: 49952 - DNA, 22 bp, Homo sapiens
gctgtgtccaggtgggggtgac

SEQ ID NO: 49953 - DNA, 22 bp, Homo sapiens
gacaatatagttgaatgagcaa

SEQ ID NO: 49954 - DNA, 22 bp, Homo sapiens
ggcggtctcagcaccctcttgg

SEQ ID NO: 49955 - DNA, 22 bp, Homo sapiens
ccccatgaagtagggtctctga

SEQ ID NO: 49956 - DNA, 22 bp, Homo sapiens
gggagtgggtttggcctaggcc

SEQ ID NO: 49957 - DNA, 22 bp, Homo sapiens
caaatgtataaatgtactttct

SEQ ID NO: 49958 - DNA, 22 bp, Homo sapiens
gggcggggggagctggaatgaa

SEQ ID NO: 49959 - DNA, 22 bp, Homo sapiens
tggcacagactgggccaaggaa

SEQ ID NO: 49960 - DNA, 22 bp, Homo sapiens
tttctcttcactgtgtgcctca

SEQ ID NO: 49961 - DNA, 22 bp, Homo sapiens
aatgagatggaattcccgccta

SEQ ID NO: 49962 - DNA, 22 bp, Homo sapiens
ctcagcagtatactctgaagat

SEQ ID NO: 49963 - DNA, 22 bp, Homo sapiens
ttgctaccattgataccagcac

SEQ ID NO: 49964 - DNA, 22 bp, Homo sapiens
ggtgggccacggcataacgggc

SEQ ID NO: 49965 - DNA, 22 bp, Homo sapiens
tgctgagcgcatccggcggccg

SEQ ID NO: 49966 - DNA, 22 bp, Homo sapiens
ctgggaggcggaggttgtagtg

SEQ ID NO: 49967 - DNA, 22 bp, Homo sapiens
agtgaaaacctaatcatgcagt

SEQ ID NO: 49968 - DNA, 17 bp, Homo sapiens
ggctgcagtccaggagg

SEQ ID NO: 49969 - DNA, 17 bp, Homo sapiens
tggtccaggtggagcca

SEQ ID NO: 49970 - DNA, 22 bp, Homo sapiens
tctcgctctgtcgcccaggctg

SEQ ID NO: 49971 - DNA, 22 bp, Homo sapiens
tcttttgtgattctttagttac

SEQ ID NO: 49972 - DNA, 22 bp, Homo sapiens
aggagggagcttaagccaggca

SEQ ID NO: 49973 - DNA, 22 bp, Homo sapiens
tgggtgagcggctgcacacccg

SEQ ID NO: 49974 - DNA, 19 bp, Homo sapiens
tcctgcccaccagccaggg

SEQ ID NO: 49975 - DNA, 22 bp, Homo sapiens
tattattgacatttacttggtg

SEQ ID NO: 49976 - DNA, 22 bp, Homo sapiens
aaagtaattgcagtttctgcca

SEQ ID NO: 49977 - DNA, 22 bp, Homo sapiens
cagagagaatcttggcagctga

SEQ ID NO: 49978 - DNA, 22 bp, Homo sapiens
tgggctgcaggggttgagagct

SEQ ID NO: 49979 - DNA, 22 bp, Homo sapiens
caggtgcctcaggatgagacaa

SEQ ID NO: 49980 - DNA, 21 bp, Homo sapiens
ggccccgcagacccagcacgt

SEQ ID NO: 49981 - DNA, 22 bp, Homo sapiens
gagtggggggtccgtctcagtg

SEQ ID NO: 49982 - DNA, 22 bp, Homo sapiens
gccctagcgccagctcagcacc

SEQ ID NO: 49983 - DNA, 21 bp, Homo sapiens
aaactgaccttgcctgagaca

SEQ ID NO: 49984 - DNA, 22 bp, Homo sapiens
ccaggctggagtgcagtggcac

SEQ ID NO: 49985 - DNA, 22 bp, Homo sapiens
tcgcccagctcatctcccacaa

SEQ ID NO: 49986 - DNA, 22 bp, Homo sapiens
tagcagaagttgcaaactaggg

SEQ ID NO: 49987 - DNA, 22 bp, Homo sapiens
atggccaggcacctctggctga

SEQ ID NO: 49988 - DNA, 22 bp, Homo sapiens
tccacgctgtgtgaccttgggc

SEQ ID NO: 49989 - DNA, 22 bp, Homo sapiens
tccattatacttctgattcaaa

SEQ ID NO: 49990 - DNA, 22 bp, Homo sapiens
acggtgaccaagcatcaccgag

SEQ ID NO: 49991 - DNA, 22 bp, Homo sapiens
gaggccacggaagggagctgtg

SEQ ID NO: 49992 - DNA, 22 bp, Homo sapiens
tcctccccaaagcccagcctgg

SEQ ID NO: 49993 - DNA, 22 bp, Homo sapiens
gaggggctgccctggtgtcagg

SEQ ID NO: 49994 - DNA, 22 bp, Homo sapiens
ggctttgggggtgtccaagaaa

SEQ ID NO: 49995 - DNA, 22 bp, Homo sapiens
gcatgtgtctttatagcagcat

SEQ ID NO: 49996 - DNA, 22 bp, Homo sapiens
gcaaacaaggacatacatcctg

SEQ ID NO: 49997 - DNA, 22 bp, Homo sapiens
aggtcacccgtttgactatcca

SEQ ID NO: 49998 - DNA, 22 bp, Homo sapiens
caaagtgctaggattacaggcg

SEQ ID NO: 49999 - DNA, 22 bp, Homo sapiens
acatgagatttgggtggtgata

SEQ ID NO: 50000 - DNA, 22 bp, Homo sapiens
aaggagcacacaatctagaacc

SEQ ID NO: 50001 - DNA, 22 bp, Homo sapiens
tgaacatgctgttgatggcctg

SEQ ID NO: 50002 - DNA, 22 bp, Homo sapiens
ggaggctgagaggtcgcagtgg

SEQ ID NO: 50003 - DNA, 22 bp, Homo sapiens
ggcagggcaggaaagtcaggaa

SEQ ID NO: 50004 - DNA, 22 bp, Homo sapiens
ggtagtcggccttgccctgggc

SEQ ID NO: 50005 - DNA, 22 bp, Homo sapiens
gaggggcacagtaaagggtccc

SEQ ID NO: 50006 - DNA, 22 bp, Homo sapiens
tccttgtaaaggagctctaaca

SEQ ID NO: 50007 - DNA, 22 bp, Homo sapiens
tccagaatcaatagcagttatc

SEQ ID NO: 50008 - DNA, 22 bp, Homo sapiens
tgtcatggggttgttttgtaca

SEQ ID NO: 50009 - DNA, 22 bp, Homo sapiens
ggtgaggggctcctctgcccgg

SEQ ID NO: 50010 - DNA, 22 bp, Homo sapiens
gatctcaaagcagtgtgggttg

SEQ ID NO: 50011 - DNA, 22 bp, Homo sapiens
gctgggctgcgtcggggaagcc

SEQ ID NO: 50012 - DNA, 22 bp, Homo sapiens
cagggtgctgcaccatccctca

SEQ ID NO: 50013 - DNA, 22 bp, Homo sapiens
gggttggatcctggtggctgcc

SEQ ID NO: 50014 - DNA, 22 bp, Homo sapiens
tttgtggcaggagcggagaccg

SEQ ID NO: 50015 - DNA, 22 bp, Homo sapiens
cagctacaaatacttttgtatg

SEQ ID NO: 50016 - DNA, 22 bp, Homo sapiens
gtgcccagcagcagcgtccccg

SEQ ID NO: 50017 - DNA, 22 bp, Homo sapiens
agaaagtgcttccctttggtga

SEQ ID NO: 50018 - DNA, 22 bp, Homo sapiens
tcctacacagataacagagacg

SEQ ID NO: 50019 - DNA, 22 bp, Homo sapiens
agtgcaggccccaggccaggcc

SEQ ID NO: 50020 - DNA, 22 bp, Homo sapiens
gctggaaatgattaaatggtga

SEQ ID NO: 50021 - DNA, 22 bp, Homo sapiens
gcctgtgacccagggcccagga

SEQ ID NO: 50022 - DNA, 22 bp, Homo sapiens
aggtggggaggagtgtctcttt

SEQ ID NO: 50023 - DNA, 22 bp, Homo sapiens
cttgaatgtcctgtggcaaagt

SEQ ID NO: 50024 - DNA, 22 bp, Homo sapiens
cctgacgaaaggcgtgctggag

SEQ ID NO: 50025 - DNA, 22 bp, Homo sapiens
tgacttgtctctttgggagaca

SEQ ID NO: 50026 - DNA, 22 bp, Homo sapiens
gtgtggtcgaagttctcccgga

SEQ ID NO: 50027 - DNA, 22 bp, Homo sapiens
ctctggaggtggaggttgcagt

SEQ ID NO: 50028 - DNA, 22 bp, Homo sapiens
tggttcctcaagcgctggcggc

SEQ ID NO: 50029 - DNA, 22 bp, Homo sapiens
cagcagcagtggctgcagaaca

SEQ ID NO: 50030 - DNA, 22 bp, Homo sapiens
caaagtgctgggattacaggtg

SEQ ID NO: 50031 - DNA, 22 bp, Homo sapiens
caggtagaggctgccatcagct

SEQ ID NO: 50032 - DNA, 22 bp, Homo sapiens
ggtagaaataatcttcaggctg

SEQ ID NO: 50033 - DNA, 22 bp, Homo sapiens
agagggatcaccctgtttctgg

SEQ ID NO: 50034 - DNA, 22 bp, Homo sapiens
aaagtgctgaaattacaggggt

SEQ ID NO: 50035 - DNA, 22 bp, Homo sapiens
ttgagacacagtttcactctgt

SEQ ID NO: 50036 - DNA, 22 bp, Homo sapiens
gcctccccaagcagcagggatt

SEQ ID NO: 50037 - DNA, 22 bp, Homo sapiens
accctaataatcacagactagt

SEQ ID NO: 50038 - DNA, 22 bp, Homo sapiens
tcactgcaagctctgccttccg

SEQ ID NO: 50039 - DNA, 22 bp, Homo sapiens
gcttccgcgatgtcctaggtgg

SEQ ID NO: 50040 - DNA, 22 bp, Homo sapiens
tgaaatgtgttctagtgttttg

SEQ ID NO: 50041 - DNA, 22 bp, Homo sapiens
gagatatgttggcagctggtat

SEQ ID NO: 50042 - DNA, 22 bp, Homo sapiens
gggagctgagctggaagagaat

SEQ ID NO: 50043 - DNA, 22 bp, Homo sapiens
aaagtgcaaggattacaggcat

SEQ ID NO: 50044 - DNA, 20 bp, Homo sapiens
caagggtttgcattggcttt

SEQ ID NO: 50045 - DNA, 22 bp, Homo sapiens
gcccagccacagtcactttcat

SEQ ID NO: 50046 - DNA, 22 bp, Homo sapiens
gggctgcactagggcaaggtga

SEQ ID NO: 50047 - DNA, 22 bp, Homo sapiens
tcccacaggtggagcttgcagt

SEQ ID NO: 50048 - DNA, 22 bp, Homo sapiens
tggggaaaatgcttgtagtcag

SEQ ID NO: 50049 - DNA, 22 bp, Homo sapiens
atggggagctcaccacctgttt

SEQ ID NO: 50050 - DNA, 22 bp, Homo sapiens
ttatttttaaaagttcacacag

SEQ ID NO: 50051 - DNA, 22 bp, Homo sapiens
gtgctttgttaagtctgaaatt

SEQ ID NO: 50052 - DNA, 21 bp, Homo sapiens
tgttttccaccttgaggcaag

SEQ ID NO: 50053 - DNA, 22 bp, Homo sapiens
ccgcggggcgtgggctcttacc

SEQ ID NO: 50054 - DNA, 22 bp, Homo sapiens
attggtagttttgtatttctct

SEQ ID NO: 50055 - DNA, 22 bp, Homo sapiens
ttgtgttaaggtgcatctagtg

SEQ ID NO: 50056 - DNA, 22 bp, Homo sapiens
cactgcactccagcctgggtga

SEQ ID NO: 50057 - DNA, 22 bp, Homo sapiens
gagctcatccccatggtccgtc

SEQ ID NO: 50058 - DNA, 22 bp, Homo sapiens
aggaaataggaccagacaaagc

SEQ ID NO: 50059 - DNA, 22 bp, Homo sapiens
taagaaatttagttatagaatg

SEQ ID NO: 50060 - DNA, 22 bp, Homo sapiens
cactgcacttcagcctgggtga

SEQ ID NO: 50061 - DNA, 22 bp, Homo sapiens
ccaggagttggaagctgccatg

SEQ ID NO: 50062 - DNA, 22 bp, Homo sapiens
gaggtaacactgttcagtgggc

SEQ ID NO: 50063 - DNA, 22 bp, Homo sapiens
ctctccattccctacagttttc

SEQ ID NO: 50064 - DNA, 23 bp, Homo sapiens
gtgcgccaggacaacctgacgga

SEQ ID NO: 50065 - DNA, 22 bp, Homo sapiens
acattaaacttgcttggctgta

SEQ ID NO: 50066 - DNA, 22 bp, Homo sapiens
ttgtcttttgtgggaaatatgg

SEQ ID NO: 50067 - DNA, 22 bp, Homo sapiens
atacaaaatatatactggagac

SEQ ID NO: 50068 - DNA, 22 bp, Homo sapiens
tgggcagggagctggaaccaca

SEQ ID NO: 50069 - DNA, 22 bp, Homo sapiens
gcaaatgctaaagtgtagagac

SEQ ID NO: 50070 - DNA, 22 bp, Homo sapiens
ttccggaaggttctctagaatt

SEQ ID NO: 50071 - DNA, 22 bp, Homo sapiens
aactaatacattaatacatgtg

SEQ ID NO: 50072 - DNA, 22 bp, Homo sapiens
gtcactgtatccaggttccagc

SEQ ID NO: 50073 - DNA, 22 bp, Homo sapiens
ccttacactgcctggggccacg

SEQ ID NO: 50074 - DNA, 22 bp, Homo sapiens
gctgctgcttgaaggctcggag

SEQ ID NO: 50075 - DNA, 22 bp, Homo sapiens
atttcccagggcctgggatttg

SEQ ID NO: 50076 - DNA, 22 bp, Homo sapiens
tgggggagctcagtccagccca

SEQ ID NO: 50077 - DNA, 22 bp, Homo sapiens
cccccagctctgctgggtcccg

SEQ ID NO: 50078 - DNA, 22 bp, Homo sapiens
tggcccagtatgtataatctta

SEQ ID NO: 50079 - DNA, 22 bp, Homo sapiens
agggatggagtgcggcccggac

SEQ ID NO: 50080 - DNA, 22 bp, Homo sapiens
gctcccagtctgatggaggaga

SEQ ID NO: 50081 - DNA, 22 bp, Homo sapiens
tcaaaattaaaccaacgtccag

SEQ ID NO: 50082 - DNA, 22 bp, Homo sapiens
tcactgcaagctccgccttccg

SEQ ID NO: 50083 - DNA, 22 bp, Homo sapiens
cactgcactccagcctgggaga

SEQ ID NO: 50084 - DNA, 22 bp, Homo sapiens
aaatgcctcattttctctcact

SEQ ID NO: 50085 - DNA, 22 bp, Homo sapiens
ccttgctcaagctagtgacggg

SEQ ID NO: 50086 - DNA, 22 bp, Homo sapiens
ggagagggtaggggtcctgccc

SEQ ID NO: 50087 - DNA, 22 bp, Homo sapiens
gcggcggagacagcaggaagcc

SEQ ID NO: 50088 - DNA, 22 bp, Homo sapiens
tggttgcctctcagagattccg

SEQ ID NO: 50089 - DNA, 22 bp, Homo sapiens
cccaggaggttgaggctgcagt

SEQ ID NO: 50090 - DNA, 22 bp, Homo sapiens
aaagtgctgggattacaagcgt

SEQ ID NO: 50091 - DNA, 22 bp, Homo sapiens
gggggaagaaagaacatggcat

SEQ ID NO: 50092 - DNA, 22 bp, Homo sapiens
tcggggtctttgacacgctctg

SEQ ID NO: 50093 - DNA, 22 bp, Homo sapiens
cccaggctggagtgtaatggtg

SEQ ID NO: 50094 - DNA, 22 bp, Homo sapiens
tccaagatctacagcagtttag

SEQ ID NO: 50095 - DNA, 22 bp, Homo sapiens
ttttatctgtgacatctggcag

SEQ ID NO: 50096 - DNA, 22 bp, Homo sapiens
ccagtgtatttttgggacctgc

SEQ ID NO: 50097 - DNA, 22 bp, Homo sapiens
aataaacaaatccttccttccc

SEQ ID NO: 50098 - DNA, 22 bp, Homo sapiens
gctgctttgtctgtaaaatgga

SEQ ID NO: 50099 - DNA, 22 bp, Homo sapiens
gccaccccataggtgttaggtg

SEQ ID NO: 50100 - DNA, 22 bp, Homo sapiens
gggcagagagctggaactcctt

SEQ ID NO: 50101 - DNA, 22 bp, Homo sapiens
gtgcagagaggaccttggggag

SEQ ID NO: 50102 - DNA, 22 bp, Homo sapiens
gagagtctagtgcacctagttt

SEQ ID NO: 50103 - DNA, 22 bp, Homo sapiens
ttagctcagaaaatttaaactt

SEQ ID NO: 50104 - DNA, 22 bp, Homo sapiens
tgcagattcaaatgaaatgcaa

SEQ ID NO: 50105 - DNA, 22 bp, Homo sapiens
tgggaagctgcattttaacaag

SEQ ID NO: 50106 - DNA, 22 bp, Homo sapiens
gtagaggggtgattctgtgaga

SEQ ID NO: 50107 - DNA, 22 bp, Homo sapiens
gaaagtgctctctctatacaca

SEQ ID NO: 50108 - DNA, 22 bp, Homo sapiens
aagattttcagtgcctaaaaca

SEQ ID NO: 50109 - DNA, 22 bp, Homo sapiens
ggcagcactgcagcttgttggg

SEQ ID NO: 50110 - DNA, 22 bp, Homo sapiens
aggactgggtgcagagggcatc

SEQ ID NO: 50111 - DNA, 22 bp, Homo sapiens
gcccaggaggagaggctgcagt

SEQ ID NO: 50112 - DNA, 22 bp, Homo sapiens
aatattatcaaaagctttttca

SEQ ID NO: 50113 - DNA, 22 bp, Homo sapiens
gcacggctaatttttgtatttt

SEQ ID NO: 50114 - DNA, 22 bp, Homo sapiens
caggcagggagctggaaaggat

SEQ ID NO: 50115 - DNA, 22 bp, Homo sapiens
aaatatcttaggagtatatgag

SEQ ID NO: 50116 - DNA, 22 bp, Homo sapiens
catgaaattgtattggcctcaa

SEQ ID NO: 50117 - DNA, 22 bp, Homo sapiens
gtaaaaggtcaaggccaagtct

SEQ ID NO: 50118 - DNA, 22 bp, Homo sapiens
cctggctgacagcttaattcca

SEQ ID NO: 50119 - DNA, 20 bp, Homo sapiens
ttgttagaggaatgccatag

SEQ ID NO: 50120 - DNA, 22 bp, Homo sapiens
gcaggagaacaaagcaagctgc

SEQ ID NO: 50121 - DNA, 22 bp, Homo sapiens
tggaaatgtttcttgagctcag

SEQ ID NO: 50122 - DNA, 22 bp, Homo sapiens
cccaggaggtcgaagctgcagt

SEQ ID NO: 50123 - DNA, 22 bp, Homo sapiens
aaagtgctgaaattacaggtgt

SEQ ID NO: 50124 - DNA, 22 bp, Homo sapiens
ctggtgtggactccgcgcggag

SEQ ID NO: 50125 - DNA, 22 bp, Homo sapiens
gctactgattgaccttggagag

SEQ ID NO: 50126 - DNA, 22 bp, Homo sapiens
tgctgggggtagctctgcgtag

SEQ ID NO: 50127 - DNA, 22 bp, Homo sapiens
acaaacagagttgaaaaatagg

SEQ ID NO: 50128 - DNA, 22 bp, Homo sapiens
aaagtgctgggattacaggcat

SEQ ID NO: 50129 - DNA, 22 bp, Homo sapiens
tatctgatacaacagaataaca

SEQ ID NO: 50130 - DNA, 22 bp, Homo sapiens
ctgggtggcagagcctgcagtg

SEQ ID NO: 50131 - DNA, 22 bp, Homo sapiens
gggctagcctcttccctgctcc

SEQ ID NO: 50132 - DNA, 22 bp, Homo sapiens
ccgggcctcgggacaccgggta

SEQ ID NO: 50133 - DNA, 22 bp, Homo sapiens
cgggttcacgccattctcctgc

SEQ ID NO: 50134 - DNA, 22 bp, Homo sapiens
atgaaatgctattttggctaga

SEQ ID NO: 50135 - DNA, 22 bp, Homo sapiens
cttctgagatgttgttttacag

SEQ ID NO: 50136 - DNA, 22 bp, Homo sapiens
agtgggccggacagcccaggcc

SEQ ID NO: 50137 - DNA, 22 bp, Homo sapiens
agaaaatgtgaacttgtgaatt

SEQ ID NO: 50138 - DNA, 22 bp, Homo sapiens
aaacttgagccaagggcttggg

SEQ ID NO: 50139 - DNA, 22 bp, Homo sapiens
cccaggcttttctcttgcccca

SEQ ID NO: 50140 - DNA, 22 bp, Homo sapiens
tatttcttttcgtgacttattg

SEQ ID NO: 50141 - DNA, 22 bp, Homo sapiens
ggatgcacgaaggcgcctcgga

SEQ ID NO: 50142 - DNA, 22 bp, Homo sapiens
attggccatttgcatgtattat

SEQ ID NO: 50143 - DNA, 22 bp, Homo sapiens
tgttgcccaggttctctcctgc

SEQ ID NO: 50144 - DNA, 23 bp, Homo sapiens
gacagagtgagaccttgtcttac

SEQ ID NO: 50145 - DNA, 22 bp, Homo sapiens
aggctgaggcaagaggatcact

SEQ ID NO: 50146 - DNA, 22 bp, Homo sapiens
actgcactccaacctgggtgac

SEQ ID NO: 50147 - DNA, 22 bp, Homo sapiens
gctgatgtatatagtgattgag

SEQ ID NO: 50148 - DNA, 22 bp, Homo sapiens
actgcacttcagcctgggtgtc

SEQ ID NO: 50149 - DNA, 22 bp, Homo sapiens
tggaggccagaggtactgggac

SEQ ID NO: 50150 - DNA, 17 bp, Homo sapiens
tcttggccagcttgctg

SEQ ID NO: 50151 - DNA, 22 bp, Homo sapiens
gggcttggcacatgggctcagc

SEQ ID NO: 50152 - DNA, 22 bp, Homo sapiens
cagcgtctcgttgtgggcctcg

SEQ ID NO: 50153 - DNA, 22 bp, Homo sapiens
cccaggaggcagagcttgcagt

SEQ ID NO: 50154 - DNA, 22 bp, Homo sapiens
cttgtcagccaattgtggattt

SEQ ID NO: 50155 - DNA, 22 bp, Homo sapiens
tcagggctgcagaagaggcagg

SEQ ID NO: 50156 - DNA, 22 bp, Homo sapiens
tcaaatgaagacagttgacttg

SEQ ID NO: 50157 - DNA, 22 bp, Homo sapiens
tgagacaggcttccttcttggg

SEQ ID NO: 50158 - DNA, 22 bp, Homo sapiens
attttctctttgtatatgctag

SEQ ID NO: 50159 - DNA, 22 bp, Homo sapiens
tgaagactcagaagctaagata

SEQ ID NO: 50160 - DNA, 22 bp, Homo sapiens
ggaggaggggtgactgaatgct

SEQ ID NO: 50161 - DNA, 22 bp, Homo sapiens
gcctccggagtcacagtgtctt

SEQ ID NO: 50162 - DNA, 22 bp, Homo sapiens
ggggccttttctgaatgtggaa

SEQ ID NO: 50163 - DNA, 22 bp, Homo sapiens
tagggcaatatttcccagaaaa

SEQ ID NO: 50164 - DNA, 22 bp, Homo sapiens
ttatttaatgtgatctgaagag

SEQ ID NO: 50165 - DNA, 23 bp, Homo sapiens
gctcatcaggcttagagtcaagg

SEQ ID NO: 50166 - DNA, 22 bp, Homo sapiens
agtggccctggagtgactcgta

SEQ ID NO: 50167 - DNA, 22 bp, Homo sapiens
ctcctggaggatagtgactggg

SEQ ID NO: 50168 - DNA, 22 bp, Homo sapiens
tctgttgactcctagcagccat

SEQ ID NO: 50169 - DNA, 22 bp, Homo sapiens
caggctggagttcagtggtgtg

SEQ ID NO: 50170 - DNA, 22 bp, Homo sapiens
ttgcccaggctggagtgcagta

SEQ ID NO: 50171 - DNA, 22 bp, Homo sapiens
tggattcacaccattctcctgc

SEQ ID NO: 50172 - DNA, 22 bp, Homo sapiens
ctgagcctcctgcttctatttc

SEQ ID NO: 50173 - DNA, 22 bp, Homo sapiens
gctaatcaatgttaaggctgtg

SEQ ID NO: 50174 - DNA, 22 bp, Homo sapiens
aataaaatggtcagttttctca

SEQ ID NO: 50175 - DNA, 22 bp, Homo sapiens
ctggcctaggaatggttttccg

SEQ ID NO: 50176 - DNA, 22 bp, Homo sapiens
cctgggaggctgaggctgcagt

SEQ ID NO: 50177 - DNA, 20 bp, Homo sapiens
ctcttccggaggggcgctcc

SEQ ID NO: 50178 - DNA, 22 bp, Homo sapiens
gtttctctgtctgttacattgg

SEQ ID NO: 50179 - DNA, 22 bp, Homo sapiens
tacaacaatttccacattagaa

SEQ ID NO: 50180 - DNA, 22 bp, Homo sapiens
ccaggaggcggaaggtacagtg

SEQ ID NO: 50181 - DNA, 22 bp, Homo sapiens
gcctccggagttgcagtgtctt

SEQ ID NO: 50182 - DNA, 22 bp, Homo sapiens
ttgctgttgatgatgtgataca

SEQ ID NO: 50183 - DNA, 22 bp, Homo sapiens
gttatataagacaaatcagagt

SEQ ID NO: 50184 - DNA, 21 bp, Homo sapiens
ccgccgctgatagctctgggc

SEQ ID NO: 50185 - DNA, 22 bp, Homo sapiens
cttgacactgtcactcaggcca

SEQ ID NO: 50186 - DNA, 22 bp, Homo sapiens
cccaggaggcagagatagcagt

SEQ ID NO: 50187 - DNA, 22 bp, Homo sapiens
ctgcatccatgttgctgcaaag

SEQ ID NO: 50188 - DNA, 22 bp, Homo sapiens
tgcaataactactttaatgttg

SEQ ID NO: 50189 - DNA, 22 bp, Homo sapiens
tttgtagcagcatgatttataa

SEQ ID NO: 50190 - DNA, 22 bp, Homo sapiens
tctcctggagcccagatgctgg

SEQ ID NO: 50191 - DNA, 22 bp, Homo sapiens
gcggggttccgtgccccagagt

SEQ ID NO: 50192 - DNA, 22 bp, Homo sapiens
ggaggtggaggttgcagtgagc

SEQ ID NO: 50193 - DNA, 22 bp, Homo sapiens
ggtcagccttggatttggtagc

SEQ ID NO: 50194 - DNA, 22 bp, Homo sapiens
cgtgaggggggtaaggcgtccg

SEQ ID NO: 50195 - DNA, 22 bp, Homo sapiens
tgggaggccaaggcaggcggat

SEQ ID NO: 50196 - DNA, 22 bp, Homo sapiens
tttaagaagttatgttataaat

SEQ ID NO: 50197 - DNA, 22 bp, Homo sapiens
ccaggctggagtatagtggcgc

SEQ ID NO: 50198 - DNA, 22 bp, Homo sapiens
cactgcagcctcgctctcctga

SEQ ID NO: 50199 - DNA, 19 bp, Homo sapiens
cggcccctcctctcgcgcc

SEQ ID NO: 50200 - DNA, 19 bp, Homo sapiens
ggctgccttctgctcatct

SEQ ID NO: 50201 - DNA, 22 bp, Homo sapiens
tagcttatcccacagtgcccag

SEQ ID NO: 50202 - DNA, 22 bp, Homo sapiens
gggaaatctcgtcctctattta

SEQ ID NO: 50203 - DNA, 20 bp, Homo sapiens
gccaacgcgctggggctgcc

SEQ ID NO: 50204 - DNA, 22 bp, Homo sapiens
gggcaggggtcagtggccccaa

SEQ ID NO: 50205 - DNA, 22 bp, Homo sapiens
tgtacacatggtgtacactccc

SEQ ID NO: 50206 - DNA, 22 bp, Homo sapiens
tagggtacatgtgcacaacatg

SEQ ID NO: 50207 - DNA, 22 bp, Homo sapiens
acaggggcaagggctcacggcc

SEQ ID NO: 50208 - DNA, 22 bp, Homo sapiens
aaccaggtgactcatggtgagc

SEQ ID NO: 50209 - DNA, 22 bp, Homo sapiens
aggacagagggaccagagccca

SEQ ID NO: 50210 - DNA, 22 bp, Homo sapiens
cctacagttatattcttgattg

SEQ ID NO: 50211 - DNA, 22 bp, Homo sapiens
gagccagactgcctgaagctca

SEQ ID NO: 50212 - DNA, 22 bp, Homo sapiens
tttcataatactgtacatgaaa

SEQ ID NO: 50213 - DNA, 22 bp, Homo sapiens
ctgtccatattcaaggggtagg

SEQ ID NO: 50214 - DNA, 22 bp, Homo sapiens
atgaaatatcttgaagaaattc

SEQ ID NO: 50215 - DNA, 22 bp, Homo sapiens
cactgcactccagcccgggcaa

SEQ ID NO: 50216 - DNA, 22 bp, Homo sapiens
ccattgcactccatcctgggca

SEQ ID NO: 50217 - DNA, 22 bp, Homo sapiens
ggccctggcagccacgaaagcc

SEQ ID NO: 50218 - DNA, 22 bp, Homo sapiens
cactgcactccagcctgggtca

SEQ ID NO: 50219 - DNA, 22 bp, Homo sapiens
acattacctggcatttgatctt

SEQ ID NO: 50220 - DNA, 22 bp, Homo sapiens
ctgggggcagcaagaagccatg

SEQ ID NO: 50221 - DNA, 22 bp, Homo sapiens
aggagcaccattgtgctggtgt

SEQ ID NO: 50222 - DNA, 22 bp, Homo sapiens
tgaagttgttaaggttgccatt

SEQ ID NO: 50223 - DNA, 22 bp, Homo sapiens
atgttatgtctgggaaggggta

SEQ ID NO: 50224 - DNA, 20 bp, Homo sapiens
agagatggggtatcaccgta

SEQ ID NO: 50225 - DNA, 22 bp, Homo sapiens
cccaggaggcgcaggttgcggt

SEQ ID NO: 50226 - DNA, 22 bp, Homo sapiens
agggccagcactcctggcagga

SEQ ID NO: 50227 - DNA, 22 bp, Homo sapiens
cgccggcttgaggcaggcggca

SEQ ID NO: 50228 - DNA, 22 bp, Homo sapiens
aactatgttaataagtttcatt

SEQ ID NO: 50229 - DNA, 22 bp, Homo sapiens
actgccctccagcctgggtgac

SEQ ID NO: 50230 - DNA, 22 bp, Homo sapiens
ggttcccggatctccgagtccc

SEQ ID NO: 50231 - DNA, 22 bp, Homo sapiens
tctgaaaactccatgagctcgt

SEQ ID NO: 50232 - DNA, 22 bp, Homo sapiens
ataaagtggaggtagtattcat

SEQ ID NO: 50233 - DNA, 23 bp, Homo sapiens
tcgttgaatagcaatagcacaac

SEQ ID NO: 50234 - DNA, 22 bp, Homo sapiens
cccaggggttcaaggctgcagt

SEQ ID NO: 50235 - DNA, 22 bp, Homo sapiens
tttgttttcaatgtgtcattca

SEQ ID NO: 50236 - DNA, 22 bp, Homo sapiens
tgggggtgtcctggtgcacaca

SEQ ID NO: 50237 - DNA, 22 bp, Homo sapiens
tcctgagataaatctcatgtga

SEQ ID NO: 50238 - DNA, 22 bp, Homo sapiens
acatcctcccgatctactggct

SEQ ID NO: 50239 - DNA, 20 bp, Homo sapiens
ttcatgggagcaaagaggcc

SEQ ID NO: 50240 - DNA, 22 bp, Homo sapiens
tgccaccccggaccccgaagtg

SEQ ID NO: 50241 - DNA, 22 bp, Homo sapiens
ctggctggagtgcaggtgagtg

SEQ ID NO: 50242 - DNA, 22 bp, Homo sapiens
ggtaccaccaattcagctgcca

SEQ ID NO: 50243 - DNA, 20 bp, Homo sapiens
tgtgatgggttctttcctgg

SEQ ID NO: 50244 - DNA, 22 bp, Homo sapiens
aaaaatcacttttataggcagc

SEQ ID NO: 50245 - DNA, 22 bp, Homo sapiens
tccttagacaaagagtgggctt

SEQ ID NO: 50246 - DNA, 22 bp, Homo sapiens
aagactgagtggcttaagaaaa

SEQ ID NO: 50247 - DNA, 22 bp, Homo sapiens
gtctcgtcaatggcaggttccc

SEQ ID NO: 50248 - DNA, 22 bp, Homo sapiens
aagcactttatgtcaatgtcct

SEQ ID NO: 50249 - DNA, 22 bp, Homo sapiens
aggggtgaaagagggccctcaa

SEQ ID NO: 50250 - DNA, 22 bp, Homo sapiens
taaaggtagtgtgacatattgt

SEQ ID NO: 50251 - DNA, 22 bp, Homo sapiens
ctgggatccacgggctcccaag

SEQ ID NO: 50252 - DNA, 22 bp, Homo sapiens
ctgccaggattctgtgaacccc

SEQ ID NO: 50253 - DNA, 22 bp, Homo sapiens
ctgggaggcggaggttgcagtg

SEQ ID NO: 50254 - DNA, 22 bp, Homo sapiens
catgagatttgggaggggccag

SEQ ID NO: 50255 - DNA, 22 bp, Homo sapiens
ccgccgtgcaggccgcgacgtg

SEQ ID NO: 50256 - DNA, 22 bp, Homo sapiens
gtggaggagaggcgccttgcgg

SEQ ID NO: 50257 - DNA, 22 bp, Homo sapiens
ggccagaagttggaaaagagcc

SEQ ID NO: 50258 - DNA, 22 bp, Homo sapiens
cagtgagctcatggccaagtca

SEQ ID NO: 50259 - DNA, 22 bp, Homo sapiens
tttccctttagcctgagaatcc

SEQ ID NO: 50260 - DNA, 22 bp, Homo sapiens
gatttttatataaagtgagaaa

SEQ ID NO: 50261 - DNA, 22 bp, Homo sapiens
ttggaacatgccggggtccagg

SEQ ID NO: 50262 - DNA, 22 bp, Homo sapiens
tctgctttcttactaaaaatga

SEQ ID NO: 50263 - DNA, 22 bp, Homo sapiens
ttggcttttatgcagcttaggt

SEQ ID NO: 50264 - DNA, 22 bp, Homo sapiens
tgtcttggttcttctgaaacac

SEQ ID NO: 50265 - DNA, 22 bp, Homo sapiens
ggtgacgaatccatagcatcga

SEQ ID NO: 50266 - DNA, 22 bp, Homo sapiens
ctggccaagatggtgaaacccc

SEQ ID NO: 50267 - DNA, 19 bp, Homo sapiens
agtcctggcctgggggacc

SEQ ID NO: 50268 - DNA, 22 bp, Homo sapiens
tcatctaagagtcttacattta

SEQ ID NO: 50269 - DNA, 22 bp, Homo sapiens
gcctcctgtcccaggctgagga

SEQ ID NO: 50270 - DNA, 22 bp, Homo sapiens
aacccgagggccccaggctcgg

SEQ ID NO: 50271 - DNA, 22 bp, Homo sapiens
cccagttgttgccggctctgga

SEQ ID NO: 50272 - DNA, 22 bp, Homo sapiens
gtgcacttgatctagacagatt

SEQ ID NO: 50273 - DNA, 22 bp, Homo sapiens
agtgaggggcagctgagtgggc

SEQ ID NO: 50274 - DNA, 22 bp, Homo sapiens
atcttctcatgtgtaatgaggt

SEQ ID NO: 50275 - DNA, 22 bp, Homo sapiens
agggggctccttggtgtgcaga

SEQ ID NO: 50276 - DNA, 23 bp, Homo sapiens
ctcaccaagcgccgccgctgtgt

SEQ ID NO: 50277 - DNA, 22 bp, Homo sapiens
agatttatgtggtcacactcag

SEQ ID NO: 50278 - DNA, 22 bp, Homo sapiens
aggctgagataggtggatcatt

SEQ ID NO: 50279 - DNA, 22 bp, Homo sapiens
ggcctgggctccgggagttact

SEQ ID NO: 50280 - DNA, 22 bp, Homo sapiens
ccctgtgggaactcctgagttg

SEQ ID NO: 50281 - DNA, 22 bp, Homo sapiens
ctgaggctggagtgcagtggtg

SEQ ID NO: 50282 - DNA, 22 bp, Homo sapiens
actgcactccagcctgggtgat

SEQ ID NO: 50283 - DNA, 22 bp, Homo sapiens
aaagtgctgggattacaagtgt

SEQ ID NO: 50284 - DNA, 22 bp, Homo sapiens
agaggctgcacttgctcatgat

SEQ ID NO: 50285 - DNA, 22 bp, Homo sapiens
gaggtagtttagttttggggaa

SEQ ID NO: 50286 - DNA, 22 bp, Homo sapiens
acgggctgggacggggaagctc

SEQ ID NO: 50287 - DNA, 22 bp, Homo sapiens
ttgcccagagtcacccagctca

SEQ ID NO: 50288 - DNA, 22 bp, Homo sapiens
cagtggcgtgatctctgctcac

SEQ ID NO: 50289 - DNA, 22 bp, Homo sapiens
tgggtgctctgcgaccgtaggg

SEQ ID NO: 50290 - DNA, 22 bp, Homo sapiens
gcggggggaggaacatcttgca

SEQ ID NO: 50291 - DNA, 22 bp, Homo sapiens
caaagtgctaggattataggtg

SEQ ID NO: 50292 - DNA, 22 bp, Homo sapiens
cccggacagaggggcagagtgt

SEQ ID NO: 50293 - DNA, 22 bp, Homo sapiens
ctggtaggggtgactgttatcg

SEQ ID NO: 50294 - DNA, 22 bp, Homo sapiens
agcgccactgcactccagcctg

SEQ ID NO: 50295 - DNA, 22 bp, Homo sapiens
gccccagcctcccgagtagctg

SEQ ID NO: 50296 - DNA, 22 bp, Homo sapiens
tgttgattagtgtttagactta

SEQ ID NO: 50297 - DNA, 22 bp, Homo sapiens
tgcccaggctggagtacagtgg

SEQ ID NO: 50298 - DNA, 22 bp, Homo sapiens
ttaataaagtatgaattggaaa

SEQ ID NO: 50299 - DNA, 22 bp, Homo sapiens
aatcacttagaacccaggaagt

SEQ ID NO: 50300 - DNA, 22 bp, Homo sapiens
gggagctgaaggagccggcggg

SEQ ID NO: 50301 - DNA, 22 bp, Homo sapiens
gaggaggcttccgggaggcacg

SEQ ID NO: 50302 - DNA, 22 bp, Homo sapiens
cttgtattaggaagaatgcttt

SEQ ID NO: 50303 - DNA, 22 bp, Homo sapiens
taacatttaaatttttcacata

SEQ ID NO: 50304 - DNA, 22 bp, Homo sapiens
cactgcactccatcctgggaaa

SEQ ID NO: 50305 - DNA, 22 bp, Homo sapiens
cgagagagacatggtgacctgc

SEQ ID NO: 50306 - DNA, 22 bp, Homo sapiens
gccttgtttcattacacgtggt

SEQ ID NO: 50307 - DNA, 22 bp, Homo sapiens
ttatgatttgccacagattggt

SEQ ID NO: 50308 - DNA, 22 bp, Homo sapiens
ctgagccaaggggacagtgaca

SEQ ID NO: 50309 - DNA, 22 bp, Homo sapiens
tgggaagggtcaacagctggaa

SEQ ID NO: 50310 - DNA, 22 bp, Homo sapiens
ggactgggaatcagggagatgc

SEQ ID NO: 50311 - DNA, 22 bp, Homo sapiens
tgcactccaggctgggtgacag

SEQ ID NO: 50312 - DNA, 22 bp, Homo sapiens
gcttaattctggctcagtttcc

SEQ ID NO: 50313 - DNA, 22 bp, Homo sapiens
gagctcattcattcattgcctg

SEQ ID NO: 50314 - DNA, 22 bp, Homo sapiens
ggctgtggcagctggaagtggt

SEQ ID NO: 50315 - DNA, 22 bp, Homo sapiens
catttacatttaaggttaatat

SEQ ID NO: 50316 - DNA, 22 bp, Homo sapiens
acccgccgcacgtccaggctga

SEQ ID NO: 50317 - DNA, 23 bp, Homo sapiens
aaataggagtatctggatcatga

SEQ ID NO: 50318 - DNA, 22 bp, Homo sapiens
gggaggctctgctcagcccccg

SEQ ID NO: 50319 - DNA, 22 bp, Homo sapiens
ttagggttacaccagcctcctg

SEQ ID NO: 50320 - DNA, 22 bp, Homo sapiens
cccgggaggtggaggttgcagt

SEQ ID NO: 50321 - DNA, 22 bp, Homo sapiens
ggtcacgtgaccgcacctgcct

SEQ ID NO: 50322 - DNA, 22 bp, Homo sapiens
tgcctcaagccctccactgcac

SEQ ID NO: 50323 - DNA, 22 bp, Homo sapiens
gctgctgggatcctgggtctca

SEQ ID NO: 50324 - DNA, 22 bp, Homo sapiens
gttcaagaccagcctggccaac

SEQ ID NO: 50325 - DNA, 20 bp, Homo sapiens
cgcccagtgcggttctgacc

SEQ ID NO: 50326 - DNA, 22 bp, Homo sapiens
ctgaagagaaagggagctcttc

SEQ ID NO: 50327 - DNA, 22 bp, Homo sapiens
ttactggctgggcctgagggct

SEQ ID NO: 50328 - DNA, 22 bp, Homo sapiens
tataaagagtctcaaagaagtt

SEQ ID NO: 50329 - DNA, 22 bp, Homo sapiens
tggcacaggatctcagcggcca

SEQ ID NO: 50330 - DNA, 22 bp, Homo sapiens
tagatctgatacaattcatctg

SEQ ID NO: 50331 - DNA, 22 bp, Homo sapiens
caaagtgctggaattacaggtg

SEQ ID NO: 50332 - DNA, 22 bp, Homo sapiens
aagtgatgctacgactttgaca

SEQ ID NO: 50333 - DNA, 22 bp, Homo sapiens
cccgggaggcggaggttgcagt

SEQ ID NO: 50334 - DNA, 22 bp, Homo sapiens
tcgaaataatttagaatataga

SEQ ID NO: 50335 - DNA, 22 bp, Homo sapiens
caggagtgtctccacacagcaa

SEQ ID NO: 50336 - DNA, 22 bp, Homo sapiens
gcgccccatctacagtactttt

SEQ ID NO: 50337 - DNA, 22 bp, Homo sapiens
tctagttctagatccctgagga

SEQ ID NO: 50338 - DNA, 22 bp, Homo sapiens
gccatcatatcccctgtgacct

SEQ ID NO: 50339 - DNA, 23 bp, Homo sapiens
attttttgtctttgtaactagat

SEQ ID NO: 50340 - DNA, 22 bp, Homo sapiens
atggccgcctgtccttcccgcc

SEQ ID NO: 50341 - DNA, 22 bp, Homo sapiens
agaaaacataggagacaggaaa

SEQ ID NO: 50342 - DNA, 22 bp, Homo sapiens
tggtagtcggcctcggtggctc

SEQ ID NO: 50343 - DNA, 22 bp, Homo sapiens
aaaaaattatcatagttcctga

SEQ ID NO: 50344 - DNA, 22 bp, Homo sapiens
ggtccccgtggaggctggagcg

SEQ ID NO: 50345 - DNA, 22 bp, Homo sapiens
tctggtgtcagtattctttgaa

SEQ ID NO: 50346 - DNA, 22 bp, Homo sapiens
cactgttttacatgttatttaa

SEQ ID NO: 50347 - DNA, 22 bp, Homo sapiens
ggggtggatttcaggcggtgtc

SEQ ID NO: 50348 - DNA, 22 bp, Homo sapiens
cgagagatgggttggcaggggc

SEQ ID NO: 50349 - DNA, 22 bp, Homo sapiens
ttggaagttgatttaaaaagga

SEQ ID NO: 50350 - DNA, 22 bp, Homo sapiens
atgagaaagttaatcatcatga

SEQ ID NO: 50351 - DNA, 22 bp, Homo sapiens
tggggtgagattcagatattca

SEQ ID NO: 50352 - DNA, 22 bp, Homo sapiens
tttctggcagcgggacaggggt

SEQ ID NO: 50353 - DNA, 22 bp, Homo sapiens
aacccacaaaggatttcagctc

SEQ ID NO: 50354 - DNA, 22 bp, Homo sapiens
atttttctctttccactgagat

SEQ ID NO: 50355 - DNA, 22 bp, Homo sapiens
tgtttgagttctagcgcattta

SEQ ID NO: 50356 - DNA, 21 bp, Homo sapiens
tgcaatccagcctgggcgaca

SEQ ID NO: 50357 - DNA, 22 bp, Homo sapiens
gctgggttttcttccgggccta

SEQ ID NO: 50358 - DNA, 22 bp, Homo sapiens
gagcacagtaaagcagtgtcac

SEQ ID NO: 50359 - DNA, 18 bp, Homo sapiens
tgagaggctattttttgc

SEQ ID NO: 50360 - DNA, 22 bp, Homo sapiens
tgggcgacagagcaagactccg

SEQ ID NO: 50361 - DNA, 22 bp, Homo sapiens
ttaatgacaggataggctctga

SEQ ID NO: 50362 - DNA, 21 bp, Homo sapiens
ctgtgatgttgccggggtagg

SEQ ID NO: 50363 - DNA, 22 bp, Homo sapiens
ggagaagaggagctggaagcct

SEQ ID NO: 50364 - DNA, 22 bp, Homo sapiens
ctgcagggagaggggacagcct

SEQ ID NO: 50365 - DNA, 22 bp, Homo sapiens
tccacaaggcagctcctccagg

SEQ ID NO: 50366 - DNA, 22 bp, Homo sapiens
tgatttacagtagtgtctaaac

SEQ ID NO: 50367 - DNA, 22 bp, Homo sapiens
ttattttaccttcctctgagct

SEQ ID NO: 50368 - DNA, 22 bp, Homo sapiens
cggtctcccgtgtgtgtgcgct

SEQ ID NO: 50369 - DNA, 22 bp, Homo sapiens
ttcccactgtggcagagcctcg

SEQ ID NO: 50370 - DNA, 22 bp, Homo sapiens
atggggctgttctctgccctgc

SEQ ID NO: 50371 - DNA, 22 bp, Homo sapiens
gagctgggcctgcgagtgctgc

SEQ ID NO: 50372 - DNA, 22 bp, Homo sapiens
aggctagaggcttctggcttca

SEQ ID NO: 50373 - DNA, 22 bp, Homo sapiens
acatgtttaagtttgttatatg

SEQ ID NO: 50374 - DNA, 22 bp, Homo sapiens
ggctgccttccctgagccccgg

SEQ ID NO: 50375 - DNA, 22 bp, Homo sapiens
tctgttttgcataatgttcttt

SEQ ID NO: 50376 - DNA, 22 bp, Homo sapiens
cgtcattgtcctggacttgcaa

SEQ ID NO: 50377 - DNA, 22 bp, Homo sapiens
acagtccagcctagtatgtata

SEQ ID NO: 50378 - DNA, 22 bp, Homo sapiens
cccaggaggtcaaggctgcagt

SEQ ID NO: 50379 - DNA, 22 bp, Homo sapiens
aagggggcggcagccagtggaa

SEQ ID NO: 50380 - DNA, 22 bp, Homo sapiens
acccgatgttggtgctctagta

SEQ ID NO: 50381 - DNA, 22 bp, Homo sapiens
gcgttggggaccccgaagctgg

SEQ ID NO: 50382 - DNA, 22 bp, Homo sapiens
caggagtccatctggcctggtg

SEQ ID NO: 50383 - DNA, 22 bp, Homo sapiens
tcctcagaatcacctggcagct

SEQ ID NO: 50384 - DNA, 22 bp, Homo sapiens
caggctgatcagggctgggatg

SEQ ID NO: 50385 - DNA, 22 bp, Homo sapiens
gttggctatgagagctttagtg

SEQ ID NO: 50386 - DNA, 22 bp, Homo sapiens
gaggtggatgttgcagtgagct

SEQ ID NO: 50387 - DNA, 22 bp, Homo sapiens
tgctccatgcgctcggccggcg

SEQ ID NO: 50388 - DNA, 22 bp, Homo sapiens
tggagggcatgctgtccatggg

SEQ ID NO: 50389 - DNA, 22 bp, Homo sapiens
tatgttgcaccaacctaataat

SEQ ID NO: 50390 - DNA, 22 bp, Homo sapiens
ctggagggctgcagcgaggctg

SEQ ID NO: 50391 - DNA, 22 bp, Homo sapiens
ctccagttggccccagttggtt

SEQ ID NO: 50392 - DNA, 20 bp, Homo sapiens
attagctcaggtgaggtcat

SEQ ID NO: 50393 - DNA, 17 bp, Homo sapiens
cgggcatggagggcagg

SEQ ID NO: 50394 - DNA, 22 bp, Homo sapiens
gaggcagaggttgcagtgagct

SEQ ID NO: 50395 - DNA, 22 bp, Homo sapiens
gtggccaacctggccctgaact

SEQ ID NO: 50396 - DNA, 22 bp, Homo sapiens
cccgggaggcagaggttgcagt

SEQ ID NO: 50397 - DNA, 22 bp, Homo sapiens
ctggcaggtggaggttgcagtg

SEQ ID NO: 50398 - DNA, 22 bp, Homo sapiens
cgcccaggctggagagcagtgg

SEQ ID NO: 50399 - DNA, 22 bp, Homo sapiens
ccaggaggttgaggctgcagtg

SEQ ID NO: 50400 - DNA, 22 bp, Homo sapiens
tctctttgcctgctgccatcca

SEQ ID NO: 50401 - DNA, 22 bp, Homo sapiens
agggctgcccagtgtgagagct

SEQ ID NO: 50402 - DNA, 21 bp, Homo sapiens
caaaagagactgattcttgga

SEQ ID NO: 50403 - DNA, 22 bp, Homo sapiens
aggagctgtcagagtgccagag

SEQ ID NO: 50404 - DNA, 22 bp, Homo sapiens
tggggagtgatgcctcggataa

SEQ ID NO: 50405 - DNA, 22 bp, Homo sapiens
cgccgtcccctaggaaagagct

SEQ ID NO: 50406 - DNA, 22 bp, Homo sapiens
tccaggctttggggcaggagcg

SEQ ID NO: 50407 - DNA, 22 bp, Homo sapiens
aggcgcctgcgggatccttgcc

SEQ ID NO: 50408 - DNA, 22 bp, Homo sapiens
catgtgaattccaaagctaggt

SEQ ID NO: 50409 - DNA, 22 bp, Homo sapiens
tgcgggtcccagggtcacaggc

SEQ ID NO: 50410 - DNA, 18 bp, Homo sapiens
gcaagtgtctgtcccctt

SEQ ID NO: 50411 - DNA, 22 bp, Homo sapiens
ggaaggggtgggtgagcctcag

SEQ ID NO: 50412 - DNA, 22 bp, Homo sapiens
gtggccaaatcatgtcaaaggc

SEQ ID NO: 50413 - DNA, 22 bp, Homo sapiens
tagggggctttgctgcttgaca

SEQ ID NO: 50414 - DNA, 22 bp, Homo sapiens
catggggcccatgtgctccaag

SEQ ID NO: 50415 - DNA, 21 bp, Homo sapiens
gcccacagtgaggaggatccc

SEQ ID NO: 50416 - DNA, 22 bp, Homo sapiens
tcagtttttctatactttgtag

SEQ ID NO: 50417 - DNA, 22 bp, Homo sapiens
ggttttatcctacccacacagc

SEQ ID NO: 50418 - DNA, 22 bp, Homo sapiens
tcgggctcgctctcctagcgga

SEQ ID NO: 50419 - DNA, 22 bp, Homo sapiens
atacaaaaattagccgggagta

SEQ ID NO: 50420 - DNA, 22 bp, Homo sapiens
ctagggtcaggggcctgcgtcg

SEQ ID NO: 50421 - DNA, 22 bp, Homo sapiens
aaagtgctcggattacaggtat

SEQ ID NO: 50422 - DNA, 22 bp, Homo sapiens
caaagtgctaggattacaggcc

SEQ ID NO: 50423 - DNA, 22 bp, Homo sapiens
tagaactacaagcattaaaagt

SEQ ID NO: 50424 - DNA, 22 bp, Homo sapiens
catttacatttaaggttaatat

SEQ ID NO: 50425 - DNA, 22 bp, Homo sapiens
ataaaatttgctactgttaaat

SEQ ID NO: 50426 - DNA, 22 bp, Homo sapiens
taagagaatgttgtggctaggt

SEQ ID NO: 50427 - DNA, 22 bp, Homo sapiens
tgtacaatgctgaggtttgggg

SEQ ID NO: 50428 - DNA, 22 bp, Homo sapiens
ttaataaagtatgaattggaaa

SEQ ID NO: 50429 - DNA, 22 bp, Homo sapiens
taattataacagttacatctta

SEQ ID NO: 50430 - DNA, 22 bp, Homo sapiens
atgaaaacggaccagagctatt

SEQ ID NO: 50431 - DNA, 22 bp, Homo sapiens
atttcatactaaggctcaaaaa

SEQ ID NO: 50432 - DNA, 22 bp, Homo sapiens
agaatttcctatgagagattcc

SEQ ID NO: 50433 - DNA, 22 bp, Homo sapiens
tcaccgtcgggggtcgctgtct

SEQ ID NO: 50434 - DNA, 22 bp, Homo sapiens
atggcatttgaatctgtctttt

SEQ ID NO: 50435 - DNA, 22 bp, Homo sapiens
gtgaataaaacacctgccaaga

SEQ ID NO: 50436 - DNA, 22 bp, Homo sapiens
aagaatgagctcaaagatctta

SEQ ID NO: 50437 - DNA, 22 bp, Homo sapiens
catcagaacgtgagctccttgt

SEQ ID NO: 50438 - DNA, 23 bp, Homo sapiens
aatatcaaggtgatgttcccaga

SEQ ID NO: 50439 - DNA, 22 bp, Homo sapiens
tgtccttatctccaaacaatca

SEQ ID NO: 50440 - DNA, 22 bp, Homo sapiens
atacataattacttccgatgtt

SEQ ID NO: 50441 - DNA, 22 bp, Homo sapiens
ttgaataatatgcttcgttctc

SEQ ID NO: 50442 - DNA, 22 bp, Homo sapiens
atggatttgcttatacacatgt

SEQ ID NO: 50443 - DNA, 22 bp, Homo sapiens
ttagtactgatagggtcaatca

SEQ ID NO: 50444 - DNA, 22 bp, Homo sapiens
tggttttagggaatcaatctat

SEQ ID NO: 50445 - DNA, 22 bp, Homo sapiens
tcaaaattaaaccaacgtccag

SEQ ID NO: 50446 - DNA, 22 bp, Homo sapiens
gcaaaaagtagtgctggttagg

SEQ ID NO: 50447 - DNA, 22 bp, Homo sapiens
ttttcatttttgtagatgcaag

SEQ ID NO: 50448 - DNA, 22 bp, Homo sapiens
tgtcaccatgcgaggctaattt

SEQ ID NO: 50449 - DNA, 22 bp, Homo sapiens
ttggtccactgtgaaattggga

SEQ ID NO: 50450 - DNA, 22 bp, Homo sapiens
atgaaatatcttgaagaaattc

SEQ ID NO: 50451 - DNA, 22 bp, Homo sapiens
actttaattaatgaactgtggc

SEQ ID NO: 50452 - DNA, 22 bp, Homo sapiens
atggatcagaatcccgggaggg

SEQ ID NO: 50453 - DNA, 22 bp, Homo sapiens
attgaaaataaggccagaaaca

SEQ ID NO: 50454 - DNA, 22 bp, Homo sapiens
tccaaagtgttgggattatagg

SEQ ID NO: 50455 - DNA, 22 bp, Homo sapiens
ctctaatcctttgtccctgggt

SEQ ID NO: 50456 - DNA, 22 bp, Homo sapiens
ttaattctgcctttcatgtaac

SEQ ID NO: 50457 - DNA, 22 bp, Homo sapiens
tttcataatactgtacatgaaa

SEQ ID NO: 50458 - DNA, 22 bp, Homo sapiens
gaataatcatgaaattcagtga

SEQ ID NO: 50459 - DNA, 22 bp, Homo sapiens
aatcagaaattgagggtctggt

SEQ ID NO: 50460 - DNA, 22 bp, Homo sapiens
gtatagaaacccagaaagatag

SEQ ID NO: 50461 - DNA, 22 bp, Homo sapiens
aaattgcaaaagtacttttagg

SEQ ID NO: 50462 - DNA, 22 bp, Homo sapiens
aatattatcaaaagctttttca

SEQ ID NO: 50463 - DNA, 22 bp, Homo sapiens
atcacaaaggtctcagagcaca

SEQ ID NO: 50464 - DNA, 22 bp, Homo sapiens
aaaactgaaatacgatccaatg

SEQ ID NO: 50465 - DNA, 22 bp, Homo sapiens
taatttcagtgcaagctcacgg

SEQ ID NO: 50466 - DNA, 22 bp, Homo sapiens
gaatttcacaaggtgaggataa

SEQ ID NO: 50467 - DNA, 22 bp, Homo sapiens
ctggatcatgggaaagggatca

SEQ ID NO: 50468 - DNA, 22 bp, Homo sapiens
tgtatgttgggtcaaagtacat

SEQ ID NO: 50469 - DNA, 22 bp, Homo sapiens
caagaatcaacattatttagtg

SEQ ID NO: 50470 - DNA, 22 bp, Homo sapiens
agatctgagggtccaagggagg

SEQ ID NO: 50471 - DNA, 22 bp, Homo sapiens
tacaaaaaattgatactgacga

SEQ ID NO: 50472 - DNA, 22 bp, Homo sapiens
ggcgcacaatgtgcaggtttgt

SEQ ID NO: 50473 - DNA, 22 bp, Homo sapiens
gcaaacaaggacatacatcctg

SEQ ID NO: 50474 - DNA, 22 bp, Homo sapiens
acaactttgacccttgttctta

SEQ ID NO: 50475 - DNA, 22 bp, Homo sapiens
aataaaatggtcagttttctca

SEQ ID NO: 50476 - DNA, 22 bp, Homo sapiens
cagtcaccttgaggactcagac

SEQ ID NO: 50477 - DNA, 22 bp, Homo sapiens
tggtatgaccgtggtgcaagca

SEQ ID NO: 50478 - DNA, 22 bp, Homo sapiens
gggcactcagctgtagagcagg

SEQ ID NO: 50479 - DNA, 22 bp, Homo sapiens
tcttgcacttcatgaatatgtt

SEQ ID NO: 50480 - DNA, 22 bp, Homo sapiens
cggctgggttcggctgcaggcc

SEQ ID NO: 50481 - DNA, 22 bp, Homo sapiens
tcccagtttttctccactaagg

SEQ ID NO: 50482 - DNA, 22 bp, Homo sapiens
ttggagatatcacaccttcaca

SEQ ID NO: 50483 - DNA, 22 bp, Homo sapiens
tggtgcaaaactaattgcggtt

SEQ ID NO: 50484 - DNA, 22 bp, Homo sapiens
ctggtaggggtgactgttatcg

SEQ ID NO: 50485 - DNA, 22 bp, Homo sapiens
ggctgggctccgggagcatgcg

SEQ ID NO: 50486 - DNA, 20 bp, Homo sapiens
ttctccagtgcggtagccat

SEQ ID NO: 50487 - DNA, 22 bp, Homo sapiens
cactgcactccagcctgggcaa

SEQ ID NO: 50488 - DNA, 22 bp, Homo sapiens
ggatgttctggggttctcttgt

SEQ ID NO: 50489 - DNA, 22 bp, Homo sapiens
ggcatagatttctttaggttta

SEQ ID NO: 50490 - DNA, 22 bp, Homo sapiens
attggccatttgcatgtattat

SEQ ID NO: 50491 - DNA, 22 bp, Homo sapiens
gttactcttgagaggctgaggt

SEQ ID NO: 50492 - DNA, 22 bp, Homo sapiens
cctactctgagcgcctccgcat

SEQ ID NO: 50493 - DNA, 22 bp, Homo sapiens
ggctagggatctagaccaggac

SEQ ID NO: 50494 - DNA, 22 bp, Homo sapiens
ggctcactgcaacttccgcctc

SEQ ID NO: 50495 - DNA, 22 bp, Homo sapiens
agggaagaggaccagagtctct

SEQ ID NO: 50496 - DNA, 22 bp, Homo sapiens
ctctccattccctacagttttc

SEQ ID NO: 50497 - DNA, 22 bp, Homo sapiens
tctcccaggcaggagtgcagtg

SEQ ID NO: 50498 - DNA, 22 bp, Homo sapiens
ggaaggggtgggtgagcctcag

SEQ ID NO: 50499 - DNA, 22 bp, Homo sapiens
cctcggggcaccgcggcctgct

SEQ ID NO: 50500 - DNA, 22 bp, Homo sapiens
aggccaggaatccttgtcccag

SEQ ID NO: 50501 - DNA, 22 bp, Homo sapiens
agggccagcactcctggcagga

SEQ ID NO: 50502 - DNA, 22 bp, Homo sapiens
tgtctggtgggttgacaggcag

SEQ ID NO: 50503 - DNA, 22 bp, Homo sapiens
gttcaagaccagcctggccaac

SEQ ID NO: 50504 - DNA, 22 bp, Homo sapiens
agggcgacaatggagagcgttt

SEQ ID NO: 50505 - DNA, 22 bp, Homo sapiens
gagctgggcctgcgagtgctgc

SEQ ID NO: 50506 - DNA, 22 bp, Homo sapiens
tcgttatagaacattcttgggt

SEQ ID NO: 50507 - DNA, 18 bp, Homo sapiens
ctgcactcccgcctgggc

SEQ ID NO: 50508 - DNA, 22 bp, Homo sapiens
actgcactccagcctgggcgac

SEQ ID NO: 50509 - DNA, 22 bp, Homo sapiens
gggagaggttacccgagcaact

SEQ ID NO: 50510 - DNA, 22 bp, Homo sapiens
gctgcactttgactgctggggt

SEQ ID NO: 50511 - DNA, 20 bp, Homo sapiens
tcagccattccttacctttc

SEQ ID NO: 50512 - DNA, 22 bp, Homo sapiens
actgcactccagcctgggcggc

SEQ ID NO: 50513 - DNA, 22 bp, Homo sapiens
tcctttgcttctgtcattctcc

SEQ ID NO: 50514 - DNA, 22 bp, Homo sapiens
gaatttcctctaaacccctgag

SEQ ID NO: 50515 - DNA, 22 bp, Homo sapiens
aggagggagcttaagccaggca

SEQ ID NO: 50516 - DNA, 22 bp, Homo sapiens
aggctagaggcttctggcttca

SEQ ID NO: 50517 - DNA, 22 bp, Homo sapiens
caggaggacatactggctcaca

SEQ ID NO: 50518 - DNA, 22 bp, Homo sapiens
aggaggggttctcgggtgctga

SEQ ID NO: 50519 - DNA, 22 bp, Homo sapiens
ctgggcacagcgttgggctctt

SEQ ID NO: 50520 - DNA, 22 bp, Homo sapiens
ggaggtggaggttgcagtgagc

SEQ ID NO: 50521 - DNA, 22 bp, Homo sapiens
ggcaaggggtcaggctgagaca

SEQ ID NO: 50522 - DNA, 22 bp, Homo sapiens
aagagggctgcaatcttattgc

SEQ ID NO: 50523 - DNA, 22 bp, Homo sapiens
cctcggtttccacatctgtaca

SEQ ID NO: 50524 - DNA, 22 bp, Homo sapiens
gcaggagaacaaagcaagctgc

SEQ ID NO: 50525 - DNA, 22 bp, Homo sapiens
tctacctggagtccgttgttaa

SEQ ID NO: 50526 - DNA, 22 bp, Homo sapiens
agccaggatggtctcgatcggc

SEQ ID NO: 50527 - DNA, 22 bp, Homo sapiens
ccttttgctctcccatccagaa

SEQ ID NO: 50528 - DNA, 22 bp, Homo sapiens
tggcctcggcatccagcaagag

SEQ ID NO: 50529 - DNA, 22 bp, Homo sapiens
agagcagctcgctacctctcta

SEQ ID NO: 50530 - DNA, 22 bp, Homo sapiens
gttgctcaggcaggagtacagt

SEQ ID NO: 50531 - DNA, 22 bp, Homo sapiens
gtggtggtcaccaaattgaggg

SEQ ID NO: 50532 - DNA, 22 bp, Homo sapiens
tgccctctttctgtacagctcc

SEQ ID NO: 50533 - DNA, 23 bp, Homo sapiens
gcagaggagcaagctggacacca

SEQ ID NO: 50534 - DNA, 22 bp, Homo sapiens
tcactcaggctggagtgcagtg

SEQ ID NO: 50535 - DNA, 22 bp, Homo sapiens
cgctgataaacgtcacgttccc

SEQ ID NO: 50536 - DNA, 22 bp, Homo sapiens
gctcagaggcacgacctcttgg

SEQ ID NO: 50537 - DNA, 22 bp, Homo sapiens
gcccagtggtaaaagcaggcct

SEQ ID NO: 50538 - DNA, 22 bp, Homo sapiens
cctcggggcaccgcggcctgct

SEQ ID NO: 50539 - DNA, 22 bp, Homo sapiens
cacgcacgctgggtggaggcgc

SEQ ID NO: 50540 - DNA, 22 bp, Homo sapiens
gtccccgacgtttggcttgatg

SEQ ID NO: 50541 - DNA, 22 bp, Homo sapiens
aataaaatggtcagttttctca

SEQ ID NO: 50542 - DNA, 22 bp, Homo sapiens
tggaaacacccacgcatgcata

SEQ ID NO: 50543 - DNA, 22 bp, Homo sapiens
atctggctcccttggaatccgt

SEQ ID NO: 50544 - DNA, 22 bp, Homo sapiens
ccacccttgggttcggaggccg

SEQ ID NO: 50545 - DNA, 22 bp, Homo sapiens
aacattgaacttggcacaccca

SEQ ID NO: 50546 - DNA, 22 bp, Homo sapiens
cattgcactcctgcctgggcaa

SEQ ID NO: 50547 - DNA, 22 bp, Homo sapiens
gcaggtggatcaccacgtcagg

SEQ ID NO: 50548 - DNA, 22 bp, Homo sapiens
gcgagtccactggggggcgcag

SEQ ID NO: 50549 - DNA, 22 bp, Homo sapiens
gcaaatacatgttgagcaccta

SEQ ID NO: 50550 - DNA, 22 bp, Homo sapiens
gagggccctggctggctccagc

SEQ ID NO: 50551 - DNA, 22 bp, Homo sapiens
ctgaacttattgagtgcttgct

SEQ ID NO: 50552 - DNA, 22 bp, Homo sapiens
attgtaacagacacatcagatt

SEQ ID NO: 50553 - DNA, 22 bp, Homo sapiens
tgctccagcaccaagagctcca

SEQ ID NO: 50554 - DNA, 23 bp, Homo sapiens
tctacaaagctgtgtcaggaccc

SEQ ID NO: 50555 - DNA, 22 bp, Homo sapiens
ccaccgccttggcgtgttcccc

SEQ ID NO: 50556 - DNA, 22 bp, Homo sapiens
cattgcactccagcctgggtaa

SEQ ID NO: 50557 - DNA, 22 bp, Homo sapiens
aactcactttgtggcttctgaa

SEQ ID NO: 50558 - DNA, 22 bp, Homo sapiens
gggagctgagctggaagagaat

SEQ ID NO: 50559 - DNA, 22 bp, Homo sapiens
tgctgggggtagctctgcgtag

SEQ ID NO: 50560 - DNA, 19 bp, Homo sapiens
tcctggggaggggcatggc

SEQ ID NO: 50561 - DNA, 22 bp, Homo sapiens
cgtgatgaatggtgagacccgc

SEQ ID NO: 50562 - DNA, 22 bp, Homo sapiens
ctctggcaattgctgctgactc

SEQ ID NO: 50563 - DNA, 22 bp, Homo sapiens
tcccagtttttctccactaagg

SEQ ID NO: 50564 - DNA, 22 bp, Homo sapiens
tgggcccgcagctgctgctcca

SEQ ID NO: 50565 - DNA, 18 bp, Homo sapiens
ggctggataccttaggaa

SEQ ID NO: 50566 - DNA, 22 bp, Homo sapiens
aggactgggtgcagagggcatc

SEQ ID NO: 50567 - DNA, 22 bp, Homo sapiens
ctctgctgtgccgccagggcct

SEQ ID NO: 50568 - DNA, 22 bp, Homo sapiens
aatgtgaggccttggtagttat

SEQ ID NO: 50569 - DNA, 22 bp, Homo sapiens
aaacttgagccaagggcttggg

SEQ ID NO: 50570 - DNA, 22 bp, Homo sapiens
gctggggaggcagcagagaaca

SEQ ID NO: 50571 - DNA, 22 bp, Homo sapiens
gagccaggttggaggctgcagt

SEQ ID NO: 50572 - DNA, 22 bp, Homo sapiens
tgcagcactgttcacaatagcc

SEQ ID NO: 50573 - DNA, 22 bp, Homo sapiens
cactgcactccagcctgggtca

SEQ ID NO: 50574 - DNA, 22 bp, Homo sapiens
actgcgctccagcctgggtgac

SEQ ID NO: 50575 - DNA, 22 bp, Homo sapiens
acagcagcaatagcagtgacat

SEQ ID NO: 50576 - DNA, 22 bp, Homo sapiens
aataatctcactttatgtggaa

SEQ ID NO: 50577 - DNA, 22 bp, Homo sapiens
cttggattcctcatatgcacag

SEQ ID NO: 50578 - DNA, 22 bp, Homo sapiens
gaggctggacgtgcatttctac

SEQ ID NO: 50579 - DNA, 22 bp, Homo sapiens
aacccaggagttggaggctgtg

SEQ ID NO: 50580 - DNA, 22 bp, Homo sapiens
tagctcaaaggttaagtgtgga

SEQ ID NO: 50581 - DNA, 22 bp, Homo sapiens
cacatgaaggctggggtcgtga

SEQ ID NO: 50582 - DNA, 22 bp, Homo sapiens
gggcggatcatttgaggtcagg

SEQ ID NO: 50583 - DNA, 22 bp, Homo sapiens
aggtgggcggattcatgaggtc

SEQ ID NO: 50584 - DNA, 22 bp, Homo sapiens
cacttgttggtggtgaaatcac

SEQ ID NO: 50585 - DNA, 22 bp, Homo sapiens
gcccaggctggagtgcagtggt

SEQ ID NO: 50586 - DNA, 22 bp, Homo sapiens
ggtccccgtggaggctggagcg

SEQ ID NO: 50587 - DNA, 22 bp, Homo sapiens
agcgccactgcactccagcctg

SEQ ID NO: 50588 - DNA, 22 bp, Homo sapiens
agtgctgtctccttcccccggg

SEQ ID NO: 50589 - DNA, 22 bp, Homo sapiens
gctctgccagcccaaggcgcag

SEQ ID NO: 50590 - DNA, 19 bp, Homo sapiens
tcctgcccaccagccaggg

SEQ ID NO: 50591 - DNA, 22 bp, Homo sapiens
atgttggagtcgtaaggcatgg

SEQ ID NO: 50592 - DNA, 22 bp, Homo sapiens
gctcgcgccgcaccggtccacc

SEQ ID NO: 50593 - DNA, 22 bp, Homo sapiens
attataggcttgagccaccgtg

SEQ ID NO: 50594 - DNA, 21 bp, Homo sapiens
cagaggcctatcacagactcc

SEQ ID NO: 50595 - DNA, 22 bp, Homo sapiens
gagggcccgcacctcgaaactc

SEQ ID NO: 50596 - DNA, 22 bp, Homo sapiens
tttctggcagcgggacaggggt

SEQ ID NO: 50597 - DNA, 21 bp, Homo sapiens
tggcggggacttgtggctgcc

SEQ ID NO: 50598 - DNA, 22 bp, Homo sapiens
gttgcctaggctggtcttgaac

SEQ ID NO: 50599 - DNA, 22 bp, Homo sapiens
agcttagtggttgtatgagtta

SEQ ID NO: 50600 - DNA, 22 bp, Homo sapiens
agcaggcctgccacctcggggt

SEQ ID NO: 50601 - DNA, 22 bp, Homo sapiens
agttattactctttaacatatt

SEQ ID NO: 50602 - DNA, 22 bp, Homo sapiens
aagccaaagtgggcatgcctca

SEQ ID NO: 50603 - DNA, 22 bp, Homo sapiens
cccattcatcctcgcttccttc

SEQ ID NO: 50604 - DNA, 22 bp, Homo sapiens
tacatttataaggcttctctgt

SEQ ID NO: 50605 - DNA, 22 bp, Homo sapiens
tggccggggctgatggacagtg

SEQ ID NO: 50606 - DNA, 19 bp, Homo sapiens
gctgttaaggaccctcgga

SEQ ID NO: 50607 - DNA, 22 bp, Homo sapiens
gtggggcctgtggcttccgtgg

SEQ ID NO: 50608 - DNA, 22 bp, Homo sapiens
aagtgctgggattacaggcgtg

SEQ ID NO: 50609 - DNA, 22 bp, Homo sapiens
tgggaagctgcattttaacaag

SEQ ID NO: 50610 - DNA, 22 bp, Homo sapiens
ctgaggctggagtgcagtggtg

SEQ ID NO: 50611 - DNA, 22 bp, Homo sapiens
tccttgaaaggggctgcagggc

SEQ ID NO: 50612 - DNA, 22 bp, Homo sapiens
tgttttggtggtctataggaaa

SEQ ID NO: 50613 - DNA, 22 bp, Homo sapiens
agggatggagtgcggcccggac

SEQ ID NO: 50614 - DNA, 22 bp, Homo sapiens
tcaggggcttgaggtgcatgtc

SEQ ID NO: 50615 - DNA, 22 bp, Homo sapiens
ttgagggtctggatctgctgct

SEQ ID NO: 50616 - DNA, 22 bp, Homo sapiens
tctggctctggagtccacctgc

SEQ ID NO: 50617 - DNA, 22 bp, Homo sapiens
cattgcactccagctctgggcg

SEQ ID NO: 50618 - DNA, 22 bp, Homo sapiens
aggctggagtgcagtggtgtga

SEQ ID NO: 50619 - DNA, 22 bp, Homo sapiens
gcaactgaacatgtgtgtggcc

SEQ ID NO: 50620 - DNA, 22 bp, Homo sapiens
ccaggcaggcgatggtgcagtg

SEQ ID NO: 50621 - DNA, 18 bp, Homo sapiens
ggaaaaggagtgtctagc

SEQ ID NO: 50622 - DNA, 22 bp, Homo sapiens
cactccagtctgggaacaaagc

SEQ ID NO: 50623 - DNA, 22 bp, Homo sapiens
atgctaaggcccaggagaaaat

SEQ ID NO: 50624 - DNA, 22 bp, Homo sapiens
atgccactgcacttcagcctgg

SEQ ID NO: 50625 - DNA, 22 bp, Homo sapiens
ctgccctttgaaagaacgtctt

SEQ ID NO: 50626 - DNA, 22 bp, Homo sapiens
cagctgctgttcagttttgttt

SEQ ID NO: 50627 - DNA, 22 bp, Homo sapiens
agcccttggtattttccgatcc

SEQ ID NO: 50628 - DNA, 22 bp, Homo sapiens
ctgctgagagccccagctgaga

SEQ ID NO: 50629 - DNA, 23 bp, Homo sapiens
gtgtggccccagggcctcctcgc

SEQ ID NO: 50630 - DNA, 22 bp, Homo sapiens
tctgacattagattaattggaa

SEQ ID NO: 50631 - DNA, 22 bp, Homo sapiens
cattgcactccagcctgggcca

SEQ ID NO: 50632 - DNA, 22 bp, Homo sapiens
ttagatttgtagtgagttcaga

SEQ ID NO: 50633 - DNA, 21 bp, Homo sapiens
gaacccagcagcagtgctctg

SEQ ID NO: 50634 - DNA, 22 bp, Homo sapiens
gacctggtccttgtactttgaa

SEQ ID NO: 50635 - DNA, 22 bp, Homo sapiens
accagaagctggagcacaagga

SEQ ID NO: 50636 - DNA, 22 bp, Homo sapiens
ggggctgaacctggaggtggtc

SEQ ID NO: 50637 - DNA, 22 bp, Homo sapiens
ttctgtggttgaaaggagagat

SEQ ID NO: 50638 - DNA, 22 bp, Homo sapiens
tttttagtagaggtgggtttca

SEQ ID NO: 50639 - DNA, 21 bp, Homo sapiens
tctgatggtagatgagatgtg

SEQ ID NO: 50640 - DNA, 22 bp, Homo sapiens
cattgcactccagccttggcaa

SEQ ID NO: 50641 - DNA, 22 bp, Homo sapiens
acaaacagagttgaaaaatagg

SEQ ID NO: 50642 - DNA, 22 bp, Homo sapiens
agtgctgggctatctactgcta

SEQ ID NO: 50643 - DNA, 22 bp, Homo sapiens
agggccagcactcctggcagga

SEQ ID NO: 50644 - DNA, 22 bp, Homo sapiens
ctgtggctcaggcctgtaagcc

SEQ ID NO: 50645 - DNA, 22 bp, Homo sapiens
agaggctgcacttgctcatgat

SEQ ID NO: 50646 - DNA, 22 bp, Homo sapiens
cgcaccactgaattccagcctg

SEQ ID NO: 50647 - DNA, 22 bp, Homo sapiens
gcccaggctggagtgcagtggc

SEQ ID NO: 50648 - DNA, 22 bp, Homo sapiens
tggccgggaagggacagtgtgg

SEQ ID NO: 50649 - DNA, 22 bp, Homo sapiens
ccgggagcaggcgccaccgcca

SEQ ID NO: 50650 - DNA, 22 bp, Homo sapiens
ggagagcttggagtgcgatttt

SEQ ID NO: 50651 - DNA, 22 bp, Homo sapiens
cgtctaggccgtgccctgaggt

SEQ ID NO: 50652 - DNA, 22 bp, Homo sapiens
gtgcgcaccctcccggcatccc

SEQ ID NO: 50653 - DNA, 22 bp, Homo sapiens
gaatgatttagtgttcaaggaa

SEQ ID NO: 50654 - DNA, 22 bp, Homo sapiens
ttaaatattatgttgtctgcaa

SEQ ID NO: 50655 - DNA, 22 bp, Homo sapiens
gcactttgcccctcctttggca

SEQ ID NO: 50656 - DNA, 22 bp, Homo sapiens
tgcctaggctggagtgcaatgg

SEQ ID NO: 50657 - DNA, 22 bp, Homo sapiens
taatgtataacaaatactcatc

SEQ ID NO: 50658 - DNA, 22 bp, Homo sapiens
atgtacataaaatgtataatga

SEQ ID NO: 50659 - DNA, 22 bp, Homo sapiens
aggggctcctttgtgctgcgtc

SEQ ID NO: 50660 - DNA, 22 bp, Homo sapiens
ttatttgtggcatatgagacga

SEQ ID NO: 50661 - DNA, 22 bp, Homo sapiens
atcctagaatcagcccttgctg

SEQ ID NO: 50662 - DNA, 22 bp, Homo sapiens
ggaggcggaggttgcagtgagt

SEQ ID NO: 50663 - DNA, 22 bp, Homo sapiens
ggaggtggaggttgcagtgagc

SEQ ID NO: 50664 - DNA, 22 bp, Homo sapiens
ttcttctttccaattacatggt

SEQ ID NO: 50665 - DNA, 22 bp, Homo sapiens
agaggggcccggttctccgtct

SEQ ID NO: 50666 - DNA, 22 bp, Homo sapiens
ctcactgcaatctccgtctccc

SEQ ID NO: 50667 - DNA, 22 bp, Homo sapiens
caagacttcaccgctctgtgct

SEQ ID NO: 50668 - DNA, 22 bp, Homo sapiens
gagccaggtcgggccgcggcga

SEQ ID NO: 50669 - DNA, 22 bp, Homo sapiens
cagtggaggccttgggaccttt

SEQ ID NO: 50670 - DNA, 22 bp, Homo sapiens
gagcctgagcaatgtgatgttt

SEQ ID NO: 50671 - DNA, 22 bp, Homo sapiens
ctgctccccagcctgcgccttt

SEQ ID NO: 50672 - DNA, 22 bp, Homo sapiens
actgcattctttatcccacaac

SEQ ID NO: 50673 - DNA, 16 bp, Homo sapiens
ggcaggcgcggagccc

SEQ ID NO: 50674 - DNA, 23 bp, Homo sapiens
agctctgctcgggcatgccctgc

SEQ ID NO: 50675 - DNA, 22 bp, Homo sapiens
tgcgaccctagccccctcactt

SEQ ID NO: 50676 - DNA, 22 bp, Homo sapiens
gttatataagacaaatcagagt

SEQ ID NO: 50677 - DNA, 22 bp, Homo sapiens
aggagctgtcagagtgccagag

SEQ ID NO: 50678 - DNA, 22 bp, Homo sapiens
cgcgctgcagacagcggaggcc

SEQ ID NO: 50679 - DNA, 22 bp, Homo sapiens
accccactcacacatggacctg

SEQ ID NO: 50680 - DNA, 19 bp, Homo sapiens
ttctctgctacattctcag

SEQ ID NO: 50681 - DNA, 21 bp, Homo sapiens
ggtgctcgctgatgaggagtg

SEQ ID NO: 50682 - DNA, 22 bp, Homo sapiens
ccaggctggagtgcagtggcac

SEQ ID NO: 50683 - DNA, 22 bp, Homo sapiens
gacaagctcccggtggccctcc

SEQ ID NO: 50684 - DNA, 22 bp, Homo sapiens
cccaggaggttgaggctgcagt

SEQ ID NO: 50685 - DNA, 22 bp, Homo sapiens
gagagtgagatcctcctgggga

SEQ ID NO: 50686 - DNA, 22 bp, Homo sapiens
aggggaggtgtccccaaatctc

SEQ ID NO: 50687 - DNA, 18 bp, Homo sapiens
tctgtgggatcagtgagg

SEQ ID NO: 50688 - DNA, 22 bp, Homo sapiens
tccagcccaggctggagtgtag

SEQ ID NO: 50689 - DNA, 22 bp, Homo sapiens
gggcaacagagcgagggcctgt

SEQ ID NO: 50690 - DNA, 22 bp, Homo sapiens
cactgcactccatcctgggaaa

SEQ ID NO: 50691 - DNA, 22 bp, Homo sapiens
atattacacacggtatcacggg

SEQ ID NO: 50692 - DNA, 22 bp, Homo sapiens
gaatttcctctaaacccctgag

SEQ ID NO: 50693 - DNA, 22 bp, Homo sapiens
ttgtgaatagtgccgctataaa

SEQ ID NO: 50694 - DNA, 20 bp, Homo sapiens
ttcatgggagcaaagaggcc

SEQ ID NO: 50695 - DNA, 22 bp, Homo sapiens
gagctgggcctgcgagtgctgc

SEQ ID NO: 50696 - DNA, 22 bp, Homo sapiens
tttgttttcaatgtgtcattca

SEQ ID NO: 50697 - DNA, 22 bp, Homo sapiens
tttgagatctcaatgaggacta

SEQ ID NO: 50698 - DNA, 22 bp, Homo sapiens
cagggatggcgctggctgcccg

SEQ ID NO: 50699 - DNA, 23 bp, Homo sapiens
agcagccagagatcctcggccct

SEQ ID NO: 50700 - DNA, 18 bp, Homo sapiens
gcactgaggaaaacctct

SEQ ID NO: 50701 - DNA, 22 bp, Homo sapiens
ctatacagcagcttactagtta

SEQ ID NO: 50702 - DNA, 22 bp, Homo sapiens
cccacgtcgaacttgctccaga

SEQ ID NO: 50703 - DNA, 22 bp, Homo sapiens
caggcggtggctcctggctgag

SEQ ID NO: 50704 - DNA, 22 bp, Homo sapiens
tccattatacttctgattcaaa

SEQ ID NO: 50705 - DNA, 22 bp, Homo sapiens
cctggaaagagaatgaatgagc

SEQ ID NO: 50706 - DNA, 22 bp, Homo sapiens
atttcacttagtgtaatgtctt

SEQ ID NO: 50707 - DNA, 22 bp, Homo sapiens
aggatcctgcgctttgggggag

SEQ ID NO: 50708 - DNA, 22 bp, Homo sapiens
aggctcagatccttgtgtcctg

SEQ ID NO: 50709 - DNA, 22 bp, Homo sapiens
aagaataagaggatttagaaca

SEQ ID NO: 50710 - DNA, 22 bp, Homo sapiens
ctcgcggcgcccgaagcccttg

SEQ ID NO: 50711 - DNA, 22 bp, Homo sapiens
ttacttaaacagaaatgcagaa

SEQ ID NO: 50712 - DNA, 16 bp, Homo sapiens
gcagaggaaaggggag

SEQ ID NO: 50713 - DNA, 22 bp, Homo sapiens
actgcaacctccgcctgccagg

SEQ ID NO: 50714 - DNA, 22 bp, Homo sapiens
aggggatgcctagtggagtctc

SEQ ID NO: 50715 - DNA, 22 bp, Homo sapiens
actgagacagctccgctgcccg

SEQ ID NO: 50716 - DNA, 22 bp, Homo sapiens
ccacagtcctggcttctgtctg

SEQ ID NO: 50717 - DNA, 22 bp, Homo sapiens
aggtgacaggacaggagctggt

SEQ ID NO: 50718 - DNA, 21 bp, Homo sapiens
tgactgaggcttcttcacaca

SEQ ID NO: 50719 - DNA, 22 bp, Homo sapiens
ccattgtaaattctgtggaagt

SEQ ID NO: 50720 - DNA, 19 bp, Homo sapiens
gcctcatttccacctcccc

SEQ ID NO: 50721 - DNA, 22 bp, Homo sapiens
ggggtgggcgtgcagggacacc

SEQ ID NO: 50722 - DNA, 22 bp, Homo sapiens
aagtcacactagacaactgagg

SEQ ID NO: 50723 - DNA, 22 bp, Homo sapiens
tcgcaccattgcactccagcca

SEQ ID NO: 50724 - DNA, 22 bp, Homo sapiens
tgttgattagtgtttagactta

SEQ ID NO: 50725 - DNA, 17 bp, Homo sapiens
ttcttttctgagccttg

SEQ ID NO: 50726 - DNA, 22 bp, Homo sapiens
gactttgtgccaaacgccagaa

SEQ ID NO: 50727 - DNA, 18 bp, Homo sapiens
agagtgttctcagtgaaa

SEQ ID NO: 50728 - DNA, 22 bp, Homo sapiens
atgccacttcattccagcctcg

SEQ ID NO: 50729 - DNA, 22 bp, Homo sapiens
tattaagtggtgagtactgcca

SEQ ID NO: 50730 - DNA, 22 bp, Homo sapiens
cgggcagcggcgtggccatggt

SEQ ID NO: 50731 - DNA, 22 bp, Homo sapiens
tgggggtgtcctggtgcacaca

SEQ ID NO: 50732 - DNA, 22 bp, Homo sapiens
cgagcatgatgacggctgtggc

SEQ ID NO: 50733 - DNA, 22 bp, Homo sapiens
agccagggacgctgcaggctac

SEQ ID NO: 50734 - DNA, 22 bp, Homo sapiens
aggaaataagggacaagacaaa

SEQ ID NO: 50735 - DNA, 22 bp, Homo sapiens
ctcactgcaagctctgcctccc

SEQ ID NO: 50736 - DNA, 22 bp, Homo sapiens
gcgagcctctggagtcctctgg

SEQ ID NO: 50737 - DNA, 22 bp, Homo sapiens
cttgcctttgtcttcaaaggct

SEQ ID NO: 50738 - DNA, 22 bp, Homo sapiens
gacggagctggttgctgcggct

SEQ ID NO: 50739 - DNA, 22 bp, Homo sapiens
tcactgcaacctccacctcctg

SEQ ID NO: 50740 - DNA, 22 bp, Homo sapiens
ccgggaggtggagattgcggtg

SEQ ID NO: 50741 - DNA, 22 bp, Homo sapiens
aatgttacgatcaacaacacat

SEQ ID NO: 50742 - DNA, 21 bp, Homo sapiens
tgtaagtttcatctgaattgg

SEQ ID NO: 50743 - DNA, 22 bp, Homo sapiens
ggggtctgggcttagctggaat

SEQ ID NO: 50744 - DNA, 22 bp, Homo sapiens
aacggctgtggctggcggcagc

SEQ ID NO: 50745 - DNA, 22 bp, Homo sapiens
cccaggaggtggaggctgcagt

SEQ ID NO: 50746 - DNA, 22 bp, Homo sapiens
caggttggagatctgtctatgg

SEQ ID NO: 50747 - DNA, 22 bp, Homo sapiens
ctagggtcaggggcctgcgtcg

SEQ ID NO: 50748 - DNA, 22 bp, Homo sapiens
taactaggattacaagcgtgcg

SEQ ID NO: 50749 - DNA, 22 bp, Homo sapiens
gcagtggggcaatcatagctca

SEQ ID NO: 50750 - DNA, 20 bp, Homo sapiens
tggcctctgagatgccacgg

SEQ ID NO: 50751 - DNA, 22 bp, Homo sapiens
gggagctgaaggagccggcggg

SEQ ID NO: 50752 - DNA, 22 bp, Homo sapiens
tggacaacatagtgagacctca

SEQ ID NO: 50753 - DNA, 22 bp, Homo sapiens
ccgcccacactaaatatgagcg

SEQ ID NO: 50754 - DNA, 22 bp, Homo sapiens
tgaagctttaggatgggttcat

SEQ ID NO: 50755 - DNA, 22 bp, Homo sapiens
atgctatgtaactggcagatag

SEQ ID NO: 50756 - DNA, 19 bp, Homo sapiens
ctgggatgtctcctcccag

SEQ ID NO: 50757 - DNA, 22 bp, Homo sapiens
ggggtggatttcaggcggtgtc

SEQ ID NO: 50758 - DNA, 22 bp, Homo sapiens
atgtttttaaatagacttacag

SEQ ID NO: 50759 - DNA, 22 bp, Homo sapiens
agacccaggattggggctgccg

SEQ ID NO: 50760 - DNA, 22 bp, Homo sapiens
ttttctaacatctagtaatttg

SEQ ID NO: 50761 - DNA, 22 bp, Homo sapiens
aggtgggcgctgctcccgctgg

SEQ ID NO: 50762 - DNA, 22 bp, Homo sapiens
ctgggcgcgtcccctgaggcgg

SEQ ID NO: 50763 - DNA, 22 bp, Homo sapiens
gggcggggggagctggaatgaa

SEQ ID NO: 50764 - DNA, 22 bp, Homo sapiens
cattctgcgatcctcaagcaca

SEQ ID NO: 50765 - DNA, 22 bp, Homo sapiens
cctgtctctgcagggccctgcc

SEQ ID NO: 50766 - DNA, 22 bp, Homo sapiens
atcctccagctcctgcttctgc

SEQ ID NO: 50767 - DNA, 22 bp, Homo sapiens
ggccagcctggggctcccagac

SEQ ID NO: 50768 - DNA, 22 bp, Homo sapiens
ggctcaggcctgtaatcctagc

SEQ ID NO: 50769 - DNA, 22 bp, Homo sapiens
caggcagaagaagtggaaggac

SEQ ID NO: 50770 - DNA, 22 bp, Homo sapiens
gcttccgcgatgtcctaggtgg

SEQ ID NO: 50771 - DNA, 22 bp, Homo sapiens
cctgggaggctgaggctgcagt

SEQ ID NO: 50772 - DNA, 22 bp, Homo sapiens
cagggccctgctcaatttctcc

SEQ ID NO: 50773 - DNA, 22 bp, Homo sapiens
tctcatgttgcttaactctatg

SEQ ID NO: 50774 - DNA, 21 bp, Homo sapiens
tggacttatggagtgtttctt

SEQ ID NO: 50775 - DNA, 22 bp, Homo sapiens
agccggggtaattaacacgggg

SEQ ID NO: 50776 - DNA, 22 bp, Homo sapiens
aacccgagggccccaggctcgg

SEQ ID NO: 50777 - DNA, 22 bp, Homo sapiens
cgggttcacgccattctcctgc

SEQ ID NO: 50778 - DNA, 22 bp, Homo sapiens
tagcataacaggtaagagtgag

SEQ ID NO: 50779 - DNA, 22 bp, Homo sapiens
aggcactgtgcagtcccaagca

SEQ ID NO: 50780 - DNA, 20 bp, Homo sapiens
aggaaaaatggaaactggag

SEQ ID NO: 50781 - DNA, 22 bp, Homo sapiens
gccccgtcgtggggccagggat

SEQ ID NO: 50782 - DNA, 22 bp, Homo sapiens
agaggaggctctgggatcgtcc

SEQ ID NO: 50783 - DNA, 16 bp, Homo sapiens
tggggatggggaagag

SEQ ID NO: 50784 - DNA, 22 bp, Homo sapiens
gctgtggcctggcgcagagctg

SEQ ID NO: 50785 - DNA, 22 bp, Homo sapiens
gtctctatcatagctgaaccct

SEQ ID NO: 50786 - DNA, 22 bp, Homo sapiens
gcccagcccagaaaggttcgga

SEQ ID NO: 50787 - DNA, 22 bp, Homo sapiens
ggggcagagaataaaaacctaa

SEQ ID NO: 50788 - DNA, 22 bp, Homo sapiens
tagaaaagccccagctggaggg

SEQ ID NO: 50789 - DNA, 22 bp, Homo sapiens
tatctcattttattgcaaatgt

SEQ ID NO: 50790 - DNA, 22 bp, Homo sapiens
ccctttagcccctgcagagact

SEQ ID NO: 50791 - DNA, 22 bp, Homo sapiens
tcactgcaacctccacctcccg

SEQ ID NO: 50792 - DNA, 22 bp, Homo sapiens
ggagagtgggagcaactgttgc

SEQ ID NO: 50793 - DNA, 22 bp, Homo sapiens
acgtagcactgagagatgcagg

SEQ ID NO: 50794 - DNA, 22 bp, Homo sapiens
tagctgggactactggccctgc

SEQ ID NO: 50795 - DNA, 22 bp, Homo sapiens
gaggtggctgcttgctgggaaa

SEQ ID NO: 50796 - DNA, 22 bp, Homo sapiens
taagaaatttagttatagaatg

SEQ ID NO: 50797 - DNA, 23 bp, Homo sapiens
cgcccagcctcagtgacctgggc

SEQ ID NO: 50798 - DNA, 22 bp, Homo sapiens
ttcctggaaattatgctcacct

SEQ ID NO: 50799 - DNA, 22 bp, Homo sapiens
gcgctgcgcctcctcttccgca

SEQ ID NO: 50800 - DNA, 22 bp, Homo sapiens
tacttttctataggtttgaaat

SEQ ID NO: 50801 - DNA, 22 bp, Homo sapiens
gggtaaatctcttttcatggct

SEQ ID NO: 50802 - DNA, 22 bp, Homo sapiens
ctattattagataatctacttg

SEQ ID NO: 50803 - DNA, 22 bp, Homo sapiens
gcttagtcaattataaataggc

SEQ ID NO: 50804 - DNA, 22 bp, Homo sapiens
gaaagacatagttgcaagatgg

SEQ ID NO: 50805 - DNA, 22 bp, Homo sapiens
cgggcgcactccgggcagctgt

SEQ ID NO: 50806 - DNA, 22 bp, Homo sapiens
gtgagaaatgacaaatgtgtcg

SEQ ID NO: 50807 - DNA, 22 bp, Homo sapiens
tccaccatgtaacaagctctgt

SEQ ID NO: 50808 - DNA, 22 bp, Homo sapiens
ctcactgcaagctccacctctt

SEQ ID NO: 50809 - DNA, 18 bp, Homo sapiens
atggtctcatactgggag

SEQ ID NO: 50810 - DNA, 22 bp, Homo sapiens
tggagggcatgctgtccatggg

SEQ ID NO: 50811 - DNA, 22 bp, Homo sapiens
tcacagacccttgctgagctct

SEQ ID NO: 50812 - DNA, 22 bp, Homo sapiens
cactgggcgtgtcctgggtgag

SEQ ID NO: 50813 - DNA, 22 bp, Homo sapiens
gtgggggcaggcagtgctagga

SEQ ID NO: 50814 - DNA, 22 bp, Homo sapiens
actgcaacacctcctgggttca

SEQ ID NO: 50815 - DNA, 22 bp, Homo sapiens
agatacattgttctaagcattg

SEQ ID NO: 50816 - DNA, 22 bp, Homo sapiens
tgtgggagaaggaagcaagctg

SEQ ID NO: 50817 - DNA, 22 bp, Homo sapiens
cagggtgctgcaccatccctca

SEQ ID NO: 50818 - DNA, 22 bp, Homo sapiens
ctgggcagctgtatcagggagt

SEQ ID NO: 50819 - DNA, 22 bp, Homo sapiens
gtggattacaagacagttgaga

SEQ ID NO: 50820 - DNA, 22 bp, Homo sapiens
atccccctgtatctggaagaat

SEQ ID NO: 50821 - DNA, 22 bp, Homo sapiens
gcaggcggaggttgcagtgagc

SEQ ID NO: 50822 - DNA, 22 bp, Homo sapiens
ggggatggaggcgtgtggtcct

SEQ ID NO: 50823 - DNA, 22 bp, Homo sapiens
cagccagtgtgaccgaggagga

SEQ ID NO: 50824 - DNA, 22 bp, Homo sapiens
ggtcgggcactctccagggctg

SEQ ID NO: 50825 - DNA, 22 bp, Homo sapiens
gggggagagacgagcggctctg

SEQ ID NO: 50826 - DNA, 22 bp, Homo sapiens
tctgtagtaggttgtagttctt

SEQ ID NO: 50827 - DNA, 22 bp, Homo sapiens
tccacgctgtgtgaccttgggc

SEQ ID NO: 50828 - DNA, 22 bp, Homo sapiens
tgctagtgtgtgagatgttcaa

SEQ ID NO: 50829 - DNA, 22 bp, Homo sapiens
cccaggaggcagagcttgcagt

SEQ ID NO: 50830 - DNA, 22 bp, Homo sapiens
tgtcttcaggagtaaatatcat

SEQ ID NO: 50831 - DNA, 22 bp, Homo sapiens
aaacttttttaggttcataggc

SEQ ID NO: 50832 - DNA, 22 bp, Homo sapiens
acgcctgtaatcccagcacttt

SEQ ID NO: 50833 - DNA, 22 bp, Homo sapiens
atgatggttgtcctaggtgcat

SEQ ID NO: 50834 - DNA, 22 bp, Homo sapiens
actattagcatatcatgaatgg

SEQ ID NO: 50835 - DNA, 19 bp, Homo sapiens
tggctctgtcgaaggcaca

SEQ ID NO: 50836 - DNA, 22 bp, Homo sapiens
cctggagagctcgggccaggca

SEQ ID NO: 50837 - DNA, 22 bp, Homo sapiens
tgaatgtgatgctaaacatatg

SEQ ID NO: 50838 - DNA, 22 bp, Homo sapiens
gaggtggccaagcgaggaaggg

SEQ ID NO: 50839 - DNA, 22 bp, Homo sapiens
taattataacagttacatctta

SEQ ID NO: 50840 - DNA, 22 bp, Homo sapiens
gcagtggcatgatgtgggctca

SEQ ID NO: 50841 - DNA, 22 bp, Homo sapiens
ctcaggatattgggctggagca

SEQ ID NO: 50842 - DNA, 22 bp, Homo sapiens
tgggaagggtcaacagctggaa

SEQ ID NO: 50843 - DNA, 22 bp, Homo sapiens
ggaggcggaggttgcagtgagc

SEQ ID NO: 50844 - DNA, 22 bp, Homo sapiens
ctccggccgcggtgcccagcgc

SEQ ID NO: 50845 - DNA, 22 bp, Homo sapiens
ccgaggctggagtgcagtggcg

SEQ ID NO: 50846 - DNA, 22 bp, Homo sapiens
acacttggagcaacacttatgg

SEQ ID NO: 50847 - DNA, 22 bp, Homo sapiens
ttttatctgtgacatctggcag

SEQ ID NO: 50848 - DNA, 22 bp, Homo sapiens
ttttcatttttgtagatgcaag

SEQ ID NO: 50849 - DNA, 22 bp, Homo sapiens
attaagtgactaaagtaatgct

SEQ ID NO: 50850 - DNA, 22 bp, Homo sapiens
gactggaaagcctgtcctcaga

SEQ ID NO: 50851 - DNA, 22 bp, Homo sapiens
tgggcaggggccctgcttccgt

SEQ ID NO: 50852 - DNA, 22 bp, Homo sapiens
tcagtttttctatactttgtag

SEQ ID NO: 50853 - DNA, 22 bp, Homo sapiens
gggaaggaaagttattagcaga

SEQ ID NO: 50854 - DNA, 22 bp, Homo sapiens
aaggtcatggcaaattactttt

SEQ ID NO: 50855 - DNA, 19 bp, Homo sapiens
gccgggcccgggttggccg

SEQ ID NO: 50856 - DNA, 22 bp, Homo sapiens
tacagtgcttggtatctagtaa

SEQ ID NO: 50857 - DNA, 22 bp, Homo sapiens
actctgtcttcatatttgcatt

SEQ ID NO: 50858 - DNA, 22 bp, Homo sapiens
cccgggttgtccgcgcgtccgg

SEQ ID NO: 50859 - DNA, 22 bp, Homo sapiens
ctgggaggtggaggttgcattg

SEQ ID NO: 50860 - DNA, 20 bp, Homo sapiens
gaaatgtacacattaccaca

SEQ ID NO: 50861 - DNA, 22 bp, Homo sapiens
ctgagctcacgccattctcctt

SEQ ID NO: 50862 - DNA, 22 bp, Homo sapiens
ggccactgacctacatctgggg

SEQ ID NO: 50863 - DNA, 22 bp, Homo sapiens
ttcccttaaattatggcatcta

SEQ ID NO: 50864 - DNA, 22 bp, Homo sapiens
atatgcagtctcttgcccttct

SEQ ID NO: 50865 - DNA, 22 bp, Homo sapiens
atctagattaggtataagagct

SEQ ID NO: 50866 - DNA, 22 bp, Homo sapiens
gccgggttcaagccattctcct

SEQ ID NO: 50867 - DNA, 22 bp, Homo sapiens
atcttcccaggctggggagagg

SEQ ID NO: 50868 - DNA, 22 bp, Homo sapiens
gagctcatccccatggtccgtc

SEQ ID NO: 50869 - DNA, 22 bp, Homo sapiens
taagtcgtggatgattcttcgg

SEQ ID NO: 50870 - DNA, 22 bp, Homo sapiens
atccaccctgtggtggctttct

SEQ ID NO: 50871 - DNA, 22 bp, Homo sapiens
tgaccaatactgtggatgccag

SEQ ID NO: 50872 - DNA, 22 bp, Homo sapiens
tcagccagccagctacaggctt

SEQ ID NO: 50873 - DNA, 22 bp, Homo sapiens
ggcccaggctggagtgcagtgg

SEQ ID NO: 50874 - DNA, 22 bp, Homo sapiens
gggcaggggtcagtggccccaa

SEQ ID NO: 50875 - DNA, 22 bp, Homo sapiens
gggctgtaggagctggaatggg

SEQ ID NO: 50876 - DNA, 21 bp, Homo sapiens
ggcctcccggaccgcagcgcc

SEQ ID NO: 50877 - DNA, 22 bp, Homo sapiens
cccatgcaccctctaagaagga

SEQ ID NO: 50878 - DNA, 22 bp, Homo sapiens
cctgcaccacaaggcttcagag

SEQ ID NO: 50879 - DNA, 22 bp, Homo sapiens
tagggtacatgtgcacaacatg

SEQ ID NO: 50880 - DNA, 20 bp, Homo sapiens
gggcaaggaaacagccccca

SEQ ID NO: 50881 - DNA, 22 bp, Homo sapiens
aggatttctgtgcctggaaaat

SEQ ID NO: 50882 - DNA, 22 bp, Homo sapiens
ggcaggaggtgagtggcgggtg

SEQ ID NO: 50883 - DNA, 22 bp, Homo sapiens
atgaaatgctattttggctaga

SEQ ID NO: 50884 - DNA, 22 bp, Homo sapiens
gttgaaatcctaaccccctagt

SEQ ID NO: 50885 - DNA, 22 bp, Homo sapiens
caggctggagtgcaatgacgcc

SEQ ID NO: 50886 - DNA, 22 bp, Homo sapiens
cactgcactccagcctgggaga

SEQ ID NO: 50887 - DNA, 22 bp, Homo sapiens
gcggggcccggacccagcctct

SEQ ID NO: 50888 - DNA, 22 bp, Homo sapiens
acccagggctcaagcgtaggca

SEQ ID NO: 50889 - DNA, 22 bp, Homo sapiens
ctagttctagatccctgaggaa

SEQ ID NO: 50890 - DNA, 22 bp, Homo sapiens
tgcgcctgtaagtccagagtcc

SEQ ID NO: 50891 - DNA, 22 bp, Homo sapiens
gcgcactgggcgcacgcgtagg

SEQ ID NO: 50892 - DNA, 22 bp, Homo sapiens
ttgtgctcctatgagaatctaa

SEQ ID NO: 50893 - DNA, 22 bp, Homo sapiens
gtcactcaggctggagttcagt

SEQ ID NO: 50894 - DNA, 22 bp, Homo sapiens
ttacctaaaatagctcaattta

SEQ ID NO: 50895 - DNA, 19 bp, Homo sapiens
gggaatgatggaagacttc

SEQ ID NO: 50896 - DNA, 23 bp, Homo sapiens
cagagctggctcagagctgcctg

SEQ ID NO: 50897 - DNA, 22 bp, Homo sapiens
gtggagggtgattgccggctgt

SEQ ID NO: 50898 - DNA, 22 bp, Homo sapiens
tcacttagatggggatcatcac

SEQ ID NO: 50899 - DNA, 22 bp, Homo sapiens
atgccactgcactccagcctgg

SEQ ID NO: 50900 - DNA, 22 bp, Homo sapiens
ggcgccgcactcggtgcagccg

SEQ ID NO: 50901 - DNA, 22 bp, Homo sapiens
gaggcggaggttgcagtgagct

SEQ ID NO: 50902 - DNA, 22 bp, Homo sapiens
ggcgtggggccttctgcccgct

SEQ ID NO: 50903 - DNA, 22 bp, Homo sapiens
gcagatggatgtggacggcgcc

SEQ ID NO: 50904 - DNA, 22 bp, Homo sapiens
gctccggcttggtgtgcagggt

SEQ ID NO: 50905 - DNA, 22 bp, Homo sapiens
ggttggacactaggtaggagcg

SEQ ID NO: 50906 - DNA, 22 bp, Homo sapiens
gagatcggtaaagagcatgcac

SEQ ID NO: 50907 - DNA, 22 bp, Homo sapiens
ttgcaattgctatggagagcgt

SEQ ID NO: 50908 - DNA, 22 bp, Homo sapiens
cgtcacttcttagtctattttc

SEQ ID NO: 50909 - DNA, 20 bp, Homo sapiens
tgaggcccagcagagtcggg

SEQ ID NO: 50910 - DNA, 22 bp, Homo sapiens
aggctagaggcttctggcttca

SEQ ID NO: 50911 - DNA, 22 bp, Homo sapiens
agaatagaattctcatagaatt

SEQ ID NO: 50912 - DNA, 22 bp, Homo sapiens
gcccagcacctctctcagggtt

SEQ ID NO: 50913 - DNA, 22 bp, Homo sapiens
catgcacttacctgaaattcaa

SEQ ID NO: 50914 - DNA, 18 bp, Homo sapiens
gaaagatgaacttttttc

SEQ ID NO: 50915 - DNA, 22 bp, Homo sapiens
agcccaggagtttgaggctgtg

SEQ ID NO: 50916 - DNA, 22 bp, Homo sapiens
cattgcacaccagcctgggcaa

SEQ ID NO: 50917 - DNA, 22 bp, Homo sapiens
atgagaaagttaatcatcatga

SEQ ID NO: 50918 - DNA, 22 bp, Homo sapiens
gagatatgttggcagctggtat

SEQ ID NO: 50919 - DNA, 23 bp, Homo sapiens
aaataggagtatctggatcatga

SEQ ID NO: 50920 - DNA, 22 bp, Homo sapiens
ccttttatagatcagtgtgtta

SEQ ID NO: 50921 - DNA, 22 bp, Homo sapiens
caggcagggagctggaaaggat

SEQ ID NO: 50922 - DNA, 22 bp, Homo sapiens
taatggttttttggagactgct

SEQ ID NO: 50923 - DNA, 22 bp, Homo sapiens
tcactgtatcatgttgcactta

SEQ ID NO: 50924 - DNA, 22 bp, Homo sapiens
ggagctcctggcagtgacagag

SEQ ID NO: 50925 - DNA, 22 bp, Homo sapiens
aggtggggaggagtgtctcttt

SEQ ID NO: 50926 - DNA, 19 bp, Homo sapiens
gcataaatacactattgtc

SEQ ID NO: 50927 - DNA, 22 bp, Homo sapiens
ctgctctgctgatcagtgtctc

SEQ ID NO: 50928 - DNA, 19 bp, Homo sapiens
agggaatccggctgaggga

SEQ ID NO: 50929 - DNA, 22 bp, Homo sapiens
atgccactgcgctctagcctgg

SEQ ID NO: 50930 - DNA, 22 bp, Homo sapiens
gaggctgaggttgcagtgagcc

SEQ ID NO: 50931 - DNA, 22 bp, Homo sapiens
cctgccctgctcactgtcggta

SEQ ID NO: 50932 - DNA, 22 bp, Homo sapiens
tgaaatgtgttctagtgttttg

SEQ ID NO: 50933 - DNA, 16 bp, Homo sapiens
tgggtgggaggagcgg

SEQ ID NO: 50934 - DNA, 20 bp, Homo sapiens
aaaatatgtataactcttct

SEQ ID NO: 50935 - DNA, 23 bp, Homo sapiens
tcatgcccaggctccagatgtca

SEQ ID NO: 50936 - DNA, 22 bp, Homo sapiens
gacctcgtgatccgccctcctt

SEQ ID NO: 50937 - DNA, 22 bp, Homo sapiens
gcaggcagaggtggaggagaca

SEQ ID NO: 50938 - DNA, 22 bp, Homo sapiens
atacaaagtattaatcctggat

SEQ ID NO: 50939 - DNA, 22 bp, Homo sapiens
cattgcactctagtctgggtga

SEQ ID NO: 50940 - DNA, 22 bp, Homo sapiens
tcctccagttccttggtttcag

SEQ ID NO: 50941 - DNA, 22 bp, Homo sapiens
agagcccctgggtcacacagcc

SEQ ID NO: 50942 - DNA, 22 bp, Homo sapiens
ttagatttacaagcactgttta

SEQ ID NO: 50943 - DNA, 22 bp, Homo sapiens
tttcataatactgtacatgaaa

SEQ ID NO: 50944 - DNA, 22 bp, Homo sapiens
gtggcagagccaaggctggagc

SEQ ID NO: 50945 - DNA, 22 bp, Homo sapiens
aggggatggagctggaaggcag

SEQ ID NO: 50946 - DNA, 22 bp, Homo sapiens
aggtacatggggtgtgtgcacg

SEQ ID NO: 50947 - DNA, 22 bp, Homo sapiens
ccctcccaggagtggccagaga

SEQ ID NO: 50948 - DNA, 22 bp, Homo sapiens
tggagccagcggcctgctgagg

SEQ ID NO: 50949 - DNA, 22 bp, Homo sapiens
aatgttgtgcatgtattttgta

SEQ ID NO: 50950 - DNA, 22 bp, Homo sapiens
atagagtgatgtaaggtatgtg

SEQ ID NO: 50951 - DNA, 23 bp, Homo sapiens
actctcaggttctttccagcagg

SEQ ID NO: 50952 - DNA, 22 bp, Homo sapiens
tggaggctggagtgcagtggcg

SEQ ID NO: 50953 - DNA, 22 bp, Homo sapiens
attggtagttttgtatttctct

SEQ ID NO: 50954 - DNA, 22 bp, Homo sapiens
tatactctgagaaacgtgtcac

SEQ ID NO: 50955 - DNA, 22 bp, Homo sapiens
tgtactgtatcattgcaacttt

SEQ ID NO: 50956 - DNA, 22 bp, Homo sapiens
tacgcgaagaaggacctgatgg

SEQ ID NO: 50957 - DNA, 22 bp, Homo sapiens
ctggagggctgcagcgaggctg

SEQ ID NO: 50958 - DNA, 23 bp, Homo sapiens
ggagtgcaatggcgccatctcgg

SEQ ID NO: 50959 - DNA, 22 bp, Homo sapiens
ttactgtttgggtctgaggtca

SEQ ID NO: 50960 - DNA, 19 bp, Homo sapiens
gagaaagcaggcacagcac

SEQ ID NO: 50961 - DNA, 21 bp, Homo sapiens
gctgctcgagatccagtgctt

SEQ ID NO: 50962 - DNA, 21 bp, Homo sapiens
ggagtttttctggaagggact

SEQ ID NO: 50963 - DNA, 19 bp, Homo sapiens
agagtattgaatttgccct

SEQ ID NO: 50964 - DNA, 22 bp, Homo sapiens
taaagttggacctgattttatt

SEQ ID NO: 50965 - DNA, 22 bp, Homo sapiens
tgtgctctgactttctcctggt

SEQ ID NO: 50966 - DNA, 22 bp, Homo sapiens
aagaggagaaaggctggctttg

SEQ ID NO: 50967 - DNA, 22 bp, Homo sapiens
tagagcattatgacaaccccat

SEQ ID NO: 50968 - DNA, 22 bp, Homo sapiens
cgcggaggaggtcaggaggtga

SEQ ID NO: 50969 - DNA, 22 bp, Homo sapiens
tgatattttatgagctttcata

SEQ ID NO: 50970 - DNA, 23 bp, Homo sapiens
ttgcagaagcagacgaccataat

SEQ ID NO: 50971 - DNA, 22 bp, Homo sapiens
ctacaaaagtaattgtggtttt

SEQ ID NO: 50972 - DNA, 22 bp, Homo sapiens
agggtgaatctcacaactctta

SEQ ID NO: 50973 - DNA, 22 bp, Homo sapiens
gcgagggcacgcggttgaaggc

SEQ ID NO: 50974 - DNA, 18 bp, Homo sapiens
gtcaggcatgaatctggg

SEQ ID NO: 50975 - DNA, 22 bp, Homo sapiens
gtgggggctggaaatcttgcca

SEQ ID NO: 50976 - DNA, 22 bp, Homo sapiens
tcaagcaattctcctgcctcag

SEQ ID NO: 50977 - DNA, 22 bp, Homo sapiens
gagccaggggtcagctccgagg

SEQ ID NO: 50978 - DNA, 22 bp, Homo sapiens
caggctggagtgcagtggcgcc

SEQ ID NO: 50979 - DNA, 22 bp, Homo sapiens
taaagggtaggttttactgtaa

SEQ ID NO: 50980 - DNA, 22 bp, Homo sapiens
agggctgcccagtgtgagagct

SEQ ID NO: 50981 - DNA, 22 bp, Homo sapiens
gatactcttcaggtcttgcaga

SEQ ID NO: 50982 - DNA, 22 bp, Homo sapiens
gagcacgttgaagcgcactgtc

SEQ ID NO: 50983 - DNA, 14 bp, Homo sapiens
aagatcaccttcct

SEQ ID NO: 50984 - DNA, 22 bp, Homo sapiens
aagttgttgttgaggtgggtaa

SEQ ID NO: 50985 - DNA, 20 bp, Homo sapiens
gctctgtggtttgagtctcc

SEQ ID NO: 50986 - DNA, 22 bp, Homo sapiens
tttcagatggaggtttaggaca

SEQ ID NO: 50987 - DNA, 22 bp, Homo sapiens
tcgttagcctcgagatctttgt

SEQ ID NO: 50988 - DNA, 22 bp, Homo sapiens
tcggagcgtcactggctggagg

SEQ ID NO: 50989 - DNA, 22 bp, Homo sapiens
attttctctttgtatatgctag

SEQ ID NO: 50990 - DNA, 22 bp, Homo sapiens
agcctagggttctgatgtcact

SEQ ID NO: 50991 - DNA, 20 bp, Homo sapiens
ctgggtggcaagcaaggggg

SEQ ID NO: 50992 - DNA, 22 bp, Homo sapiens
tctgttttgcataatgttcttt

SEQ ID NO: 50993 - DNA, 22 bp, Homo sapiens
caaggtgccatgctgggcgggg

SEQ ID NO: 50994 - DNA, 22 bp, Homo sapiens
gcgcgggcaggccttccgagtg

SEQ ID NO: 50995 - DNA, 22 bp, Homo sapiens
gtacaaatgcaggtttgttaca

SEQ ID NO: 50996 - DNA, 22 bp, Homo sapiens
gagtctctgaccagggtgccaa

SEQ ID NO: 50997 - DNA, 22 bp, Homo sapiens
gttttgaatactactagaactt

SEQ ID NO: 50998 - DNA, 22 bp, Homo sapiens
ggccttggcctagccctccagg

SEQ ID NO: 50999 - DNA, 22 bp, Homo sapiens
tttctcttcactgtgtgcctca

SEQ ID NO: 51000 - DNA, 22 bp, Homo sapiens
tctgttgactcctagcagccat

SEQ ID NO: 51001 - DNA, 22 bp, Homo sapiens
gaggctgaggttgcagtgagct

SEQ ID NO: 51002 - DNA, 22 bp, Homo sapiens
agctggggctgtggttgtgatt

SEQ ID NO: 51003 - DNA, 22 bp, Homo sapiens
gctaatcaatgttaaggctgtg

SEQ ID NO: 51004 - DNA, 22 bp, Homo sapiens
tctgcaacagtgccctgtaaat

SEQ ID NO: 51005 - DNA, 22 bp, Homo sapiens
accctccccaagaggtcgtgcc

SEQ ID NO: 51006 - DNA, 22 bp, Homo sapiens
aactagaaaaagactttctgag

SEQ ID NO: 51007 - DNA, 22 bp, Homo sapiens
accgggctaatttttgtatctt

SEQ ID NO: 51008 - DNA, 22 bp, Homo sapiens
aagaatgagctcaaagatctta

SEQ ID NO: 51009 - DNA, 22 bp, Homo sapiens
tatgaggtaggtattatactta

SEQ ID NO: 51010 - DNA, 22 bp, Homo sapiens
agctagtatttcattgaggatt

SEQ ID NO: 51011 - DNA, 22 bp, Homo sapiens
cccaggaggcctgcctggccgg

SEQ ID NO: 51012 - DNA, 22 bp, Homo sapiens
cattctctctacttgttttcaa

SEQ ID NO: 51013 - DNA, 22 bp, Homo sapiens
ccgggcgggggctctcgtcacc

SEQ ID NO: 51014 - DNA, 22 bp, Homo sapiens
gggggactggaccgtcctgggt

SEQ ID NO: 51015 - DNA, 22 bp, Homo sapiens
acatttatataactcactagga

SEQ ID NO: 51016 - DNA, 21 bp, Homo sapiens
ctcccagggtgactgttcaac

SEQ ID NO: 51017 - DNA, 22 bp, Homo sapiens
aaaaatcacttttataggcagc

SEQ ID NO: 51018 - DNA, 22 bp, Homo sapiens
ttgtctctggaaggaaaaagca

SEQ ID NO: 51019 - DNA, 19 bp, Homo sapiens
tccaggggctccacctcct

SEQ ID NO: 51020 - DNA, 22 bp, Homo sapiens
ggggcgtcaccggggcacctgg

SEQ ID NO: 51021 - DNA, 22 bp, Homo sapiens
agtacccttttcactgtcacaa

SEQ ID NO: 51022 - DNA, 22 bp, Homo sapiens
gcaggtggatcacctgaggtca

SEQ ID NO: 51023 - DNA, 22 bp, Homo sapiens
catggtgggtgtagtttccgcc

SEQ ID NO: 51024 - DNA, 22 bp, Homo sapiens
ttggagttctgggcacagctgc

SEQ ID NO: 51025 - DNA, 22 bp, Homo sapiens
gtgtaagaaccttctagagccc

SEQ ID NO: 51026 - DNA, 22 bp, Homo sapiens
gcagccagagggggtgtgatca

SEQ ID NO: 51027 - DNA, 22 bp, Homo sapiens
agtggctgagtgactgtgactc

SEQ ID NO: 51028 - DNA, 22 bp, Homo sapiens
tccaaggtcagcgagagtcact

SEQ ID NO: 51029 - DNA, 22 bp, Homo sapiens
tggccactgctctcaagctcag

SEQ ID NO: 51030 - DNA, 22 bp, Homo sapiens
atctccgccatcgcgaacgcct

SEQ ID NO: 51031 - DNA, 22 bp, Homo sapiens
cccaggccccagggcttgtcag

SEQ ID NO: 51032 - DNA, 22 bp, Homo sapiens
agagtccctcttcccaggaggc

SEQ ID NO: 51033 - DNA, 22 bp, Homo sapiens
gggaagagggagctggaatgat

SEQ ID NO: 51034 - DNA, 22 bp, Homo sapiens
caccctcaagcagtggcacgtg

SEQ ID NO: 51035 - DNA, 22 bp, Homo sapiens
tcctttgcttctgtcattctcc

SEQ ID NO: 51036 - DNA, 22 bp, Homo sapiens
gttttagataaagctgtccttg

SEQ ID NO: 51037 - DNA, 22 bp, Homo sapiens
agcttgtagaaggccacgagca

SEQ ID NO: 51038 - DNA, 22 bp, Homo sapiens
tctgtgagaaccagtgccaggg

SEQ ID NO: 51039 - DNA, 22 bp, Homo sapiens
agctggtgctcggggagctggc

SEQ ID NO: 51040 - DNA, 22 bp, Homo sapiens
gcctggagaaaggaaggtggga

SEQ ID NO: 51041 - DNA, 17 bp, Homo sapiens
ccctcactcctgccggg

SEQ ID NO: 51042 - DNA, 22 bp, Homo sapiens
ggcaaaaaccataattactttt

SEQ ID NO: 51043 - DNA, 22 bp, Homo sapiens
gtggcccaggttggagtgcagt

SEQ ID NO: 51044 - DNA, 22 bp, Homo sapiens
tcgaactcatagtcgtagctgt

SEQ ID NO: 51045 - DNA, 18 bp, Homo sapiens
agtgtcagctgcagctca

SEQ ID NO: 51046 - DNA, 22 bp, Homo sapiens
ccaggcagcctgctccattctg

SEQ ID NO: 51047 - DNA, 22 bp, Homo sapiens
tcacattttcaaaagctggtgc

SEQ ID NO: 51048 - DNA, 22 bp, Homo sapiens
atgcacctgaactccatcagct

SEQ ID NO: 51049 - DNA, 21 bp, Homo sapiens
gcagcagtgttctagaatact

SEQ ID NO: 51050 - DNA, 22 bp, Homo sapiens
tgcctactagtactattttgtg

SEQ ID NO: 51051 - DNA, 22 bp, Homo sapiens
atacaaaaattagccgggagta

SEQ ID NO: 51052 - DNA, 22 bp, Homo sapiens
gccctgggcaaggttctggcca

SEQ ID NO: 51053 - DNA, 22 bp, Homo sapiens
aaacatctactgtaggctggag

SEQ ID NO: 51054 - DNA, 22 bp, Homo sapiens
ctgggaggcggaggttgtagtg

SEQ ID NO: 51055 - DNA, 22 bp, Homo sapiens
tcttgggcatgtgtttgatttc

SEQ ID NO: 51056 - DNA, 22 bp, Homo sapiens
gaggctgaggcggatggatcac

SEQ ID NO: 51057 - DNA, 22 bp, Homo sapiens
tggaggccagaggtactgggac

SEQ ID NO: 51058 - DNA, 22 bp, Homo sapiens
tcttttgtgattctttagttac

SEQ ID NO: 51059 - DNA, 22 bp, Homo sapiens
tgggcgacagagcaagactccg

SEQ ID NO: 51060 - DNA, 22 bp, Homo sapiens
tgaacatgctgttgatggcctg

SEQ ID NO: 51061 - DNA, 22 bp, Homo sapiens
gggaggttgaggctgcagtgag

SEQ ID NO: 51062 - DNA, 22 bp, Homo sapiens
aggtcctcgtcgtgctgggcca

SEQ ID NO: 51063 - DNA, 22 bp, Homo sapiens
gcgaggaggggtgctgggcccc

SEQ ID NO: 51064 - DNA, 22 bp, Homo sapiens
gggaggcacgaggcgcgcagtg

SEQ ID NO: 51065 - DNA, 22 bp, Homo sapiens
ggcaaaaagttcccatcagtgt

SEQ ID NO: 51066 - DNA, 21 bp, Homo sapiens
gttcttgcaggatttccttcc

SEQ ID NO: 51067 - DNA, 22 bp, Homo sapiens
ctggaggtgcttcgctggccac

SEQ ID NO: 51068 - DNA, 22 bp, Homo sapiens
ggcgtgggcgaggtgctctatc

SEQ ID NO: 51069 - DNA, 22 bp, Homo sapiens
aagtgctgggattacaggcgtc

SEQ ID NO: 51070 - DNA, 22 bp, Homo sapiens
ggaggcggaggctgcagtgagc

SEQ ID NO: 51071 - DNA, 22 bp, Homo sapiens
ttttgagatggagtcttgctct

SEQ ID NO: 51072 - DNA, 22 bp, Homo sapiens
caggaacagggtgtcctggcag

SEQ ID NO: 51073 - DNA, 22 bp, Homo sapiens
tcctccccaaagcccagcctgg

SEQ ID NO: 51074 - DNA, 22 bp, Homo sapiens
tgcctcaagccctccactgcac

SEQ ID NO: 51075 - DNA, 22 bp, Homo sapiens
tcaagcaaagtttagctggtta

SEQ ID NO: 51076 - DNA, 22 bp, Homo sapiens
gggagctggagctggaagactc

SEQ ID NO: 51077 - DNA, 22 bp, Homo sapiens
atttttctctttccactgagat

SEQ ID NO: 51078 - DNA, 22 bp, Homo sapiens
tctgctcagccgatctgctccg

SEQ ID NO: 51079 - DNA, 21 bp, Homo sapiens
ggccgccgccttgtgctctgc

SEQ ID NO: 51080 - DNA, 23 bp, Homo sapiens
acagtcgtaggtatccttttcct

SEQ ID NO: 51081 - DNA, 22 bp, Homo sapiens
actcccagaacatgctcttctt

SEQ ID NO: 51082 - DNA, 22 bp, Homo sapiens
agagtggctctgctgggcacag

SEQ ID NO: 51083 - DNA, 22 bp, Homo sapiens
gaccctgtttctacaaataatt

SEQ ID NO: 51084 - DNA, 22 bp, Homo sapiens
caaatgtataaatgtactttct

SEQ ID NO: 51085 - DNA, 22 bp, Homo sapiens
tctgacattttgagaatgacat

SEQ ID NO: 51086 - DNA, 22 bp, Homo sapiens
ccgggccccacggtgacctcag

SEQ ID NO: 51087 - DNA, 22 bp, Homo sapiens
tgtacacatggtgtacactccc

SEQ ID NO: 51088 - DNA, 22 bp, Homo sapiens
gggccctgcgactcgcggcgga

SEQ ID NO: 51089 - DNA, 22 bp, Homo sapiens
gaggggcacagtaaagggtccc

SEQ ID NO: 51090 - DNA, 22 bp, Homo sapiens
gtgagtaaaggttcattgaatt

SEQ ID NO: 51091 - DNA, 22 bp, Homo sapiens
agggctggagccacagctggga

SEQ ID NO: 51092 - DNA, 20 bp, Homo sapiens
gggcagagccagccagtccc

SEQ ID NO: 51093 - DNA, 22 bp, Homo sapiens
ataatacatggttgatcttttc

SEQ ID NO: 51094 - DNA, 22 bp, Homo sapiens
atgttattgatgcctgaggctt

SEQ ID NO: 51095 - DNA, 20 bp, Homo sapiens
ttgagcttttagtacagaca

SEQ ID NO: 51096 - DNA, 20 bp, Homo sapiens
ggccggggagctctccaggg

SEQ ID NO: 51097 - DNA, 22 bp, Homo sapiens
gccctgagaagaagtcggaggg

SEQ ID NO: 51098 - DNA, 21 bp, Homo sapiens
tcgtgcagcagctgaggcttg

SEQ ID NO: 51099 - DNA, 23 bp, Homo sapiens
caggagatggctgctgtgtcagc

SEQ ID NO: 51100 - DNA, 22 bp, Homo sapiens
cattgcactccagcctgggtga

SEQ ID NO: 51101 - DNA, 22 bp, Homo sapiens
tcaggcaccttcctcttatctg

SEQ ID NO: 51102 - DNA, 22 bp, Homo sapiens
tcactgcaagctccacctcccg

SEQ ID NO: 51103 - DNA, 22 bp, Homo sapiens
tctggctccaggaccgggcaca

SEQ ID NO: 51104 - DNA, 22 bp, Homo sapiens
agcctggtttaagcattttata

SEQ ID NO: 51105 - DNA, 22 bp, Homo sapiens
gagggagggactagcattctct

SEQ ID NO: 51106 - DNA, 22 bp, Homo sapiens
gacaggaggcagagctcaggtg

SEQ ID NO: 51107 - DNA, 22 bp, Homo sapiens
tctaattttggcattttaacct

SEQ ID NO: 51108 - DNA, 22 bp, Homo sapiens
agtaaaactcacaaaaggatgg

SEQ ID NO: 51109 - DNA, 21 bp, Homo sapiens
ccaccaggtcttctgctcggg

SEQ ID NO: 51110 - DNA, 22 bp, Homo sapiens
tctgaggctgaatggactccgt

SEQ ID NO: 51111 - DNA, 17 bp, Homo sapiens
ggcctgcacctcctgct

SEQ ID NO: 51112 - DNA, 22 bp, Homo sapiens
caccagcagcggtgtgagggtg

SEQ ID NO: 51113 - DNA, 22 bp, Homo sapiens
gggaaatctcgtcctctattta

SEQ ID NO: 51114 - DNA, 22 bp, Homo sapiens
atgccactgacatggacaattt

SEQ ID NO: 51115 - DNA, 22 bp, Homo sapiens
catttacatttaaggttaatat

SEQ ID NO: 51116 - DNA, 22 bp, Homo sapiens
gcctggattccttgtttctcag

SEQ ID NO: 51117 - DNA, 22 bp, Homo sapiens
cactgcactccagcccgggcaa

SEQ ID NO: 51118 - DNA, 23 bp, Homo sapiens
tgcatgtgattcatagagtccag

SEQ ID NO: 51119 - DNA, 22 bp, Homo sapiens
ggaggctgaggcaggcggatca

SEQ ID NO: 51120 - DNA, 22 bp, Homo sapiens
ttgctgccttggagaagctcct

SEQ ID NO: 51121 - DNA, 22 bp, Homo sapiens
cctccccacagcccaggagact

SEQ ID NO: 51122 - DNA, 22 bp, Homo sapiens
ttagacatgatggtgcagagag

SEQ ID NO: 51123 - DNA, 22 bp, Homo sapiens
cattccttaacgtggggagtct

SEQ ID NO: 51124 - DNA, 23 bp, Homo sapiens
gggtccagccaattccaaggaaa

SEQ ID NO: 51125 - DNA, 22 bp, Homo sapiens
atagtatttaatagttagctca

SEQ ID NO: 51126 - DNA, 22 bp, Homo sapiens
ggcgggacggggcgtgcacaga

SEQ ID NO: 51127 - DNA, 22 bp, Homo sapiens
ttttctagggtgctaaatgaac

SEQ ID NO: 51128 - DNA, 22 bp, Homo sapiens
ctcagagtcccttccctcgtgg

SEQ ID NO: 51129 - DNA, 22 bp, Homo sapiens
aggggagagttaatgtgaatgt

SEQ ID NO: 51130 - DNA, 21 bp, Homo sapiens
ggcaagaaacacaatcaagta

SEQ ID NO: 51131 - DNA, 22 bp, Homo sapiens
ggaagaaaggtggacaacaggt

SEQ ID NO: 51132 - DNA, 22 bp, Homo sapiens
gagatggagtctttttctgtca

SEQ ID NO: 51133 - DNA, 22 bp, Homo sapiens
agacaaagaaaccgtagaagca

SEQ ID NO: 51134 - DNA, 22 bp, Homo sapiens
caggcgctgtggctcccacctg

SEQ ID NO: 51135 - DNA, 17 bp, Homo sapiens
gggcagggactcctggg

SEQ ID NO: 51136 - DNA, 22 bp, Homo sapiens
ttatttaaaagtggtaagattc

SEQ ID NO: 51137 - DNA, 22 bp, Homo sapiens
acagttaataagtagtaagtca

SEQ ID NO: 51138 - DNA, 22 bp, Homo sapiens
cgcgctctccttctggcaccca

SEQ ID NO: 51139 - DNA, 22 bp, Homo sapiens
cagcagcattgctctggattcc

SEQ ID NO: 51140 - DNA, 22 bp, Homo sapiens
gtaagggatttgaacataggtt

SEQ ID NO: 51141 - DNA, 22 bp, Homo sapiens
ggcctgcctcacagtcagcacc

SEQ ID NO: 51142 - DNA, 22 bp, Homo sapiens
ttctcatgaaactcgcttcctc

SEQ ID NO: 51143 - DNA, 22 bp, Homo sapiens
tacagatgaggaaactgaggca

SEQ ID NO: 51144 - DNA, 22 bp, Homo sapiens
gacaggtgctaagggacctggc

SEQ ID NO: 51145 - DNA, 22 bp, Homo sapiens
ttggaaacgtcaccttttcctt

SEQ ID NO: 51146 - DNA, 22 bp, Homo sapiens
ttatgggagcaattggggaggt

SEQ ID NO: 51147 - DNA, 22 bp, Homo sapiens
aggtggaaatggctttcctagg

SEQ ID NO: 51148 - DNA, 22 bp, Homo sapiens
ttccccttgataagcagggttg

SEQ ID NO: 51149 - DNA, 22 bp, Homo sapiens
cacagagctggaaaggctgggc

SEQ ID NO: 51150 - DNA, 17 bp, Homo sapiens
tgcatgtcctttgttcc

SEQ ID NO: 51151 - DNA, 22 bp, Homo sapiens
gcgggttgaagggcgcatcgaa

SEQ ID NO: 51152 - DNA, 20 bp, Homo sapiens
ataaaataactgccacaaga

SEQ ID NO: 51153 - DNA, 22 bp, Homo sapiens
gggagtgggtttggcctaggcc

SEQ ID NO: 51154 - DNA, 22 bp, Homo sapiens
gaggtaacactgttcagtgggc

SEQ ID NO: 51155 - DNA, 22 bp, Homo sapiens
aaacccagggttttgtcttccc

SEQ ID NO: 51156 - DNA, 22 bp, Homo sapiens
ctgcagggagaggggacagcct

SEQ ID NO: 51157 - DNA, 22 bp, Homo sapiens
tggattcacaccattctcctgc

SEQ ID NO: 51158 - DNA, 22 bp, Homo sapiens
aaggcggggggatcacgaggtc

SEQ ID NO: 51159 - DNA, 22 bp, Homo sapiens
caggccagggttgagaagagaa

SEQ ID NO: 51160 - DNA, 22 bp, Homo sapiens
aggactcatccctgcttgtcag

SEQ ID NO: 51161 - DNA, 22 bp, Homo sapiens
cctggaggcggaggttgcagtg

SEQ ID NO: 51162 - DNA, 22 bp, Homo sapiens
agtccaaagcagatgagggcca

SEQ ID NO: 51163 - DNA, 22 bp, Homo sapiens
cccagggaggcccaggctctgc

SEQ ID NO: 51164 - DNA, 22 bp, Homo sapiens
cattgcactccagcctgggcaa

SEQ ID NO: 51165 - DNA, 22 bp, Homo sapiens
gtggaggagaggcgccttgcgg

SEQ ID NO: 51166 - DNA, 22 bp, Homo sapiens
atacaaaatatatactggagac

SEQ ID NO: 51167 - DNA, 22 bp, Homo sapiens
gtatagaaacccagaaagatag

SEQ ID NO: 51168 - DNA, 22 bp, Homo sapiens
gcccatgaggtggaggctgcag

SEQ ID NO: 51169 - DNA, 22 bp, Homo sapiens
gaattcttttctttctgaaagt

SEQ ID NO: 51170 - DNA, 22 bp, Homo sapiens
tagactggtgaattagggggaa

SEQ ID NO: 51171 - DNA, 23 bp, Homo sapiens
attttttgtctttgtaactagat

SEQ ID NO: 51172 - DNA, 22 bp, Homo sapiens
tcaccgccttgcccggccgggc

SEQ ID NO: 51173 - DNA, 23 bp, Homo sapiens
ctggggctttcaaatctgggcag

SEQ ID NO: 51174 - DNA, 22 bp, Homo sapiens
ttgtgagtagtgccgcaataaa

SEQ ID NO: 51175 - DNA, 22 bp, Homo sapiens
acgttttctagagaatatgcag

SEQ ID NO: 51176 - DNA, 22 bp, Homo sapiens
atgaattgaggaaaacagtcgt

SEQ ID NO: 51177 - DNA, 22 bp, Homo sapiens
tccttaggcaatttgggagagt

SEQ ID NO: 51178 - DNA, 22 bp, Homo sapiens
gcaccaggtgcagccgggcccc

SEQ ID NO: 51179 - DNA, 22 bp, Homo sapiens
cactgctacctctgcctcccgg

SEQ ID NO: 51180 - DNA, 22 bp, Homo sapiens
cctgcgggctgtgctgaagcct

SEQ ID NO: 51181 - DNA, 22 bp, Homo sapiens
agctgccgatgcccagctgcat

SEQ ID NO: 51182 - DNA, 22 bp, Homo sapiens
aaagtaattgcagtttctgcca

SEQ ID NO: 51183 - DNA, 22 bp, Homo sapiens
atatttagataaaaatgggctt

SEQ ID NO: 51184 - DNA, 22 bp, Homo sapiens
ccaggctgctgttggtgtccgc

SEQ ID NO: 51185 - DNA, 22 bp, Homo sapiens
gtcctgtgagattcatgctcaa

SEQ ID NO: 51186 - DNA, 22 bp, Homo sapiens
cggggaagcggttctggcggta

SEQ ID NO: 51187 - DNA, 22 bp, Homo sapiens
ggcctggcagagcgcgcggctg

SEQ ID NO: 51188 - DNA, 22 bp, Homo sapiens
tctttgctccacactctagaga

SEQ ID NO: 51189 - DNA, 22 bp, Homo sapiens
cccaggaggcggaggttgcagt

SEQ ID NO: 51190 - DNA, 22 bp, Homo sapiens
caggctggagtgcagtggcgct

SEQ ID NO: 51191 - DNA, 22 bp, Homo sapiens
tctgctctgtggcttcagctaa

SEQ ID NO: 51192 - DNA, 22 bp, Homo sapiens
caattgacaatgacagtgtcaa

SEQ ID NO: 51193 - DNA, 22 bp, Homo sapiens
gcgggcgggggttcccaggtct

SEQ ID NO: 51194 - DNA, 22 bp, Homo sapiens
tacaacaatttccacattagaa

SEQ ID NO: 51195 - DNA, 22 bp, Homo sapiens
agaaatatgctgattagatgaa

SEQ ID NO: 51196 - DNA, 22 bp, Homo sapiens
tggatgctgtaggacacgctct

SEQ ID NO: 51197 - DNA, 23 bp, Homo sapiens
ccaagactgttaggagtggggag

SEQ ID NO: 51198 - DNA, 22 bp, Homo sapiens
ggccactgctctccagcctggg

SEQ ID NO: 51199 - DNA, 22 bp, Homo sapiens
tttctttatcatagcatctttg

SEQ ID NO: 51200 - DNA, 22 bp, Homo sapiens
ccccatcatctttgaggtcatt

SEQ ID NO: 51201 - DNA, 22 bp, Homo sapiens
atgaaatatcttgaagaaattc

SEQ ID NO: 51202 - DNA, 22 bp, Homo sapiens
tttggtattgcacactgtcttc

SEQ ID NO: 51203 - DNA, 22 bp, Homo sapiens
atatattttttgagacagagtc

SEQ ID NO: 51204 - DNA, 22 bp, Homo sapiens
ggtggcagtagcactgggcctg

SEQ ID NO: 51205 - DNA, 16 bp, Homo sapiens
cattgcactctagcct

SEQ ID NO: 51206 - DNA, 22 bp, Homo sapiens
gctgctgcttgaaggctcggag

SEQ ID NO: 51207 - DNA, 22 bp, Homo sapiens
cggggccctggggctgaaggtc

SEQ ID NO: 51208 - DNA, 22 bp, Homo sapiens
gaggagggagctggaagctctt

SEQ ID NO: 51209 - DNA, 22 bp, Homo sapiens
ctgggaggcagaggttgcagtg

SEQ ID NO: 51210 - DNA, 22 bp, Homo sapiens
tcactgcaagctcctcctcctg

SEQ ID NO: 51211 - DNA, 22 bp, Homo sapiens
cacccaggctggaatgcagtgg

SEQ ID NO: 51212 - DNA, 22 bp, Homo sapiens
ggctccaccctgcttccagaag

SEQ ID NO: 51213 - DNA, 22 bp, Homo sapiens
tgtgtggattcatctcaaagag

SEQ ID NO: 51214 - DNA, 22 bp, Homo sapiens
ttctaattaaatctacgctagg

SEQ ID NO: 51215 - DNA, 22 bp, Homo sapiens
atgtaaactactgactacacta

SEQ ID NO: 51216 - DNA, 22 bp, Homo sapiens
ggagtgactcacagctgggaca

SEQ ID NO: 51217 - DNA, 22 bp, Homo sapiens
ccgtggggggccgtcgtccctg

SEQ ID NO: 51218 - DNA, 22 bp, Homo sapiens
tgggcagggagctggaaccaca

SEQ ID NO: 51219 - DNA, 22 bp, Homo sapiens
cctacagttatattcttgattg

SEQ ID NO: 51220 - DNA, 22 bp, Homo sapiens
ccaggaggttgaggctgcagtg

SEQ ID NO: 51221 - DNA, 22 bp, Homo sapiens
gaggcagaagttgcagtgagca

SEQ ID NO: 51222 - DNA, 22 bp, Homo sapiens
actgcaacctccacctcctggg

SEQ ID NO: 51223 - DNA, 22 bp, Homo sapiens
atagaatatgacttttagatcc

SEQ ID NO: 51224 - DNA, 22 bp, Homo sapiens
tgcctcagctgaggccgctcca

SEQ ID NO: 51225 - DNA, 22 bp, Homo sapiens
ttctctgcctcacaggtctaag

SEQ ID NO: 51226 - DNA, 22 bp, Homo sapiens
agtccggggtctggacacctgg

SEQ ID NO: 51227 - DNA, 22 bp, Homo sapiens
aaatggaagctatttatgattc

SEQ ID NO: 51228 - DNA, 22 bp, Homo sapiens
gtggagagagataagcctggtc

SEQ ID NO: 51229 - DNA, 22 bp, Homo sapiens
ccaggaggcggaaggtacagtg

SEQ ID NO: 51230 - DNA, 22 bp, Homo sapiens
ggaggcggaagttgcagtgagc

SEQ ID NO: 51231 - DNA, 22 bp, Homo sapiens
aagccgggcctgagaaatgaca

SEQ ID NO: 51232 - DNA, 22 bp, Homo sapiens
acgaggttggagagttgtttgg

SEQ ID NO: 51233 - DNA, 22 bp, Homo sapiens
ccggagtgtctggcctgctggg

SEQ ID NO: 51234 - DNA, 22 bp, Homo sapiens
gagaggtggaggttgcagtgag

SEQ ID NO: 51235 - DNA, 22 bp, Homo sapiens
cagagctgtccaaaccctgaca

SEQ ID NO: 51236 - DNA, 22 bp, Homo sapiens
gaaatcatattctcagtccttc

SEQ ID NO: 51237 - DNA, 22 bp, Homo sapiens
gttcaagaccagcctggccaac

SEQ ID NO: 51238 - DNA, 22 bp, Homo sapiens
tgagcttgcagtgccagccttg

SEQ ID NO: 51239 - DNA, 22 bp, Homo sapiens
tggtgggctgagtctcatcgga

SEQ ID NO: 51240 - DNA, 22 bp, Homo sapiens
tatcttaaaaatcgaagcagat

SEQ ID NO: 51241 - DNA, 22 bp, Homo sapiens
gcctccccaagcagcagggatt

SEQ ID NO: 51242 - DNA, 22 bp, Homo sapiens
ccccacaactcatgttgaaact

SEQ ID NO: 51243 - DNA, 22 bp, Homo sapiens
gggctagcctcttccctgctcc

SEQ ID NO: 51244 - DNA, 22 bp, Homo sapiens
ctcactgcaagctctgcctcca

SEQ ID NO: 51245 - DNA, 22 bp, Homo sapiens
tttgtgaataggttggcttcca

SEQ ID NO: 51246 - DNA, 22 bp, Homo sapiens
gagaaatatggctcagttccac

SEQ ID NO: 51247 - DNA, 22 bp, Homo sapiens
caaccccactacacgttggaga

SEQ ID NO: 51248 - DNA, 22 bp, Homo sapiens
gtcccataagtagtgcaacttg

SEQ ID NO: 51249 - DNA, 22 bp, Homo sapiens
cattgcactccagcctaggcaa

SEQ ID NO: 51250 - DNA, 22 bp, Homo sapiens
cggctgggttcggctgcaggcc

SEQ ID NO: 51251 - DNA, 22 bp, Homo sapiens
gagcacagtaaagcagtgtcac

SEQ ID NO: 51252 - DNA, 22 bp, Homo sapiens
tgggcggactcgggcatggaat

SEQ ID NO: 51253 - DNA, 22 bp, Homo sapiens
gccggggctggggagagacatg

SEQ ID NO: 51254 - DNA, 22 bp, Homo sapiens
tcgggctcgctctcctagcgga

SEQ ID NO: 51255 - DNA, 22 bp, Homo sapiens
gcagaggacacaggagggcaag

SEQ ID NO: 51256 - DNA, 22 bp, Homo sapiens
cccccaaagtttgcacggataa

SEQ ID NO: 51257 - DNA, 22 bp, Homo sapiens
tctgttgcaatgtgcatggtga

SEQ ID NO: 51258 - DNA, 17 bp, Homo sapiens
aggaggccctggcgttt

SEQ ID NO: 51259 - DNA, 22 bp, Homo sapiens
cagtgcagccaaggacaggcac

SEQ ID NO: 51260 - DNA, 22 bp, Homo sapiens
cagtggccaacttcctgcctct

SEQ ID NO: 51261 - DNA, 22 bp, Homo sapiens
tgtccagctcgagacactatct

SEQ ID NO: 51262 - DNA, 22 bp, Homo sapiens
ggctttgacatgctgaattaaa

SEQ ID NO: 51263 - DNA, 22 bp, Homo sapiens
tcctccactttgtctagcaaca

SEQ ID NO: 51264 - DNA, 22 bp, Homo sapiens
gatgcgggcccgctccactgcc

SEQ ID NO: 51265 - DNA, 22 bp, Homo sapiens
ttttcagaattagcataccatt

SEQ ID NO: 51266 - DNA, 22 bp, Homo sapiens
gggccctgggattcagagcaag

SEQ ID NO: 51267 - DNA, 22 bp, Homo sapiens
tgctgagcgcatccggcggccg

SEQ ID NO: 51268 - DNA, 22 bp, Homo sapiens
tggggccatctcacccactgtt

SEQ ID NO: 51269 - DNA, 22 bp, Homo sapiens
caggctggagtgcagtggtgcc

SEQ ID NO: 51270 - DNA, 22 bp, Homo sapiens
ctgagctcaagcgatcctccca

SEQ ID NO: 51271 - DNA, 20 bp, Homo sapiens
ggggcccaagccctcttgcc

SEQ ID NO: 51272 - DNA, 22 bp, Homo sapiens
gccagggttcgaatccgtatgg

SEQ ID NO: 51273 - DNA, 22 bp, Homo sapiens
atgccactgcgctccagcctgg

SEQ ID NO: 51274 - DNA, 22 bp, Homo sapiens
aaattgtaatgacttcacttga

SEQ ID NO: 51275 - DNA, 22 bp, Homo sapiens
ggaggagcatgagagggtagtg

SEQ ID NO: 51276 - DNA, 22 bp, Homo sapiens
gtcggccacgcaggtgcggtag

SEQ ID NO: 51277 - DNA, 21 bp, Homo sapiens
cagagctgtccaaaccctgac

SEQ ID NO: 51278 - DNA, 22 bp, Homo sapiens
aggaaaacagaccaaggagctc

SEQ ID NO: 51279 - DNA, 22 bp, Homo sapiens
gtgtgaaagcttgtcctctgta

SEQ ID NO: 51280 - DNA, 22 bp, Homo sapiens
ccggggacagcaggtccgactt

SEQ ID NO: 51281 - DNA, 22 bp, Homo sapiens
tttctaatctgattctcctacc

SEQ ID NO: 51282 - DNA, 22 bp, Homo sapiens
gggaaggccttgtcagcggatt

SEQ ID NO: 51283 - DNA, 22 bp, Homo sapiens
ttatgatttgccacagattggt

SEQ ID NO: 51284 - DNA, 22 bp, Homo sapiens
tccagggccatctccatgaggc

SEQ ID NO: 51285 - DNA, 22 bp, Homo sapiens
cccaggaggtcaaggctgcagt

SEQ ID NO: 51286 - DNA, 19 bp, Homo sapiens
caggcctcttaccctctct

SEQ ID NO: 51287 - DNA, 22 bp, Homo sapiens
attcttcctcatcaatctgtag

SEQ ID NO: 51288 - DNA, 22 bp, Homo sapiens
gccctagcgccagctcagcacc

SEQ ID NO: 51289 - DNA, 22 bp, Homo sapiens
tgggctgcaggggttgagagct

SEQ ID NO: 51290 - DNA, 19 bp, Homo sapiens
gggcaaagtgatcgtcctg

SEQ ID NO: 51291 - DNA, 22 bp, Homo sapiens
gtggatggagctggaagccatt

SEQ ID NO: 51292 - DNA, 22 bp, Homo sapiens
tgggaggccgaggcaggtggat

SEQ ID NO: 51293 - DNA, 22 bp, Homo sapiens
tctgcatattgttaatggaatg

SEQ ID NO: 51294 - DNA, 22 bp, Homo sapiens
tttgctgctgtatatggagccc

SEQ ID NO: 51295 - DNA, 22 bp, Homo sapiens
aggaaaatggaccagagttgtt

SEQ ID NO: 51296 - DNA, 22 bp, Homo sapiens
caggagctcagatgacatctca

SEQ ID NO: 51297 - DNA, 22 bp, Homo sapiens
gcttccacctactaaatgccac

SEQ ID NO: 51298 - DNA, 22 bp, Homo sapiens
ctgagcagatgaccagccccag

SEQ ID NO: 51299 - DNA, 22 bp, Homo sapiens
acaggggacctaggaccctcgg

SEQ ID NO: 51300 - DNA, 22 bp, Homo sapiens
gcccagccacagtcactttcat

SEQ ID NO: 51301 - DNA, 22 bp, Homo sapiens
ccaggaggcggaggttgcagtg

SEQ ID NO: 51302 - DNA, 22 bp, Homo sapiens
tttggactgcatgatgatctgg

SEQ ID NO: 51303 - DNA, 22 bp, Homo sapiens
gccaggacctcagatgcagggc

SEQ ID NO: 51304 - DNA, 21 bp, Homo sapiens
ccgtgctcggctatggaccac

SEQ ID NO: 51305 - DNA, 22 bp, Homo sapiens
gggtccagtagttggtggccgt

SEQ ID NO: 51306 - DNA, 22 bp, Homo sapiens
aatgtgagccaatgcccgtggg

SEQ ID NO: 51307 - DNA, 22 bp, Homo sapiens
gtggcccaggctggagtgcagt

SEQ ID NO: 51308 - DNA, 22 bp, Homo sapiens
tgtgaatggacaattaaatcta

SEQ ID NO: 51309 - DNA, 22 bp, Homo sapiens
cagagggttgatgtgaggctta

SEQ ID NO: 51310 - DNA, 22 bp, Homo sapiens
gggccggagctgggtcccgcgc

SEQ ID NO: 51311 - DNA, 22 bp, Homo sapiens
atgccactgcactccagcctag

SEQ ID NO: 51312 - DNA, 22 bp, Homo sapiens
tagatagattctcctatagagt

SEQ ID NO: 51313 - DNA, 22 bp, Homo sapiens
tccataaattttatgaacatat

SEQ ID NO: 51314 - DNA, 21 bp, Homo sapiens
tgctccaggagggggcagtcc

SEQ ID NO: 51315 - DNA, 22 bp, Homo sapiens
ggacagccgagtggccttctcc

SEQ ID NO: 51316 - DNA, 22 bp, Homo sapiens
tcttgcacttcatgaatatgtt

SEQ ID NO: 51317 - DNA, 22 bp, Homo sapiens
aagcatttcaggtagagatatt

SEQ ID NO: 51318 - DNA, 22 bp, Homo sapiens
cactgcactccagcctgggtga

SEQ ID NO: 51319 - DNA, 22 bp, Homo sapiens
cattgcactctagcctgggtga

SEQ ID NO: 51320 - DNA, 22 bp, Homo sapiens
aaaagcaattgcagttcttgcc

SEQ ID NO: 51321 - DNA, 22 bp, Homo sapiens
gccctgccctctcggcactcgc

SEQ ID NO: 51322 - DNA, 22 bp, Homo sapiens
tgcaatctcggcactttgggag

SEQ ID NO: 51323 - DNA, 22 bp, Homo sapiens
tagaataatctgaggaaatgct

SEQ ID NO: 51324 - DNA, 22 bp, Homo sapiens
tgattcatcagaataggagttt

SEQ ID NO: 51325 - DNA, 22 bp, Homo sapiens
tgaaatctttagtttctgtccc

SEQ ID NO: 51326 - DNA, 22 bp, Homo sapiens
gcggctccgaagccaggccgcg

SEQ ID NO: 51327 - DNA, 22 bp, Homo sapiens
ccaggagctggagggtgcagtg

SEQ ID NO: 51328 - DNA, 22 bp, Homo sapiens
gcccctgcctttgaacctggag

SEQ ID NO: 51329 - DNA, 22 bp, Homo sapiens
gaggttggggctgcagtgagct

SEQ ID NO: 51330 - DNA, 22 bp, Homo sapiens
gcaggcagatcacctgtcagga

SEQ ID NO: 51331 - DNA, 22 bp, Homo sapiens
ggaggaggggtgactgaatgct

SEQ ID NO: 51332 - DNA, 19 bp, Homo sapiens
aggaatggaattaattctg

SEQ ID NO: 51333 - DNA, 20 bp, Homo sapiens
tgttgattggtgtcatctca

SEQ ID NO: 51334 - DNA, 22 bp, Homo sapiens
gtcctggggattatagagtgtt

SEQ ID NO: 51335 - DNA, 22 bp, Homo sapiens
cccagcaggtcggtgctgcctg

SEQ ID NO: 51336 - DNA, 22 bp, Homo sapiens
gcaggaggttgagccaggactg

SEQ ID NO: 51337 - DNA, 22 bp, Homo sapiens
ccaggaggtggaggttgcggtg

SEQ ID NO: 51338 - DNA, 22 bp, Homo sapiens
accattgcactctagcctgggc

SEQ ID NO: 51339 - DNA, 22 bp, Homo sapiens
ctgccgttgtgaagctcttaga

SEQ ID NO: 51340 - DNA, 22 bp, Homo sapiens
agtgtggagcatcgagggcaga

SEQ ID NO: 51341 - DNA, 22 bp, Homo sapiens
tcactgcaagctctgccttccg

SEQ ID NO: 51342 - DNA, 22 bp, Homo sapiens
gaggggctgccctggtgtcagg

SEQ ID NO: 51343 - DNA, 22 bp, Homo sapiens
tcacaaatgtttgcatgtgtct

SEQ ID NO: 51344 - DNA, 22 bp, Homo sapiens
ctgtccgccgacttggccaggc

SEQ ID NO: 51345 - DNA, 22 bp, Homo sapiens
tgtggccattcttgaggtcgac

SEQ ID NO: 51346 - DNA, 22 bp, Homo sapiens
ggaggctgagaggtcgcagtgg

SEQ ID NO: 51347 - DNA, 22 bp, Homo sapiens
gctgcagggagctggaaggctc

SEQ ID NO: 51348 - DNA, 22 bp, Homo sapiens
ggcctctcttgggacagctgtc

SEQ ID NO: 51349 - DNA, 22 bp, Homo sapiens
gtcagtaggaacctagggtcaa

SEQ ID NO: 51350 - DNA, 18 bp, Homo sapiens
tcaaatactttgggcagt

SEQ ID NO: 51351 - DNA, 22 bp, Homo sapiens
cttaatctcacctgcaaagtcc

SEQ ID NO: 51352 - DNA, 22 bp, Homo sapiens
ctagttgaagaggctgtcatca

SEQ ID NO: 51353 - DNA, 22 bp, Homo sapiens
cccaggggttcaaggctgcagt

SEQ ID NO: 51354 - DNA, 22 bp, Homo sapiens
catataaatacaacatgtgtta

SEQ ID NO: 51355 - DNA, 22 bp, Homo sapiens
tgggggagctcagtccagccca

SEQ ID NO: 51356 - DNA, 22 bp, Homo sapiens
tggcccgaagatccgagggtca

SEQ ID NO: 51357 - DNA, 18 bp, Homo sapiens
agagtatacagacaacaa

SEQ ID NO: 51358 - DNA, 22 bp, Homo sapiens
gaggaggcagcctatcccttag

SEQ ID NO: 51359 - DNA, 22 bp, Homo sapiens
aagaaatgtgaatattgaatag

SEQ ID NO: 51360 - DNA, 22 bp, Homo sapiens
gggcttcagttctgaccatctt

SEQ ID NO: 51361 - DNA, 22 bp, Homo sapiens
gaggggagcccccatcctccag

SEQ ID NO: 51362 - DNA, 22 bp, Homo sapiens
agcatttatcttttgtttgagt

SEQ ID NO: 51363 - DNA, 22 bp, Homo sapiens
tcataaattctggtgctgtgag

SEQ ID NO: 51364 - DNA, 22 bp, Homo sapiens
cggtctcccgtgtgtgtgcgct

SEQ ID NO: 51365 - DNA, 22 bp, Homo sapiens
gggctctcccacaacgtgccag

SEQ ID NO: 51366 - DNA, 22 bp, Homo sapiens
ttgtgctcctgtgagaatctag

SEQ ID NO: 51367 - DNA, 22 bp, Homo sapiens
agctcaagctacacacagagtc

SEQ ID NO: 51368 - DNA, 22 bp, Homo sapiens
taggctaggctgaaggttttgg

SEQ ID NO: 51369 - DNA, 22 bp, Homo sapiens
cttcctcctccatctcgaaggc

SEQ ID NO: 51370 - DNA, 22 bp, Homo sapiens
gtccacagctctgaggtctccc

SEQ ID NO: 51371 - DNA, 22 bp, Homo sapiens
atgtatatgcatgcattcaaag

SEQ ID NO: 51372 - DNA, 22 bp, Homo sapiens
ggagtagctgcattccgagcac

SEQ ID NO: 51373 - DNA, 22 bp, Homo sapiens
tttcttctatgtgtgatatttt

SEQ ID NO: 51374 - DNA, 18 bp, Homo sapiens
tgtagagccaggtttgcc

SEQ ID NO: 51375 - DNA, 22 bp, Homo sapiens
gtacagaggttgctggaggctc

SEQ ID NO: 51376 - DNA, 22 bp, Homo sapiens
cttcccaccaaagcccttgttg

SEQ ID NO: 51377 - DNA, 22 bp, Homo sapiens
atatatttgagaatattcatga

SEQ ID NO: 51378 - DNA, 22 bp, Homo sapiens
ctcactgcaacctctgcctccc

SEQ ID NO: 51379 - DNA, 21 bp, Homo sapiens
cagggccaatcctgacctcta

SEQ ID NO: 51380 - DNA, 22 bp, Homo sapiens
atgccactgcacttcagcttgg

SEQ ID NO: 51381 - DNA, 22 bp, Homo sapiens
gggcggggtggctcatgcctgt

SEQ ID NO: 51382 - DNA, 22 bp, Homo sapiens
ctgcgggctgtcaggcgtgcca

SEQ ID NO: 51383 - DNA, 22 bp, Homo sapiens
ccaggaggcggaggttgcagcg

SEQ ID NO: 51384 - DNA, 22 bp, Homo sapiens
gggcgccgtgggaaacagccgg

SEQ ID NO: 51385 - DNA, 22 bp, Homo sapiens
gcagggtctgaggccacagagg

SEQ ID NO: 51386 - DNA, 22 bp, Homo sapiens
cggggcgagcagacggcggcaa

SEQ ID NO: 51387 - DNA, 22 bp, Homo sapiens
tcactgcactaggtaatgccac

SEQ ID NO: 51388 - DNA, 22 bp, Homo sapiens
acacagagccaaaccatatcac

SEQ ID NO: 51389 - DNA, 22 bp, Homo sapiens
gaggcggaggttgcagtgagcc

SEQ ID NO: 51390 - DNA, 22 bp, Homo sapiens
atatgggggggcgtgcagagga

SEQ ID NO: 51391 - DNA, 22 bp, Homo sapiens
gcctcctgtcccaggctgagga

SEQ ID NO: 51392 - DNA, 22 bp, Homo sapiens
acagtgcttagcacagagtaga

SEQ ID NO: 51393 - DNA, 22 bp, Homo sapiens
gaggaggcttccgggaggcacg

SEQ ID NO: 51394 - DNA, 22 bp, Homo sapiens
tcctcattcttggtgcatcaaa

SEQ ID NO: 51395 - DNA, 22 bp, Homo sapiens
tggctcctcacgtcctcagagc

SEQ ID NO: 51396 - DNA, 22 bp, Homo sapiens
gatggcggtcgtcgacggtcct

SEQ ID NO: 51397 - DNA, 22 bp, Homo sapiens
gcctccggagtcacagtgtctt

SEQ ID NO: 51398 - DNA, 22 bp, Homo sapiens
tataactacttgaagagttcag

SEQ ID NO: 51399 - DNA, 22 bp, Homo sapiens
gggctgggattgcttgctgtga

SEQ ID NO: 51400 - DNA, 22 bp, Homo sapiens
ctgagatggagttttgctcttg

SEQ ID NO: 51401 - DNA, 21 bp, Homo sapiens
aggcttggatctagacaggcc

SEQ ID NO: 51402 - DNA, 18 bp, Homo sapiens
aggagcggctgcggctgc

SEQ ID NO: 51403 - DNA, 22 bp, Homo sapiens
ggagagggtaggggtcctgccc

SEQ ID NO: 51404 - DNA, 22 bp, Homo sapiens
tgagctgacacccaatcatact

SEQ ID NO: 51405 - DNA, 22 bp, Homo sapiens
tctgcgtgaaactagatggcag

SEQ ID NO: 51406 - DNA, 22 bp, Homo sapiens
ggtccccccatggtgagcactg

SEQ ID NO: 51407 - DNA, 22 bp, Homo sapiens
ctgggaggcggaggttgcagtg

SEQ ID NO: 51408 - DNA, 20 bp, Homo sapiens
aggggcacctgcgacggggc

SEQ ID NO: 51409 - DNA, 22 bp, Homo sapiens
atgggttcaagtgattctcctg

SEQ ID NO: 51410 - DNA, 22 bp, Homo sapiens
gtcaggactctgacccgtcccg

SEQ ID NO: 51411 - DNA, 22 bp, Homo sapiens
cagtgggtcctgcgtctgccag

SEQ ID NO: 51412 - DNA, 22 bp, Homo sapiens
cgtctctggcccggcccctggg

SEQ ID NO: 51413 - DNA, 22 bp, Homo sapiens
gagtccctgctgtcaggtgctg

SEQ ID NO: 51414 - DNA, 22 bp, Homo sapiens
actgcatttgtctgtctcaatt

SEQ ID NO: 51415 - DNA, 22 bp, Homo sapiens
cgtgagcaaaatggacactccc

SEQ ID NO: 51416 - DNA, 20 bp, Homo sapiens
tttgaatgtaaagcatgtca

SEQ ID NO: 51417 - DNA, 18 bp, Homo sapiens
gaggatggaaggagatgc

SEQ ID NO: 51418 - DNA, 22 bp, Homo sapiens
cctaggagttcgaagctgcagt

SEQ ID NO: 51419 - DNA, 22 bp, Homo sapiens
taacatttaaatttttcacata

SEQ ID NO: 51420 - DNA, 21 bp, Homo sapiens
cttccccaggctggtctgtat

SEQ ID NO: 51421 - DNA, 22 bp, Homo sapiens
ggtgaggggctcctctgcccgg

SEQ ID NO: 51422 - DNA, 22 bp, Homo sapiens
cccagcaggaggaggttgcagt

SEQ ID NO: 51423 - DNA, 22 bp, Homo sapiens
cgcggtggcggcctccagcgcc

SEQ ID NO: 51424 - DNA, 22 bp, Homo sapiens
accaggcccgctgctatggtgg

SEQ ID NO: 51425 - DNA, 22 bp, Homo sapiens
aaatatcttaggagtatatgag

SEQ ID NO: 51426 - DNA, 22 bp, Homo sapiens
tggaatggaaacaaactgagga

SEQ ID NO: 51427 - DNA, 22 bp, Homo sapiens
gccatcatatcccctgtgacct

SEQ ID NO: 51428 - DNA, 22 bp, Homo sapiens
cattgcactccagtctgggcca

SEQ ID NO: 51429 - DNA, 22 bp, Homo sapiens
gatgcactgcagtatatactgt

SEQ ID NO: 51430 - DNA, 22 bp, Homo sapiens
cacagctgtgagaagggagcct

SEQ ID NO: 51431 - DNA, 22 bp, Homo sapiens
acatgtttaagtttgttatatg

SEQ ID NO: 51432 - DNA, 22 bp, Homo sapiens
cagggtttcaccatgttagcag

SEQ ID NO: 51433 - DNA, 22 bp, Homo sapiens
tgaaatcttcactaagtctctt

SEQ ID NO: 51434 - DNA, 22 bp, Homo sapiens
ggaggggatttagtagatgcta

SEQ ID NO: 51435 - DNA, 22 bp, Homo sapiens
aggagcagaccgtagtcctgca

SEQ ID NO: 51436 - DNA, 21 bp, Homo sapiens
gttcaaatcctgacactacac

SEQ ID NO: 51437 - DNA, 22 bp, Homo sapiens
agttgcagacgcagagatgttg

SEQ ID NO: 51438 - DNA, 22 bp, Homo sapiens
ggtgggagagctctgtctccag

SEQ ID NO: 51439 - DNA, 20 bp, Homo sapiens
aactcctagcctcaagtgat

SEQ ID NO: 51440 - DNA, 22 bp, Homo sapiens
gccttgtttcattacacgtggt

SEQ ID NO: 51441 - DNA, 22 bp, Homo sapiens
ggtgatccaccagcctcggcct

SEQ ID NO: 51442 - DNA, 22 bp, Homo sapiens
gggaggcagtgctggaggctgg

SEQ ID NO: 51443 - DNA, 22 bp, Homo sapiens
atttagaactttgtttgccaat

SEQ ID NO: 51444 - DNA, 22 bp, Homo sapiens
gagcccaggaagtggaggctga

SEQ ID NO: 51445 - DNA, 20 bp, Homo sapiens
ggtggccgtagcgggcggcg

SEQ ID NO: 51446 - DNA, 22 bp, Homo sapiens
gagggggctagcgcagtgccca

SEQ ID NO: 51447 - DNA, 22 bp, Homo sapiens
ggagcagggaattacagcgcag

SEQ ID NO: 51448 - DNA, 19 bp, Homo sapiens
catctggatgattctcctg

SEQ ID NO: 51449 - DNA, 22 bp, Homo sapiens
cgaggaggaaacgcggagaact

SEQ ID NO: 51450 - DNA, 21 bp, Homo sapiens
tccctgagcccaaggggctcc

SEQ ID NO: 51451 - DNA, 21 bp, Homo sapiens
gtggttctagagaaacagaat

SEQ ID NO: 51452 - DNA, 22 bp, Homo sapiens
tccaactttctcctccggcttg

SEQ ID NO: 51453 - DNA, 22 bp, Homo sapiens
gaggtaggtgtaggaggcctgc

SEQ ID NO: 51454 - DNA, 22 bp, Homo sapiens
gtgaaatatttaacgtccaggt

SEQ ID NO: 51455 - DNA, 22 bp, Homo sapiens
cagctggtgtcaggcactgcag

SEQ ID NO: 51456 - DNA, 22 bp, Homo sapiens
accctggacatcttgtcatagc

SEQ ID NO: 51457 - DNA, 22 bp, Homo sapiens
acttttaaatgagtttcagttg

SEQ ID NO: 51458 - DNA, 22 bp, Homo sapiens
tggggcagttaataaacattct

SEQ ID NO: 51459 - DNA, 22 bp, Homo sapiens
gaggaccactgcttagtaagat

SEQ ID NO: 51460 - DNA, 20 bp, Homo sapiens
gtctccactgggggttaacc

SEQ ID NO: 51461 - DNA, 22 bp, Homo sapiens
tagcacagcttcttgatgtcac

SEQ ID NO: 51462 - DNA, 22 bp, Homo sapiens
ccatgaattcactccatgctag

SEQ ID NO: 51463 - DNA, 22 bp, Homo sapiens
tggtgccatcatagctcactgc

SEQ ID NO: 51464 - DNA, 22 bp, Homo sapiens
gcatctaaataaacgtgggagt

SEQ ID NO: 51465 - DNA, 22 bp, Homo sapiens
ggaaggggtgggtgagcctcag

SEQ ID NO: 51466 - DNA, 22 bp, Homo sapiens
tgtgaaagatactaggcagagg

SEQ ID NO: 51467 - DNA, 22 bp, Homo sapiens
tcgcggggaagtggtgggctaa

SEQ ID NO: 51468 - DNA, 22 bp, Homo sapiens
cacagctgaagtagccatgtgg

SEQ ID NO: 51469 - DNA, 22 bp, Homo sapiens
gtaggtcagacataagaggaca

SEQ ID NO: 51470 - DNA, 22 bp, Homo sapiens
ctgaggagaggtggcctgtgtt

SEQ ID NO: 51471 - DNA, 22 bp, Homo sapiens
ggcctcacccatcggtgccttt

SEQ ID NO: 51472 - DNA, 22 bp, Homo sapiens
gggaagatagtgttgagggccc

SEQ ID NO: 51473 - DNA, 22 bp, Homo sapiens
cgggcccgagcacggcacccac

SEQ ID NO: 51474 - DNA, 22 bp, Homo sapiens
aagtcattggtagcttgatagg

SEQ ID NO: 51475 - DNA, 22 bp, Homo sapiens
ggctgcaggttggttggcagct

SEQ ID NO: 51476 - DNA, 22 bp, Homo sapiens
aggccagcagcatgacggcatc

SEQ ID NO: 51477 - DNA, 22 bp, Homo sapiens
tgatctttggtaatctggcaca

SEQ ID NO: 51478 - DNA, 22 bp, Homo sapiens
tttaagaagttatgttataaat

SEQ ID NO: 51479 - DNA, 22 bp, Homo sapiens
taaaatttgtccctgagtgttg

SEQ ID NO: 51480 - DNA, 22 bp, Homo sapiens
gggaagtgatggagccaggatt

SEQ ID NO: 51481 - DNA, 22 bp, Homo sapiens
gtttgtcttaattaggcatcga

SEQ ID NO: 51482 - DNA, 19 bp, Homo sapiens
acacagggatcagagggtt

SEQ ID NO: 51483 - DNA, 22 bp, Homo sapiens
gccatgggcaaatgcagagctg

SEQ ID NO: 51484 - DNA, 22 bp, Homo sapiens
tcactgtagcctcaactcttgg

SEQ ID NO: 51485 - DNA, 20 bp, Homo sapiens
ggcagagggcctgggagaag

SEQ ID NO: 51486 - DNA, 22 bp, Homo sapiens
atacacgtgccatgttggtgtg

SEQ ID NO: 51487 - DNA, 22 bp, Homo sapiens
tgtattctaaatacatcttacc

SEQ ID NO: 51488 - DNA, 22 bp, Homo sapiens
agggcagagctgtctaaatggc

SEQ ID NO: 51489 - DNA, 22 bp, Homo sapiens
ggcgccagcactgcagcgcctc

SEQ ID NO: 51490 - DNA, 22 bp, Homo sapiens
ctcagctcattgtggatccggt

SEQ ID NO: 51491 - DNA, 22 bp, Homo sapiens
agatgtgagaatcaagtgacca

SEQ ID NO: 51492 - DNA, 22 bp, Homo sapiens
cattacagaatatgtaatgatc

SEQ ID NO: 51493 - DNA, 22 bp, Homo sapiens
ggtgcagaggagccagctgggg

SEQ ID NO: 51494 - DNA, 22 bp, Homo sapiens
gaggcgggcagatcacctgagg

SEQ ID NO: 51495 - DNA, 22 bp, Homo sapiens
agctcaccacaacctccgcctc

SEQ ID NO: 51496 - DNA, 22 bp, Homo sapiens
atggggctgttctctgccctgc

SEQ ID NO: 51497 - DNA, 22 bp, Homo sapiens
aggtctgtttaacaaagtcagg

SEQ ID NO: 51498 - DNA, 22 bp, Homo sapiens
gaggtggatgttgcagtgagct

SEQ ID NO: 51499 - DNA, 22 bp, Homo sapiens
aatattatcaaaagctttttca

SEQ ID NO: 51500 - DNA, 22 bp, Homo sapiens
tagatctgatacaattcatctg

SEQ ID NO: 51501 - DNA, 22 bp, Homo sapiens
aaaaagtattggccatggttga

SEQ ID NO: 51502 - DNA, 22 bp, Homo sapiens
tggagaattctatgttgagggg

SEQ ID NO: 51503 - DNA, 22 bp, Homo sapiens
attcgcgggcctggagggtggg

SEQ ID NO: 51504 - DNA, 23 bp, Homo sapiens
cagggccctgctcaatttctcca

SEQ ID NO: 51505 - DNA, 22 bp, Homo sapiens
ccgtggtcacctgagctccttg

SEQ ID NO: 51506 - DNA, 22 bp, Homo sapiens
aggtattattagcatctctatt

SEQ ID NO: 51507 - DNA, 22 bp, Homo sapiens
aggggtgaaagagggccctcaa

SEQ ID NO: 51508 - DNA, 22 bp, Homo sapiens
ggctgggcctctccctcagctg

SEQ ID NO: 51509 - DNA, 22 bp, Homo sapiens
atccttgagccaatgactgatt

SEQ ID NO: 51510 - DNA, 22 bp, Homo sapiens
ctcactgcaacctccgtctccc

SEQ ID NO: 51511 - DNA, 23 bp, Homo sapiens
ctcaccaagcgccgccgctgtgt

SEQ ID NO: 51512 - DNA, 22 bp, Homo sapiens
tgagatgagggctgcactcaaa

SEQ ID NO: 51513 - DNA, 22 bp, Homo sapiens
atatccagcagcaggtgagtat

SEQ ID NO: 51514 - DNA, 22 bp, Homo sapiens
ggctgggctccgggagcatgcg

SEQ ID NO: 51515 - DNA, 20 bp, Homo sapiens
tcacatcctctcccaacatg

SEQ ID NO: 51516 - DNA, 22 bp, Homo sapiens
actctgcctgcggtgggcggga

SEQ ID NO: 51517 - DNA, 21 bp, Homo sapiens
ctggaggcaggtggtgccagg

SEQ ID NO: 51518 - DNA, 22 bp, Homo sapiens
gagaaagcttctttcccacagg

SEQ ID NO: 51519 - DNA, 22 bp, Homo sapiens
attaaagctatccagtcatgaa

SEQ ID NO: 51520 - DNA, 21 bp, Homo sapiens
ggccccgcagacccagcacgt

SEQ ID NO: 51521 - DNA, 23 bp, Homo sapiens
ggggcctgcaccggtctgcgcgg

SEQ ID NO: 51522 - DNA, 22 bp, Homo sapiens
ctcctccacccgctggggccca

SEQ ID NO: 51523 - DNA, 22 bp, Homo sapiens
ttggagatatcacaccttcaca

SEQ ID NO: 51524 - DNA, 22 bp, Homo sapiens
acagtatagggcttatattgta

SEQ ID NO: 51525 - DNA, 22 bp, Homo sapiens
ggctcctgggggtgctcctgcc

SEQ ID NO: 51526 - DNA, 22 bp, Homo sapiens
tttctcatggaacatcgtttag

SEQ ID NO: 51527 - DNA, 22 bp, Homo sapiens
tctgcaacattcctctccccac

SEQ ID NO: 51528 - DNA, 22 bp, Homo sapiens
tgggaaggggagctggaaagga

SEQ ID NO: 51529 - DNA, 22 bp, Homo sapiens
ggagagtggattccagctgtat

SEQ ID NO: 51530 - DNA, 22 bp, Homo sapiens
ggctctgcgcctgcggggactt

SEQ ID NO: 51531 - DNA, 22 bp, Homo sapiens
tttgaggttagctagcagatca

SEQ ID NO: 51532 - DNA, 22 bp, Homo sapiens
cttggggcagcccaggctgagc

SEQ ID NO: 51533 - DNA, 22 bp, Homo sapiens
gggacctcgcatgcacgaagcc

SEQ ID NO: 51534 - DNA, 22 bp, Homo sapiens
tgccgcagtgcggggagggccc

SEQ ID NO: 51535 - DNA, 22 bp, Homo sapiens
cggctggtgtcgggcacagcaa

SEQ ID NO: 51536 - DNA, 22 bp, Homo sapiens
ggctcttccgccaccagccaca

SEQ ID NO: 51537 - DNA, 22 bp, Homo sapiens
gctggaggatggactggaagaa

SEQ ID NO: 51538 - DNA, 21 bp, Homo sapiens
ctctgtttgcctgctgccatc

SEQ ID NO: 51539 - DNA, 23 bp, Homo sapiens
tcaagcaattctcctgcctcggc

SEQ ID NO: 51540 - DNA, 22 bp, Homo sapiens
tgcgcggctcagtcatctccag

SEQ ID NO: 51541 - DNA, 22 bp, Homo sapiens
gtgttaaccagctaaactttgc

SEQ ID NO: 51542 - DNA, 22 bp, Homo sapiens
tcctgccgtcctccggggcctc

SEQ ID NO: 51543 - DNA, 19 bp, Homo sapiens
ggggcccggggtctgcgag

SEQ ID NO: 51544 - DNA, 22 bp, Homo sapiens
ggccggggcctgctcgcctgtg

SEQ ID NO: 51545 - DNA, 22 bp, Homo sapiens
ggcagggcaggaaagtcaggaa

SEQ ID NO: 51546 - DNA, 22 bp, Homo sapiens
gagctctgactgctgggtgaca

SEQ ID NO: 51547 - DNA, 22 bp, Homo sapiens
caggctggagttcagtggtgtg

SEQ ID NO: 51548 - DNA, 22 bp, Homo sapiens
tttgcattgcattaagtattct

SEQ ID NO: 51549 - DNA, 19 bp, Homo sapiens
gatttaaacgtggctctat

SEQ ID NO: 51550 - DNA, 22 bp, Homo sapiens
agctggagatgagtgacgtgcc

SEQ ID NO: 51551 - DNA, 22 bp, Homo sapiens
aggccagcctcaggcagggacc

SEQ ID NO: 51552 - DNA, 22 bp, Homo sapiens
ggctctgcttgaggccagcctg

SEQ ID NO: 51553 - DNA, 22 bp, Homo sapiens
tgggaagaggggtataaagaag

SEQ ID NO: 51554 - DNA, 22 bp, Homo sapiens
caccaggctggagtgcagtggc

SEQ ID NO: 51555 - DNA, 22 bp, Homo sapiens
ccaggaggcagaagttgcagtg

SEQ ID NO: 51556 - DNA, 22 bp, Homo sapiens
ggtcacgtgaccgcacctgcct

SEQ ID NO: 51557 - DNA, 20 bp, Homo sapiens
tcagccattccttacctttc

SEQ ID NO: 51558 - DNA, 22 bp, Homo sapiens
tacaccattcccaggtggattt

SEQ ID NO: 51559 - DNA, 22 bp, Homo sapiens
ctgggaggcagaggttgtagtg

SEQ ID NO: 51560 - DNA, 22 bp, Homo sapiens
tgttatctgagcaacgtcgacg

SEQ ID NO: 51561 - DNA, 19 bp, Homo sapiens
gcagacaggtccagagagg

SEQ ID NO: 51562 - DNA, 22 bp, Homo sapiens
tgctgtgaggttgagaaggaag

SEQ ID NO: 51563 - DNA, 22 bp, Homo sapiens
cttagatgaagtcacagaaccc

SEQ ID NO: 51564 - DNA, 22 bp, Homo sapiens
ttgtgttggcgaaagcatgtca

SEQ ID NO: 51565 - DNA, 22 bp, Homo sapiens
tgctattgtgaacagtgccaca

SEQ ID NO: 51566 - DNA, 22 bp, Homo sapiens
agtgcactggcaccatctcagc

SEQ ID NO: 51567 - DNA, 18 bp, Homo sapiens
cttgttcttctcttggcg

SEQ ID NO: 51568 - DNA, 18 bp, Homo sapiens
ccctgccagctcccagca

SEQ ID NO: 51569 - DNA, 22 bp, Homo sapiens
gaaaggagagggttaaggagct

SEQ ID NO: 51570 - DNA, 22 bp, Homo sapiens
ctcgggcaccctggttctggtg

SEQ ID NO: 51571 - DNA, 22 bp, Homo sapiens
tcgaaataatttagaatataga

SEQ ID NO: 51572 - DNA, 22 bp, Homo sapiens
gctcaagccttctgcccacctc

SEQ ID NO: 51573 - DNA, 22 bp, Homo sapiens
gggtggtggccagcagtgggca

SEQ ID NO: 51574 - DNA, 22 bp, Homo sapiens
gagccaggaggcagagactgca

SEQ ID NO: 51575 - DNA, 22 bp, Homo sapiens
aaagcctcccaggttatgagta

SEQ ID NO: 51576 - DNA, 22 bp, Homo sapiens
caggaagaccagggctgtggct

SEQ ID NO: 51577 - DNA, 22 bp, Homo sapiens
ctgaaggatgtgtggtgggagt

SEQ ID NO: 51578 - DNA, 22 bp, Homo sapiens
ttctccgctaagttctctgcag

SEQ ID NO: 51579 - DNA, 22 bp, Homo sapiens
aggtaaagacagtgaaagaggg

SEQ ID NO: 51580 - DNA, 22 bp, Homo sapiens
tgtcctcatcctccagtctgtc

SEQ ID NO: 51581 - DNA, 22 bp, Homo sapiens
gggcagagactcagaaacagaa

SEQ ID NO: 51582 - DNA, 22 bp, Homo sapiens
agaaaacataggagacaggaaa

SEQ ID NO: 51583 - DNA, 22 bp, Homo sapiens
cgaggcggcggaagtgcccgta

SEQ ID NO: 51584 - DNA, 22 bp, Homo sapiens
ggggcaggagcccttcttcagc

SEQ ID NO: 51585 - DNA, 22 bp, Homo sapiens
ctcccagccttcgccagtctga

SEQ ID NO: 51586 - DNA, 22 bp, Homo sapiens
actggggctgatgcgttcgtgt

SEQ ID NO: 51587 - DNA, 22 bp, Homo sapiens
cggagcgctgggggactctgca

SEQ ID NO: 51588 - DNA, 22 bp, Homo sapiens
catcactgtccaaagttcagtt

SEQ ID NO: 51589 - DNA, 22 bp, Homo sapiens
agaaaatttaaagagacacaca

SEQ ID NO: 51590 - DNA, 22 bp, Homo sapiens
catagacagatggtaagaagct

SEQ ID NO: 51591 - DNA, 22 bp, Homo sapiens
gaagatacaaatttcttagatg

SEQ ID NO: 51592 - DNA, 22 bp, Homo sapiens
actagaaagaagttttttgaga

SEQ ID NO: 51593 - DNA, 22 bp, Homo sapiens
ggcaggactgatcagtgggatg

SEQ ID NO: 51594 - DNA, 22 bp, Homo sapiens
aacagcttgctgcaccttaata

SEQ ID NO: 51595 - DNA, 18 bp, Homo sapiens
ccgggctttggtgacaca

SEQ ID NO: 51596 - DNA, 20 bp, Homo sapiens
caagggtttgcattggcttt

SEQ ID NO: 51597 - DNA, 22 bp, Homo sapiens
tctcgctctgtcgcccaggctg

SEQ ID NO: 51598 - DNA, 22 bp, Homo sapiens
aagtaaatatctgtagtcttta

SEQ ID NO: 51599 - DNA, 17 bp, Homo sapiens
tgttccatttgaccacc

SEQ ID NO: 51600 - DNA, 22 bp, Homo sapiens
cggctcactgcagctccgcctc

SEQ ID NO: 51601 - DNA, 22 bp, Homo sapiens
ggaggcagaatagagtgtgggt

SEQ ID NO: 51602 - DNA, 22 bp, Homo sapiens
actgggcagcagctcgagccgc

SEQ ID NO: 51603 - DNA, 22 bp, Homo sapiens
gagtgttccagaaactggccct

SEQ ID NO: 51604 - DNA, 22 bp, Homo sapiens
tggatctcggcaatgcgggact

SEQ ID NO: 51605 - DNA, 22 bp, Homo sapiens
cctgtgcttggccagagaggtt

SEQ ID NO: 51606 - DNA, 18 bp, Homo sapiens
ggcgggtgttttattcac

SEQ ID NO: 51607 - DNA, 22 bp, Homo sapiens
aggaggggttctcgggtgctga

SEQ ID NO: 51608 - DNA, 22 bp, Homo sapiens
acagcagagcctggtacttact

SEQ ID NO: 51609 - DNA, 22 bp, Homo sapiens
cccaggaggtggagcttgcagt

SEQ ID NO: 51610 - DNA, 22 bp, Homo sapiens
tgagcacatttcacatgacagg

SEQ ID NO: 51611 - DNA, 22 bp, Homo sapiens
tttgtagattttctctccagta

SEQ ID NO: 51612 - DNA, 22 bp, Homo sapiens
aaggagaggttgtccgtgttgt

SEQ ID NO: 51613 - DNA, 22 bp, Homo sapiens
atacatgcgccatgttggtgtg

SEQ ID NO: 51614 - DNA, 21 bp, Homo sapiens
gggcagaggggcctcctgggt

SEQ ID NO: 51615 - DNA, 22 bp, Homo sapiens
gcctccggagttgcagtgtctt

SEQ ID NO: 51616 - DNA, 23 bp, Homo sapiens
tgtgggcgcattgtaagggtagc

SEQ ID NO: 51617 - DNA, 22 bp, Homo sapiens
gaggcagaggttgcagtgagct

SEQ ID NO: 51618 - DNA, 22 bp, Homo sapiens
ccgccgtgtcgacaggccctgg

SEQ ID NO: 51619 - DNA, 22 bp, Homo sapiens
tcatcagggatattggcctgaa

SEQ ID NO: 51620 - DNA, 22 bp, Homo sapiens
agagcgagtctggggctcggat

SEQ ID NO: 51621 - DNA, 22 bp, Homo sapiens
tatgacttttcccaattcagga

SEQ ID NO: 51622 - DNA, 22 bp, Homo sapiens
tgagatgaataactcctgctaa

SEQ ID NO: 51623 - DNA, 22 bp, Homo sapiens
acgggctgggacggggaagctc

SEQ ID NO: 51624 - DNA, 22 bp, Homo sapiens
tctgcaggaagctggcggctga

SEQ ID NO: 51625 - DNA, 19 bp, Homo sapiens
ggagccgccgcccttcatt

SEQ ID NO: 51626 - DNA, 22 bp, Homo sapiens
caggctggagtgcagtggggcg

SEQ ID NO: 51627 - DNA, 22 bp, Homo sapiens
gaggtgggtgtatcacaggtca

SEQ ID NO: 51628 - DNA, 22 bp, Homo sapiens
cctcgtccacaatccttgcaca

SEQ ID NO: 51629 - DNA, 22 bp, Homo sapiens
gcggggcctgactctgacccgc

SEQ ID NO: 51630 - DNA, 22 bp, Homo sapiens
cctgggccctcaccgccggtgg

SEQ ID NO: 51631 - DNA, 22 bp, Homo sapiens
gggcagagagctggaactcctt

SEQ ID NO: 51632 - DNA, 22 bp, Homo sapiens
tcgctgaggctgcacggctgcc

SEQ ID NO: 51633 - DNA, 22 bp, Homo sapiens
ctgtggctctcagaggctgctg

SEQ ID NO: 51634 - DNA, 22 bp, Homo sapiens
tccttgactgtgaggaactagc

SEQ ID NO: 51635 - DNA, 22 bp, Homo sapiens
tgaggcaggagaatcaccggaa

SEQ ID NO: 51636 - DNA, 22 bp, Homo sapiens
gcccccgtagtagatgaggcgc

SEQ ID NO: 51637 - DNA, 22 bp, Homo sapiens
aaaggtcaaaatcgtgacattg

SEQ ID NO: 51638 - DNA, 22 bp, Homo sapiens
ggtgccaggctgtagtcagggt

SEQ ID NO: 51639 - DNA, 22 bp, Homo sapiens
ttatttttaaaagttcacacag

SEQ ID NO: 51640 - DNA, 22 bp, Homo sapiens
cactgcacttcagcctgggtga

SEQ ID NO: 51641 - DNA, 22 bp, Homo sapiens
gtctgctcatgctaccgcgggc

SEQ ID NO: 51642 - DNA, 16 bp, Homo sapiens
aggctcagaggctgga

SEQ ID NO: 51643 - DNA, 22 bp, Homo sapiens
atttggcagtataaattctggc

SEQ ID NO: 51644 - DNA, 22 bp, Homo sapiens
ctacattaaattggcttactta

SEQ ID NO: 51645 - DNA, 21 bp, Homo sapiens
atgcattcctcccctttcctc

SEQ ID NO: 51646 - DNA, 22 bp, Homo sapiens
gtctccggccgccctggtgctg

SEQ ID NO: 51647 - DNA, 22 bp, Homo sapiens
taaatgttgtaagtacatctaa

SEQ ID NO: 51648 - DNA, 23 bp, Homo sapiens
ggctgggagctccgggtgcacgt

SEQ ID NO: 51649 - DNA, 22 bp, Homo sapiens
tgcgggagggcaacgcggcatt

SEQ ID NO: 51650 - DNA, 22 bp, Homo sapiens
tcagcaatcctcccacaggtgg

SEQ ID NO: 51651 - DNA, 22 bp, Homo sapiens
gtgtggtcgaagttctcccgga

SEQ ID NO: 51652 - DNA, 22 bp, Homo sapiens
tcactgcagcctctgcctcccg

SEQ ID NO: 51653 - DNA, 22 bp, Homo sapiens
agcccggcttccccggttgcta

SEQ ID NO: 51654 - DNA, 22 bp, Homo sapiens
gccgtggggagagagggtgcgt

SEQ ID NO: 51655 - DNA, 22 bp, Homo sapiens
gtggactgcgcttgagggggcc

SEQ ID NO: 51656 - DNA, 22 bp, Homo sapiens
tgacagaggagctggaatgatt

SEQ ID NO: 51657 - DNA, 22 bp, Homo sapiens
gcgagtgccgagagggcagggc

SEQ ID NO: 51658 - DNA, 22 bp, Homo sapiens
tcctgagataaatctcatgtga

SEQ ID NO: 51659 - DNA, 22 bp, Homo sapiens
agtgcaggccccaggccaggcc

SEQ ID NO: 51660 - DNA, 22 bp, Homo sapiens
ctcttagtaatgccatgaagca

SEQ ID NO: 51661 - DNA, 22 bp, Homo sapiens
ctggcaggttatagagctgccc

SEQ ID NO: 51662 - DNA, 22 bp, Homo sapiens
cccagtttcaactttccagtgg

SEQ ID NO: 51663 - DNA, 22 bp, Homo sapiens
tcccagaaacgcatatgttcat

SEQ ID NO: 51664 - DNA, 22 bp, Homo sapiens
attttctatgttgtaattgtta

SEQ ID NO: 51665 - DNA, 22 bp, Homo sapiens
aggctctgtcaggcggagcagc

SEQ ID NO: 51666 - DNA, 22 bp, Homo sapiens
ttgatcaaatcagctactgagg

SEQ ID NO: 51667 - DNA, 22 bp, Homo sapiens
cactccagatcacaccccttgg

SEQ ID NO: 51668 - DNA, 22 bp, Homo sapiens
atcatgttttaattagcaaact

SEQ ID NO: 51669 - DNA, 22 bp, Homo sapiens
ccctggaggttgaggctgcagt

SEQ ID NO: 51670 - DNA, 22 bp, Homo sapiens
acaggatcgccctgttgcccag

SEQ ID NO: 51671 - DNA, 22 bp, Homo sapiens
agtgaccgaggcacttggcaac

SEQ ID NO: 51672 - DNA, 22 bp, Homo sapiens
gggcggatcacctgaggtcagg

SEQ ID NO: 51673 - DNA, 22 bp, Homo sapiens
gagtggggggtccgtctcagtg

SEQ ID NO: 51674 - DNA, 22 bp, Homo sapiens
cccaggccctggcagagcttgt

SEQ ID NO: 51675 - DNA, 22 bp, Homo sapiens
gaggtgggcggatcacaaggtc

SEQ ID NO: 51676 - DNA, 22 bp, Homo sapiens
gctttatccgcttgacccttac

SEQ ID NO: 51677 - DNA, 22 bp, Homo sapiens
aacatacgagcagtttatagag

SEQ ID NO: 51678 - DNA, 22 bp, Homo sapiens
tagcatgtcagtcgccacacgt

SEQ ID NO: 51679 - DNA, 22 bp, Homo sapiens
accctggaggtggaggtgcagt

SEQ ID NO: 51680 - DNA, 22 bp, Homo sapiens
aaccaccattctctcctcttcc

SEQ ID NO: 51681 - DNA, 18 bp, Homo sapiens
ggtgagggagctggaagc

SEQ ID NO: 51682 - DNA, 22 bp, Homo sapiens
gaaggaagtcattagtgcagac

SEQ ID NO: 51683 - DNA, 21 bp, Homo sapiens
tactgtagccttgcactgtag

SEQ ID NO: 51684 - DNA, 22 bp, Homo sapiens
tttcctcttctggcaggcaggg

SEQ ID NO: 51685 - DNA, 23 bp, Homo sapiens
gggggccgtcctggggattatag

SEQ ID NO: 51686 - DNA, 22 bp, Homo sapiens
agagctccagggttttgtagtg

SEQ ID NO: 51687 - DNA, 22 bp, Homo sapiens
cctgggggccaggaaggtgtga

SEQ ID NO: 51688 - DNA, 22 bp, Homo sapiens
tccggcggccggcctgagcccg

SEQ ID NO: 51689 - DNA, 22 bp, Homo sapiens
ggtgccagatgaggcccgcgat

SEQ ID NO: 51690 - DNA, 22 bp, Homo sapiens
gccagcagcttcttctcatcct

SEQ ID NO: 51691 - DNA, 22 bp, Homo sapiens
ccaagcaaataatcacccacta

SEQ ID NO: 51692 - DNA, 22 bp, Homo sapiens
ctcactgcaagctcagcctccc

SEQ ID NO: 51693 - DNA, 22 bp, Homo sapiens
gagaaagctaaataagttgatt

SEQ ID NO: 51694 - DNA, 22 bp, Homo sapiens
tcttaagcagagaagaagttga

SEQ ID NO: 51695 - DNA, 22 bp, Homo sapiens
ctgctttgcatagctgccagag

SEQ ID NO: 51696 - DNA, 22 bp, Homo sapiens
agaagcagaaactgggcttgtg

SEQ ID NO: 51697 - DNA, 22 bp, Homo sapiens
ggaggcccagaaggaagcccag

SEQ ID NO: 51698 - DNA, 23 bp, Homo sapiens
gcgtccggcctctctcgctcccg

SEQ ID NO: 51699 - DNA, 22 bp, Homo sapiens
tttattctgtgctacatgaaga

SEQ ID NO: 51700 - DNA, 22 bp, Homo sapiens
gtgaggcgaaggtgctggcgcc

SEQ ID NO: 51701 - DNA, 22 bp, Homo sapiens
ggctccccaggtccaggagctg

SEQ ID NO: 51702 - DNA, 22 bp, Homo sapiens
cagccccacacggtctagctct

SEQ ID NO: 51703 - DNA, 22 bp, Homo sapiens
ccccatgaagtagggtctctga

SEQ ID NO: 51704 - DNA, 22 bp, Homo sapiens
attgattttcagactatgcgag

SEQ ID NO: 51705 - DNA, 22 bp, Homo sapiens
tggtgctgccaggctcctgcca

SEQ ID NO: 51706 - DNA, 22 bp, Homo sapiens
caggcgggcaggtgcggcccct

SEQ ID NO: 51707 - DNA, 20 bp, Homo sapiens
ttgttagaggaatgccatag

SEQ ID NO: 51708 - DNA, 22 bp, Homo sapiens
tctctttgcctgctgccatcca

SEQ ID NO: 51709 - DNA, 22 bp, Homo sapiens
cccaggagttggaggctgcagt

SEQ ID NO: 51710 - DNA, 22 bp, Homo sapiens
ccgcggggtcatggctgggccg

SEQ ID NO: 51711 - DNA, 22 bp, Homo sapiens
cagtgatatttatcctactcac

SEQ ID NO: 51712 - DNA, 22 bp, Homo sapiens
cgcggctctgcgggccgctgag

SEQ ID NO: 51713 - DNA, 22 bp, Homo sapiens
tcactgcaacctctgcctcccg

SEQ ID NO: 51714 - DNA, 22 bp, Homo sapiens
cctcagacccctgctgagcttc

SEQ ID NO: 51715 - DNA, 22 bp, Homo sapiens
gtctatgatattttgttatagc

SEQ ID NO: 51716 - DNA, 22 bp, Homo sapiens
ggagtgtgattgttctctgtta

SEQ ID NO: 51717 - DNA, 22 bp, Homo sapiens
ctgggtggcagagcctgcagtg

SEQ ID NO: 51718 - DNA, 22 bp, Homo sapiens
cgccgcctgctgcagcagctgt

SEQ ID NO: 51719 - DNA, 22 bp, Homo sapiens
gatttctctgcacccactcagg

SEQ ID NO: 51720 - DNA, 17 bp, Homo sapiens
acctattgatctgtcac

SEQ ID NO: 51721 - DNA, 18 bp, Homo sapiens
cccacggtgctgtagggc

SEQ ID NO: 51722 - DNA, 20 bp, Homo sapiens
tcactgtaacatttgggggg

SEQ ID NO: 51723 - DNA, 22 bp, Homo sapiens
gccgtgtcatctgcgggtggca

SEQ ID NO: 51724 - DNA, 22 bp, Homo sapiens
catgtaaagaatttcacacaag

SEQ ID NO: 51725 - DNA, 22 bp, Homo sapiens
cagggcctcctaaggcatctaa

SEQ ID NO: 51726 - DNA, 22 bp, Homo sapiens
ttgtgaaacattcatggatttg

SEQ ID NO: 51727 - DNA, 22 bp, Homo sapiens
tcaaatgaagacagttgacttg

SEQ ID NO: 51728 - DNA, 22 bp, Homo sapiens
cctggggccccgagccagaagc

SEQ ID NO: 51729 - DNA, 22 bp, Homo sapiens
attgtgtcctcattgaccttca

SEQ ID NO: 51730 - DNA, 21 bp, Homo sapiens
acacaagcactcgtacatacg

SEQ ID NO: 51731 - DNA, 22 bp, Homo sapiens
gcggcccgagcaggacgggtgg

SEQ ID NO: 51732 - DNA, 22 bp, Homo sapiens
tacaaagtcttgggttctaggc

SEQ ID NO: 51733 - DNA, 22 bp, Homo sapiens
ccagggtggcgtagatgctggg

SEQ ID NO: 51734 - DNA, 22 bp, Homo sapiens
tgggaggccaaggcaggcggat

SEQ ID NO: 51735 - DNA, 22 bp, Homo sapiens
cattgcactgcagcccgggcaa

SEQ ID NO: 51736 - DNA, 22 bp, Homo sapiens
gcggcaggagtaaaggaggaag

SEQ ID NO: 51737 - DNA, 22 bp, Homo sapiens
aagaaatgtgaatattgaatag

SEQ ID NO: 51738 - DNA, 22 bp, Homo sapiens
tgggaagaggagcactggaatg

SEQ ID NO: 51739 - DNA, 22 bp, Homo sapiens
acaaacagagttgaaaaatagg

SEQ ID NO: 51740 - DNA, 22 bp, Homo sapiens
gtgcagagaggaccttggggag

SEQ ID NO: 51741 - DNA, 22 bp, Homo sapiens
tggttcctcaagcgctggcggc

SEQ ID NO: 51742 - DNA, 22 bp, Homo sapiens
ctgtcctggggaaagccagccc

SEQ ID NO: 51743 - DNA, 22 bp, Homo sapiens
cagcagcattgctctggattcc

SEQ ID NO: 51744 - DNA, 22 bp, Homo sapiens
actggacagaggaaatatggag

SEQ ID NO: 51745 - DNA, 22 bp, Homo sapiens
agacagggtgatcgcttgagcc

SEQ ID NO: 51746 - DNA, 22 bp, Homo sapiens
ttaattctgcctttcatgtaac

SEQ ID NO: 51747 - DNA, 22 bp, Homo sapiens
tgctcgaggtccccaccggctc

SEQ ID NO: 51748 - DNA, 22 bp, Homo sapiens
cacccaggttggagtgcagtgg

SEQ ID NO: 51749 - DNA, 22 bp, Homo sapiens
atcttcccaggctggggagagg

SEQ ID NO: 51750 - DNA, 22 bp, Homo sapiens
ttcctaagtcctgccagcagtc

SEQ ID NO: 51751 - DNA, 22 bp, Homo sapiens
gcagaggacacaggagggcaag

SEQ ID NO: 51752 - DNA, 22 bp, Homo sapiens
gaggtggctgcttgctgggaaa

SEQ ID NO: 51753 - DNA, 22 bp, Homo sapiens
cgagcatgatgacggctgtggc

SEQ ID NO: 51754 - DNA, 22 bp, Homo sapiens
ggagtgaatcactagatgcaga

SEQ ID NO: 51755 - DNA, 22 bp, Homo sapiens
tacaccattcccaggtggattt

SEQ ID NO: 51756 - DNA, 22 bp, Homo sapiens
gggcggatcatttgaggtcagg

SEQ ID NO: 51757 - DNA, 22 bp, Homo sapiens
ctgtcaggttggtctcagagct

SEQ ID NO: 51758 - DNA, 22 bp, Homo sapiens
tgcttttagctagtaactagta

SEQ ID NO: 51759 - DNA, 22 bp, Homo sapiens
cttctcttcctttgtcaactga

SEQ ID NO: 51760 - DNA, 22 bp, Homo sapiens
gggcagatcacctgaggtcagg

SEQ ID NO: 51761 - DNA, 22 bp, Homo sapiens
tggagccagcggcctgctgagg

SEQ ID NO: 51762 - DNA, 22 bp, Homo sapiens
tgctcatcaacatgatgatcat

SEQ ID NO: 51763 - DNA, 22 bp, Homo sapiens
gaactcattagcctgctttcag

SEQ ID NO: 51764 - DNA, 22 bp, Homo sapiens
gctgcgccggatcccacgttcc

SEQ ID NO: 51765 - DNA, 22 bp, Homo sapiens
ttcccttaaattatggcatcta

SEQ ID NO: 51766 - DNA, 21 bp, Homo sapiens
gttcaaatcctgacactacac

SEQ ID NO: 51767 - DNA, 22 bp, Homo sapiens
ggggtccctgcaccagcatgtc

SEQ ID NO: 51768 - DNA, 22 bp, Homo sapiens
actgcaacacctcctgggttca

SEQ ID NO: 51769 - DNA, 22 bp, Homo sapiens
gctcatgactgtaatcccagca

SEQ ID NO: 51770 - DNA, 22 bp, Homo sapiens
tgctagtgtgtgagatgttcaa

SEQ ID NO: 51771 - DNA, 22 bp, Homo sapiens
agttgggtttgtgtcagttgca

SEQ ID NO: 51772 - DNA, 20 bp, Homo sapiens
gtttctgattcagtaggtct

SEQ ID NO: 51773 - DNA, 18 bp, Homo sapiens
gcctggcttcggagccgc

SEQ ID NO: 51774 - DNA, 22 bp, Homo sapiens
atgatactctaggtgatttaca

SEQ ID NO: 51775 - DNA, 22 bp, Homo sapiens
tcactgcaacctccacctcctg

SEQ ID NO: 51776 - DNA, 22 bp, Homo sapiens
ttggatgggcattaggaaagtc

SEQ ID NO: 51777 - DNA, 22 bp, Homo sapiens
caggagatgacagggaagaacc

SEQ ID NO: 51778 - DNA, 22 bp, Homo sapiens
ggttcacagtaaggtttgtgct

SEQ ID NO: 51779 - DNA, 22 bp, Homo sapiens
atggaaggctttatgactcaaa

SEQ ID NO: 51780 - DNA, 22 bp, Homo sapiens
ctgattctcctcaagactttcg

SEQ ID NO: 51781 - DNA, 22 bp, Homo sapiens
agctgctgagccaggctgatgt

SEQ ID NO: 51782 - DNA, 22 bp, Homo sapiens
taaaatttgtccctgagtgttg

SEQ ID NO: 51783 - DNA, 22 bp, Homo sapiens
ttatttttaaaagttcacacag

SEQ ID NO: 51784 - DNA, 22 bp, Homo sapiens
caggcagggagctggaaaggat

SEQ ID NO: 51785 - DNA, 22 bp, Homo sapiens
aatattatcaaaagctttttca

SEQ ID NO: 51786 - DNA, 22 bp, Homo sapiens
tgcctgtggaaaggctggtgct

SEQ ID NO: 51787 - DNA, 22 bp, Homo sapiens
aaaaaattatcatagttcctga

SEQ ID NO: 51788 - DNA, 22 bp, Homo sapiens
tccaggattgtcagccagaagg

SEQ ID NO: 51789 - DNA, 22 bp, Homo sapiens
ctggcctaaaaatacagaacaa

SEQ ID NO: 51790 - DNA, 22 bp, Homo sapiens
aggtggaaatggctttcctagg

SEQ ID NO: 51791 - DNA, 22 bp, Homo sapiens
tggcctcggcatccagcaagag

SEQ ID NO: 51792 - DNA, 22 bp, Homo sapiens
acatcctcccgatctactggct

SEQ ID NO: 51793 - DNA, 22 bp, Homo sapiens
gggaaatctcgtcctctattta

SEQ ID NO: 51794 - DNA, 22 bp, Homo sapiens
tgactcctggtatggatgacag

SEQ ID NO: 51795 - DNA, 22 bp, Homo sapiens
aggagagctggtgtctggaatc

SEQ ID NO: 51796 - DNA, 22 bp, Homo sapiens
gtggggtctgtcctcttctggg

SEQ ID NO: 51797 - DNA, 22 bp, Homo sapiens
atgtttttaaatagacttacag

SEQ ID NO: 51798 - DNA, 22 bp, Homo sapiens
tgcctagttctgtatttacagt

SEQ ID NO: 51799 - DNA, 22 bp, Homo sapiens
gcgagtgccgagagggcagggc

SEQ ID NO: 51800 - DNA, 22 bp, Homo sapiens
cttcctcctccatctcgaaggc

SEQ ID NO: 51801 - DNA, 21 bp, Homo sapiens
ggccgccgccttgtgctctgc

SEQ ID NO: 51802 - DNA, 22 bp, Homo sapiens
caggaaagggatgggctgccac

SEQ ID NO: 51803 - DNA, 22 bp, Homo sapiens
ggcgggaagttcttgcccactt

SEQ ID NO: 51804 - DNA, 22 bp, Homo sapiens
gaggcaggaggattgcttgagc

SEQ ID NO: 51805 - DNA, 22 bp, Homo sapiens
tgagtgaggctgggcagtccct

SEQ ID NO: 51806 - DNA, 22 bp, Homo sapiens
gtcggccacgcaggtgcggtag

SEQ ID NO: 51807 - DNA, 22 bp, Homo sapiens
tccagtttccaatcactgcacg

SEQ ID NO: 51808 - DNA, 22 bp, Homo sapiens
ttaaattttagaaacagactct

SEQ ID NO: 51809 - DNA, 22 bp, Homo sapiens
actcatgtcctaggagtaaagc

SEQ ID NO: 51810 - DNA, 22 bp, Homo sapiens
tgtttacagctgatcaggcatc

SEQ ID NO: 51811 - DNA, 22 bp, Homo sapiens
gagatatgttggcagctggtat

SEQ ID NO: 51812 - DNA, 22 bp, Homo sapiens
tttattggatatttacaagata

SEQ ID NO: 51813 - DNA, 22 bp, Homo sapiens
cccaggaggtggaggctgcagt

SEQ ID NO: 51814 - DNA, 22 bp, Homo sapiens
agtcaggggatctagacttgaa

SEQ ID NO: 51815 - DNA, 22 bp, Homo sapiens
ggggccttttctgaatgtggaa

SEQ ID NO: 51816 - DNA, 22 bp, Homo sapiens
catttacatttaaggttaatat

SEQ ID NO: 51817 - DNA, 22 bp, Homo sapiens
cccagcagtagagctcatatgg

SEQ ID NO: 51818 - DNA, 22 bp, Homo sapiens
cctcctgcacctccaggaactc

SEQ ID NO: 51819 - DNA, 19 bp, Homo sapiens
gactccaactttaagcatg

SEQ ID NO: 51820 - DNA, 22 bp, Homo sapiens
tctcgatctcctgaccttgtga

SEQ ID NO: 51821 - DNA, 22 bp, Homo sapiens
ttctttgcccatgtttcctaag

SEQ ID NO: 51822 - DNA, 22 bp, Homo sapiens
cactgcacttcagcctgggtga

SEQ ID NO: 51823 - DNA, 22 bp, Homo sapiens
caggtggcagtgcctgcattct

SEQ ID NO: 51824 - DNA, 22 bp, Homo sapiens
tcttcccagaggaggtgccagc

SEQ ID NO: 51825 - DNA, 22 bp, Homo sapiens
caggctggagtacaattgtgtg

SEQ ID NO: 51826 - DNA, 22 bp, Homo sapiens
taggtttactgaattagtggaa

SEQ ID NO: 51827 - DNA, 22 bp, Homo sapiens
ttatacagggagtttccctgca

SEQ ID NO: 51828 - DNA, 22 bp, Homo sapiens
agaaagagatgaatgctttaag

SEQ ID NO: 51829 - DNA, 22 bp, Homo sapiens
acccgatgttggtgctctagta

SEQ ID NO: 51830 - DNA, 22 bp, Homo sapiens
gccccaagtccctatgtttcca

SEQ ID NO: 51831 - DNA, 22 bp, Homo sapiens
gtgttgatgacattttagaaac

SEQ ID NO: 51832 - DNA, 22 bp, Homo sapiens
ggcatctggatctgcttctccc

SEQ ID NO: 51833 - DNA, 22 bp, Homo sapiens
gcccttctgctgttaggtagcc

SEQ ID NO: 51834 - DNA, 22 bp, Homo sapiens
agtcaaagatgaccgagttcct

SEQ ID NO: 51835 - DNA, 22 bp, Homo sapiens
aaaaatcacttttataggcagc

SEQ ID NO: 51836 - DNA, 22 bp, Homo sapiens
tgaggcaggagttcaggctgcg

SEQ ID NO: 51837 - DNA, 22 bp, Homo sapiens
tctgagacaggaagtggagggt

SEQ ID NO: 51838 - DNA, 22 bp, Homo sapiens
gcgggccaccttggagagcgct

SEQ ID NO: 51839 - DNA, 20 bp, Homo sapiens
agacagtgtggagattcctt

SEQ ID NO: 51840 - DNA, 23 bp, Homo sapiens
ctcaaccctagtaagggagtagg

SEQ ID NO: 51841 - DNA, 22 bp, Homo sapiens
acatttttcacatttgtagggt

SEQ ID NO: 51842 - DNA, 22 bp, Homo sapiens
cccagcaggtcggtgctgcctg

SEQ ID NO: 51843 - DNA, 22 bp, Homo sapiens
ccagaggagttgaggctttggg

SEQ ID NO: 51844 - DNA, 22 bp, Homo sapiens
acatttatataactcactagga

SEQ ID NO: 51845 - DNA, 22 bp, Homo sapiens
tgccagctgcttgtcccccaca

SEQ ID NO: 51846 - DNA, 22 bp, Homo sapiens
tggagataggctgaggcagggc

SEQ ID NO: 51847 - DNA, 22 bp, Homo sapiens
tcttggattttaatggatcaaa

SEQ ID NO: 51848 - DNA, 22 bp, Homo sapiens
gctcggtggccagcctgaggcc

SEQ ID NO: 51849 - DNA, 22 bp, Homo sapiens
ttattttaccttcctctgagct

SEQ ID NO: 51850 - DNA, 22 bp, Homo sapiens
gggcatggtggcaggcacctgt

SEQ ID NO: 51851 - DNA, 22 bp, Homo sapiens
ggctcactgcaagctccgcctc

SEQ ID NO: 51852 - DNA, 22 bp, Homo sapiens
ggtgggagagcttgctttgatg

SEQ ID NO: 51853 - DNA, 22 bp, Homo sapiens
cttgcctttgtcttcaaaggct

SEQ ID NO: 51854 - DNA, 22 bp, Homo sapiens
tctgcgcgctgctggtaccgaa

SEQ ID NO: 51855 - DNA, 22 bp, Homo sapiens
tgggcaggggccctgcttccgt

SEQ ID NO: 51856 - DNA, 22 bp, Homo sapiens
taattataacagttacatctta

SEQ ID NO: 51857 - DNA, 22 bp, Homo sapiens
gggagtgggtttggcctaggcc

SEQ ID NO: 51858 - DNA, 22 bp, Homo sapiens
cactgcagcctcgctctcctga

SEQ ID NO: 51859 - DNA, 22 bp, Homo sapiens
ttgcccaggctggagtgcagta

SEQ ID NO: 51860 - DNA, 22 bp, Homo sapiens
tagcagtgtctaggtaggccat

SEQ ID NO: 51861 - DNA, 22 bp, Homo sapiens
ttatagcagcatgatttataat

SEQ ID NO: 51862 - DNA, 22 bp, Homo sapiens
aagacttgaccaggttgaaggc

SEQ ID NO: 51863 - DNA, 20 bp, Homo sapiens
gttaggaggttggacatgga

SEQ ID NO: 51864 - DNA, 22 bp, Homo sapiens
ggctgcaggttggttggcagct

SEQ ID NO: 51865 - DNA, 22 bp, Homo sapiens
ttacttaaacagaaatgcagaa

SEQ ID NO: 51866 - DNA, 22 bp, Homo sapiens
gagggggctagcgcagtgccca

SEQ ID NO: 51867 - DNA, 22 bp, Homo sapiens
aaagaggcaatcaatgtagcaa

SEQ ID NO: 51868 - DNA, 22 bp, Homo sapiens
tcacccctccattctctcatgt

SEQ ID NO: 51869 - DNA, 22 bp, Homo sapiens
caaatctctgctactagctatg

SEQ ID NO: 51870 - DNA, 22 bp, Homo sapiens
gatgtagacacttggaggctta

SEQ ID NO: 51871 - DNA, 20 bp, Homo sapiens
caggtccagcacgtgcacgg

SEQ ID NO: 51872 - DNA, 22 bp, Homo sapiens
ttcaatagaaagtccctagtta

SEQ ID NO: 51873 - DNA, 22 bp, Homo sapiens
aaggagaggttgtccgtgttgt

SEQ ID NO: 51874 - DNA, 22 bp, Homo sapiens
gagcagtaggagaaccctgagc

SEQ ID NO: 51875 - DNA, 22 bp, Homo sapiens
gcagcgaggtgatgaaatagct

SEQ ID NO: 51876 - DNA, 22 bp, Homo sapiens
tgtctctgtgactccttccgcc

SEQ ID NO: 51877 - DNA, 22 bp, Homo sapiens
ttgtaagtcacaccagggcagg

SEQ ID NO: 51878 - DNA, 22 bp, Homo sapiens
tgtgaatggacaattaaatcta

SEQ ID NO: 51879 - DNA, 22 bp, Homo sapiens
ggaggtagcctcaaaagcagct

SEQ ID NO: 51880 - DNA, 22 bp, Homo sapiens
gaagtgtagtcttgagccccca

SEQ ID NO: 51881 - DNA, 22 bp, Homo sapiens
agaggaagtaatcaggacctgc

SEQ ID NO: 51882 - DNA, 22 bp, Homo sapiens
tcatctaagagtcttacattta

SEQ ID NO: 51883 - DNA, 19 bp, Homo sapiens
tcctgcccaccagccaggg

SEQ ID NO: 51884 - DNA, 22 bp, Homo sapiens
cagtggcgtgatctctgctcac

SEQ ID NO: 51885 - DNA, 22 bp, Homo sapiens
ggggtgtggacggctgtgccag

SEQ ID NO: 51886 - DNA, 22 bp, Homo sapiens
ggggaccctcaggactgcgtct

SEQ ID NO: 51887 - DNA, 22 bp, Homo sapiens
acacggcactttaggaaggggc

SEQ ID NO: 51888 - DNA, 22 bp, Homo sapiens
acaaagccagattctggagcac

SEQ ID NO: 51889 - DNA, 22 bp, Homo sapiens
aggacctactgatatcttagca

SEQ ID NO: 51890 - DNA, 22 bp, Homo sapiens
aggcaatcccctgaggatactt

SEQ ID NO: 51891 - DNA, 22 bp, Homo sapiens
aacccaggaggtggaggttgtg

SEQ ID NO: 51892 - DNA, 22 bp, Homo sapiens
cctggcctttgaacgctagact

SEQ ID NO: 51893 - DNA, 22 bp, Homo sapiens
cgcggtggcggcctccagcgcc

SEQ ID NO: 51894 - DNA, 22 bp, Homo sapiens
gtccacagctctgaggtctccc

SEQ ID NO: 51895 - DNA, 22 bp, Homo sapiens
agtgagagtattaatgtgaact

SEQ ID NO: 51896 - DNA, 22 bp, Homo sapiens
actttaaaactgatcatcagag

SEQ ID NO: 51897 - DNA, 22 bp, Homo sapiens
cacccaggctggattgcagtgg

SEQ ID NO: 51898 - DNA, 22 bp, Homo sapiens
gccaggcgggtctcaaactcct

SEQ ID NO: 51899 - DNA, 22 bp, Homo sapiens
aaaatggtctcagctggcacca

SEQ ID NO: 51900 - DNA, 22 bp, Homo sapiens
cgtaggtggctcagcacctggg

SEQ ID NO: 51901 - DNA, 22 bp, Homo sapiens
tacatagctcctagtgatgcat

SEQ ID NO: 51902 - DNA, 22 bp, Homo sapiens
cttctgagatgttgttttacag

SEQ ID NO: 51903 - DNA, 22 bp, Homo sapiens
ataaaaactgacccatcctttg

SEQ ID NO: 51904 - DNA, 22 bp, Homo sapiens
gaaggagccgagctcttcccca

SEQ ID NO: 51905 - DNA, 22 bp, Homo sapiens
tgttgagtatatacctacaagt

SEQ ID NO: 51906 - DNA, 21 bp, Homo sapiens
ggccccgcagacccagcacgt

SEQ ID NO: 51907 - DNA, 22 bp, Homo sapiens
agtgaatgtccccgcgggtcag

SEQ ID NO: 51908 - DNA, 22 bp, Homo sapiens
ggcctgcctcacagtcagcacc

SEQ ID NO: 51909 - DNA, 22 bp, Homo sapiens
tttctcatggaacatcgtttag

SEQ ID NO: 51910 - DNA, 22 bp, Homo sapiens
tgggctttgagctcggtcacct

SEQ ID NO: 51911 - DNA, 22 bp, Homo sapiens
gctgggacaacaggtgagcacc

SEQ ID NO: 51912 - DNA, 22 bp, Homo sapiens
tctcaagcttgttggtatgttt

SEQ ID NO: 51913 - DNA, 22 bp, Homo sapiens
cagtggcaggatttcagctcag

SEQ ID NO: 51914 - DNA, 22 bp, Homo sapiens
aacccaggctggagtgcagtgg

SEQ ID NO: 51915 - DNA, 22 bp, Homo sapiens
aaggaggttatcccagtggact

SEQ ID NO: 51916 - DNA, 22 bp, Homo sapiens
aatggctctgatgttgttgtga

SEQ ID NO: 51917 - DNA, 22 bp, Homo sapiens
agggaagaggaccagagtctct

SEQ ID NO: 51918 - DNA, 22 bp, Homo sapiens
gaggcagaggttgcagtgagct

SEQ ID NO: 51919 - DNA, 22 bp, Homo sapiens
taaagggtaggttttactgtaa

SEQ ID NO: 51920 - DNA, 22 bp, Homo sapiens
gggcaggaacaaatcaaatgat

SEQ ID NO: 51921 - DNA, 22 bp, Homo sapiens
gagcactgatttatttttgtct

SEQ ID NO: 51922 - DNA, 22 bp, Homo sapiens
tctcgctctgtcgcccaggctg

SEQ ID NO: 51923 - DNA, 22 bp, Homo sapiens
gcagcctgggcaacagagtgag

SEQ ID NO: 51924 - DNA, 22 bp, Homo sapiens
atgccacttcattccagcctcg

SEQ ID NO: 51925 - DNA, 22 bp, Homo sapiens
ttggttttgaaatagcttattg

SEQ ID NO: 51926 - DNA, 22 bp, Homo sapiens
agcccttagtacatttctcaag

SEQ ID NO: 51927 - DNA, 22 bp, Homo sapiens
cagcctttgggtcagaagattc

SEQ ID NO: 51928 - DNA, 22 bp, Homo sapiens
cagcagcagtgttctagaatct

SEQ ID NO: 51929 - DNA, 22 bp, Homo sapiens
tttgagatggagtcttgctctg

SEQ ID NO: 51930 - DNA, 22 bp, Homo sapiens
tcagcaatcctcccacaggtgg

SEQ ID NO: 51931 - DNA, 22 bp, Homo sapiens
gggcaggggtcagtggccccaa

SEQ ID NO: 51932 - DNA, 22 bp, Homo sapiens
tgaacatgctgttgatggcctg

SEQ ID NO: 51933 - DNA, 22 bp, Homo sapiens
tgctccatgcgctcggccggcg

SEQ ID NO: 51934 - DNA, 22 bp, Homo sapiens
aatcagaaattgagggtctggt

SEQ ID NO: 51935 - DNA, 22 bp, Homo sapiens
tcctcagaatcacctggcagct

SEQ ID NO: 51936 - DNA, 22 bp, Homo sapiens
gggggggtcttcagacctcaga

SEQ ID NO: 51937 - DNA, 22 bp, Homo sapiens
ggctgggctccgggagcatgcg

SEQ ID NO: 51938 - DNA, 22 bp, Homo sapiens
gtgggctgcccttgaggtcagc

SEQ ID NO: 51939 - DNA, 20 bp, Homo sapiens
gataatatttactaggtact

SEQ ID NO: 51940 - DNA, 22 bp, Homo sapiens
cggcatccccacttcctcctgc

SEQ ID NO: 51941 - DNA, 22 bp, Homo sapiens
agggagcaaaggtttcagggtt

SEQ ID NO: 51942 - DNA, 22 bp, Homo sapiens
acagttaataagtagtaagtca

SEQ ID NO: 51943 - DNA, 22 bp, Homo sapiens
ttgtgggatctccctgttgctc

SEQ ID NO: 51944 - DNA, 22 bp, Homo sapiens
tgcaataactactttaatgttg

SEQ ID NO: 51945 - DNA, 22 bp, Homo sapiens
ctcagatctttcccattttccc

SEQ ID NO: 51946 - DNA, 22 bp, Homo sapiens
cctgtggcgggggccagtgcct

SEQ ID NO: 51947 - DNA, 22 bp, Homo sapiens
cactgggcgtgtcctgggtgag

SEQ ID NO: 51948 - DNA, 22 bp, Homo sapiens
tgtgactaggcctgagctcttg

SEQ ID NO: 51949 - DNA, 22 bp, Homo sapiens
gaatgctaagcatgtgggagtt

SEQ ID NO: 51950 - DNA, 22 bp, Homo sapiens
acgcagtttgtggacatttttt

SEQ ID NO: 51951 - DNA, 22 bp, Homo sapiens
actgcactccagcctgggtaac

SEQ ID NO: 51952 - DNA, 22 bp, Homo sapiens
actgcactccaacctgggtgac

SEQ ID NO: 51953 - DNA, 20 bp, Homo sapiens
tgatatggtttggctgtgtt

SEQ ID NO: 51954 - DNA, 19 bp, Homo sapiens
ccagagagctaggtacaga

SEQ ID NO: 51955 - DNA, 22 bp, Homo sapiens
gagcacagtaaagcagtgtcac

SEQ ID NO: 51956 - DNA, 22 bp, Homo sapiens
ctatgaccccagcatgaataag

SEQ ID NO: 51957 - DNA, 22 bp, Homo sapiens
tgagacgaagtcttgctctgtt

SEQ ID NO: 51958 - DNA, 22 bp, Homo sapiens
tcctccccaaagcccagcctgg

SEQ ID NO: 51959 - DNA, 22 bp, Homo sapiens
gtcaccagtgctaagaggtgga

SEQ ID NO: 51960 - DNA, 22 bp, Homo sapiens
gaggtaacactgttcagtgggc

SEQ ID NO: 51961 - DNA, 22 bp, Homo sapiens
tccattatacttctgattcaaa

SEQ ID NO: 51962 - DNA, 22 bp, Homo sapiens
atgttgtgtttgactgttaccc

SEQ ID NO: 51963 - DNA, 22 bp, Homo sapiens
tccttagacaaagagtgggctt

SEQ ID NO: 51964 - DNA, 22 bp, Homo sapiens
aacccacaaaggatttcagctc

SEQ ID NO: 51965 - DNA, 22 bp, Homo sapiens
aaagattaaatcaaattggtca

SEQ ID NO: 51966 - DNA, 22 bp, Homo sapiens
atgcttgcccatgtttctgaag

SEQ ID NO: 51967 - DNA, 22 bp, Homo sapiens
gctccctggtagccatgctctc

SEQ ID NO: 51968 - DNA, 21 bp, Homo sapiens
cctcaagtgcctcctgctgct

SEQ ID NO: 51969 - DNA, 22 bp, Homo sapiens
ggtaccaccaattcagctgcca

SEQ ID NO: 51970 - DNA, 22 bp, Homo sapiens
ttctagtgtccttggacttgct

SEQ ID NO: 51971 - DNA, 22 bp, Homo sapiens
gaccagtcattactcatgccct

SEQ ID NO: 51972 - DNA, 22 bp, Homo sapiens
gaggccaactttggagaacagg

SEQ ID NO: 51973 - DNA, 22 bp, Homo sapiens
cgtgcgcctcagcctcgtgcgc

SEQ ID NO: 51974 - DNA, 18 bp, Homo sapiens
cagggctgtggggtcact

SEQ ID NO: 51975 - DNA, 22 bp, Homo sapiens
taagggaacagcttcaaactca

SEQ ID NO: 51976 - DNA, 22 bp, Homo sapiens
actgcacttcaccctgggtgac

SEQ ID NO: 51977 - DNA, 22 bp, Homo sapiens
tttgaaatgtatcagtataggt

SEQ ID NO: 51978 - DNA, 18 bp, Homo sapiens
gaggatggaaggagatgc

SEQ ID NO: 51979 - DNA, 22 bp, Homo sapiens
aattcacatccgaccaggtcaa

SEQ ID NO: 51980 - DNA, 22 bp, Homo sapiens
ggccttggcctagccctccagg

SEQ ID NO: 51981 - DNA, 22 bp, Homo sapiens
actgcactccagcctcggggtc

SEQ ID NO: 51982 - DNA, 16 bp, Homo sapiens
gcagaggaaaggggag

SEQ ID NO: 51983 - DNA, 22 bp, Homo sapiens
ttaaatattatgttgtctgcaa

SEQ ID NO: 51984 - DNA, 19 bp, Homo sapiens
acacagggatcagagggtt

SEQ ID NO: 51985 - DNA, 22 bp, Homo sapiens
tttaagaagttatgttataaat

SEQ ID NO: 51986 - DNA, 20 bp, Homo sapiens
aaattactgccacacatttc

SEQ ID NO: 51987 - DNA, 22 bp, Homo sapiens
atttagtagagaaattaagaaa

SEQ ID NO: 51988 - DNA, 22 bp, Homo sapiens
tgagcacatttcacatgacagg

SEQ ID NO: 51989 - DNA, 22 bp, Homo sapiens
aaagatcacgtcccaggactcg

SEQ ID NO: 51990 - DNA, 22 bp, Homo sapiens
cagccccatggtgtgctccagc

SEQ ID NO: 51991 - DNA, 22 bp, Homo sapiens
ctgctcctgtccagcagggcca

SEQ ID NO: 51992 - DNA, 22 bp, Homo sapiens
tcctgccttgcctgggacatca

SEQ ID NO: 51993 - DNA, 22 bp, Homo sapiens
ccaggaggcagaagttgcagtg

SEQ ID NO: 51994 - DNA, 22 bp, Homo sapiens
tcagcctccgaaagtgctggga

SEQ ID NO: 51995 - DNA, 22 bp, Homo sapiens
tgagccaggagtttgaggctgt

SEQ ID NO: 51996 - DNA, 22 bp, Homo sapiens
gggaagagggagctggaatgat

SEQ ID NO: 51997 - DNA, 22 bp, Homo sapiens
atgccactgcacttcagcctgg

SEQ ID NO: 51998 - DNA, 22 bp, Homo sapiens
ggcagggagtggagactcccta

SEQ ID NO: 51999 - DNA, 22 bp, Homo sapiens
cagtggaggccttgggaccttt

SEQ ID NO: 52000 - DNA, 22 bp, Homo sapiens
gaggaggcttccgggaggcacg

SEQ ID NO: 52001 - DNA, 22 bp, Homo sapiens
ggcagggcaggaaagtcaggaa

SEQ ID NO: 52002 - DNA, 22 bp, Homo sapiens
gttcacagtttctaatcccagc

SEQ ID NO: 52003 - DNA, 22 bp, Homo sapiens
tggtattctttctgtagatcat

SEQ ID NO: 52004 - DNA, 22 bp, Homo sapiens
tagagtgtcataacagtgccca

SEQ ID NO: 52005 - DNA, 22 bp, Homo sapiens
cattggccttttatcctagagg

SEQ ID NO: 52006 - DNA, 22 bp, Homo sapiens
atggctagcaccgcgttgctgg

SEQ ID NO: 52007 - DNA, 22 bp, Homo sapiens
gagacacaggcacagaagaggc

SEQ ID NO: 52008 - DNA, 22 bp, Homo sapiens
ggaaatctcagatctcccagat

SEQ ID NO: 52009 - DNA, 21 bp, Homo sapiens
gccagcggccgccctccagga

SEQ ID NO: 52010 - DNA, 22 bp, Homo sapiens
agagggatcaccctgtttctgg

SEQ ID NO: 52011 - DNA, 19 bp, Homo sapiens
agggaatccggctgaggga

SEQ ID NO: 52012 - DNA, 22 bp, Homo sapiens
cccattcatcctcgcttccttc

SEQ ID NO: 52013 - DNA, 23 bp, Homo sapiens
cctgcctccccatcagttataca

SEQ ID NO: 52014 - DNA, 22 bp, Homo sapiens
tgcccaggctggagtacagtgg

SEQ ID NO: 52015 - DNA, 22 bp, Homo sapiens
caggctggagtgcagtggggcg

SEQ ID NO: 52016 - DNA, 22 bp, Homo sapiens
gatgcacggtcatgtcttttca

SEQ ID NO: 52017 - DNA, 22 bp, Homo sapiens
gagaacagaagcattcctaatt

SEQ ID NO: 52018 - DNA, 17 bp, Homo sapiens
ggctgcagtccaggagg

SEQ ID NO: 52019 - DNA, 22 bp, Homo sapiens
gggagaggttacccgagcaact

SEQ ID NO: 52020 - DNA, 22 bp, Homo sapiens
tccgccaggactgagggcccat

SEQ ID NO: 52021 - DNA, 22 bp, Homo sapiens
ttgcttcttagatattcctctc

SEQ ID NO: 52022 - DNA, 22 bp, Homo sapiens
tcacattttcaaaagctggtgc

SEQ ID NO: 52023 - DNA, 23 bp, Homo sapiens
tgttccagatacgccttttcctc

SEQ ID NO: 52024 - DNA, 22 bp, Homo sapiens
agaggctgcacttgctcatgat

SEQ ID NO: 52025 - DNA, 18 bp, Homo sapiens
agctccatctgtcagcat

SEQ ID NO: 52026 - DNA, 22 bp, Homo sapiens
ccgggcctcgggacaccgggta

SEQ ID NO: 52027 - DNA, 23 bp, Homo sapiens
aggatgtaggatgtatggcagag

SEQ ID NO: 52028 - DNA, 22 bp, Homo sapiens
ttatagcagcatgatttacaat

SEQ ID NO: 52029 - DNA, 22 bp, Homo sapiens
agctcctgaaaatccagactgg

SEQ ID NO: 52030 - DNA, 22 bp, Homo sapiens
agagcacagggttttgtgccgg

SEQ ID NO: 52031 - DNA, 22 bp, Homo sapiens
tcactgcaagctcctcctcctg

SEQ ID NO: 52032 - DNA, 22 bp, Homo sapiens
aagaggcgctcctcacttccta

SEQ ID NO: 52033 - DNA, 22 bp, Homo sapiens
ggctctgcttgaggccagcctg

SEQ ID NO: 52034 - DNA, 22 bp, Homo sapiens
gcactggccgcacgcgtagggc

SEQ ID NO: 52035 - DNA, 22 bp, Homo sapiens
tgccgcagtgcggggagggccc

SEQ ID NO: 52036 - DNA, 22 bp, Homo sapiens
ttcaaatgatggcagtcctggc

SEQ ID NO: 52037 - DNA, 22 bp, Homo sapiens
tccagggagagccgctgctcca

SEQ ID NO: 52038 - DNA, 22 bp, Homo sapiens
caggagtgttgattgctcagga

SEQ ID NO: 52039 - DNA, 22 bp, Homo sapiens
tcttttgtgattctttagttac

SEQ ID NO: 52040 - DNA, 22 bp, Homo sapiens
atcatcctagaaggaagctagg

SEQ ID NO: 52041 - DNA, 22 bp, Homo sapiens
acacagagccaaaccatatcac

SEQ ID NO: 52042 - DNA, 22 bp, Homo sapiens
gaggcaggcagattgcttgagg

SEQ ID NO: 52043 - DNA, 22 bp, Homo sapiens
gagcaggaaggccagaagggtc

SEQ ID NO: 52044 - DNA, 22 bp, Homo sapiens
ggggccttggatctgtgccccg

SEQ ID NO: 52045 - DNA, 22 bp, Homo sapiens
cagagggttgatgtgaggctta

SEQ ID NO: 52046 - DNA, 23 bp, Homo sapiens
gtgccgacgctccagcaccatcc

SEQ ID NO: 52047 - DNA, 22 bp, Homo sapiens
gcaggtggatcacctgaggtca

SEQ ID NO: 52048 - DNA, 22 bp, Homo sapiens
tgggactcactcttttggccag

SEQ ID NO: 52049 - DNA, 22 bp, Homo sapiens
aaggaaagctgtggttctgaga

SEQ ID NO: 52050 - DNA, 22 bp, Homo sapiens
tcctgggtccatggcagccgaa

SEQ ID NO: 52051 - DNA, 22 bp, Homo sapiens
gaaaattattgaaaatggctct

SEQ ID NO: 52052 - DNA, 22 bp, Homo sapiens
tttctaatctgattctcctacc

SEQ ID NO: 52053 - DNA, 22 bp, Homo sapiens
gctgagactgacatgaagaggt

SEQ ID NO: 52054 - DNA, 22 bp, Homo sapiens
tatttaataaaactatggcatg

SEQ ID NO: 52055 - DNA, 22 bp, Homo sapiens
ccttcccatgcagcctgtctga

SEQ ID NO: 52056 - DNA, 22 bp, Homo sapiens
gaatatcccgctatgcaaagta

SEQ ID NO: 52057 - DNA, 22 bp, Homo sapiens
gcttccggagccaaaaggcccc

SEQ ID NO: 52058 - DNA, 20 bp, Homo sapiens
aggccccaggtggacactag

SEQ ID NO: 52059 - DNA, 22 bp, Homo sapiens
taaggcaggaactggctgtttt

SEQ ID NO: 52060 - DNA, 22 bp, Homo sapiens
aacccagggtggaggttgcagt

SEQ ID NO: 52061 - DNA, 22 bp, Homo sapiens
tagtatagattgaagcagatca

SEQ ID NO: 52062 - DNA, 22 bp, Homo sapiens
tattgtccaataggatgttcct

SEQ ID NO: 52063 - DNA, 22 bp, Homo sapiens
aggagaagccaagttgtgagca

SEQ ID NO: 52064 - DNA, 22 bp, Homo sapiens
tttattctgtgctacatgaaga

SEQ ID NO: 52065 - DNA, 22 bp, Homo sapiens
gcccagtagttcaaggttgcag

SEQ ID NO: 52066 - DNA, 22 bp, Homo sapiens
aatgccttggagagcctagagg

SEQ ID NO: 52067 - DNA, 22 bp, Homo sapiens
acccaggctggagtgcagtggg

SEQ ID NO: 52068 - DNA, 22 bp, Homo sapiens
acggtgctgggtattggggttc

SEQ ID NO: 52069 - DNA, 22 bp, Homo sapiens
acacttctttgtcacctgcttc

SEQ ID NO: 52070 - DNA, 22 bp, Homo sapiens
tcaggctcaggttaggggccaa

SEQ ID NO: 52071 - DNA, 22 bp, Homo sapiens
agggcactctgcagggaccacc

SEQ ID NO: 52072 - DNA, 22 bp, Homo sapiens
attgtaaatagtgccacaataa

SEQ ID NO: 52073 - DNA, 22 bp, Homo sapiens
aagccaggttccatggaggagc

SEQ ID NO: 52074 - DNA, 22 bp, Homo sapiens
ggcctctcttgggacagctgtc

SEQ ID NO: 52075 - DNA, 22 bp, Homo sapiens
tcttttgtgattcttcagttac

SEQ ID NO: 52076 - DNA, 23 bp, Homo sapiens
aattatctatttcaaatttagca

SEQ ID NO: 52077 - DNA, 22 bp, Homo sapiens
gatgtgtttccaggatttgttt

SEQ ID NO: 52078 - DNA, 22 bp, Homo sapiens
accagtaggagttggagaggaa

SEQ ID NO: 52079 - DNA, 22 bp, Homo sapiens
tgatatgggaaaagggctcgga

SEQ ID NO: 52080 - DNA, 22 bp, Homo sapiens
attaagtgttttacatacatta

SEQ ID NO: 52081 - DNA, 21 bp, Homo sapiens
aggcatgagccctgcatggac

SEQ ID NO: 52082 - DNA, 22 bp, Homo sapiens
atgccaggaacaaacagtggtg

SEQ ID NO: 52083 - DNA, 22 bp, Homo sapiens
taagaaatttagttatagaatg

SEQ ID NO: 52084 - DNA, 22 bp, Homo sapiens
ttttaatactgctattgtagga

SEQ ID NO: 52085 - DNA, 22 bp, Homo sapiens
acaggcttacaggctgcaagta

SEQ ID NO: 52086 - DNA, 22 bp, Homo sapiens
tgcacgtgtgagcattcacatg

SEQ ID NO: 52087 - DNA, 22 bp, Homo sapiens
gttcagtcacgtgcccaagttc

SEQ ID NO: 52088 - DNA, 22 bp, Homo sapiens
gcaggaggttgagccaggactg

SEQ ID NO: 52089 - DNA, 22 bp, Homo sapiens
ctgtggctctcagaggctgctg

SEQ ID NO: 52090 - DNA, 22 bp, Homo sapiens
agcgtgaattagttggtacaca

SEQ ID NO: 52091 - DNA, 22 bp, Homo sapiens
tggtggctaccaggtcctgggg

SEQ ID NO: 52092 - DNA, 22 bp, Homo sapiens
actcatgtaagcggaatgtagt

SEQ ID NO: 52093 - DNA, 22 bp, Homo sapiens
ggagagcttggagtgcgatttt

SEQ ID NO: 52094 - DNA, 22 bp, Homo sapiens
cttgctttcagtctcggcctca

SEQ ID NO: 52095 - DNA, 22 bp, Homo sapiens
agctttggttgccatgatctga

SEQ ID NO: 52096 - DNA, 18 bp, Homo sapiens
ttgcttcttttctctagg

SEQ ID NO: 52097 - DNA, 22 bp, Homo sapiens
tattcatagtaaacaaaagtgg

SEQ ID NO: 52098 - DNA, 22 bp, Homo sapiens
gtggctcacgcctgtaatccca

SEQ ID NO: 52099 - DNA, 22 bp, Homo sapiens
gaggcagaggttgttgcagtga

SEQ ID NO: 52100 - DNA, 22 bp, Homo sapiens
ggagtgctttgaagccttcatt

SEQ ID NO: 52101 - DNA, 22 bp, Homo sapiens
ctcattgcagctgcattactgt

SEQ ID NO: 52102 - DNA, 22 bp, Homo sapiens
cttgccttcagtccatcagtca

SEQ ID NO: 52103 - DNA, 22 bp, Homo sapiens
attataggcttgagccaccgtg

SEQ ID NO: 52104 - DNA, 22 bp, Homo sapiens
ttcacagtggtagtgcatttag

SEQ ID NO: 52105 - DNA, 18 bp, Homo sapiens
cagcctctgattggttgc

SEQ ID NO: 52106 - DNA, 22 bp, Homo sapiens
tggccagctttgactgtaaacc

SEQ ID NO: 52107 - DNA, 22 bp, Homo sapiens
attgagaagaaaatctaatata

SEQ ID NO: 52108 - DNA, 22 bp, Homo sapiens
ttctgattgctgatgaggccca

SEQ ID NO: 52109 - DNA, 22 bp, Homo sapiens
ggagtgactcacagctgggaca

SEQ ID NO: 52110 - DNA, 22 bp, Homo sapiens
agggctggagccacagctggga

SEQ ID NO: 52111 - DNA, 22 bp, Homo sapiens
aaagcctcccaggttatgagta

SEQ ID NO: 52112 - DNA, 22 bp, Homo sapiens
ctgaacttattgagtgcttgct

SEQ ID NO: 52113 - DNA, 22 bp, Homo sapiens
agcaggagtttgatgcttttat

SEQ ID NO: 52114 - DNA, 22 bp, Homo sapiens
atctagattaggtataagagct

SEQ ID NO: 52115 - DNA, 22 bp, Homo sapiens
ggcagacctctccagccccaca

SEQ ID NO: 52116 - DNA, 22 bp, Homo sapiens
tgtgctctgactttctcctggt

SEQ ID NO: 52117 - DNA, 20 bp, Homo sapiens
gggcagagccagccagtccc

SEQ ID NO: 52118 - DNA, 22 bp, Homo sapiens
actgcactcctgcctgggtaac

SEQ ID NO: 52119 - DNA, 22 bp, Homo sapiens
cttagatgaagtcacagaaccc

SEQ ID NO: 52120 - DNA, 22 bp, Homo sapiens
gtggcccaggctggagtgcagt

SEQ ID NO: 52121 - DNA, 22 bp, Homo sapiens
tctacctggagtccgttgttaa

SEQ ID NO: 52122 - DNA, 22 bp, Homo sapiens
agcccggcttccccggttgcta

SEQ ID NO: 52123 - DNA, 22 bp, Homo sapiens
ctgcaccctcaaactcctgggc

SEQ ID NO: 52124 - DNA, 22 bp, Homo sapiens
gcaggcagaggtggaggagaca

SEQ ID NO: 52125 - DNA, 22 bp, Homo sapiens
ggaccaggactggtggtatctc

SEQ ID NO: 52126 - DNA, 22 bp, Homo sapiens
aacaattactaccaaggcctgt

SEQ ID NO: 52127 - DNA, 22 bp, Homo sapiens
ctggcagagttgggtctcaaat

SEQ ID NO: 52128 - DNA, 22 bp, Homo sapiens
tggtgccatcatagctcactgc

SEQ ID NO: 52129 - DNA, 22 bp, Homo sapiens
aagaggttgtctgtgatgagtt

SEQ ID NO: 52130 - DNA, 22 bp, Homo sapiens
tggggagtgatgcctcggataa

SEQ ID NO: 52131 - DNA, 22 bp, Homo sapiens
gggaggaggaatgttttgtgta

SEQ ID NO: 52132 - DNA, 22 bp, Homo sapiens
tggggaaaatgcttgtagtcag

SEQ ID NO: 52133 - DNA, 22 bp, Homo sapiens
cacccaggctggagtgcagtgg

SEQ ID NO: 52134 - DNA, 22 bp, Homo sapiens
tgtgtttctgagaatcccacct

SEQ ID NO: 52135 - DNA, 22 bp, Homo sapiens
attgttcaatgtaataattttg

SEQ ID NO: 52136 - DNA, 22 bp, Homo sapiens
cagtgacgtaaactgcatgtgc

SEQ ID NO: 52137 - DNA, 22 bp, Homo sapiens
ctgggcagctgtatcagggagt

SEQ ID NO: 52138 - DNA, 22 bp, Homo sapiens
ttcctccagccatgattgtaaa

SEQ ID NO: 52139 - DNA, 22 bp, Homo sapiens
gccctgggcaaggttctggcca

SEQ ID NO: 52140 - DNA, 22 bp, Homo sapiens
acacccaggctggcgtgcagtg

SEQ ID NO: 52141 - DNA, 22 bp, Homo sapiens
ttcttttaattgtgggggagtg

SEQ ID NO: 52142 - DNA, 20 bp, Homo sapiens
tgtggtttttgccagttgaa

SEQ ID NO: 52143 - DNA, 22 bp, Homo sapiens
ttggaacatgccggggtccagg

SEQ ID NO: 52144 - DNA, 22 bp, Homo sapiens
tcacagagttaaaagtttcttt

SEQ ID NO: 52145 - DNA, 22 bp, Homo sapiens
tcaccgaggctggagtgcagtg

SEQ ID NO: 52146 - DNA, 22 bp, Homo sapiens
aggtgacaggacaggagctggt

SEQ ID NO: 52147 - DNA, 22 bp, Homo sapiens
tttaaaaaactagtctgagtct

SEQ ID NO: 52148 - DNA, 22 bp, Homo sapiens
tggcacagactgggccaaggaa

SEQ ID NO: 52149 - DNA, 22 bp, Homo sapiens
atacagggacatccagtttttc

SEQ ID NO: 52150 - DNA, 22 bp, Homo sapiens
ccctcccaggagtggccagaga

SEQ ID NO: 52151 - DNA, 22 bp, Homo sapiens
tgtgggagaaggaagcaagctg

SEQ ID NO: 52152 - DNA, 22 bp, Homo sapiens
ttaaactgcttgaattgggttt

SEQ ID NO: 52153 - DNA, 22 bp, Homo sapiens
gcctggagaaaggaaggtggga

SEQ ID NO: 52154 - DNA, 22 bp, Homo sapiens
ggcaaggggtcaggctgagaca

SEQ ID NO: 52155 - DNA, 22 bp, Homo sapiens
ttgtctaatgagctccacttca

SEQ ID NO: 52156 - DNA, 22 bp, Homo sapiens
aatgagatggaattcccgccta

SEQ ID NO: 52157 - DNA, 22 bp, Homo sapiens
atccaccctgtggtggctttct

SEQ ID NO: 52158 - DNA, 22 bp, Homo sapiens
caggctggagttcagtggtgtg

SEQ ID NO: 52159 - DNA, 22 bp, Homo sapiens
gccagggttgccaatgggggca

SEQ ID NO: 52160 - DNA, 22 bp, Homo sapiens
taagcctgcatgaaccatgaga

SEQ ID NO: 52161 - DNA, 19 bp, Homo sapiens
tcctgcctggggccgcctg

SEQ ID NO: 52162 - DNA, 22 bp, Homo sapiens
aatgtgaggccttggtagttat

SEQ ID NO: 52163 - DNA, 22 bp, Homo sapiens
ctggaaggcagaggttgcagtg

SEQ ID NO: 52164 - DNA, 22 bp, Homo sapiens
gtggagagagataagcctggtc

SEQ ID NO: 52165 - DNA, 22 bp, Homo sapiens
ttgtgaatagtgccgcaataaa

SEQ ID NO: 52166 - DNA, 22 bp, Homo sapiens
agtgctatcgagttctaatgct

SEQ ID NO: 52167 - DNA, 22 bp, Homo sapiens
gtcagaggggcagctgccaggc

SEQ ID NO: 52168 - DNA, 22 bp, Homo sapiens
aagccctggacggcccttcccc

SEQ ID NO: 52169 - DNA, 22 bp, Homo sapiens
cgtgtacagtctatcttttttc

SEQ ID NO: 52170 - DNA, 22 bp, Homo sapiens
cgccccggacgtctgaccaaac

SEQ ID NO: 52171 - DNA, 23 bp, Homo sapiens
ggatggacgtgatgccttagcca

SEQ ID NO: 52172 - DNA, 22 bp, Homo sapiens
atgggctgtccattgctggctg

SEQ ID NO: 52173 - DNA, 22 bp, Homo sapiens
cccaggaggcagagcttgcagt

SEQ ID NO: 52174 - DNA, 23 bp, Homo sapiens
gtgcgccaggacaacctgacgga

SEQ ID NO: 52175 - DNA, 22 bp, Homo sapiens
ttcaccctggaccagaaattgg

SEQ ID NO: 52176 - DNA, 22 bp, Homo sapiens
gaccatcctggccaacgtggta

SEQ ID NO: 52177 - DNA, 22 bp, Homo sapiens
gaggagggagctggaagctctt

SEQ ID NO: 52178 - DNA, 22 bp, Homo sapiens
ctgaggctggagtgcagtggtg

SEQ ID NO: 52179 - DNA, 14 bp, Homo sapiens
gcaggcggatcact

SEQ ID NO: 52180 - DNA, 22 bp, Homo sapiens
aactcaggagtttaaggctgca

SEQ ID NO: 52181 - DNA, 22 bp, Homo sapiens
tatttcttttcgtgacttattg

SEQ ID NO: 52182 - DNA, 22 bp, Homo sapiens
cctagagctctgctttatctaa

SEQ ID NO: 52183 - DNA, 23 bp, Homo sapiens
aggaaagcattcatttttaccat

SEQ ID NO: 52184 - DNA, 22 bp, Homo sapiens
aagtcattggtagcttgatagg

SEQ ID NO: 52185 - DNA, 22 bp, Homo sapiens
tgaactcctgacctcatgatcc

SEQ ID NO: 52186 - DNA, 22 bp, Homo sapiens
gctactgattgaccttggagag

SEQ ID NO: 52187 - DNA, 19 bp, Homo sapiens
ctctggagtcattgctccc

SEQ ID NO: 52188 - DNA, 22 bp, Homo sapiens
ggctctgcgcctgcggggactt

SEQ ID NO: 52189 - DNA, 22 bp, Homo sapiens
attgtactacaccatagtactg

SEQ ID NO: 52190 - DNA, 22 bp, Homo sapiens
tggagccagagcgcagcctggg

SEQ ID NO: 52191 - DNA, 22 bp, Homo sapiens
atttctctgcagtgttcggaat

SEQ ID NO: 52192 - DNA, 22 bp, Homo sapiens
tgaggcaggaggattgcaggat

SEQ ID NO: 52193 - DNA, 22 bp, Homo sapiens
catgagataatttttctccagt

SEQ ID NO: 52194 - DNA, 22 bp, Homo sapiens
taaaggtagtgtgacatattgt

SEQ ID NO: 52195 - DNA, 22 bp, Homo sapiens
gagccaggggtcagctccgagg

SEQ ID NO: 52196 - DNA, 23 bp, Homo sapiens
aacgacagctacaggcatcccac

SEQ ID NO: 52197 - DNA, 22 bp, Homo sapiens
tcacaaatgtttgcatgtgtct

SEQ ID NO: 52198 - DNA, 22 bp, Homo sapiens
tagcataacaggtaagagtgag

SEQ ID NO: 52199 - DNA, 22 bp, Homo sapiens
agtggcctggagccccgcctgg

SEQ ID NO: 52200 - DNA, 22 bp, Homo sapiens
gaagccttgaactgcaaacccc

SEQ ID NO: 52201 - DNA, 22 bp, Homo sapiens
cggaggttgaggctgcagtgag

SEQ ID NO: 52202 - DNA, 22 bp, Homo sapiens
tggcgcgacgtgccccctgctt

SEQ ID NO: 52203 - DNA, 22 bp, Homo sapiens
ccttctagcaaatcaacataaa

SEQ ID NO: 52204 - DNA, 22 bp, Homo sapiens
ttccaaaggctgcaccttgccc

SEQ ID NO: 52205 - DNA, 22 bp, Homo sapiens
ttgagaaccactgagttagata

SEQ ID NO: 52206 - DNA, 22 bp, Homo sapiens
cgggttcacgccattctcctgc

SEQ ID NO: 52207 - DNA, 22 bp, Homo sapiens
attttctctttgtatatgctag

SEQ ID NO: 52208 - DNA, 22 bp, Homo sapiens
ccatgaattcactccatgctag

SEQ ID NO: 52209 - DNA, 22 bp, Homo sapiens
gcttacaggtgaggcagcaaga

SEQ ID NO: 52210 - DNA, 22 bp, Homo sapiens
tgcctcagctgaggccgctcca

SEQ ID NO: 52211 - DNA, 22 bp, Homo sapiens
attaaagctatccagtcatgaa

SEQ ID NO: 52212 - DNA, 22 bp, Homo sapiens
cccaggagttagaggttgtggt

SEQ ID NO: 52213 - DNA, 22 bp, Homo sapiens
tgttttaagggtcaactgtcac

SEQ ID NO: 52214 - DNA, 22 bp, Homo sapiens
tcaaaatgccgagtgcccaggt

SEQ ID NO: 52215 - DNA, 22 bp, Homo sapiens
taatactgtatactgcaaattt

SEQ ID NO: 52216 - DNA, 23 bp, Homo sapiens
aggtaggttattgctgctacctg

SEQ ID NO: 52217 - DNA, 22 bp, Homo sapiens
gtgtatgttctacttaatatta

SEQ ID NO: 52218 - DNA, 22 bp, Homo sapiens
ctgtgatttctaaagagtagca

SEQ ID NO: 52219 - DNA, 22 bp, Homo sapiens
gccagcagcttcttctcatcct

SEQ ID NO: 52220 - DNA, 22 bp, Homo sapiens
cagtgcagccaaggacaggcac

SEQ ID NO: 52221 - DNA, 22 bp, Homo sapiens
cccaggggttctgagcagcagc

SEQ ID NO: 52222 - DNA, 22 bp, Homo sapiens
tcaatactaatcttgctggaag

SEQ ID NO: 52223 - DNA, 22 bp, Homo sapiens
gtgtaagtatctttgtatcttt

SEQ ID NO: 52224 - DNA, 17 bp, Homo sapiens
tactgaggggtctggag

SEQ ID NO: 52225 - DNA, 22 bp, Homo sapiens
aaggctgtggttctatacagaa

SEQ ID NO: 52226 - DNA, 22 bp, Homo sapiens
ctctgcaacttctagcagtgtc

SEQ ID NO: 52227 - DNA, 22 bp, Homo sapiens
tgaagcaaattgtttagcctga

SEQ ID NO: 52228 - DNA, 22 bp, Homo sapiens
gtggagggtgattgccggctgt

SEQ ID NO: 52229 - DNA, 22 bp, Homo sapiens
gtgggacaaggatgaagatatt

SEQ ID NO: 52230 - DNA, 22 bp, Homo sapiens
caaatactacgattcttgcagt

SEQ ID NO: 52231 - DNA, 22 bp, Homo sapiens
cacagcctcctctggctcacgg

SEQ ID NO: 52232 - DNA, 20 bp, Homo sapiens
aggggcacctgcgacggggc

SEQ ID NO: 52233 - DNA, 22 bp, Homo sapiens
tagatgaccttgtgttaggcaa

SEQ ID NO: 52234 - DNA, 22 bp, Homo sapiens
gtggattacaagacagttgaga

SEQ ID NO: 52235 - DNA, 22 bp, Homo sapiens
cgcgctctccttctggcaccca

SEQ ID NO: 52236 - DNA, 23 bp, Homo sapiens
ctgtggtgaggccctagaatctg

SEQ ID NO: 52237 - DNA, 22 bp, Homo sapiens
caggaaggcgcggctgtgcctg

SEQ ID NO: 52238 - DNA, 22 bp, Homo sapiens
gagctgaaggagaaagcagggg

SEQ ID NO: 52239 - DNA, 22 bp, Homo sapiens
ttacaattacttgatctcagct

SEQ ID NO: 52240 - DNA, 22 bp, Homo sapiens
ttggatccatctcaggcatagg

SEQ ID NO: 52241 - DNA, 22 bp, Homo sapiens
agaggcaggaggttgacttgag

SEQ ID NO: 52242 - DNA, 22 bp, Homo sapiens
gaatttaagaggatgaatctgt

SEQ ID NO: 52243 - DNA, 22 bp, Homo sapiens
gagtttcttcatggtgcagagg

SEQ ID NO: 52244 - DNA, 18 bp, Homo sapiens
tctggaacaacttcatgt

SEQ ID NO: 52245 - DNA, 22 bp, Homo sapiens
atggtggacgggagacaggact

SEQ ID NO: 52246 - DNA, 22 bp, Homo sapiens
ttgtgaatagtgctgcaataaa

SEQ ID NO: 52247 - DNA, 22 bp, Homo sapiens
aggcaggaggatcatggatgca

SEQ ID NO: 52248 - DNA, 22 bp, Homo sapiens
tcctgagataaatctcatgtga

SEQ ID NO: 52249 - DNA, 21 bp, Homo sapiens
tgactgaggcttcttcacaca

SEQ ID NO: 52250 - DNA, 22 bp, Homo sapiens
gtggcccatcacgtttcgcctt

SEQ ID NO: 52251 - DNA, 22 bp, Homo sapiens
gagatcggtaaagagcatgcac

SEQ ID NO: 52252 - DNA, 22 bp, Homo sapiens
tcataaattctggtgctgtgag

SEQ ID NO: 52253 - DNA, 22 bp, Homo sapiens
tggaatggaaacaaactgagga

SEQ ID NO: 52254 - DNA, 22 bp, Homo sapiens
gcccaggctggagttcagtggt

SEQ ID NO: 52255 - DNA, 22 bp, Homo sapiens
ttggaatgcacactgagcctgc

SEQ ID NO: 52256 - DNA, 22 bp, Homo sapiens
acgcccggtctccatagttttt

SEQ ID NO: 52257 - DNA, 22 bp, Homo sapiens
tgggagaaagaaccctgagtga

SEQ ID NO: 52258 - DNA, 22 bp, Homo sapiens
tcccgcttcttccgaatcgcga

SEQ ID NO: 52259 - DNA, 17 bp, Homo sapiens
cgggcatggagggcagg

SEQ ID NO: 52260 - DNA, 22 bp, Homo sapiens
aacccaggagccggaggttgtg

SEQ ID NO: 52261 - DNA, 22 bp, Homo sapiens
agcataagttggtacagccact

SEQ ID NO: 52262 - DNA, 22 bp, Homo sapiens
atgaggcaggtggaggctgcca

SEQ ID NO: 52263 - DNA, 22 bp, Homo sapiens
attttctatgttgtaattgtta

SEQ ID NO: 52264 - DNA, 22 bp, Homo sapiens
aacccgagggccccaggctcgg

SEQ ID NO: 52265 - DNA, 22 bp, Homo sapiens
tccctagtcgcatctgtggaga

SEQ ID NO: 52266 - DNA, 22 bp, Homo sapiens
tcgcccagctcatctcccacaa

SEQ ID NO: 52267 - DNA, 20 bp, Homo sapiens
gagattaactgagaatctag

SEQ ID NO: 52268 - DNA, 22 bp, Homo sapiens
tttgtagcagcatgatttataa

SEQ ID NO: 52269 - DNA, 22 bp, Homo sapiens
cttttcattgtttgtacatgca

SEQ ID NO: 52270 - DNA, 22 bp, Homo sapiens
cccagccaaaagcaagtttacc

SEQ ID NO: 52271 - DNA, 22 bp, Homo sapiens
atgttattgatgcctgaggctt

SEQ ID NO: 52272 - DNA, 22 bp, Homo sapiens
aggaaagcttggcaaactaaat

SEQ ID NO: 52273 - DNA, 22 bp, Homo sapiens
atagagtgatgtaaggtatgtg

SEQ ID NO: 52274 - DNA, 23 bp, Homo sapiens
tactatggttattatccctctcc

SEQ ID NO: 52275 - DNA, 22 bp, Homo sapiens
atgccactgcacttcagcttgg

SEQ ID NO: 52276 - DNA, 22 bp, Homo sapiens
gctcccaggatgaggagccagg

SEQ ID NO: 52277 - DNA, 22 bp, Homo sapiens
tgacagcctcactttgttaatt

SEQ ID NO: 52278 - DNA, 22 bp, Homo sapiens
ttttatctgtgacatctggcag

SEQ ID NO: 52279 - DNA, 22 bp, Homo sapiens
ctcgggcaccctggttctggtg

SEQ ID NO: 52280 - DNA, 22 bp, Homo sapiens
ttggccatctaagcccagccac

SEQ ID NO: 52281 - DNA, 22 bp, Homo sapiens
gattgtggaagtcagtggttct

SEQ ID NO: 52282 - DNA, 22 bp, Homo sapiens
gtggatggccctgcacacaggt

SEQ ID NO: 52283 - DNA, 22 bp, Homo sapiens
ggggtctcactatgttacccag

SEQ ID NO: 52284 - DNA, 22 bp, Homo sapiens
agatgctgctccacaggccagg

SEQ ID NO: 52285 - DNA, 22 bp, Homo sapiens
gaagcctcaacatctctgcgtc

SEQ ID NO: 52286 - DNA, 22 bp, Homo sapiens
ttgcccaggctggagtgcagtg

SEQ ID NO: 52287 - DNA, 23 bp, Homo sapiens
agctctgctcgggcatgccctgc

SEQ ID NO: 52288 - DNA, 22 bp, Homo sapiens
cactgggcacttgggttgcttc

SEQ ID NO: 52289 - DNA, 22 bp, Homo sapiens
ccgaggctggagtgcagtggcg

SEQ ID NO: 52290 - DNA, 22 bp, Homo sapiens
ggagggcagagtcccctgctga

SEQ ID NO: 52291 - DNA, 22 bp, Homo sapiens
ttgtgctctgtgttatttaagg

SEQ ID NO: 52292 - DNA, 22 bp, Homo sapiens
ggggatggaggcgtgtggtcct

SEQ ID NO: 52293 - DNA, 22 bp, Homo sapiens
aatgtcaaaggctatacattca

SEQ ID NO: 52294 - DNA, 22 bp, Homo sapiens
caagcgtggctgctctgatgga

SEQ ID NO: 52295 - DNA, 22 bp, Homo sapiens
ataatacatggttgatcttttc

SEQ ID NO: 52296 - DNA, 22 bp, Homo sapiens
tgatgaccgccaacgtttaggt

SEQ ID NO: 52297 - DNA, 22 bp, Homo sapiens
gctgcagtgagccaagatcgtg

SEQ ID NO: 52298 - DNA, 22 bp, Homo sapiens
cgcccaggctggagtgcagtgg

SEQ ID NO: 52299 - DNA, 22 bp, Homo sapiens
ttcagcagtgcagacacccagt

SEQ ID NO: 52300 - DNA, 22 bp, Homo sapiens
acagattcactgcactggccat

SEQ ID NO: 52301 - DNA, 22 bp, Homo sapiens
cgtgggtcgggactccgcctcg

SEQ ID NO: 52302 - DNA, 22 bp, Homo sapiens
ttctacagtgactgcagccata

SEQ ID NO: 52303 - DNA, 21 bp, Homo sapiens
ctggaggcaggtggtgccagg

SEQ ID NO: 52304 - DNA, 22 bp, Homo sapiens
tgagaaacacaggcatgaatag

SEQ ID NO: 52305 - DNA, 21 bp, Homo sapiens
cgggaaggaggttctgaccct

SEQ ID NO: 52306 - DNA, 22 bp, Homo sapiens
gttgaggtgatgccagccctgc

SEQ ID NO: 52307 - DNA, 22 bp, Homo sapiens
catccgcatgcaagtgctgtcc

SEQ ID NO: 52308 - DNA, 22 bp, Homo sapiens
gggcagagagctggaactcctt

SEQ ID NO: 52309 - DNA, 22 bp, Homo sapiens
taggctgggggtaggaattgag

SEQ ID NO: 52310 - DNA, 22 bp, Homo sapiens
atacaaaatatatactggagac

SEQ ID NO: 52311 - DNA, 22 bp, Homo sapiens
cagctggcgactctcctcgatg

SEQ ID NO: 52312 - DNA, 22 bp, Homo sapiens
tgccagaatttgcttccaatgt

SEQ ID NO: 52313 - DNA, 22 bp, Homo sapiens
tccgtggggcctgtggcttccg

SEQ ID NO: 52314 - DNA, 22 bp, Homo sapiens
aaccaccattctctcctcttcc

SEQ ID NO: 52315 - DNA, 22 bp, Homo sapiens
ggaggagcatgagagggtagtg

SEQ ID NO: 52316 - DNA, 22 bp, Homo sapiens
atgcacctgaactccatcagct

SEQ ID NO: 52317 - DNA, 22 bp, Homo sapiens
ccttacactgcctggggccacg

SEQ ID NO: 52318 - DNA, 22 bp, Homo sapiens
gaggctgaggttgcagtgagct

SEQ ID NO: 52319 - DNA, 22 bp, Homo sapiens
cactgcactccagcctgggtca

SEQ ID NO: 52320 - DNA, 22 bp, Homo sapiens
gctgctctccaagcctccttga

SEQ ID NO: 52321 - DNA, 22 bp, Homo sapiens
ttttggctctgtctgtatcttt

SEQ ID NO: 52322 - DNA, 20 bp, Homo sapiens
tcagccttgaatgcttgaaa

SEQ ID NO: 52323 - DNA, 22 bp, Homo sapiens
atgtttaaagggttgagaaata

SEQ ID NO: 52324 - DNA, 22 bp, Homo sapiens
tctcctggtacccttcctagca

SEQ ID NO: 52325 - DNA, 22 bp, Homo sapiens
ggctgtggcagctggaagtggt

SEQ ID NO: 52326 - DNA, 22 bp, Homo sapiens
gctcttgtcaaaaattagttga

SEQ ID NO: 52327 - DNA, 22 bp, Homo sapiens
gccaggacctcagatgcagggc

SEQ ID NO: 52328 - DNA, 22 bp, Homo sapiens
tatactctgagaaacgtgtcac

SEQ ID NO: 52329 - DNA, 22 bp, Homo sapiens
agcctctctgttagtcactggg

SEQ ID NO: 52330 - DNA, 22 bp, Homo sapiens
ttagctcagaaaatttaaactt

SEQ ID NO: 52331 - DNA, 22 bp, Homo sapiens
ggaggtcccaggcctggcagca

SEQ ID NO: 52332 - DNA, 22 bp, Homo sapiens
acccggagtcggaggttgcagt

SEQ ID NO: 52333 - DNA, 23 bp, Homo sapiens
gttttacaggtgagaaaatggag

SEQ ID NO: 52334 - DNA, 22 bp, Homo sapiens
ggttcccggatctccgagtccc

SEQ ID NO: 52335 - DNA, 22 bp, Homo sapiens
ccctgcctacagggttttcttt

SEQ ID NO: 52336 - DNA, 18 bp, Homo sapiens
ccctcttgcacaaagcaa

SEQ ID NO: 52337 - DNA, 22 bp, Homo sapiens
actgcacttcagcctgggtgac

SEQ ID NO: 52338 - DNA, 22 bp, Homo sapiens
tgccgtggggctgaggctggag

SEQ ID NO: 52339 - DNA, 19 bp, Homo sapiens
aggaatggaattaattctg

SEQ ID NO: 52340 - DNA, 22 bp, Homo sapiens
cacccaggctggaatgcagtgg

SEQ ID NO: 52341 - DNA, 22 bp, Homo sapiens
cacccaggctggagtgcagtga

SEQ ID NO: 52342 - DNA, 22 bp, Homo sapiens
tcgccatggaagtccttgcgga

SEQ ID NO: 52343 - DNA, 22 bp, Homo sapiens
aacccgtgatcctgactcccct

SEQ ID NO: 52344 - DNA, 22 bp, Homo sapiens
acaagcgggccacagtgctggt

SEQ ID NO: 52345 - DNA, 22 bp, Homo sapiens
tcactgcaacctctgcctcccg

SEQ ID NO: 52346 - DNA, 22 bp, Homo sapiens
gaaagacatagttgcaagatgg

SEQ ID NO: 52347 - DNA, 23 bp, Homo sapiens
tgaggcaggcggatcacgaggtc

SEQ ID NO: 52348 - DNA, 22 bp, Homo sapiens
ataccaccatctatgaaaggta

SEQ ID NO: 52349 - DNA, 22 bp, Homo sapiens
tcctggcttgtcacatctacgt

SEQ ID NO: 52350 - DNA, 22 bp, Homo sapiens
tttggtattgcacactgtcttc

SEQ ID NO: 52351 - DNA, 22 bp, Homo sapiens
aggctagaggcttctggcttca

SEQ ID NO: 52352 - DNA, 22 bp, Homo sapiens
tgtgttgtgacattcttggatg

SEQ ID NO: 52353 - DNA, 22 bp, Homo sapiens
cagggaaagtcccaccccacac

SEQ ID NO: 52354 - DNA, 22 bp, Homo sapiens
tggtccgctcctattcgccgca

SEQ ID NO: 52355 - DNA, 22 bp, Homo sapiens
ctggagggctgcagcgaggctg

SEQ ID NO: 52356 - DNA, 22 bp, Homo sapiens
tctcctggagcccagatgctgg

SEQ ID NO: 52357 - DNA, 22 bp, Homo sapiens
aggtggggaggagtgtctcttt

SEQ ID NO: 52358 - DNA, 22 bp, Homo sapiens
tatgcacaacatgcaggtttgt

SEQ ID NO: 52359 - DNA, 23 bp, Homo sapiens
cagagctggctcagagctgcctg

SEQ ID NO: 52360 - DNA, 22 bp, Homo sapiens
atatgggggggcgtgcagagga

SEQ ID NO: 52361 - DNA, 22 bp, Homo sapiens
cagggggctcaaaggagagtgc

SEQ ID NO: 52362 - DNA, 22 bp, Homo sapiens
tgaggcaggaggttgagaactg

SEQ ID NO: 52363 - DNA, 22 bp, Homo sapiens
tgcttctgactaagctgcatga

SEQ ID NO: 52364 - DNA, 22 bp, Homo sapiens
tgtgagttcttagaaagtcagt

SEQ ID NO: 52365 - DNA, 22 bp, Homo sapiens
cgaggaggaaacgcggagaact

SEQ ID NO: 52366 - DNA, 22 bp, Homo sapiens
atggccgcctgtccttcccgcc

SEQ ID NO: 52367 - DNA, 18 bp, Homo sapiens
tctgtgggatcagtgagg

SEQ ID NO: 52368 - DNA, 22 bp, Homo sapiens
gcccaggctggagtgcagtggc

SEQ ID NO: 52369 - DNA, 22 bp, Homo sapiens
gccaggaaagggaattccctga

SEQ ID NO: 52370 - DNA, 22 bp, Homo sapiens
acatcccatgcgcatctggcaa

SEQ ID NO: 52371 - DNA, 22 bp, Homo sapiens
cactgcactccagctgggtgac

SEQ ID NO: 52372 - DNA, 22 bp, Homo sapiens
gcctgttctccagcatccaggt

SEQ ID NO: 52373 - DNA, 22 bp, Homo sapiens
actgccctccagcctgggtgac

SEQ ID NO: 52374 - DNA, 22 bp, Homo sapiens
caccttactccctctggatgcc

SEQ ID NO: 52375 - DNA, 20 bp, Homo sapiens
agcagagtgcccatcccgga

SEQ ID NO: 52376 - DNA, 22 bp, Homo sapiens
acccagccatgttcagttctct

SEQ ID NO: 52377 - DNA, 22 bp, Homo sapiens
actccacaccacgggggccgcc

SEQ ID NO: 52378 - DNA, 22 bp, Homo sapiens
cagcgtctcgttgtgggcctcg

SEQ ID NO: 52379 - DNA, 22 bp, Homo sapiens
gctgtcttgctcactcttgcag

SEQ ID NO: 52380 - DNA, 22 bp, Homo sapiens
agtgctgggctatctactgcta

SEQ ID NO: 52381 - DNA, 22 bp, Homo sapiens
ttctcttttcaccagttgctaa

SEQ ID NO: 52382 - DNA, 22 bp, Homo sapiens
tgcccagggtggagtgcagtgg

SEQ ID NO: 52383 - DNA, 22 bp, Homo sapiens
ctggtttgtcttgggaggatgt

SEQ ID NO: 52384 - DNA, 22 bp, Homo sapiens
aataaacaaatccttccttccc

SEQ ID NO: 52385 - DNA, 19 bp, Homo sapiens
acccagcccaggagtggca

SEQ ID NO: 52386 - DNA, 22 bp, Homo sapiens
acggtgaccaagcatcaccgag

SEQ ID NO: 52387 - DNA, 22 bp, Homo sapiens
tggtctgctgaacagccgtatc

SEQ ID NO: 52388 - DNA, 19 bp, Homo sapiens
aggtggctgaaactacaga

SEQ ID NO: 52389 - DNA, 22 bp, Homo sapiens
aaattagtcatgttgtattact

SEQ ID NO: 52390 - DNA, 22 bp, Homo sapiens
tttctataaaaagtgctaggat

SEQ ID NO: 52391 - DNA, 22 bp, Homo sapiens
actgcactccagcccgagcaac

SEQ ID NO: 52392 - DNA, 22 bp, Homo sapiens
gcccagcacctctctcagggtt

SEQ ID NO: 52393 - DNA, 22 bp, Homo sapiens
tgtgtggattcatctcaaagag

SEQ ID NO: 52394 - DNA, 22 bp, Homo sapiens
atatatttgagaatattcatga

SEQ ID NO: 52395 - DNA, 22 bp, Homo sapiens
tcacccaggctggactgcagtg

SEQ ID NO: 52396 - DNA, 22 bp, Homo sapiens
aggacagagggaccagagccca

SEQ ID NO: 52397 - DNA, 22 bp, Homo sapiens
tatgctctgagacctttgtgca

SEQ ID NO: 52398 - DNA, 18 bp, Homo sapiens
atgagaggtgtcagaaga

SEQ ID NO: 52399 - DNA, 22 bp, Homo sapiens
aatgcaatgcagcacctccttg

SEQ ID NO: 52400 - DNA, 22 bp, Homo sapiens
ccagcagccaccttctcgaaat

SEQ ID NO: 52401 - DNA, 22 bp, Homo sapiens
gaattcttttctttctgaaagt

SEQ ID NO: 52402 - DNA, 22 bp, Homo sapiens
gtgagactcgcctttgtgtagc

SEQ ID NO: 52403 - DNA, 22 bp, Homo sapiens
gaggctgaggcaggaggatcac

SEQ ID NO: 52404 - DNA, 22 bp, Homo sapiens
tgtggctcaggcggcttctcct

SEQ ID NO: 52405 - DNA, 22 bp, Homo sapiens
ccctttagcccctgcagagact

SEQ ID NO: 52406 - DNA, 20 bp, Homo sapiens
attagctcaggtgaggtcat

SEQ ID NO: 52407 - DNA, 22 bp, Homo sapiens
gttactcttgagaggctgaggt

SEQ ID NO: 52408 - DNA, 22 bp, Homo sapiens
agtatgtcagagtgaaaatggt

SEQ ID NO: 52409 - DNA, 22 bp, Homo sapiens
gcctcaaatgtggagcactatt

SEQ ID NO: 52410 - DNA, 22 bp, Homo sapiens
gcccaggaggagaggctgcagt

SEQ ID NO: 52411 - DNA, 22 bp, Homo sapiens
cattgcaacttcaaactcctgg

SEQ ID NO: 52412 - DNA, 22 bp, Homo sapiens
ggctcactacaacctccgcctt

SEQ ID NO: 52413 - DNA, 22 bp, Homo sapiens
tttctttatcatagcatctttg

SEQ ID NO: 52414 - DNA, 22 bp, Homo sapiens
gtaaaaaggccaagcccttgtg

SEQ ID NO: 52415 - DNA, 22 bp, Homo sapiens
ggaaaagtgttaaggtgttgat

SEQ ID NO: 52416 - DNA, 22 bp, Homo sapiens
actccacatttgaacacagttc

SEQ ID NO: 52417 - DNA, 22 bp, Homo sapiens
gcgccccatctacagtactttt

SEQ ID NO: 52418 - DNA, 22 bp, Homo sapiens
caggaagaccagggctgtggct

SEQ ID NO: 52419 - DNA, 22 bp, Homo sapiens
tgtcttcaggagtaaatatcat

SEQ ID NO: 52420 - DNA, 22 bp, Homo sapiens
attgcactccagcctgggggac

SEQ ID NO: 52421 - DNA, 22 bp, Homo sapiens
cagctggtgtcaggcactgcag

SEQ ID NO: 52422 - DNA, 22 bp, Homo sapiens
ccaggcagcctgctccattctg

SEQ ID NO: 52423 - DNA, 22 bp, Homo sapiens
gcccaggagttcaagtctagtg

SEQ ID NO: 52424 - DNA, 22 bp, Homo sapiens
cgcgaggtggaggttgcagtga

SEQ ID NO: 52425 - DNA, 22 bp, Homo sapiens
gtctcctccctttcattcacct

SEQ ID NO: 52426 - DNA, 22 bp, Homo sapiens
tattgggtaaagatccagtttt

SEQ ID NO: 52427 - DNA, 22 bp, Homo sapiens
ctgccctggggggcctccttgc

SEQ ID NO: 52428 - DNA, 22 bp, Homo sapiens
tgtagtagcattcacgaagtgt

SEQ ID NO: 52429 - DNA, 22 bp, Homo sapiens
ccctgctgtcaggtgctgggag

SEQ ID NO: 52430 - DNA, 22 bp, Homo sapiens
gcagggtctgaggccacagagg

SEQ ID NO: 52431 - DNA, 22 bp, Homo sapiens
tgcagattcaaatgaaatgcaa

SEQ ID NO: 52432 - DNA, 22 bp, Homo sapiens
cgtgccactgcactctagcctg

SEQ ID NO: 52433 - DNA, 22 bp, Homo sapiens
caattgtcagtgctgtttaaat

SEQ ID NO: 52434 - DNA, 21 bp, Homo sapiens
acatggactgtgaatggggac

SEQ ID NO: 52435 - DNA, 22 bp, Homo sapiens
attgtgaatagtgccgcagtaa

SEQ ID NO: 52436 - DNA, 22 bp, Homo sapiens
tgcactccaggctgggtgacag

SEQ ID NO: 52437 - DNA, 22 bp, Homo sapiens
cagcctggtccccggctcaccc

SEQ ID NO: 52438 - DNA, 22 bp, Homo sapiens
cacactgtctttatgagctgta

SEQ ID NO: 52439 - DNA, 22 bp, Homo sapiens
aggaaataggaccagacaaagc

SEQ ID NO: 52440 - DNA, 22 bp, Homo sapiens
aaattgtaatgacttcacttga

SEQ ID NO: 52441 - DNA, 22 bp, Homo sapiens
tcttaattctgtgtcttcacta

SEQ ID NO: 52442 - DNA, 22 bp, Homo sapiens
ttggaggcaatgggaaggaggc

SEQ ID NO: 52443 - DNA, 21 bp, Homo sapiens
cgtgactgggtccgtctggct

SEQ ID NO: 52444 - DNA, 22 bp, Homo sapiens
gagggaaaggttaatacatgat

SEQ ID NO: 52445 - DNA, 22 bp, Homo sapiens
ctggctgggagcgagctgctca

SEQ ID NO: 52446 - DNA, 22 bp, Homo sapiens
ggcagcactgcagcttgttggg

SEQ ID NO: 52447 - DNA, 18 bp, Homo sapiens
ggaaaaggagtgtctagc

SEQ ID NO: 52448 - DNA, 22 bp, Homo sapiens
taattgtaaagtagtagtacag

SEQ ID NO: 52449 - DNA, 22 bp, Homo sapiens
ctggagggtggagagaagtctc

SEQ ID NO: 52450 - DNA, 22 bp, Homo sapiens
ccaaagtgctggggttacaggc

SEQ ID NO: 52451 - DNA, 22 bp, Homo sapiens
catataaatacaacatgtgtta

SEQ ID NO: 52452 - DNA, 22 bp, Homo sapiens
gcccagcgagcagaggtggacg

SEQ ID NO: 52453 - DNA, 22 bp, Homo sapiens
cctggcaggtggcgccctcggc

SEQ ID NO: 52454 - DNA, 22 bp, Homo sapiens
gtggctcacacctgtaatccca

SEQ ID NO: 52455 - DNA, 22 bp, Homo sapiens
gctggggaggcagcagagaaca

SEQ ID NO: 52456 - DNA, 22 bp, Homo sapiens
ggctgtggagctgcagagttgg

SEQ ID NO: 52457 - DNA, 22 bp, Homo sapiens
tctaaacttgtaaacaagcata

SEQ ID NO: 52458 - DNA, 22 bp, Homo sapiens
ctggctttgatcagagtgacct

SEQ ID NO: 52459 - DNA, 22 bp, Homo sapiens
tgatttatgcattatactgttg

SEQ ID NO: 52460 - DNA, 22 bp, Homo sapiens
atcatccaagcgtagttcttct

SEQ ID NO: 52461 - DNA, 22 bp, Homo sapiens
tccaactttctcctccggcttg

SEQ ID NO: 52462 - DNA, 22 bp, Homo sapiens
aggccttaccatagctgtagca

SEQ ID NO: 52463 - DNA, 22 bp, Homo sapiens
tctcttgagctcagttctgatg

SEQ ID NO: 52464 - DNA, 22 bp, Homo sapiens
atcctagaatcagcccttgctg

SEQ ID NO: 52465 - DNA, 22 bp, Homo sapiens
accccaggaagtggaggtcatg

SEQ ID NO: 52466 - DNA, 22 bp, Homo sapiens
tggtctttgtccctccttgatc

SEQ ID NO: 52467 - DNA, 22 bp, Homo sapiens
ccaggaggcggaggttgcagtg

SEQ ID NO: 52468 - DNA, 22 bp, Homo sapiens
agtcccaacagcttacaaggaa

SEQ ID NO: 52469 - DNA, 22 bp, Homo sapiens
ttcattcttcagagctgcgctt

SEQ ID NO: 52470 - DNA, 22 bp, Homo sapiens
cctgggcctctcaaagtgctgg

SEQ ID NO: 52471 - DNA, 22 bp, Homo sapiens
aggggcacgagtagagctctag

SEQ ID NO: 52472 - DNA, 21 bp, Homo sapiens
agtggctctcagcttgctaag

SEQ ID NO: 52473 - DNA, 22 bp, Homo sapiens
tttgtgaataggttggcttcca

SEQ ID NO: 52474 - DNA, 22 bp, Homo sapiens
atgaggcaggagtgcagtggca

SEQ ID NO: 52475 - DNA, 22 bp, Homo sapiens
gaattttattactagtcaactg

SEQ ID NO: 52476 - DNA, 18 bp, Homo sapiens
cagctgccagctcatgga

SEQ ID NO: 52477 - DNA, 22 bp, Homo sapiens
attcttcctcatcaatctgtag

SEQ ID NO: 52478 - DNA, 22 bp, Homo sapiens
gacctcatgatccacctgcctt

SEQ ID NO: 52479 - DNA, 22 bp, Homo sapiens
gcccagccacagtcactttcat

SEQ ID NO: 52480 - DNA, 22 bp, Homo sapiens
aacctcaaactcttgggcttaa

SEQ ID NO: 52481 - DNA, 22 bp, Homo sapiens
cttgtagaattgaaatggtctc

SEQ ID NO: 52482 - DNA, 22 bp, Homo sapiens
caagggaattgtgtgtgagagg

SEQ ID NO: 52483 - DNA, 22 bp, Homo sapiens
gaatgcttggaacctgaagttc

SEQ ID NO: 52484 - DNA, 22 bp, Homo sapiens
gtgcgcaccctcccggcatccc

SEQ ID NO: 52485 - DNA, 20 bp, Homo sapiens
tcagccattccttacctttc

SEQ ID NO: 52486 - DNA, 22 bp, Homo sapiens
aacccaggaggcggaggttgtg

SEQ ID NO: 52487 - DNA, 22 bp, Homo sapiens
ctgggctagaaggaccaggatg

SEQ ID NO: 52488 - DNA, 22 bp, Homo sapiens
gaggctgaggttgcagtgagcc

SEQ ID NO: 52489 - DNA, 16 bp, Homo sapiens
aggctcagaggctgga

SEQ ID NO: 52490 - DNA, 22 bp, Homo sapiens
gagagaagggggatatgagcct

SEQ ID NO: 52491 - DNA, 22 bp, Homo sapiens
ctggcctcggcagcaggaacag

SEQ ID NO: 52492 - DNA, 22 bp, Homo sapiens
gagatgggcgagaaggtggact

SEQ ID NO: 52493 - DNA, 19 bp, Homo sapiens
ccctcttgcacaaagcaaa

SEQ ID NO: 52494 - DNA, 22 bp, Homo sapiens
gggaaagaccttcctggggtgt

SEQ ID NO: 52495 - DNA, 22 bp, Homo sapiens
cctgacaggcggaggctgcagt

SEQ ID NO: 52496 - DNA, 22 bp, Homo sapiens
ttctccgctaagttctctgcag

SEQ ID NO: 52497 - DNA, 22 bp, Homo sapiens
gctgcactttgactgctggggt

SEQ ID NO: 52498 - DNA, 22 bp, Homo sapiens
tctagttctagatccctgagga

SEQ ID NO: 52499 - DNA, 22 bp, Homo sapiens
tggctccgttgtacaggctgga

SEQ ID NO: 52500 - DNA, 22 bp, Homo sapiens
tgcaatctcggcactttgggag

SEQ ID NO: 52501 - DNA, 22 bp, Homo sapiens
attctaaatcagagagctctgt

SEQ ID NO: 52502 - DNA, 22 bp, Homo sapiens
aatggcactttataaatgttaa

SEQ ID NO: 52503 - DNA, 22 bp, Homo sapiens
gcctccccaagcagcagggatt

SEQ ID NO: 52504 - DNA, 17 bp, Homo sapiens
tggtccaggtggagcca

SEQ ID NO: 52505 - DNA, 23 bp, Homo sapiens
caccactttctccttctccttgg

SEQ ID NO: 52506 - DNA, 22 bp, Homo sapiens
gccgggttcaagccattctcct

SEQ ID NO: 52507 - DNA, 22 bp, Homo sapiens
gccggggctggggagagacatg

SEQ ID NO: 52508 - DNA, 22 bp, Homo sapiens
ggaggcagaatagagtgtgggt

SEQ ID NO: 52509 - DNA, 22 bp, Homo sapiens
agaggcagtatacaatccgagc

SEQ ID NO: 52510 - DNA, 22 bp, Homo sapiens
gtggatggagctggaagccatt

SEQ ID NO: 52511 - DNA, 22 bp, Homo sapiens
ttgtcttttgtgggaaatatgg

SEQ ID NO: 52512 - DNA, 22 bp, Homo sapiens
atgccactgcactccagcctag

SEQ ID NO: 52513 - DNA, 22 bp, Homo sapiens
accactgcccatggtgaaaact

SEQ ID NO: 52514 - DNA, 22 bp, Homo sapiens
atggcagcggagctggaaatga

SEQ ID NO: 52515 - DNA, 22 bp, Homo sapiens
ctgaggagaggtggcctgtgtt

SEQ ID NO: 52516 - DNA, 22 bp, Homo sapiens
gcctcctggggtgccatcatct

SEQ ID NO: 52517 - DNA, 22 bp, Homo sapiens
tccacaaggcagctcctccagg

SEQ ID NO: 52518 - DNA, 22 bp, Homo sapiens
gaggtaggtgtaggaggcctgc

SEQ ID NO: 52519 - DNA, 22 bp, Homo sapiens
ggaggaggggtgactgaatgct

SEQ ID NO: 52520 - DNA, 22 bp, Homo sapiens
cttggggcagcccaggctgagc

SEQ ID NO: 52521 - DNA, 22 bp, Homo sapiens
acccggcggagcctgcagtgag

SEQ ID NO: 52522 - DNA, 22 bp, Homo sapiens
ccagcagagcatggggaggaag

SEQ ID NO: 52523 - DNA, 22 bp, Homo sapiens
ttctatttttgtggaactgtag

SEQ ID NO: 52524 - DNA, 22 bp, Homo sapiens
acccaagttttccatgcctgtt

SEQ ID NO: 52525 - DNA, 22 bp, Homo sapiens
gcaggtggatcaccacgtcagg

SEQ ID NO: 52526 - DNA, 22 bp, Homo sapiens
agagaagagtcttgtcaaatta

SEQ ID NO: 52527 - DNA, 17 bp, Homo sapiens
tgggatccgtctctgtg

SEQ ID NO: 52528 - DNA, 22 bp, Homo sapiens
gctgcagctcgccttccggcct

SEQ ID NO: 52529 - DNA, 22 bp, Homo sapiens
taacatttaaatttttcacata

SEQ ID NO: 52530 - DNA, 22 bp, Homo sapiens
tttggaaatgaccccgtctaag

SEQ ID NO: 52531 - DNA, 22 bp, Homo sapiens
atattagtttggagactacaat

SEQ ID NO: 52532 - DNA, 22 bp, Homo sapiens
actgggaagtcagagagaggct

SEQ ID NO: 52533 - DNA, 21 bp, Homo sapiens
cagtggcacgatttcggctca

SEQ ID NO: 52534 - DNA, 22 bp, Homo sapiens
gccctagcgccagctcagcacc

SEQ ID NO: 52535 - DNA, 22 bp, Homo sapiens
tcacccaggctggagtgcagtg

SEQ ID NO: 52536 - DNA, 22 bp, Homo sapiens
tctcccaggcaggagtgcagtg

SEQ ID NO: 52537 - DNA, 22 bp, Homo sapiens
tttcataatactgtacatgaaa

SEQ ID NO: 52538 - DNA, 22 bp, Homo sapiens
tttgctttgtttaaaagtggta

SEQ ID NO: 52539 - DNA, 22 bp, Homo sapiens
caggctggagtgcagtggtgcc

SEQ ID NO: 52540 - DNA, 22 bp, Homo sapiens
tctcatggagtcaggagcagaa

SEQ ID NO: 52541 - DNA, 22 bp, Homo sapiens
cccaggaggtggagcttgcagt

SEQ ID NO: 52542 - DNA, 22 bp, Homo sapiens
agcatgcgcttgatcagctcca

SEQ ID NO: 52543 - DNA, 22 bp, Homo sapiens
acatatgcgatcataggatgca

SEQ ID NO: 52544 - DNA, 22 bp, Homo sapiens
ggaggtgggctaaggactctct

SEQ ID NO: 52545 - DNA, 22 bp, Homo sapiens
cccaggaattggaggctgcagt

SEQ ID NO: 52546 - DNA, 22 bp, Homo sapiens
gaagctgtgtgaagctctgaag

SEQ ID NO: 52547 - DNA, 20 bp, Homo sapiens
ttcaggaataagatagcagc

SEQ ID NO: 52548 - DNA, 22 bp, Homo sapiens
cccaggggttcaaggctgcagt

SEQ ID NO: 52549 - DNA, 22 bp, Homo sapiens
ggggcagagaataaaaacctaa

SEQ ID NO: 52550 - DNA, 19 bp, Homo sapiens
taccatccaagctggtttg

SEQ ID NO: 52551 - DNA, 22 bp, Homo sapiens
aggctgagataggtggatcatt

SEQ ID NO: 52552 - DNA, 22 bp, Homo sapiens
cctacagttatattcttgattg

SEQ ID NO: 52553 - DNA, 22 bp, Homo sapiens
agctgaaacttcccattaattg

SEQ ID NO: 52554 - DNA, 22 bp, Homo sapiens
tgccacctgtacatgctatctg

SEQ ID NO: 52555 - DNA, 22 bp, Homo sapiens
cgcccaggctggagtgcagtga

SEQ ID NO: 52556 - DNA, 22 bp, Homo sapiens
aggggaggtgtccccaaatctc

SEQ ID NO: 52557 - DNA, 22 bp, Homo sapiens
gctgcagctgtaggacacaatt

SEQ ID NO: 52558 - DNA, 22 bp, Homo sapiens
tcctccactttgtctagcaaca

SEQ ID NO: 52559 - DNA, 22 bp, Homo sapiens
gttcaagaccagcctggccaac

SEQ ID NO: 52560 - DNA, 22 bp, Homo sapiens
agaatacttgggaatgggttaa

SEQ ID NO: 52561 - DNA, 22 bp, Homo sapiens
ttctgcagtgttaacaatgtca

SEQ ID NO: 52562 - DNA, 22 bp, Homo sapiens
ctaggctggagtgcagtggcac

SEQ ID NO: 52563 - DNA, 22 bp, Homo sapiens
agcacctgtcaagtccaggctg

SEQ ID NO: 52564 - DNA, 21 bp, Homo sapiens
tttcttaggctctaaaatgac

SEQ ID NO: 52565 - DNA, 22 bp, Homo sapiens
aggggaatgggtagactgttga

SEQ ID NO: 52566 - DNA, 19 bp, Homo sapiens
agataagagttgactgtgg

SEQ ID NO: 52567 - DNA, 22 bp, Homo sapiens
ctctttggatagaattacaaag

SEQ ID NO: 52568 - DNA, 22 bp, Homo sapiens
ggtgacctcacctggtcccacc

SEQ ID NO: 52569 - DNA, 22 bp, Homo sapiens
tcactgcaacctccacctcccg

SEQ ID NO: 52570 - DNA, 22 bp, Homo sapiens
ttgtgaatagtgccgctataaa

SEQ ID NO: 52571 - DNA, 22 bp, Homo sapiens
aacccaggagatggaggttgtg

SEQ ID NO: 52572 - DNA, 22 bp, Homo sapiens
atgttctacagatggaaagggg

SEQ ID NO: 52573 - DNA, 22 bp, Homo sapiens
ttcagagaattggataattcgt

SEQ ID NO: 52574 - DNA, 22 bp, Homo sapiens
tggctacctgatttcttttcag

SEQ ID NO: 52575 - DNA, 22 bp, Homo sapiens
cttaactctacactgcacttta

SEQ ID NO: 52576 - DNA, 23 bp, Homo sapiens
agagcaaggaaatgaggtgtgat

SEQ ID NO: 52577 - DNA, 22 bp, Homo sapiens
gctgaggctcctcgggaggaca

SEQ ID NO: 52578 - DNA, 22 bp, Homo sapiens
accctcaacaaattcactctat

SEQ ID NO: 52579 - DNA, 17 bp, Homo sapiens
gtaaggcttgcagatgc

SEQ ID NO: 52580 - DNA, 22 bp, Homo sapiens
gggacgacaggctctgtggtag

SEQ ID NO: 52581 - DNA, 22 bp, Homo sapiens
gagagtctaggaacctcatata

SEQ ID NO: 52582 - DNA, 22 bp, Homo sapiens
cgcaactcagcaacttaactgc

SEQ ID NO: 52583 - DNA, 22 bp, Homo sapiens
gggcagagactcagaaacagaa

SEQ ID NO: 52584 - DNA, 20 bp, Homo sapiens
tgcagcacgggccctttcca

SEQ ID NO: 52585 - DNA, 23 bp, Homo sapiens
tcagaacagttcttggtgcatag

SEQ ID NO: 52586 - DNA, 22 bp, Homo sapiens
gcccagcccagaaaggttcgga

SEQ ID NO: 52587 - DNA, 22 bp, Homo sapiens
aaaatcttgtgacttaggaagg

SEQ ID NO: 52588 - DNA, 22 bp, Homo sapiens
tcactgcagcctctgcctcccg

SEQ ID NO: 52589 - DNA, 22 bp, Homo sapiens
atgtggcaccgatctttagcca

SEQ ID NO: 52590 - DNA, 21 bp, Homo sapiens
agtagtttagcacagggtttg

SEQ ID NO: 52591 - DNA, 22 bp, Homo sapiens
tgaagaaacgcagagaggtagg

SEQ ID NO: 52592 - DNA, 22 bp, Homo sapiens
actgcgctccagcctgggtgac

SEQ ID NO: 52593 - DNA, 22 bp, Homo sapiens
gcagatcaacactctctttcaa

SEQ ID NO: 52594 - DNA, 22 bp, Homo sapiens
cccagtttcaactttccagtgg

SEQ ID NO: 52595 - DNA, 22 bp, Homo sapiens
cccagctcttcaagtcaccccc

SEQ ID NO: 52596 - DNA, 22 bp, Homo sapiens
agatgtttataactcatgagtg

SEQ ID NO: 52597 - DNA, 22 bp, Homo sapiens
cccactgtttccctgaggctct

SEQ ID NO: 52598 - DNA, 22 bp, Homo sapiens
gctcccagtctgatggaggaga

SEQ ID NO: 52599 - DNA, 22 bp, Homo sapiens
tctgcaggtaagcgttcttgga

SEQ ID NO: 52600 - DNA, 22 bp, Homo sapiens
cggggttcatccatgctgtggc

SEQ ID NO: 52601 - DNA, 23 bp, Homo sapiens
gacagagtgagaccttgtcttac

SEQ ID NO: 52602 - DNA, 22 bp, Homo sapiens
ccatgtacatgaacacggcggc

SEQ ID NO: 52603 - DNA, 22 bp, Homo sapiens
catggcggtcaggatgtaggtg

SEQ ID NO: 52604 - DNA, 22 bp, Homo sapiens
agagagcagtggatcacctagc

SEQ ID NO: 52605 - DNA, 22 bp, Homo sapiens
gatgaggcataaacacagtcac

SEQ ID NO: 52606 - DNA, 22 bp, Homo sapiens
tcactacaacctccgcctcctg

SEQ ID NO: 52607 - DNA, 22 bp, Homo sapiens
atgcccaatgtcacaatttttg

SEQ ID NO: 52608 - DNA, 22 bp, Homo sapiens
gagccaggtcgggccgcggcga

SEQ ID NO: 52609 - DNA, 22 bp, Homo sapiens
ttaataaagtatgaattggaaa

SEQ ID NO: 52610 - DNA, 22 bp, Homo sapiens
tgctggaggccagaagtctgag

SEQ ID NO: 52611 - DNA, 22 bp, Homo sapiens
ctggcaggtggaggttgcagtg

SEQ ID NO: 52612 - DNA, 22 bp, Homo sapiens
gggtggagagaaagaaacgtga

SEQ ID NO: 52613 - DNA, 22 bp, Homo sapiens
gcaggcagatcacctgtcagga

SEQ ID NO: 52614 - DNA, 22 bp, Homo sapiens
tggctcctcacgtcctcagagc

SEQ ID NO: 52615 - DNA, 22 bp, Homo sapiens
gtcttgggacccgcactgtggg

SEQ ID NO: 52616 - DNA, 22 bp, Homo sapiens
aaagcttaccttttcagtcttt

SEQ ID NO: 52617 - DNA, 22 bp, Homo sapiens
cgcccaggctggagagcagtgg

SEQ ID NO: 52618 - DNA, 22 bp, Homo sapiens
aaatggaagctatttatgattc

SEQ ID NO: 52619 - DNA, 22 bp, Homo sapiens
ggggaaggaaagttattagcag

SEQ ID NO: 52620 - DNA, 21 bp, Homo sapiens
tggcggggacttgtggctgcc

SEQ ID NO: 52621 - DNA, 22 bp, Homo sapiens
gtacagaggttgctggaggctc

SEQ ID NO: 52622 - DNA, 22 bp, Homo sapiens
caggagtccatctggcctggtg

SEQ ID NO: 52623 - DNA, 22 bp, Homo sapiens
tgttgattagtgtttagactta

SEQ ID NO: 52624 - DNA, 22 bp, Homo sapiens
aatgctctttaacctattctga

SEQ ID NO: 52625 - DNA, 22 bp, Homo sapiens
agcaccgttcaaacccaggtta

SEQ ID NO: 52626 - DNA, 22 bp, Homo sapiens
atggagttctgccagcgctgct

SEQ ID NO: 52627 - DNA, 22 bp, Homo sapiens
cttgacactgtcactcaggcca

SEQ ID NO: 52628 - DNA, 22 bp, Homo sapiens
tgaggcaggagaatcaccggaa

SEQ ID NO: 52629 - DNA, 22 bp, Homo sapiens
tcaccagatctctctgtaatgg

SEQ ID NO: 52630 - DNA, 22 bp, Homo sapiens
tcctcagtcacggtagcacatt

SEQ ID NO: 52631 - DNA, 22 bp, Homo sapiens
ctgtccctgagcaactcctgtt

SEQ ID NO: 52632 - DNA, 22 bp, Homo sapiens
ttacaaagtttaaggtggcact

SEQ ID NO: 52633 - DNA, 22 bp, Homo sapiens
cccaggaggtcaaggctgcagt

SEQ ID NO: 52634 - DNA, 22 bp, Homo sapiens
ccaggaggtggagattgcagtg

SEQ ID NO: 52635 - DNA, 22 bp, Homo sapiens
gacagacacaattgatccatga

SEQ ID NO: 52636 - DNA, 22 bp, Homo sapiens
tcactcaggctggagtgcagtg

SEQ ID NO: 52637 - DNA, 22 bp, Homo sapiens
agaaatatgctgattagatgaa

SEQ ID NO: 52638 - DNA, 22 bp, Homo sapiens
acgtgcaggatctggttggcga

SEQ ID NO: 52639 - DNA, 22 bp, Homo sapiens
ctagggtcaggggcctgcgtcg

SEQ ID NO: 52640 - DNA, 22 bp, Homo sapiens
agcctattccaggatgagctca

SEQ ID NO: 52641 - DNA, 22 bp, Homo sapiens
cctcccctcagacagagactgg

SEQ ID NO: 52642 - DNA, 22 bp, Homo sapiens
caggaggattgcttgaggccag

SEQ ID NO: 52643 - DNA, 22 bp, Homo sapiens
acccaggctggagtgcagtgat

SEQ ID NO: 52644 - DNA, 22 bp, Homo sapiens
taggtttaggagtgaaggtgaa

SEQ ID NO: 52645 - DNA, 22 bp, Homo sapiens
gccaccctggacgcactgttcg

SEQ ID NO: 52646 - DNA, 22 bp, Homo sapiens
gatgatcatctgtaaagttaga

SEQ ID NO: 52647 - DNA, 22 bp, Homo sapiens
ccctgctgtgtagcggaggaac

SEQ ID NO: 52648 - DNA, 21 bp, Homo sapiens
aagaggaagcattatggcata

SEQ ID NO: 52649 - DNA, 22 bp, Homo sapiens
ggaggtggaggttgcagtgagc

SEQ ID NO: 52650 - DNA, 22 bp, Homo sapiens
gctaggagtggtgggtcaagga

SEQ ID NO: 52651 - DNA, 22 bp, Homo sapiens
aaagaaatagatggcatttaaa

SEQ ID NO: 52652 - DNA, 22 bp, Homo sapiens
ccagcctggttcagaattggct

SEQ ID NO: 52653 - DNA, 19 bp, Homo sapiens
caggcctcttaccctctct

SEQ ID NO: 52654 - DNA, 22 bp, Homo sapiens
cctgggaggctgaggctgcagt

SEQ ID NO: 52655 - DNA, 22 bp, Homo sapiens
ttgaggcctgctggaaggtgtt

SEQ ID NO: 52656 - DNA, 22 bp, Homo sapiens
tcgcgcccccaagcgtcattgg

SEQ ID NO: 52657 - DNA, 22 bp, Homo sapiens
atcacaaaggtctcagagcaca

SEQ ID NO: 52658 - DNA, 22 bp, Homo sapiens
gagcgattgcgggggtcagagg

SEQ ID NO: 52659 - DNA, 22 bp, Homo sapiens
taggctgggaagaaagattctc

SEQ ID NO: 52660 - DNA, 22 bp, Homo sapiens
acagcccagctctttctctgca

SEQ ID NO: 52661 - DNA, 22 bp, Homo sapiens
aagggggcggcagccagtggaa

SEQ ID NO: 52662 - DNA, 22 bp, Homo sapiens
ggccagaagttggaaaagagcc

SEQ ID NO: 52663 - DNA, 22 bp, Homo sapiens
gtgcccagcagcagcgtccccg

SEQ ID NO: 52664 - DNA, 22 bp, Homo sapiens
aagagggaaattgttggctgct

SEQ ID NO: 52665 - DNA, 22 bp, Homo sapiens
aaagcagaggttgcagtgagct

SEQ ID NO: 52666 - DNA, 22 bp, Homo sapiens
ttagatttacaagcactgttta

SEQ ID NO: 52667 - DNA, 22 bp, Homo sapiens
cagagagaatcttggcagctga

SEQ ID NO: 52668 - DNA, 22 bp, Homo sapiens
caccgcggagtgatggagaaac

SEQ ID NO: 52669 - DNA, 22 bp, Homo sapiens
gcagggaggtttgctgacctgg

SEQ ID NO: 52670 - DNA, 22 bp, Homo sapiens
cacctagggtttcgcctttctt

SEQ ID NO: 52671 - DNA, 22 bp, Homo sapiens
cactgctacctctgcctcccgg

SEQ ID NO: 52672 - DNA, 22 bp, Homo sapiens
cggtctcccgtgtgtgtgcgct

SEQ ID NO: 52673 - DNA, 22 bp, Homo sapiens
tttgtcttatccaatctctcag

SEQ ID NO: 52674 - DNA, 18 bp, Homo sapiens
gatatggaaggccatgcc

SEQ ID NO: 52675 - DNA, 22 bp, Homo sapiens
acccaggctggcgtgcagtggc

SEQ ID NO: 52676 - DNA, 22 bp, Homo sapiens
gatggcacacagacatccccgc

SEQ ID NO: 52677 - DNA, 22 bp, Homo sapiens
attcacatttagcctctgacat

SEQ ID NO: 52678 - DNA, 22 bp, Homo sapiens
tgcgcctctaatctcgggcgtc

SEQ ID NO: 52679 - DNA, 22 bp, Homo sapiens
tgaggcaggtggattacaaggt

SEQ ID NO: 52680 - DNA, 22 bp, Homo sapiens
attgaaaataaggccagaaaca

SEQ ID NO: 52681 - DNA, 22 bp, Homo sapiens
gagcacgttgaagcgcactgtc

SEQ ID NO: 52682 - DNA, 22 bp, Homo sapiens
gtgctggggagataggaagaga

SEQ ID NO: 52683 - DNA, 22 bp, Homo sapiens
gagaaatgcatgcatgtcatca

SEQ ID NO: 52684 - DNA, 22 bp, Homo sapiens
tcagacaactctggaggctggc

SEQ ID NO: 52685 - DNA, 22 bp, Homo sapiens
tttcaggacacctttaaaaacg

SEQ ID NO: 52686 - DNA, 22 bp, Homo sapiens
ctgctccccagcctgcgccttt

SEQ ID NO: 52687 - DNA, 22 bp, Homo sapiens
aactcactttgtggcttctgaa

SEQ ID NO: 52688 - DNA, 22 bp, Homo sapiens
aaaatatgtataactcttctgc

SEQ ID NO: 52689 - DNA, 22 bp, Homo sapiens
tgaggcaggagaatcacatgaa

SEQ ID NO: 52690 - DNA, 22 bp, Homo sapiens
tttgaagactactgggagtgaa

SEQ ID NO: 52691 - DNA, 22 bp, Homo sapiens
ggagaagaggagctggaagcct

SEQ ID NO: 52692 - DNA, 22 bp, Homo sapiens
catggcactgagcaggtatgca

SEQ ID NO: 52693 - DNA, 22 bp, Homo sapiens
ctttggaacacccagctctgtg

SEQ ID NO: 52694 - DNA, 22 bp, Homo sapiens
gcaaacaaggacatacatcctg

SEQ ID NO: 52695 - DNA, 22 bp, Homo sapiens
gagatggagtctttttctgtca

SEQ ID NO: 52696 - DNA, 22 bp, Homo sapiens
ttccgagggctcggcggccgcc

SEQ ID NO: 52697 - DNA, 20 bp, Homo sapiens
aggaaaaatggaaactggag

SEQ ID NO: 52698 - DNA, 22 bp, Homo sapiens
acaagaagtaaaggtcggatgc

SEQ ID NO: 52699 - DNA, 22 bp, Homo sapiens
ggaggacaggggctgcagcaca

SEQ ID NO: 52700 - DNA, 22 bp, Homo sapiens
gcctcctgagtagctgggattg

SEQ ID NO: 52701 - DNA, 22 bp, Homo sapiens
aactctatttaccctactaaac

SEQ ID NO: 52702 - DNA, 22 bp, Homo sapiens
cactgcactccagcctgggcaa

SEQ ID NO: 52703 - DNA, 22 bp, Homo sapiens
gaggcagaagttgcagtgagca

SEQ ID NO: 52704 - DNA, 22 bp, Homo sapiens
cctgagtagctggaattaaagg

SEQ ID NO: 52705 - DNA, 22 bp, Homo sapiens
gagctgggcctgcgagtgctgc

SEQ ID NO: 52706 - DNA, 22 bp, Homo sapiens
ggctcttccgccaccagccaca

SEQ ID NO: 52707 - DNA, 22 bp, Homo sapiens
aacccaggagttggaggctgtg

SEQ ID NO: 52708 - DNA, 22 bp, Homo sapiens
tggagacacaggaccagactgc

SEQ ID NO: 52709 - DNA, 22 bp, Homo sapiens
caggctggagtgcagtggcgcc

SEQ ID NO: 52710 - DNA, 18 bp, Homo sapiens
taggagagaatttattta

SEQ ID NO: 52711 - DNA, 22 bp, Homo sapiens
gggcttggcacatgggctcagc

SEQ ID NO: 52712 - DNA, 22 bp, Homo sapiens
gttactcttccccggggtctgg

SEQ ID NO: 52713 - DNA, 22 bp, Homo sapiens
aagcgccatggttcctgcgcag

SEQ ID NO: 52714 - DNA, 22 bp, Homo sapiens
gcggcggagacagcaggaagcc

SEQ ID NO: 52715 - DNA, 22 bp, Homo sapiens
ttaccaaatgaaatagagattt

SEQ ID NO: 52716 - DNA, 22 bp, Homo sapiens
gagacgtggcctttgcctgagc

SEQ ID NO: 52717 - DNA, 22 bp, Homo sapiens
actgcactccagcctgggtgat

SEQ ID NO: 52718 - DNA, 22 bp, Homo sapiens
gcttctcaattctcaccctcca

SEQ ID NO: 52719 - DNA, 22 bp, Homo sapiens
tcctttgcttctgtcattctcc

SEQ ID NO: 52720 - DNA, 22 bp, Homo sapiens
actttcttggtcccatgtttga

SEQ ID NO: 52721 - DNA, 21 bp, Homo sapiens
ccgccgctgatagctctgggc

SEQ ID NO: 52722 - DNA, 22 bp, Homo sapiens
tcactgcactccagcactcagg

SEQ ID NO: 52723 - DNA, 22 bp, Homo sapiens
tctttcttgtgggtgccctttt

SEQ ID NO: 52724 - DNA, 22 bp, Homo sapiens
tgtgtctttgttccaggtacga

SEQ ID NO: 52725 - DNA, 22 bp, Homo sapiens
ggagttgattttggatatatta

SEQ ID NO: 52726 - DNA, 22 bp, Homo sapiens
gtcagatctttggggatgctgt

SEQ ID NO: 52727 - DNA, 22 bp, Homo sapiens
ctgggaggcggagcttgcagtg

SEQ ID NO: 52728 - DNA, 22 bp, Homo sapiens
cacttcattgggaccagggctg

SEQ ID NO: 52729 - DNA, 17 bp, Homo sapiens
cttcccaccatctcctg

SEQ ID NO: 52730 - DNA, 22 bp, Homo sapiens
tgcccaggctggagtgcagtgg

SEQ ID NO: 52731 - DNA, 22 bp, Homo sapiens
agctcaccacaacctccgcctc

SEQ ID NO: 52732 - DNA, 22 bp, Homo sapiens
gtctttcttaaacaacagaaca

SEQ ID NO: 52733 - DNA, 22 bp, Homo sapiens
aggacttagaacattatgtact

SEQ ID NO: 52734 - DNA, 22 bp, Homo sapiens
aggggctcctttgtgctgcgtc

SEQ ID NO: 52735 - DNA, 22 bp, Homo sapiens
gtgctccctccttcctcaagga

SEQ ID NO: 52736 - DNA, 22 bp, Homo sapiens
tcttgaattgtactcccataag

SEQ ID NO: 52737 - DNA, 22 bp, Homo sapiens
tgactacaacctccacctcccg

SEQ ID NO: 52738 - DNA, 22 bp, Homo sapiens
aaagtaattgcagtttctgcca

SEQ ID NO: 52739 - DNA, 22 bp, Homo sapiens
tgggaggccgaggcaggtggat

SEQ ID NO: 52740 - DNA, 22 bp, Homo sapiens
tttcttcctgctttgtcccatg

SEQ ID NO: 52741 - DNA, 23 bp, Homo sapiens
ggagtgcaatggcgccatctcgg

SEQ ID NO: 52742 - DNA, 22 bp, Homo sapiens
agcaagattgaggcttcctcag

SEQ ID NO: 52743 - DNA, 22 bp, Homo sapiens
aaatactcatcccaggaactgg

SEQ ID NO: 52744 - DNA, 22 bp, Homo sapiens
aggcaaggtgctacagacagtg

SEQ ID NO: 52745 - DNA, 20 bp, Homo sapiens
caaatccctgctctgtgctg

SEQ ID NO: 52746 - DNA, 22 bp, Homo sapiens
catcagaacgtgagctccttgt

SEQ ID NO: 52747 - DNA, 22 bp, Homo sapiens
gggaggctctgctcagcccccg

SEQ ID NO: 52748 - DNA, 22 bp, Homo sapiens
atttggcagtataaattctggc

SEQ ID NO: 52749 - DNA, 22 bp, Homo sapiens
atgagaaagttaatcatcatga

SEQ ID NO: 52750 - DNA, 22 bp, Homo sapiens
aagaatgagctcaaagatctta

SEQ ID NO: 52751 - DNA, 22 bp, Homo sapiens
ttggaagacaatgctgattctc

SEQ ID NO: 52752 - DNA, 22 bp, Homo sapiens
tagaagaaagtgaagctgggga

SEQ ID NO: 52753 - DNA, 22 bp, Homo sapiens
tgccatagcaatggtaagctga

SEQ ID NO: 52754 - DNA, 22 bp, Homo sapiens
gtcttagatttcaccgataatg

SEQ ID NO: 52755 - DNA, 22 bp, Homo sapiens
aaggagtctgggccattcagag

SEQ ID NO: 52756 - DNA, 22 bp, Homo sapiens
tagatgtgttgcctggagttgt

SEQ ID NO: 52757 - DNA, 22 bp, Homo sapiens
cctggtgctgctatcaggggta

SEQ ID NO: 52758 - DNA, 20 bp, Homo sapiens
tatttctgggcaaccattta

SEQ ID NO: 52759 - DNA, 22 bp, Homo sapiens
gcctcctgtcccaggctgagga

SEQ ID NO: 52760 - DNA, 22 bp, Homo sapiens
agcttgacagacagatggtagc

SEQ ID NO: 52761 - DNA, 22 bp, Homo sapiens
ctggcctggcgcagtggctcac

SEQ ID NO: 52762 - DNA, 20 bp, Homo sapiens
tttgagaccagtctgcccaa

SEQ ID NO: 52763 - DNA, 22 bp, Homo sapiens
aaattctgatttaataagtgta

SEQ ID NO: 52764 - DNA, 22 bp, Homo sapiens
aggaaaacagaccaaggagctc

SEQ ID NO: 52765 - DNA, 22 bp, Homo sapiens
gccatcctgatgacaggccact

SEQ ID NO: 52766 - DNA, 22 bp, Homo sapiens
tgaggaaacttacaaggcagaa

SEQ ID NO: 52767 - DNA, 22 bp, Homo sapiens
ctagttgaagaggctgtcatca

SEQ ID NO: 52768 - DNA, 22 bp, Homo sapiens
cggctggtgtcgggcacagcaa

SEQ ID NO: 52769 - DNA, 22 bp, Homo sapiens
tttaatcataagaaggaaaata

SEQ ID NO: 52770 - DNA, 22 bp, Homo sapiens
gctgctctcagagctcatgctg

SEQ ID NO: 52771 - DNA, 22 bp, Homo sapiens
cctccccacagcccaggagact

SEQ ID NO: 52772 - DNA, 21 bp, Homo sapiens
accactgcctccaaggttcag

SEQ ID NO: 52773 - DNA, 22 bp, Homo sapiens
ctgtgggatcccatgactttcc

SEQ ID NO: 52774 - DNA, 22 bp, Homo sapiens
agttatgtcctcagcaaatcaa

SEQ ID NO: 52775 - DNA, 22 bp, Homo sapiens
atgccactgcactccagcctgg

SEQ ID NO: 52776 - DNA, 19 bp, Homo sapiens
catggtgaaaccccgtctc

SEQ ID NO: 52777 - DNA, 22 bp, Homo sapiens
gccttgtttcattacacgtggt

SEQ ID NO: 52778 - DNA, 22 bp, Homo sapiens
aaagggaagttgcacatgttcc

SEQ ID NO: 52779 - DNA, 22 bp, Homo sapiens
ttgcatcagaattacttggagg

SEQ ID NO: 52780 - DNA, 22 bp, Homo sapiens
cttatttgcccatgtttcttta

SEQ ID NO: 52781 - DNA, 22 bp, Homo sapiens
gcggggttccgtgccccagagt

SEQ ID NO: 52782 - DNA, 22 bp, Homo sapiens
atgaattgaggaaaacagtcgt

SEQ ID NO: 52783 - DNA, 22 bp, Homo sapiens
tgtgtgagtaaggctgagagag

SEQ ID NO: 52784 - DNA, 22 bp, Homo sapiens
agggcgacaatggagagcgttt

SEQ ID NO: 52785 - DNA, 22 bp, Homo sapiens
ataaaatttgctactgttaaat

SEQ ID NO: 52786 - DNA, 22 bp, Homo sapiens
tgcgcggctcagtcatctccag

SEQ ID NO: 52787 - DNA, 22 bp, Homo sapiens
tctctcaggctggagtgcagtg

SEQ ID NO: 52788 - DNA, 22 bp, Homo sapiens
catgcacttacctgaaattcaa

SEQ ID NO: 52789 - DNA, 22 bp, Homo sapiens
tggctgtgtccctgtccagagt

SEQ ID NO: 52790 - DNA, 22 bp, Homo sapiens
tgcaatccccgcctcaacagga

SEQ ID NO: 52791 - DNA, 22 bp, Homo sapiens
taggcactgtgtttgtaggagt

SEQ ID NO: 52792 - DNA, 20 bp, Homo sapiens
ctgggtggcaagcaaggggg

SEQ ID NO: 52793 - DNA, 22 bp, Homo sapiens
cttagagatgggttttacttag

SEQ ID NO: 52794 - DNA, 22 bp, Homo sapiens
ggtgctggacacgtggcactcc

SEQ ID NO: 52795 - DNA, 22 bp, Homo sapiens
cttgatctacatagtgaaaccc

SEQ ID NO: 52796 - DNA, 22 bp, Homo sapiens
tcagtgccatgggcagacaggc

SEQ ID NO: 52797 - DNA, 22 bp, Homo sapiens
acatgtttaagtttgttatatg

SEQ ID NO: 52798 - DNA, 23 bp, Homo sapiens
ggttctgccgcttactgctgtgc

SEQ ID NO: 52799 - DNA, 22 bp, Homo sapiens
gggaagtgagctggaatcaagg

SEQ ID NO: 52800 - DNA, 22 bp, Homo sapiens
ggcgccagcactgcagcgcctc

SEQ ID NO: 52801 - DNA, 22 bp, Homo sapiens
ccctgccttgtctgggctaggt

SEQ ID NO: 52802 - DNA, 22 bp, Homo sapiens
ccaggaggttgaggctgcagtg

SEQ ID NO: 52803 - DNA, 22 bp, Homo sapiens
cattcatctatcaaatggtacc

SEQ ID NO: 52804 - DNA, 22 bp, Homo sapiens
gctgctgcttgaaggctcggag

SEQ ID NO: 52805 - DNA, 22 bp, Homo sapiens
ctgagggtcaacttgattgtat

SEQ ID NO: 52806 - DNA, 22 bp, Homo sapiens
accctccccaagaggtcgtgcc

SEQ ID NO: 52807 - DNA, 22 bp, Homo sapiens
cccaggaggcgcaggttgcggt

SEQ ID NO: 52808 - DNA, 22 bp, Homo sapiens
ccaggcaggcgatggtgcagtg

SEQ ID NO: 52809 - DNA, 22 bp, Homo sapiens
tagcaaaggatgactatgtacc

SEQ ID NO: 52810 - DNA, 22 bp, Homo sapiens
tcgtgatctgtccacctcggcc

SEQ ID NO: 52811 - DNA, 22 bp, Homo sapiens
acttgccccagaattgctgctg

SEQ ID NO: 52812 - DNA, 22 bp, Homo sapiens
tttgaagggcacgacaatagtt

SEQ ID NO: 52813 - DNA, 22 bp, Homo sapiens
ctgggtggcagagcctgcagtg

SEQ ID NO: 52814 - DNA, 22 bp, Homo sapiens
ctccacagctgtaaatataggg

SEQ ID NO: 52815 - DNA, 21 bp, Homo sapiens
tggtttatgtgcttagggtct

SEQ ID NO: 52816 - DNA, 22 bp, Homo sapiens
catgtgaattccaaagctaggt

SEQ ID NO: 52817 - DNA, 22 bp, Homo sapiens
tggcccagtatgtataatctta

SEQ ID NO: 52818 - DNA, 22 bp, Homo sapiens
gtgtcaataaatagcggtgtgg

SEQ ID NO: 52819 - DNA, 22 bp, Homo sapiens
ccctctacagggaagcgctttc

SEQ ID NO: 52820 - DNA, 22 bp, Homo sapiens
aggcaggaaaatcgcttgaacc

SEQ ID NO: 52821 - DNA, 22 bp, Homo sapiens
aggctatttccactcttctcat

SEQ ID NO: 52822 - DNA, 22 bp, Homo sapiens
ccctggctgcgtgatggatgaa

SEQ ID NO: 52823 - DNA, 22 bp, Homo sapiens
ctctccattccctacagttttc

SEQ ID NO: 52824 - DNA, 22 bp, Homo sapiens
aggtagaaggaccagaatttat

SEQ ID NO: 52825 - DNA, 22 bp, Homo sapiens
tgtatattctgcctaaaagctt

SEQ ID NO: 52826 - DNA, 22 bp, Homo sapiens
atgctattgaaaagaaataaga

SEQ ID NO: 52827 - DNA, 22 bp, Homo sapiens
gcaggcaggcttccttgaactg

SEQ ID NO: 52828 - DNA, 22 bp, Homo sapiens
catgaaattgtattggcctcaa

SEQ ID NO: 52829 - DNA, 22 bp, Homo sapiens
tgaggcactccaggatgctgtt

SEQ ID NO: 52830 - DNA, 22 bp, Homo sapiens
tgccacagacaggacagaacag

SEQ ID NO: 52831 - DNA, 20 bp, Homo sapiens
ggcagagggcctgggagaag

SEQ ID NO: 52832 - DNA, 22 bp, Homo sapiens
ccaggctgctgttggtgtccgc

SEQ ID NO: 52833 - DNA, 22 bp, Homo sapiens
tacttttagcctatttgattct

SEQ ID NO: 52834 - DNA, 22 bp, Homo sapiens
aagagggctgcaatcttattgc

SEQ ID NO: 52835 - DNA, 22 bp, Homo sapiens
cactccagcctcagtgacagag

SEQ ID NO: 52836 - DNA, 22 bp, Homo sapiens
aggacaaaggaccagatctgga

SEQ ID NO: 52837 - DNA, 22 bp, Homo sapiens
cagtttcttcctcccccagaga

SEQ ID NO: 52838 - DNA, 22 bp, Homo sapiens
ctacaaaagtaattgtggtttt

SEQ ID NO: 52839 - DNA, 22 bp, Homo sapiens
aggagctgtcagagtgccagag

SEQ ID NO: 52840 - DNA, 22 bp, Homo sapiens
gggagctgagctggaagagaat

SEQ ID NO: 52841 - DNA, 22 bp, Homo sapiens
aacccaggagacaggttgcagt

SEQ ID NO: 52842 - DNA, 22 bp, Homo sapiens
gggcggatcacctgaggtcagg

SEQ ID NO: 52843 - DNA, 22 bp, Homo sapiens
tttgttttcaatgtgtcattca

SEQ ID NO: 52844 - DNA, 22 bp, Homo sapiens
gtctctatcatagctgaaccct

SEQ ID NO: 52845 - DNA, 22 bp, Homo sapiens
ggcatcttgttgctcaaatcta

SEQ ID NO: 52846 - DNA, 22 bp, Homo sapiens
tcaaaccagccttgcatcccag

SEQ ID NO: 52847 - DNA, 22 bp, Homo sapiens
ttagggttacaccagcctcctg

SEQ ID NO: 52848 - DNA, 22 bp, Homo sapiens
cccagagcatgtgctgcctttg

SEQ ID NO: 52849 - DNA, 22 bp, Homo sapiens
agagagcccgggccagggcaca

SEQ ID NO: 52850 - DNA, 22 bp, Homo sapiens
cttgcacgtcagatcttcctca

SEQ ID NO: 52851 - DNA, 22 bp, Homo sapiens
aataaaatggtcagttttctca

SEQ ID NO: 52852 - DNA, 22 bp, Homo sapiens
ttgtgaatggtgccgcaataaa

SEQ ID NO: 52853 - DNA, 23 bp, Homo sapiens
tctgtgtctccacccaaatctca

SEQ ID NO: 52854 - DNA, 22 bp, Homo sapiens
ccaggaggtggaggttgcggtg

SEQ ID NO: 52855 - DNA, 22 bp, Homo sapiens
atgctaaggcactaccttctca

SEQ ID NO: 52856 - DNA, 22 bp, Homo sapiens
cttcctttgctgttcggaggtt

SEQ ID NO: 52857 - DNA, 22 bp, Homo sapiens
tgttagtcagacacacctaaat

SEQ ID NO: 52858 - DNA, 22 bp, Homo sapiens
tgatcaggtctgaacagggagg

SEQ ID NO: 52859 - DNA, 22 bp, Homo sapiens
ctgccgtgtttttcatgttaaa

SEQ ID NO: 52860 - DNA, 22 bp, Homo sapiens
gggaacagcttgggctctgcca

SEQ ID NO: 52861 - DNA, 22 bp, Homo sapiens
gaagatgttatggagagctcag

SEQ ID NO: 52862 - DNA, 22 bp, Homo sapiens
tgtattctaaatacatcttacc

SEQ ID NO: 52863 - DNA, 22 bp, Homo sapiens
ggcaatagttgtgggttcttta

SEQ ID NO: 52864 - DNA, 22 bp, Homo sapiens
tttcccagcctcagctcagcag

SEQ ID NO: 52865 - DNA, 22 bp, Homo sapiens
gcaggcattagcccccatggct

SEQ ID NO: 52866 - DNA, 22 bp, Homo sapiens
aatactgcctgtgaggtaactc

SEQ ID NO: 52867 - DNA, 22 bp, Homo sapiens
cccaggaggttgaggctgcagt

SEQ ID NO: 52868 - DNA, 22 bp, Homo sapiens
tttgaaatatgtgtcttttgaa

SEQ ID NO: 52869 - DNA, 22 bp, Homo sapiens
agctcaagctacacacagagtc

SEQ ID NO: 52870 - DNA, 22 bp, Homo sapiens
ggctgccttccctgagccccgg

SEQ ID NO: 52871 - DNA, 21 bp, Homo sapiens
cagaggcctatcacagactcc

SEQ ID NO: 52872 - DNA, 22 bp, Homo sapiens
cagcccaggactgcaggtgttt

SEQ ID NO: 52873 - DNA, 22 bp, Homo sapiens
gagcccaggaagtggaggctga

SEQ ID NO: 52874 - DNA, 21 bp, Homo sapiens
gggcagaggggcctcctgggt

SEQ ID NO: 52875 - DNA, 22 bp, Homo sapiens
cctttcccgctttgagggcaag

SEQ ID NO: 52876 - DNA, 22 bp, Homo sapiens
ccgggagcaggcgccaccgcca

SEQ ID NO: 52877 - DNA, 22 bp, Homo sapiens
gatggcggtcgtcgacggtcct

SEQ ID NO: 52878 - DNA, 22 bp, Homo sapiens
ttgcccagagtcacccagctca

SEQ ID NO: 52879 - DNA, 18 bp, Homo sapiens
tcctttctccctcatctt

SEQ ID NO: 52880 - DNA, 22 bp, Homo sapiens
tctgagctgggtcttgacagct

SEQ ID NO: 52881 - DNA, 22 bp, Homo sapiens
cccagcgagtttgccggtgaac

SEQ ID NO: 52882 - DNA, 22 bp, Homo sapiens
actgcaacctccgcctgccagg

SEQ ID NO: 52883 - DNA, 23 bp, Homo sapiens
cgcccagcctcagtgacctgggc

SEQ ID NO: 52884 - DNA, 22 bp, Homo sapiens
tacaacaatttccacattagaa

SEQ ID NO: 52885 - DNA, 22 bp, Homo sapiens
cagcaggaggtgagtagcaggt

SEQ ID NO: 52886 - DNA, 22 bp, Homo sapiens
tttacacagaggacactgggct

SEQ ID NO: 52887 - DNA, 22 bp, Homo sapiens
ccaggctggagtatagtggcgc

SEQ ID NO: 52888 - DNA, 22 bp, Homo sapiens
actaaagctcacagagttgaac

SEQ ID NO: 52889 - DNA, 22 bp, Homo sapiens
ccacccttgggttcggaggccg

SEQ ID NO: 52890 - DNA, 19 bp, Homo sapiens
tctcacagctctactatgt

SEQ ID NO: 52891 - DNA, 18 bp, Homo sapiens
gtcaggcatgaatctggg

SEQ ID NO: 52892 - DNA, 21 bp, Homo sapiens
aggcttggatctagacaggcc

SEQ ID NO: 52893 - DNA, 22 bp, Homo sapiens
taggtagctttggcgtttcttg

SEQ ID NO: 52894 - DNA, 22 bp, Homo sapiens
cagctgctgttcagttttgttt

SEQ ID NO: 52895 - DNA, 22 bp, Homo sapiens
caggaggacatactggctcaca

SEQ ID NO: 52896 - DNA, 22 bp, Homo sapiens
gactatctgccaggtcccaggg

SEQ ID NO: 52897 - DNA, 22 bp, Homo sapiens
cacgcacgctgggtggaggcgc

SEQ ID NO: 52898 - DNA, 22 bp, Homo sapiens
caattcccagctgccgggctgc

SEQ ID NO: 52899 - DNA, 22 bp, Homo sapiens
gctcaagccttctgcccacctc

SEQ ID NO: 52900 - DNA, 22 bp, Homo sapiens
ggagtgcggtggcaccatctca

SEQ ID NO: 52901 - DNA, 22 bp, Homo sapiens
aggactgggtgcagagggcatc

SEQ ID NO: 52902 - DNA, 22 bp, Homo sapiens
tgcagaaacaagccatcattca

SEQ ID NO: 52903 - DNA, 22 bp, Homo sapiens
tataaagagtctcaaagaagtt

SEQ ID NO: 52904 - DNA, 22 bp, Homo sapiens
gatttagtggcccttggtacac

SEQ ID NO: 52905 - DNA, 22 bp, Homo sapiens
tccagctctgctgtgcgccggt

SEQ ID NO: 52906 - DNA, 22 bp, Homo sapiens
tagctcaaaggttaagtgtgga

SEQ ID NO: 52907 - DNA, 19 bp, Homo sapiens
gcctcatttccacctcccc

SEQ ID NO: 52908 - DNA, 22 bp, Homo sapiens
cagtcctgaatactggacggtg

SEQ ID NO: 52909 - DNA, 22 bp, Homo sapiens
cagcagcagtggctgcagaaca

SEQ ID NO: 52910 - DNA, 22 bp, Homo sapiens
atatattttttgagacagagtc

SEQ ID NO: 52911 - DNA, 22 bp, Homo sapiens
tgatgcaattagattgtaattt

SEQ ID NO: 52912 - DNA, 22 bp, Homo sapiens
aggggatggagctggaaggcag

SEQ ID NO: 52913 - DNA, 22 bp, Homo sapiens
aagcagagaatctgggagcgag

SEQ ID NO: 52914 - DNA, 22 bp, Homo sapiens
gtggcagagccaaggctggagc

SEQ ID NO: 52915 - DNA, 22 bp, Homo sapiens
agccccaaacaccaggattact

SEQ ID NO: 52916 - DNA, 22 bp, Homo sapiens
actgttttctgtaaagggccag

SEQ ID NO: 52917 - DNA, 22 bp, Homo sapiens
gccccagcctcccgagtagctg

SEQ ID NO: 52918 - DNA, 22 bp, Homo sapiens
attcatcagctaatggacattt

SEQ ID NO: 52919 - DNA, 22 bp, Homo sapiens
gttctgagtcctcctttgaagg

SEQ ID NO: 52920 - DNA, 22 bp, Homo sapiens
tccagcagtccatgtgagacac

SEQ ID NO: 52921 - DNA, 22 bp, Homo sapiens
atgagctagaaaaccatgtgga

SEQ ID NO: 52922 - DNA, 22 bp, Homo sapiens
gggctgggattgcttgctgtga

SEQ ID NO: 52923 - DNA, 22 bp, Homo sapiens
acccaggctggagtgcagtggc

SEQ ID NO: 52924 - DNA, 23 bp, Homo sapiens
tctacaaagctgtgtcaggaccc

SEQ ID NO: 52925 - DNA, 22 bp, Homo sapiens
cccagcaggaggaggttgcagt

SEQ ID NO: 52926 - DNA, 22 bp, Homo sapiens
taactgattcctttttgaaaat

SEQ ID NO: 52927 - DNA, 16 bp, Homo sapiens
ccacctgcagctctca

SEQ ID NO: 52928 - DNA, 22 bp, Homo sapiens
gaccttgtgatccacccgcctt

SEQ ID NO: 52929 - DNA, 22 bp, Homo sapiens
gagaggaagccttctgtacttg

SEQ ID NO: 52930 - DNA, 22 bp, Homo sapiens
agtgaaaacctaatcatgcagt

SEQ ID NO: 52931 - DNA, 22 bp, Homo sapiens
tgatattttatgagctttcata

SEQ ID NO: 52932 - DNA, 22 bp, Homo sapiens
ctccatatgttcagttatgcag

SEQ ID NO: 52933 - DNA, 22 bp, Homo sapiens
cagaggaacgtttggattgatt

SEQ ID NO: 52934 - DNA, 22 bp, Homo sapiens
aggctgaggcaagaggatcact

SEQ ID NO: 52935 - DNA, 22 bp, Homo sapiens
ggcatcgtcctgggcataggga

SEQ ID NO: 52936 - DNA, 21 bp, Homo sapiens
ctcccagggtgactgttcaac

SEQ ID NO: 52937 - DNA, 22 bp, Homo sapiens
ggtttattgttaataagtttga

SEQ ID NO: 52938 - DNA, 22 bp, Homo sapiens
gtagtctgaacagtaattttgt

SEQ ID NO: 52939 - DNA, 22 bp, Homo sapiens
tgaggcaggacttgcataaagt

SEQ ID NO: 52940 - DNA, 22 bp, Homo sapiens
aggagcagaccgtagtcctgca

SEQ ID NO: 52941 - DNA, 22 bp, Homo sapiens
ggaactcctgctccaagcagct

SEQ ID NO: 52942 - DNA, 22 bp, Homo sapiens
agccaggatggtctcgatcggc

SEQ ID NO: 52943 - DNA, 22 bp, Homo sapiens
aatggaatacctaggtggccca

SEQ ID NO: 52944 - DNA, 22 bp, Homo sapiens
atggtactggggtcccggagtt

SEQ ID NO: 52945 - DNA, 22 bp, Homo sapiens
acagcagcaatagcagtgacat

SEQ ID NO: 52946 - DNA, 22 bp, Homo sapiens
tcaggaggtccgcccgggaggg

SEQ ID NO: 52947 - DNA, 22 bp, Homo sapiens
tgtaagtagtaatggaaggaca

SEQ ID NO: 52948 - DNA, 22 bp, Homo sapiens
gaggtgggtgtatcacaggtca

SEQ ID NO: 52949 - DNA, 22 bp, Homo sapiens
agcttgtgtttttctaagtatc

SEQ ID NO: 52950 - DNA, 22 bp, Homo sapiens
tctttggtttctgtctctgtaa

SEQ ID NO: 52951 - DNA, 22 bp, Homo sapiens
ttactttaagggtgtcttatta

SEQ ID NO: 52952 - DNA, 21 bp, Homo sapiens
gggcctggctgcgcaggacgg

SEQ ID NO: 52953 - DNA, 22 bp, Homo sapiens
ggtgggagccaacacccttctg

SEQ ID NO: 52954 - DNA, 22 bp, Homo sapiens
actgagctccaagcctggaatc

SEQ ID NO: 52955 - DNA, 22 bp, Homo sapiens
ttgctcagtggcagggctggta

SEQ ID NO: 52956 - DNA, 22 bp, Homo sapiens
agcagcttgaggctggattcca

SEQ ID NO: 52957 - DNA, 22 bp, Homo sapiens
gggaggcagtgctggaggctgg

SEQ ID NO: 52958 - DNA, 22 bp, Homo sapiens
tgtctggtgggttgacaggcag

SEQ ID NO: 52959 - DNA, 22 bp, Homo sapiens
ttgttgtcattgtagaggattt

SEQ ID NO: 52960 - DNA, 22 bp, Homo sapiens
actcttgattgatttagtcttt

SEQ ID NO: 52961 - DNA, 22 bp, Homo sapiens
aacagcgacgtcctccccaaca

SEQ ID NO: 52962 - DNA, 22 bp, Homo sapiens
ggtggcagtagcactgggcctg

SEQ ID NO: 52963 - DNA, 22 bp, Homo sapiens
gcccaggctggagtgcagtggt

SEQ ID NO: 52964 - DNA, 22 bp, Homo sapiens
atcagtgtgtcaaaagcacaaa

SEQ ID NO: 52965 - DNA, 22 bp, Homo sapiens
accatgttggccaagctggtct

SEQ ID NO: 52966 - DNA, 22 bp, Homo sapiens
gcttctggtgaggcctcaggaa

SEQ ID NO: 52967 - DNA, 22 bp, Homo sapiens
gtccgtagtggctgatgctttg

SEQ ID NO: 52968 - DNA, 22 bp, Homo sapiens
aggagggagcttaagccaggca

SEQ ID NO: 52969 - DNA, 22 bp, Homo sapiens
cagccagtgtgaccgaggagga

SEQ ID NO: 52970 - DNA, 22 bp, Homo sapiens
ttatagcagcatgatttatagt

SEQ ID NO: 52971 - DNA, 22 bp, Homo sapiens
actgcacttcagcctgggtgtc

SEQ ID NO: 52972 - DNA, 22 bp, Homo sapiens
gcgctgcgcctcctcttccgca

SEQ ID NO: 52973 - DNA, 22 bp, Homo sapiens
ggtccccccatggtgagcactg

SEQ ID NO: 52974 - DNA, 22 bp, Homo sapiens
caggtgagaggcggtcctgcat

SEQ ID NO: 52975 - DNA, 22 bp, Homo sapiens
tttgaggttagctagcagatca

SEQ ID NO: 52976 - DNA, 19 bp, Homo sapiens
tctgaagaattagagagca

SEQ ID NO: 52977 - DNA, 22 bp, Homo sapiens
tgttggagcccgagtcagggag

SEQ ID NO: 52978 - DNA, 22 bp, Homo sapiens
agcccaggttgaggctgcagtg

SEQ ID NO: 52979 - DNA, 22 bp, Homo sapiens
aagatgcggttgaccatggtgt

SEQ ID NO: 52980 - DNA, 22 bp, Homo sapiens
ctggcagatagtaagtgatcaa

SEQ ID NO: 52981 - DNA, 22 bp, Homo sapiens
tgtgagttattttcaggagttt

SEQ ID NO: 52982 - DNA, 22 bp, Homo sapiens
tagaaaagccccagctggaggg

SEQ ID NO: 52983 - DNA, 22 bp, Homo sapiens
cctgaggatgccagcatgggtg

SEQ ID NO: 52984 - DNA, 21 bp, Homo sapiens
gctcctggtgctgcgtggcgc

SEQ ID NO: 52985 - DNA, 22 bp, Homo sapiens
aggcactgtgcagtcccaagca

SEQ ID NO: 52986 - DNA, 22 bp, Homo sapiens
ttgcttcagagggagacacttt

SEQ ID NO: 52987 - DNA, 22 bp, Homo sapiens
agccactttagataccatctta

SEQ ID NO: 52988 - DNA, 22 bp, Homo sapiens
gaggactgaaacttacaggaaa

SEQ ID NO: 52989 - DNA, 22 bp, Homo sapiens
cccaggatggggctgcagttat

SEQ ID NO: 52990 - DNA, 22 bp, Homo sapiens
tcccccaggctggagtgcagtg

SEQ ID NO: 52991 - DNA, 22 bp, Homo sapiens
gtgggtggacggtgcttttgtt

SEQ ID NO: 52992 - DNA, 22 bp, Homo sapiens
gatctggaatctgaaggctgag

SEQ ID NO: 52993 - DNA, 22 bp, Homo sapiens
aaggagaaatggtagatgtgca

SEQ ID NO: 52994 - DNA, 22 bp, Homo sapiens
ctcagggccaaggatgctgttg

SEQ ID NO: 52995 - DNA, 22 bp, Homo sapiens
gcgagcctctggagtcctctgg

SEQ ID NO: 52996 - DNA, 20 bp, Homo sapiens
tcacatcctctcccaacatg

SEQ ID NO: 52997 - DNA, 22 bp, Homo sapiens
ccacagtctatgcaacaaggtc

SEQ ID NO: 52998 - DNA, 22 bp, Homo sapiens
ggtgacagtggttaaaatttgt

SEQ ID NO: 52999 - DNA, 22 bp, Homo sapiens
ccttttgctctcccatccagaa

SEQ ID NO: 53000 - DNA, 22 bp, Homo sapiens
ctcaggagttggaggctacagt

SEQ ID NO: 53001 - DNA, 22 bp, Homo sapiens
tctcatctgccatttgcaggag

SEQ ID NO: 53002 - DNA, 22 bp, Homo sapiens
ggaggctgaggcaggcggatca

SEQ ID NO: 53003 - DNA, 22 bp, Homo sapiens
gggcaccttgggtctcaggcaa

SEQ ID NO: 53004 - DNA, 21 bp, Homo sapiens
ttagaagctaatgcagctggt

SEQ ID NO: 53005 - DNA, 23 bp, Homo sapiens
gtctctagagtgtggagcaaaga

SEQ ID NO: 53006 - DNA, 22 bp, Homo sapiens
ggggtgggcgtgcagggacacc

SEQ ID NO: 53007 - DNA, 22 bp, Homo sapiens
ctccagattccgtttattcagg

SEQ ID NO: 53008 - DNA, 22 bp, Homo sapiens
gaatttcctctaaacccctgag

SEQ ID NO: 53009 - DNA, 22 bp, Homo sapiens
actttatttcctattgcatcca

SEQ ID NO: 53010 - DNA, 22 bp, Homo sapiens
aaagctgtcaaggcaggaggct

SEQ ID NO: 53011 - DNA, 22 bp, Homo sapiens
cttctggcgttggaggtctgag

SEQ ID NO: 53012 - DNA, 18 bp, Homo sapiens
tcttccaacactgacacc

SEQ ID NO: 53013 - DNA, 22 bp, Homo sapiens
ggcagagcttgcagtgagccga

SEQ ID NO: 53014 - DNA, 22 bp, Homo sapiens
gtgggccagcttttctcctggg

SEQ ID NO: 53015 - DNA, 22 bp, Homo sapiens
gctgtctgtcttcacatctcgc

SEQ ID NO: 53016 - DNA, 22 bp, Homo sapiens
agatgcagtggttaacaataca

SEQ ID NO: 53017 - DNA, 21 bp, Homo sapiens
tctgccagctgaagaggtgga

SEQ ID NO: 53018 - DNA, 22 bp, Homo sapiens
agtgtattctgcatgggagact

SEQ ID NO: 53019 - DNA, 22 bp, Homo sapiens
cccaggaggcagagatagcagt

SEQ ID NO: 53020 - DNA, 22 bp, Homo sapiens
ctgcagggagaggggacagcct

SEQ ID NO: 53021 - DNA, 22 bp, Homo sapiens
gggaggcacgaggcgcgcagtg

SEQ ID NO: 53022 - DNA, 22 bp, Homo sapiens
ccattgtaaattctgtggaagt

SEQ ID NO: 53023 - DNA, 22 bp, Homo sapiens
atttcagtattatacaactgct

SEQ ID NO: 53024 - DNA, 22 bp, Homo sapiens
agcgaggtgagtcctccagctc

SEQ ID NO: 53025 - DNA, 22 bp, Homo sapiens
gtttctctgtctgttacattgg

SEQ ID NO: 53026 - DNA, 22 bp, Homo sapiens
caggccagggttgagaagagaa

SEQ ID NO: 53027 - DNA, 22 bp, Homo sapiens
ggcaagaacctcaattaccttt

SEQ ID NO: 53028 - DNA, 22 bp, Homo sapiens
agctacagtcggaaggacagac

SEQ ID NO: 53029 - DNA, 22 bp, Homo sapiens
atgaaatatcttgaagaaattc

SEQ ID NO: 53030 - DNA, 18 bp, Homo sapiens
actctgcggaggccccag

SEQ ID NO: 53031 - DNA, 22 bp, Homo sapiens
tgtctttgttattgtggacagg

SEQ ID NO: 53032 - DNA, 20 bp, Homo sapiens
cagtgcattgcttctgattt

SEQ ID NO: 53033 - DNA, 22 bp, Homo sapiens
gggttgaggcggatgtcggcgg

SEQ ID NO: 53034 - DNA, 22 bp, Homo sapiens
gtggcccaggttggagtgcagt

SEQ ID NO: 53035 - DNA, 22 bp, Homo sapiens
agagaggtctcaggagaaacca

SEQ ID NO: 53036 - DNA, 22 bp, Homo sapiens
ttccagctaactcacatccctt

SEQ ID NO: 53037 - DNA, 22 bp, Homo sapiens
cttgtgcttttatgaatgcaga

SEQ ID NO: 53038 - DNA, 22 bp, Homo sapiens
ggcatggacgtctctgaggcca

SEQ ID NO: 53039 - DNA, 22 bp, Homo sapiens
gtagcccacctggggagggcga

SEQ ID NO: 53040 - DNA, 22 bp, Homo sapiens
ctggcaagaaatatatatctta

SEQ ID NO: 53041 - DNA, 22 bp, Homo sapiens
taactctgaatcctcacagcag

SEQ ID NO: 53042 - DNA, 22 bp, Homo sapiens
tcaggcagtagaattgcttgaa

SEQ ID NO: 53043 - DNA, 22 bp, Homo sapiens
cactgcactccagcctgggtga

SEQ ID NO: 53044 - DNA, 22 bp, Homo sapiens
tgagatggagccactgcactct

SEQ ID NO: 53045 - DNA, 22 bp, Homo sapiens
catggggcccatgtgctccaag

SEQ ID NO: 53046 - DNA, 22 bp, Homo sapiens
tttagcgtagctgacagctaat

SEQ ID NO: 53047 - DNA, 22 bp, Homo sapiens
ggaagaaaggtggacaacaggt

SEQ ID NO: 53048 - DNA, 22 bp, Homo sapiens
cccaggccctggcagagcttgt

SEQ ID NO: 53049 - DNA, 22 bp, Homo sapiens
aaaggctttaaaatgtacatat

SEQ ID NO: 53050 - DNA, 22 bp, Homo sapiens
tccgggcaactgaagggaggtt

SEQ ID NO: 53051 - DNA, 22 bp, Homo sapiens
caggtgcctcaggatgagacaa

SEQ ID NO: 53052 - DNA, 22 bp, Homo sapiens
catggcattgcataacggggct

SEQ ID NO: 53053 - DNA, 19 bp, Homo sapiens
gagaaagcaggcacagcac

SEQ ID NO: 53054 - DNA, 22 bp, Homo sapiens
aggccagcctcaggcagggacc

SEQ ID NO: 53055 - DNA, 23 bp, Homo sapiens
gcctgggagttgcgatctgcccg

SEQ ID NO: 53056 - DNA, 20 bp, Homo sapiens
tggcctctgagatgccacgg

SEQ ID NO: 53057 - DNA, 22 bp, Homo sapiens
tgtctattaattccacataaaa

SEQ ID NO: 53058 - DNA, 22 bp, Homo sapiens
atacaaaaattagccgggagta

SEQ ID NO: 53059 - DNA, 22 bp, Homo sapiens
tctgctggaaaaccagggaatt

SEQ ID NO: 53060 - DNA, 22 bp, Homo sapiens
ttcacagcttaataaggctcag

SEQ ID NO: 53061 - DNA, 22 bp, Homo sapiens
acaccatactcatgttggttcc

SEQ ID NO: 53062 - DNA, 22 bp, Homo sapiens
tagatctgatacaattcatctg

SEQ ID NO: 53063 - DNA, 22 bp, Homo sapiens
ggccagcctggggctcccagac

SEQ ID NO: 53064 - DNA, 22 bp, Homo sapiens
tttggaggggaagaccttggag

SEQ ID NO: 53065 - DNA, 22 bp, Homo sapiens
gggtccctggaattacttgaca

SEQ ID NO: 53066 - DNA, 22 bp, Homo sapiens
ccagagtcccttgcagctcagt

SEQ ID NO: 53067 - DNA, 23 bp, Homo sapiens
ggctgggagctccgggtgcacgt

SEQ ID NO: 53068 - DNA, 22 bp, Homo sapiens
tggctcatgcctgtaatcttag

SEQ ID NO: 53069 - DNA, 22 bp, Homo sapiens
agcagctttcacctccccgcct

SEQ ID NO: 53070 - DNA, 19 bp, Homo sapiens
gcctatgtcttcaaatcat

SEQ ID NO: 53071 - DNA, 22 bp, Homo sapiens
ccaggaggcggaaggtacagtg

SEQ ID NO: 53072 - DNA, 22 bp, Homo sapiens
ttccatttggcacttcactgag

SEQ ID NO: 53073 - DNA, 22 bp, Homo sapiens
tttgctattgtgaatagtgcca

SEQ ID NO: 53074 - DNA, 20 bp, Homo sapiens
ataaaataactgccacaaga

SEQ ID NO: 53075 - DNA, 18 bp, Homo sapiens
gcagctagccaggggggc

SEQ ID NO: 53076 - DNA, 22 bp, Homo sapiens
ggatgtcgaggatggggtagca

SEQ ID NO: 53077 - DNA, 22 bp, Homo sapiens
ataaaagatcccttctgagctc

SEQ ID NO: 53078 - DNA, 22 bp, Homo sapiens
ttctcaaagtgtgctccctgga

SEQ ID NO: 53079 - DNA, 22 bp, Homo sapiens
gagcccgagcgcgtacccggcg

SEQ ID NO: 53080 - DNA, 22 bp, Homo sapiens
agctggaattacaggagcccat

SEQ ID NO: 53081 - DNA, 22 bp, Homo sapiens
gcagggcacaaggacgcacagg

SEQ ID NO: 53082 - DNA, 22 bp, Homo sapiens
gtgaagttggccagtttagttt

SEQ ID NO: 53083 - DNA, 22 bp, Homo sapiens
tggaaagaaagtaaaggcgtat

SEQ ID NO: 53084 - DNA, 22 bp, Homo sapiens
tgggcagggagctggaaccaca

SEQ ID NO: 53085 - DNA, 22 bp, Homo sapiens
aggaaataagggacaagacaaa

SEQ ID NO: 53086 - DNA, 19 bp, Homo sapiens
gttttgcaggcagagggga

SEQ ID NO: 53087 - DNA, 22 bp, Homo sapiens
cttggggaagccactgatccct

SEQ ID NO: 53088 - DNA, 22 bp, Homo sapiens
ctggaaggcggaggttgtagtg

SEQ ID NO: 53089 - DNA, 22 bp, Homo sapiens
cacaaccatgcacagctaattt

SEQ ID NO: 53090 - DNA, 22 bp, Homo sapiens
tctctatttgcctaggcttgtg

SEQ ID NO: 53091 - DNA, 22 bp, Homo sapiens
gaggctgaggcggatggatcac

SEQ ID NO: 53092 - DNA, 22 bp, Homo sapiens
tccttgtaaaggagctctaaca

SEQ ID NO: 53093 - DNA, 22 bp, Homo sapiens
gtagtcccagctaccccggagg

SEQ ID NO: 53094 - DNA, 22 bp, Homo sapiens
gtctttatttgagattgtcatt

SEQ ID NO: 53095 - DNA, 22 bp, Homo sapiens
ctgccaggattctgtgaacccc

SEQ ID NO: 53096 - DNA, 22 bp, Homo sapiens
gcagtatctatgtgatgggttg

SEQ ID NO: 53097 - DNA, 22 bp, Homo sapiens
caattttcaattccttcagata

SEQ ID NO: 53098 - DNA, 22 bp, Homo sapiens
agcttgtgctggaattacatgt

SEQ ID NO: 53099 - DNA, 22 bp, Homo sapiens
caggctggagtgcaatgacgcc

SEQ ID NO: 53100 - DNA, 22 bp, Homo sapiens
cagggtttcaccatgttagcag

SEQ ID NO: 53101 - DNA, 22 bp, Homo sapiens
taaatgttgtaagtacatctaa

SEQ ID NO: 53102 - DNA, 22 bp, Homo sapiens
tgacagaggagctggaatgatt

SEQ ID NO: 53103 - DNA, 22 bp, Homo sapiens
gtggcatctcagaggccaagaa

SEQ ID NO: 53104 - DNA, 22 bp, Homo sapiens
cacccaggctggagagcagtgg

SEQ ID NO: 53105 - DNA, 22 bp, Homo sapiens
agggaaattaatgtgagcaatg

SEQ ID NO: 53106 - DNA, 17 bp, Homo sapiens
tggctctgtcctcagct

SEQ ID NO: 53107 - DNA, 22 bp, Homo sapiens
taaatacttagttttgtgtcta

SEQ ID NO: 53108 - DNA, 22 bp, Homo sapiens
tgaatgtgatgctaaacatatg

SEQ ID NO: 53109 - DNA, 21 bp, Homo sapiens
gcccacagtgaggaggatccc

SEQ ID NO: 53110 - DNA, 22 bp, Homo sapiens
tgccgctccaggtctcgcggtg

SEQ ID NO: 53111 - DNA, 22 bp, Homo sapiens
gcacagagagggaaggtaactt

SEQ ID NO: 53112 - DNA, 22 bp, Homo sapiens
tttctcttcactgtgtgcctca

SEQ ID NO: 53113 - DNA, 22 bp, Homo sapiens
gacaattgcttttgccgaataa

SEQ ID NO: 53114 - DNA, 22 bp, Homo sapiens
tcagttacttgcttgtttgaaa

SEQ ID NO: 53115 - DNA, 22 bp, Homo sapiens
gctggcagacttcctctggaac

SEQ ID NO: 53116 - DNA, 19 bp, Homo sapiens
accttctgggaaacattcc

SEQ ID NO: 53117 - DNA, 22 bp, Homo sapiens
agccacatggacctgatgctag

SEQ ID NO: 53118 - DNA, 22 bp, Homo sapiens
tgggaagggtcaacagctggaa

SEQ ID NO: 53119 - DNA, 17 bp, Homo sapiens
tgcatgtcctttgttcc

SEQ ID NO: 53120 - DNA, 22 bp, Homo sapiens
cactgcactccagcctgggaga

SEQ ID NO: 53121 - DNA, 22 bp, Homo sapiens
ggaaactagaagaatactagtc

SEQ ID NO: 53122 - DNA, 22 bp, Homo sapiens
ggcaaaaaccataattactttt

SEQ ID NO: 53123 - DNA, 22 bp, Homo sapiens
ttactcgtgacaatgtccttga

SEQ ID NO: 53124 - DNA, 22 bp, Homo sapiens
actcctacatattagcattaac

SEQ ID NO: 53125 - DNA, 22 bp, Homo sapiens
tgagcaggcgcagcaggaggtc

SEQ ID NO: 53126 - DNA, 22 bp, Homo sapiens
ctcctggaggatagtgactggg

SEQ ID NO: 53127 - DNA, 22 bp, Homo sapiens
aactatgttaataagtttcatt

SEQ ID NO: 53128 - DNA, 22 bp, Homo sapiens
ttcattcttttacatgtgaata

SEQ ID NO: 53129 - DNA, 22 bp, Homo sapiens
gaaaggagagggttaaggagct

SEQ ID NO: 53130 - DNA, 22 bp, Homo sapiens
gaggctggacgtgcatttctac

SEQ ID NO: 53131 - DNA, 22 bp, Homo sapiens
caggcaggtcagtgaagaagga

SEQ ID NO: 53132 - DNA, 22 bp, Homo sapiens
cactgcaagctctgccacctgg

SEQ ID NO: 53133 - DNA, 22 bp, Homo sapiens
ggctgggcaggtctgcacaggg

SEQ ID NO: 53134 - DNA, 22 bp, Homo sapiens
cactgcactccatcctgggaaa

SEQ ID NO: 53135 - DNA, 22 bp, Homo sapiens
gtcagtgtcttaacagagatta

SEQ ID NO: 53136 - DNA, 22 bp, Homo sapiens
ccaattttattcttctgcaagt

SEQ ID NO: 53137 - DNA, 22 bp, Homo sapiens
tagggggctttgctgcttgaca

SEQ ID NO: 53138 - DNA, 22 bp, Homo sapiens
agcaacccgtccttgggggact

SEQ ID NO: 53139 - DNA, 22 bp, Homo sapiens
ggaactgaatgtctcggtataa

SEQ ID NO: 53140 - DNA, 22 bp, Homo sapiens
gctgctgggatcctgggtctca

SEQ ID NO: 53141 - DNA, 22 bp, Homo sapiens
ttatttgtggcatatgagacga

SEQ ID NO: 53142 - DNA, 22 bp, Homo sapiens
gtctgctcatgctaccgcgggc

SEQ ID NO: 53143 - DNA, 22 bp, Homo sapiens
gctgggttttcttccgggccta

SEQ ID NO: 53144 - DNA, 22 bp, Homo sapiens
tgtgcctactgatagagccaag

SEQ ID NO: 53145 - DNA, 22 bp, Homo sapiens
acctcctggcctcaagcaatcc

SEQ ID NO: 53146 - DNA, 22 bp, Homo sapiens
agggcagagctgtctaaatggc

SEQ ID NO: 53147 - DNA, 22 bp, Homo sapiens
gaaccattgttgaaaagaatag

SEQ ID NO: 53148 - DNA, 22 bp, Homo sapiens
tctgaggctgaatggactccgt

SEQ ID NO: 53149 - DNA, 22 bp, Homo sapiens
tgtggctctcatgcactcccag

SEQ ID NO: 53150 - DNA, 22 bp, Homo sapiens
aaggtggaggttgcagtgagct

SEQ ID NO: 53151 - DNA, 22 bp, Homo sapiens
ctgaggcaggatggcctggctg

SEQ ID NO: 53152 - DNA, 22 bp, Homo sapiens
ctagttctagatccctgaggaa

SEQ ID NO: 53153 - DNA, 22 bp, Homo sapiens
caggctggagtgcagtggcgct

SEQ ID NO: 53154 - DNA, 22 bp, Homo sapiens
ttatgatttgccacagattggt

SEQ ID NO: 53155 - DNA, 22 bp, Homo sapiens
gcaggagaacaaagcaagctgc

SEQ ID NO: 53156 - DNA, 22 bp, Homo sapiens
gccctgccctctcggcactcgc

SEQ ID NO: 53157 - DNA, 22 bp, Homo sapiens
cccagggaggcccaggctctgc

SEQ ID NO: 53158 - DNA, 22 bp, Homo sapiens
ggtcgctgtgtaggttcagcta

SEQ ID NO: 53159 - DNA, 22 bp, Homo sapiens
gtgggggctggaaatcttgcca

SEQ ID NO: 53160 - DNA, 22 bp, Homo sapiens
aggacgctctcgctgaacttct

SEQ ID NO: 53161 - DNA, 22 bp, Homo sapiens
aaattgcaaaagtacttttagg

SEQ ID NO: 53162 - DNA, 19 bp, Homo sapiens
ggctgccttctgctcatct

SEQ ID NO: 53163 - DNA, 22 bp, Homo sapiens
tcaccggcagacgtggcctgat

SEQ ID NO: 53164 - DNA, 22 bp, Homo sapiens
ttgcaattgctatggagagcgt

SEQ ID NO: 53165 - DNA, 22 bp, Homo sapiens
tgtggtgccgagagtctggacg

SEQ ID NO: 53166 - DNA, 22 bp, Homo sapiens
cacttgttggtggtgaaatcac

SEQ ID NO: 53167 - DNA, 22 bp, Homo sapiens
cacatgaaggctggggtcgtga

SEQ ID NO: 53168 - DNA, 22 bp, Homo sapiens
caggcactgtgctgagctctgc

SEQ ID NO: 53169 - DNA, 22 bp, Homo sapiens
tgtcaccttgctcatcctcgga

SEQ ID NO: 53170 - DNA, 22 bp, Homo sapiens
tggagaattctatgttgagggg

SEQ ID NO: 53171 - DNA, 22 bp, Homo sapiens
cgtgagcaaaatggacactccc

SEQ ID NO: 53172 - DNA, 22 bp, Homo sapiens
cactgcaacctccacctcctgg

SEQ ID NO: 53173 - DNA, 22 bp, Homo sapiens
aagtggcagttcaggaagcaga

SEQ ID NO: 53174 - DNA, 22 bp, Homo sapiens
ccagggtggcgtagatgctggg

SEQ ID NO: 53175 - DNA, 22 bp, Homo sapiens
cccaggagttggaggctgcagt

SEQ ID NO: 53176 - DNA, 22 bp, Homo sapiens
accctgctttatgccgtcctct

SEQ ID NO: 53177 - DNA, 22 bp, Homo sapiens
gcgagggcacgcggttgaaggc

SEQ ID NO: 53178 - DNA, 22 bp, Homo sapiens
actgcactccagcctgggtgac

SEQ ID NO: 53179 - DNA, 22 bp, Homo sapiens
gaccttgtgctccgaggcgggc

SEQ ID NO: 53180 - DNA, 22 bp, Homo sapiens
cgggaaggtggaggttgcagtg

SEQ ID NO: 53181 - DNA, 22 bp, Homo sapiens
ctgcgtgagcgtgcccgtcttg

SEQ ID NO: 53182 - DNA, 20 bp, Homo sapiens
aaaatatgtataactcttct

SEQ ID NO: 53183 - DNA, 22 bp, Homo sapiens
cctttcctgtgtccttttaagg

SEQ ID NO: 53184 - DNA, 22 bp, Homo sapiens
agaccactaaaactttctctat

SEQ ID NO: 53185 - DNA, 22 bp, Homo sapiens
gaaagagaacctgggcctagat

SEQ ID NO: 53186 - DNA, 22 bp, Homo sapiens
atgctatgtaactggcagatag

SEQ ID NO: 53187 - DNA, 22 bp, Homo sapiens
gaggggctgccctggtgtcagg

SEQ ID NO: 53188 - DNA, 22 bp, Homo sapiens
tggaaacacccacgcatgcata

SEQ ID NO: 53189 - DNA, 22 bp, Homo sapiens
ggtgttgcagttgaagactggt

SEQ ID NO: 53190 - DNA, 22 bp, Homo sapiens
agcccaggtccagttcactgca

SEQ ID NO: 53191 - DNA, 22 bp, Homo sapiens
gccactgtggtcctcccatgat

SEQ ID NO: 53192 - DNA, 22 bp, Homo sapiens
ggccctgggccctctagcttgt

SEQ ID NO: 53193 - DNA, 16 bp, Homo sapiens
atgctgctattagagg

SEQ ID NO: 53194 - DNA, 22 bp, Homo sapiens
atcaaatacaaagggcataagg

SEQ ID NO: 53195 - DNA, 22 bp, Homo sapiens
cggagtcttgctatgttgccca

SEQ ID NO: 53196 - DNA, 22 bp, Homo sapiens
gaggcaaagcatgtggctcagg

SEQ ID NO: 53197 - DNA, 22 bp, Homo sapiens
gcaggctgtctaaagttagagt

SEQ ID NO: 53198 - DNA, 22 bp, Homo sapiens
cccaggaggtcgaagctgcagt

SEQ ID NO: 53199 - DNA, 22 bp, Homo sapiens
gctcaagacccctctgtgactg

SEQ ID NO: 53200 - DNA, 22 bp, Homo sapiens
acccaggccattggcaagagtc

SEQ ID NO: 53201 - DNA, 21 bp, Homo sapiens
aggagcattgttgtggtggag

SEQ ID NO: 53202 - DNA, 22 bp, Homo sapiens
tgggaacagaggacttgactgt

SEQ ID NO: 53203 - DNA, 22 bp, Homo sapiens
gcttggaagtaggattgggaga

SEQ ID NO: 53204 - DNA, 22 bp, Homo sapiens
cagctacaaatacttttgtatg

SEQ ID NO: 53205 - DNA, 22 bp, Homo sapiens
tgtgcgtcctgtgcgcacactg

SEQ ID NO: 53206 - DNA, 22 bp, Homo sapiens
ctcttcctagtgtgcagcgtgg

SEQ ID NO: 53207 - DNA, 22 bp, Homo sapiens
tccccagcttgctacttctgct

SEQ ID NO: 53208 - DNA, 22 bp, Homo sapiens
ccttgctcaagctagtgacggg

SEQ ID NO: 53209 - DNA, 22 bp, Homo sapiens
tgtggttttggttcagaaacaa

SEQ ID NO: 53210 - DNA, 22 bp, Homo sapiens
caggctgctgcctagaatgaca

SEQ ID NO: 53211 - DNA, 22 bp, Homo sapiens
gagagcaggaggcagcgggacg

SEQ ID NO: 53212 - DNA, 23 bp, Homo sapiens
gcagaggagcaagctggacacca

SEQ ID NO: 53213 - DNA, 22 bp, Homo sapiens
ttctcatgaaactcgcttcctc

SEQ ID NO: 53214 - DNA, 18 bp, Homo sapiens
acgtgctgtgccttttgc

SEQ ID NO: 53215 - DNA, 22 bp, Homo sapiens
cccagttttctgattgaagagc

SEQ ID NO: 53216 - DNA, 22 bp, Homo sapiens
tgcagtcttccagctgcacaaa

SEQ ID NO: 53217 - DNA, 22 bp, Homo sapiens
tgggaggccaaggcaggcggat

SEQ ID NO: 53218 - DNA, 22 bp, Homo sapiens
tttaggttttttcacgtggcta

SEQ ID NO: 53219 - DNA, 22 bp, Homo sapiens
caaagggaaaagccatgtgggc

SEQ ID NO: 53220 - DNA, 22 bp, Homo sapiens
tttggaaattttcatccagaca

SEQ ID NO: 53221 - DNA, 22 bp, Homo sapiens
gctttggacaataactgctttt

SEQ ID NO: 53222 - DNA, 22 bp, Homo sapiens
atattgttagtaatatttcgaa

SEQ ID NO: 53223 - DNA, 22 bp, Homo sapiens
gatttttatataaagtgagaaa

SEQ ID NO: 53224 - DNA, 22 bp, Homo sapiens
catgagatttgggaggggccag

SEQ ID NO: 53225 - DNA, 22 bp, Homo sapiens
attggtagttttgtatttctct

SEQ ID NO: 53226 - DNA, 22 bp, Homo sapiens
gccgggaccaaggccacggagc

SEQ ID NO: 53227 - DNA, 22 bp, Homo sapiens
ttgggacagctgtggtagtgag

SEQ ID NO: 53228 - DNA, 22 bp, Homo sapiens
tcctgggacaagccgtggaagt

SEQ ID NO: 53229 - DNA, 22 bp, Homo sapiens
atttacaggtagaattttaagt

SEQ ID NO: 53230 - DNA, 22 bp, Homo sapiens
tgtgacagcacggttcaactgc

SEQ ID NO: 53231 - DNA, 22 bp, Homo sapiens
gcacatccaatgattgttttga

SEQ ID NO: 53232 - DNA, 22 bp, Homo sapiens
atgatggctaggctggttttga

SEQ ID NO: 53233 - DNA, 22 bp, Homo sapiens
aatgtgagccaatgcccgtggg

SEQ ID NO: 53234 - DNA, 22 bp, Homo sapiens
gagggagggactagcattctct

SEQ ID NO: 53235 - DNA, 21 bp, Homo sapiens
ccgtgctcggctatggaccac

SEQ ID NO: 53236 - DNA, 22 bp, Homo sapiens
tacaaaaaattgatactgacga

SEQ ID NO: 53237 - DNA, 22 bp, Homo sapiens
tcaatgtgaattaagaatactt

SEQ ID NO: 53238 - DNA, 22 bp, Homo sapiens
tgtagatatagaaaaagactga

SEQ ID NO: 53239 - DNA, 22 bp, Homo sapiens
gtcttgatctcctgaccttgtg

SEQ ID NO: 53240 - DNA, 22 bp, Homo sapiens
cacagggcttctcatggggtgc

SEQ ID NO: 53241 - DNA, 22 bp, Homo sapiens
ccaggaggcggaggttgcagcg

SEQ ID NO: 53242 - DNA, 22 bp, Homo sapiens
actgagcaggagaatcacttta

SEQ ID NO: 53243 - DNA, 22 bp, Homo sapiens
agaaaatttaaagagacacaca

SEQ ID NO: 53244 - DNA, 22 bp, Homo sapiens
gacctccgtgtacacctcccag

SEQ ID NO: 53245 - DNA, 22 bp, Homo sapiens
gttgggttaaccaggatgtcaa

SEQ ID NO: 53246 - DNA, 22 bp, Homo sapiens
gaagggaactgggtctccttgt

SEQ ID NO: 53247 - DNA, 22 bp, Homo sapiens
agcgccactgcactccagcctg

SEQ ID NO: 53248 - DNA, 22 bp, Homo sapiens
gaggtgggcggatcacaaggtc

SEQ ID NO: 53249 - DNA, 23 bp, Homo sapiens
aaataggagtatctggatcatga

SEQ ID NO: 53250 - DNA, 22 bp, Homo sapiens
agaaaacataggagacaggaaa

SEQ ID NO: 53251 - DNA, 22 bp, Homo sapiens
aacactctctgttggtaaggct

SEQ ID NO: 53252 - DNA, 22 bp, Homo sapiens
agcgagtgggtcagcgttgcag

SEQ ID NO: 53253 - DNA, 22 bp, Homo sapiens
tctctagtctcctttaacctga

SEQ ID NO: 53254 - DNA, 22 bp, Homo sapiens
aattttctggtgtgtaatgaag

SEQ ID NO: 53255 - DNA, 22 bp, Homo sapiens
agccagtgcagctggaaattca

SEQ ID NO: 53256 - DNA, 22 bp, Homo sapiens
tgggaaggggagctggaaagga

SEQ ID NO: 53257 - DNA, 22 bp, Homo sapiens
tcccgtcttgctgttgtctgcg

SEQ ID NO: 53258 - DNA, 22 bp, Homo sapiens
gatggaggagatggcagggtgc

SEQ ID NO: 53259 - DNA, 22 bp, Homo sapiens
gccaatgacagtctcagttctg

SEQ ID NO: 53260 - DNA, 22 bp, Homo sapiens
tagcacagcttcttgatgtcac

SEQ ID NO: 53261 - DNA, 22 bp, Homo sapiens
cttctacacgtggctgtgccaa

SEQ ID NO: 53262 - DNA, 22 bp, Homo sapiens
tagcagcatttttgtagagtat

SEQ ID NO: 53263 - DNA, 19 bp, Homo sapiens
ttttggaaatgtgaacagc

SEQ ID NO: 53264 - DNA, 22 bp, Homo sapiens
cctggctctgccacttactgcc

SEQ ID NO: 53265 - DNA, 22 bp, Homo sapiens
gagcctggagctggaacgaagc

SEQ ID NO: 53266 - DNA, 22 bp, Homo sapiens
atttttctctttccactgagat

SEQ ID NO: 53267 - DNA, 22 bp, Homo sapiens
tctggcttcgcagctcccagcc

SEQ ID NO: 53268 - DNA, 22 bp, Homo sapiens
ggaggctgagaggtcgcagtgg

SEQ ID NO: 53269 - DNA, 21 bp, Homo sapiens
accctgctttatgccgtcctc

SEQ ID NO: 53270 - DNA, 22 bp, Homo sapiens
tagtttcatctccaccctgccc

SEQ ID NO: 53271 - DNA, 21 bp, Homo sapiens
tctgatggtagatgagatgtg

SEQ ID NO: 53272 - DNA, 22 bp, Homo sapiens
cccttggggtggaggttgcagt

SEQ ID NO: 53273 - DNA, 22 bp, Homo sapiens
gctgcagggagctggaaggctc

SEQ ID NO: 53274 - DNA, 22 bp, Homo sapiens
atgccactgcgctctagcctgg

SEQ ID NO: 53275 - DNA, 22 bp, Homo sapiens
tctgcatattgttaatggaatg

SEQ ID NO: 53276 - DNA, 22 bp, Homo sapiens
ggtgacgaatccatagcatcga

SEQ ID NO: 53277 - DNA, 22 bp, Homo sapiens
ctggcccaggtggtcgttgagg

SEQ ID NO: 53278 - DNA, 22 bp, Homo sapiens
acctagaatttaaaacattgct

SEQ ID NO: 53279 - DNA, 22 bp, Homo sapiens
ttactggctgggcctgagggct

SEQ ID NO: 53280 - DNA, 22 bp, Homo sapiens
atgccactgcgctccagcctgg

SEQ ID NO: 53281 - DNA, 22 bp, Homo sapiens
agggtgaatctcacaactctta

SEQ ID NO: 53282 - DNA, 22 bp, Homo sapiens
agccagggacgctgcaggctac

SEQ ID NO: 53283 - DNA, 22 bp, Homo sapiens
ttgtggttaaccgcacattttt

SEQ ID NO: 53284 - DNA, 22 bp, Homo sapiens
tactgcgccttcaccaagcggc

SEQ ID NO: 53285 - DNA, 16 bp, Homo sapiens
gcaggcagatcacatg

SEQ ID NO: 53286 - DNA, 22 bp, Homo sapiens
ctgagatctttatacgaggcac

SEQ ID NO: 53287 - DNA, 18 bp, Homo sapiens
tgagaggctattttttgc

SEQ ID NO: 53288 - DNA, 22 bp, Homo sapiens
gagccaggttggaggctgcagt

SEQ ID NO: 53289 - DNA, 19 bp, Homo sapiens
gccttcccaccacccgtcc

SEQ ID NO: 53290 - DNA, 22 bp, Homo sapiens
cttgtcagccaattgtggattt

SEQ ID NO: 53291 - DNA, 22 bp, Homo sapiens
tattgagaccagtgcttgctta

SEQ ID NO: 53292 - DNA, 22 bp, Homo sapiens
gtggctcacgtctgtcatctca

SEQ ID NO: 53293 - DNA, 22 bp, Homo sapiens
gtggggtagatctttctcagga

SEQ ID NO: 53294 - DNA, 22 bp, Homo sapiens
aagccctggcgggtggagggcc

SEQ ID NO: 53295 - DNA, 22 bp, Homo sapiens
ctctgctgtgccgccagggcct

SEQ ID NO: 53296 - DNA, 17 bp, Homo sapiens
aggaggccctggcgttt

SEQ ID NO: 53297 - DNA, 22 bp, Homo sapiens
cctggagagctcgggccaggca

SEQ ID NO: 53298 - DNA, 22 bp, Homo sapiens
ccttacctgattgctggcatcc

SEQ ID NO: 53299 - DNA, 22 bp, Homo sapiens
tgagatcattgacttgttcctg

SEQ ID NO: 53300 - DNA, 22 bp, Homo sapiens
gcggggggaggaacatcttgca

SEQ ID NO: 53301 - DNA, 22 bp, Homo sapiens
ggtcagccttggatttggtagc

SEQ ID NO: 53302 - DNA, 22 bp, Homo sapiens
aggctctgtcaggcggagcagc

SEQ ID NO: 53303 - DNA, 22 bp, Homo sapiens
atgctaaggcccaggagaaaat

SEQ ID NO: 53304 - DNA, 22 bp, Homo sapiens
cagtggttgaacccaaatactt

SEQ ID NO: 53305 - DNA, 22 bp, Homo sapiens
tgcagcttcactcctgaagcca

SEQ ID NO: 53306 - DNA, 22 bp, Homo sapiens
acttgtgttaccaaggtttggt

SEQ ID NO: 53307 - DNA, 22 bp, Homo sapiens
agagggtgggcacgtgatggat

SEQ ID NO: 53308 - DNA, 22 bp, Homo sapiens
ttttctcttccctctggacctg

SEQ ID NO: 53309 - DNA, 22 bp, Homo sapiens
tgacttgtctctttgggagaca

SEQ ID NO: 53310 - DNA, 17 bp, Homo sapiens
gggcagggactcctggg

SEQ ID NO: 53311 - DNA, 22 bp, Homo sapiens
tacaggcatgtagcatggtgat

SEQ ID NO: 53312 - DNA, 22 bp, Homo sapiens
cccaggaggcagatgttgcagt

SEQ ID NO: 53313 - DNA, 22 bp, Homo sapiens
atcgcaagtttaaaaatctttg

SEQ ID NO: 53314 - DNA, 22 bp, Homo sapiens
tacagtgcttggtatctagtaa

SEQ ID NO: 53315 - DNA, 22 bp, Homo sapiens
ctgccctttgaaagaacgtctt

SEQ ID NO: 53316 - DNA, 18 bp, Homo sapiens
cccggctaatttttggta

SEQ ID NO: 53317 - DNA, 22 bp, Homo sapiens
cagcagagaaattacatatttg

SEQ ID NO: 53318 - DNA, 21 bp, Homo sapiens
gccatttcacacagacatttg

SEQ ID NO: 53319 - DNA, 22 bp, Homo sapiens
ggtgcagaggagccagctgggg

SEQ ID NO: 53320 - DNA, 22 bp, Homo sapiens
tagattatccctgatttgtcca

SEQ ID NO: 53321 - DNA, 22 bp, Homo sapiens
gggacgtgagtgaagaaggtct

SEQ ID NO: 53322 - DNA, 22 bp, Homo sapiens
ttgccttgttattctctcagaa

SEQ ID NO: 53323 - DNA, 22 bp, Homo sapiens
caatccatcaattacacaggct

SEQ ID NO: 53324 - DNA, 22 bp, Homo sapiens
ccaaggtgggaggattgcttga

SEQ ID NO: 53325 - DNA, 22 bp, Homo sapiens
caggcagaagaagtggaaggac

SEQ ID NO: 53326 - DNA, 18 bp, Homo sapiens
tcttcatctcctgagctg

SEQ ID NO: 53327 - DNA, 22 bp, Homo sapiens
tccaggattgcaggtgcacaac

SEQ ID NO: 53328 - DNA, 22 bp, Homo sapiens
cacattggcaaacggggttgca

SEQ ID NO: 53329 - DNA, 20 bp, Homo sapiens
gggactgtcccatcctcatc

SEQ ID NO: 53330 - DNA, 22 bp, Homo sapiens
ttccacaatggttaagctcgtt

SEQ ID NO: 53331 - DNA, 22 bp, Homo sapiens
tcacagtgttaaacctttcttt

SEQ ID NO: 53332 - DNA, 22 bp, Homo sapiens
gaggggcacagtaaagggtccc

SEQ ID NO: 53333 - DNA, 22 bp, Homo sapiens
tggtgctgccaggctcctgcca

SEQ ID NO: 53334 - DNA, 21 bp, Homo sapiens
cagggccaatcctgacctcta

SEQ ID NO: 53335 - DNA, 22 bp, Homo sapiens
attcttcctcatcaatctgtag

SEQ ID NO: 53336 - DNA, 20 bp, Homo sapiens
tcagccattccttacctttc

SEQ ID NO: 53337 - DNA, 22 bp, Homo sapiens
aaaatatgtataactcttctgc

SEQ ID NO: 53338 - DNA, 22 bp, Homo sapiens
taacaaagtattgtttgtgtat

SEQ ID NO: 53339 - DNA, 22 bp, Homo sapiens
tggtattacttctagacacaag

SEQ ID NO: 53340 - DNA, 22 bp, Homo sapiens
tgatttcaagccagggggcgtt

SEQ ID NO: 53341 - DNA, 21 bp, Homo sapiens
taaacataaccttgtatggct

SEQ ID NO: 53342 - DNA, 22 bp, Homo sapiens
agtgaaaacctaatcatgcagt

SEQ ID NO: 53343 - DNA, 22 bp, Homo sapiens
tgagaattacaaatgagtcaca

SEQ ID NO: 53344 - DNA, 22 bp, Homo sapiens
ttgaagactaatttagataatg

SEQ ID NO: 53345 - DNA, 22 bp, Homo sapiens
taatactgtatactgcaaattt

SEQ ID NO: 53346 - DNA, 22 bp, Homo sapiens
tttgaaatgtatcagtataggt

SEQ ID NO: 53347 - DNA, 22 bp, Homo sapiens
atgaaaacggaccagagctatt

SEQ ID NO: 53348 - DNA, 22 bp, Homo sapiens
attgtgaataatgctgcaataa

SEQ ID NO: 53349 - DNA, 22 bp, Homo sapiens
atcacaaaggtctcagagcaca

SEQ ID NO: 53350 - DNA, 22 bp, Homo sapiens
atgaaatatcttgaagaaattc

SEQ ID NO: 53351 - DNA, 22 bp, Homo sapiens
cagctacaaatacttttgtatg

SEQ ID NO: 53352 - DNA, 22 bp, Homo sapiens
tcttatacccctaaactgcagc

SEQ ID NO: 53353 - DNA, 22 bp, Homo sapiens
aataaacaaatccttccttccc

SEQ ID NO: 53354 - DNA, 20 bp, Homo sapiens
aaaatatgtataactcttct

SEQ ID NO: 53355 - DNA, 22 bp, Homo sapiens
ataaaaactgacccatcctttg

SEQ ID NO: 53356 - DNA, 22 bp, Homo sapiens
aaaaagtattggccatggttga

SEQ ID NO: 53357 - DNA, 21 bp, Homo sapiens
aaactgaccttgcctgagaca

SEQ ID NO: 53358 - DNA, 22 bp, Homo sapiens
tttaatgtagcgtgaaatgatt

SEQ ID NO: 53359 - DNA, 22 bp, Homo sapiens
atgtatacgtgcaggtcacagg

SEQ ID NO: 53360 - DNA, 22 bp, Homo sapiens
aaattctgatttaataagtgta

SEQ ID NO: 53361 - DNA, 22 bp, Homo sapiens
tcatctaagagtcttacattta

SEQ ID NO: 53362 - DNA, 22 bp, Homo sapiens
atattgaaccctacagactgta

SEQ ID NO: 53363 - DNA, 22 bp, Homo sapiens
atttacaggtagaattttaagt

SEQ ID NO: 53364 - DNA, 22 bp, Homo sapiens
ttgtgaatagtgctgcaataaa

SEQ ID NO: 53365 - DNA, 22 bp, Homo sapiens
aacagaatgcaggggatgctgc

SEQ ID NO: 53366 - DNA, 22 bp, Homo sapiens
ttatttgtggcatatgagacga

SEQ ID NO: 53367 - DNA, 22 bp, Homo sapiens
ctttgctactgtgaatagtgcc

SEQ ID NO: 53368 - DNA, 22 bp, Homo sapiens
ttttaatactgctattgtagga

SEQ ID NO: 53369 - DNA, 22 bp, Homo sapiens
actttatttcctattgcatcca

SEQ ID NO: 53370 - DNA, 22 bp, Homo sapiens
agttggagtgaacatgagattg

SEQ ID NO: 53371 - DNA, 22 bp, Homo sapiens
attgaaaataaggccagaaaca

SEQ ID NO: 53372 - DNA, 22 bp, Homo sapiens
tttcataatactgtacatgaaa

SEQ ID NO: 53373 - DNA, 22 bp, Homo sapiens
taaaatttgtccctgagtgttg

SEQ ID NO: 53374 - DNA, 22 bp, Homo sapiens
ttgtgaaacattcatggatttg

SEQ ID NO: 53375 - DNA, 22 bp, Homo sapiens
aaaagcaattgcagttcttgcc

SEQ ID NO: 53376 - DNA, 22 bp, Homo sapiens
tttgtcttatccaatctctcag

SEQ ID NO: 53377 - DNA, 22 bp, Homo sapiens
atatatttgagaatattcatga

SEQ ID NO: 53378 - DNA, 19 bp, Homo sapiens
ttcacattggaagaagtag

SEQ ID NO: 53379 - DNA, 22 bp, Homo sapiens
ataaaatttgctactgttaaat

SEQ ID NO: 53380 - DNA, 22 bp, Homo sapiens
aaggcaggatgggaaaagattt

SEQ ID NO: 53381 - DNA, 22 bp, Homo sapiens
tacaaaaaattgatactgacga

SEQ ID NO: 53382 - DNA, 22 bp, Homo sapiens
taacatttaaatttttcacata

SEQ ID NO: 53383 - DNA, 22 bp, Homo sapiens
acatgtttaagtttgttatatg

SEQ ID NO: 53384 - DNA, 22 bp, Homo sapiens
aggaagatgtgcaaagttggaa

SEQ ID NO: 53385 - DNA, 22 bp, Homo sapiens
aagaataagaggatttagaaca

SEQ ID NO: 53386 - DNA, 22 bp, Homo sapiens
ttctgtgaatcttttttcccac

SEQ ID NO: 53387 - DNA, 20 bp, Homo sapiens
ataaaataactgccacaaga

SEQ ID NO: 53388 - DNA, 20 bp, Homo sapiens
ttgcaactgtaagaagcagg

SEQ ID NO: 53389 - DNA, 22 bp, Homo sapiens
tacaaagtcttgggttctaggc

SEQ ID NO: 53390 - DNA, 22 bp, Homo sapiens
ccatgaattcactccatgctag

SEQ ID NO: 53391 - DNA, 22 bp, Homo sapiens
tacatttataaggcttctctgt

SEQ ID NO: 53392 - DNA, 17 bp, Homo sapiens
gagattttcgtcctgaa

SEQ ID NO: 53393 - DNA, 22 bp, Homo sapiens
ttacaattacttgatctcagct

SEQ ID NO: 53394 - DNA, 22 bp, Homo sapiens
aatataacacagatggcctgtt

SEQ ID NO: 53395 - DNA, 22 bp, Homo sapiens
tgtgcctagttctgtatttaca

SEQ ID NO: 53396 - DNA, 22 bp, Homo sapiens
ttccaactttgtcatatattat

SEQ ID NO: 53397 - DNA, 22 bp, Homo sapiens
attttctatgttgtaattgtta

SEQ ID NO: 53398 - DNA, 22 bp, Homo sapiens
attgtgaatagtgctgcaataa

SEQ ID NO: 53399 - DNA, 22 bp, Homo sapiens
ttgaaattttaggccttgcaat

SEQ ID NO: 53400 - DNA, 22 bp, Homo sapiens
gatttttatataaagtgagaaa

SEQ ID NO: 53401 - DNA, 20 bp, Homo sapiens
aaattactgccacacatttc

SEQ ID NO: 53402 - DNA, 22 bp, Homo sapiens
aaaactgaaatacgatccaatg

SEQ ID NO: 53403 - DNA, 22 bp, Homo sapiens
ttgcactataggaaaatgtgtc

SEQ ID NO: 53404 - DNA, 22 bp, Homo sapiens
atcaacatgtcataaagtgaaa

SEQ ID NO: 53405 - DNA, 22 bp, Homo sapiens
agttacagaatgtacagaggtt

SEQ ID NO: 53406 - DNA, 22 bp, Homo sapiens
agaaaatttaaagagacacaca

SEQ ID NO: 53407 - DNA, 22 bp, Homo sapiens
ttttctaacatctagtaatttg

SEQ ID NO: 53408 - DNA, 22 bp, Homo sapiens
aaaaaattatcatagttcctga

SEQ ID NO: 53409 - DNA, 22 bp, Homo sapiens
tctgaaaactccatgagctcgt

SEQ ID NO: 53410 - DNA, 22 bp, Homo sapiens
tttaaaaaactagtctgagtct

SEQ ID NO: 53411 - DNA, 22 bp, Homo sapiens
acaactttgacccttgttctta

SEQ ID NO: 53412 - DNA, 22 bp, Homo sapiens
cttcagctgcagttatgtttag

SEQ ID NO: 53413 - DNA, 22 bp, Homo sapiens
taagaaatttagttatagaatg

SEQ ID NO: 53414 - DNA, 20 bp, Homo sapiens
aggaaaaatggaaactggag

SEQ ID NO: 53415 - DNA, 22 bp, Homo sapiens
tttaagaagttatgttataaat

SEQ ID NO: 53416 - DNA, 22 bp, Homo sapiens
cacatttttactgccaacttaa

SEQ ID NO: 53417 - DNA, 22 bp, Homo sapiens
tcaaatctcatcttgaattgta

SEQ ID NO: 53418 - DNA, 22 bp, Homo sapiens
aaagagactggtggcattttgc

SEQ ID NO: 53419 - DNA, 19 bp, Homo sapiens
aaatccaagctcaggcctc

SEQ ID NO: 53420 - DNA, 22 bp, Homo sapiens
gcatctaaataaacgtgggagt

SEQ ID NO: 53421 - DNA, 22 bp, Homo sapiens
gtgttgatgacattttagaaac

SEQ ID NO: 53422 - DNA, 22 bp, Homo sapiens
tgctcccaaacctgacaggctc

SEQ ID NO: 53423 - DNA, 22 bp, Homo sapiens
aagagggaaattgttggctgct

SEQ ID NO: 53424 - DNA, 22 bp, Homo sapiens
agggaattcactggaacgccct

SEQ ID NO: 53425 - DNA, 22 bp, Homo sapiens
tgggaagaggagcactggaatg

SEQ ID NO: 53426 - DNA, 22 bp, Homo sapiens
tgtgctctgactttctcctggt

SEQ ID NO: 53427 - DNA, 22 bp, Homo sapiens
aagcctggcacattggagtctg

SEQ ID NO: 53428 - DNA, 22 bp, Homo sapiens
aatgccttggagagcctagagg

SEQ ID NO: 53429 - DNA, 22 bp, Homo sapiens
tggaggctggagtgcagtggcg

SEQ ID NO: 53430 - DNA, 22 bp, Homo sapiens
aagatattcaaagatttattag

SEQ ID NO: 53431 - DNA, 22 bp, Homo sapiens
atacaaaatatatactggagac

SEQ ID NO: 53432 - DNA, 22 bp, Homo sapiens
cagccctcctaccctgccaggc

SEQ ID NO: 53433 - DNA, 22 bp, Homo sapiens
ttctgggtttacatctgacttc

SEQ ID NO: 53434 - DNA, 22 bp, Homo sapiens
tttgatccgttgctggtgagga

SEQ ID NO: 53435 - DNA, 22 bp, Homo sapiens
ggaggcccagaaggaagcccag

SEQ ID NO: 53436 - DNA, 23 bp, Homo sapiens
ggctgggagctccgggtgcacgt

SEQ ID NO: 53437 - DNA, 22 bp, Homo sapiens
ctcccagccttcgccagtctga

SEQ ID NO: 53438 - DNA, 21 bp, Homo sapiens
aggcttggatctagacaggcc

SEQ ID NO: 53439 - DNA, 22 bp, Homo sapiens
ccctggcagtgctcctttagac

SEQ ID NO: 53440 - DNA, 22 bp, Homo sapiens
ccattgtaaattctgtggaagt

SEQ ID NO: 53441 - DNA, 22 bp, Homo sapiens
tggcacgacaattggcaccaat

SEQ ID NO: 53442 - DNA, 22 bp, Homo sapiens
tcgcaccattgcactccagcca

SEQ ID NO: 53443 - DNA, 22 bp, Homo sapiens
gaggagggagctggaagctctt

SEQ ID NO: 53444 - DNA, 22 bp, Homo sapiens
tgcgaccctagccccctcactt

SEQ ID NO: 53445 - DNA, 22 bp, Homo sapiens
gaggcacagagtaggtgcacac

SEQ ID NO: 53446 - DNA, 22 bp, Homo sapiens
aggtaggcctgacgctggggtg

SEQ ID NO: 53447 - DNA, 22 bp, Homo sapiens
agtgctgggctatctactgcta

SEQ ID NO: 53448 - DNA, 22 bp, Homo sapiens
tcttcctgtcaatgagaattaa

SEQ ID NO: 53449 - DNA, 22 bp, Homo sapiens
cctgtcataatgtccgatgtca

SEQ ID NO: 53450 - DNA, 22 bp, Homo sapiens
accactgcccatggtgaaaact

SEQ ID NO: 53451 - DNA, 22 bp, Homo sapiens
ggctcactgcaacctctgcctc

SEQ ID NO: 53452 - DNA, 20 bp, Homo sapiens
ttctccagtgcggtagccat

SEQ ID NO: 53453 - DNA, 22 bp, Homo sapiens
cactgcactccagcctgggaga

SEQ ID NO: 53454 - DNA, 22 bp, Homo sapiens
caggccagggttgagaagagaa

SEQ ID NO: 53455 - DNA, 22 bp, Homo sapiens
ttctccgctaagttctctgcag

SEQ ID NO: 53456 - DNA, 22 bp, Homo sapiens
tagcacagggctcctcaaccca

SEQ ID NO: 53457 - DNA, 22 bp, Homo sapiens
caggctggagtgcagtggggcg

SEQ ID NO: 53458 - DNA, 22 bp, Homo sapiens
ttcctggaaattatgctcacct

SEQ ID NO: 53459 - DNA, 22 bp, Homo sapiens
ttcctgggattattgtcaagca

SEQ ID NO: 53460 - DNA, 22 bp, Homo sapiens
cactgctacctctgcctcccgg

SEQ ID NO: 53461 - DNA, 22 bp, Homo sapiens
ggcaagagggcagatggagtgc

SEQ ID NO: 53462 - DNA, 22 bp, Homo sapiens
cctgggggccaggaaggtgtga

SEQ ID NO: 53463 - DNA, 22 bp, Homo sapiens
agtaatcaatttttcggtggat

SEQ ID NO: 53464 - DNA, 22 bp, Homo sapiens
ggtggcagtagcactgggcctg

SEQ ID NO: 53465 - DNA, 22 bp, Homo sapiens
cactgcactccagcctcggtga

SEQ ID NO: 53466 - DNA, 21 bp, Homo sapiens
acctgagctccacctcctgcc

SEQ ID NO: 53467 - DNA, 22 bp, Homo sapiens
acgcagtttgtggacatttttt

SEQ ID NO: 53468 - DNA, 22 bp, Homo sapiens
cctggagagctcgggccaggca

SEQ ID NO: 53469 - DNA, 22 bp, Homo sapiens
ggagagggtaggggtcctgccc

SEQ ID NO: 53470 - DNA, 22 bp, Homo sapiens
aggagctgtcagagtgccagag

SEQ ID NO: 53471 - DNA, 22 bp, Homo sapiens
caggctggagtgcagtggcgcc

SEQ ID NO: 53472 - DNA, 22 bp, Homo sapiens
agccctggtttgcagcatttgc

SEQ ID NO: 53473 - DNA, 22 bp, Homo sapiens
gagctactgaaatattgatttt

SEQ ID NO: 53474 - DNA, 19 bp, Homo sapiens
agtcctggcctgggggacc

SEQ ID NO: 53475 - DNA, 22 bp, Homo sapiens
taatcctgtcttgaccatcagg

SEQ ID NO: 53476 - DNA, 22 bp, Homo sapiens
aaggggaagagaccgcagagtc

SEQ ID NO: 53477 - DNA, 22 bp, Homo sapiens
gctcactgcaagctctgcctcc

SEQ ID NO: 53478 - DNA, 22 bp, Homo sapiens
gggtgtagaaagaaccctctgg

SEQ ID NO: 53479 - DNA, 22 bp, Homo sapiens
gagaggtggaggttgcagtgag

SEQ ID NO: 53480 - DNA, 22 bp, Homo sapiens
aggccctattcaatggggccca

SEQ ID NO: 53481 - DNA, 22 bp, Homo sapiens
aatgttacgatcaacaacacat

SEQ ID NO: 53482 - DNA, 22 bp, Homo sapiens
ggcagggcaggaaagtcaggaa

SEQ ID NO: 53483 - DNA, 22 bp, Homo sapiens
tccagcccaggctggagtgtag

SEQ ID NO: 53484 - DNA, 22 bp, Homo sapiens
caggaaagggatgggctgccac

SEQ ID NO: 53485 - DNA, 22 bp, Homo sapiens
ctcctggaggatagtgactggg

SEQ ID NO: 53486 - DNA, 16 bp, Homo sapiens
ccacctgcagctctca

SEQ ID NO: 53487 - DNA, 22 bp, Homo sapiens
gctcactgcaacctctgcctcc

SEQ ID NO: 53488 - DNA, 22 bp, Homo sapiens
tgggaggccgaggcaggtggat

SEQ ID NO: 53489 - DNA, 22 bp, Homo sapiens
gagcaggaaggccagaagggtc

SEQ ID NO: 53490 - DNA, 22 bp, Homo sapiens
attgttgggtctcactcctaga

SEQ ID NO: 53491 - DNA, 22 bp, Homo sapiens
ctgtgctccctctggcgccccg

SEQ ID NO: 53492 - DNA, 22 bp, Homo sapiens
aataaaatggtcagttttctca

SEQ ID NO: 53493 - DNA, 22 bp, Homo sapiens
tgctgctccccagcacacagca

SEQ ID NO: 53494 - DNA, 22 bp, Homo sapiens
acagtcttcagaagggattggg

SEQ ID NO: 53495 - DNA, 22 bp, Homo sapiens
ttttaagttggattgctaagta

SEQ ID NO: 53496 - DNA, 19 bp, Homo sapiens
gatttaaacgtggctctat

SEQ ID NO: 53497 - DNA, 22 bp, Homo sapiens
gcacagagagggaaggtaactt

SEQ ID NO: 53498 - DNA, 22 bp, Homo sapiens
agggccagcactcctggcagga

SEQ ID NO: 53499 - DNA, 22 bp, Homo sapiens
gcgagtgccgagagggcagggc

SEQ ID NO: 53500 - DNA, 22 bp, Homo sapiens
cggctcactgcagctccgcctc

SEQ ID NO: 53501 - DNA, 22 bp, Homo sapiens
gccctgggcaaggttctggcca

SEQ ID NO: 53502 - DNA, 22 bp, Homo sapiens
cttgacactgtcactcaggcca

SEQ ID NO: 53503 - DNA, 22 bp, Homo sapiens
ctccagttggccccagttggtt

SEQ ID NO: 53504 - DNA, 22 bp, Homo sapiens
gggaagagggagctggaatgat

SEQ ID NO: 53505 - DNA, 22 bp, Homo sapiens
gctgctctcagagctcatgctg

SEQ ID NO: 53506 - DNA, 22 bp, Homo sapiens
cagccccacacggtctagctct

SEQ ID NO: 53507 - DNA, 22 bp, Homo sapiens
ggctagggatctagaccaggac

SEQ ID NO: 53508 - DNA, 22 bp, Homo sapiens
gcctccggagttgcagtgtctt

SEQ ID NO: 53509 - DNA, 22 bp, Homo sapiens
gacaatatagttgaatgagcaa

SEQ ID NO: 53510 - DNA, 22 bp, Homo sapiens
gaggtggccaagcgaggaaggg

SEQ ID NO: 53511 - DNA, 22 bp, Homo sapiens
ctctccattccctacagttttc

SEQ ID NO: 53512 - DNA, 22 bp, Homo sapiens
gaggcagaagttgcagtgagca

SEQ ID NO: 53513 - DNA, 22 bp, Homo sapiens
ctgctccccagcctgcgccttt

SEQ ID NO: 53514 - DNA, 22 bp, Homo sapiens
aaaatcttgtgacttaggaagg

SEQ ID NO: 53515 - DNA, 22 bp, Homo sapiens
ttggcgcccaggacgccgccgc

SEQ ID NO: 53516 - DNA, 22 bp, Homo sapiens
gggagctggagctggaagactc

SEQ ID NO: 53517 - DNA, 22 bp, Homo sapiens
attataggcttgagccaccgtg

SEQ ID NO: 53518 - DNA, 22 bp, Homo sapiens
tcactgcaacctccacctcctg

SEQ ID NO: 53519 - DNA, 22 bp, Homo sapiens
aggtgggcggattcatgaggtc

SEQ ID NO: 53520 - DNA, 22 bp, Homo sapiens
atgcattgtcaggcaatttcat

SEQ ID NO: 53521 - DNA, 22 bp, Homo sapiens
gctcttgtcaaaaattagttga

SEQ ID NO: 53522 - DNA, 22 bp, Homo sapiens
agaggccggccgagcccatggg

SEQ ID NO: 53523 - DNA, 18 bp, Homo sapiens
gaaagatgaacttttttc

SEQ ID NO: 53524 - DNA, 19 bp, Homo sapiens
gctggatggatcctggagt

SEQ ID NO: 53525 - DNA, 22 bp, Homo sapiens
ataaaatttgctactgttaaat

SEQ ID NO: 53526 - DNA, 22 bp, Homo sapiens
gcaccgccttggaccgcccgct

SEQ ID NO: 53527 - DNA, 22 bp, Homo sapiens
ggcctcttatctggctcctgca

SEQ ID NO: 53528 - DNA, 22 bp, Homo sapiens
ggggctgaacctggaggtggtc

SEQ ID NO: 53529 - DNA, 22 bp, Homo sapiens
gaggctggacgtgcatttctac

SEQ ID NO: 53530 - DNA, 21 bp, Homo sapiens
accaccctgtttatccagagg

SEQ ID NO: 53531 - DNA, 22 bp, Homo sapiens
tattcatagtaaacaaaagtgg

SEQ ID NO: 53532 - DNA, 22 bp, Homo sapiens
cctcttctaggacgtccttgtg

SEQ ID NO: 53533 - DNA, 22 bp, Homo sapiens
gtgcacttgatctagacagatt

SEQ ID NO: 53534 - DNA, 22 bp, Homo sapiens
ggctggtgttgagtgcctgtag

SEQ ID NO: 53535 - DNA, 22 bp, Homo sapiens
tctgctcagccgatctgctccg

SEQ ID NO: 53536 - DNA, 22 bp, Homo sapiens
aaggaaagctgtggttctgaga

SEQ ID NO: 53537 - DNA, 22 bp, Homo sapiens
ttggaaacgtcaccttttcctt

SEQ ID NO: 53538 - DNA, 22 bp, Homo sapiens
tccttaggcaatttgggagagt

SEQ ID NO: 53539 - DNA, 22 bp, Homo sapiens
aaacactcatgtgttactctcc

SEQ ID NO: 53540 - DNA, 22 bp, Homo sapiens
gtggagagagataagcctggtc

SEQ ID NO: 53541 - DNA, 22 bp, Homo sapiens
ttccctccatttcattttataa

SEQ ID NO: 53542 - DNA, 22 bp, Homo sapiens
ggaggcagaatagagtgtgggt

SEQ ID NO: 53543 - DNA, 22 bp, Homo sapiens
tgtctgttattggtgtataaga

SEQ ID NO: 53544 - DNA, 22 bp, Homo sapiens
gcctccggagtcacagtgtctt

SEQ ID NO: 53545 - DNA, 22 bp, Homo sapiens
gaggtggctgcttgctgggaaa

SEQ ID NO: 53546 - DNA, 22 bp, Homo sapiens
ctgaatccacacaaggtgatgg

SEQ ID NO: 53547 - DNA, 22 bp, Homo sapiens
gggaggcagtgctggaggctgg

SEQ ID NO: 53548 - DNA, 22 bp, Homo sapiens
ggctcactgcaacttccgcctc

SEQ ID NO: 53549 - DNA, 22 bp, Homo sapiens
agcgccgcccctgctggtgttg

SEQ ID NO: 53550 - DNA, 22 bp, Homo sapiens
gaggtgggtgtatcacaggtca

SEQ ID NO: 53551 - DNA, 22 bp, Homo sapiens
cactgcactccatcctgggaaa

SEQ ID NO: 53552 - DNA, 22 bp, Homo sapiens
caggctggagtgcagtggcgct

SEQ ID NO: 53553 - DNA, 22 bp, Homo sapiens
tggctcctcacgtcctcagagc

SEQ ID NO: 53554 - DNA, 20 bp, Homo sapiens
tgtcattcttctttcacagg

SEQ ID NO: 53555 - DNA, 22 bp, Homo sapiens
cactccagcctcagtgacagag

SEQ ID NO: 53556 - DNA, 19 bp, Homo sapiens
ccttgtctggtgaaggact

SEQ ID NO: 53557 - DNA, 22 bp, Homo sapiens
taatatctacttcatagagttt

SEQ ID NO: 53558 - DNA, 22 bp, Homo sapiens
tccggtccgggtactcctctct

SEQ ID NO: 53559 - DNA, 22 bp, Homo sapiens
ttcaatatgatattagctgtgg

SEQ ID NO: 53560 - DNA, 22 bp, Homo sapiens
tcctagttctctgccagtcgct

SEQ ID NO: 53561 - DNA, 22 bp, Homo sapiens
gtcaccttgaacaggctactca

SEQ ID NO: 53562 - DNA, 18 bp, Homo sapiens
tccatgcacatagccccc

SEQ ID NO: 53563 - DNA, 22 bp, Homo sapiens
tcagcctgctccaagtgctgcc

SEQ ID NO: 53564 - DNA, 22 bp, Homo sapiens
tctggctctggagtccacctgc

SEQ ID NO: 53565 - DNA, 22 bp, Homo sapiens
gaccttgtgatctgcccacctt

SEQ ID NO: 53566 - DNA, 22 bp, Homo sapiens
ataaaaactgacccatcctttg

SEQ ID NO: 53567 - DNA, 22 bp, Homo sapiens
ctgggcacagcgttgggctctt

SEQ ID NO: 53568 - DNA, 22 bp, Homo sapiens
agggggctccttggtgtgcaga

SEQ ID NO: 53569 - DNA, 22 bp, Homo sapiens
aggaggggttctcgggtgctga

SEQ ID NO: 53570 - DNA, 22 bp, Homo sapiens
gagccaggttggaggctgcagt

SEQ ID NO: 53571 - DNA, 22 bp, Homo sapiens
ctctggaggtggaggttgcagt

SEQ ID NO: 53572 - DNA, 22 bp, Homo sapiens
agccagggacgctgcaggctac

SEQ ID NO: 53573 - DNA, 22 bp, Homo sapiens
tgaggaaacttacaaggcagaa

SEQ ID NO: 53574 - DNA, 22 bp, Homo sapiens
ctatggtctggaccgaggtcct

SEQ ID NO: 53575 - DNA, 22 bp, Homo sapiens
ggcagacctctccagccccaca

SEQ ID NO: 53576 - DNA, 22 bp, Homo sapiens
atatatttgagaatattcatga

SEQ ID NO: 53577 - DNA, 22 bp, Homo sapiens
gcttccgcgatgtcctaggtgg

SEQ ID NO: 53578 - DNA, 22 bp, Homo sapiens
cctgggaggctgaggctgcagt

SEQ ID NO: 53579 - DNA, 22 bp, Homo sapiens
tcctgggatcaagtgatcctcc

SEQ ID NO: 53580 - DNA, 22 bp, Homo sapiens
gctcagacctgtaatcttagca

SEQ ID NO: 53581 - DNA, 23 bp, Homo sapiens
gaggtggcaatgagggcagttgg

SEQ ID NO: 53582 - DNA, 22 bp, Homo sapiens
aggtaaagacagtgaaagaggg

SEQ ID NO: 53583 - DNA, 22 bp, Homo sapiens
agcctggcctgggcaggcacat

SEQ ID NO: 53584 - DNA, 23 bp, Homo sapiens
aatgggtgcaactatccatgaca

SEQ ID NO: 53585 - DNA, 22 bp, Homo sapiens
tacaacaatttccacattagaa

SEQ ID NO: 53586 - DNA, 22 bp, Homo sapiens
tgcgatgcaacagcttggcgga

SEQ ID NO: 53587 - DNA, 22 bp, Homo sapiens
gtcacctcgctgtcttcctgag

SEQ ID NO: 53588 - DNA, 22 bp, Homo sapiens
tcccagattcctgctcttatat

SEQ ID NO: 53589 - DNA, 22 bp, Homo sapiens
acctggacacctgctgtcatct

SEQ ID NO: 53590 - DNA, 22 bp, Homo sapiens
gtgcgcttcttcctgagccagg

SEQ ID NO: 53591 - DNA, 22 bp, Homo sapiens
caggaggattgcttgaggccag

SEQ ID NO: 53592 - DNA, 22 bp, Homo sapiens
aggagggagcttaagccaggca

SEQ ID NO: 53593 - DNA, 22 bp, Homo sapiens
cgagagttagctaggagtcaca

SEQ ID NO: 53594 - DNA, 22 bp, Homo sapiens
accatgttggccaagctggtct

SEQ ID NO: 53595 - DNA, 23 bp, Homo sapiens
gacagagtgagaccttgtcttac

SEQ ID NO: 53596 - DNA, 22 bp, Homo sapiens
tacatttataaggcttctctgt

SEQ ID NO: 53597 - DNA, 22 bp, Homo sapiens
gctgctctccaagcctccttga

SEQ ID NO: 53598 - DNA, 22 bp, Homo sapiens
agggaagaggaccagagtctct

SEQ ID NO: 53599 - DNA, 22 bp, Homo sapiens
ctttgcttgacactgtgattgt

SEQ ID NO: 53600 - DNA, 22 bp, Homo sapiens
ggagtgaagtggcgcgatctcg

SEQ ID NO: 53601 - DNA, 22 bp, Homo sapiens
ctgcagggagaggggacagcct

SEQ ID NO: 53602 - DNA, 22 bp, Homo sapiens
aagaggttgtctgtgatgagtt

SEQ ID NO: 53603 - DNA, 22 bp, Homo sapiens
tgggtagtttcccctgccctgc

SEQ ID NO: 53604 - DNA, 22 bp, Homo sapiens
tccttgtaaaggagctctaaca

SEQ ID NO: 53605 - DNA, 22 bp, Homo sapiens
cttcagctgcagttatgtttag

SEQ ID NO: 53606 - DNA, 22 bp, Homo sapiens
cactgcactccagcccgggcaa

SEQ ID NO: 53607 - DNA, 22 bp, Homo sapiens
ctgaaggatgtgtggtgggagt

SEQ ID NO: 53608 - DNA, 22 bp, Homo sapiens
gacaggaggcagagctcaggtg

SEQ ID NO: 53609 - DNA, 22 bp, Homo sapiens
ttggaagttgatttaaaaagga

SEQ ID NO: 53610 - DNA, 22 bp, Homo sapiens
ggctgtggcagctggaagtggt

SEQ ID NO: 53611 - DNA, 22 bp, Homo sapiens
tgggaagggtcaacagctggaa

SEQ ID NO: 53612 - DNA, 22 bp, Homo sapiens
tgtagctctccagccagcaagg

SEQ ID NO: 53613 - DNA, 22 bp, Homo sapiens
gatcctgggcccttctgggtca

SEQ ID NO: 53614 - DNA, 22 bp, Homo sapiens
aggctctcaccctctgaccaga

SEQ ID NO: 53615 - DNA, 22 bp, Homo sapiens
gaggcagaggttgcagtgagct

SEQ ID NO: 53616 - DNA, 22 bp, Homo sapiens
cactctcacatgccctgtcagt

SEQ ID NO: 53617 - DNA, 22 bp, Homo sapiens
tgctttgtgacagattagtttt

SEQ ID NO: 53618 - DNA, 22 bp, Homo sapiens
tggctcactgtagccttgacct

SEQ ID NO: 53619 - DNA, 22 bp, Homo sapiens
tgttgattagtgtttagactta

SEQ ID NO: 53620 - DNA, 22 bp, Homo sapiens
tcacatctaattccatttctgc

SEQ ID NO: 53621 - DNA, 22 bp, Homo sapiens
cactgcactccagcctgcgcaa

SEQ ID NO: 53622 - DNA, 22 bp, Homo sapiens
atgcacacgtaccctacaaggc

SEQ ID NO: 53623 - DNA, 22 bp, Homo sapiens
aggaattcaagaccagctgggc

SEQ ID NO: 53624 - DNA, 22 bp, Homo sapiens
gtccaagagtcaagaagggggc

SEQ ID NO: 53625 - DNA, 22 bp, Homo sapiens
aggacagagggaccagagccca

SEQ ID NO: 53626 - DNA, 22 bp, Homo sapiens
gtctgctcatgctaccgcgggc

SEQ ID NO: 53627 - DNA, 22 bp, Homo sapiens
tatacgtgcaggtcacagggga

SEQ ID NO: 53628 - DNA, 22 bp, Homo sapiens
ttcctggtcactgctgttccct

SEQ ID NO: 53629 - DNA, 22 bp, Homo sapiens
ggctgatgggcatgagctgtca

SEQ ID NO: 53630 - DNA, 22 bp, Homo sapiens
ttttcagaattagcataccatt

SEQ ID NO: 53631 - DNA, 22 bp, Homo sapiens
gctcccaccttaaccttcacat

SEQ ID NO: 53632 - DNA, 22 bp, Homo sapiens
tctctagtctcctttaacctga

SEQ ID NO: 53633 - DNA, 22 bp, Homo sapiens
ctgggtggcagagcctgcagtg

SEQ ID NO: 53634 - DNA, 22 bp, Homo sapiens
aaaatcctgctgactcgagatg

SEQ ID NO: 53635 - DNA, 22 bp, Homo sapiens
cagcacatgctcatcagggaag

SEQ ID NO: 53636 - DNA, 22 bp, Homo sapiens
tgttcagaacaaaggtaaatga

SEQ ID NO: 53637 - DNA, 23 bp, Homo sapiens
gtgccgacgctccagcaccatcc

SEQ ID NO: 53638 - DNA, 22 bp, Homo sapiens
gcaaacaaggacatacatcctg

SEQ ID NO: 53639 - DNA, 22 bp, Homo sapiens
aaagtgctgggattccaggcgt

SEQ ID NO: 53640 - DNA, 22 bp, Homo sapiens
gtcctggggattatagagtgtt

SEQ ID NO: 53641 - DNA, 22 bp, Homo sapiens
caggagatgacagggaagaacc

SEQ ID NO: 53642 - DNA, 22 bp, Homo sapiens
atagaatatgacttttagatcc

SEQ ID NO: 53643 - DNA, 22 bp, Homo sapiens
gaatttaagaggatgaatctgt

SEQ ID NO: 53644 - DNA, 20 bp, Homo sapiens
ataaaataactgccacaaga

SEQ ID NO: 53645 - DNA, 22 bp, Homo sapiens
caggaggacatactggctcaca

SEQ ID NO: 53646 - DNA, 22 bp, Homo sapiens
ttccacggggctccccgctctt

SEQ ID NO: 53647 - DNA, 22 bp, Homo sapiens
ctacaaaagtaattgtggtttt

SEQ ID NO: 53648 - DNA, 22 bp, Homo sapiens
agagggtgggcacgtgatggat

SEQ ID NO: 53649 - DNA, 22 bp, Homo sapiens
tctccgatcacaggttttcaat

SEQ ID NO: 53650 - DNA, 22 bp, Homo sapiens
gagctgggcctgcgagtgctgc

SEQ ID NO: 53651 - DNA, 22 bp, Homo sapiens
accattgccccctagtgtctgt

SEQ ID NO: 53652 - DNA, 22 bp, Homo sapiens
ctgggttggggttacatgactg

SEQ ID NO: 53653 - DNA, 23 bp, Homo sapiens
aaataggagtatctggatcatga

SEQ ID NO: 53654 - DNA, 22 bp, Homo sapiens
ccatgaattcactccatgctag

SEQ ID NO: 53655 - DNA, 22 bp, Homo sapiens
tacaaaaaattgatactgacga

SEQ ID NO: 53656 - DNA, 21 bp, Homo sapiens
gctgttcggcggccctcgcgc

SEQ ID NO: 53657 - DNA, 22 bp, Homo sapiens
caaccccactacacgttggaga

SEQ ID NO: 53658 - DNA, 22 bp, Homo sapiens
ccaggaggttgaggctgcagtg

SEQ ID NO: 53659 - DNA, 22 bp, Homo sapiens
ttctcccatctcagtcttacat

SEQ ID NO: 53660 - DNA, 22 bp, Homo sapiens
tgcactccaggctgggtgacag

SEQ ID NO: 53661 - DNA, 19 bp, Homo sapiens
tgaaggacagtgcacatca

SEQ ID NO: 53662 - DNA, 21 bp, Homo sapiens
caatggcgagatcttggctca

SEQ ID NO: 53663 - DNA, 22 bp, Homo sapiens
caagcgtggctgctctgatgga

SEQ ID NO: 53664 - DNA, 22 bp, Homo sapiens
agctggtgtgccagttccagtt

SEQ ID NO: 53665 - DNA, 22 bp, Homo sapiens
cctgggtttggagcctgcagaa

SEQ ID NO: 53666 - DNA, 22 bp, Homo sapiens
ggtccccgtggaggctggagcg

SEQ ID NO: 53667 - DNA, 22 bp, Homo sapiens
taattataacagttacatctta

SEQ ID NO: 53668 - DNA, 22 bp, Homo sapiens
agatttctgggcttcaccacct

SEQ ID NO: 53669 - DNA, 17 bp, Homo sapiens
tggctctgtcctcagct

SEQ ID NO: 53670 - DNA, 22 bp, Homo sapiens
gaggggctgccctggtgtcagg

SEQ ID NO: 53671 - DNA, 22 bp, Homo sapiens
gtcactcaggctggagttcagt

SEQ ID NO: 53672 - DNA, 20 bp, Homo sapiens
ggcagagggcctgggagaag

SEQ ID NO: 53673 - DNA, 22 bp, Homo sapiens
gaagaaggtggcccaggggtag

SEQ ID NO: 53674 - DNA, 22 bp, Homo sapiens
atacaaaaattagccgggagta

SEQ ID NO: 53675 - DNA, 22 bp, Homo sapiens
ctgtccctgagcaactcctgtt

SEQ ID NO: 53676 - DNA, 22 bp, Homo sapiens
atcctagaatcagcccttgctg

SEQ ID NO: 53677 - DNA, 22 bp, Homo sapiens
tcactgcaacctccacctcccg

SEQ ID NO: 53678 - DNA, 22 bp, Homo sapiens
ctgtggctcaggcctgtaagcc

SEQ ID NO: 53679 - DNA, 22 bp, Homo sapiens
gtggagaggaacccagctctgt

SEQ ID NO: 53680 - DNA, 22 bp, Homo sapiens
gccaggcgggtctcaaactcct

SEQ ID NO: 53681 - DNA, 22 bp, Homo sapiens
aggattgtgcctccagtcagaa

SEQ ID NO: 53682 - DNA, 22 bp, Homo sapiens
gcgagggcacgcggttgaaggc

SEQ ID NO: 53683 - DNA, 22 bp, Homo sapiens
agaggcagtatacaatccgagc

SEQ ID NO: 53684 - DNA, 22 bp, Homo sapiens
actgcactccagcctcggggtc

SEQ ID NO: 53685 - DNA, 22 bp, Homo sapiens
agagcccctgggtcacacagcc

SEQ ID NO: 53686 - DNA, 22 bp, Homo sapiens
agtggccagcagcctagcctag

SEQ ID NO: 53687 - DNA, 22 bp, Homo sapiens
gaggcagaagttgcagtgagca

SEQ ID NO: 53688 - DNA, 22 bp, Homo sapiens
agccaggatggtctcgatcggc

SEQ ID NO: 53689 - DNA, 21 bp, Homo sapiens
acagcctccatctcctgggct

SEQ ID NO: 53690 - DNA, 22 bp, Homo sapiens
tctcatggagtcaggagcagaa

SEQ ID NO: 53691 - DNA, 22 bp, Homo sapiens
atccccctcttggatggcggca

SEQ ID NO: 53692 - DNA, 22 bp, Homo sapiens
actgcaacctccgcctgccagg

SEQ ID NO: 53693 - DNA, 22 bp, Homo sapiens
ccaggaggcagaagttgcagtg

SEQ ID NO: 53694 - DNA, 22 bp, Homo sapiens
aggcaggaggatcatggatgca

SEQ ID NO: 53695 - DNA, 22 bp, Homo sapiens
gtgggctgcccttgaggtcagc

SEQ ID NO: 53696 - DNA, 22 bp, Homo sapiens
agggctggagccacagctggga

SEQ ID NO: 53697 - DNA, 22 bp, Homo sapiens
catgcctgtaatcccagcactt

SEQ ID NO: 53698 - DNA, 21 bp, Homo sapiens
gccatttcacacagacatttg

SEQ ID NO: 53699 - DNA, 22 bp, Homo sapiens
agctacagtcggaaggacagac

SEQ ID NO: 53700 - DNA, 22 bp, Homo sapiens
tgggcttggtttctaggtaggt

SEQ ID NO: 53701 - DNA, 22 bp, Homo sapiens
gctactgattgaccttggagag

SEQ ID NO: 53702 - DNA, 22 bp, Homo sapiens
agcccaggttgaggctgcagtg

SEQ ID NO: 53703 - DNA, 22 bp, Homo sapiens
aggcaaggtgctacagacagtg

SEQ ID NO: 53704 - DNA, 21 bp, Homo sapiens
tcacgtggtcacatgagcttt

SEQ ID NO: 53705 - DNA, 20 bp, Homo sapiens
tgttgattggtgtcatctca

SEQ ID NO: 53706 - DNA, 22 bp, Homo sapiens
cgctccttgagcgtgtcggcct

SEQ ID NO: 53707 - DNA, 22 bp, Homo sapiens
aactctatttaccctactaaac

SEQ ID NO: 53708 - DNA, 22 bp, Homo sapiens
cccagttgttgccggctctgga

SEQ ID NO: 53709 - DNA, 22 bp, Homo sapiens
gctcccaccttaaccttcacat

SEQ ID NO: 53710 - DNA, 22 bp, Homo sapiens
tgggtggcagcttcagcatgtt

SEQ ID NO: 53711 - DNA, 22 bp, Homo sapiens
ccaggaggcggaggttgcagcg

SEQ ID NO: 53712 - DNA, 22 bp, Homo sapiens
tgtggacgtcattaaagcagtg

SEQ ID NO: 53713 - DNA, 22 bp, Homo sapiens
atgccactgcacttcagcctgg

SEQ ID NO: 53714 - DNA, 22 bp, Homo sapiens
caggctggagtgcagtggcgct

SEQ ID NO: 53715 - DNA, 22 bp, Homo sapiens
ccagggtggcgtagatgctggg

SEQ ID NO: 53716 - DNA, 22 bp, Homo sapiens
caggaaggggctcactctggcc

SEQ ID NO: 53717 - DNA, 22 bp, Homo sapiens
tgggaagggtcaacagctggaa

SEQ ID NO: 53718 - DNA, 22 bp, Homo sapiens
gggaggcacgaggcgcgcagtg

SEQ ID NO: 53719 - DNA, 22 bp, Homo sapiens
caggaagctgtgaaggagacgg

SEQ ID NO: 53720 - DNA, 22 bp, Homo sapiens
aggtgacaggacaggagctggt

SEQ ID NO: 53721 - DNA, 22 bp, Homo sapiens
gaagattgaaggctgggaatta

SEQ ID NO: 53722 - DNA, 22 bp, Homo sapiens
agggaagaggaccagagtctct

SEQ ID NO: 53723 - DNA, 22 bp, Homo sapiens
ccaggaggcggaggttgcagtg

SEQ ID NO: 53724 - DNA, 22 bp, Homo sapiens
tctaaacttgtaaacaagcata

SEQ ID NO: 53725 - DNA, 22 bp, Homo sapiens
caggctggagttcagtggtgtg

SEQ ID NO: 53726 - DNA, 22 bp, Homo sapiens
tgtggccattcttgaggtcgac

SEQ ID NO: 53727 - DNA, 22 bp, Homo sapiens
tgtacacatggtgtacactccc

SEQ ID NO: 53728 - DNA, 22 bp, Homo sapiens
taatggttttttggagactgct

SEQ ID NO: 53729 - DNA, 22 bp, Homo sapiens
ccgaggctggagtgcagtggcg

SEQ ID NO: 53730 - DNA, 22 bp, Homo sapiens
ccaggctggagtatagtggcgc

SEQ ID NO: 53731 - DNA, 22 bp, Homo sapiens
caggtgttggaagggcagtggg

SEQ ID NO: 53732 - DNA, 22 bp, Homo sapiens
ggctgggcaggtctgcacaggg

SEQ ID NO: 53733 - DNA, 22 bp, Homo sapiens
aggagatggagctcagtgggca

SEQ ID NO: 53734 - DNA, 22 bp, Homo sapiens
ctgtggctctcagaggctgctg

SEQ ID NO: 53735 - DNA, 22 bp, Homo sapiens
ggcagggcaggaaagtcaggaa

SEQ ID NO: 53736 - DNA, 22 bp, Homo sapiens
tcaggaggtccgcccgggaggg

SEQ ID NO: 53737 - DNA, 23 bp, Homo sapiens
ccactagcacctgttcaacttct

SEQ ID NO: 53738 - DNA, 22 bp, Homo sapiens
aagtggactaatacaaggacta

SEQ ID NO: 53739 - DNA, 22 bp, Homo sapiens
gggagctggagctggaagactc

SEQ ID NO: 53740 - DNA, 22 bp, Homo sapiens
gcagactgtatcaatgtcagta

SEQ ID NO: 53741 - DNA, 22 bp, Homo sapiens
tatctatgtgctctgacctctc

SEQ ID NO: 53742 - DNA, 22 bp, Homo sapiens
actgcaacctccacctcctggg

SEQ ID NO: 53743 - DNA, 22 bp, Homo sapiens
gctatgggatgtgctgtggatg

SEQ ID NO: 53744 - DNA, 22 bp, Homo sapiens
tggtggggccagacttcagctc

SEQ ID NO: 53745 - DNA, 22 bp, Homo sapiens
tgagacgaagtcttgctctgtt

SEQ ID NO: 53746 - DNA, 22 bp, Homo sapiens
cccagcaggaggaggttgcagt

SEQ ID NO: 53747 - DNA, 22 bp, Homo sapiens
ggagaagaggagctggaagcct

SEQ ID NO: 53748 - DNA, 22 bp, Homo sapiens
acccagggctcaagcgtaggca

SEQ ID NO: 53749 - DNA, 22 bp, Homo sapiens
aggaatgtgaaacaggtggctg

SEQ ID NO: 53750 - DNA, 22 bp, Homo sapiens
tgaggcaggagaatcacatgaa

SEQ ID NO: 53751 - DNA, 22 bp, Homo sapiens
agctggtgctcggggagctggc

SEQ ID NO: 53752 - DNA, 22 bp, Homo sapiens
ctcactgcaacctctgcctccc

SEQ ID NO: 53753 - DNA, 20 bp, Homo sapiens
gggcagagccagccagtccc

SEQ ID NO: 53754 - DNA, 22 bp, Homo sapiens
tcatctaagagtcttacattta

SEQ ID NO: 53755 - DNA, 22 bp, Homo sapiens
ggctagggatctagaccaggac

SEQ ID NO: 53756 - DNA, 22 bp, Homo sapiens
cggctgggttcggctgcaggcc

SEQ ID NO: 53757 - DNA, 22 bp, Homo sapiens
ctgagcagatgaccagccccag

SEQ ID NO: 53758 - DNA, 22 bp, Homo sapiens
tgggcaggggccctgcttccgt

SEQ ID NO: 53759 - DNA, 17 bp, Homo sapiens
caggtgacctggtgatg

SEQ ID NO: 53760 - DNA, 22 bp, Homo sapiens
aggtggagaagagatgggcagt

SEQ ID NO: 53761 - DNA, 22 bp, Homo sapiens
gctgggctgcgtcggggaagcc

SEQ ID NO: 53762 - DNA, 23 bp, Homo sapiens
aaaacagcttcctccagtggctc

SEQ ID NO: 53763 - DNA, 22 bp, Homo sapiens
aggtggggaggagtgtctcttt

SEQ ID NO: 53764 - DNA, 22 bp, Homo sapiens
actgcaacacctcctgggttca

SEQ ID NO: 53765 - DNA, 22 bp, Homo sapiens
aggaggaagggaagacaagtaa

SEQ ID NO: 53766 - DNA, 22 bp, Homo sapiens
gccccagcctcccgagtagctg

SEQ ID NO: 53767 - DNA, 17 bp, Homo sapiens
gggcagggactcctggg

SEQ ID NO: 53768 - DNA, 22 bp, Homo sapiens
gggctgagacgatggggtcttc

SEQ ID NO: 53769 - DNA, 22 bp, Homo sapiens
gggttggatcctggtggctgcc

SEQ ID NO: 53770 - DNA, 22 bp, Homo sapiens
aggaattgtgttgtagtggaga

SEQ ID NO: 53771 - DNA, 22 bp, Homo sapiens
tgtagatatagaaaaagactga

SEQ ID NO: 53772 - DNA, 22 bp, Homo sapiens
tggcctcggcatccagcaagag

SEQ ID NO: 53773 - DNA, 22 bp, Homo sapiens
gccggggctggggagagacatg

SEQ ID NO: 53774 - DNA, 22 bp, Homo sapiens
ggggcaggagcccttcttcagc

SEQ ID NO: 53775 - DNA, 22 bp, Homo sapiens
tgggtactcctattagttcagt

SEQ ID NO: 53776 - DNA, 22 bp, Homo sapiens
tgattttctccattgtaaattc

SEQ ID NO: 53777 - DNA, 22 bp, Homo sapiens
ttgatcaaatcagctactgagg

SEQ ID NO: 53778 - DNA, 22 bp, Homo sapiens
ttggccatctaagcccagccac

SEQ ID NO: 53779 - DNA, 22 bp, Homo sapiens
taatggattaacgtccctgtcg

SEQ ID NO: 53780 - DNA, 22 bp, Homo sapiens
tgaggcaggagttcaggctgcg

SEQ ID NO: 53781 - DNA, 22 bp, Homo sapiens
ttgctttcccaaggcagaacat

SEQ ID NO: 53782 - DNA, 22 bp, Homo sapiens
tgggcagggagctggaaccaca

SEQ ID NO: 53783 - DNA, 22 bp, Homo sapiens
tgctgagcgcatccggcggccg

SEQ ID NO: 53784 - DNA, 22 bp, Homo sapiens
agggtggcactggtggctctat

SEQ ID NO: 53785 - DNA, 22 bp, Homo sapiens
cgggcaaggcgagactaggccc

SEQ ID NO: 53786 - DNA, 17 bp, Homo sapiens
caggtgttctgtttttc

SEQ ID NO: 53787 - DNA, 23 bp, Homo sapiens
cgcccagcctcagtgacctgggc

SEQ ID NO: 53788 - DNA, 22 bp, Homo sapiens
agcccaggctggagtgcagtgg

SEQ ID NO: 53789 - DNA, 22 bp, Homo sapiens
cagctgcccctccagggctggg

SEQ ID NO: 53790 - DNA, 22 bp, Homo sapiens
tggagggcatgctgtccatggg

SEQ ID NO: 53791 - DNA, 22 bp, Homo sapiens
tggcccgaagatccgagggtca

SEQ ID NO: 53792 - DNA, 22 bp, Homo sapiens
agggatggagtgcggcccggac

SEQ ID NO: 53793 - DNA, 22 bp, Homo sapiens
gtcactgtatccaggttccagc

SEQ ID NO: 53794 - DNA, 22 bp, Homo sapiens
tagcagcaaagcaggatctgct

SEQ ID NO: 53795 - DNA, 22 bp, Homo sapiens
agctggtgtgccagttccagtt

SEQ ID NO: 53796 - DNA, 22 bp, Homo sapiens
ctctggagtgtctggccagggt

SEQ ID NO: 53797 - DNA, 22 bp, Homo sapiens
gcagggcacaaggacgcacagg

SEQ ID NO: 53798 - DNA, 22 bp, Homo sapiens
ctggagggctgcagcgaggctg

SEQ ID NO: 53799 - DNA, 22 bp, Homo sapiens
gttcagtcacgtgcccaagttc

SEQ ID NO: 53800 - DNA, 22 bp, Homo sapiens
ctgggtggcagagcctgcagtg

SEQ ID NO: 53801 - DNA, 22 bp, Homo sapiens
ttgggctcaggagtttgagacc

SEQ ID NO: 53802 - DNA, 22 bp, Homo sapiens
ttaggctgttcttgtgttgtta

SEQ ID NO: 53803 - DNA, 22 bp, Homo sapiens
cccacacacatttatgatagga

SEQ ID NO: 53804 - DNA, 22 bp, Homo sapiens
agaaacgcctgtgaaattatct

SEQ ID NO: 53805 - DNA, 22 bp, Homo sapiens
tgagccagaggaggctgtgtgg

SEQ ID NO: 53806 - DNA, 22 bp, Homo sapiens
tgaggcaggaggttgagaactg

SEQ ID NO: 53807 - DNA, 22 bp, Homo sapiens
accactgcccatggtgaaaact

SEQ ID NO: 53808 - DNA, 22 bp, Homo sapiens
atgaggcaggagtgcagtggca

SEQ ID NO: 53809 - DNA, 22 bp, Homo sapiens
cacccaggctggagtgcagtga

SEQ ID NO: 53810 - DNA, 22 bp, Homo sapiens
cccaggctggagtgcagtggcg

SEQ ID NO: 53811 - DNA, 20 bp, Homo sapiens
aagacaccagtggcagcccc

SEQ ID NO: 53812 - DNA, 22 bp, Homo sapiens
ctacccttaagtttctgtgggg

SEQ ID NO: 53813 - DNA, 22 bp, Homo sapiens
gagggtggtggcttaaggtgct

SEQ ID NO: 53814 - DNA, 22 bp, Homo sapiens
gggtggtggccagcagtgggca

SEQ ID NO: 53815 - DNA, 22 bp, Homo sapiens
atggcagaatatctgcatcgca

SEQ ID NO: 53816 - DNA, 22 bp, Homo sapiens
aaggaggttatcccagtggact

SEQ ID NO: 53817 - DNA, 22 bp, Homo sapiens
ggaggagcatgagagggtagtg

SEQ ID NO: 53818 - DNA, 22 bp, Homo sapiens
ctaggctggagtgcagtggcac

SEQ ID NO: 53819 - DNA, 22 bp, Homo sapiens
cagtgagctcatggccaagtca

SEQ ID NO: 53820 - DNA, 22 bp, Homo sapiens
ggaggaggggtgactgaatgct

SEQ ID NO: 53821 - DNA, 22 bp, Homo sapiens
gaggtaggtgtaggaggcctgc

SEQ ID NO: 53822 - DNA, 22 bp, Homo sapiens
tcttaagcagagaagaagttga

SEQ ID NO: 53823 - DNA, 22 bp, Homo sapiens
caggctggagtgcagtggcgcc

SEQ ID NO: 53824 - DNA, 22 bp, Homo sapiens
ccaaccattggctaagaattgg

SEQ ID NO: 53825 - DNA, 22 bp, Homo sapiens
gggccggagctgggtcccgcgc

SEQ ID NO: 53826 - DNA, 17 bp, Homo sapiens
cactagtagtctctggc

SEQ ID NO: 53827 - DNA, 19 bp, Homo sapiens
gcctcatttccacctcccc

SEQ ID NO: 53828 - DNA, 22 bp, Homo sapiens
aactgctgacaagtgaccagtg

SEQ ID NO: 53829 - DNA, 22 bp, Homo sapiens
aactcactttgtggcttctgaa

SEQ ID NO: 53830 - DNA, 22 bp, Homo sapiens
tcactgcaacctccacctcccg

SEQ ID NO: 53831 - DNA, 22 bp, Homo sapiens
tgaacatgctgttgatggcctg

SEQ ID NO: 53832 - DNA, 22 bp, Homo sapiens
tgaggcaggagaatcaccggaa

SEQ ID NO: 53833 - DNA, 22 bp, Homo sapiens
taggcatgcaaataaatgtgca

SEQ ID NO: 53834 - DNA, 22 bp, Homo sapiens
ctgggaggtggaggttgcattg

SEQ ID NO: 53835 - DNA, 20 bp, Homo sapiens
aggccccaggtggacactag

SEQ ID NO: 53836 - DNA, 20 bp, Homo sapiens
ctgggtggcaagcaaggggg

SEQ ID NO: 53837 - DNA, 22 bp, Homo sapiens
ctcggcaggtggaggttgtagt

SEQ ID NO: 53838 - DNA, 22 bp, Homo sapiens
ccagaaaaatcctcccttgtcc

SEQ ID NO: 53839 - DNA, 23 bp, Homo sapiens
agcagccagagatcctcggccct

SEQ ID NO: 53840 - DNA, 22 bp, Homo sapiens
ctgaggctggagtgcagtggtg

SEQ ID NO: 53841 - DNA, 22 bp, Homo sapiens
ccaggctggagtgcagtggcac

SEQ ID NO: 53842 - DNA, 22 bp, Homo sapiens
ccaggaggtggaggttgcggtg

SEQ ID NO: 53843 - DNA, 22 bp, Homo sapiens
gggcaggaacaaatcaaatgat

SEQ ID NO: 53844 - DNA, 22 bp, Homo sapiens
gggagtgggtttggcctaggcc

SEQ ID NO: 53845 - DNA, 22 bp, Homo sapiens
gggctgcatcagcaggacccgg

SEQ ID NO: 53846 - DNA, 22 bp, Homo sapiens
ttgaggtccccagtacccactg

SEQ ID NO: 53847 - DNA, 22 bp, Homo sapiens
gcccaggctggagtgcagtggt

SEQ ID NO: 53848 - DNA, 22 bp, Homo sapiens
gccaggttgctgacgacgatct

SEQ ID NO: 53849 - DNA, 22 bp, Homo sapiens
ccaggaggcggaaggtacagtg

SEQ ID NO: 53850 - DNA, 22 bp, Homo sapiens
aagttactggcaagggctgcag

SEQ ID NO: 53851 - DNA, 22 bp, Homo sapiens
cccgactagctgggattacagg

SEQ ID NO: 53852 - DNA, 22 bp, Homo sapiens
atcacccaggctggagtgcagt

SEQ ID NO: 53853 - DNA, 21 bp, Homo sapiens
aaggacgaggttttgattaca

SEQ ID NO: 53854 - DNA, 22 bp, Homo sapiens
cccagcagtagagctcatatgg

SEQ ID NO: 53855 - DNA, 23 bp, Homo sapiens
aatggtcttcctccacccctctg

SEQ ID NO: 53856 - DNA, 22 bp, Homo sapiens
cagcccgccctgaactttcggg

SEQ ID NO: 53857 - DNA, 22 bp, Homo sapiens
cgcccaggctggagtgcagtgg

SEQ ID NO: 53858 - DNA, 22 bp, Homo sapiens
agctgctgagccaggctgatgt

SEQ ID NO: 53859 - DNA, 22 bp, Homo sapiens
gaggggctgccctggtgtcagg

SEQ ID NO: 53860 - DNA, 22 bp, Homo sapiens
caggaaggcgcggctgtgcctg

SEQ ID NO: 53861 - DNA, 22 bp, Homo sapiens
atacagggacatccagtttttc

SEQ ID NO: 53862 - DNA, 22 bp, Homo sapiens
tcttcccccgtgctccagtgca

SEQ ID NO: 53863 - DNA, 23 bp, Homo sapiens
tgcatggggctatactgctgttc

SEQ ID NO: 53864 - DNA, 22 bp, Homo sapiens
gggcatggtggcaggcacctgt

SEQ ID NO: 53865 - DNA, 22 bp, Homo sapiens
actgccaatggtagtttgatgg

SEQ ID NO: 53866 - DNA, 22 bp, Homo sapiens
tgagatcattgacttgttcctg

SEQ ID NO: 53867 - DNA, 22 bp, Homo sapiens
tgctcgccccacatgccctcat

SEQ ID NO: 53868 - DNA, 22 bp, Homo sapiens
taggtttactgaattagtggaa

SEQ ID NO: 53869 - DNA, 22 bp, Homo sapiens
ctcccagccttcgccagtctga

SEQ ID NO: 53870 - DNA, 18 bp, Homo sapiens
catgggtgacaggtggat

SEQ ID NO: 53871 - DNA, 22 bp, Homo sapiens
atgtgtattacctcgattgtga

SEQ ID NO: 53872 - DNA, 22 bp, Homo sapiens
aggatttctgtgcctggaaaat

SEQ ID NO: 53873 - DNA, 22 bp, Homo sapiens
ctgaggagaggtggcctgtgtt

SEQ ID NO: 53874 - DNA, 21 bp, Homo sapiens
gctgctcgagatccagtgctt

SEQ ID NO: 53875 - DNA, 20 bp, Homo sapiens
caaatccctgctctgtgctg

SEQ ID NO: 53876 - DNA, 22 bp, Homo sapiens
agtgaatgtccccgcgggtcag

SEQ ID NO: 53877 - DNA, 22 bp, Homo sapiens
gcccgcgccagcctctccatct

SEQ ID NO: 53878 - DNA, 22 bp, Homo sapiens
gcctgtgtctgggtggccagag

SEQ ID NO: 53879 - DNA, 22 bp, Homo sapiens
agaggctgcacttgctcatgat

SEQ ID NO: 53880 - DNA, 21 bp, Homo sapiens
gcccacagtgaggaggatccc

SEQ ID NO: 53881 - DNA, 22 bp, Homo sapiens
ggagtgactctcggggccacta

SEQ ID NO: 53882 - DNA, 22 bp, Homo sapiens
tggcacgacaattggcaccaat

SEQ ID NO: 53883 - DNA, 22 bp, Homo sapiens
cgagagttagctaggagtcaca

SEQ ID NO: 53884 - DNA, 22 bp, Homo sapiens
tcaggaggcggaggttgcagtg

SEQ ID NO: 53885 - DNA, 20 bp, Homo sapiens
ggcagagggcctgggagaag

SEQ ID NO: 53886 - DNA, 22 bp, Homo sapiens
gttgaaatcctaaccccctagt

SEQ ID NO: 53887 - DNA, 22 bp, Homo sapiens
aggctcagatccttgtgtcctg

SEQ ID NO: 53888 - DNA, 21 bp, Homo sapiens
cagggccaatcctgacctcta

SEQ ID NO: 53889 - DNA, 22 bp, Homo sapiens
caggctggagtgcagtggtgcc

SEQ ID NO: 53890 - DNA, 22 bp, Homo sapiens
gaatgcagatggctggtgtatg

SEQ ID NO: 53891 - DNA, 23 bp, Homo sapiens
ggctgggagctccgggtgcacgt

SEQ ID NO: 53892 - DNA, 22 bp, Homo sapiens
gaggcagaggttgcagtgagct

SEQ ID NO: 53893 - DNA, 22 bp, Homo sapiens
aatttcggttcaaggcccagtt

SEQ ID NO: 53894 - DNA, 22 bp, Homo sapiens
actttatttcctattgcatcca

SEQ ID NO: 53895 - DNA, 16 bp, Homo sapiens
atgctgctattagagg

SEQ ID NO: 53896 - DNA, 22 bp, Homo sapiens
tgctcattggcgatctgaggga

SEQ ID NO: 53897 - DNA, 22 bp, Homo sapiens
ggggctgaacctggaggtggtc

SEQ ID NO: 53898 - DNA, 22 bp, Homo sapiens
aagtggcagttcaggaagcaga

SEQ ID NO: 53899 - DNA, 22 bp, Homo sapiens
cactgcaacctccacctcctgg

SEQ ID NO: 53900 - DNA, 22 bp, Homo sapiens
aagcgccatggttcctgcgcag

SEQ ID NO: 53901 - DNA, 22 bp, Homo sapiens
cgtcccgggttcacgccattct

SEQ ID NO: 53902 - DNA, 22 bp, Homo sapiens
ccaggaggtggagattgcagtg

SEQ ID NO: 53903 - DNA, 22 bp, Homo sapiens
tggaggctggagtgcagtggcg

SEQ ID NO: 53904 - DNA, 22 bp, Homo sapiens
cagggccagcgtctcgggctat

SEQ ID NO: 53905 - DNA, 22 bp, Homo sapiens
agatttatgtggtcacactcag

SEQ ID NO: 53906 - DNA, 22 bp, Homo sapiens
tggaatgtcagctacaagaggg

SEQ ID NO: 53907 - DNA, 22 bp, Homo sapiens
ctcattgcccagatccccacag

SEQ ID NO: 53908 - DNA, 22 bp, Homo sapiens
tgttgactcaacactgtgggca

SEQ ID NO: 53909 - DNA, 22 bp, Homo sapiens
tcactgcaacctccacctcctg

SEQ ID NO: 53910 - DNA, 22 bp, Homo sapiens
gggcaggggtcagtggccccaa

SEQ ID NO: 53911 - DNA, 22 bp, Homo sapiens
acaggggacctaggaccctcgg

SEQ ID NO: 53912 - DNA, 22 bp, Homo sapiens
gggctagcctcttccctgctcc

SEQ ID NO: 53913 - DNA, 22 bp, Homo sapiens
aggaggggttctcgggtgctga

SEQ ID NO: 53914 - DNA, 22 bp, Homo sapiens
ccaggaggttgaggctgcagtg

SEQ ID NO: 53915 - DNA, 22 bp, Homo sapiens
aaggctgaggcagtgaggcaga

SEQ ID NO: 53916 - DNA, 22 bp, Homo sapiens
ggtcacacaccaggacctgcag

SEQ ID NO: 53917 - DNA, 21 bp, Homo sapiens
ggtgctcgctgatgaggagtg

SEQ ID NO: 53918 - DNA, 22 bp, Homo sapiens
caatagtgtctgcttgtttcta

SEQ ID NO: 53919 - DNA, 22 bp, Homo sapiens
catggggcccatgtgctccaag

SEQ ID NO: 53920 - DNA, 22 bp, Homo sapiens
atttaagggatttggagaccaa

SEQ ID NO: 53921 - DNA, 22 bp, Homo sapiens
aggaatggtgctcagcagaaat

SEQ ID NO: 53922 - DNA, 22 bp, Homo sapiens
caggaggttgagggtgcagtga

SEQ ID NO: 53923 - DNA, 22 bp, Homo sapiens
ctcactgcaagctctgcctcca

SEQ ID NO: 53924 - DNA, 22 bp, Homo sapiens
ggaatcgttaggtaagcaggga

SEQ ID NO: 53925 - DNA, 22 bp, Homo sapiens
gggcttggcacatgggctcagc

SEQ ID NO: 53926 - DNA, 22 bp, Homo sapiens
gaggtgctgctgtacttcttgc

SEQ ID NO: 53927 - DNA, 21 bp, Homo sapiens
aggtgctggcgccccaggaga

SEQ ID NO: 53928 - DNA, 22 bp, Homo sapiens
gggccatgagaggttcatcaac

SEQ ID NO: 53929 - DNA, 22 bp, Homo sapiens
gggtccagtagttggtggccgt

SEQ ID NO: 53930 - DNA, 22 bp, Homo sapiens
gaagaaggtggcccaggggtag

SEQ ID NO: 53931 - DNA, 22 bp, Homo sapiens
tgtgttgtgacattcttggatg

SEQ ID NO: 53932 - DNA, 22 bp, Homo sapiens
tcgcccaggctggaagtgcagt

SEQ ID NO: 53933 - DNA, 22 bp, Homo sapiens
gaggaggcttccgggaggcacg

SEQ ID NO: 53934 - DNA, 22 bp, Homo sapiens
agaggaagtaatcaggacctgc

SEQ ID NO: 53935 - DNA, 22 bp, Homo sapiens
cacccaggctggagtgcagtgg

SEQ ID NO: 53936 - DNA, 22 bp, Homo sapiens
ctgggcagctgtatcagggagt

SEQ ID NO: 53937 - DNA, 22 bp, Homo sapiens
ggcaaggggtcaggctgagaca

SEQ ID NO: 53938 - DNA, 18 bp, Homo sapiens
cccggctaatttttggta

SEQ ID NO: 53939 - DNA, 22 bp, Homo sapiens
agggccagcactcctggcagga

SEQ ID NO: 53940 - DNA, 22 bp, Homo sapiens
tgaggcaggtggattacaaggt

SEQ ID NO: 53941 - DNA, 22 bp, Homo sapiens
tagactagaggatcagcaaggg

SEQ ID NO: 53942 - DNA, 22 bp, Homo sapiens
agaaaacataggagacaggaaa

SEQ ID NO: 53943 - DNA, 22 bp, Homo sapiens
catttacatttaaggttaatat

SEQ ID NO: 53944 - DNA, 22 bp, Homo sapiens
gaggtggccaagcgaggaaggg

SEQ ID NO: 53945 - DNA, 22 bp, Homo sapiens
gacctcatgatccacctgcctt

SEQ ID NO: 53946 - DNA, 22 bp, Homo sapiens
ggagtgactcacagctgggaca

SEQ ID NO: 53947 - DNA, 19 bp, Homo sapiens
ccagagagctaggtacaga

SEQ ID NO: 53948 - DNA, 22 bp, Homo sapiens
tctaccctgcggtcttggggca

SEQ ID NO: 53949 - DNA, 22 bp, Homo sapiens
ttatatgtttctgtttggaggc

SEQ ID NO: 53950 - DNA, 22 bp, Homo sapiens
cgggttcacgccattctcctgc

SEQ ID NO: 53951 - DNA, 22 bp, Homo sapiens
ttgagcccaggaggcctgggtg

SEQ ID NO: 53952 - DNA, 22 bp, Homo sapiens
gcagaggacacaggagggcaag

SEQ ID NO: 53953 - DNA, 22 bp, Homo sapiens
tggcacaggatctcagcggcca

SEQ ID NO: 53954 - DNA, 22 bp, Homo sapiens
aggatgagccgcgcaagctgac

SEQ ID NO: 53955 - DNA, 22 bp, Homo sapiens
gcagcgaggtgatgaaatagct

SEQ ID NO: 53956 - DNA, 22 bp, Homo sapiens
gctggtgagcaaaggagaagga

SEQ ID NO: 53957 - DNA, 19 bp, Homo sapiens
ccacagcctgctgtcttcc

SEQ ID NO: 53958 - DNA, 22 bp, Homo sapiens
agaggcaggaggttgacttgag

SEQ ID NO: 53959 - DNA, 22 bp, Homo sapiens
gctggaggatggactggaagaa

SEQ ID NO: 53960 - DNA, 22 bp, Homo sapiens
agatacattgttctaagcattg

SEQ ID NO: 53961 - DNA, 22 bp, Homo sapiens
gcttggaagtaggattgggaga

SEQ ID NO: 53962 - DNA, 22 bp, Homo sapiens
agaagccaccagctgaggaaga

SEQ ID NO: 53963 - DNA, 22 bp, Homo sapiens
tgtggcacatacacaggagggc

SEQ ID NO: 53964 - DNA, 22 bp, Homo sapiens
tgagcccagagatctgagctat

SEQ ID NO: 53965 - DNA, 22 bp, Homo sapiens
ggcatcttgttgctcaaatcta

SEQ ID NO: 53966 - DNA, 22 bp, Homo sapiens
agaggaggctctgggatcgtcc

SEQ ID NO: 53967 - DNA, 22 bp, Homo sapiens
cacccaggctggagagcagtgg

SEQ ID NO: 53968 - DNA, 22 bp, Homo sapiens
gcaggcagaggtggaggagaca

SEQ ID NO: 53969 - DNA, 22 bp, Homo sapiens
gcccagctgcaccctggtgggt

SEQ ID NO: 53970 - DNA, 21 bp, Homo sapiens
gccagcggccgccctccagga

SEQ ID NO: 53971 - DNA, 22 bp, Homo sapiens
cgtgagcaaaatggacactccc

SEQ ID NO: 53972 - DNA, 22 bp, Homo sapiens
ctagttgaagaggctgtcatca

SEQ ID NO: 53973 - DNA, 22 bp, Homo sapiens
taggaatggtgctcagcagaaa

SEQ ID NO: 53974 - DNA, 22 bp, Homo sapiens
ggcgggaagttcttgcccactt

SEQ ID NO: 53975 - DNA, 22 bp, Homo sapiens
ttgttgtcattgtagaggattt

SEQ ID NO: 53976 - DNA, 22 bp, Homo sapiens
tcacagcctggacagttgcctg

SEQ ID NO: 53977 - DNA, 22 bp, Homo sapiens
gaccttgtgatctgcctgcctt

SEQ ID NO: 53978 - DNA, 22 bp, Homo sapiens
agggaagaaaatccatcgctgc

SEQ ID NO: 53979 - DNA, 22 bp, Homo sapiens
ggccgtgctccaaagtcatcgt

SEQ ID NO: 53980 - DNA, 22 bp, Homo sapiens
cgcccaggctggagagcagtgg

SEQ ID NO: 53981 - DNA, 22 bp, Homo sapiens
atgccactgcacttcagcttgg

SEQ ID NO: 53982 - DNA, 22 bp, Homo sapiens
gataccagacagggagggagaa

SEQ ID NO: 53983 - DNA, 22 bp, Homo sapiens
ggcctggcagagcgcgcggctg

SEQ ID NO: 53984 - DNA, 22 bp, Homo sapiens
acctggacacctgctgtcatct

SEQ ID NO: 53985 - DNA, 22 bp, Homo sapiens
ctggcaggttatagagctgccc

SEQ ID NO: 53986 - DNA, 22 bp, Homo sapiens
tctcgctctgtcgcccaggctg

SEQ ID NO: 53987 - DNA, 17 bp, Homo sapiens
tgtagcttctccttctc

SEQ ID NO: 53988 - DNA, 22 bp, Homo sapiens
gggaatgtagcaaatctgcaat

SEQ ID NO: 53989 - DNA, 19 bp, Homo sapiens
atgtacccagtgtcaatcc

SEQ ID NO: 53990 - DNA, 22 bp, Homo sapiens
ccaggctggagtgcaatggcat

SEQ ID NO: 53991 - DNA, 22 bp, Homo sapiens
cctgggaggctgaggctgcagt

SEQ ID NO: 53992 - DNA, 22 bp, Homo sapiens
agtggtcttagcttgctgggct

SEQ ID NO: 53993 - DNA, 22 bp, Homo sapiens
tcaccgaggctggagtgcagtg

SEQ ID NO: 53994 - DNA, 22 bp, Homo sapiens
caaagggaaaagccatgtgggc

SEQ ID NO: 53995 - DNA, 22 bp, Homo sapiens
ggagtgcagtggtgggatctca

SEQ ID NO: 53996 - DNA, 22 bp, Homo sapiens
gtggcccaggttggagtgcagt

SEQ ID NO: 53997 - DNA, 22 bp, Homo sapiens
tgaggcaggacttgcataaagt

SEQ ID NO: 53998 - DNA, 22 bp, Homo sapiens
gtgggccactgggaggcaaggg

SEQ ID NO: 53999 - DNA, 22 bp, Homo sapiens
aactcaaagatgcatgacgctt

SEQ ID NO: 54000 - DNA, 22 bp, Homo sapiens
gcccaggctggagtgcagtggc

SEQ ID NO: 54001 - DNA, 23 bp, Homo sapiens
tactatggttattatccctctcc

SEQ ID NO: 54002 - DNA, 22 bp, Homo sapiens
tgatcaaaacattactccacca

SEQ ID NO: 54003 - DNA, 22 bp, Homo sapiens
attacctatttcattttctgtc

SEQ ID NO: 54004 - DNA, 22 bp, Homo sapiens
ccaccgccatggcgttgtacag

SEQ ID NO: 54005 - DNA, 22 bp, Homo sapiens
ctgtcctggggaaagccagccc

SEQ ID NO: 54006 - DNA, 22 bp, Homo sapiens
cttaatctcacctgcaaagtcc

SEQ ID NO: 54007 - DNA, 22 bp, Homo sapiens
atttacaggtagaattttaagt

SEQ ID NO: 54008 - DNA, 22 bp, Homo sapiens
ttagaggaaagactgggactaa

SEQ ID NO: 54009 - DNA, 22 bp, Homo sapiens
cccaggcttttctcttgcccca

SEQ ID NO: 54010 - DNA, 22 bp, Homo sapiens
tcccccaggctggagtgcagtg

SEQ ID NO: 54011 - DNA, 22 bp, Homo sapiens
gaggcagaggttgttgcagtga

SEQ ID NO: 54012 - DNA, 22 bp, Homo sapiens
tgaagactcagaagctaagata

SEQ ID NO: 54013 - DNA, 22 bp, Homo sapiens
ctggagagaatgtggaatgatt

SEQ ID NO: 54014 - DNA, 22 bp, Homo sapiens
ggggtgggcgtgcagggacacc

SEQ ID NO: 54015 - DNA, 22 bp, Homo sapiens
gcaactgaacatgtgtgtggcc

SEQ ID NO: 54016 - DNA, 22 bp, Homo sapiens
agccagggtctctcgctctgtt

SEQ ID NO: 54017 - DNA, 22 bp, Homo sapiens
tacagcctggcactaccctggg

SEQ ID NO: 54018 - DNA, 22 bp, Homo sapiens
tgagccaggagtttgaggctgt

SEQ ID NO: 54019 - DNA, 22 bp, Homo sapiens
gggcagagactcagaaacagaa

SEQ ID NO: 54020 - DNA, 22 bp, Homo sapiens
ggctgtggcagctggaagtggt

SEQ ID NO: 54021 - DNA, 18 bp, Homo sapiens
cagggctgtggggtcact

SEQ ID NO: 54022 - DNA, 22 bp, Homo sapiens
gacaggaggcagagctcaggtg

SEQ ID NO: 54023 - DNA, 22 bp, Homo sapiens
gggaagagggagctggaatgat

SEQ ID NO: 54024 - DNA, 22 bp, Homo sapiens
ggggccgaccgcggttcaggcc

SEQ ID NO: 54025 - DNA, 22 bp, Homo sapiens
ggcctcgcggcttctggtggct

SEQ ID NO: 54026 - DNA, 16 bp, Homo sapiens
aggctcagaggctgga

SEQ ID NO: 54027 - DNA, 22 bp, Homo sapiens
ctcagcactgacccaggagatg

SEQ ID NO: 54028 - DNA, 20 bp, Homo sapiens
atcaggtgttcagccactgc

SEQ ID NO: 54029 - DNA, 22 bp, Homo sapiens
gtggattacaagacagttgaga

SEQ ID NO: 54030 - DNA, 22 bp, Homo sapiens
tgaactcctgacctcatgatcc

SEQ ID NO: 54031 - DNA, 21 bp, Homo sapiens
caatggcgagatcttggctca

SEQ ID NO: 54032 - DNA, 22 bp, Homo sapiens
ttactttaagggtgtcttatta

SEQ ID NO: 54033 - DNA, 22 bp, Homo sapiens
tggtattctttctgtagatcat

SEQ ID NO: 54034 - DNA, 22 bp, Homo sapiens
tgagtgaggctgggcagtccct

SEQ ID NO: 54035 - DNA, 22 bp, Homo sapiens
gccatgcttggtatgctgtgag

SEQ ID NO: 54036 - DNA, 22 bp, Homo sapiens
agccacacagcttaatgacaga

SEQ ID NO: 54037 - DNA, 22 bp, Homo sapiens
catgggtaagactcttttgccc

SEQ ID NO: 54038 - DNA, 22 bp, Homo sapiens
ggaggcagaatagagtgtgggt

SEQ ID NO: 54039 - DNA, 22 bp, Homo sapiens
tgaggcaggaggattgcaggat

SEQ ID NO: 54040 - DNA, 22 bp, Homo sapiens
tctacatgcagcgaggggactt

SEQ ID NO: 54041 - DNA, 22 bp, Homo sapiens
agtgggtgacagtgaacacgta

SEQ ID NO: 54042 - DNA, 22 bp, Homo sapiens
ggcaggaacacagatggtgccg

SEQ ID NO: 54043 - DNA, 22 bp, Homo sapiens
ctcactgcaagctctgcctccc

SEQ ID NO: 54044 - DNA, 22 bp, Homo sapiens
gtggcagagccaaggctggagc

SEQ ID NO: 54045 - DNA, 22 bp, Homo sapiens
aatgttgcagagtgattgtcca

SEQ ID NO: 54046 - DNA, 22 bp, Homo sapiens
gcaggcagatcacctgtcagga

SEQ ID NO: 54047 - DNA, 22 bp, Homo sapiens
cggggccctggggctgaaggtc

SEQ ID NO: 54048 - DNA, 22 bp, Homo sapiens
ctcattgcaacctccgcctccc

SEQ ID NO: 54049 - DNA, 22 bp, Homo sapiens
cagtgcagccaaggacaggcac

SEQ ID NO: 54050 - DNA, 22 bp, Homo sapiens
acagcagcaatagcagtgacat

SEQ ID NO: 54051 - DNA, 22 bp, Homo sapiens
gcaggaggttgagccaggactg

SEQ ID NO: 54052 - DNA, 22 bp, Homo sapiens
aatggcactttataaatgttaa

SEQ ID NO: 54053 - DNA, 22 bp, Homo sapiens
ctggcaggtggaggttgcagtg

SEQ ID NO: 54054 - DNA, 22 bp, Homo sapiens
gtggcccaggctggagtgcagt

SEQ ID NO: 54055 - DNA, 22 bp, Homo sapiens
ccaggctagaaactgaggcaca

SEQ ID NO: 54056 - DNA, 22 bp, Homo sapiens
gagccaagattgtgtccctgca

SEQ ID NO: 54057 - DNA, 22 bp, Homo sapiens
taggtttaggagtgaaggtgaa

SEQ ID NO: 54058 - DNA, 22 bp, Homo sapiens
gctgtggcctggcgcagagctg

SEQ ID NO: 54059 - DNA, 22 bp, Homo sapiens
gatctggaatctgaaggctgag

SEQ ID NO: 54060 - DNA, 22 bp, Homo sapiens
ggaggtgggctaaggactctct

SEQ ID NO: 54061 - DNA, 19 bp, Homo sapiens
gggcttggggctgaagcct

SEQ ID NO: 54062 - DNA, 22 bp, Homo sapiens
atgcagtggcttcagtgtcagt

SEQ ID NO: 54063 - DNA, 18 bp, Homo sapiens
ggtgagggagctggaagc

SEQ ID NO: 54064 - DNA, 22 bp, Homo sapiens
gcacggctaatttttgtatttt

SEQ ID NO: 54065 - DNA, 22 bp, Homo sapiens
aggagctgtcagagtgccagag

SEQ ID NO: 54066 - DNA, 22 bp, Homo sapiens
gtgtgggctgcagaggcacagc

SEQ ID NO: 54067 - DNA, 22 bp, Homo sapiens
cagggccagggacacgctgtca

SEQ ID NO: 54068 - DNA, 22 bp, Homo sapiens
ccctggaggttgaggctgcagt

SEQ ID NO: 54069 - DNA, 22 bp, Homo sapiens
ccaggcaggcgatggtgcagtg

SEQ ID NO: 54070 - DNA, 22 bp, Homo sapiens
gctgtgcagaggtgagaatcca

SEQ ID NO: 54071 - DNA, 22 bp, Homo sapiens
atcacccaagctggagtgcagt

SEQ ID NO: 54072 - DNA, 23 bp, Homo sapiens
tgaggcaggcggatcacgaggtc

SEQ ID NO: 54073 - DNA, 22 bp, Homo sapiens
gcccagcacctctctcagggtt

SEQ ID NO: 54074 - DNA, 22 bp, Homo sapiens
tgggaaggggagctggaaagga

SEQ ID NO: 54075 - DNA, 22 bp, Homo sapiens
gccgggttcaagccattctcct

SEQ ID NO: 54076 - DNA, 22 bp, Homo sapiens
cacccaggttggagtgcagtgg

SEQ ID NO: 54077 - DNA, 22 bp, Homo sapiens
tcagggattgcaaaattcatcc

SEQ ID NO: 54078 - DNA, 22 bp, Homo sapiens
gcccaggctggagttcagtggt

SEQ ID NO: 54079 - DNA, 22 bp, Homo sapiens
gttggccttgaggtggtagagt

SEQ ID NO: 54080 - DNA, 22 bp, Homo sapiens
tgatgaccgccaacgtttaggt

SEQ ID NO: 54081 - DNA, 22 bp, Homo sapiens
ccaggctggagtgcaatggcgt

SEQ ID NO: 54082 - DNA, 22 bp, Homo sapiens
gtggggtagatctttctcagga

SEQ ID NO: 54083 - DNA, 22 bp, Homo sapiens
cgcccaggctggagtgcagtga

SEQ ID NO: 54084 - DNA, 22 bp, Homo sapiens
gaggtgggtgtatcacaggtca

SEQ ID NO: 54085 - DNA, 22 bp, Homo sapiens
gccagtggtcactgaggaagaa

SEQ ID NO: 54086 - DNA, 22 bp, Homo sapiens
tccgccaggactgagggcccat

SEQ ID NO: 54087 - DNA, 22 bp, Homo sapiens
tgaaggggttcagcatgggggt

SEQ ID NO: 54088 - DNA, 22 bp, Homo sapiens
ctctcgccagcggggctgcgct

SEQ ID NO: 54089 - DNA, 18 bp, Homo sapiens
tgtccctgcaaataacat

SEQ ID NO: 54090 - DNA, 22 bp, Homo sapiens
aggaggggttctcgggtgctga

SEQ ID NO: 54091 - DNA, 22 bp, Homo sapiens
gctggccacagatccccaggga

SEQ ID NO: 54092 - DNA, 22 bp, Homo sapiens
gcggcggagacagcaggaagcc

SEQ ID NO: 54093 - DNA, 22 bp, Homo sapiens
aactatgttaataagtttcatt

SEQ ID NO: 54094 - DNA, 22 bp, Homo sapiens
aatgtattcttcaaccttgcta

SEQ ID NO: 54095 - DNA, 22 bp, Homo sapiens
ctcgggcaccctggttctggtg

SEQ ID NO: 54096 - DNA, 22 bp, Homo sapiens
gctgcgccggatcccacgttcc

SEQ ID NO: 54097 - DNA, 22 bp, Homo sapiens
ggaggcagaatagagtgtgggt

SEQ ID NO: 54098 - DNA, 22 bp, Homo sapiens
tgagcaggcgcagcaggaggtc

SEQ ID NO: 54099 - DNA, 22 bp, Homo sapiens
caggaaggcgcggctgtgcctg

SEQ ID NO: 54100 - DNA, 19 bp, Homo sapiens
aggaatggaattaattctg

SEQ ID NO: 54101 - DNA, 22 bp, Homo sapiens
aggtggggaggagtgtctcttt

SEQ ID NO: 54102 - DNA, 22 bp, Homo sapiens
gctttatccgcttgacccttac

SEQ ID NO: 54103 - DNA, 22 bp, Homo sapiens
acaaggcactttatgaagagga

SEQ ID NO: 54104 - DNA, 22 bp, Homo sapiens
tatctatgtgctctgacctctc

SEQ ID NO: 54105 - DNA, 22 bp, Homo sapiens
aagtcgtcgaagatggaggttg

SEQ ID NO: 54106 - DNA, 22 bp, Homo sapiens
tgagatgtaaggtatgcttact

SEQ ID NO: 54107 - DNA, 22 bp, Homo sapiens
gggaacagcttgggctctgcca

SEQ ID NO: 54108 - DNA, 22 bp, Homo sapiens
agcataagttggtacagccact

SEQ ID NO: 54109 - DNA, 22 bp, Homo sapiens
ggaaggggtgggtgagcctcag

SEQ ID NO: 54110 - DNA, 21 bp, Homo sapiens
tgaaggggtggcagtgtgctt

SEQ ID NO: 54111 - DNA, 22 bp, Homo sapiens
ccacgtccagctaattttcgta

SEQ ID NO: 54112 - DNA, 22 bp, Homo sapiens
gcggcccgagcaggacgggtgg

SEQ ID NO: 54113 - DNA, 22 bp, Homo sapiens
ggagtagctgcattccgagcac

SEQ ID NO: 54114 - DNA, 22 bp, Homo sapiens
gacgagagactccatccaccac

SEQ ID NO: 54115 - DNA, 22 bp, Homo sapiens
agctgccgatgcccagctgcat

SEQ ID NO: 54116 - DNA, 22 bp, Homo sapiens
tgttatctgagcaacgtcgacg

SEQ ID NO: 54117 - DNA, 22 bp, Homo sapiens
ggccctggtcctaggggtggaa

SEQ ID NO: 54118 - DNA, 22 bp, Homo sapiens
actttatttcctattgcatcca

SEQ ID NO: 54119 - DNA, 22 bp, Homo sapiens
agaaggggcccaaggatgtcag

SEQ ID NO: 54120 - DNA, 22 bp, Homo sapiens
tggaagggagctggaatttgga

SEQ ID NO: 54121 - DNA, 22 bp, Homo sapiens
gcttccgcgatgtcctaggtgg

SEQ ID NO: 54122 - DNA, 22 bp, Homo sapiens
gcgggccaccttggagagcgct

SEQ ID NO: 54123 - DNA, 22 bp, Homo sapiens
agcgccgcccctgctggtgttg

SEQ ID NO: 54124 - DNA, 20 bp, Homo sapiens
tcacatcctctcccaacatg

SEQ ID NO: 54125 - DNA, 22 bp, Homo sapiens
tctgcgttgctcacgctgggag

SEQ ID NO: 54126 - DNA, 22 bp, Homo sapiens
ttattttaccttcctctgagct

SEQ ID NO: 54127 - DNA, 22 bp, Homo sapiens
ctgggcacagcgttgggctctt

SEQ ID NO: 54128 - DNA, 22 bp, Homo sapiens
gaggtgggcggatcacaaggtc

SEQ ID NO: 54129 - DNA, 22 bp, Homo sapiens
accgggctaatttttgtatctt

SEQ ID NO: 54130 - DNA, 22 bp, Homo sapiens
gggcaccttgggtctcaggcaa

SEQ ID NO: 54131 - DNA, 22 bp, Homo sapiens
acacggcactttaggaaggggc

SEQ ID NO: 54132 - DNA, 22 bp, Homo sapiens
agccggccatgtggtcttgtgc

SEQ ID NO: 54133 - DNA, 22 bp, Homo sapiens
cttgatctacatagtgaaaccc

SEQ ID NO: 54134 - DNA, 22 bp, Homo sapiens
cccagttgttgccggctctgga

SEQ ID NO: 54135 - DNA, 22 bp, Homo sapiens
caggagatgacagggaagaacc

SEQ ID NO: 54136 - DNA, 22 bp, Homo sapiens
ggagctgaggacactacatttt

SEQ ID NO: 54137 - DNA, 22 bp, Homo sapiens
tccaagatctacagcagtttag

SEQ ID NO: 54138 - DNA, 22 bp, Homo sapiens
atgctatgtaactggcagatag

SEQ ID NO: 54139 - DNA, 22 bp, Homo sapiens
ctcctgggaaaggctggacaca

SEQ ID NO: 54140 - DNA, 22 bp, Homo sapiens
ccggctcggcgaccaggctgaa

SEQ ID NO: 54141 - DNA, 22 bp, Homo sapiens
tgatctcctgaccttgtaatcc

SEQ ID NO: 54142 - DNA, 22 bp, Homo sapiens
ggagagcttggagtgcgatttt

SEQ ID NO: 54143 - DNA, 22 bp, Homo sapiens
tcctttgcttctgtcattctcc

SEQ ID NO: 54144 - DNA, 22 bp, Homo sapiens
ttacctaaaatagctcaattta

SEQ ID NO: 54145 - DNA, 22 bp, Homo sapiens
actgcacttcagcctgggtgtc

SEQ ID NO: 54146 - DNA, 22 bp, Homo sapiens
cctagatgggatggcggccggg

SEQ ID NO: 54147 - DNA, 22 bp, Homo sapiens
tgcagattcaaatgaaatgcaa

SEQ ID NO: 54148 - DNA, 22 bp, Homo sapiens
ggaactgaggaacgaactggga

SEQ ID NO: 54149 - DNA, 22 bp, Homo sapiens
gctgcagtgagccaagatcgtg

SEQ ID NO: 54150 - DNA, 22 bp, Homo sapiens
ttaaacatttatggaggcagca

SEQ ID NO: 54151 - DNA, 22 bp, Homo sapiens
gagctgtgtatgcatcattctg

SEQ ID NO: 54152 - DNA, 22 bp, Homo sapiens
atgttctacagatggaaagggg

SEQ ID NO: 54153 - DNA, 22 bp, Homo sapiens
ctcaggagttggaggctacagt

SEQ ID NO: 54154 - DNA, 20 bp, Homo sapiens
tttgcgaggccaaggcgggc

SEQ ID NO: 54155 - DNA, 22 bp, Homo sapiens
gagcactgatttatttttgtct

SEQ ID NO: 54156 - DNA, 22 bp, Homo sapiens
gggcttggcacatgggctcagc

SEQ ID NO: 54157 - DNA, 22 bp, Homo sapiens
tttggtaagtacccacctgggt

SEQ ID NO: 54158 - DNA, 22 bp, Homo sapiens
gctcatgactgtaatcccagca

SEQ ID NO: 54159 - DNA, 22 bp, Homo sapiens
gagagtctagtgcacctagttt

SEQ ID NO: 54160 - DNA, 22 bp, Homo sapiens
ggcctctcttgggacagctgtc

SEQ ID NO: 54161 - DNA, 22 bp, Homo sapiens
tgaggcaggaggattgcaggat

SEQ ID NO: 54162 - DNA, 22 bp, Homo sapiens
aaggaggcctggcagatgaaga

SEQ ID NO: 54163 - DNA, 22 bp, Homo sapiens
tcttacccggcaacgtgtgtcg

SEQ ID NO: 54164 - DNA, 21 bp, Homo sapiens
tgactgaggcttcttcacaca

SEQ ID NO: 54165 - DNA, 22 bp, Homo sapiens
taagcctgcatgaaccatgaga

SEQ ID NO: 54166 - DNA, 22 bp, Homo sapiens
agggacctcatgtaagtggatt

SEQ ID NO: 54167 - DNA, 22 bp, Homo sapiens
aaggccttgccgaaggatgcca

SEQ ID NO: 54168 - DNA, 19 bp, Homo sapiens
aggaatggaattaattctg

SEQ ID NO: 54169 - DNA, 22 bp, Homo sapiens
agcactgatttaaactggattt

SEQ ID NO: 54170 - DNA, 22 bp, Homo sapiens
agctggagatgagtgacgtgcc

SEQ ID NO: 54171 - DNA, 22 bp, Homo sapiens
agtccggggtctggacacctgg

SEQ ID NO: 54172 - DNA, 22 bp, Homo sapiens
actgcactccagcctgggtgac

SEQ ID NO: 54173 - DNA, 22 bp, Homo sapiens
gcttggaagtaggattgggaga

SEQ ID NO: 54174 - DNA, 22 bp, Homo sapiens
ttctcagtgaagtttagaacat

SEQ ID NO: 54175 - DNA, 22 bp, Homo sapiens
gggcggatcacctgaggtcagg

SEQ ID NO: 54176 - DNA, 22 bp, Homo sapiens
gttcaagaccagcctggccaac

SEQ ID NO: 54177 - DNA, 22 bp, Homo sapiens
ggccactgacctacatctgggg

SEQ ID NO: 54178 - DNA, 22 bp, Homo sapiens
gcaccgccttggaccgcccgct

SEQ ID NO: 54179 - DNA, 22 bp, Homo sapiens
ggacctgaacataaaacgaggc

SEQ ID NO: 54180 - DNA, 22 bp, Homo sapiens
aagaataagaggatttagaaca

SEQ ID NO: 54181 - DNA, 22 bp, Homo sapiens
ggctccaccctgcttccagaag

SEQ ID NO: 54182 - DNA, 22 bp, Homo sapiens
tgagatgaataactcctgctaa

SEQ ID NO: 54183 - DNA, 22 bp, Homo sapiens
gttatgatggcaccactgcact

SEQ ID NO: 54184 - DNA, 22 bp, Homo sapiens
gtccaagagtcaagaagggggc

SEQ ID NO: 54185 - DNA, 19 bp, Homo sapiens
gggcttggggctgaagcct

SEQ ID NO: 54186 - DNA, 22 bp, Homo sapiens
gcctacatttcccagttgaatg

SEQ ID NO: 54187 - DNA, 22 bp, Homo sapiens
gtaatctcagctacttgggagg

SEQ ID NO: 54188 - DNA, 22 bp, Homo sapiens
cggaggttgaggctgcagtgag

SEQ ID NO: 54189 - DNA, 23 bp, Homo sapiens
tgtcttcgactcctgcgtgcttc

SEQ ID NO: 54190 - DNA, 22 bp, Homo sapiens
ggtgagaaagggattcctgttc

SEQ ID NO: 54191 - DNA, 22 bp, Homo sapiens
cgcaccactgaattccagcctg

SEQ ID NO: 54192 - DNA, 23 bp, Homo sapiens
aaataggagtatctggatcatga

SEQ ID NO: 54193 - DNA, 22 bp, Homo sapiens
atgccactgcactccagcctag

SEQ ID NO: 54194 - DNA, 22 bp, Homo sapiens
aaccccgctcaggctgggtgag

SEQ ID NO: 54195 - DNA, 22 bp, Homo sapiens
tccgccaggactgagggcccat

SEQ ID NO: 54196 - DNA, 22 bp, Homo sapiens
cttgcctttgtcttcaaaggct

SEQ ID NO: 54197 - DNA, 22 bp, Homo sapiens
actgcactccagcctcggggtc

SEQ ID NO: 54198 - DNA, 22 bp, Homo sapiens
gtttcgtcaggcttattctatc

SEQ ID NO: 54199 - DNA, 22 bp, Homo sapiens
tgcctgatgcaggagtatcaga

SEQ ID NO: 54200 - DNA, 22 bp, Homo sapiens
atttacaggtagaattttaagt

SEQ ID NO: 54201 - DNA, 22 bp, Homo sapiens
agcgccactgcactccagcctg

SEQ ID NO: 54202 - DNA, 22 bp, Homo sapiens
agggctgcccagtgtgagagct

SEQ ID NO: 54203 - DNA, 22 bp, Homo sapiens
taagaaatttagttatagaatg

SEQ ID NO: 54204 - DNA, 22 bp, Homo sapiens
gggcggatcatttgaggtcagg

SEQ ID NO: 54205 - DNA, 22 bp, Homo sapiens
gcttggccagcagccgggatgc

SEQ ID NO: 54206 - DNA, 22 bp, Homo sapiens
tcctagttctctgccagtcgct

SEQ ID NO: 54207 - DNA, 22 bp, Homo sapiens
aggctagaggcttctggcttca

SEQ ID NO: 54208 - DNA, 22 bp, Homo sapiens
ggctcacgcaattatcccggcc

SEQ ID NO: 54209 - DNA, 21 bp, Homo sapiens
gttcaaatcctgacactacac

SEQ ID NO: 54210 - DNA, 22 bp, Homo sapiens
ttttacctgaaccacacagtat

SEQ ID NO: 54211 - DNA, 22 bp, Homo sapiens
gtaggtcagacataagaggaca

SEQ ID NO: 54212 - DNA, 22 bp, Homo sapiens
agagaagagtcttgtcaaatta

SEQ ID NO: 54213 - DNA, 22 bp, Homo sapiens
attataggcttgagccaccgtg

SEQ ID NO: 54214 - DNA, 22 bp, Homo sapiens
atatatttgagaatattcatga

SEQ ID NO: 54215 - DNA, 22 bp, Homo sapiens
tattcatagtaaacaaaagtgg

SEQ ID NO: 54216 - DNA, 20 bp, Homo sapiens
tttgagaccagtctgcccaa

SEQ ID NO: 54217 - DNA, 22 bp, Homo sapiens
agaacagaggccttatgtttca

SEQ ID NO: 54218 - DNA, 22 bp, Homo sapiens
ctcggcaggtggaggttgtagt

SEQ ID NO: 54219 - DNA, 22 bp, Homo sapiens
gtggtggatgtctgtaatctca

SEQ ID NO: 54220 - DNA, 22 bp, Homo sapiens
aaagaaatagatggcatttaaa

SEQ ID NO: 54221 - DNA, 22 bp, Homo sapiens
gaggacaagctgtgagtggggt

SEQ ID NO: 54222 - DNA, 22 bp, Homo sapiens
ttttgagatggtgtctcgctcc

SEQ ID NO: 54223 - DNA, 22 bp, Homo sapiens
aagtctctcacatatctggtcc

SEQ ID NO: 54224 - DNA, 22 bp, Homo sapiens
gtcttagatttcaccgataatg

SEQ ID NO: 54225 - DNA, 21 bp, Homo sapiens
tgcaatccagcctgggcgaca

SEQ ID NO: 54226 - DNA, 22 bp, Homo sapiens
tagctcaaaggttaagtgtgga

SEQ ID NO: 54227 - DNA, 22 bp, Homo sapiens
atgccacttcattccagcctcg

SEQ ID NO: 54228 - DNA, 22 bp, Homo sapiens
gaggctgcagctatcagacatt

SEQ ID NO: 54229 - DNA, 22 bp, Homo sapiens
tcgggctcgctctcctagcgga

SEQ ID NO: 54230 - DNA, 22 bp, Homo sapiens
gaaggaagtcattagtgcagac

SEQ ID NO: 54231 - DNA, 22 bp, Homo sapiens
atgcacctgaactccatcagct

SEQ ID NO: 54232 - DNA, 22 bp, Homo sapiens
tgttgattagtgtttagactta

SEQ ID NO: 54233 - DNA, 22 bp, Homo sapiens
ttatagcagcatgatttacaat

SEQ ID NO: 54234 - DNA, 22 bp, Homo sapiens
actgcacttcagcctgggtgac

SEQ ID NO: 54235 - DNA, 22 bp, Homo sapiens
ggctcactgcaacttccgcctc

SEQ ID NO: 54236 - DNA, 22 bp, Homo sapiens
aaaaagtattggccatggttga

SEQ ID NO: 54237 - DNA, 22 bp, Homo sapiens
actgccaatggtagtttgatgg

SEQ ID NO: 54238 - DNA, 22 bp, Homo sapiens
gtgtaagtatctttgtatcttt

SEQ ID NO: 54239 - DNA, 22 bp, Homo sapiens
tggttcagttgcacaggctgtt

SEQ ID NO: 54240 - DNA, 17 bp, Homo sapiens
cactagtagtctctggc

SEQ ID NO: 54241 - DNA, 23 bp, Homo sapiens
acctgtctgcctcccaccatcaa

SEQ ID NO: 54242 - DNA, 22 bp, Homo sapiens
tgcgaccctagccccctcactt

SEQ ID NO: 54243 - DNA, 22 bp, Homo sapiens
tctccgatcacaggttttcaat

SEQ ID NO: 54244 - DNA, 22 bp, Homo sapiens
attgagaagaaaatctaatata

SEQ ID NO: 54245 - DNA, 22 bp, Homo sapiens
gccaggcgggtctcaaactcct

SEQ ID NO: 54246 - DNA, 20 bp, Homo sapiens
attagctcaggtgaggtcat

SEQ ID NO: 54247 - DNA, 22 bp, Homo sapiens
aggggaatgggtagactgttga

SEQ ID NO: 54248 - DNA, 22 bp, Homo sapiens
tgctagtgtgtgagatgttcaa

SEQ ID NO: 54249 - DNA, 22 bp, Homo sapiens
tcacaatatttatcttccaatt

SEQ ID NO: 54250 - DNA, 22 bp, Homo sapiens
aggggagagttaatgtgaatgt

SEQ ID NO: 54251 - DNA, 22 bp, Homo sapiens
tgggcgacagagcaagactccg

SEQ ID NO: 54252 - DNA, 22 bp, Homo sapiens
ctccagttggccccagttggtt

SEQ ID NO: 54253 - DNA, 22 bp, Homo sapiens
aggggaggtgtccccaaatctc

SEQ ID NO: 54254 - DNA, 22 bp, Homo sapiens
tacttttagcctatttgattct

SEQ ID NO: 54255 - DNA, 22 bp, Homo sapiens
aaagaaggtagggctggtgact

SEQ ID NO: 54256 - DNA, 22 bp, Homo sapiens
tgaagaaacgcagagaggtagg

SEQ ID NO: 54257 - DNA, 22 bp, Homo sapiens
cctgcctactgagttttatatt

SEQ ID NO: 54258 - DNA, 23 bp, Homo sapiens
gtctctagagtgtggagcaaaga

SEQ ID NO: 54259 - DNA, 22 bp, Homo sapiens
gatgcgggcccgctccactgcc

SEQ ID NO: 54260 - DNA, 22 bp, Homo sapiens
taagagaatgttgtggctaggt

SEQ ID NO: 54261 - DNA, 22 bp, Homo sapiens
tgaggcaggagttcaggctgcg

SEQ ID NO: 54262 - DNA, 22 bp, Homo sapiens
tcctgcagctgataaatacagt

SEQ ID NO: 54263 - DNA, 22 bp, Homo sapiens
tgggtactcctattagttcagt

SEQ ID NO: 54264 - DNA, 22 bp, Homo sapiens
gggccatgagaggttcatcaac

SEQ ID NO: 54265 - DNA, 22 bp, Homo sapiens
cccagtttcaactttccagtgg

SEQ ID NO: 54266 - DNA, 22 bp, Homo sapiens
tgctgagcgcatccggcggccg

SEQ ID NO: 54267 - DNA, 22 bp, Homo sapiens
tccaaggagcagtcttcaacct

SEQ ID NO: 54268 - DNA, 22 bp, Homo sapiens
ttccagctaactcacatccctt

SEQ ID NO: 54269 - DNA, 22 bp, Homo sapiens
ctagggacctcagctcctggag

SEQ ID NO: 54270 - DNA, 22 bp, Homo sapiens
gatgtagacacttggaggctta

SEQ ID NO: 54271 - DNA, 22 bp, Homo sapiens
ttgtaagtcacaccagggcagg

SEQ ID NO: 54272 - DNA, 23 bp, Homo sapiens
gacagagtgagaccttgtcttac

SEQ ID NO: 54273 - DNA, 22 bp, Homo sapiens
cctggaggcggaggttgcagtg

SEQ ID NO: 54274 - DNA, 18 bp, Homo sapiens
ttcggcagatacgcttgg

SEQ ID NO: 54275 - DNA, 22 bp, Homo sapiens
tgcgccatgtgctctcggccct

SEQ ID NO: 54276 - DNA, 22 bp, Homo sapiens
tgaggcaggaggttgagaactg

SEQ ID NO: 54277 - DNA, 22 bp, Homo sapiens
ggagttgattttggatatatta

SEQ ID NO: 54278 - DNA, 22 bp, Homo sapiens
ccagctttatagcttcaaagga

SEQ ID NO: 54279 - DNA, 22 bp, Homo sapiens
tctttcattctagtctgaggtt

SEQ ID NO: 54280 - DNA, 22 bp, Homo sapiens
catagcggtattccacgtggtt

SEQ ID NO: 54281 - DNA, 22 bp, Homo sapiens
tgaaatgattatatggtgtttg

SEQ ID NO: 54282 - DNA, 21 bp, Homo sapiens
aggcttggatctagacaggcc

SEQ ID NO: 54283 - DNA, 22 bp, Homo sapiens
gaggggcacagtaaagggtccc

SEQ ID NO: 54284 - DNA, 22 bp, Homo sapiens
tgtgacaagcattgtatattgg

SEQ ID NO: 54285 - DNA, 22 bp, Homo sapiens
tgacaagaaagcgtcttctttt

SEQ ID NO: 54286 - DNA, 22 bp, Homo sapiens
aagatattcaaagatttattag

SEQ ID NO: 54287 - DNA, 17 bp, Homo sapiens
cgggcatggagggcagg

SEQ ID NO: 54288 - DNA, 22 bp, Homo sapiens
aggaggaagggaagacaagtaa

SEQ ID NO: 54289 - DNA, 20 bp, Homo sapiens
agcagagtgcccatcccgga

SEQ ID NO: 54290 - DNA, 22 bp, Homo sapiens
tcctttgcttctgtcattctcc

SEQ ID NO: 54291 - DNA, 22 bp, Homo sapiens
gcaaatacatgttgagcaccta

SEQ ID NO: 54292 - DNA, 22 bp, Homo sapiens
cacccaggctggagagcagtgg

SEQ ID NO: 54293 - DNA, 22 bp, Homo sapiens
gcttggctttactagggggaca

SEQ ID NO: 54294 - DNA, 18 bp, Homo sapiens
gcctgagggtcaagtgtg

SEQ ID NO: 54295 - DNA, 22 bp, Homo sapiens
aaggcaggatgggaaaagattt

SEQ ID NO: 54296 - DNA, 22 bp, Homo sapiens
tccaccatgtaacaagctctgt

SEQ ID NO: 54297 - DNA, 22 bp, Homo sapiens
tcaactaactctattatttgaa

SEQ ID NO: 54298 - DNA, 22 bp, Homo sapiens
tacgcctgtaatcccagcactt

SEQ ID NO: 54299 - DNA, 22 bp, Homo sapiens
agctttacctgccttggggcac

SEQ ID NO: 54300 - DNA, 22 bp, Homo sapiens
ttacatgtggtgtgaagaagag

SEQ ID NO: 54301 - DNA, 22 bp, Homo sapiens
cccacacacatttatgatagga

SEQ ID NO: 54302 - DNA, 22 bp, Homo sapiens
actattagcatatcatgaatgg

SEQ ID NO: 54303 - DNA, 22 bp, Homo sapiens
tggctgtgtccctgtccagagt

SEQ ID NO: 54304 - DNA, 22 bp, Homo sapiens
gcacttcatgactttgtcaaat

SEQ ID NO: 54305 - DNA, 22 bp, Homo sapiens
attaagtgactaaagtaatgct

SEQ ID NO: 54306 - DNA, 22 bp, Homo sapiens
ggctgagttgagaggattactt

SEQ ID NO: 54307 - DNA, 22 bp, Homo sapiens
cagtggctggttagggacagga

SEQ ID NO: 54308 - DNA, 22 bp, Homo sapiens
ttatttaaaagtggtaagattc

SEQ ID NO: 54309 - DNA, 22 bp, Homo sapiens
aggtatatattctggtccttat

SEQ ID NO: 54310 - DNA, 22 bp, Homo sapiens
agtgcaggccccaggccaggcc

SEQ ID NO: 54311 - DNA, 22 bp, Homo sapiens
ttttgagatggagtcttgctct

SEQ ID NO: 54312 - DNA, 22 bp, Homo sapiens
cactgcactccagcttgggtga

SEQ ID NO: 54313 - DNA, 22 bp, Homo sapiens
aagacttgaccaggttgaaggc

SEQ ID NO: 54314 - DNA, 23 bp, Homo sapiens
gcgtccggcctctctcgctcccg

SEQ ID NO: 54315 - DNA, 22 bp, Homo sapiens
aagtggactaatacaaggacta

SEQ ID NO: 54316 - DNA, 22 bp, Homo sapiens
acgggccttctcttcaggcgag

SEQ ID NO: 54317 - DNA, 22 bp, Homo sapiens
aatggcaagagccacagaggcg

SEQ ID NO: 54318 - DNA, 22 bp, Homo sapiens
atgccactgcgctccagcctgg

SEQ ID NO: 54319 - DNA, 22 bp, Homo sapiens
cttccccaggacctctgctaaa

SEQ ID NO: 54320 - DNA, 22 bp, Homo sapiens
ctccaggctcgtccaagatcga

SEQ ID NO: 54321 - DNA, 22 bp, Homo sapiens
agtcccaacagcttacaaggaa

SEQ ID NO: 54322 - DNA, 23 bp, Homo sapiens
gtgcgccaggacaacctgacgga

SEQ ID NO: 54323 - DNA, 22 bp, Homo sapiens
caaggtgccatgctgggcgggg

SEQ ID NO: 54324 - DNA, 22 bp, Homo sapiens
ctgagatctttatacgaggcac

SEQ ID NO: 54325 - DNA, 22 bp, Homo sapiens
atagcaacaccccaattttcta

SEQ ID NO: 54326 - DNA, 23 bp, Homo sapiens
aatggtcttcctccacccctctg

SEQ ID NO: 54327 - DNA, 22 bp, Homo sapiens
tggaagggagctggaatttgga

SEQ ID NO: 54328 - DNA, 22 bp, Homo sapiens
gctttatccgcttgacccttac

SEQ ID NO: 54329 - DNA, 22 bp, Homo sapiens
gcctgttctccagcatccaggt

SEQ ID NO: 54330 - DNA, 22 bp, Homo sapiens
cttagatgaagtcacagaaccc

SEQ ID NO: 54331 - DNA, 22 bp, Homo sapiens
ttcccttaaattatggcatcta

SEQ ID NO: 54332 - DNA, 22 bp, Homo sapiens
gggccctgggattcagagcaag

SEQ ID NO: 54333 - DNA, 22 bp, Homo sapiens
ttgcactccagcccgagcaaca

SEQ ID NO: 54334 - DNA, 22 bp, Homo sapiens
caggcagggagctggaaaggat

SEQ ID NO: 54335 - DNA, 22 bp, Homo sapiens
gagggaaaggttaatacatgat

SEQ ID NO: 54336 - DNA, 22 bp, Homo sapiens
acctgcaggcacaggtgtgcgc

SEQ ID NO: 54337 - DNA, 22 bp, Homo sapiens
tctgtggcccaagtgatggctg

SEQ ID NO: 54338 - DNA, 22 bp, Homo sapiens
caagcttgtttctcctgggggt

SEQ ID NO: 54339 - DNA, 22 bp, Homo sapiens
tacagtgcttggtatctagtaa

SEQ ID NO: 54340 - DNA, 22 bp, Homo sapiens
gtgcccagcagcagcgtccccg

SEQ ID NO: 54341 - DNA, 22 bp, Homo sapiens
cgcgaggtggaggttgcagtga

SEQ ID NO: 54342 - DNA, 22 bp, Homo sapiens
tcgcttgaacccaggaagtgga

SEQ ID NO: 54343 - DNA, 18 bp, Homo sapiens
tggaggaaaaatctcatg

SEQ ID NO: 54344 - DNA, 22 bp, Homo sapiens
ggagtgactcacagctgggaca

SEQ ID NO: 54345 - DNA, 18 bp, Homo sapiens
cttgttcttctcttggcg

SEQ ID NO: 54346 - DNA, 22 bp, Homo sapiens
gaatttcctctaaacccctgag

SEQ ID NO: 54347 - DNA, 22 bp, Homo sapiens
ctgaggaggctaatttgaggat

SEQ ID NO: 54348 - DNA, 22 bp, Homo sapiens
gtgaccatcatctcagctagtt

SEQ ID NO: 54349 - DNA, 22 bp, Homo sapiens
gagcaacacgcagtagtatacg

SEQ ID NO: 54350 - DNA, 23 bp, Homo sapiens
ttgcttagagacctcctcatcag

SEQ ID NO: 54351 - DNA, 21 bp, Homo sapiens
cactccacttagaacagggtt

SEQ ID NO: 54352 - DNA, 22 bp, Homo sapiens
gtcactgtatccaggttccagc

SEQ ID NO: 54353 - DNA, 20 bp, Homo sapiens
tctcgcactcggagcagccg

SEQ ID NO: 54354 - DNA, 22 bp, Homo sapiens
gtggcttgagcaggggcagagg

SEQ ID NO: 54355 - DNA, 22 bp, Homo sapiens
acattcccaccaacagtgtaaa

SEQ ID NO: 54356 - DNA, 22 bp, Homo sapiens
ttgggctcaggagtttgagacc

SEQ ID NO: 54357 - DNA, 22 bp, Homo sapiens
tctaatccttgctacctgggtg

SEQ ID NO: 54358 - DNA, 22 bp, Homo sapiens
agtcggaagctgtgcgtaaatc

SEQ ID NO: 54359 - DNA, 22 bp, Homo sapiens
ccaatgatggtgcccacgatga

SEQ ID NO: 54360 - DNA, 22 bp, Homo sapiens
ctgtaatcccagctactcggga

SEQ ID NO: 54361 - DNA, 22 bp, Homo sapiens
aatatgcactctgatttagcag

SEQ ID NO: 54362 - DNA, 22 bp, Homo sapiens
atggccgcctgtccttcccgcc

SEQ ID NO: 54363 - DNA, 22 bp, Homo sapiens
cgcggtggcggcctccagcgcc

SEQ ID NO: 54364 - DNA, 19 bp, Homo sapiens
ctgtccttggctgcactgt

SEQ ID NO: 54365 - DNA, 22 bp, Homo sapiens
tttcttaggctctaaaatgact

SEQ ID NO: 54366 - DNA, 22 bp, Homo sapiens
gcgactgtacagaattgcccct

SEQ ID NO: 54367 - DNA, 22 bp, Homo sapiens
tttattctgtgctacatgaaga

SEQ ID NO: 54368 - DNA, 22 bp, Homo sapiens
tagcagtgtctaggtaggccat

SEQ ID NO: 54369 - DNA, 22 bp, Homo sapiens
actttatttcctattgcatcca

SEQ ID NO: 54370 - DNA, 23 bp, Homo sapiens
aaactacaacgccaggcactgag

SEQ ID NO: 54371 - DNA, 20 bp, Homo sapiens
gtctccactgggggttaacc

SEQ ID NO: 54372 - DNA, 22 bp, Homo sapiens
gcccggcagtcacacacccagg

SEQ ID NO: 54373 - DNA, 22 bp, Homo sapiens
ttaaatattatgttgtctgcaa

SEQ ID NO: 54374 - DNA, 22 bp, Homo sapiens
ctagttctagatccctgaggaa

SEQ ID NO: 54375 - DNA, 22 bp, Homo sapiens
tcactgcaacctccacctcctg

SEQ ID NO: 54376 - DNA, 22 bp, Homo sapiens
cactgcaccctcaaactcctgg

SEQ ID NO: 54377 - DNA, 22 bp, Homo sapiens
aacatgatttcatgcatttaga

SEQ ID NO: 54378 - DNA, 22 bp, Homo sapiens
ctgtaatcccagctacctggga

SEQ ID NO: 54379 - DNA, 23 bp, Homo sapiens
cgcccagcctcagtgacctgggc

SEQ ID NO: 54380 - DNA, 22 bp, Homo sapiens
gaagcctcaacatctctgcgtc

SEQ ID NO: 54381 - DNA, 22 bp, Homo sapiens
tttgttttcaatgtgtcattca

SEQ ID NO: 54382 - DNA, 22 bp, Homo sapiens
gccactgtggtcctcccatgat

SEQ ID NO: 54383 - DNA, 22 bp, Homo sapiens
ggaggtggaggttgcagtgagc

SEQ ID NO: 54384 - DNA, 22 bp, Homo sapiens
tggctaacaaggtgaaaccccg

SEQ ID NO: 54385 - DNA, 18 bp, Homo sapiens
actctttctgcccacagg

SEQ ID NO: 54386 - DNA, 22 bp, Homo sapiens
ttatttttaaaagttcacacag

SEQ ID NO: 54387 - DNA, 22 bp, Homo sapiens
tcctgtgatattgtttgttata

SEQ ID NO: 54388 - DNA, 22 bp, Homo sapiens
aggagggagcttaagccaggca

SEQ ID NO: 54389 - DNA, 19 bp, Homo sapiens
catggtgaaaccccgtctc

SEQ ID NO: 54390 - DNA, 22 bp, Homo sapiens
agaggccggccgagcccatggg

SEQ ID NO: 54391 - DNA, 22 bp, Homo sapiens
atcttcccaggctggggagagg

SEQ ID NO: 54392 - DNA, 22 bp, Homo sapiens
aagtgatgctacgactttgaca

SEQ ID NO: 54393 - DNA, 22 bp, Homo sapiens
ttggaacatgccggggtccagg

SEQ ID NO: 54394 - DNA, 22 bp, Homo sapiens
tctttctacatcatttgcttct

SEQ ID NO: 54395 - DNA, 22 bp, Homo sapiens
atgcagaagactgaaaagctga

SEQ ID NO: 54396 - DNA, 22 bp, Homo sapiens
tctgaggctgaatggactccgt

SEQ ID NO: 54397 - DNA, 22 bp, Homo sapiens
ctctgcaacttctagcagtgtc

SEQ ID NO: 54398 - DNA, 22 bp, Homo sapiens
caagatcttcctcaatagacct

SEQ ID NO: 54399 - DNA, 22 bp, Homo sapiens
gctctagtaggaatgtccctct

SEQ ID NO: 54400 - DNA, 22 bp, Homo sapiens
gcagctattgtctcctgggccc

SEQ ID NO: 54401 - DNA, 22 bp, Homo sapiens
taggtttactgaattagtggaa

SEQ ID NO: 54402 - DNA, 22 bp, Homo sapiens
tcaatcacgtgttccatgttct

SEQ ID NO: 54403 - DNA, 22 bp, Homo sapiens
ggcctcgcggcttctggtggct

SEQ ID NO: 54404 - DNA, 22 bp, Homo sapiens
tcgcaccattgcactccagcca

SEQ ID NO: 54405 - DNA, 22 bp, Homo sapiens
gcccgcagagatctttaacaaa

SEQ ID NO: 54406 - DNA, 22 bp, Homo sapiens
gagatggagtctttttctgtca

SEQ ID NO: 54407 - DNA, 22 bp, Homo sapiens
actgcgctccagcctgggtgac

SEQ ID NO: 54408 - DNA, 22 bp, Homo sapiens
gttggctatgagagctttagtg

SEQ ID NO: 54409 - DNA, 22 bp, Homo sapiens
gctgtggcctggcgcagagctg

SEQ ID NO: 54410 - DNA, 22 bp, Homo sapiens
ttcatagtgtttccttccagtg

SEQ ID NO: 54411 - DNA, 22 bp, Homo sapiens
gagcctcgtggcggccactgcg

SEQ ID NO: 54412 - DNA, 22 bp, Homo sapiens
ttattttaccttcctctgagct

SEQ ID NO: 54413 - DNA, 22 bp, Homo sapiens
tcggagctgtagatgaaaccct

SEQ ID NO: 54414 - DNA, 22 bp, Homo sapiens
cgactgtcatacacaagacatg

SEQ ID NO: 54415 - DNA, 22 bp, Homo sapiens
cagctttgccaagtaaggtctt

SEQ ID NO: 54416 - DNA, 22 bp, Homo sapiens
ttgcccaggctggagtgcagta

SEQ ID NO: 54417 - DNA, 22 bp, Homo sapiens
aagaaatgtgaatattgaatag

SEQ ID NO: 54418 - DNA, 22 bp, Homo sapiens
ttttcatttttgtagatgcaag

SEQ ID NO: 54419 - DNA, 22 bp, Homo sapiens
atgcattgtcaggcaatttcat

SEQ ID NO: 54420 - DNA, 23 bp, Homo sapiens
acagtcgtaggtatccttttcct

SEQ ID NO: 54421 - DNA, 22 bp, Homo sapiens
caaatgaatatttccatgggtt

SEQ ID NO: 54422 - DNA, 22 bp, Homo sapiens
cagcgtctcgttgtgggcctcg

SEQ ID NO: 54423 - DNA, 22 bp, Homo sapiens
cctgcttaacattgccatgaca

SEQ ID NO: 54424 - DNA, 17 bp, Homo sapiens
ttcttttctgagccttg

SEQ ID NO: 54425 - DNA, 22 bp, Homo sapiens
acccagccatgttcagttctct

SEQ ID NO: 54426 - DNA, 22 bp, Homo sapiens
ctgcagggagaggggacagcct

SEQ ID NO: 54427 - DNA, 22 bp, Homo sapiens
agtgactggtgtgaagttaaat

SEQ ID NO: 54428 - DNA, 22 bp, Homo sapiens
agcctgcgatcccacctggcct

SEQ ID NO: 54429 - DNA, 22 bp, Homo sapiens
gctgcgccggatcccacgttcc

SEQ ID NO: 54430 - DNA, 22 bp, Homo sapiens
taacatttaaatttttcacata

SEQ ID NO: 54431 - DNA, 22 bp, Homo sapiens
gctcaagccttctgcccacctc

SEQ ID NO: 54432 - DNA, 22 bp, Homo sapiens
gaggccaactttggagaacagg

SEQ ID NO: 54433 - DNA, 22 bp, Homo sapiens
gggaggttgaggctgcagtgag

SEQ ID NO: 54434 - DNA, 22 bp, Homo sapiens
actgcactccagcctgggtgat

SEQ ID NO: 54435 - DNA, 22 bp, Homo sapiens
tggaatggaaacaaactgagga

SEQ ID NO: 54436 - DNA, 22 bp, Homo sapiens
atgcttgcccatgtttctgaag

SEQ ID NO: 54437 - DNA, 22 bp, Homo sapiens
tcactgcgcttcagcctgggtg

SEQ ID NO: 54438 - DNA, 22 bp, Homo sapiens
acaccatactcatgttggttcc

SEQ ID NO: 54439 - DNA, 22 bp, Homo sapiens
tccctagtcgcatctgtggaga

SEQ ID NO: 54440 - DNA, 22 bp, Homo sapiens
gcctgcagggcctgggcctacc

SEQ ID NO: 54441 - DNA, 22 bp, Homo sapiens
ggcagcactgcagcttgttggg

SEQ ID NO: 54442 - DNA, 22 bp, Homo sapiens
ttatatgtttctgtttggaggc

SEQ ID NO: 54443 - DNA, 22 bp, Homo sapiens
gtggaggagaggcgccttgcgg

SEQ ID NO: 54444 - DNA, 23 bp, Homo sapiens
aggttatgattatagagcgagga

SEQ ID NO: 54445 - DNA, 22 bp, Homo sapiens
atctggttcttcttaggcatca

SEQ ID NO: 54446 - DNA, 22 bp, Homo sapiens
ttttctaacatctagtaatttg

SEQ ID NO: 54447 - DNA, 22 bp, Homo sapiens
gacagacacaattgatccatga

SEQ ID NO: 54448 - DNA, 22 bp, Homo sapiens
ctagggtcaggggcctgcgtcg

SEQ ID NO: 54449 - DNA, 22 bp, Homo sapiens
cacagacagtgtccctttgttg

SEQ ID NO: 54450 - DNA, 22 bp, Homo sapiens
ggccagaagttggaaaagagcc

SEQ ID NO: 54451 - DNA, 21 bp, Homo sapiens
ctgtggtacagctgggacgga

SEQ ID NO: 54452 - DNA, 22 bp, Homo sapiens
cttaatctcacctgcaaagtcc

SEQ ID NO: 54453 - DNA, 22 bp, Homo sapiens
caagggctcaaacggtggttgc

SEQ ID NO: 54454 - DNA, 22 bp, Homo sapiens
agtccaaagcagatgagggcca

SEQ ID NO: 54455 - DNA, 22 bp, Homo sapiens
gccccagcctcccgagtagctg

SEQ ID NO: 54456 - DNA, 22 bp, Homo sapiens
tctaatcctatggtggggaggg

SEQ ID NO: 54457 - DNA, 22 bp, Homo sapiens
tggttcctcaagcgctggcggc

SEQ ID NO: 54458 - DNA, 22 bp, Homo sapiens
ggggacctgggcttcaagggtt

SEQ ID NO: 54459 - DNA, 22 bp, Homo sapiens
ttatcacttatgagctttttgc

SEQ ID NO: 54460 - DNA, 22 bp, Homo sapiens
gtgccccagacacgcatgtggg

SEQ ID NO: 54461 - DNA, 22 bp, Homo sapiens
aacccgggaggcagaggttgtg

SEQ ID NO: 54462 - DNA, 19 bp, Homo sapiens
ttcacattggaagaagtag

SEQ ID NO: 54463 - DNA, 23 bp, Homo sapiens
gttttacaggtgagaaaatggag

SEQ ID NO: 54464 - DNA, 22 bp, Homo sapiens
agcccaatcctagcactttgag

SEQ ID NO: 54465 - DNA, 22 bp, Homo sapiens
ctccccagccctggtattctga

SEQ ID NO: 54466 - DNA, 21 bp, Homo sapiens
gttctacagttttagaattcc

SEQ ID NO: 54467 - DNA, 22 bp, Homo sapiens
cactgcactccatcctgggaaa

SEQ ID NO: 54468 - DNA, 22 bp, Homo sapiens
agcccttagtacatttctcaag

SEQ ID NO: 54469 - DNA, 19 bp, Homo sapiens
tttgatagggcataatata

SEQ ID NO: 54470 - DNA, 22 bp, Homo sapiens
attgcactccagcctgggtgac

SEQ ID NO: 54471 - DNA, 22 bp, Homo sapiens
agagggaagatggtccaatctt

SEQ ID NO: 54472 - DNA, 22 bp, Homo sapiens
atgccccagtgtgtgcttcctt

SEQ ID NO: 54473 - DNA, 22 bp, Homo sapiens
aagcgccatggttcctgcgcag

SEQ ID NO: 54474 - DNA, 22 bp, Homo sapiens
cccattcatcctcgcttccttc

SEQ ID NO: 54475 - DNA, 22 bp, Homo sapiens
agtactgtcagcagggtgttga

SEQ ID NO: 54476 - DNA, 22 bp, Homo sapiens
gggaaagaccttcctggggtgt

SEQ ID NO: 54477 - DNA, 22 bp, Homo sapiens
agagcacagggttttgtgccgg

SEQ ID NO: 54478 - DNA, 22 bp, Homo sapiens
ctgaggagaggtggcctgtgtt

SEQ ID NO: 54479 - DNA, 22 bp, Homo sapiens
aagattttcagtgcctaaaaca

SEQ ID NO: 54480 - DNA, 22 bp, Homo sapiens
gcgcactgggcgcacgcgtagg

SEQ ID NO: 54481 - DNA, 22 bp, Homo sapiens
gttaggtagaagtttactttga

SEQ ID NO: 54482 - DNA, 22 bp, Homo sapiens
tgagatgtaaggtatgcttact

SEQ ID NO: 54483 - DNA, 22 bp, Homo sapiens
ttcttttaattgtgggggagtg

SEQ ID NO: 54484 - DNA, 23 bp, Homo sapiens
tgaggcaggcggatcacgaggtc

SEQ ID NO: 54485 - DNA, 22 bp, Homo sapiens
ctgctaaacctctctgagagct

SEQ ID NO: 54486 - DNA, 22 bp, Homo sapiens
ggggtactggctggagccccac

SEQ ID NO: 54487 - DNA, 22 bp, Homo sapiens
aatgagatggaattcccgccta

SEQ ID NO: 54488 - DNA, 22 bp, Homo sapiens
gctgtcttgctcactcttgcag

SEQ ID NO: 54489 - DNA, 22 bp, Homo sapiens
gatggtgcaggtgaagtgctgg

SEQ ID NO: 54490 - DNA, 22 bp, Homo sapiens
ataaaatttgctactgttaaat

SEQ ID NO: 54491 - DNA, 22 bp, Homo sapiens
aaggagaaatggtagatgtgca

SEQ ID NO: 54492 - DNA, 22 bp, Homo sapiens
ggccactgctctccagcctggg

SEQ ID NO: 54493 - DNA, 22 bp, Homo sapiens
ggatgttctggggttctcttgt

SEQ ID NO: 54494 - DNA, 22 bp, Homo sapiens
ttagctcagaaaatttaaactt

SEQ ID NO: 54495 - DNA, 22 bp, Homo sapiens
ggagctgaggacactacatttt

SEQ ID NO: 54496 - DNA, 22 bp, Homo sapiens
gggaggttctgttcgcacttga

SEQ ID NO: 54497 - DNA, 22 bp, Homo sapiens
atgccactgcactccagcctgg

SEQ ID NO: 54498 - DNA, 22 bp, Homo sapiens
agggactatttacccatctcac

SEQ ID NO: 54499 - DNA, 22 bp, Homo sapiens
tgtgaccctctccgatgggcag

SEQ ID NO: 54500 - DNA, 22 bp, Homo sapiens
cttttcattgtttgtacatgca

SEQ ID NO: 54501 - DNA, 22 bp, Homo sapiens
cctttgatttcccccgtctcag

SEQ ID NO: 54502 - DNA, 22 bp, Homo sapiens
actgcactccagcctgggtaac

SEQ ID NO: 54503 - DNA, 22 bp, Homo sapiens
actgcactccaacctgggtgac

SEQ ID NO: 54504 - DNA, 19 bp, Homo sapiens
ggtatatgggcctcacttg

SEQ ID NO: 54505 - DNA, 22 bp, Homo sapiens
gctgcagggagctggaaggctc

SEQ ID NO: 54506 - DNA, 22 bp, Homo sapiens
cactgcactccagcctgggtca

SEQ ID NO: 54507 - DNA, 22 bp, Homo sapiens
aaatgcctcattttctctcact

SEQ ID NO: 54508 - DNA, 22 bp, Homo sapiens
gtctttatttgagattgtcatt

SEQ ID NO: 54509 - DNA, 22 bp, Homo sapiens
tttcataatactgtacatgaaa

SEQ ID NO: 54510 - DNA, 22 bp, Homo sapiens
gagccaggggtcagctccgagg

SEQ ID NO: 54511 - DNA, 22 bp, Homo sapiens
aagaggttgtctgtgatgagtt

SEQ ID NO: 54512 - DNA, 22 bp, Homo sapiens
aaagcctcccaggttatgagta

SEQ ID NO: 54513 - DNA, 22 bp, Homo sapiens
tgttgatttgtgggctgcaaaa

SEQ ID NO: 54514 - DNA, 22 bp, Homo sapiens
tgcactccaggctgggtgacag

SEQ ID NO: 54515 - DNA, 22 bp, Homo sapiens
caatgcattattctcccacttc

SEQ ID NO: 54516 - DNA, 22 bp, Homo sapiens
caggagttttaaatctagcatg

SEQ ID NO: 54517 - DNA, 22 bp, Homo sapiens
atcaaatacaaagggcataagg

SEQ ID NO: 54518 - DNA, 22 bp, Homo sapiens
cactgcactccagcccgggcaa

SEQ ID NO: 54519 - DNA, 22 bp, Homo sapiens
ttccatacgactgaggtctcgg

SEQ ID NO: 54520 - DNA, 18 bp, Homo sapiens
tgagaggctattttttgc

SEQ ID NO: 54521 - DNA, 19 bp, Homo sapiens
ccagagagctaggtacaga

SEQ ID NO: 54522 - DNA, 22 bp, Homo sapiens
ttattgaaggaactgaaataaa

SEQ ID NO: 54523 - DNA, 22 bp, Homo sapiens
aatattatacagtcaacctctt

SEQ ID NO: 54524 - DNA, 23 bp, Homo sapiens
ctcaccaagcgccgccgctgtgt

SEQ ID NO: 54525 - DNA, 22 bp, Homo sapiens
ccttacactgcctggggccacg

SEQ ID NO: 54526 - DNA, 22 bp, Homo sapiens
tgtcttcagcagtcatctgggg

SEQ ID NO: 54527 - DNA, 22 bp, Homo sapiens
tcagagagcagaacttttttac

SEQ ID NO: 54528 - DNA, 22 bp, Homo sapiens
aggaatgtgaaacaggtggctg

SEQ ID NO: 54529 - DNA, 22 bp, Homo sapiens
atgagttgaagctacaagaggc

SEQ ID NO: 54530 - DNA, 22 bp, Homo sapiens
tgacttgtctctttgggagaca

SEQ ID NO: 54531 - DNA, 22 bp, Homo sapiens
ttatgggagcaattggggaggt

SEQ ID NO: 54532 - DNA, 22 bp, Homo sapiens
gtagctctgtttaaagttcttt

SEQ ID NO: 54533 - DNA, 22 bp, Homo sapiens
gaattttattactagtcaactg

SEQ ID NO: 54534 - DNA, 22 bp, Homo sapiens
gtaatagtctcaaactcctgga

SEQ ID NO: 54535 - DNA, 22 bp, Homo sapiens
aggacaaaggaccagatctgga

SEQ ID NO: 54536 - DNA, 22 bp, Homo sapiens
tttgcttgttcaagatttctgt

SEQ ID NO: 54537 - DNA, 22 bp, Homo sapiens
tgaacatgctgttgatggcctg

SEQ ID NO: 54538 - DNA, 22 bp, Homo sapiens
cggctcactgcagctccgcctc

SEQ ID NO: 54539 - DNA, 22 bp, Homo sapiens
atgccactgcacttcagcttgg

SEQ ID NO: 54540 - DNA, 22 bp, Homo sapiens
gatgaaggggctggtgccctct

SEQ ID NO: 54541 - DNA, 22 bp, Homo sapiens
cagagactggagtgcagtggcg

SEQ ID NO: 54542 - DNA, 22 bp, Homo sapiens
ctcctgagctctgaggaagctt

SEQ ID NO: 54543 - DNA, 22 bp, Homo sapiens
cagtgcagccaaggacaggcac

SEQ ID NO: 54544 - DNA, 22 bp, Homo sapiens
ctggaggccactgtacagattg

SEQ ID NO: 54545 - DNA, 22 bp, Homo sapiens
gggagctgagctggaagagaat

SEQ ID NO: 54546 - DNA, 22 bp, Homo sapiens
taggtataggattctaggttgg

SEQ ID NO: 54547 - DNA, 22 bp, Homo sapiens
gagaaatgcatgcatgtcatca

SEQ ID NO: 54548 - DNA, 21 bp, Homo sapiens
tcgtgcagcagctgaggcttg

SEQ ID NO: 54549 - DNA, 22 bp, Homo sapiens
gaatatcccgctatgcaaagta

SEQ ID NO: 54550 - DNA, 22 bp, Homo sapiens
acgcccagactcccatactttg

SEQ ID NO: 54551 - DNA, 22 bp, Homo sapiens
ggcgcacaatgtgcaggtttgt

SEQ ID NO: 54552 - DNA, 22 bp, Homo sapiens
tgacttcctgcactcaggtgat

SEQ ID NO: 54553 - DNA, 22 bp, Homo sapiens
attgcactccggcctgggtgac

SEQ ID NO: 54554 - DNA, 22 bp, Homo sapiens
tcagggctgcagaagaggcagg

SEQ ID NO: 54555 - DNA, 17 bp, Homo sapiens
catccgtgagctcggca

SEQ ID NO: 54556 - DNA, 22 bp, Homo sapiens
agatttatgtggtcacactcag

SEQ ID NO: 54557 - DNA, 22 bp, Homo sapiens
agggcgacaatggagagcgttt

SEQ ID NO: 54558 - DNA, 22 bp, Homo sapiens
tggtggctaccaggtcctgggg

SEQ ID NO: 54559 - DNA, 22 bp, Homo sapiens
aaaatcctgctgactcgagatg

SEQ ID NO: 54560 - DNA, 22 bp, Homo sapiens
ggcagacctctccagccccaca

SEQ ID NO: 54561 - DNA, 22 bp, Homo sapiens
cacattccttacattcatagag

SEQ ID NO: 54562 - DNA, 22 bp, Homo sapiens
gctgtgtatcagatgccacggg

SEQ ID NO: 54563 - DNA, 19 bp, Homo sapiens
gttctttcatagtaagagc

SEQ ID NO: 54564 - DNA, 22 bp, Homo sapiens
ttcatcttgatggcttcctaat

SEQ ID NO: 54565 - DNA, 22 bp, Homo sapiens
tggtacacatgtccaaggtcag

SEQ ID NO: 54566 - DNA, 22 bp, Homo sapiens
cttctttcaagaatggattagg

SEQ ID NO: 54567 - DNA, 22 bp, Homo sapiens
attctacatgatagaagggaga

SEQ ID NO: 54568 - DNA, 22 bp, Homo sapiens
gaagtgtagtcttgagccccca

SEQ ID NO: 54569 - DNA, 22 bp, Homo sapiens
gagagtctaggaacctcatata

SEQ ID NO: 54570 - DNA, 22 bp, Homo sapiens
aggaccatcctaaggtaggcaa

SEQ ID NO: 54571 - DNA, 22 bp, Homo sapiens
atattacacacggtatcacggg

SEQ ID NO: 54572 - DNA, 22 bp, Homo sapiens
tttctttatcatagcatctttg

SEQ ID NO: 54573 - DNA, 21 bp, Homo sapiens
tggctaaaccctagtaaatta

SEQ ID NO: 54574 - DNA, 22 bp, Homo sapiens
actgcatttgtctgtctcaatt

SEQ ID NO: 54575 - DNA, 22 bp, Homo sapiens
tctcgctctgtcgcccaggctg

SEQ ID NO: 54576 - DNA, 22 bp, Homo sapiens
agagggatcaccctgtttctgg

SEQ ID NO: 54577 - DNA, 22 bp, Homo sapiens
ttgcccaggctggagtgcagtg

SEQ ID NO: 54578 - DNA, 22 bp, Homo sapiens
tgcactactgtgatacacagcc

SEQ ID NO: 54579 - DNA, 22 bp, Homo sapiens
aacccgggaggcggaggttgtg

SEQ ID NO: 54580 - DNA, 22 bp, Homo sapiens
tcctggtgctgacacccatagc

SEQ ID NO: 54581 - DNA, 22 bp, Homo sapiens
gtggattacaagacagttgaga

SEQ ID NO: 54582 - DNA, 22 bp, Homo sapiens
cagccacttgtgatgctgggga

SEQ ID NO: 54583 - DNA, 22 bp, Homo sapiens
tgcttgaacccaggaagtggag

SEQ ID NO: 54584 - DNA, 22 bp, Homo sapiens
actgcactcctgcctgggtaac

SEQ ID NO: 54585 - DNA, 18 bp, Homo sapiens
ggcgggtgttttattcac

SEQ ID NO: 54586 - DNA, 22 bp, Homo sapiens
ggttccccaggcggcccttgga

SEQ ID NO: 54587 - DNA, 22 bp, Homo sapiens
gggtttcatggttctcacaatg

SEQ ID NO: 54588 - DNA, 22 bp, Homo sapiens
gggagctggagctggaagactc

SEQ ID NO: 54589 - DNA, 22 bp, Homo sapiens
tttagattgtgacctcccccca

SEQ ID NO: 54590 - DNA, 22 bp, Homo sapiens
gttggtgagtttctgatcacaa

SEQ ID NO: 54591 - DNA, 22 bp, Homo sapiens
tgaagctttaggatgggttcat

SEQ ID NO: 54592 - DNA, 22 bp, Homo sapiens
tccttagacaaagagtgggctt

SEQ ID NO: 54593 - DNA, 22 bp, Homo sapiens
ttattaggaactcaggattttt

SEQ ID NO: 54594 - DNA, 22 bp, Homo sapiens
agttgcagacgcagagatgttg

SEQ ID NO: 54595 - DNA, 22 bp, Homo sapiens
tccccagcttgctacttctgct

SEQ ID NO: 54596 - DNA, 22 bp, Homo sapiens
aacactgctgctgggttctgtg

SEQ ID NO: 54597 - DNA, 22 bp, Homo sapiens
gctggaggatggactggaagaa

SEQ ID NO: 54598 - DNA, 22 bp, Homo sapiens
taactctgaatcctcacagcag

SEQ ID NO: 54599 - DNA, 22 bp, Homo sapiens
cggccgcagcagtgtcggccca

SEQ ID NO: 54600 - DNA, 22 bp, Homo sapiens
caggagtccatctggcctggtg

SEQ ID NO: 54601 - DNA, 22 bp, Homo sapiens
ttttctagggtgctaaatgaac

SEQ ID NO: 54602 - DNA, 22 bp, Homo sapiens
aagggctctgtgcttgtcccat

SEQ ID NO: 54603 - DNA, 22 bp, Homo sapiens
caagcgtggctgctctgatgga

SEQ ID NO: 54604 - DNA, 22 bp, Homo sapiens
gactactcaaactttctctata

SEQ ID NO: 54605 - DNA, 22 bp, Homo sapiens
gaggagggagctggaagctctt

SEQ ID NO: 54606 - DNA, 22 bp, Homo sapiens
gtgcgggcctgggggtttctct

SEQ ID NO: 54607 - DNA, 22 bp, Homo sapiens
gcttagcaaacatctgtagtcc

SEQ ID NO: 54608 - DNA, 22 bp, Homo sapiens
ctggcccaggtggtcgttgagg

SEQ ID NO: 54609 - DNA, 22 bp, Homo sapiens
gagacacaggcacagaagaggc

SEQ ID NO: 54610 - DNA, 22 bp, Homo sapiens
atgattgaaaatgacattgcca

SEQ ID NO: 54611 - DNA, 22 bp, Homo sapiens
catggcggtcaggatgtaggtg

SEQ ID NO: 54612 - DNA, 23 bp, Homo sapiens
ccactagcacctgttcaacttct

SEQ ID NO: 54613 - DNA, 22 bp, Homo sapiens
ctggtttgtcttgggaggatgt

SEQ ID NO: 54614 - DNA, 22 bp, Homo sapiens
cccgggaggaggaagttgcagt

SEQ ID NO: 54615 - DNA, 22 bp, Homo sapiens
acccggagtcggaggttgcagt

SEQ ID NO: 54616 - DNA, 22 bp, Homo sapiens
gcccagtagttcaaggttgcag

SEQ ID NO: 54617 - DNA, 22 bp, Homo sapiens
cttcatgctgatatcctcgatg

SEQ ID NO: 54618 - DNA, 22 bp, Homo sapiens
atgacaagagtgttcagggaga

SEQ ID NO: 54619 - DNA, 22 bp, Homo sapiens
gggagaagaatgtgtcaattgt

SEQ ID NO: 54620 - DNA, 22 bp, Homo sapiens
tggacaacatagtgagacctca

SEQ ID NO: 54621 - DNA, 22 bp, Homo sapiens
ggctgtggcagctggaagtggt

SEQ ID NO: 54622 - DNA, 22 bp, Homo sapiens
acgtcttcgttggcagagattt

SEQ ID NO: 54623 - DNA, 22 bp, Homo sapiens
gggcaacagagcgagggcctgt

SEQ ID NO: 54624 - DNA, 22 bp, Homo sapiens
accactgcccatggtgaaaact

SEQ ID NO: 54625 - DNA, 22 bp, Homo sapiens
tgtgcctactgatagagccaag

SEQ ID NO: 54626 - DNA, 22 bp, Homo sapiens
tactaggaagcagctgcattgg

SEQ ID NO: 54627 - DNA, 22 bp, Homo sapiens
atacacgtgccatgttggtgtg

SEQ ID NO: 54628 - DNA, 22 bp, Homo sapiens
gagcaacagtggcagtggtggg

SEQ ID NO: 54629 - DNA, 22 bp, Homo sapiens
tgaatatgtgactttgatttca

SEQ ID NO: 54630 - DNA, 22 bp, Homo sapiens
ctacttgttcactgtaggtcgc

SEQ ID NO: 54631 - DNA, 22 bp, Homo sapiens
ttaaattttagaaacagactct

SEQ ID NO: 54632 - DNA, 22 bp, Homo sapiens
ccggctactcgggaggctgacg

SEQ ID NO: 54633 - DNA, 22 bp, Homo sapiens
atgtgggccgtgcgggtgtcct

SEQ ID NO: 54634 - DNA, 22 bp, Homo sapiens
acttattagacatcttcattgt

SEQ ID NO: 54635 - DNA, 22 bp, Homo sapiens
aagaaatgctgatgttggatgg

SEQ ID NO: 54636 - DNA, 22 bp, Homo sapiens
ggtggttcacgcctataatccc

SEQ ID NO: 54637 - DNA, 22 bp, Homo sapiens
tcattgccatggcatttgcaga

SEQ ID NO: 54638 - DNA, 22 bp, Homo sapiens
cactgcactccagcctgggaga

SEQ ID NO: 54639 - DNA, 22 bp, Homo sapiens
tggggtcccaactctgattgat

SEQ ID NO: 54640 - DNA, 22 bp, Homo sapiens
tctagttctagatccctgagga

SEQ ID NO: 54641 - DNA, 22 bp, Homo sapiens
ttcttcatgggttcttttagga

SEQ ID NO: 54642 - DNA, 22 bp, Homo sapiens
gcgcaccacctccaggtggccg

SEQ ID NO: 54643 - DNA, 22 bp, Homo sapiens
atccaccctgtggtggctttct

SEQ ID NO: 54644 - DNA, 22 bp, Homo sapiens
ttgcccagagtcacccagctca

SEQ ID NO: 54645 - DNA, 22 bp, Homo sapiens
cgtgagcaaaatggacactccc

SEQ ID NO: 54646 - DNA, 23 bp, Homo sapiens
ttgcttgagcccaggaagtggag

SEQ ID NO: 54647 - DNA, 22 bp, Homo sapiens
tgagggaatattgatagatccg

SEQ ID NO: 54648 - DNA, 22 bp, Homo sapiens
agcctattccaggatgagctca

SEQ ID NO: 54649 - DNA, 22 bp, Homo sapiens
aggccttaccatagctgtagca

SEQ ID NO: 54650 - DNA, 22 bp, Homo sapiens
tttacagcagcatgatttataa

SEQ ID NO: 54651 - DNA, 22 bp, Homo sapiens
aggcaatcccctgaggatactt

SEQ ID NO: 54652 - DNA, 22 bp, Homo sapiens
ccaggcaggcgatggtgcagtg

SEQ ID NO: 54653 - DNA, 22 bp, Homo sapiens
tgtgtgagtaaggctgagagag

SEQ ID NO: 54654 - DNA, 20 bp, Homo sapiens
caaatccctgctctgtgctg

SEQ ID NO: 54655 - DNA, 23 bp, Homo sapiens
ggcactcggccgtgaactcgtgc

SEQ ID NO: 54656 - DNA, 22 bp, Homo sapiens
tccctgatgccttgatccgtgg

SEQ ID NO: 54657 - DNA, 22 bp, Homo sapiens
acgcctgtaatcccagcacttt

SEQ ID NO: 54658 - DNA, 22 bp, Homo sapiens
aggtattattagcatctctatt

SEQ ID NO: 54659 - DNA, 22 bp, Homo sapiens
aaaaaattatcatagttcctga

SEQ ID NO: 54660 - DNA, 22 bp, Homo sapiens
cggggccctggggctgaaggtc

SEQ ID NO: 54661 - DNA, 22 bp, Homo sapiens
tctgtcttagccatctcaggct

SEQ ID NO: 54662 - DNA, 18 bp, Homo sapiens
tctgccccagccgcactg

SEQ ID NO: 54663 - DNA, 22 bp, Homo sapiens
aaaaatcacttttataggcagc

SEQ ID NO: 54664 - DNA, 22 bp, Homo sapiens
acatcctcccgatctactggct

SEQ ID NO: 54665 - DNA, 22 bp, Homo sapiens
tttagggacaagggtctggggt

SEQ ID NO: 54666 - DNA, 22 bp, Homo sapiens
gccttgtttcattacacgtggt

SEQ ID NO: 54667 - DNA, 22 bp, Homo sapiens
ggcagggagtggagactcccta

SEQ ID NO: 54668 - DNA, 20 bp, Homo sapiens
tgcagcacgggccctttcca

SEQ ID NO: 54669 - DNA, 22 bp, Homo sapiens
cctgtggcgggggccagtgcct

SEQ ID NO: 54670 - DNA, 22 bp, Homo sapiens
tcactgcaacctccacctcccg

SEQ ID NO: 54671 - DNA, 22 bp, Homo sapiens
cactgcacttcagcctgggtga

SEQ ID NO: 54672 - DNA, 22 bp, Homo sapiens
cttgatctacatagtgaaaccc

SEQ ID NO: 54673 - DNA, 22 bp, Homo sapiens
tgcagaaacaagccatcattca

SEQ ID NO: 54674 - DNA, 22 bp, Homo sapiens
cacctgtacagggccgggctgg

SEQ ID NO: 54675 - DNA, 22 bp, Homo sapiens
actgcacttcaccctgggtgac

SEQ ID NO: 54676 - DNA, 22 bp, Homo sapiens
tttaaaaaactagtctgagtct

SEQ ID NO: 54677 - DNA, 22 bp, Homo sapiens
aagtgccccaggctgttaacat

SEQ ID NO: 54678 - DNA, 23 bp, Homo sapiens
aaaacagcttcctccagtggctc

SEQ ID NO: 54679 - DNA, 22 bp, Homo sapiens
cactgcactccagcctgggtga

SEQ ID NO: 54680 - DNA, 22 bp, Homo sapiens
cccagttgttgccggctctgga

SEQ ID NO: 54681 - DNA, 22 bp, Homo sapiens
gcctgatgagcttccagctgag

SEQ ID NO: 54682 - DNA, 22 bp, Homo sapiens
tttgaggttagctagcagatca

SEQ ID NO: 54683 - DNA, 22 bp, Homo sapiens
cgagcatgatgacggctgtggc

SEQ ID NO: 54684 - DNA, 22 bp, Homo sapiens
tcgcccaggctggaagtgcagt

SEQ ID NO: 54685 - DNA, 22 bp, Homo sapiens
tgctggaggccagaagtctgag

SEQ ID NO: 54686 - DNA, 22 bp, Homo sapiens
aggacttagaacattatgtact

SEQ ID NO: 54687 - DNA, 22 bp, Homo sapiens
acaggatcgccctgttgcccag

SEQ ID NO: 54688 - DNA, 22 bp, Homo sapiens
tagggaccttagaattgtatgt

SEQ ID NO: 54689 - DNA, 22 bp, Homo sapiens
agtgggtgtagtcttcctcctg

SEQ ID NO: 54690 - DNA, 22 bp, Homo sapiens
gccatcatatcccctgtgacct

SEQ ID NO: 54691 - DNA, 22 bp, Homo sapiens
ctgtatctgtgttggatgagtt

SEQ ID NO: 54692 - DNA, 22 bp, Homo sapiens
tttcccaggctggaatgcagtg

SEQ ID NO: 54693 - DNA, 22 bp, Homo sapiens
tttcagatggaggtttaggaca

SEQ ID NO: 54694 - DNA, 22 bp, Homo sapiens
atcctagaatcagcccttgctg

SEQ ID NO: 54695 - DNA, 22 bp, Homo sapiens
tctgtgcctgcttccccaccca

SEQ ID NO: 54696 - DNA, 22 bp, Homo sapiens
tctgagacaggaagtggagggt

SEQ ID NO: 54697 - DNA, 22 bp, Homo sapiens
tgagtgaggctgggcagtccct

SEQ ID NO: 54698 - DNA, 22 bp, Homo sapiens
gtacaaatgcaggtttgttaca

SEQ ID NO: 54699 - DNA, 22 bp, Homo sapiens
gacccggctccaggcccagcag

SEQ ID NO: 54700 - DNA, 22 bp, Homo sapiens
gatgggcgtggcgcgtttggtg

SEQ ID NO: 54701 - DNA, 22 bp, Homo sapiens
cctccccacagcccaggagact

SEQ ID NO: 54702 - DNA, 22 bp, Homo sapiens
agcccggcttccccggttgcta

SEQ ID NO: 54703 - DNA, 22 bp, Homo sapiens
actgttttctgtaaagggccag

SEQ ID NO: 54704 - DNA, 22 bp, Homo sapiens
gggagaggttacccgagcaact

SEQ ID NO: 54705 - DNA, 22 bp, Homo sapiens
aggctcccaagcactgacccca

SEQ ID NO: 54706 - DNA, 22 bp, Homo sapiens
gattgagtctgaggatgctgca

SEQ ID NO: 54707 - DNA, 22 bp, Homo sapiens
attgcacttcagcctgggtgac

SEQ ID NO: 54708 - DNA, 22 bp, Homo sapiens
tcagtgcagggtgggagagaga

SEQ ID NO: 54709 - DNA, 22 bp, Homo sapiens
tagtcagtgcacagacacttgt

SEQ ID NO: 54710 - DNA, 22 bp, Homo sapiens
tacctcaagttccaggaaagcg

SEQ ID NO: 54711 - DNA, 22 bp, Homo sapiens
acgtgcaggatctggttggcga

SEQ ID NO: 54712 - DNA, 22 bp, Homo sapiens
gaccctgtttctacaaataatt

SEQ ID NO: 54713 - DNA, 22 bp, Homo sapiens
ctgattgagaaggaaggggatc

SEQ ID NO: 54714 - DNA, 22 bp, Homo sapiens
taattataacagttacatctta

SEQ ID NO: 54715 - DNA, 22 bp, Homo sapiens
agagaagagtcttgtcaaatta

SEQ ID NO: 54716 - DNA, 22 bp, Homo sapiens
aaagattaaatcaaattggtca

SEQ ID NO: 54717 - DNA, 22 bp, Homo sapiens
actattagcatatcatgaatgg

SEQ ID NO: 54718 - DNA, 22 bp, Homo sapiens
ctggagagaatgtggaatgatt

SEQ ID NO: 54719 - DNA, 22 bp, Homo sapiens
agtaatcaatttttcggtggat

SEQ ID NO: 54720 - DNA, 20 bp, Homo sapiens
aggaaaaatggaaactggag

SEQ ID NO: 54721 - DNA, 22 bp, Homo sapiens
gaaaattattgaaaatggctct

SEQ ID NO: 54722 - DNA, 20 bp, Homo sapiens
attagagctacatggctaca

SEQ ID NO: 54723 - DNA, 22 bp, Homo sapiens
taagaaatttagttatagaatg

SEQ ID NO: 54724 - DNA, 20 bp, Homo sapiens
ctgccgaccacagccatgga

SEQ ID NO: 54725 - DNA, 22 bp, Homo sapiens
aagaactgtttacaattttcac

SEQ ID NO: 54726 - DNA, 22 bp, Homo sapiens
caaatactacgattcttgcagt

SEQ ID NO: 54727 - DNA, 22 bp, Homo sapiens
ttaagtaacttgtccaaatgag

SEQ ID NO: 54728 - DNA, 22 bp, Homo sapiens
aagtagttaggaacattctctc

SEQ ID NO: 54729 - DNA, 22 bp, Homo sapiens
gtggggtagatctttctcagga

SEQ ID NO: 54730 - DNA, 23 bp, Homo sapiens
cagtctgcagcccacttgggcag

SEQ ID NO: 54731 - DNA, 22 bp, Homo sapiens
gactttctgatgtaaacattta

SEQ ID NO: 54732 - DNA, 22 bp, Homo sapiens
agagcactttcgagagccggag

SEQ ID NO: 54733 - DNA, 18 bp, Homo sapiens
cagggctgtggggtcact

SEQ ID NO: 54734 - DNA, 22 bp, Homo sapiens
actttatttcctattgcatcca

SEQ ID NO: 54735 - DNA, 22 bp, Homo sapiens
tacaaaaaattgatactgacga

SEQ ID NO: 54736 - DNA, 22 bp, Homo sapiens
agcactgtgagcaccagcacgc

SEQ ID NO: 54737 - DNA, 22 bp, Homo sapiens
gaatttaagaggatgaatctgt

SEQ ID NO: 54738 - DNA, 22 bp, Homo sapiens
gagcagtgtttgtggacctgga

SEQ ID NO: 54739 - DNA, 22 bp, Homo sapiens
ataatctttcttttccagatag

SEQ ID NO: 54740 - DNA, 22 bp, Homo sapiens
ttccaaagaagttcacatttac

SEQ ID NO: 54741 - DNA, 22 bp, Homo sapiens
aatgaattgcagtactgacttg

SEQ ID NO: 54742 - DNA, 22 bp, Homo sapiens
tagcaaaggatgactatgtacc

SEQ ID NO: 54743 - DNA, 22 bp, Homo sapiens
agaacgtggaatgtggctcctt

SEQ ID NO: 54744 - DNA, 22 bp, Homo sapiens
aaagaaatagatggcatttaaa

SEQ ID NO: 54745 - DNA, 22 bp, Homo sapiens
aagaactgagtacgttaataaa

SEQ ID NO: 54746 - DNA, 22 bp, Homo sapiens
taaatacttagttttgtgtcta

SEQ ID NO: 54747 - DNA, 22 bp, Homo sapiens
aggtaaacaggagaaaatgaga

SEQ ID NO: 54748 - DNA, 22 bp, Homo sapiens
acatgtttaagtttgttatatg

SEQ ID NO: 54749 - DNA, 22 bp, Homo sapiens
agcttgacagacagatggtagc

SEQ ID NO: 54750 - DNA, 22 bp, Homo sapiens
gactggtaaggaaattcactaa

SEQ ID NO: 54751 - DNA, 22 bp, Homo sapiens
tgtccaggctaaagtgcagtgg

SEQ ID NO: 54752 - DNA, 22 bp, Homo sapiens
accccagaggcggaggctgcag

SEQ ID NO: 54753 - DNA, 22 bp, Homo sapiens
caaatgaatatttccatgggtt

SEQ ID NO: 54754 - DNA, 22 bp, Homo sapiens
ttctaattaaatctacgctagg

SEQ ID NO: 54755 - DNA, 22 bp, Homo sapiens
tgacagtattgatggcaggatt

SEQ ID NO: 54756 - DNA, 22 bp, Homo sapiens
taattataacatgctttctggc

SEQ ID NO: 54757 - DNA, 22 bp, Homo sapiens
tatacactgttgttgggagtct

SEQ ID NO: 54758 - DNA, 22 bp, Homo sapiens
tgtccaggctggagtgcagtgg

SEQ ID NO: 54759 - DNA, 22 bp, Homo sapiens
gagcactgagctggaattggag

SEQ ID NO: 54760 - DNA, 22 bp, Homo sapiens
atattagtttggagactacaat

SEQ ID NO: 54761 - DNA, 22 bp, Homo sapiens
actgggcctacccagattggca

SEQ ID NO: 54762 - DNA, 22 bp, Homo sapiens
tctttcattctagtctgaggtt

SEQ ID NO: 54763 - DNA, 22 bp, Homo sapiens
aaagctaaggtagcattggaga

SEQ ID NO: 54764 - DNA, 22 bp, Homo sapiens
tcagtgcacccaattctctcca

SEQ ID NO: 54765 - DNA, 22 bp, Homo sapiens
gtcttagatttcaccgataatg

SEQ ID NO: 54766 - DNA, 22 bp, Homo sapiens
acatctagactcttgccctctt

SEQ ID NO: 54767 - DNA, 22 bp, Homo sapiens
ttgaggcaggtccgggtccttc

SEQ ID NO: 54768 - DNA, 22 bp, Homo sapiens
gaggactgaaacttacaggaaa

SEQ ID NO: 54769 - DNA, 22 bp, Homo sapiens
agaatagaattctcatagaatt

SEQ ID NO: 54770 - DNA, 22 bp, Homo sapiens
gcctggccgggtcttggatttt

SEQ ID NO: 54771 - DNA, 22 bp, Homo sapiens
tgcagaaacaagccatcattca

SEQ ID NO: 54772 - DNA, 22 bp, Homo sapiens
ggagacagggttgaaccacgca

SEQ ID NO: 54773 - DNA, 22 bp, Homo sapiens
ttttctagggtgctaaatgaac

SEQ ID NO: 54774 - DNA, 22 bp, Homo sapiens
agctgctgagccaggctgatgt

SEQ ID NO: 54775 - DNA, 21 bp, Homo sapiens
gcccacagtgaggaggatccc

SEQ ID NO: 54776 - DNA, 22 bp, Homo sapiens
tggagggcatgctgtccatggg

SEQ ID NO: 54777 - DNA, 19 bp, Homo sapiens
tctcaattctccccactgc

SEQ ID NO: 54778 - DNA, 22 bp, Homo sapiens
ctcagggccaaggatgctgttg

SEQ ID NO: 54779 - DNA, 22 bp, Homo sapiens
agcaagattgaggcttcctcag

SEQ ID NO: 54780 - DNA, 22 bp, Homo sapiens
acccaggctggagtgcagtggc

SEQ ID NO: 54781 - DNA, 20 bp, Homo sapiens
cctgtcatcccagcattttg

SEQ ID NO: 54782 - DNA, 22 bp, Homo sapiens
atatattttttgagacagagtc

SEQ ID NO: 54783 - DNA, 22 bp, Homo sapiens
tctgccttgtttgagctttgac

SEQ ID NO: 54784 - DNA, 21 bp, Homo sapiens
ttgctgttttcccaatgcagt

SEQ ID NO: 54785 - DNA, 22 bp, Homo sapiens
tgctgggctggggcctcagacc

SEQ ID NO: 54786 - DNA, 17 bp, Homo sapiens
gggcagggactcctggg

SEQ ID NO: 54787 - DNA, 23 bp, Homo sapiens
aaaacagcttcctccagtggctc

SEQ ID NO: 54788 - DNA, 22 bp, Homo sapiens
agctacagtcggaaggacagac

SEQ ID NO: 54789 - DNA, 22 bp, Homo sapiens
ggagaggggaacttgttgcttg

SEQ ID NO: 54790 - DNA, 22 bp, Homo sapiens
atgcagaagactgaaaagctga

SEQ ID NO: 54791 - DNA, 22 bp, Homo sapiens
tgtgtgcatgcttggggcagca

SEQ ID NO: 54792 - DNA, 17 bp, Homo sapiens
aggtgggtggatcacct

SEQ ID NO: 54793 - DNA, 22 bp, Homo sapiens
tcacgtgagggacctgtgtctg

SEQ ID NO: 54794 - DNA, 22 bp, Homo sapiens
tcctgggacaagccgtggaagt

SEQ ID NO: 54795 - DNA, 22 bp, Homo sapiens
cccttagaattttgtagttatt

SEQ ID NO: 54796 - DNA, 22 bp, Homo sapiens
tccacgtgagcttcgtgtgcag

SEQ ID NO: 54797 - DNA, 22 bp, Homo sapiens
gagcactgagctggaattggag

SEQ ID NO: 54798 - DNA, 19 bp, Homo sapiens
ggctgccttctgctcatct

SEQ ID NO: 54799 - DNA, 23 bp, Homo sapiens
ggagtgcaatggcgccatctcgg

SEQ ID NO: 54800 - DNA, 22 bp, Homo sapiens
agccggccatgtggtcttgtgc

SEQ ID NO: 54801 - DNA, 19 bp, Homo sapiens
gggtcccactgcccgtctg

SEQ ID NO: 54802 - DNA, 19 bp, Homo sapiens
ccatggcaatgatctgatg

SEQ ID NO: 54803 - DNA, 22 bp, Homo sapiens
ccaggcaggcgatggtgcagtg

SEQ ID NO: 54804 - DNA, 22 bp, Homo sapiens
gggatctgggacaacaggtggt

SEQ ID NO: 54805 - DNA, 22 bp, Homo sapiens
agcccttagtacatttctcaag

SEQ ID NO: 54806 - DNA, 19 bp, Homo sapiens
gactccaactttaagcatg

SEQ ID NO: 54807 - DNA, 22 bp, Homo sapiens
ctgcaccctcaaactcctgggc

SEQ ID NO: 54808 - DNA, 22 bp, Homo sapiens
tttgagtagtgagactaggcag

SEQ ID NO: 54809 - DNA, 22 bp, Homo sapiens
tggctcctcacgtcctcagagc

SEQ ID NO: 54810 - DNA, 22 bp, Homo sapiens
gcgccccatctacagtactttt

SEQ ID NO: 54811 - DNA, 22 bp, Homo sapiens
gatggtgcaggtgaagtgctgg

SEQ ID NO: 54812 - DNA, 22 bp, Homo sapiens
cagggcctcctaaggcatctaa

SEQ ID NO: 54813 - DNA, 22 bp, Homo sapiens
gtgagcagagatcgcgtgattg

SEQ ID NO: 54814 - DNA, 22 bp, Homo sapiens
acactgtgtgacttctgagact

SEQ ID NO: 54815 - DNA, 21 bp, Homo sapiens
tctgcaccccagcctgagtga

SEQ ID NO: 54816 - DNA, 22 bp, Homo sapiens
agaagcctgttgagagggccgt

SEQ ID NO: 54817 - DNA, 22 bp, Homo sapiens
tggaaaactttggtggtgaggg

SEQ ID NO: 54818 - DNA, 22 bp, Homo sapiens
tttaatcaggcaaagcataata

SEQ ID NO: 54819 - DNA, 22 bp, Homo sapiens
agtcaggggatctagacttgaa

SEQ ID NO: 54820 - DNA, 22 bp, Homo sapiens
agcataagttggtacagccact

SEQ ID NO: 54821 - DNA, 22 bp, Homo sapiens
tccagcccaggctggagtgtag

SEQ ID NO: 54822 - DNA, 22 bp, Homo sapiens
caggagtgttgattgctcagga

SEQ ID NO: 54823 - DNA, 22 bp, Homo sapiens
tcagccagccagctacaggctt

SEQ ID NO: 54824 - DNA, 22 bp, Homo sapiens
gggtccctggaattacttgaca

SEQ ID NO: 54825 - DNA, 22 bp, Homo sapiens
tgacttcctgcactcaggtgat

SEQ ID NO: 54826 - DNA, 22 bp, Homo sapiens
ttgggcctctcaaagtgctggg

SEQ ID NO: 54827 - DNA, 22 bp, Homo sapiens
ctgccctggggggcctccttgc

SEQ ID NO: 54828 - DNA, 22 bp, Homo sapiens
gttccaggtggtcacagagctc

SEQ ID NO: 54829 - DNA, 22 bp, Homo sapiens
gaaagacatagttgcaagatgg

SEQ ID NO: 54830 - DNA, 22 bp, Homo sapiens
tccctagtcgcatctgtggaga

SEQ ID NO: 54831 - DNA, 22 bp, Homo sapiens
gcaggtctgttgattacagtca

SEQ ID NO: 54832 - DNA, 22 bp, Homo sapiens
actgcactccagcctgggtgac

SEQ ID NO: 54833 - DNA, 22 bp, Homo sapiens
ttgtacttgccatagaacaaca

SEQ ID NO: 54834 - DNA, 21 bp, Homo sapiens
aaactgaccttgcctgagaca

SEQ ID NO: 54835 - DNA, 21 bp, Homo sapiens
ggagtttttctggaagggact

SEQ ID NO: 54836 - DNA, 22 bp, Homo sapiens
tacagaggaggggattttaata

SEQ ID NO: 54837 - DNA, 22 bp, Homo sapiens
tttcttaggctctaaaatgact

SEQ ID NO: 54838 - DNA, 22 bp, Homo sapiens
gttgcagatgtggaactcgtgc

SEQ ID NO: 54839 - DNA, 22 bp, Homo sapiens
catccctgtcgtcaagtctctg

SEQ ID NO: 54840 - DNA, 22 bp, Homo sapiens
aaccaccaccgtaatttaccca

SEQ ID NO: 54841 - DNA, 22 bp, Homo sapiens
ttggccatctaagcccagccac

SEQ ID NO: 54842 - DNA, 22 bp, Homo sapiens
ccttacctgattgctggcatcc

SEQ ID NO: 54843 - DNA, 22 bp, Homo sapiens
gtatccatgggggattggttcc

SEQ ID NO: 54844 - DNA, 20 bp, Homo sapiens
gtgtggccaggagctgcgct

SEQ ID NO: 54845 - DNA, 22 bp, Homo sapiens
ccagatgtccctctcaggtttg

SEQ ID NO: 54846 - DNA, 19 bp, Homo sapiens
catggtgaaaccccgtctc

SEQ ID NO: 54847 - DNA, 22 bp, Homo sapiens
taggtataggattctaggttgg

SEQ ID NO: 54848 - DNA, 22 bp, Homo sapiens
gggcagagactcagaaacagaa

SEQ ID NO: 54849 - DNA, 17 bp, Homo sapiens
ggctgcagtccaggagg

SEQ ID NO: 54850 - DNA, 22 bp, Homo sapiens
ccaggaggcggaggttgcagcg

SEQ ID NO: 54851 - DNA, 22 bp, Homo sapiens
gggaagatagtgttgagggccc

SEQ ID NO: 54852 - DNA, 22 bp, Homo sapiens
cccaagaggtggaggttgcagt

SEQ ID NO: 54853 - DNA, 17 bp, Homo sapiens
ttaaggtggatcagcac

SEQ ID NO: 54854 - DNA, 22 bp, Homo sapiens
gtggcagaccttcccttctcct

SEQ ID NO: 54855 - DNA, 22 bp, Homo sapiens
ccaagctacttaggagtctgag

SEQ ID NO: 54856 - DNA, 22 bp, Homo sapiens
atgtgggccgtgcgggtgtcct

SEQ ID NO: 54857 - DNA, 22 bp, Homo sapiens
gctgtctgtcttcacatctcgc

SEQ ID NO: 54858 - DNA, 22 bp, Homo sapiens
gaggccaaggtgggcagatcac

SEQ ID NO: 54859 - DNA, 22 bp, Homo sapiens
gagcgattgcgggggtcagagg

SEQ ID NO: 54860 - DNA, 22 bp, Homo sapiens
caggaagctgtgaaggagacgg

SEQ ID NO: 54861 - DNA, 22 bp, Homo sapiens
tacaccattcccaggtggattt

SEQ ID NO: 54862 - DNA, 22 bp, Homo sapiens
gtggcctggctggcaccacctc

SEQ ID NO: 54863 - DNA, 22 bp, Homo sapiens
ctgagcctcctgcttctatttc

SEQ ID NO: 54864 - DNA, 22 bp, Homo sapiens
gagcacgttgaagcgcactgtc

SEQ ID NO: 54865 - DNA, 22 bp, Homo sapiens
ctgaggcaggcagatcacttga

SEQ ID NO: 54866 - DNA, 22 bp, Homo sapiens
gctgtgcagaggtgagaatcca

SEQ ID NO: 54867 - DNA, 22 bp, Homo sapiens
agacagctggtagcacttcctg

SEQ ID NO: 54868 - DNA, 22 bp, Homo sapiens
tgtacttgaacttgactgtaga

SEQ ID NO: 54869 - DNA, 22 bp, Homo sapiens
ctgtcaggtttcccggctcacg

SEQ ID NO: 54870 - DNA, 22 bp, Homo sapiens
tcttggattttaatggatcaaa

SEQ ID NO: 54871 - DNA, 22 bp, Homo sapiens
aaagattaaatcaaattggtca

SEQ ID NO: 54872 - DNA, 22 bp, Homo sapiens
gtcagatctttggggatgctgt

SEQ ID NO: 54873 - DNA, 22 bp, Homo sapiens
aaaggctttaaaatgtacatat

SEQ ID NO: 54874 - DNA, 22 bp, Homo sapiens
ttcccacattctttacattcat

SEQ ID NO: 54875 - DNA, 22 bp, Homo sapiens
tttgcattgcattaagtattct

SEQ ID NO: 54876 - DNA, 22 bp, Homo sapiens
tgttttaagggtcaactgtcac

SEQ ID NO: 54877 - DNA, 21 bp, Homo sapiens
tcgtgcagcagctgaggcttg

SEQ ID NO: 54878 - DNA, 22 bp, Homo sapiens
cttcagctcttggtaaatgttt

SEQ ID NO: 54879 - DNA, 23 bp, Homo sapiens
cagagctggcttcatgggtgtgc

SEQ ID NO: 54880 - DNA, 22 bp, Homo sapiens
aggtcacccgtttgactatcca

SEQ ID NO: 54881 - DNA, 22 bp, Homo sapiens
ggaggcagaatagagtgtgggt

SEQ ID NO: 54882 - DNA, 22 bp, Homo sapiens
ctgcactgacttccccggctgc

SEQ ID NO: 54883 - DNA, 22 bp, Homo sapiens
catctctggcttggattatggt

SEQ ID NO: 54884 - DNA, 22 bp, Homo sapiens
atcctagaatcagcccttgctg

SEQ ID NO: 54885 - DNA, 22 bp, Homo sapiens
ttgggctcaggagtttgagacc

SEQ ID NO: 54886 - DNA, 22 bp, Homo sapiens
caaagtgctgggattacaggct

SEQ ID NO: 54887 - DNA, 22 bp, Homo sapiens
gactggtaaggaaattcactaa

SEQ ID NO: 54888 - DNA, 22 bp, Homo sapiens
aatgttacgatcaacaacacat

SEQ ID NO: 54889 - DNA, 22 bp, Homo sapiens
caccaggctggagtgcagtggc

SEQ ID NO: 54890 - DNA, 22 bp, Homo sapiens
agctcagggccaggcgcgtttc

SEQ ID NO: 54891 - DNA, 22 bp, Homo sapiens
gagcagtaggagaaccctgagc

SEQ ID NO: 54892 - DNA, 22 bp, Homo sapiens
agcccggcttccccggttgcta

SEQ ID NO: 54893 - DNA, 22 bp, Homo sapiens
gtaatagtctcaaactcctgga

SEQ ID NO: 54894 - DNA, 23 bp, Homo sapiens
tcaagcaattctcctgcctcggc

SEQ ID NO: 54895 - DNA, 22 bp, Homo sapiens
tagggggctttgctgcttgaca

SEQ ID NO: 54896 - DNA, 19 bp, Homo sapiens
gctgttaaggaccctcgga

SEQ ID NO: 54897 - DNA, 22 bp, Homo sapiens
tctgagaaatttctttgtgatg

SEQ ID NO: 54898 - DNA, 22 bp, Homo sapiens
tctcccctggtctcgcgcgctg

SEQ ID NO: 54899 - DNA, 22 bp, Homo sapiens
tctcaagcttgttggtatgttt

SEQ ID NO: 54900 - DNA, 20 bp, Homo sapiens
ccagagctgatggctgcccg

SEQ ID NO: 54901 - DNA, 22 bp, Homo sapiens
gccccagcctcccgagtagctg

SEQ ID NO: 54902 - DNA, 22 bp, Homo sapiens
taaggctatcttttgagtgtgt

SEQ ID NO: 54903 - DNA, 22 bp, Homo sapiens
ggttgcaaactcctgggatcaa

SEQ ID NO: 54904 - DNA, 22 bp, Homo sapiens
ttctcttacattttctcagcct

SEQ ID NO: 54905 - DNA, 22 bp, Homo sapiens
ttaagggccattatggatgggt

SEQ ID NO: 54906 - DNA, 22 bp, Homo sapiens
agagcagctcgctacctctcta

SEQ ID NO: 54907 - DNA, 22 bp, Homo sapiens
gagggaaaggttaatacatgat

SEQ ID NO: 54908 - DNA, 21 bp, Homo sapiens
ggtgacacgtggccccgctct

SEQ ID NO: 54909 - DNA, 22 bp, Homo sapiens
agatttatgtggtcacactcag

SEQ ID NO: 54910 - DNA, 19 bp, Homo sapiens
tcctggggaggggcatggc

SEQ ID NO: 54911 - DNA, 22 bp, Homo sapiens
cctgacaggcggaggctgcagt

SEQ ID NO: 54912 - DNA, 22 bp, Homo sapiens
cctgggctctgtcagaattggg

SEQ ID NO: 54913 - DNA, 22 bp, Homo sapiens
aaaggacacacaggaggtgtct

SEQ ID NO: 54914 - DNA, 22 bp, Homo sapiens
aggtagaaggaccagaatttat

SEQ ID NO: 54915 - DNA, 22 bp, Homo sapiens
taattagtgtccagcttctgct

SEQ ID NO: 54916 - DNA, 22 bp, Homo sapiens
gacaagctcccggtggccctcc

SEQ ID NO: 54917 - DNA, 22 bp, Homo sapiens
gggaggctctgctcagcccccg

SEQ ID NO: 54918 - DNA, 22 bp, Homo sapiens
cccagggaggcccaggctctgc

SEQ ID NO: 54919 - DNA, 22 bp, Homo sapiens
acccagggctcaagcgtaggca

SEQ ID NO: 54920 - DNA, 22 bp, Homo sapiens
ttttctaacatctagtaatttg

SEQ ID NO: 54921 - DNA, 20 bp, Homo sapiens
tatgtgattttctcatcaat

SEQ ID NO: 54922 - DNA, 22 bp, Homo sapiens
tcacttagatggggatcatcac

SEQ ID NO: 54923 - DNA, 22 bp, Homo sapiens
gagctgaaggagaaagcagggg

SEQ ID NO: 54924 - DNA, 22 bp, Homo sapiens
cagcaagtcatccaggatgatg

SEQ ID NO: 54925 - DNA, 22 bp, Homo sapiens
tcagtcttgaacagccccctgt

SEQ ID NO: 54926 - DNA, 22 bp, Homo sapiens
tcaacagtggcaaagaggcacg

SEQ ID NO: 54927 - DNA, 22 bp, Homo sapiens
gagagagctctgtgcctgggat

SEQ ID NO: 54928 - DNA, 22 bp, Homo sapiens
gcctgcagggcctgggcctacc

SEQ ID NO: 54929 - DNA, 22 bp, Homo sapiens
ggtgacgaatccatagcatcga

SEQ ID NO: 54930 - DNA, 22 bp, Homo sapiens
ctgctgagagccccagctgaga

SEQ ID NO: 54931 - DNA, 22 bp, Homo sapiens
agtgcaggccccaggccaggcc

SEQ ID NO: 54932 - DNA, 22 bp, Homo sapiens
aaggctccagtgaatgctggca

SEQ ID NO: 54933 - DNA, 22 bp, Homo sapiens
gggggctaccgtctctggagct

SEQ ID NO: 54934 - DNA, 22 bp, Homo sapiens
gtgtggtcgaagttctcccgga

SEQ ID NO: 54935 - DNA, 22 bp, Homo sapiens
aggctctgtcaggcggagcagc

SEQ ID NO: 54936 - DNA, 22 bp, Homo sapiens
caggcacggtggctcatgcctg

SEQ ID NO: 54937 - DNA, 22 bp, Homo sapiens
ccaccagctgcatatgcacgta

SEQ ID NO: 54938 - DNA, 22 bp, Homo sapiens
tggctaacaaggtgaaaccccg

SEQ ID NO: 54939 - DNA, 22 bp, Homo sapiens
ggccactgacctacatctgggg

SEQ ID NO: 54940 - DNA, 22 bp, Homo sapiens
tttacctttgtgggtctccctc

SEQ ID NO: 54941 - DNA, 22 bp, Homo sapiens
tcagggctgcagaagaggcagg

SEQ ID NO: 54942 - DNA, 22 bp, Homo sapiens
ggagagtggattccagctgtat

SEQ ID NO: 54943 - DNA, 22 bp, Homo sapiens
aggagggagcttaagccaggca

SEQ ID NO: 54944 - DNA, 22 bp, Homo sapiens
gcttccggagccaaaaggcccc

SEQ ID NO: 54945 - DNA, 22 bp, Homo sapiens
aatggctctgatgttgttgtga

SEQ ID NO: 54946 - DNA, 22 bp, Homo sapiens
ctggctgggagcgagctgctca

SEQ ID NO: 54947 - DNA, 22 bp, Homo sapiens
gttgagtgggttaggatgctga

SEQ ID NO: 54948 - DNA, 22 bp, Homo sapiens
tcagtgcagggtgggagagaga

SEQ ID NO: 54949 - DNA, 22 bp, Homo sapiens
tgatgtggccccacttagctgt

SEQ ID NO: 54950 - DNA, 22 bp, Homo sapiens
gtgcccagcagcagcgtccccg

SEQ ID NO: 54951 - DNA, 22 bp, Homo sapiens
agtgaatgtccccgcgggtcag

SEQ ID NO: 54952 - DNA, 23 bp, Homo sapiens
tactatggttattatccctctcc

SEQ ID NO: 54953 - DNA, 22 bp, Homo sapiens
tgagacgaagtcttgctctgtt

SEQ ID NO: 54954 - DNA, 22 bp, Homo sapiens
gagcaccgcctccacgatgccc

SEQ ID NO: 54955 - DNA, 22 bp, Homo sapiens
tttgctttgtttaaaagtggta

SEQ ID NO: 54956 - DNA, 22 bp, Homo sapiens
tccagtttccaatcactgcacg

SEQ ID NO: 54957 - DNA, 22 bp, Homo sapiens
ggggaccctcaggactgcgtct

SEQ ID NO: 54958 - DNA, 22 bp, Homo sapiens
agagctgggtggacttgtagtt

SEQ ID NO: 54959 - DNA, 22 bp, Homo sapiens
accccagaggcggaggctgcag

SEQ ID NO: 54960 - DNA, 22 bp, Homo sapiens
tctgtcttagccatctcaggct

SEQ ID NO: 54961 - DNA, 22 bp, Homo sapiens
ttgcttcctctagtttcttgaa

SEQ ID NO: 54962 - DNA, 22 bp, Homo sapiens
gtttctctgtctgttacattgg

SEQ ID NO: 54963 - DNA, 22 bp, Homo sapiens
tacagggattgttttaatcacc

SEQ ID NO: 54964 - DNA, 22 bp, Homo sapiens
ctcagcagtatactctgaagat

SEQ ID NO: 54965 - DNA, 22 bp, Homo sapiens
acattcccaccaacagtgtaaa

SEQ ID NO: 54966 - DNA, 18 bp, Homo sapiens
tcttcatctcctgagctg

SEQ ID NO: 54967 - DNA, 22 bp, Homo sapiens
gatttttatataaagtgagaaa

SEQ ID NO: 54968 - DNA, 22 bp, Homo sapiens
ttgaccactgaatggttctgaa

SEQ ID NO: 54969 - DNA, 22 bp, Homo sapiens
aaagaaatagatggcatttaaa

SEQ ID NO: 54970 - DNA, 22 bp, Homo sapiens
ttgagatggagcctcagtcttg

SEQ ID NO: 54971 - DNA, 22 bp, Homo sapiens
gcaggtggatcacctgaggtca

SEQ ID NO: 54972 - DNA, 22 bp, Homo sapiens
gaggtgggtgtatcacaggtca

SEQ ID NO: 54973 - DNA, 22 bp, Homo sapiens
cctgtggcgggggccagtgcct

SEQ ID NO: 54974 - DNA, 22 bp, Homo sapiens
ggcagcactgcagcttgttggg

SEQ ID NO: 54975 - DNA, 22 bp, Homo sapiens
ccaggctggagtgcaatggcgt

SEQ ID NO: 54976 - DNA, 22 bp, Homo sapiens
cagcaggaggtgagtagcaggt

SEQ ID NO: 54977 - DNA, 22 bp, Homo sapiens
gcacagccacgtaatgtggtca

SEQ ID NO: 54978 - DNA, 22 bp, Homo sapiens
agaaactctggaagaactttta

SEQ ID NO: 54979 - DNA, 22 bp, Homo sapiens
tggtccgctcctattcgccgca

SEQ ID NO: 54980 - DNA, 22 bp, Homo sapiens
cgtgccactgcactctagcctg

SEQ ID NO: 54981 - DNA, 21 bp, Homo sapiens
agcctcaggttgttggttctt

SEQ ID NO: 54982 - DNA, 22 bp, Homo sapiens
ccgtggtcacctgagctccttg

SEQ ID NO: 54983 - DNA, 22 bp, Homo sapiens
taggctgggaagaaagattctc

SEQ ID NO: 54984 - DNA, 22 bp, Homo sapiens
actgtgaacggactgaagccca

SEQ ID NO: 54985 - DNA, 22 bp, Homo sapiens
aaaggcttcggatcagaaggta

SEQ ID NO: 54986 - DNA, 22 bp, Homo sapiens
tttgaagggcacgacaatagtt

SEQ ID NO: 54987 - DNA, 19 bp, Homo sapiens
taccatccaagctggtttg

SEQ ID NO: 54988 - DNA, 22 bp, Homo sapiens
ttggcgcccaggacgccgccgc

SEQ ID NO: 54989 - DNA, 22 bp, Homo sapiens
ggtgttcaaatgaacacatgca

SEQ ID NO: 54990 - DNA, 22 bp, Homo sapiens
gtccaggagctcagggcttatt

SEQ ID NO: 54991 - DNA, 22 bp, Homo sapiens
acagacaagtagttcagacaag

SEQ ID NO: 54992 - DNA, 22 bp, Homo sapiens
gctgctgggatcctgggtctca

SEQ ID NO: 54993 - DNA, 22 bp, Homo sapiens
gagggccctggctggctccagc

SEQ ID NO: 54994 - DNA, 22 bp, Homo sapiens
tgagcttccctcctgcactaca

SEQ ID NO: 54995 - DNA, 22 bp, Homo sapiens
tggagaagattggtcaccattc

SEQ ID NO: 54996 - DNA, 22 bp, Homo sapiens
ctggcccaggtggtcgttgagg

SEQ ID NO: 54997 - DNA, 22 bp, Homo sapiens
ttcctagggcagagccgctggg

SEQ ID NO: 54998 - DNA, 22 bp, Homo sapiens
cgtgccctgcgcaagtgctgct

SEQ ID NO: 54999 - DNA, 22 bp, Homo sapiens
gggcagagagctggaactcctt

SEQ ID NO: 55000 - DNA, 22 bp, Homo sapiens
agatgaatccacacatggcaaa

SEQ ID NO: 55001 - DNA, 22 bp, Homo sapiens
tggctgagttacgaacagagca

SEQ ID NO: 55002 - DNA, 17 bp, Homo sapiens
tggtccaggtggagcca

SEQ ID NO: 55003 - DNA, 22 bp, Homo sapiens
aattagttcacgtcctgtgctt

SEQ ID NO: 55004 - DNA, 22 bp, Homo sapiens
ggtgagcagctgtctgtatgga

SEQ ID NO: 55005 - DNA, 22 bp, Homo sapiens
gaaaaggcctggggcaaagtgt

SEQ ID NO: 55006 - DNA, 22 bp, Homo sapiens
tgctcccaaacctgacaggctc

SEQ ID NO: 55007 - DNA, 22 bp, Homo sapiens
gggttggatcctggtggctgcc

SEQ ID NO: 55008 - DNA, 22 bp, Homo sapiens
atgaaatatcttgaagaaattc

SEQ ID NO: 55009 - DNA, 22 bp, Homo sapiens
tggcagtggcgggactcagggc

SEQ ID NO: 55010 - DNA, 22 bp, Homo sapiens
gcccgcgccagcctctccatct

SEQ ID NO: 55011 - DNA, 19 bp, Homo sapiens
caggcctcttaccctctct

SEQ ID NO: 55012 - DNA, 22 bp, Homo sapiens
ggcaagagggcagatggagtgc

SEQ ID NO: 55013 - DNA, 22 bp, Homo sapiens
tgctcgaggtccccaccggctc

SEQ ID NO: 55014 - DNA, 22 bp, Homo sapiens
atggcagcggagctggaaatga

SEQ ID NO: 55015 - DNA, 22 bp, Homo sapiens
caaagtgctggaattacaggtg

SEQ ID NO: 55016 - DNA, 22 bp, Homo sapiens
agccctcgtttctgcatcctgt

SEQ ID NO: 55017 - DNA, 22 bp, Homo sapiens
gagatgggcgagaaggtggact

SEQ ID NO: 55018 - DNA, 22 bp, Homo sapiens
tcaggctcaggttaggggccaa

SEQ ID NO: 55019 - DNA, 19 bp, Homo sapiens
ctgtccttggctgcactgt

SEQ ID NO: 55020 - DNA, 22 bp, Homo sapiens
tcttcctgtcaatgagaattaa

SEQ ID NO: 55021 - DNA, 22 bp, Homo sapiens
ttctgtggttgaaaggagagat

SEQ ID NO: 55022 - DNA, 22 bp, Homo sapiens
tcttacccggcaacgtgtgtcg

SEQ ID NO: 55023 - DNA, 22 bp, Homo sapiens
gagtgtgtcggtcagcgtggcg

SEQ ID NO: 55024 - DNA, 22 bp, Homo sapiens
cccaggaggtggagttcacagt

SEQ ID NO: 55025 - DNA, 22 bp, Homo sapiens
cctagatgggatggcggccggg

SEQ ID NO: 55026 - DNA, 22 bp, Homo sapiens
caggctggagtgcagtggcgct

SEQ ID NO: 55027 - DNA, 22 bp, Homo sapiens
tactgtactgcagttctgcaaa

SEQ ID NO: 55028 - DNA, 18 bp, Homo sapiens
cccacggtgctgtagggc

SEQ ID NO: 55029 - DNA, 22 bp, Homo sapiens
tagtcagtgcacagacacttgt

SEQ ID NO: 55030 - DNA, 22 bp, Homo sapiens
cccagccaaaagcaagtttacc

SEQ ID NO: 55031 - DNA, 22 bp, Homo sapiens
gcaggtggatcaccacgtcagg

SEQ ID NO: 55032 - DNA, 22 bp, Homo sapiens
cgcaccactgaattccagcctg

SEQ ID NO: 55033 - DNA, 22 bp, Homo sapiens
attgtgaatagtgccgcagtaa

SEQ ID NO: 55034 - DNA, 22 bp, Homo sapiens
actattagcatatcatgaatgg

SEQ ID NO: 55035 - DNA, 22 bp, Homo sapiens
taattcttcaggccttttgtct

SEQ ID NO: 55036 - DNA, 22 bp, Homo sapiens
tgtccaggttagcttcaaacac

SEQ ID NO: 55037 - DNA, 22 bp, Homo sapiens
cgcaactcagcaacttaactgc

SEQ ID NO: 55038 - DNA, 22 bp, Homo sapiens
ccttttgctctcccatccagaa

SEQ ID NO: 55039 - DNA, 22 bp, Homo sapiens
acccaggccattggcaagagtc

SEQ ID NO: 55040 - DNA, 23 bp, Homo sapiens
tcagaacagttcttggtgcatag

SEQ ID NO: 55041 - DNA, 23 bp, Homo sapiens
caccactttctccttctccttgg

SEQ ID NO: 55042 - DNA, 22 bp, Homo sapiens
atattacacacggtatcacggg

SEQ ID NO: 55043 - DNA, 22 bp, Homo sapiens
ttctcccatctcagtcttacat

SEQ ID NO: 55044 - DNA, 22 bp, Homo sapiens
gcccaggctggagttcagtggt

SEQ ID NO: 55045 - DNA, 22 bp, Homo sapiens
gcagccagagggggtgtgatca

SEQ ID NO: 55046 - DNA, 22 bp, Homo sapiens
atttattcctttatggctggag

SEQ ID NO: 55047 - DNA, 22 bp, Homo sapiens
aggcaaggtgctacagacagtg

SEQ ID NO: 55048 - DNA, 22 bp, Homo sapiens
gaggcagaggttgcagtgagct

SEQ ID NO: 55049 - DNA, 22 bp, Homo sapiens
gtctttatttgagattgtcatt

SEQ ID NO: 55050 - DNA, 22 bp, Homo sapiens
caggagctcaagaccaccctgg

SEQ ID NO: 55051 - DNA, 22 bp, Homo sapiens
atgccactgcactccagcctgg

SEQ ID NO: 55052 - DNA, 22 bp, Homo sapiens
caaagtgctaggattacaggcg

SEQ ID NO: 55053 - DNA, 23 bp, Homo sapiens
ccagtgattgcctggaaggaggt

SEQ ID NO: 55054 - DNA, 22 bp, Homo sapiens
tggtggaattgtaaaatagtgt

SEQ ID NO: 55055 - DNA, 22 bp, Homo sapiens
actcaaatagcaacggtgagaa

SEQ ID NO: 55056 - DNA, 17 bp, Homo sapiens
tctgagaatgctggagg

SEQ ID NO: 55057 - DNA, 22 bp, Homo sapiens
atggtggacgggagacaggact

SEQ ID NO: 55058 - DNA, 22 bp, Homo sapiens
actgcacttcagcctgggtgtc

SEQ ID NO: 55059 - DNA, 22 bp, Homo sapiens
gccttgccgctcagcagtgggg

SEQ ID NO: 55060 - DNA, 22 bp, Homo sapiens
agtactgtcagcagggtgttga

SEQ ID NO: 55061 - DNA, 22 bp, Homo sapiens
agggaagaggaccagagtctct

SEQ ID NO: 55062 - DNA, 22 bp, Homo sapiens
ctctgtggtggagtgggtcacc

SEQ ID NO: 55063 - DNA, 22 bp, Homo sapiens
gggggaagaaagaacatggcat

SEQ ID NO: 55064 - DNA, 22 bp, Homo sapiens
accactgcccatggtgaaaact

SEQ ID NO: 55065 - DNA, 22 bp, Homo sapiens
tccacagtggttgaactagtaa

SEQ ID NO: 55066 - DNA, 22 bp, Homo sapiens
ttgaaattttaggccttgcaat

SEQ ID NO: 55067 - DNA, 22 bp, Homo sapiens
gttccgtttatatgctggatta

SEQ ID NO: 55068 - DNA, 22 bp, Homo sapiens
ctctgtagactccacctttgag

SEQ ID NO: 55069 - DNA, 22 bp, Homo sapiens
agggctggagccacagctggga

SEQ ID NO: 55070 - DNA, 22 bp, Homo sapiens
agcagtgtgggctgcacgctgg

SEQ ID NO: 55071 - DNA, 22 bp, Homo sapiens
acccagccatgttcagttctct

SEQ ID NO: 55072 - DNA, 22 bp, Homo sapiens
tctgtagtaggttgtagttctt

SEQ ID NO: 55073 - DNA, 22 bp, Homo sapiens
gccaggacctcagatgcagggc

SEQ ID NO: 55074 - DNA, 22 bp, Homo sapiens
tggaatggaaacaaactgagga

SEQ ID NO: 55075 - DNA, 22 bp, Homo sapiens
aggggtgacacatatcagtgca

SEQ ID NO: 55076 - DNA, 22 bp, Homo sapiens
tctgctctgtggcttcagctaa

SEQ ID NO: 55077 - DNA, 20 bp, Homo sapiens
gccaacgcgctggggctgcc

SEQ ID NO: 55078 - DNA, 22 bp, Homo sapiens
ggctcacgcaattatcccggcc

SEQ ID NO: 55079 - DNA, 22 bp, Homo sapiens
ctggacacactggagtctggca

SEQ ID NO: 55080 - DNA, 22 bp, Homo sapiens
tgtcagtgtctatgaagaattt

SEQ ID NO: 55081 - DNA, 22 bp, Homo sapiens
gcaggagaacaaagcaagctgc

SEQ ID NO: 55082 - DNA, 22 bp, Homo sapiens
caggaaagggatgggctgccac

SEQ ID NO: 55083 - DNA, 22 bp, Homo sapiens
cctcccctcagacagagactgg

SEQ ID NO: 55084 - DNA, 22 bp, Homo sapiens
taaatacttagttttgtgtcta

SEQ ID NO: 55085 - DNA, 22 bp, Homo sapiens
ggccactgctctccagcctggg

SEQ ID NO: 55086 - DNA, 22 bp, Homo sapiens
tgattttctccattgtaaattc

SEQ ID NO: 55087 - DNA, 22 bp, Homo sapiens
gtgcacatcgtgcaggtttgtt

SEQ ID NO: 55088 - DNA, 22 bp, Homo sapiens
aatgaattgcagtactgacttg

SEQ ID NO: 55089 - DNA, 22 bp, Homo sapiens
tcacccctccattctctcatgt

SEQ ID NO: 55090 - DNA, 22 bp, Homo sapiens
gaggtgatggttgcacaatgct

SEQ ID NO: 55091 - DNA, 22 bp, Homo sapiens
cgggttcacgccattctcctgc

SEQ ID NO: 55092 - DNA, 22 bp, Homo sapiens
agcgtgaattagttggtacaca

SEQ ID NO: 55093 - DNA, 22 bp, Homo sapiens
ggcccaggctggagtgcagtgg

SEQ ID NO: 55094 - DNA, 20 bp, Homo sapiens
ttggatgtgcatggccgtgc

SEQ ID NO: 55095 - DNA, 22 bp, Homo sapiens
aagtctctcacatatctggtcc

SEQ ID NO: 55096 - DNA, 21 bp, Homo sapiens
aacaggtcccccacgggcttt

SEQ ID NO: 55097 - DNA, 22 bp, Homo sapiens
agcaggcctgccacctcggggt

SEQ ID NO: 55098 - DNA, 22 bp, Homo sapiens
gaaaggagagggttaaggagct

SEQ ID NO: 55099 - DNA, 22 bp, Homo sapiens
ccaagcagagcagcctctctgg

SEQ ID NO: 55100 - DNA, 22 bp, Homo sapiens
gactactcaaactttctctata

SEQ ID NO: 55101 - DNA, 22 bp, Homo sapiens
gagcccaggaagtggaggctga

SEQ ID NO: 55102 - DNA, 22 bp, Homo sapiens
taattataacatgctttctggc

SEQ ID NO: 55103 - DNA, 19 bp, Homo sapiens
gccttcccaccacccgtcc

SEQ ID NO: 55104 - DNA, 17 bp, Homo sapiens
catcaaagaaatttcca

SEQ ID NO: 55105 - DNA, 22 bp, Homo sapiens
gggcaaaacctgggcatcatga

SEQ ID NO: 55106 - DNA, 22 bp, Homo sapiens
acctggacacctgctgtcatct

SEQ ID NO: 55107 - DNA, 22 bp, Homo sapiens
gggacatctttctagtcagggt

SEQ ID NO: 55108 - DNA, 22 bp, Homo sapiens
caaagtgctgggattacaggtg

SEQ ID NO: 55109 - DNA, 22 bp, Homo sapiens
aaattacagccttgggtagctt

SEQ ID NO: 55110 - DNA, 22 bp, Homo sapiens
ctgaggagaggtggcctgtgtt

SEQ ID NO: 55111 - DNA, 22 bp, Homo sapiens
gaggcctcagcctgccctgaac

SEQ ID NO: 55112 - DNA, 22 bp, Homo sapiens
tatccaattcaccattgatggg

SEQ ID NO: 55113 - DNA, 22 bp, Homo sapiens
atggggggatgaaggagtccaa

SEQ ID NO: 55114 - DNA, 22 bp, Homo sapiens
cagagatgtgatccagctgtct

SEQ ID NO: 55115 - DNA, 21 bp, Homo sapiens
tcttttctcagctttgtggtt

SEQ ID NO: 55116 - DNA, 22 bp, Homo sapiens
tctcccaggcaggagtgcagtg

SEQ ID NO: 55117 - DNA, 19 bp, Homo sapiens
ttctggtctggaatcaagg

SEQ ID NO: 55118 - DNA, 22 bp, Homo sapiens
agggtggcactggtggctctat

SEQ ID NO: 55119 - DNA, 22 bp, Homo sapiens
acaattctgatggtttcccagt

SEQ ID NO: 55120 - DNA, 22 bp, Homo sapiens
ctggaaggagcccgggcggatc

SEQ ID NO: 55121 - DNA, 22 bp, Homo sapiens
tggagccagagcgcagcctggg

SEQ ID NO: 55122 - DNA, 22 bp, Homo sapiens
catccaggctgaagtgcagtgg

SEQ ID NO: 55123 - DNA, 22 bp, Homo sapiens
cactgcactccagcctgggaga

SEQ ID NO: 55124 - DNA, 22 bp, Homo sapiens
agtccaaagcagatgagggcca

SEQ ID NO: 55125 - DNA, 22 bp, Homo sapiens
tcatctgaagattgctgttcaa

SEQ ID NO: 55126 - DNA, 22 bp, Homo sapiens
gtggcttggaccagtcacagtg

SEQ ID NO: 55127 - DNA, 22 bp, Homo sapiens
aggctgagataggtggatcatt

SEQ ID NO: 55128 - DNA, 22 bp, Homo sapiens
gttgaaatcctaaccccctagt

SEQ ID NO: 55129 - DNA, 22 bp, Homo sapiens
gcccagccacagtcactttcat

SEQ ID NO: 55130 - DNA, 22 bp, Homo sapiens
tttctttatcatagcatctttg

SEQ ID NO: 55131 - DNA, 23 bp, Homo sapiens
ggaagctcacgtagtcctgcact

SEQ ID NO: 55132 - DNA, 22 bp, Homo sapiens
ttttaatactgctattgtagga

SEQ ID NO: 55133 - DNA, 22 bp, Homo sapiens
tccaggattgtcagccagaagg

SEQ ID NO: 55134 - DNA, 22 bp, Homo sapiens
ggctcctgggggtgctcctgcc

SEQ ID NO: 55135 - DNA, 22 bp, Homo sapiens
gggtttcatggttctcacaatg

SEQ ID NO: 55136 - DNA, 22 bp, Homo sapiens
gattccacagcttcgaggtctt

SEQ ID NO: 55137 - DNA, 22 bp, Homo sapiens
cagctgcccctccagggctggg

SEQ ID NO: 55138 - DNA, 22 bp, Homo sapiens
actcatgtcctaggagtaaagc

SEQ ID NO: 55139 - DNA, 23 bp, Homo sapiens
tgtgggcgcattgtaagggtagc

SEQ ID NO: 55140 - DNA, 22 bp, Homo sapiens
ctccagtgcttctagaaaatac

SEQ ID NO: 55141 - DNA, 22 bp, Homo sapiens
aggacctactgatatcttagca

SEQ ID NO: 55142 - DNA, 22 bp, Homo sapiens
gacaattagatcattcctttga

SEQ ID NO: 55143 - DNA, 22 bp, Homo sapiens
gagacacaggcacagaagaggc

SEQ ID NO: 55144 - DNA, 22 bp, Homo sapiens
tgtgggagaaggaagcaagctg

SEQ ID NO: 55145 - DNA, 23 bp, Homo sapiens
tctctgcatgtcctgagcacatc

SEQ ID NO: 55146 - DNA, 22 bp, Homo sapiens
ccaataattcttcaagtgtttt

SEQ ID NO: 55147 - DNA, 22 bp, Homo sapiens
tctggtgtcagtattctttgaa

SEQ ID NO: 55148 - DNA, 22 bp, Homo sapiens
ctcagcactgacccaggagatg

SEQ ID NO: 55149 - DNA, 22 bp, Homo sapiens
tggtgctgccaggctcctgcca

SEQ ID NO: 55150 - DNA, 22 bp, Homo sapiens
aaacttttttaggttcataggc

SEQ ID NO: 55151 - DNA, 22 bp, Homo sapiens
atacttctttagcatattgaac

SEQ ID NO: 55152 - DNA, 22 bp, Homo sapiens
ctgctttaaaactgatacatga

SEQ ID NO: 55153 - DNA, 22 bp, Homo sapiens
ctgctcttgagggactgcggtc

SEQ ID NO: 55154 - DNA, 22 bp, Homo sapiens
ataatctttcttttccagatag

SEQ ID NO: 55155 - DNA, 22 bp, Homo sapiens
aggtgcttggctcgtgcacaca

SEQ ID NO: 55156 - DNA, 22 bp, Homo sapiens
tgacagaggagctggaatgatt

SEQ ID NO: 55157 - DNA, 22 bp, Homo sapiens
agttgcagacgcagagatgttg

SEQ ID NO: 55158 - DNA, 22 bp, Homo sapiens
ctgggggcagcaagaagccatg

SEQ ID NO: 55159 - DNA, 22 bp, Homo sapiens
tcccagctactctagaggctga

SEQ ID NO: 55160 - DNA, 22 bp, Homo sapiens
tgagccaggagtttgaggctgt

SEQ ID NO: 55161 - DNA, 22 bp, Homo sapiens
ggccagaagttggaaaagagcc

SEQ ID NO: 55162 - DNA, 22 bp, Homo sapiens
aggtctcttgctgtctctgggc

SEQ ID NO: 55163 - DNA, 22 bp, Homo sapiens
gttactcttgagaggctgaggt

SEQ ID NO: 55164 - DNA, 22 bp, Homo sapiens
aagaataagaggatttagaaca

SEQ ID NO: 55165 - DNA, 22 bp, Homo sapiens
caacaacatgggattcatttct

SEQ ID NO: 55166 - DNA, 22 bp, Homo sapiens
tacatttataaggcttctctgt

SEQ ID NO: 55167 - DNA, 23 bp, Homo sapiens
ctcaaccctagtaagggagtagg

SEQ ID NO: 55168 - DNA, 22 bp, Homo sapiens
ctcagcactttggaaggctgat

SEQ ID NO: 55169 - DNA, 22 bp, Homo sapiens
cttgaatgtcctgtggcaaagt

SEQ ID NO: 55170 - DNA, 22 bp, Homo sapiens
tgcagtcttccagctgcacaaa

SEQ ID NO: 55171 - DNA, 22 bp, Homo sapiens
atgccactgcacttcagcctgg

SEQ ID NO: 55172 - DNA, 22 bp, Homo sapiens
caaatactacgattcttgcagt

SEQ ID NO: 55173 - DNA, 22 bp, Homo sapiens
cagaaaccaaatgggatgggga

SEQ ID NO: 55174 - DNA, 22 bp, Homo sapiens
acatgtttaagtttgttatatg

SEQ ID NO: 55175 - DNA, 22 bp, Homo sapiens
ctctcagtcctgcgcgcctctg

SEQ ID NO: 55176 - DNA, 21 bp, Homo sapiens
gctcctggtgctgcgtggcgc

SEQ ID NO: 55177 - DNA, 22 bp, Homo sapiens
tcacagcctggacagttgcctg

SEQ ID NO: 55178 - DNA, 22 bp, Homo sapiens
atacaaagtattgatcctgagt

SEQ ID NO: 55179 - DNA, 22 bp, Homo sapiens
taagcctgcatgaaccatgaga

SEQ ID NO: 55180 - DNA, 22 bp, Homo sapiens
aggaaataggaccagacaaagc

SEQ ID NO: 55181 - DNA, 23 bp, Homo sapiens
aggatgtaggatgtatggcagag

SEQ ID NO: 55182 - DNA, 22 bp, Homo sapiens
gtgaggtggtacaatattaact

SEQ ID NO: 55183 - DNA, 23 bp, Homo sapiens
tgagctgggcctgcaggggtctc

SEQ ID NO: 55184 - DNA, 22 bp, Homo sapiens
gggagctggagctggaagactc

SEQ ID NO: 55185 - DNA, 22 bp, Homo sapiens
gcccagtggtaaaagcaggcct

SEQ ID NO: 55186 - DNA, 22 bp, Homo sapiens
ccatgaattcactccatgctag

SEQ ID NO: 55187 - DNA, 22 bp, Homo sapiens
gccactgtggtcctcccatgat

SEQ ID NO: 55188 - DNA, 22 bp, Homo sapiens
actgcaaagggaagccctttct

SEQ ID NO: 55189 - DNA, 22 bp, Homo sapiens
gaggctggacgtgcatttctac

SEQ ID NO: 55190 - DNA, 21 bp, Homo sapiens
aggcatgagccctgcatggac

SEQ ID NO: 55191 - DNA, 22 bp, Homo sapiens
ccagaccctccattcaagctcc

SEQ ID NO: 55192 - DNA, 22 bp, Homo sapiens
acacccaggctggcgtgcagtg

SEQ ID NO: 55193 - DNA, 22 bp, Homo sapiens
gccctgggcaaggttctggcca

SEQ ID NO: 55194 - DNA, 22 bp, Homo sapiens
aagaaatgtgaatattgaatag

SEQ ID NO: 55195 - DNA, 22 bp, Homo sapiens
ccactgcacttcagcctgggtg

SEQ ID NO: 55196 - DNA, 22 bp, Homo sapiens
gaaagtgctctctctatacaca

SEQ ID NO: 55197 - DNA, 22 bp, Homo sapiens
ctgggaggcagaggttgtagtg

SEQ ID NO: 55198 - DNA, 22 bp, Homo sapiens
tcttcccagaggaggtgccagc

SEQ ID NO: 55199 - DNA, 22 bp, Homo sapiens
tgataaacttagaaagaatgtt

SEQ ID NO: 55200 - DNA, 22 bp, Homo sapiens
aagcgccatggttcctgcgcag

SEQ ID NO: 55201 - DNA, 22 bp, Homo sapiens
gtgggggctggaaatcttgcca

SEQ ID NO: 55202 - DNA, 22 bp, Homo sapiens
tgccacagacaggacagaacag

SEQ ID NO: 55203 - DNA, 22 bp, Homo sapiens
cttatcagattatctgggctgt

SEQ ID NO: 55204 - DNA, 22 bp, Homo sapiens
tattattgacatttacttggtg

SEQ ID NO: 55205 - DNA, 22 bp, Homo sapiens
cagagagaatcttggcagctga

SEQ ID NO: 55206 - DNA, 22 bp, Homo sapiens
gtggcccaggctggagtgcagt

SEQ ID NO: 55207 - DNA, 21 bp, Homo sapiens
tcctgtaagcttgggtggctc

SEQ ID NO: 55208 - DNA, 22 bp, Homo sapiens
ttgagcccaggaggcctgggtg

SEQ ID NO: 55209 - DNA, 22 bp, Homo sapiens
cctgggccctcaccgccggtgg

SEQ ID NO: 55210 - DNA, 22 bp, Homo sapiens
tgggccactgctgcggaaggcg

SEQ ID NO: 55211 - DNA, 22 bp, Homo sapiens
tctgcatattgttaatggaatg

SEQ ID NO: 55212 - DNA, 22 bp, Homo sapiens
ttccatatctgttgcatatcat

SEQ ID NO: 55213 - DNA, 22 bp, Homo sapiens
ctgtaatcccagctacctggga

SEQ ID NO: 55214 - DNA, 22 bp, Homo sapiens
tgcccaggctggagtgcagtgg

SEQ ID NO: 55215 - DNA, 22 bp, Homo sapiens
tgcctcagctgaggccgctcca

SEQ ID NO: 55216 - DNA, 22 bp, Homo sapiens
ctgggcctggggctgttgagag

SEQ ID NO: 55217 - DNA, 22 bp, Homo sapiens
ttgagatggagcttcactcttg

SEQ ID NO: 55218 - DNA, 22 bp, Homo sapiens
ccctcgtgcatccatcatttag

SEQ ID NO: 55219 - DNA, 22 bp, Homo sapiens
ggcctcgcggcttctggtggct

SEQ ID NO: 55220 - DNA, 22 bp, Homo sapiens
ctgggaggcggagcttgcagtg

SEQ ID NO: 55221 - DNA, 22 bp, Homo sapiens
ggcaggaggtgagtggcgggtg

SEQ ID NO: 55222 - DNA, 22 bp, Homo sapiens
gtccaaaagagccagccgggcg

SEQ ID NO: 55223 - DNA, 22 bp, Homo sapiens
aaccagctaacatgtggaatga

SEQ ID NO: 55224 - DNA, 22 bp, Homo sapiens
attggtggtgaggacatgccag

SEQ ID NO: 55225 - DNA, 22 bp, Homo sapiens
ctggcctcggcagcaggaacag

SEQ ID NO: 55226 - DNA, 22 bp, Homo sapiens
aagtgctgggattacaggcgtc

SEQ ID NO: 55227 - DNA, 22 bp, Homo sapiens
ttaagtaacttgtccaaatgag

SEQ ID NO: 55228 - DNA, 22 bp, Homo sapiens
tccttagacaaagagtgggctt

SEQ ID NO: 55229 - DNA, 22 bp, Homo sapiens
gaaactctcgcatcctgggaac

SEQ ID NO: 55230 - DNA, 22 bp, Homo sapiens
gaatatcccgctatgcaaagta

SEQ ID NO: 55231 - DNA, 22 bp, Homo sapiens
tcctcctgtctaccagttcctg

SEQ ID NO: 55232 - DNA, 22 bp, Homo sapiens
ctgcgtgagcgtgcccgtcttg

SEQ ID NO: 55233 - DNA, 22 bp, Homo sapiens
gagctgaacgggaattccccga

SEQ ID NO: 55234 - DNA, 22 bp, Homo sapiens
gtctttcttaaacaacagaaca

SEQ ID NO: 55235 - DNA, 22 bp, Homo sapiens
ttcaaagcagagggtcaataca

SEQ ID NO: 55236 - DNA, 22 bp, Homo sapiens
aagaagcattctttcattggtt

SEQ ID NO: 55237 - DNA, 22 bp, Homo sapiens
aaattgtaatgacttcacttga

SEQ ID NO: 55238 - DNA, 22 bp, Homo sapiens
ggtcgctgtgtaggttcagcta

SEQ ID NO: 55239 - DNA, 22 bp, Homo sapiens
cggctgggttcggctgcaggcc

SEQ ID NO: 55240 - DNA, 22 bp, Homo sapiens
tgagccatgggactccaaggga

SEQ ID NO: 55241 - DNA, 22 bp, Homo sapiens
ctgggctcaagtgatccaccca

SEQ ID NO: 55242 - DNA, 22 bp, Homo sapiens
tcttagaaattccccagtggct

SEQ ID NO: 55243 - DNA, 22 bp, Homo sapiens
ttatttttaaaagttcacacag

SEQ ID NO: 55244 - DNA, 22 bp, Homo sapiens
tgccctggctcttcttgttcca

SEQ ID NO: 55245 - DNA, 22 bp, Homo sapiens
gggcggatcacctgaggtcagg

SEQ ID NO: 55246 - DNA, 22 bp, Homo sapiens
aaggtgggcagatcacaaggtc

SEQ ID NO: 55247 - DNA, 22 bp, Homo sapiens
tgtagctctccagccagcaagg

SEQ ID NO: 55248 - DNA, 22 bp, Homo sapiens
agcacctccagagcttgaagct

SEQ ID NO: 55249 - DNA, 22 bp, Homo sapiens
gggctgggattgcttgctgtga

SEQ ID NO: 55250 - DNA, 22 bp, Homo sapiens
tgaaggggttcagcatgggggt

SEQ ID NO: 55251 - DNA, 22 bp, Homo sapiens
cagctggttgaagaggagctgg

SEQ ID NO: 55252 - DNA, 22 bp, Homo sapiens
gagagcaggaggcagcgggacg

SEQ ID NO: 55253 - DNA, 22 bp, Homo sapiens
aaaagttattgatgcaggacaa

SEQ ID NO: 55254 - DNA, 22 bp, Homo sapiens
tctccccagtatggattctctg

SEQ ID NO: 55255 - DNA, 22 bp, Homo sapiens
ggctgccttccctgagccccgg

SEQ ID NO: 55256 - DNA, 22 bp, Homo sapiens
gcgagtgccgagagggcagggc

SEQ ID NO: 55257 - DNA, 22 bp, Homo sapiens
ggtcccatgactgacacagcag

SEQ ID NO: 55258 - DNA, 22 bp, Homo sapiens
ctgtaatcccagctactcggga

SEQ ID NO: 55259 - DNA, 21 bp, Homo sapiens
ggccccgcagacccagcacgt

SEQ ID NO: 55260 - DNA, 22 bp, Homo sapiens
gctgacccctacaggttgtgtt

SEQ ID NO: 55261 - DNA, 22 bp, Homo sapiens
cattccttaacgtggggagtct

SEQ ID NO: 55262 - DNA, 22 bp, Homo sapiens
aaggccttgccgaaggatgcca

SEQ ID NO: 55263 - DNA, 22 bp, Homo sapiens
ttcagcagtgcagacacccagt

SEQ ID NO: 55264 - DNA, 22 bp, Homo sapiens
gagccccaccctagacattctg

SEQ ID NO: 55265 - DNA, 22 bp, Homo sapiens
gggagctgagctggaagagaat

SEQ ID NO: 55266 - DNA, 22 bp, Homo sapiens
gaagttctttatagcagtgtga

SEQ ID NO: 55267 - DNA, 22 bp, Homo sapiens
acattaaaattgggtggggtaa

SEQ ID NO: 55268 - DNA, 20 bp, Homo sapiens
tttgagaccagtctgcccaa

SEQ ID NO: 55269 - DNA, 22 bp, Homo sapiens
acgggccttctcttcaggcgag

SEQ ID NO: 55270 - DNA, 22 bp, Homo sapiens
gcctccggagtcacagtgtctt

SEQ ID NO: 55271 - DNA, 22 bp, Homo sapiens
agtcaaagatgaccgagttcct

SEQ ID NO: 55272 - DNA, 20 bp, Homo sapiens
gaaatgtacacattaccaca

SEQ ID NO: 55273 - DNA, 22 bp, Homo sapiens
ccatcacagtccccatcgtgat

SEQ ID NO: 55274 - DNA, 22 bp, Homo sapiens
gagcacagtaaagcagtgtcac

SEQ ID NO: 55275 - DNA, 20 bp, Homo sapiens
cagagccagggttttgtttt

SEQ ID NO: 55276 - DNA, 22 bp, Homo sapiens
ggctgtggcagctggaagtggt

SEQ ID NO: 55277 - DNA, 22 bp, Homo sapiens
cgggagcctctgggtcacactg

SEQ ID NO: 55278 - DNA, 22 bp, Homo sapiens
ggagactgatctgagtgataac

SEQ ID NO: 55279 - DNA, 22 bp, Homo sapiens
actgcactccagcctgggtgat

SEQ ID NO: 55280 - DNA, 23 bp, Homo sapiens
cccagaccttgtgctgcccttgg

SEQ ID NO: 55281 - DNA, 22 bp, Homo sapiens
ctggagggctgcagcgaggctg

SEQ ID NO: 55282 - DNA, 19 bp, Homo sapiens
ctcgtgcacccatcacctg

SEQ ID NO: 55283 - DNA, 22 bp, Homo sapiens
gcagctattgtctcctgggccc

SEQ ID NO: 55284 - DNA, 22 bp, Homo sapiens
caggaggattgcttgaggccag

SEQ ID NO: 55285 - DNA, 21 bp, Homo sapiens
tctgagactgggttagaatgt

SEQ ID NO: 55286 - DNA, 22 bp, Homo sapiens
taacagtatatttaccaaacct

SEQ ID NO: 55287 - DNA, 22 bp, Homo sapiens
ttgcaaatcagaagtatagatt

SEQ ID NO: 55288 - DNA, 22 bp, Homo sapiens
gaatgctaagcatgtgggagtt

SEQ ID NO: 55289 - DNA, 22 bp, Homo sapiens
ttcctttctctggactgcagcc

SEQ ID NO: 55290 - DNA, 23 bp, Homo sapiens
aaactacaacgccaggcactgag

SEQ ID NO: 55291 - DNA, 22 bp, Homo sapiens
agcctggtttaagcattttata

SEQ ID NO: 55292 - DNA, 22 bp, Homo sapiens
ttctttgcccatgtttcctaag

SEQ ID NO: 55293 - DNA, 22 bp, Homo sapiens
atgaccagccgagataaacaga

SEQ ID NO: 55294 - DNA, 22 bp, Homo sapiens
gttgctcaggcaggagtacagt

SEQ ID NO: 55295 - DNA, 20 bp, Homo sapiens
ttctccagtgcggtagccat

SEQ ID NO: 55296 - DNA, 22 bp, Homo sapiens
tcgtacagcagactgaagtcct

SEQ ID NO: 55297 - DNA, 22 bp, Homo sapiens
tctgggtccgggactgtggatg

SEQ ID NO: 55298 - DNA, 20 bp, Homo sapiens
tatttctgggcaaccattta

SEQ ID NO: 55299 - DNA, 22 bp, Homo sapiens
cctttcccgctttgagggcaag

SEQ ID NO: 55300 - DNA, 22 bp, Homo sapiens
gaggcctcatgaggtgagcatt

SEQ ID NO: 55301 - DNA, 22 bp, Homo sapiens
attaagtgactaaagtaatgct

SEQ ID NO: 55302 - DNA, 22 bp, Homo sapiens
ccaggaggcagaagttgcagtg

SEQ ID NO: 55303 - DNA, 22 bp, Homo sapiens
gctgtagtgaatggccgcgttc

SEQ ID NO: 55304 - DNA, 22 bp, Homo sapiens
gtggatggccctgcacacaggt

SEQ ID NO: 55305 - DNA, 22 bp, Homo sapiens
tgcactactgtgatacacagcc

SEQ ID NO: 55306 - DNA, 23 bp, Homo sapiens
acctgtctgcctcccaccatcaa

SEQ ID NO: 55307 - DNA, 22 bp, Homo sapiens
ggcctctcttgggacagctgtc

SEQ ID NO: 55308 - DNA, 22 bp, Homo sapiens
actctttgtctgttgccgctta

SEQ ID NO: 55309 - DNA, 22 bp, Homo sapiens
aaggagaaatggtagatgtgca

SEQ ID NO: 55310 - DNA, 22 bp, Homo sapiens
cactgcactccagcctgggtca

SEQ ID NO: 55311 - DNA, 22 bp, Homo sapiens
aattacagtcggagcagcactg

SEQ ID NO: 55312 - DNA, 22 bp, Homo sapiens
tttgttttcaatgtgtcattca

SEQ ID NO: 55313 - DNA, 22 bp, Homo sapiens
tgggtgctctgcgaccgtaggg

SEQ ID NO: 55314 - DNA, 22 bp, Homo sapiens
ttgcccaggctggagtgcagtg

SEQ ID NO: 55315 - DNA, 22 bp, Homo sapiens
ggccctgggccctctagcttgt

SEQ ID NO: 55316 - DNA, 22 bp, Homo sapiens
ctcgttgctgaagccaaagtca

SEQ ID NO: 55317 - DNA, 22 bp, Homo sapiens
tgctccagcaccaagagctcca

SEQ ID NO: 55318 - DNA, 22 bp, Homo sapiens
gctctagtaggaatgtccctct

SEQ ID NO: 55319 - DNA, 22 bp, Homo sapiens
tcaccttgtgatctccctgcct

SEQ ID NO: 55320 - DNA, 22 bp, Homo sapiens
attgataaattgcaatggggct

SEQ ID NO: 55321 - DNA, 20 bp, Homo sapiens
gctgaggggtctatggcata

SEQ ID NO: 55322 - DNA, 22 bp, Homo sapiens
tgtgcacaatgtgcaggtttgt

SEQ ID NO: 55323 - DNA, 22 bp, Homo sapiens
gaggcaggaggattgcttgagc

SEQ ID NO: 55324 - DNA, 22 bp, Homo sapiens
ttattttaccttcctctgagct

SEQ ID NO: 55325 - DNA, 18 bp, Homo sapiens
gaggatggaaggagatgc

SEQ ID NO: 55326 - DNA, 22 bp, Homo sapiens
tcgcccagctcatctcccacaa

SEQ ID NO: 55327 - DNA, 22 bp, Homo sapiens
ctgaggggatgtttttgacgga

SEQ ID NO: 55328 - DNA, 22 bp, Homo sapiens
ggggtgggcgtgcagggacacc

SEQ ID NO: 55329 - DNA, 20 bp, Homo sapiens
tctcgcactcggagcagccg

SEQ ID NO: 55330 - DNA, 21 bp, Homo sapiens
ggtgctcgctgatgaggagtg

SEQ ID NO: 55331 - DNA, 22 bp, Homo sapiens
ttattgaaggaactgaaataaa

SEQ ID NO: 55332 - DNA, 22 bp, Homo sapiens
acaagcgggccacagtgctggt

SEQ ID NO: 55333 - DNA, 20 bp, Homo sapiens
ttgagcttttagtacagaca

SEQ ID NO: 55334 - DNA, 22 bp, Homo sapiens
caggagatgacagggaagaacc

SEQ ID NO: 55335 - DNA, 18 bp, Homo sapiens
cccaggttggcctacaga

SEQ ID NO: 55336 - DNA, 22 bp, Homo sapiens
ggctagggatctagaccaggac

SEQ ID NO: 55337 - DNA, 22 bp, Homo sapiens
cacagctgtgagaagggagcct

SEQ ID NO: 55338 - DNA, 22 bp, Homo sapiens
agagcactttcgagagccggag

SEQ ID NO: 55339 - DNA, 22 bp, Homo sapiens
tgccgtggggctgaggctggag

SEQ ID NO: 55340 - DNA, 22 bp, Homo sapiens
atcttggggaatcctctgtgta

SEQ ID NO: 55341 - DNA, 23 bp, Homo sapiens
ggatggacgtgatgccttagcca

SEQ ID NO: 55342 - DNA, 22 bp, Homo sapiens
ggtgttgcagttgaagactggt

SEQ ID NO: 55343 - DNA, 22 bp, Homo sapiens
agtggcaggatctcggttcact

SEQ ID NO: 55344 - DNA, 22 bp, Homo sapiens
cctgccagagcagcttgtcctc

SEQ ID NO: 55345 - DNA, 22 bp, Homo sapiens
cagtcactggaatagctgagga

SEQ ID NO: 55346 - DNA, 22 bp, Homo sapiens
tgaggcaggagaatcacatgaa

SEQ ID NO: 55347 - DNA, 22 bp, Homo sapiens
ggtcagccttggatttggtagc

SEQ ID NO: 55348 - DNA, 22 bp, Homo sapiens
cgtgatttctggctttctatat

SEQ ID NO: 55349 - DNA, 22 bp, Homo sapiens
tgaagctttaggatgggttcat

SEQ ID NO: 55350 - DNA, 22 bp, Homo sapiens
cagcgtctcgttgtgggcctcg

SEQ ID NO: 55351 - DNA, 22 bp, Homo sapiens
gaaccacaatgtgaagaaggag

SEQ ID NO: 55352 - DNA, 22 bp, Homo sapiens
ggctggtgttgagtgcctgtag

SEQ ID NO: 55353 - DNA, 22 bp, Homo sapiens
tccacagtggttgaactagttt

SEQ ID NO: 55354 - DNA, 22 bp, Homo sapiens
tgggaagggtcaacagctggaa

SEQ ID NO: 55355 - DNA, 22 bp, Homo sapiens
tccaaacgggagccaaatgagc

SEQ ID NO: 55356 - DNA, 22 bp, Homo sapiens
attgcacttcagcctgggtgac

SEQ ID NO: 55357 - DNA, 22 bp, Homo sapiens
gggtccaggcggcatagttgta

SEQ ID NO: 55358 - DNA, 22 bp, Homo sapiens
gaggctgaggttgcagtgagcc

SEQ ID NO: 55359 - DNA, 22 bp, Homo sapiens
agcctgggccctgcctcttctc

SEQ ID NO: 55360 - DNA, 22 bp, Homo sapiens
agggccagcactcctggcagga

SEQ ID NO: 55361 - DNA, 22 bp, Homo sapiens
acatcctcccgatctactggct

SEQ ID NO: 55362 - DNA, 22 bp, Homo sapiens
aatataacacagatggcctgtt

SEQ ID NO: 55363 - DNA, 22 bp, Homo sapiens
gatttctctgcacccactcagg

SEQ ID NO: 55364 - DNA, 22 bp, Homo sapiens
tgtctggtgggttgacaggcag

SEQ ID NO: 55365 - DNA, 22 bp, Homo sapiens
tttggcatgggctatttgcttt

SEQ ID NO: 55366 - DNA, 22 bp, Homo sapiens
acgtagcactgagagatgcagg

SEQ ID NO: 55367 - DNA, 22 bp, Homo sapiens
aaaaagtattggccatggttga

SEQ ID NO: 55368 - DNA, 22 bp, Homo sapiens
gcttaattctggctcagtttcc

SEQ ID NO: 55369 - DNA, 22 bp, Homo sapiens
cctgcagacacttgtccagcaa

SEQ ID NO: 55370 - DNA, 22 bp, Homo sapiens
ttcctgggattattgtcaagca

SEQ ID NO: 55371 - DNA, 22 bp, Homo sapiens
tgagccgtggtctctgagggtg

SEQ ID NO: 55372 - DNA, 22 bp, Homo sapiens
gccagggttcgaatccgtatgg

SEQ ID NO: 55373 - DNA, 22 bp, Homo sapiens
tgcctactagtactattttgtg

SEQ ID NO: 55374 - DNA, 22 bp, Homo sapiens
atgccactgcactccagcctag

SEQ ID NO: 55375 - DNA, 22 bp, Homo sapiens
gtggaatttttacctatgaatg

SEQ ID NO: 55376 - DNA, 22 bp, Homo sapiens
cttccccaggacctctgctaaa

SEQ ID NO: 55377 - DNA, 22 bp, Homo sapiens
tgaggcaggaggttgagaactg

SEQ ID NO: 55378 - DNA, 22 bp, Homo sapiens
agtcacagggggcccctgcaac

SEQ ID NO: 55379 - DNA, 22 bp, Homo sapiens
agtccaggactgtttcagctga

SEQ ID NO: 55380 - DNA, 22 bp, Homo sapiens
tagctgaatataggcacaacag

SEQ ID NO: 55381 - DNA, 23 bp, Homo sapiens
ctggggctttcaaatctgggcag

SEQ ID NO: 55382 - DNA, 22 bp, Homo sapiens
agcctgattttgataattatat

SEQ ID NO: 55383 - DNA, 22 bp, Homo sapiens
aagaactgtttacaattttcac

SEQ ID NO: 55384 - DNA, 22 bp, Homo sapiens
tctgcaacattcctctccccac

SEQ ID NO: 55385 - DNA, 22 bp, Homo sapiens
cttgacactgtcactcaggcca

SEQ ID NO: 55386 - DNA, 22 bp, Homo sapiens
aatctgagggaacttgaactcc

SEQ ID NO: 55387 - DNA, 22 bp, Homo sapiens
cctgaggatgccagcatgggtg

SEQ ID NO: 55388 - DNA, 22 bp, Homo sapiens
ggtgggagagctctgtctccag

SEQ ID NO: 55389 - DNA, 22 bp, Homo sapiens
gcagagctcatgcctgcacctc

SEQ ID NO: 55390 - DNA, 22 bp, Homo sapiens
gctgcagggagctggaaggctc

SEQ ID NO: 55391 - DNA, 22 bp, Homo sapiens
cctcagctcccatgagatctgc

SEQ ID NO: 55392 - DNA, 22 bp, Homo sapiens
cgccggcttgaggcaggcggca

SEQ ID NO: 55393 - DNA, 22 bp, Homo sapiens
atacctgtgtatccacaagcgt

SEQ ID NO: 55394 - DNA, 22 bp, Homo sapiens
ttctcaagaacatatgtagggt

SEQ ID NO: 55395 - DNA, 22 bp, Homo sapiens
ttcttttaattgtgggggagtg

SEQ ID NO: 55396 - DNA, 22 bp, Homo sapiens
cttgtttatctctgtagccctg

SEQ ID NO: 55397 - DNA, 22 bp, Homo sapiens
acctagaatttaaaacattgct

SEQ ID NO: 55398 - DNA, 20 bp, Homo sapiens
tcccccactgtttctgctac

SEQ ID NO: 55399 - DNA, 22 bp, Homo sapiens
cctggggccccgagccagaagc

SEQ ID NO: 55400 - DNA, 22 bp, Homo sapiens
agcagagcaaagctcagaaatg

SEQ ID NO: 55401 - DNA, 19 bp, Homo sapiens
gttctttcatagtaagagc

SEQ ID NO: 55402 - DNA, 22 bp, Homo sapiens
ctgaccaacatggtgaaacctt

SEQ ID NO: 55403 - DNA, 22 bp, Homo sapiens
caggaggacatactggctcaca

SEQ ID NO: 55404 - DNA, 22 bp, Homo sapiens
tggagaattctatgttgagggg

SEQ ID NO: 55405 - DNA, 22 bp, Homo sapiens
ttacatgtggtgtgaagaagag

SEQ ID NO: 55406 - DNA, 22 bp, Homo sapiens
acctgcaggcacaggtgtgcgc

SEQ ID NO: 55407 - DNA, 23 bp, Homo sapiens
gcctgggagttgcgatctgcccg

SEQ ID NO: 55408 - DNA, 22 bp, Homo sapiens
aggccagcctcaggcagggacc

SEQ ID NO: 55409 - DNA, 22 bp, Homo sapiens
attgaaaataaggccagaaaca

SEQ ID NO: 55410 - DNA, 22 bp, Homo sapiens
cttatagtatgatgttgagaat

SEQ ID NO: 55411 - DNA, 22 bp, Homo sapiens
cagctacaaatacttttgtatg

SEQ ID NO: 55412 - DNA, 22 bp, Homo sapiens
tgggaagctgcattttaacaag

SEQ ID NO: 55413 - DNA, 22 bp, Homo sapiens
tcctagttctctgccagtcgct

SEQ ID NO: 55414 - DNA, 22 bp, Homo sapiens
gcccaggctggagtgcagtggc

SEQ ID NO: 55415 - DNA, 22 bp, Homo sapiens
ggaaggcagaggtgtcgtgggg

SEQ ID NO: 55416 - DNA, 22 bp, Homo sapiens
cactcagctgagccctcagccc

SEQ ID NO: 55417 - DNA, 22 bp, Homo sapiens
cccagagcatgtgctgcctttg

SEQ ID NO: 55418 - DNA, 21 bp, Homo sapiens
acataggcgaatgttcgggag

SEQ ID NO: 55419 - DNA, 22 bp, Homo sapiens
aagcctggactatcgcgtgtgc

SEQ ID NO: 55420 - DNA, 22 bp, Homo sapiens
tttctggcagcgggacaggggt

SEQ ID NO: 55421 - DNA, 22 bp, Homo sapiens
aactgaggtatctgctgtgttt

SEQ ID NO: 55422 - DNA, 17 bp, Homo sapiens
ttcttttctgagccttg

SEQ ID NO: 55423 - DNA, 23 bp, Homo sapiens
tgttccagatacgccttttcctc

SEQ ID NO: 55424 - DNA, 22 bp, Homo sapiens
ctccaatctgggcaacagagca

SEQ ID NO: 55425 - DNA, 19 bp, Homo sapiens
aggctaaagagtcttgcgt

SEQ ID NO: 55426 - DNA, 22 bp, Homo sapiens
agcccagaggctgggcgtgcat

SEQ ID NO: 55427 - DNA, 22 bp, Homo sapiens
gattgagtctgaggatgctgca

SEQ ID NO: 55428 - DNA, 22 bp, Homo sapiens
caggctggagtgcaatgacgcc

SEQ ID NO: 55429 - DNA, 18 bp, Homo sapiens
ccctgccagctcccagca

SEQ ID NO: 55430 - DNA, 22 bp, Homo sapiens
tggctccacaggccagggtgtg

SEQ ID NO: 55431 - DNA, 22 bp, Homo sapiens
catggcggtcaggatgtaggtg

SEQ ID NO: 55432 - DNA, 22 bp, Homo sapiens
tcctgggccctccggatcaggt

SEQ ID NO: 55433 - DNA, 22 bp, Homo sapiens
tactgtgtgcccagccgagctg

SEQ ID NO: 55434 - DNA, 22 bp, Homo sapiens
tggttgcctctcagagattccg

SEQ ID NO: 55435 - DNA, 22 bp, Homo sapiens
gccgtgtcatctgcgggtggca

SEQ ID NO: 55436 - DNA, 22 bp, Homo sapiens
aaggagtctgggccattcagag

SEQ ID NO: 55437 - DNA, 22 bp, Homo sapiens
tgtgaaagatactaggcagagg

SEQ ID NO: 55438 - DNA, 22 bp, Homo sapiens
agtctgcaggaccgcgtcacat

SEQ ID NO: 55439 - DNA, 22 bp, Homo sapiens
cactgcactccagcccgggcaa

SEQ ID NO: 55440 - DNA, 22 bp, Homo sapiens
gtccaggcctgcctctgaggag

SEQ ID NO: 55441 - DNA, 22 bp, Homo sapiens
cagtgcagccaaggacaggcac

SEQ ID NO: 55442 - DNA, 22 bp, Homo sapiens
tctaatcctatggtggggaggg

SEQ ID NO: 55443 - DNA, 21 bp, Homo sapiens
gggcagaggggcctcctgggt

SEQ ID NO: 55444 - DNA, 22 bp, Homo sapiens
agacagggtgatcgcttgagcc

SEQ ID NO: 55445 - DNA, 22 bp, Homo sapiens
cctcggctgggccttggccact

SEQ ID NO: 55446 - DNA, 22 bp, Homo sapiens
gagggagggactagcattctct

SEQ ID NO: 55447 - DNA, 22 bp, Homo sapiens
gagaaatgcatgcatgtcatca

SEQ ID NO: 55448 - DNA, 20 bp, Homo sapiens
ttcatgggagcaaagaggcc

SEQ ID NO: 55449 - DNA, 22 bp, Homo sapiens
tgggggtgtcctggtgcacaca

SEQ ID NO: 55450 - DNA, 22 bp, Homo sapiens
ggctgagttgagaggattactt

SEQ ID NO: 55451 - DNA, 22 bp, Homo sapiens
tagctcaaaggttaagtgtgga

SEQ ID NO: 55452 - DNA, 22 bp, Homo sapiens
ttgtgaatagtgctgcaataaa

SEQ ID NO: 55453 - DNA, 22 bp, Homo sapiens
ctggtagtttgcaaaatggtgt

SEQ ID NO: 55454 - DNA, 22 bp, Homo sapiens
taacaactgctgaggtatttga

SEQ ID NO: 55455 - DNA, 22 bp, Homo sapiens
tcacagagaaatgtggcacaaa

SEQ ID NO: 55456 - DNA, 22 bp, Homo sapiens
ggtgactggtttatctggcagt

SEQ ID NO: 55457 - DNA, 22 bp, Homo sapiens
ggtatactgcatgacattgggg

SEQ ID NO: 55458 - DNA, 22 bp, Homo sapiens
ttctgattgctgatgaggccca

SEQ ID NO: 55459 - DNA, 22 bp, Homo sapiens
tgagacttaagaggtcatgttg

SEQ ID NO: 55460 - DNA, 22 bp, Homo sapiens
aagaagcaggtcacagacaggg

SEQ ID NO: 55461 - DNA, 22 bp, Homo sapiens
gcaaatacatgttgagcaccta

SEQ ID NO: 55462 - DNA, 22 bp, Homo sapiens
tctaccctgcggtcttggggca

SEQ ID NO: 55463 - DNA, 22 bp, Homo sapiens
tccaggattgcaggtgcacaac

SEQ ID NO: 55464 - DNA, 22 bp, Homo sapiens
tgttacagcagaattgaaagag

SEQ ID NO: 55465 - DNA, 22 bp, Homo sapiens
tggtctttgtccctccttgatc

SEQ ID NO: 55466 - DNA, 22 bp, Homo sapiens
gaagccttgaactgcaaacccc

SEQ ID NO: 55467 - DNA, 22 bp, Homo sapiens
agatggggtttcatcatgttgg

SEQ ID NO: 55468 - DNA, 22 bp, Homo sapiens
tggcaaaatgagcaattacttt

SEQ ID NO: 55469 - DNA, 22 bp, Homo sapiens
tgccagattgtggcatggcact

SEQ ID NO: 55470 - DNA, 22 bp, Homo sapiens
gggaggcagtgctggaggctgg

SEQ ID NO: 55471 - DNA, 22 bp, Homo sapiens
gctaggttggggaagttctcct

SEQ ID NO: 55472 - DNA, 22 bp, Homo sapiens
agggtcctgggtgcagttgctt

SEQ ID NO: 55473 - DNA, 18 bp, Homo sapiens
atgagaggtgtcagaaga

SEQ ID NO: 55474 - DNA, 22 bp, Homo sapiens
cagagcccctcgtctccaccac

SEQ ID NO: 55475 - DNA, 22 bp, Homo sapiens
ctggcaggttatagagctgccc

SEQ ID NO: 55476 - DNA, 22 bp, Homo sapiens
taacaatacccattctaattac

SEQ ID NO: 55477 - DNA, 22 bp, Homo sapiens
gatataggttcatagtgttaca

SEQ ID NO: 55478 - DNA, 22 bp, Homo sapiens
ggtgtagctctgtgtcccactg

SEQ ID NO: 55479 - DNA, 22 bp, Homo sapiens
agttattactctttaacatatt

SEQ ID NO: 55480 - DNA, 22 bp, Homo sapiens
tcaaattgtcatcttgataatg

SEQ ID NO: 55481 - DNA, 22 bp, Homo sapiens
cccaggaggtggagcttgcagt

SEQ ID NO: 55482 - DNA, 22 bp, Homo sapiens
ctccaggccatggctgcggagg

SEQ ID NO: 55483 - DNA, 22 bp, Homo sapiens
ttcttctttccaattacatggt

SEQ ID NO: 55484 - DNA, 22 bp, Homo sapiens
ccaggagctggagggtgcagtg

SEQ ID NO: 55485 - DNA, 22 bp, Homo sapiens
caggaggagggcagccgcctcc

SEQ ID NO: 55486 - DNA, 22 bp, Homo sapiens
gtgcgggcctgggggtttctct

SEQ ID NO: 55487 - DNA, 22 bp, Homo sapiens
aggggagagttaatgtgaatgt

SEQ ID NO: 55488 - DNA, 17 bp, Homo sapiens
tgtagcttctccttctc

SEQ ID NO: 55489 - DNA, 22 bp, Homo sapiens
cctgcctactgagttttatatt

SEQ ID NO: 55490 - DNA, 22 bp, Homo sapiens
aagtgctgggattacaggcgtg

SEQ ID NO: 55491 - DNA, 22 bp, Homo sapiens
gagccagactgcctgaagctca

SEQ ID NO: 55492 - DNA, 22 bp, Homo sapiens
accacatcgggcggacactggg

SEQ ID NO: 55493 - DNA, 22 bp, Homo sapiens
aaggcaaggcttccagctcccc

SEQ ID NO: 55494 - DNA, 22 bp, Homo sapiens
caggcagggagctggaaaggat

SEQ ID NO: 55495 - DNA, 22 bp, Homo sapiens
tgtgttcagaatttgctgcttt

SEQ ID NO: 55496 - DNA, 22 bp, Homo sapiens
taggcaagtggaccagaggttt

SEQ ID NO: 55497 - DNA, 22 bp, Homo sapiens
gtggtgtttgagctgccaggga

SEQ ID NO: 55498 - DNA, 22 bp, Homo sapiens
gctgggctgcgtcggggaagcc

SEQ ID NO: 55499 - DNA, 22 bp, Homo sapiens
tcaggggcttgaggtgcatgtc

SEQ ID NO: 55500 - DNA, 22 bp, Homo sapiens
ggacaagcctgtgagtgggttt

SEQ ID NO: 55501 - DNA, 22 bp, Homo sapiens
gccctcctggcaggcagtgatg

SEQ ID NO: 55502 - DNA, 22 bp, Homo sapiens
tgttaaatgctcagctcgggga

SEQ ID NO: 55503 - DNA, 22 bp, Homo sapiens
ggcaatagttgtgggttcttta

SEQ ID NO: 55504 - DNA, 22 bp, Homo sapiens
cattacagaatatgtaatgatc

SEQ ID NO: 55505 - DNA, 22 bp, Homo sapiens
cactgcactccagcactccagc

SEQ ID NO: 55506 - DNA, 22 bp, Homo sapiens
tagactagaggatcagcaaggg

SEQ ID NO: 55507 - DNA, 22 bp, Homo sapiens
aagacttgaccaggttgaaggc

SEQ ID NO: 55508 - DNA, 22 bp, Homo sapiens
tacatgctccttatgagaatct

SEQ ID NO: 55509 - DNA, 22 bp, Homo sapiens
ggtgcagtgcagggtaattata

SEQ ID NO: 55510 - DNA, 22 bp, Homo sapiens
gaggctgaggcaggaggatcac

SEQ ID NO: 55511 - DNA, 22 bp, Homo sapiens
tctgctttcttactaaaaatga

SEQ ID NO: 55512 - DNA, 18 bp, Homo sapiens
cagctgccagctcatgga

SEQ ID NO: 55513 - DNA, 22 bp, Homo sapiens
tggaaccatcaaagagatcctg

SEQ ID NO: 55514 - DNA, 22 bp, Homo sapiens
ttaggatttgaaaaggggcaga

SEQ ID NO: 55515 - DNA, 22 bp, Homo sapiens
gagagtctaggaacctcatata

SEQ ID NO: 55516 - DNA, 22 bp, Homo sapiens
acagtgcttagcacagagtaga

SEQ ID NO: 55517 - DNA, 22 bp, Homo sapiens
gccaggctgaggctctggaaga

SEQ ID NO: 55518 - DNA, 22 bp, Homo sapiens
agagagcccgggccagggcaca

SEQ ID NO: 55519 - DNA, 22 bp, Homo sapiens
actgcactccaacctgggtgac

SEQ ID NO: 55520 - DNA, 22 bp, Homo sapiens
actgcactccagcctgggtaac

SEQ ID NO: 55521 - DNA, 22 bp, Homo sapiens
ccaggctggagtgcagtggcac

SEQ ID NO: 55522 - DNA, 21 bp, Homo sapiens
agctgcctccacttctgaggc

SEQ ID NO: 55523 - DNA, 22 bp, Homo sapiens
ggcaaaaagttcccatcagtgt

SEQ ID NO: 55524 - DNA, 22 bp, Homo sapiens
gaggagggagctggaagctctt

SEQ ID NO: 55525 - DNA, 22 bp, Homo sapiens
tatttcttttcgtgacttattg

SEQ ID NO: 55526 - DNA, 22 bp, Homo sapiens
ggttctctaactttgactggag

SEQ ID NO: 55527 - DNA, 22 bp, Homo sapiens
tagggtagtaccatgctgccag

SEQ ID NO: 55528 - DNA, 22 bp, Homo sapiens
ccaggcagcctgctccattctg

SEQ ID NO: 55529 - DNA, 22 bp, Homo sapiens
gatgaggcataaacacagtcac

SEQ ID NO: 55530 - DNA, 22 bp, Homo sapiens
cccaggccctggcagagcttgt

SEQ ID NO: 55531 - DNA, 22 bp, Homo sapiens
gaggtggatgttgcagtgagct

SEQ ID NO: 55532 - DNA, 22 bp, Homo sapiens
agaagtataactatttgctttc

SEQ ID NO: 55533 - DNA, 22 bp, Homo sapiens
ctgggggtcttgaaagggagag

SEQ ID NO: 55534 - DNA, 22 bp, Homo sapiens
ttgtaacaggtactaaataact

SEQ ID NO: 55535 - DNA, 22 bp, Homo sapiens
atagggctgccatcacagaaga

SEQ ID NO: 55536 - DNA, 22 bp, Homo sapiens
ataataacaatgccagatgcct

SEQ ID NO: 55537 - DNA, 22 bp, Homo sapiens
aagggggcggcagccagtggaa

SEQ ID NO: 55538 - DNA, 22 bp, Homo sapiens
tgacagtattgatggcaggatt

SEQ ID NO: 55539 - DNA, 22 bp, Homo sapiens
agaaatatgctgattagatgaa

SEQ ID NO: 55540 - DNA, 23 bp, Homo sapiens
tgtcttcgactcctgcgtgcttc

SEQ ID NO: 55541 - DNA, 22 bp, Homo sapiens
tcctgggatcaagtgatcctcc

SEQ ID NO: 55542 - DNA, 22 bp, Homo sapiens
tctgttgactcctagcagccat

SEQ ID NO: 55543 - DNA, 22 bp, Homo sapiens
cggcttctgcccattcagtcct

SEQ ID NO: 55544 - DNA, 22 bp, Homo sapiens
ctccagattccgtttattcagg

SEQ ID NO: 55545 - DNA, 22 bp, Homo sapiens
agacgctattttgaggggtcta

SEQ ID NO: 55546 - DNA, 22 bp, Homo sapiens
gcgactgtacagaattgcccct

SEQ ID NO: 55547 - DNA, 22 bp, Homo sapiens
taatgtataacaaatactcatc

SEQ ID NO: 55548 - DNA, 22 bp, Homo sapiens
aatttaagagcatagctccaac

SEQ ID NO: 55549 - DNA, 22 bp, Homo sapiens
gccagccagaaacgtcacactg

SEQ ID NO: 55550 - DNA, 22 bp, Homo sapiens
caggctggagtacaattgtgtg

SEQ ID NO: 55551 - DNA, 22 bp, Homo sapiens
ttgtctaatgagctccacttca

SEQ ID NO: 55552 - DNA, 21 bp, Homo sapiens
tgcaatccagcctgggcgaca

SEQ ID NO: 55553 - DNA, 22 bp, Homo sapiens
catgtaaagaatttcacacaag

SEQ ID NO: 55554 - DNA, 22 bp, Homo sapiens
cctagagccgcacctcctccac

SEQ ID NO: 55555 - DNA, 22 bp, Homo sapiens
ctgggaggcagaggttgcagtg

SEQ ID NO: 55556 - DNA, 22 bp, Homo sapiens
tgatctggtcctactgtgggca

SEQ ID NO: 55557 - DNA, 22 bp, Homo sapiens
ttagtgcttggcacacaataca

SEQ ID NO: 55558 - DNA, 22 bp, Homo sapiens
gttaggtagaagtttactttga

SEQ ID NO: 55559 - DNA, 22 bp, Homo sapiens
tccagcagtccatgtgagacac

SEQ ID NO: 55560 - DNA, 22 bp, Homo sapiens
tctacctggagtccgttgttaa

SEQ ID NO: 55561 - DNA, 22 bp, Homo sapiens
tcccccaggctggagtgcagtg

SEQ ID NO: 55562 - DNA, 22 bp, Homo sapiens
tggagccagcggcctgctgagg

SEQ ID NO: 55563 - DNA, 22 bp, Homo sapiens
ggaatgaatttccagctgggtc

SEQ ID NO: 55564 - DNA, 22 bp, Homo sapiens
acattaaacttgcttggctgta

SEQ ID NO: 55565 - DNA, 22 bp, Homo sapiens
gacttctgaattcctatcaggt

SEQ ID NO: 55566 - DNA, 20 bp, Homo sapiens
aggccccaggtggacactag

SEQ ID NO: 55567 - DNA, 22 bp, Homo sapiens
tcttttgtgattcttcagttac

SEQ ID NO: 55568 - DNA, 22 bp, Homo sapiens
ccaggaggcggaggttgcagtg

SEQ ID NO: 55569 - DNA, 22 bp, Homo sapiens
gccctgtgcaggtgtgcagcag

SEQ ID NO: 55570 - DNA, 22 bp, Homo sapiens
ctgctgagccgcacccaggagc

SEQ ID NO: 55571 - DNA, 22 bp, Homo sapiens
cagcagcagtgttctagaatct

SEQ ID NO: 55572 - DNA, 22 bp, Homo sapiens
aagaactgagtacgttaataaa

SEQ ID NO: 55573 - DNA, 22 bp, Homo sapiens
tttcccaggctggaatgcagtg

SEQ ID NO: 55574 - DNA, 22 bp, Homo sapiens
aaagcactgcacatatatttgc

SEQ ID NO: 55575 - DNA, 22 bp, Homo sapiens
atggctgcctgggcgctggccg

SEQ ID NO: 55576 - DNA, 22 bp, Homo sapiens
cagcttggaggaggatctaaga

SEQ ID NO: 55577 - DNA, 22 bp, Homo sapiens
ctattgtttctatgctctgagg

SEQ ID NO: 55578 - DNA, 22 bp, Homo sapiens
tgtccaggctggagtgcagtgg

SEQ ID NO: 55579 - DNA, 22 bp, Homo sapiens
aggctgaggcaagaggatcact

SEQ ID NO: 55580 - DNA, 22 bp, Homo sapiens
ggctcttccgccaccagccaca

SEQ ID NO: 55581 - DNA, 22 bp, Homo sapiens
agaggccggccgagcccatggg

SEQ ID NO: 55582 - DNA, 22 bp, Homo sapiens
gccggggctggggagagacatg

SEQ ID NO: 55583 - DNA, 22 bp, Homo sapiens
ttgtgttaaggtgcatctagtg

SEQ ID NO: 55584 - DNA, 22 bp, Homo sapiens
atgacaagagtgttcagggaga

SEQ ID NO: 55585 - DNA, 22 bp, Homo sapiens
gctcttgtcaaaaattagttga

SEQ ID NO: 55586 - DNA, 22 bp, Homo sapiens
taggcatgcaaataaatgtgca

SEQ ID NO: 55587 - DNA, 22 bp, Homo sapiens
cctccccacagcccaggagact

SEQ ID NO: 55588 - DNA, 22 bp, Homo sapiens
tgcagattcaaatgaaatgcaa

SEQ ID NO: 55589 - DNA, 22 bp, Homo sapiens
ggaccaggactggtggtatctc

SEQ ID NO: 55590 - DNA, 22 bp, Homo sapiens
tttgtgaataggttggcttcca

SEQ ID NO: 55591 - DNA, 22 bp, Homo sapiens
ttgtcttttgtgggaaatatgg

SEQ ID NO: 55592 - DNA, 20 bp, Homo sapiens
ttgttagaggaatgccatag

SEQ ID NO: 55593 - DNA, 22 bp, Homo sapiens
ggaagaaaggtggacaacaggt

SEQ ID NO: 55594 - DNA, 22 bp, Homo sapiens
cttaatctcacctgcaaagtcc

SEQ ID NO: 55595 - DNA, 22 bp, Homo sapiens
agaggaagtaatcaggacctgc

SEQ ID NO: 55596 - DNA, 22 bp, Homo sapiens
gttactcttccccggggtctgg

SEQ ID NO: 55597 - DNA, 22 bp, Homo sapiens
tgtctccaccatcatcttacca

SEQ ID NO: 55598 - DNA, 22 bp, Homo sapiens
atacaaaatatatactggagac

SEQ ID NO: 55599 - DNA, 22 bp, Homo sapiens
ttcccttaaattatggcatcta

SEQ ID NO: 55600 - DNA, 22 bp, Homo sapiens
ctgaggcaggagagttgcttga

SEQ ID NO: 55601 - DNA, 22 bp, Homo sapiens
ttaggcctttgattggggtgct

SEQ ID NO: 55602 - DNA, 22 bp, Homo sapiens
tcctggcttgtcacatctacgt

SEQ ID NO: 55603 - DNA, 22 bp, Homo sapiens
gaggaggcttccgggaggcacg

SEQ ID NO: 55604 - DNA, 21 bp, Homo sapiens
tccctgagcccaaggggctcc

SEQ ID NO: 55605 - DNA, 22 bp, Homo sapiens
gtcccctgtccagggccagcca

SEQ ID NO: 55606 - DNA, 22 bp, Homo sapiens
aaaaaattatcatagttcctga

SEQ ID NO: 55607 - DNA, 22 bp, Homo sapiens
cactgcactccagcttgggtga

SEQ ID NO: 55608 - DNA, 22 bp, Homo sapiens
gcagcctgggcaacagagtgag

SEQ ID NO: 55609 - DNA, 22 bp, Homo sapiens
tttggactgcatgatgatctgg

SEQ ID NO: 55610 - DNA, 22 bp, Homo sapiens
cttgtattaggaagaatgcttt

SEQ ID NO: 55611 - DNA, 22 bp, Homo sapiens
gtgggacaaggatgaagatatt

SEQ ID NO: 55612 - DNA, 22 bp, Homo sapiens
gtgcaaaagtaattgtggtttt

SEQ ID NO: 55613 - DNA, 22 bp, Homo sapiens
agaccactaaaactttctctat

SEQ ID NO: 55614 - DNA, 22 bp, Homo sapiens
atgagctcatccgagtcacact

SEQ ID NO: 55615 - DNA, 22 bp, Homo sapiens
gcctgtgtctgggtggccagag

SEQ ID NO: 55616 - DNA, 22 bp, Homo sapiens
aaagaggcaatcaatgtagcaa

SEQ ID NO: 55617 - DNA, 22 bp, Homo sapiens
ctgagatctttatacgaggcac

SEQ ID NO: 55618 - DNA, 22 bp, Homo sapiens
aatgtattcttcaaccttgcta

SEQ ID NO: 55619 - DNA, 22 bp, Homo sapiens
acatcttttactctggttcggg

SEQ ID NO: 55620 - DNA, 22 bp, Homo sapiens
tgatatgtaactactccttata

SEQ ID NO: 55621 - DNA, 22 bp, Homo sapiens
gctgaaggcccggaggacaggg

SEQ ID NO: 55622 - DNA, 22 bp, Homo sapiens
ctctggagtgtctggccagggt

SEQ ID NO: 55623 - DNA, 22 bp, Homo sapiens
cggcatccccacttcctcctgc

SEQ ID NO: 55624 - DNA, 22 bp, Homo sapiens
gtctgctcatgctaccgcgggc

SEQ ID NO: 55625 - DNA, 22 bp, Homo sapiens
agccaggatggtctcgatcggc

SEQ ID NO: 55626 - DNA, 22 bp, Homo sapiens
agcccaggagtttgaggctgtg

SEQ ID NO: 55627 - DNA, 22 bp, Homo sapiens
agaagccaccagctgaggaaga

SEQ ID NO: 55628 - DNA, 22 bp, Homo sapiens
aaagtgcaaggattacaggcat

SEQ ID NO: 55629 - DNA, 22 bp, Homo sapiens
caagacttcaccgctctgtgct

SEQ ID NO: 55630 - DNA, 22 bp, Homo sapiens
gagccaggttggaggctgcagt

SEQ ID NO: 55631 - DNA, 22 bp, Homo sapiens
gtcacctcgctgtcttcctgag

SEQ ID NO: 55632 - DNA, 22 bp, Homo sapiens
taagtcttcatagtctaatgtc

SEQ ID NO: 55633 - DNA, 22 bp, Homo sapiens
cataaaaggtagcagtttgaaa

SEQ ID NO: 55634 - DNA, 22 bp, Homo sapiens
gacagctccagctcctccaggc

SEQ ID NO: 55635 - DNA, 22 bp, Homo sapiens
tgacaagaaagcgtcttctttt

SEQ ID NO: 55636 - DNA, 22 bp, Homo sapiens
tgatttacagtagtgtctaaac

SEQ ID NO: 55637 - DNA, 22 bp, Homo sapiens
actgccctccagcctgggtgac

SEQ ID NO: 55638 - DNA, 22 bp, Homo sapiens
gttgacagtgaccctgaaagca

SEQ ID NO: 55639 - DNA, 22 bp, Homo sapiens
ccaggctggagtgcaatggcat

SEQ ID NO: 55640 - DNA, 22 bp, Homo sapiens
aaagttctctatggtgtaaaaa

SEQ ID NO: 55641 - DNA, 22 bp, Homo sapiens
ggacctgaacataaaacgaggc

SEQ ID NO: 55642 - DNA, 22 bp, Homo sapiens
gggaagagggagctggaatgat

SEQ ID NO: 55643 - DNA, 22 bp, Homo sapiens
tcaactaactctattatttgaa

SEQ ID NO: 55644 - DNA, 22 bp, Homo sapiens
ttttcatttttgtagatgcaag

SEQ ID NO: 55645 - DNA, 22 bp, Homo sapiens
catgagatctgcagggatgggc

SEQ ID NO: 55646 - DNA, 22 bp, Homo sapiens
tcggagctgtagatgaaaccct

SEQ ID NO: 55647 - DNA, 22 bp, Homo sapiens
gttgaggtgatgccagccctgc

SEQ ID NO: 55648 - DNA, 22 bp, Homo sapiens
gtcctggggattatagagtgtt

SEQ ID NO: 55649 - DNA, 22 bp, Homo sapiens
gcctccagggatgattccttcc

SEQ ID NO: 55650 - DNA, 22 bp, Homo sapiens
atttagaactttgtttgccaat

SEQ ID NO: 55651 - DNA, 22 bp, Homo sapiens
cctgccctgctcactgtcggta

SEQ ID NO: 55652 - DNA, 22 bp, Homo sapiens
gccttgtttcattacacgtggt

SEQ ID NO: 55653 - DNA, 23 bp, Homo sapiens
agagcaaggaaatgaggtgtgat

SEQ ID NO: 55654 - DNA, 22 bp, Homo sapiens
agacactgttctcacatgcttg

SEQ ID NO: 55655 - DNA, 22 bp, Homo sapiens
ggatgtcgaggatggggtagca

SEQ ID NO: 55656 - DNA, 22 bp, Homo sapiens
gtgctgacaggagcctggcggt

SEQ ID NO: 55657 - DNA, 22 bp, Homo sapiens
atgcacctgaactccatcagct

SEQ ID NO: 55658 - DNA, 22 bp, Homo sapiens
catctgctgttccttggactca

SEQ ID NO: 55659 - DNA, 22 bp, Homo sapiens
actttaaaactgatcatcagag

SEQ ID NO: 55660 - DNA, 22 bp, Homo sapiens
ctgaggcctctcccactccagc

SEQ ID NO: 55661 - DNA, 18 bp, Homo sapiens
ggaaaaggagtgtctagc

SEQ ID NO: 55662 - DNA, 22 bp, Homo sapiens
agatgtgtttctagttcctgca

SEQ ID NO: 55663 - DNA, 22 bp, Homo sapiens
atatgcagtctcttgcccttct

SEQ ID NO: 55664 - DNA, 22 bp, Homo sapiens
agcttgacagacagatggtagc

SEQ ID NO: 55665 - DNA, 22 bp, Homo sapiens
atctagattaggtataagagct

SEQ ID NO: 55666 - DNA, 22 bp, Homo sapiens
tgaatgtgatgctaaacatatg

SEQ ID NO: 55667 - DNA, 22 bp, Homo sapiens
gacccggctccaggcccagcag

SEQ ID NO: 55668 - DNA, 22 bp, Homo sapiens
accccttggagtccgcgcccag

SEQ ID NO: 55669 - DNA, 22 bp, Homo sapiens
caggcaggtcagtgaagaagga

SEQ ID NO: 55670 - DNA, 23 bp, Homo sapiens
agctctgctcgggcatgccctgc

SEQ ID NO: 55671 - DNA, 22 bp, Homo sapiens
accaggcccgctgctatggtgg

SEQ ID NO: 55672 - DNA, 22 bp, Homo sapiens
tcaggcaatctgacagctggag

SEQ ID NO: 55673 - DNA, 22 bp, Homo sapiens
atatacacatctttttaaatat

SEQ ID NO: 55674 - DNA, 22 bp, Homo sapiens
agtgctgggctatctactgcta

SEQ ID NO: 55675 - DNA, 18 bp, Homo sapiens
tcctttctccctcatctt

SEQ ID NO: 55676 - DNA, 22 bp, Homo sapiens
agtatacatagtgcttcctctt

SEQ ID NO: 55677 - DNA, 22 bp, Homo sapiens
gagaggaagccttctgtacttg

SEQ ID NO: 55678 - DNA, 22 bp, Homo sapiens
gagcagtgtttgtggacctgga

SEQ ID NO: 55679 - DNA, 22 bp, Homo sapiens
taagggttcagaatgcagtggt

SEQ ID NO: 55680 - DNA, 22 bp, Homo sapiens
tgggaggccgaggcaggtggat

SEQ ID NO: 55681 - DNA, 18 bp, Homo sapiens
tccctcagaattatagaa

SEQ ID NO: 55682 - DNA, 22 bp, Homo sapiens
agctcaatgcaacctccgcctc

SEQ ID NO: 55683 - DNA, 22 bp, Homo sapiens
cgactgtcatacacaagacatg

SEQ ID NO: 55684 - DNA, 22 bp, Homo sapiens
acccaggctggagtgcagtggg

SEQ ID NO: 55685 - DNA, 22 bp, Homo sapiens
aacgcccagccttgatcaaatg

SEQ ID NO: 55686 - DNA, 22 bp, Homo sapiens
aaatgtggggctggaggcagga

SEQ ID NO: 55687 - DNA, 22 bp, Homo sapiens
acgtcttcgttggcagagattt

SEQ ID NO: 55688 - DNA, 22 bp, Homo sapiens
tgcaaatgtgttttaaaccaaa

SEQ ID NO: 55689 - DNA, 22 bp, Homo sapiens
tcttttgtgattctttagttac

SEQ ID NO: 55690 - DNA, 23 bp, Homo sapiens
caccccaccctgaggaggaggga

SEQ ID NO: 55691 - DNA, 22 bp, Homo sapiens
agagcacagccaccatttacaa

SEQ ID NO: 55692 - DNA, 21 bp, Homo sapiens
tactgtagccttgcactgtag

SEQ ID NO: 55693 - DNA, 22 bp, Homo sapiens
aggacaaaggaccagatctgga

SEQ ID NO: 55694 - DNA, 22 bp, Homo sapiens
ccagaggagttgaggctttggg

SEQ ID NO: 55695 - DNA, 20 bp, Homo sapiens
acgtggccaccagtggctta

SEQ ID NO: 55696 - DNA, 22 bp, Homo sapiens
acagcagagcctggtacttact

SEQ ID NO: 55697 - DNA, 22 bp, Homo sapiens
aaaatcttgtgacttaggaagg

SEQ ID NO: 55698 - DNA, 22 bp, Homo sapiens
tttcccagcctcagctcagcag

SEQ ID NO: 55699 - DNA, 22 bp, Homo sapiens
gagatggagtctttttctgtca

SEQ ID NO: 55700 - DNA, 22 bp, Homo sapiens
agccctcttccagccagcacag

SEQ ID NO: 55701 - DNA, 22 bp, Homo sapiens
cccacaggtgtgagcttgctgg

SEQ ID NO: 55702 - DNA, 22 bp, Homo sapiens
ccaggaggttgaggctgcagtg

SEQ ID NO: 55703 - DNA, 22 bp, Homo sapiens
tatctgatacaacagaataaca

SEQ ID NO: 55704 - DNA, 22 bp, Homo sapiens
gggaggttgaggctgcagtgag

SEQ ID NO: 55705 - DNA, 22 bp, Homo sapiens
tcccgttgatgacggtgcatcc

SEQ ID NO: 55706 - DNA, 22 bp, Homo sapiens
atgcgagtgatgcagagtggct

SEQ ID NO: 55707 - DNA, 22 bp, Homo sapiens
tggcacagactgggccaaggaa

SEQ ID NO: 55708 - DNA, 23 bp, Homo sapiens
gggtccagccaattccaaggaaa

SEQ ID NO: 55709 - DNA, 22 bp, Homo sapiens
ctggggaacgcagcgagcagcg

SEQ ID NO: 55710 - DNA, 22 bp, Homo sapiens
ggggtactggctggagccccac

SEQ ID NO: 55711 - DNA, 21 bp, Homo sapiens
agtagtttagcacagggtttg

SEQ ID NO: 55712 - DNA, 22 bp, Homo sapiens
tgcgcctctaatctcgggcgtc

SEQ ID NO: 55713 - DNA, 22 bp, Homo sapiens
gctgctaagcgtttctgttcca

SEQ ID NO: 55714 - DNA, 22 bp, Homo sapiens
gggaggaggaatgttttgtgta

SEQ ID NO: 55715 - DNA, 22 bp, Homo sapiens
tgtcctcgtccgcctcgaactc

SEQ ID NO: 55716 - DNA, 22 bp, Homo sapiens
tgagtggacacctgcttcttta

SEQ ID NO: 55717 - DNA, 22 bp, Homo sapiens
ccagcagagcatggggaggaag

SEQ ID NO: 55718 - DNA, 22 bp, Homo sapiens
ggagtgactcacagctgggaca

SEQ ID NO: 55719 - DNA, 22 bp, Homo sapiens
tccttaggcaatttgggagagt

SEQ ID NO: 55720 - DNA, 22 bp, Homo sapiens
cctgcctatgagacgttttgcc

SEQ ID NO: 55721 - DNA, 22 bp, Homo sapiens
cactgcacttcagcctgggtga

SEQ ID NO: 55722 - DNA, 15 bp, Homo sapiens
catatcactgggaat

SEQ ID NO: 55723 - DNA, 22 bp, Homo sapiens
tgttgagtatatacctacaagt

SEQ ID NO: 55724 - DNA, 22 bp, Homo sapiens
gggaaactttcacaatgtccag

SEQ ID NO: 55725 - DNA, 22 bp, Homo sapiens
ggctttgacatgctgaattaaa

SEQ ID NO: 55726 - DNA, 22 bp, Homo sapiens
tcgcaccattgcactccagcca

SEQ ID NO: 55727 - DNA, 22 bp, Homo sapiens
atgccactgcgctccagcctgg

SEQ ID NO: 55728 - DNA, 22 bp, Homo sapiens
acatagtgttttgagagacagc

SEQ ID NO: 55729 - DNA, 20 bp, Homo sapiens
gccactgggcaccagcaggg

SEQ ID NO: 55730 - DNA, 22 bp, Homo sapiens
aaggctgaggcagtgaggcaga

SEQ ID NO: 55731 - DNA, 22 bp, Homo sapiens
tcaggcagtagaattgcttgaa

SEQ ID NO: 55732 - DNA, 22 bp, Homo sapiens
cttgcctttgtcttcaaaggct

SEQ ID NO: 55733 - DNA, 22 bp, Homo sapiens
actgcactcctgcctgggtaac

SEQ ID NO: 55734 - DNA, 22 bp, Homo sapiens
ggaggtggagctggaagttcca

SEQ ID NO: 55735 - DNA, 22 bp, Homo sapiens
tagcataacaggtaagagtgag

SEQ ID NO: 55736 - DNA, 22 bp, Homo sapiens
caggctggagtgcagtggggcg

SEQ ID NO: 55737 - DNA, 15 bp, Homo sapiens
gcaggcaggtcacct

SEQ ID NO: 55738 - DNA, 22 bp, Homo sapiens
accccaggaagtggaggtcatg

SEQ ID NO: 55739 - DNA, 22 bp, Homo sapiens
ggaggtgggctaaggactctct

SEQ ID NO: 55740 - DNA, 22 bp, Homo sapiens
gagccaagctcttctccatgag

SEQ ID NO: 55741 - DNA, 22 bp, Homo sapiens
atgtgctgagtgtgtatataca

SEQ ID NO: 55742 - DNA, 22 bp, Homo sapiens
aaccaccattctctcctcttcc

SEQ ID NO: 55743 - DNA, 22 bp, Homo sapiens
gtagcccacctggggagggcga

SEQ ID NO: 55744 - DNA, 22 bp, Homo sapiens
gaccctgtttctacaaataatt

SEQ ID NO: 55745 - DNA, 22 bp, Homo sapiens
agcctggcggtcgtcggtcagg

SEQ ID NO: 55746 - DNA, 22 bp, Homo sapiens
agtggcacaattttgactcccc

SEQ ID NO: 55747 - DNA, 22 bp, Homo sapiens
tccaggatggtgacggtggcca

SEQ ID NO: 55748 - DNA, 22 bp, Homo sapiens
aagacacaatgtagcccagcac

SEQ ID NO: 55749 - DNA, 22 bp, Homo sapiens
atatatttgagaatattcatga

SEQ ID NO: 55750 - DNA, 22 bp, Homo sapiens
tagatttgtttccttctctcca

SEQ ID NO: 55751 - DNA, 22 bp, Homo sapiens
attgttgggtctcactcctaga

SEQ ID NO: 55752 - DNA, 22 bp, Homo sapiens
tctggcttccctctgttctggg

SEQ ID NO: 55753 - DNA, 22 bp, Homo sapiens
ggcatctggatctgcttctccc

SEQ ID NO: 55754 - DNA, 19 bp, Homo sapiens
agccagccagcaggtatgc

SEQ ID NO: 55755 - DNA, 22 bp, Homo sapiens
gcaggcagatcacctgtcagga

SEQ ID NO: 55756 - DNA, 22 bp, Homo sapiens
gacaattgcttttgccgaataa

SEQ ID NO: 55757 - DNA, 22 bp, Homo sapiens
agcgggtctgcaagccttccct

SEQ ID NO: 55758 - DNA, 22 bp, Homo sapiens
ggctccaccctgcttccagaag

SEQ ID NO: 55759 - DNA, 22 bp, Homo sapiens
agtggctgagtgactgtgactc

SEQ ID NO: 55760 - DNA, 22 bp, Homo sapiens
acaggcttacaggctgcaagta

SEQ ID NO: 55761 - DNA, 22 bp, Homo sapiens
tgcacgtgtgagcattcacatg

SEQ ID NO: 55762 - DNA, 22 bp, Homo sapiens
ttgccatgttgccaaggctggt

SEQ ID NO: 55763 - DNA, 22 bp, Homo sapiens
agcttgggcaacacagcaagac

SEQ ID NO: 55764 - DNA, 22 bp, Homo sapiens
ctggctggagtgcaggtgagtg

SEQ ID NO: 55765 - DNA, 22 bp, Homo sapiens
cccgggttgtccgcgcgtccgg

SEQ ID NO: 55766 - DNA, 22 bp, Homo sapiens
ggtaccaccaattcagctgcca

SEQ ID NO: 55767 - DNA, 22 bp, Homo sapiens
aagccctggcgggtggagggcc

SEQ ID NO: 55768 - DNA, 22 bp, Homo sapiens
catataaatacaacatgtgtta

SEQ ID NO: 55769 - DNA, 22 bp, Homo sapiens
ggtgggagagcttgctttgatg

SEQ ID NO: 55770 - DNA, 22 bp, Homo sapiens
tgctgtgaggttgagaaggaag

SEQ ID NO: 55771 - DNA, 22 bp, Homo sapiens
gacccttagaatgtgatcttat

SEQ ID NO: 55772 - DNA, 22 bp, Homo sapiens
atcttcccaggctggggagagg

SEQ ID NO: 55773 - DNA, 18 bp, Homo sapiens
ggtgagggagctggaagc

SEQ ID NO: 55774 - DNA, 22 bp, Homo sapiens
tgtccaggctaaagtgcagtgg

SEQ ID NO: 55775 - DNA, 22 bp, Homo sapiens
tgagcaggcgcagcaggaggtc

SEQ ID NO: 55776 - DNA, 22 bp, Homo sapiens
attaagactgcccatgttttta

SEQ ID NO: 55777 - DNA, 22 bp, Homo sapiens
gaggggcacagtaaagggtccc

SEQ ID NO: 55778 - DNA, 22 bp, Homo sapiens
ggtggctgcaatggctaacttc

SEQ ID NO: 55779 - DNA, 22 bp, Homo sapiens
tacaacaatttccacattagaa

SEQ ID NO: 55780 - DNA, 22 bp, Homo sapiens
atggggaagcaattggatttcc

SEQ ID NO: 55781 - DNA, 22 bp, Homo sapiens
gtccacagctctgaggtctccc

SEQ ID NO: 55782 - DNA, 22 bp, Homo sapiens
aagctgtagcttttcaaaacgt

SEQ ID NO: 55783 - DNA, 22 bp, Homo sapiens
ggaggacaggggctgcagcaca

SEQ ID NO: 55784 - DNA, 22 bp, Homo sapiens
ttccaaagaagttcacatttac

SEQ ID NO: 55785 - DNA, 22 bp, Homo sapiens
ttccagctaactcacatccctt

SEQ ID NO: 55786 - DNA, 22 bp, Homo sapiens
aaagtgctgggattacaagtgt

SEQ ID NO: 55787 - DNA, 22 bp, Homo sapiens
agtggcctggagccccgcctgg

SEQ ID NO: 55788 - DNA, 22 bp, Homo sapiens
aatgcaatgcagcacctccttg

SEQ ID NO: 55789 - DNA, 22 bp, Homo sapiens
ttgtgagtagtgccgcaataaa

SEQ ID NO: 55790 - DNA, 22 bp, Homo sapiens
cggaggttgaggctgcagtgag

SEQ ID NO: 55791 - DNA, 22 bp, Homo sapiens
cccagcgagtttgccggtgaac

SEQ ID NO: 55792 - DNA, 22 bp, Homo sapiens
tgtttgagttctagcgcattta

SEQ ID NO: 55793 - DNA, 22 bp, Homo sapiens
actgcacttcaccctgggtgac

SEQ ID NO: 55794 - DNA, 22 bp, Homo sapiens
ccaagtgttttataagggacag

SEQ ID NO: 55795 - DNA, 22 bp, Homo sapiens
tttctcttcactgtgtgcctca

SEQ ID NO: 55796 - DNA, 22 bp, Homo sapiens
acagttaattgttgttgggtgt

SEQ ID NO: 55797 - DNA, 22 bp, Homo sapiens
caaagggaaaagccatgtgggc

SEQ ID NO: 55798 - DNA, 22 bp, Homo sapiens
gtggatggagctggaagccatt

SEQ ID NO: 55799 - DNA, 22 bp, Homo sapiens
gttctgggagatcttgagcttc

SEQ ID NO: 55800 - DNA, 16 bp, Homo sapiens
aggctcagaggctgga

SEQ ID NO: 55801 - DNA, 22 bp, Homo sapiens
ttgcatttggttctgcctggta

SEQ ID NO: 55802 - DNA, 22 bp, Homo sapiens
ctgaggcaggatggcctggctg

SEQ ID NO: 55803 - DNA, 22 bp, Homo sapiens
cagcctggtccccggctcaccc

SEQ ID NO: 55804 - DNA, 22 bp, Homo sapiens
tgagtactgatttaagatacac

SEQ ID NO: 55805 - DNA, 22 bp, Homo sapiens
tgaggcaggaggattgcaggat

SEQ ID NO: 55806 - DNA, 22 bp, Homo sapiens
gtctccccagggccctcttcat

SEQ ID NO: 55807 - DNA, 21 bp, Homo sapiens
gttcatgtcagcattaaggga

SEQ ID NO: 55808 - DNA, 22 bp, Homo sapiens
tgtcttcaggagtaaatatcat

SEQ ID NO: 55809 - DNA, 22 bp, Homo sapiens
gcctggagaaaggaaggtggga

SEQ ID NO: 55810 - DNA, 22 bp, Homo sapiens
aataaaatggtcagttttctca

SEQ ID NO: 55811 - DNA, 22 bp, Homo sapiens
tgagcccagagatctgagctat

SEQ ID NO: 55812 - DNA, 22 bp, Homo sapiens
taggcccctagtgccacgtggc

SEQ ID NO: 55813 - DNA, 22 bp, Homo sapiens
atggcatttgaatctgtctttt

SEQ ID NO: 55814 - DNA, 22 bp, Homo sapiens
tggcaatgttagcaaagcattt

SEQ ID NO: 55815 - DNA, 22 bp, Homo sapiens
caattttcaattccttcagata

SEQ ID NO: 55816 - DNA, 22 bp, Homo sapiens
gcccagcacctctctcagggtt

SEQ ID NO: 55817 - DNA, 22 bp, Homo sapiens
tgggcaggggccctgcttccgt

SEQ ID NO: 55818 - DNA, 22 bp, Homo sapiens
agagtactgctgctgggtactg

SEQ ID NO: 55819 - DNA, 22 bp, Homo sapiens
atcacaaaggtctcagagcaca

SEQ ID NO: 55820 - DNA, 22 bp, Homo sapiens
atgccactgcacttcagcttgg

SEQ ID NO: 55821 - DNA, 22 bp, Homo sapiens
tataaagagtctcaaagaagtt

SEQ ID NO: 55822 - DNA, 22 bp, Homo sapiens
atatttagataaaaatgggctt

SEQ ID NO: 55823 - DNA, 22 bp, Homo sapiens
agaaagtgcttccctttggtga

SEQ ID NO: 55824 - DNA, 22 bp, Homo sapiens
ggccctggtcctaggggtggaa

SEQ ID NO: 55825 - DNA, 22 bp, Homo sapiens
ctgaagagaaagggagctcttc

SEQ ID NO: 55826 - DNA, 22 bp, Homo sapiens
tccccagcttgctacttctgct

SEQ ID NO: 55827 - DNA, 22 bp, Homo sapiens
gcccagagttcaaggctgcagt

SEQ ID NO: 55828 - DNA, 22 bp, Homo sapiens
gcaggcagaggtggaggagaca

SEQ ID NO: 55829 - DNA, 22 bp, Homo sapiens
ggaggctgagaggtcgcagtgg

SEQ ID NO: 55830 - DNA, 22 bp, Homo sapiens
ctgaagcagggagtgatgaagt

SEQ ID NO: 55831 - DNA, 22 bp, Homo sapiens
tccattatacttctgattcaaa

SEQ ID NO: 55832 - DNA, 22 bp, Homo sapiens
attgtggtgtcagttataggca

SEQ ID NO: 55833 - DNA, 22 bp, Homo sapiens
gctgggttttcttccgggccta

SEQ ID NO: 55834 - DNA, 22 bp, Homo sapiens
cccaggatggggctgcagttat

SEQ ID NO: 55835 - DNA, 22 bp, Homo sapiens
tgaaatgttaaacaagtggctc

SEQ ID NO: 55836 - DNA, 22 bp, Homo sapiens
tttgtagcagcatgatttataa

SEQ ID NO: 55837 - DNA, 22 bp, Homo sapiens
ggggtctgggcttagctggaat

SEQ ID NO: 55838 - DNA, 22 bp, Homo sapiens
gcagaccctgaactgggcatgg

SEQ ID NO: 55839 - DNA, 22 bp, Homo sapiens
ctggcctggcgcagtggctcac

SEQ ID NO: 55840 - DNA, 16 bp, Homo sapiens
gcgcctcctcggcctc

SEQ ID NO: 55841 - DNA, 22 bp, Homo sapiens
caggaaggcgcggctgtgcctg

SEQ ID NO: 55842 - DNA, 22 bp, Homo sapiens
tcctgggaggcggaggttgcag

SEQ ID NO: 55843 - DNA, 22 bp, Homo sapiens
tctgctggaaaaccagggaatt

SEQ ID NO: 55844 - DNA, 22 bp, Homo sapiens
gtgggctgcccttgaggtcagc

SEQ ID NO: 55845 - DNA, 23 bp, Homo sapiens
tcgttgaatagcaatagcacaac

SEQ ID NO: 55846 - DNA, 22 bp, Homo sapiens
tctcgctctgtcgcccaggctg

SEQ ID NO: 55847 - DNA, 22 bp, Homo sapiens
tccataaattttatgaacatat

SEQ ID NO: 55848 - DNA, 22 bp, Homo sapiens
cagccagtgtgaccgaggagga

SEQ ID NO: 55849 - DNA, 22 bp, Homo sapiens
gagatatgttggcagctggtat

SEQ ID NO: 55850 - DNA, 22 bp, Homo sapiens
gttctgagtcctcctttgaagg

SEQ ID NO: 55851 - DNA, 22 bp, Homo sapiens
agcccaggttgaggctgcagtg

SEQ ID NO: 55852 - DNA, 22 bp, Homo sapiens
ctgtggctctttagttgagcac

SEQ ID NO: 55853 - DNA, 22 bp, Homo sapiens
ggagtagctgcattccgagcac

SEQ ID NO: 55854 - DNA, 22 bp, Homo sapiens
cctgcaccacaaggcttcagag

SEQ ID NO: 55855 - DNA, 22 bp, Homo sapiens
gcagggaggtttgctgacctgg

SEQ ID NO: 55856 - DNA, 22 bp, Homo sapiens
tcagcctgctccaagtgctgcc

SEQ ID NO: 55857 - DNA, 22 bp, Homo sapiens
ttcatagtgtttccttccagtg

SEQ ID NO: 55858 - DNA, 22 bp, Homo sapiens
ccagagctgcaggtaaaatgct

SEQ ID NO: 55859 - DNA, 20 bp, Homo sapiens
ggcagagggcctgggagaag

SEQ ID NO: 55860 - DNA, 22 bp, Homo sapiens
gaggcaggcagattgcttgagg

SEQ ID NO: 55861 - DNA, 22 bp, Homo sapiens
agctcttacatttaggtctatg

SEQ ID NO: 55862 - DNA, 22 bp, Homo sapiens
gagccaggaggcagagactgca

SEQ ID NO: 55863 - DNA, 22 bp, Homo sapiens
gcccaggctggagtgcagtggt

SEQ ID NO: 55864 - DNA, 18 bp, Homo sapiens
taatccatatgctttgcc

SEQ ID NO: 55865 - DNA, 22 bp, Homo sapiens
tacagtgcttggtatctagtaa

SEQ ID NO: 55866 - DNA, 23 bp, Homo sapiens
caggagatggctgctgtgtcagc

SEQ ID NO: 55867 - DNA, 22 bp, Homo sapiens
tctgcaggtaagcgttcttgga

SEQ ID NO: 55868 - DNA, 21 bp, Homo sapiens
gggcctggctgcgcaggacgg

SEQ ID NO: 55869 - DNA, 22 bp, Homo sapiens
gggagaggttacccgagcaact

SEQ ID NO: 55870 - DNA, 22 bp, Homo sapiens
gggccctgggattcagagcaag

SEQ ID NO: 55871 - DNA, 22 bp, Homo sapiens
tgaagaaacgcagagaggtagg

SEQ ID NO: 55872 - DNA, 22 bp, Homo sapiens
agctggaattacaggagcccat

SEQ ID NO: 55873 - DNA, 22 bp, Homo sapiens
cagcccaggactgcaggtgttt

SEQ ID NO: 55874 - DNA, 22 bp, Homo sapiens
tcatcagggatattggcctgaa

SEQ ID NO: 55875 - DNA, 22 bp, Homo sapiens
gaaatctttgccttagctgtgt

SEQ ID NO: 55876 - DNA, 22 bp, Homo sapiens
gccatgcttggtatgctgtgag

SEQ ID NO: 55877 - DNA, 21 bp, Homo sapiens
cagaggcctatcacagactcc

SEQ ID NO: 55878 - DNA, 22 bp, Homo sapiens
gctactgattgaccttggagag

SEQ ID NO: 55879 - DNA, 22 bp, Homo sapiens
ccagggatgcagaggttgcagt

SEQ ID NO: 55880 - DNA, 22 bp, Homo sapiens
aggctcagatccttgtgtcctg

SEQ ID NO: 55881 - DNA, 22 bp, Homo sapiens
tccagtgcaatggctcattcat

SEQ ID NO: 55882 - DNA, 22 bp, Homo sapiens
cagagactggagtgcagtggcg

SEQ ID NO: 55883 - DNA, 22 bp, Homo sapiens
tcctgagataaatctcatgtga

SEQ ID NO: 55884 - DNA, 22 bp, Homo sapiens
gcagctcaaaggccacggacgg

SEQ ID NO: 55885 - DNA, 23 bp, Homo sapiens
ttctgggctgtggaagcctcggg

SEQ ID NO: 55886 - DNA, 22 bp, Homo sapiens
ctgagcagatgaccagccccag

SEQ ID NO: 55887 - DNA, 22 bp, Homo sapiens
atgaaaacggaccagagctatt

SEQ ID NO: 55888 - DNA, 22 bp, Homo sapiens
gcggctccgaagccaggccgcg

SEQ ID NO: 55889 - DNA, 22 bp, Homo sapiens
gggctgcatcagcaggacccgg

SEQ ID NO: 55890 - DNA, 22 bp, Homo sapiens
gggaggttctgttcgcacttga

SEQ ID NO: 55891 - DNA, 22 bp, Homo sapiens
ttgtgaatagtgccgcaataaa

SEQ ID NO: 55892 - DNA, 22 bp, Homo sapiens
cccactgctgcgccgggcgccg

SEQ ID NO: 55893 - DNA, 22 bp, Homo sapiens
catccaggctggagtacagtgg

SEQ ID NO: 55894 - DNA, 22 bp, Homo sapiens
ggctccctgcaacctccgcctc

SEQ ID NO: 55895 - DNA, 22 bp, Homo sapiens
ctcgggtaccatgctaggcact

SEQ ID NO: 55896 - DNA, 22 bp, Homo sapiens
aatgccttggagagcctagagg

SEQ ID NO: 55897 - DNA, 22 bp, Homo sapiens
tcgggctcgctctcctagcgga

SEQ ID NO: 55898 - DNA, 22 bp, Homo sapiens
cctacagttatattcttgattg

SEQ ID NO: 55899 - DNA, 22 bp, Homo sapiens
cacagctgaagtagccatgtgg

SEQ ID NO: 55900 - DNA, 22 bp, Homo sapiens
cccagttgttgccggctctgga

SEQ ID NO: 55901 - DNA, 22 bp, Homo sapiens
ttctaattaaatctacgctagg

SEQ ID NO: 55902 - DNA, 21 bp, Homo sapiens
tgaaggggtggcagtgtgctt

SEQ ID NO: 55903 - DNA, 22 bp, Homo sapiens
ttgcccaggctggagtgcagta

SEQ ID NO: 55904 - DNA, 22 bp, Homo sapiens
tgctgagcgcatccggcggccg

SEQ ID NO: 55905 - DNA, 20 bp, Homo sapiens
aaattactgccacacatttc

SEQ ID NO: 55906 - DNA, 22 bp, Homo sapiens
tgagcctgggagatggaggctg

SEQ ID NO: 55907 - DNA, 18 bp, Homo sapiens
cagggctgtggggtcact

SEQ ID NO: 55908 - DNA, 22 bp, Homo sapiens
agagggtgggcacgtgatggat

SEQ ID NO: 55909 - DNA, 22 bp, Homo sapiens
gcgagaaactaagtgccctttg

SEQ ID NO: 55910 - DNA, 17 bp, Homo sapiens
tgtatttatcatgtcag

SEQ ID NO: 55911 - DNA, 22 bp, Homo sapiens
ggcatagcggctcagcgtccag

SEQ ID NO: 55912 - DNA, 22 bp, Homo sapiens
gcctgtgtggatgcgccggtgc

SEQ ID NO: 55913 - DNA, 22 bp, Homo sapiens
tacaagatgacaggtgcatgat

SEQ ID NO: 55914 - DNA, 22 bp, Homo sapiens
tcgcttgaacccaggaagtgga

SEQ ID NO: 55915 - DNA, 22 bp, Homo sapiens
gtggattacaagacagttgaga

SEQ ID NO: 55916 - DNA, 22 bp, Homo sapiens
agcactgtgagcaccagcacgc

SEQ ID NO: 55917 - DNA, 22 bp, Homo sapiens
cagagcttcctgctgggcttct

SEQ ID NO: 55918 - DNA, 20 bp, Homo sapiens
caaatccctgctctgtgctg

SEQ ID NO: 55919 - DNA, 22 bp, Homo sapiens
caaagtgctaggattacaggcc

SEQ ID NO: 55920 - DNA, 22 bp, Homo sapiens
tacgcctgtaatcccagcactt

SEQ ID NO: 55921 - DNA, 22 bp, Homo sapiens
agcccaggctggagtgcagtgg

SEQ ID NO: 55922 - DNA, 22 bp, Homo sapiens
accagcctggccaacatggtga

SEQ ID NO: 55923 - DNA, 22 bp, Homo sapiens
ttgaaaagttttgaaacactct

SEQ ID NO: 55924 - DNA, 22 bp, Homo sapiens
tggccttggccgtgctggggtc

SEQ ID NO: 55925 - DNA, 23 bp, Homo sapiens
agcaatctgtgtttcagcaagcc

SEQ ID NO: 55926 - DNA, 22 bp, Homo sapiens
aggccctattcaatggggccca

SEQ ID NO: 55927 - DNA, 22 bp, Homo sapiens
tcctgccttgcctgggacatca

SEQ ID NO: 55928 - DNA, 22 bp, Homo sapiens
gagtggggggtccgtctcagtg

SEQ ID NO: 55929 - DNA, 20 bp, Homo sapiens
cagagattttacttcctcac

SEQ ID NO: 55930 - DNA, 22 bp, Homo sapiens
ctgtatctgtgttggatgagtt

SEQ ID NO: 55931 - DNA, 22 bp, Homo sapiens
ctcacctccaggagctgctggc

SEQ ID NO: 55932 - DNA, 22 bp, Homo sapiens
aggcaggaggatcatggatgca

SEQ ID NO: 55933 - DNA, 22 bp, Homo sapiens
tgtacacatggtgtacactccc

SEQ ID NO: 55934 - DNA, 22 bp, Homo sapiens
tgcaggctcttggtgacgtggg

SEQ ID NO: 55935 - DNA, 22 bp, Homo sapiens
cggccgcagcagtgtcggccca

SEQ ID NO: 55936 - DNA, 22 bp, Homo sapiens
aatctcagctcatgcaattcca

SEQ ID NO: 55937 - DNA, 22 bp, Homo sapiens
tctaatccttgctacctgggtg

SEQ ID NO: 55938 - DNA, 22 bp, Homo sapiens
tttattctgtgctacatgaaga

SEQ ID NO: 55939 - DNA, 21 bp, Homo sapiens
gctgctcgagatccagtgctt

SEQ ID NO: 55940 - DNA, 22 bp, Homo sapiens
tgcctcaagccctccactgcac

SEQ ID NO: 55941 - DNA, 22 bp, Homo sapiens
taggtttaggagtgaaggtgaa

SEQ ID NO: 55942 - DNA, 22 bp, Homo sapiens
tccggactcacctgacaatggc

SEQ ID NO: 55943 - DNA, 21 bp, Homo sapiens
ctggaggcaggtggtgccagg

SEQ ID NO: 55944 - DNA, 22 bp, Homo sapiens
ttggaacatgccggggtccagg

SEQ ID NO: 55945 - DNA, 22 bp, Homo sapiens
gatcgggtgggttctgccatca

SEQ ID NO: 55946 - DNA, 22 bp, Homo sapiens
tctgccttttactagctggatg

SEQ ID NO: 55947 - DNA, 22 bp, Homo sapiens
gagtgtatggaaggaagagatt

SEQ ID NO: 55948 - DNA, 22 bp, Homo sapiens
ggctcactgcaacttccgcctc

SEQ ID NO: 55949 - DNA, 22 bp, Homo sapiens
cccagacccagagggaggcagg

SEQ ID NO: 55950 - DNA, 22 bp, Homo sapiens
gcaagacatgtctaaggtttaa

SEQ ID NO: 55951 - DNA, 22 bp, Homo sapiens
gaccactggggtgagggccatc

SEQ ID NO: 55952 - DNA, 22 bp, Homo sapiens
ttcctggaaattatgctcacct

SEQ ID NO: 55953 - DNA, 22 bp, Homo sapiens
tgtggttttggttcagaaacaa

SEQ ID NO: 55954 - DNA, 22 bp, Homo sapiens
ccggctactcgggaggctgacg

SEQ ID NO: 55955 - DNA, 23 bp, Homo sapiens
ggctgggagctccgggtgcacgt

SEQ ID NO: 55956 - DNA, 22 bp, Homo sapiens
acaggtgcatgctaccatgtct

SEQ ID NO: 55957 - DNA, 18 bp, Homo sapiens
gctctgcaggtgctcggt

SEQ ID NO: 55958 - DNA, 19 bp, Homo sapiens
gatgctcattcaggtggaa

SEQ ID NO: 55959 - DNA, 22 bp, Homo sapiens
tggcccttgttcaaatatgtca

SEQ ID NO: 55960 - DNA, 22 bp, Homo sapiens
aaagccttcttgtatcgagcca

SEQ ID NO: 55961 - DNA, 22 bp, Homo sapiens
atgattgaaaatgacattgcca

SEQ ID NO: 55962 - DNA, 22 bp, Homo sapiens
cagaggaacgtttggattgatt

SEQ ID NO: 55963 - DNA, 22 bp, Homo sapiens
gctcccagtctgatggaggaga

SEQ ID NO: 55964 - DNA, 22 bp, Homo sapiens
aagtgatgctacgactttgaca

SEQ ID NO: 55965 - DNA, 22 bp, Homo sapiens
ccaggagttggaggctgcagtg

SEQ ID NO: 55966 - DNA, 22 bp, Homo sapiens
agctgaaacttcccattaattg

SEQ ID NO: 55967 - DNA, 22 bp, Homo sapiens
tttgtggcaggagcggagaccg

SEQ ID NO: 55968 - DNA, 22 bp, Homo sapiens
actgttttctgtaaagggccag

SEQ ID NO: 55969 - DNA, 22 bp, Homo sapiens
caggctgatcagggctgggatg

SEQ ID NO: 55970 - DNA, 22 bp, Homo sapiens
agagaagagtcttgtcaaatta

SEQ ID NO: 55971 - DNA, 22 bp, Homo sapiens
tacagctgcaagggtttctggg

SEQ ID NO: 55972 - DNA, 22 bp, Homo sapiens
gggctgtgaggtgagaacttac

SEQ ID NO: 55973 - DNA, 22 bp, Homo sapiens
tgttttaagctctagaagggga

SEQ ID NO: 55974 - DNA, 22 bp, Homo sapiens
gctggccacagatccccaggga

SEQ ID NO: 55975 - DNA, 22 bp, Homo sapiens
cacgggagacgtgatcttggac

SEQ ID NO: 55976 - DNA, 22 bp, Homo sapiens
accagtaggagttggagaggaa

SEQ ID NO: 55977 - DNA, 22 bp, Homo sapiens
aggtgacaggacaggagctggt

SEQ ID NO: 55978 - DNA, 22 bp, Homo sapiens
atgccactgcgctctagcctgg

SEQ ID NO: 55979 - DNA, 22 bp, Homo sapiens
agagaggtctcaggagaaacca

SEQ ID NO: 55980 - DNA, 22 bp, Homo sapiens
ccgggcctcgggacaccgggta

SEQ ID NO: 55981 - DNA, 23 bp, Homo sapiens
attttttgtctttgtaactagat

SEQ ID NO: 55982 - DNA, 22 bp, Homo sapiens
cttagatgaagtcacagaaccc

SEQ ID NO: 55983 - DNA, 22 bp, Homo sapiens
gtggctgcagcggctgtggaga

SEQ ID NO: 55984 - DNA, 20 bp, Homo sapiens
tgttgattggtgtcatctca

SEQ ID NO: 55985 - DNA, 22 bp, Homo sapiens
ataatggtagatgtccacgcag

SEQ ID NO: 55986 - DNA, 16 bp, Homo sapiens
gcaggcagatcacatg

SEQ ID NO: 55987 - DNA, 22 bp, Homo sapiens
aaggcaaaagaggtgtcatcac

SEQ ID NO: 55988 - DNA, 18 bp, Homo sapiens
tctgccccagccgcactg

SEQ ID NO: 55989 - DNA, 22 bp, Homo sapiens
ctcaggagttggaggctacagt

SEQ ID NO: 55990 - DNA, 22 bp, Homo sapiens
gaaaattattgaaaatggctct

SEQ ID NO: 55991 - DNA, 22 bp, Homo sapiens
ctggaatctttggagaatgtgg

SEQ ID NO: 55992 - DNA, 22 bp, Homo sapiens
tgggcgacagagcaagactccg

SEQ ID NO: 55993 - DNA, 22 bp, Homo sapiens
aagtggcagttcaggaagcaga

SEQ ID NO: 55994 - DNA, 22 bp, Homo sapiens
tctgccttctatcttttgtctg

SEQ ID NO: 55995 - DNA, 22 bp, Homo sapiens
aggtgcatctcgtagctcttct

SEQ ID NO: 55996 - DNA, 22 bp, Homo sapiens
ggaggtggaggttgcagtgagc

SEQ ID NO: 55997 - DNA, 22 bp, Homo sapiens
atccatttgacataatttcagc

SEQ ID NO: 55998 - DNA, 22 bp, Homo sapiens
tacaggcatgtagcatggtgat

SEQ ID NO: 55999 - DNA, 22 bp, Homo sapiens
taggctgggggtaggaattgag

SEQ ID NO: 56000 - DNA, 22 bp, Homo sapiens
aagtgctgagactacaggcatg

SEQ ID NO: 56001 - DNA, 22 bp, Homo sapiens
agtaatcaatttttcggtggat

SEQ ID NO: 56002 - DNA, 22 bp, Homo sapiens
gttttgaatactactagaactt

SEQ ID NO: 56003 - DNA, 22 bp, Homo sapiens
aggcgaagggaccagacggtag

SEQ ID NO: 56004 - DNA, 22 bp, Homo sapiens
cactgcactccagcctgggtga

SEQ ID NO: 56005 - DNA, 22 bp, Homo sapiens
ctgagctcaagcgatcctccca

SEQ ID NO: 56006 - DNA, 22 bp, Homo sapiens
accctaataatcacagactagt

SEQ ID NO: 56007 - DNA, 22 bp, Homo sapiens
tcagtctttccctccctcagtt

SEQ ID NO: 56008 - DNA, 22 bp, Homo sapiens
cccaggaggcagaagttgcagt

SEQ ID NO: 56009 - DNA, 22 bp, Homo sapiens
gaatttcctctaaacccctgag

SEQ ID NO: 56010 - DNA, 22 bp, Homo sapiens
tggcacaggatctcagcggcca

SEQ ID NO: 56011 - DNA, 22 bp, Homo sapiens
aaaagcaattgcgggttttgcc

SEQ ID NO: 56012 - DNA, 22 bp, Homo sapiens
tctgcaccatcgtatgcttaat

SEQ ID NO: 56013 - DNA, 22 bp, Homo sapiens
ggtcttttctgctgcaggttgt

SEQ ID NO: 56014 - DNA, 22 bp, Homo sapiens
actgggcctgattgggtcggag

SEQ ID NO: 56015 - DNA, 22 bp, Homo sapiens
aactctatttaccctactaaac

SEQ ID NO: 56016 - DNA, 22 bp, Homo sapiens
ctgctcctgtccagcagggcca

SEQ ID NO: 56017 - DNA, 19 bp, Homo sapiens
tttgatagggcataatata

SEQ ID NO: 56018 - DNA, 22 bp, Homo sapiens
ttggatgggcattaggaaagtc

SEQ ID NO: 56019 - DNA, 22 bp, Homo sapiens
gcagcctcaaactccccagctc

SEQ ID NO: 56020 - DNA, 22 bp, Homo sapiens
gctctctgcagcctccttggag

SEQ ID NO: 56021 - DNA, 19 bp, Homo sapiens
gggcttggggctgaagcct

SEQ ID NO: 56022 - DNA, 22 bp, Homo sapiens
acccaggctggagtgcagtgat

SEQ ID NO: 56023 - DNA, 22 bp, Homo sapiens
gcctgatgagcttccagctgag

SEQ ID NO: 56024 - DNA, 22 bp, Homo sapiens
ttcctggcttgtcacatctacg

SEQ ID NO: 56025 - DNA, 22 bp, Homo sapiens
ctgggaggcggaggttgtagtg

SEQ ID NO: 56026 - DNA, 22 bp, Homo sapiens
aggaggggttctcgggtgctga

SEQ ID NO: 56027 - DNA, 22 bp, Homo sapiens
gaccttcttgctgtgtcctaac

SEQ ID NO: 56028 - DNA, 22 bp, Homo sapiens
cctgggcctctcaaagtgctgg

SEQ ID NO: 56029 - DNA, 22 bp, Homo sapiens
agagggatcaccctgtttctgg

SEQ ID NO: 56030 - DNA, 17 bp, Homo sapiens
tggctctgtcctcagct

SEQ ID NO: 56031 - DNA, 22 bp, Homo sapiens
cggctcactgcagctccgcctc

SEQ ID NO: 56032 - DNA, 22 bp, Homo sapiens
attggccatttgcatgtattat

SEQ ID NO: 56033 - DNA, 22 bp, Homo sapiens
tgagatgtaaggtatgcttact

SEQ ID NO: 56034 - DNA, 22 bp, Homo sapiens
tagatacctgctggacctcatt

SEQ ID NO: 56035 - DNA, 22 bp, Homo sapiens
aggtcaccatggcatgctccac

SEQ ID NO: 56036 - DNA, 22 bp, Homo sapiens
ttgtgctcctatgagaatctaa

SEQ ID NO: 56037 - DNA, 22 bp, Homo sapiens
ggctctgcgcctgcggggactt

SEQ ID NO: 56038 - DNA, 22 bp, Homo sapiens
gtgaattacatgtatttttaag

SEQ ID NO: 56039 - DNA, 22 bp, Homo sapiens
ccgaggctggagtgcagtggcg

SEQ ID NO: 56040 - DNA, 22 bp, Homo sapiens
aggctcccaagcactgacccca

SEQ ID NO: 56041 - DNA, 18 bp, Homo sapiens
cagcctctgattggttgc

SEQ ID NO: 56042 - DNA, 22 bp, Homo sapiens
tcagggattgcaaaattcatcc

SEQ ID NO: 56043 - DNA, 22 bp, Homo sapiens
ttgagatggagtctcactctgt

SEQ ID NO: 56044 - DNA, 22 bp, Homo sapiens
agtgctatcgagttctaatgct

SEQ ID NO: 56045 - DNA, 22 bp, Homo sapiens
ggcatggacgtctctgaggcca

SEQ ID NO: 56046 - DNA, 22 bp, Homo sapiens
gctgatagactgaatgttggga

SEQ ID NO: 56047 - DNA, 20 bp, Homo sapiens
gggcaaggaaacagccccca

SEQ ID NO: 56048 - DNA, 22 bp, Homo sapiens
aaggtgggtggatcacgaggtc

SEQ ID NO: 56049 - DNA, 22 bp, Homo sapiens
gagtgctttgtcttgtaattct

SEQ ID NO: 56050 - DNA, 22 bp, Homo sapiens
gcaccgccttggaccgcccgct

SEQ ID NO: 56051 - DNA, 22 bp, Homo sapiens
gactttggttcagggctcagag

SEQ ID NO: 56052 - DNA, 22 bp, Homo sapiens
atgccacttcattccagcctcg

SEQ ID NO: 56053 - DNA, 22 bp, Homo sapiens
agaagtatcaggaagattctca

SEQ ID NO: 56054 - DNA, 22 bp, Homo sapiens
cccagttttctgattgaagagc

SEQ ID NO: 56055 - DNA, 22 bp, Homo sapiens
tcatggcttttattatgttgag

SEQ ID NO: 56056 - DNA, 22 bp, Homo sapiens
ctacaaaagtaattgtggtttt

SEQ ID NO: 56057 - DNA, 22 bp, Homo sapiens
tctcagggctcagagctcaggc

SEQ ID NO: 56058 - DNA, 23 bp, Homo sapiens
tagatgtattaagtgcattttca

SEQ ID NO: 56059 - DNA, 22 bp, Homo sapiens
ttgctcttgaaaattgatgctg

SEQ ID NO: 56060 - DNA, 22 bp, Homo sapiens
ccgggctggagtgcaatggctc

SEQ ID NO: 56061 - DNA, 22 bp, Homo sapiens
aaggagaggttgtccgtgttgt

SEQ ID NO: 56062 - DNA, 22 bp, Homo sapiens
taattataacagttacatctta

SEQ ID NO: 56063 - DNA, 22 bp, Homo sapiens
cacagcgtgatgaatgtagcgt

SEQ ID NO: 56064 - DNA, 22 bp, Homo sapiens
tcccgcatgccgccggtgaaca

SEQ ID NO: 56065 - DNA, 22 bp, Homo sapiens
gaagagctgacagtgtcatcct

SEQ ID NO: 56066 - DNA, 22 bp, Homo sapiens
gtggcccaggttggagtgcagt

SEQ ID NO: 56067 - DNA, 22 bp, Homo sapiens
ccgggagcaggcgccaccgcca

SEQ ID NO: 56068 - DNA, 22 bp, Homo sapiens
agtcttagaactacagtgccta

SEQ ID NO: 56069 - DNA, 22 bp, Homo sapiens
tgtttcttacgtttttagaggc

SEQ ID NO: 56070 - DNA, 22 bp, Homo sapiens
gatagtcacctcccttaacttt

SEQ ID NO: 56071 - DNA, 22 bp, Homo sapiens
gcctccagcccacgcaggcctg

SEQ ID NO: 56072 - DNA, 22 bp, Homo sapiens
tgtatattctgcctaaaagctt

SEQ ID NO: 56073 - DNA, 22 bp, Homo sapiens
agcctggcctgggcaggcacat

SEQ ID NO: 56074 - DNA, 21 bp, Homo sapiens
tggcggggacttgtggctgcc

SEQ ID NO: 56075 - DNA, 22 bp, Homo sapiens
cccaggaggcagatgttgcagt

SEQ ID NO: 56076 - DNA, 22 bp, Homo sapiens
ggcagccccatcagagacgctg

SEQ ID NO: 56077 - DNA, 22 bp, Homo sapiens
aggtggcagatgggggtgctcg

SEQ ID NO: 56078 - DNA, 22 bp, Homo sapiens
tgccaggcgtggtggtgcgcac

SEQ ID NO: 56079 - DNA, 22 bp, Homo sapiens
tcaccgaggctggagtgcagtg

SEQ ID NO: 56080 - DNA, 22 bp, Homo sapiens
aagcatttcaggtagagatatt

SEQ ID NO: 56081 - DNA, 22 bp, Homo sapiens
ccacagaattctgtctccagga

SEQ ID NO: 56082 - DNA, 22 bp, Homo sapiens
tctctttgcctgctgccatcca

SEQ ID NO: 56083 - DNA, 22 bp, Homo sapiens
tgctcatcaacatgatgatcat

SEQ ID NO: 56084 - DNA, 22 bp, Homo sapiens
aacagtgctgttataaatgtac

SEQ ID NO: 56085 - DNA, 21 bp, Homo sapiens
ccaccaggtcttctgctcggg

SEQ ID NO: 56086 - DNA, 22 bp, Homo sapiens
cgcggtggcggcctccagcgcc

SEQ ID NO: 56087 - DNA, 22 bp, Homo sapiens
tgcctgcctaggaagctgtgaa

SEQ ID NO: 56088 - DNA, 22 bp, Homo sapiens
ttcaaatgatggcagtcctggc

SEQ ID NO: 56089 - DNA, 22 bp, Homo sapiens
tttaaaaaactagtctgagtct

SEQ ID NO: 56090 - DNA, 19 bp, Homo sapiens
taggaccctggtggccccc

SEQ ID NO: 56091 - DNA, 22 bp, Homo sapiens
tggggcagttaataaacattct

SEQ ID NO: 56092 - DNA, 18 bp, Homo sapiens
taggagagaatttattta

SEQ ID NO: 56093 - DNA, 22 bp, Homo sapiens
ggcccagacccaagagtggtgg

SEQ ID NO: 56094 - DNA, 22 bp, Homo sapiens
caggaagaccagggctgtggct

SEQ ID NO: 56095 - DNA, 22 bp, Homo sapiens
gaaggaagtcattagtgcagac

SEQ ID NO: 56096 - DNA, 22 bp, Homo sapiens
tgagtgactccactggggcaga

SEQ ID NO: 56097 - DNA, 22 bp, Homo sapiens
ccgccaggatattgtggctttt

SEQ ID NO: 56098 - DNA, 22 bp, Homo sapiens
actttcttggtcccatgtttga

SEQ ID NO: 56099 - DNA, 22 bp, Homo sapiens
tctaattttggcattttaacct

SEQ ID NO: 56100 - DNA, 22 bp, Homo sapiens
tttaagaagttatgttataaat

SEQ ID NO: 56101 - DNA, 22 bp, Homo sapiens
ttgtgctcctgtgagaatctag

SEQ ID NO: 56102 - DNA, 22 bp, Homo sapiens
agccccaaacaccaggattact

SEQ ID NO: 56103 - DNA, 22 bp, Homo sapiens
ccagttccagtgctcacatcca

SEQ ID NO: 56104 - DNA, 22 bp, Homo sapiens
acgcccagactcccatactttg

SEQ ID NO: 56105 - DNA, 22 bp, Homo sapiens
gaggcagaagttgcagtgagca

SEQ ID NO: 56106 - DNA, 22 bp, Homo sapiens
ctctgcaagtccagcccctggc

SEQ ID NO: 56107 - DNA, 22 bp, Homo sapiens
aggagctgtcagagtgccagag

SEQ ID NO: 56108 - DNA, 22 bp, Homo sapiens
ccaggctagagtgcaatggcat

SEQ ID NO: 56109 - DNA, 22 bp, Homo sapiens
ccaggctggagtatagtggcgc

SEQ ID NO: 56110 - DNA, 22 bp, Homo sapiens
ggtgggagccaacacccttctg

SEQ ID NO: 56111 - DNA, 22 bp, Homo sapiens
cattggccttttatcctagagg

SEQ ID NO: 56112 - DNA, 22 bp, Homo sapiens
aggatgagccgcgcaagctgac

SEQ ID NO: 56113 - DNA, 22 bp, Homo sapiens
tgcccagggtggagtgcagtgg

SEQ ID NO: 56114 - DNA, 22 bp, Homo sapiens
atgctatgtaactggcagatag

SEQ ID NO: 56115 - DNA, 22 bp, Homo sapiens
tctgagctgggtcttgacagct

SEQ ID NO: 56116 - DNA, 18 bp, Homo sapiens
tccaccgcgtgcacctct

SEQ ID NO: 56117 - DNA, 22 bp, Homo sapiens
tgcctgttgcccacctgataaa

SEQ ID NO: 56118 - DNA, 22 bp, Homo sapiens
ctcctgcttcacgggcaccgcc

SEQ ID NO: 56119 - DNA, 20 bp, Homo sapiens
aagacaccagtggcagcccc

SEQ ID NO: 56120 - DNA, 22 bp, Homo sapiens
cttcccaccaaagcccttgttg

SEQ ID NO: 56121 - DNA, 22 bp, Homo sapiens
agtgaggggcagctgagtgggc

SEQ ID NO: 56122 - DNA, 22 bp, Homo sapiens
ttgtgctctgtgttatttaagg

SEQ ID NO: 56123 - DNA, 17 bp, Homo sapiens
cgggcatggagggcagg

SEQ ID NO: 56124 - DNA, 22 bp, Homo sapiens
atattgttagtaatatttcgaa

SEQ ID NO: 56125 - DNA, 22 bp, Homo sapiens
ctggcctaaaaatacagaacaa

SEQ ID NO: 56126 - DNA, 22 bp, Homo sapiens
cccaggccccagggcttgtcag

SEQ ID NO: 56127 - DNA, 22 bp, Homo sapiens
cgagcatgatgacggctgtggc

SEQ ID NO: 56128 - DNA, 22 bp, Homo sapiens
caactgggataaagagctaaag

SEQ ID NO: 56129 - DNA, 22 bp, Homo sapiens
tgcaatctcggcactttgggag

SEQ ID NO: 56130 - DNA, 22 bp, Homo sapiens
aggtcaagggagctgagggcca

SEQ ID NO: 56131 - DNA, 22 bp, Homo sapiens
gtgcaaccatcaccactgactc

SEQ ID NO: 56132 - DNA, 22 bp, Homo sapiens
agaggggcccggttctccgtct

SEQ ID NO: 56133 - DNA, 21 bp, Homo sapiens
ttagaagctaatgcagctggt

SEQ ID NO: 56134 - DNA, 20 bp, Homo sapiens
attagagctacatggctaca

SEQ ID NO: 56135 - DNA, 22 bp, Homo sapiens
gcaaatgctaaagtgtagagac

SEQ ID NO: 56136 - DNA, 22 bp, Homo sapiens
tggcctcggcatccagcaagag

SEQ ID NO: 56137 - DNA, 23 bp, Homo sapiens
tgaatgtttattctcggtgcaga

SEQ ID NO: 56138 - DNA, 22 bp, Homo sapiens
gggccggagctgggtcccgcgc

SEQ ID NO: 56139 - DNA, 22 bp, Homo sapiens
tctctggttatgtcattaagca

SEQ ID NO: 56140 - DNA, 22 bp, Homo sapiens
acctcctggcctcaagcaatcc

SEQ ID NO: 56141 - DNA, 22 bp, Homo sapiens
aggaaataagggacaagacaaa

SEQ ID NO: 56142 - DNA, 22 bp, Homo sapiens
tcaaaattaaaccaacgtccag

SEQ ID NO: 56143 - DNA, 17 bp, Homo sapiens
cactagtagtctctggc

SEQ ID NO: 56144 - DNA, 22 bp, Homo sapiens
gaagtattactctgaatgtatt

SEQ ID NO: 56145 - DNA, 23 bp, Homo sapiens
cagagctggctcagagctgcctg

SEQ ID NO: 56146 - DNA, 18 bp, Homo sapiens
cttgttcttctcttggcg

SEQ ID NO: 56147 - DNA, 22 bp, Homo sapiens
tttaatcataagaaggaaaata

SEQ ID NO: 56148 - DNA, 22 bp, Homo sapiens
gctgtcttgctcactcttgcag

SEQ ID NO: 56149 - DNA, 22 bp, Homo sapiens
ttatttaaaagtggtaagattc

SEQ ID NO: 56150 - DNA, 22 bp, Homo sapiens
gcttttgcctacatcttggtct

SEQ ID NO: 56151 - DNA, 22 bp, Homo sapiens
atattgaaccctacagactgta

SEQ ID NO: 56152 - DNA, 22 bp, Homo sapiens
catctttgcccatccacttcca

SEQ ID NO: 56153 - DNA, 22 bp, Homo sapiens
taatatctacttcatagagttt

SEQ ID NO: 56154 - DNA, 22 bp, Homo sapiens
cagtgacgtaaactgcatgtgc

SEQ ID NO: 56155 - DNA, 22 bp, Homo sapiens
aggccagcagcatgacggcatc

SEQ ID NO: 56156 - DNA, 22 bp, Homo sapiens
cggggttcatccatgctgtggc

SEQ ID NO: 56157 - DNA, 22 bp, Homo sapiens
cccattcatcctcgcttccttc

SEQ ID NO: 56158 - DNA, 22 bp, Homo sapiens
ttgtgaatggtgccgcaataaa

SEQ ID NO: 56159 - DNA, 22 bp, Homo sapiens
aagaggcgccgggtacgtggcg

SEQ ID NO: 56160 - DNA, 22 bp, Homo sapiens
cacagtggtccccgaagcccct

SEQ ID NO: 56161 - DNA, 22 bp, Homo sapiens
aagaaatgctgatgttggatgg

SEQ ID NO: 56162 - DNA, 22 bp, Homo sapiens
aaggtccttttgcagtgtgatc

SEQ ID NO: 56163 - DNA, 22 bp, Homo sapiens
actgttgaagtgccagcttgat

SEQ ID NO: 56164 - DNA, 22 bp, Homo sapiens
cctgagtagctggaattaaagg

SEQ ID NO: 56165 - DNA, 22 bp, Homo sapiens
tcctcagcttttatttcacttg

SEQ ID NO: 56166 - DNA, 23 bp, Homo sapiens
aagttagtttcaataaagcaatt

SEQ ID NO: 56167 - DNA, 22 bp, Homo sapiens
aggcaggaaaatcgcttgaacc

SEQ ID NO: 56168 - DNA, 22 bp, Homo sapiens
gggaacagcttgggctctgcca

SEQ ID NO: 56169 - DNA, 22 bp, Homo sapiens
ggagaagaggagctggaagcct

SEQ ID NO: 56170 - DNA, 22 bp, Homo sapiens
cctggctgacagcttaattcca

SEQ ID NO: 56171 - DNA, 22 bp, Homo sapiens
gcctcagtctcccgagtagctg

SEQ ID NO: 56172 - DNA, 22 bp, Homo sapiens
ggcgcacaatgtgcaggtttgt

SEQ ID NO: 56173 - DNA, 22 bp, Homo sapiens
tgatttatgcattatactgttg

SEQ ID NO: 56174 - DNA, 22 bp, Homo sapiens
catttacatttaaggttaatat

SEQ ID NO: 56175 - DNA, 22 bp, Homo sapiens
ctctctgggcccagttggcacc

SEQ ID NO: 56176 - DNA, 22 bp, Homo sapiens
gagagaagggggatatgagcct

SEQ ID NO: 56177 - DNA, 22 bp, Homo sapiens
tggttcagttgcacaggctgtt

SEQ ID NO: 56178 - DNA, 22 bp, Homo sapiens
cagcagcagtggctgcagaaca

SEQ ID NO: 56179 - DNA, 22 bp, Homo sapiens
tgctttgtgacagattagtttt

SEQ ID NO: 56180 - DNA, 22 bp, Homo sapiens
attgcactccagcctgggtgac

SEQ ID NO: 56181 - DNA, 22 bp, Homo sapiens
gtgggttcgtggtctcgctggc

SEQ ID NO: 56182 - DNA, 22 bp, Homo sapiens
gtagaccatttatctggggagt

SEQ ID NO: 56183 - DNA, 22 bp, Homo sapiens
acccggagtcggaggttgcagt

SEQ ID NO: 56184 - DNA, 22 bp, Homo sapiens
atataatttttggttagctcaa

SEQ ID NO: 56185 - DNA, 22 bp, Homo sapiens
gggagaagaatgtgtcaattgt

SEQ ID NO: 56186 - DNA, 22 bp, Homo sapiens
gtgcagagaggaccttggggag

SEQ ID NO: 56187 - DNA, 22 bp, Homo sapiens
ctgaagaggctccgcccacaag

SEQ ID NO: 56188 - DNA, 22 bp, Homo sapiens
tcacatctaattccatttctgc

SEQ ID NO: 56189 - DNA, 22 bp, Homo sapiens
gctccaaagtacagtgacttac

SEQ ID NO: 56190 - DNA, 17 bp, Homo sapiens
tgcatgtcctttgttcc

SEQ ID NO: 56191 - DNA, 22 bp, Homo sapiens
gcccagtagttcaaggttgcag

SEQ ID NO: 56192 - DNA, 22 bp, Homo sapiens
ttataagctctgaaatctccta

SEQ ID NO: 56193 - DNA, 22 bp, Homo sapiens
ctccccagccctggtattctga

SEQ ID NO: 56194 - DNA, 22 bp, Homo sapiens
cacagagctggaaaggctgggc

SEQ ID NO: 56195 - DNA, 20 bp, Homo sapiens
aaactaaaggtgtttggttt

SEQ ID NO: 56196 - DNA, 22 bp, Homo sapiens
gccagatttacagatttgccct

SEQ ID NO: 56197 - DNA, 22 bp, Homo sapiens
gcacatccaatgattgttttga

SEQ ID NO: 56198 - DNA, 22 bp, Homo sapiens
gcctccggagttgcagtgtctt

SEQ ID NO: 56199 - DNA, 22 bp, Homo sapiens
tgagaaattacttcagtgatgg

SEQ ID NO: 56200 - DNA, 22 bp, Homo sapiens
attctacatgatagaagggaga

SEQ ID NO: 56201 - DNA, 22 bp, Homo sapiens
taggtttactgaattagtggaa

SEQ ID NO: 56202 - DNA, 22 bp, Homo sapiens
tccctgatgccttgatccgtgg

SEQ ID NO: 56203 - DNA, 22 bp, Homo sapiens
gagagtctagtgcacctagttt

SEQ ID NO: 56204 - DNA, 22 bp, Homo sapiens
ctggtctggctacccagcgaat

SEQ ID NO: 56205 - DNA, 22 bp, Homo sapiens
ctttggaacacccagctctgtg

SEQ ID NO: 56206 - DNA, 22 bp, Homo sapiens
tctgagacaggaagtggagggt

SEQ ID NO: 56207 - DNA, 22 bp, Homo sapiens
ctccttctgggcctggcagtgg

SEQ ID NO: 56208 - DNA, 22 bp, Homo sapiens
atgaattgaggaaaacagtcgt

SEQ ID NO: 56209 - DNA, 22 bp, Homo sapiens
ctgatgaggatatagatacaca

SEQ ID NO: 56210 - DNA, 22 bp, Homo sapiens
aagccaggttccatggaggagc

SEQ ID NO: 56211 - DNA, 22 bp, Homo sapiens
gaaaaggcagagttccggggaa

SEQ ID NO: 56212 - DNA, 22 bp, Homo sapiens
ggaactgaatgtctcggtataa

SEQ ID NO: 56213 - DNA, 22 bp, Homo sapiens
gcagtatctatgtgatgggttg

SEQ ID NO: 56214 - DNA, 22 bp, Homo sapiens
ccacgacgagtcatcagggcga

SEQ ID NO: 56215 - DNA, 22 bp, Homo sapiens
ctcccagccttcgccagtctga

SEQ ID NO: 56216 - DNA, 22 bp, Homo sapiens
aggaaaatggaccagagttgtt

SEQ ID NO: 56217 - DNA, 22 bp, Homo sapiens
aggagcagaccgtagtcctgca

SEQ ID NO: 56218 - DNA, 22 bp, Homo sapiens
caggagtgtctccacacagcaa

SEQ ID NO: 56219 - DNA, 22 bp, Homo sapiens
tcgtgatctgtccacctcggcc

SEQ ID NO: 56220 - DNA, 22 bp, Homo sapiens
ctctgcaacttctagcagtgtc

SEQ ID NO: 56221 - DNA, 22 bp, Homo sapiens
atttttctctttccactgagat

SEQ ID NO: 56222 - DNA, 22 bp, Homo sapiens
ctggaaggcggaggttgtagtg

SEQ ID NO: 56223 - DNA, 22 bp, Homo sapiens
ccaagcaaataatcacccacta

SEQ ID NO: 56224 - DNA, 22 bp, Homo sapiens
gcgggttgaagggcgcatcgaa

SEQ ID NO: 56225 - DNA, 22 bp, Homo sapiens
ttcagcttgctgactgcggcag

SEQ ID NO: 56226 - DNA, 22 bp, Homo sapiens
tagctgggactactggccctgc

SEQ ID NO: 56227 - DNA, 22 bp, Homo sapiens
tgctagtgtgtgagatgttcaa

SEQ ID NO: 56228 - DNA, 22 bp, Homo sapiens
cctcagacccctgctgagcttc

SEQ ID NO: 56229 - DNA, 22 bp, Homo sapiens
aagctgttgttcatcctgaatt

SEQ ID NO: 56230 - DNA, 22 bp, Homo sapiens
ggagtgaatcactagatgcaga

SEQ ID NO: 56231 - DNA, 22 bp, Homo sapiens
gtgaaatatttaacgtccaggt

SEQ ID NO: 56232 - DNA, 22 bp, Homo sapiens
agctggaagtgcatttctcact

SEQ ID NO: 56233 - DNA, 22 bp, Homo sapiens
caggctggagtgcagtggtgcc

SEQ ID NO: 56234 - DNA, 22 bp, Homo sapiens
ttctcatgaaactcgcttcctc

SEQ ID NO: 56235 - DNA, 22 bp, Homo sapiens
aggaattcaagaccagctgggc

SEQ ID NO: 56236 - DNA, 22 bp, Homo sapiens
gcctggattccttgtttctcag

SEQ ID NO: 56237 - DNA, 22 bp, Homo sapiens
acagttaataagtagtaagtca

SEQ ID NO: 56238 - DNA, 22 bp, Homo sapiens
catgtgtgtctccaccagctgc

SEQ ID NO: 56239 - DNA, 18 bp, Homo sapiens
agaggatgcatctaagag

SEQ ID NO: 56240 - DNA, 22 bp, Homo sapiens
ctgaacttattgagtgcttgct

SEQ ID NO: 56241 - DNA, 22 bp, Homo sapiens
ctcctgggaaaggctggacaca

SEQ ID NO: 56242 - DNA, 18 bp, Homo sapiens
gatatggaaggccatgcc

SEQ ID NO: 56243 - DNA, 22 bp, Homo sapiens
ggctcaggcctgtaatcctagc

SEQ ID NO: 56244 - DNA, 22 bp, Homo sapiens
ggctgcaggttggttggcagct

SEQ ID NO: 56245 - DNA, 19 bp, Homo sapiens
acccagcccaggagtggca

SEQ ID NO: 56246 - DNA, 22 bp, Homo sapiens
gctgcagtgagccaagatcgtg

SEQ ID NO: 56247 - DNA, 22 bp, Homo sapiens
agaaagtgcttccctttggact

SEQ ID NO: 56248 - DNA, 19 bp, Homo sapiens
ttcacattggaagaagtag

SEQ ID NO: 56249 - DNA, 22 bp, Homo sapiens
ttctgggcacacaggccctggt

SEQ ID NO: 56250 - DNA, 22 bp, Homo sapiens
tcatctaagagtcttacattta

SEQ ID NO: 56251 - DNA, 22 bp, Homo sapiens
aaagaaggtagggctggtgact

SEQ ID NO: 56252 - DNA, 22 bp, Homo sapiens
ttaaatattatgttgtctgcaa

SEQ ID NO: 56253 - DNA, 22 bp, Homo sapiens
gcagaggacacaggagggcaag

SEQ ID NO: 56254 - DNA, 22 bp, Homo sapiens
atgtcgataggagtgccatcgg

SEQ ID NO: 56255 - DNA, 22 bp, Homo sapiens
tcgtctgtgaaattgggataag

SEQ ID NO: 56256 - DNA, 22 bp, Homo sapiens
ggcgccagcactgcagcgcctc

SEQ ID NO: 56257 - DNA, 22 bp, Homo sapiens
aagtggactaatacaaggacta

SEQ ID NO: 56258 - DNA, 22 bp, Homo sapiens
acactgcagatgaaagcataag

SEQ ID NO: 56259 - DNA, 22 bp, Homo sapiens
tagggtacatgtgcacaacatg

SEQ ID NO: 56260 - DNA, 22 bp, Homo sapiens
tggcccagtatgtataatctta

SEQ ID NO: 56261 - DNA, 20 bp, Homo sapiens
gttaggaggttggacatgga

SEQ ID NO: 56262 - DNA, 22 bp, Homo sapiens
atggagttctgccagcgctgct

SEQ ID NO: 56263 - DNA, 21 bp, Homo sapiens
agaaggcaaaagcagacatct

SEQ ID NO: 56264 - DNA, 22 bp, Homo sapiens
gtggggtagatctttctcagga

SEQ ID NO: 56265 - DNA, 22 bp, Homo sapiens
cctccctgccggctggactagt

SEQ ID NO: 56266 - DNA, 22 bp, Homo sapiens
aggtggggaggagtgtctcttt

SEQ ID NO: 56267 - DNA, 22 bp, Homo sapiens
cacagacagtgtccctttgttg

SEQ ID NO: 56268 - DNA, 23 bp, Homo sapiens
acagcaagaggaccagatgtgag

SEQ ID NO: 56269 - DNA, 21 bp, Homo sapiens
tctcttcctccgcgccgccgc

SEQ ID NO: 56270 - DNA, 22 bp, Homo sapiens
caccatttagtagcaagagctc

SEQ ID NO: 56271 - DNA, 22 bp, Homo sapiens
tgtgcctgttcccactttgcct

SEQ ID NO: 56272 - DNA, 22 bp, Homo sapiens
tctcatggagtcaggagcagaa

SEQ ID NO: 56273 - DNA, 22 bp, Homo sapiens
ccccatgaagtagggtctctga

SEQ ID NO: 56274 - DNA, 22 bp, Homo sapiens
tgtctattaattccacataaaa

SEQ ID NO: 56275 - DNA, 22 bp, Homo sapiens
accgggaagtcctgcactgggc

SEQ ID NO: 56276 - DNA, 22 bp, Homo sapiens
tgtcatagtgtggtagcagtgg

SEQ ID NO: 56277 - DNA, 22 bp, Homo sapiens
cccaaaggttgaggctgcagtg

SEQ ID NO: 56278 - DNA, 22 bp, Homo sapiens
tagcaaaggatgactatgtacc

SEQ ID NO: 56279 - DNA, 22 bp, Homo sapiens
aagattttcagtgcctaaaaca

SEQ ID NO: 56280 - DNA, 22 bp, Homo sapiens
agcgctgtgggcgtgcgaggag

SEQ ID NO: 56281 - DNA, 22 bp, Homo sapiens
cattgcaacttcaaactcctgg

SEQ ID NO: 56282 - DNA, 22 bp, Homo sapiens
aagtagttaggaacattctctc

SEQ ID NO: 56283 - DNA, 22 bp, Homo sapiens
atgaggcaggtggaggctgcca

SEQ ID NO: 56284 - DNA, 22 bp, Homo sapiens
ggtagaaataatcttcaggctg

SEQ ID NO: 56285 - DNA, 22 bp, Homo sapiens
ctggcagatagtaagtgatcaa

SEQ ID NO: 56286 - DNA, 22 bp, Homo sapiens
agcattccacactgaagtctgc

SEQ ID NO: 56287 - DNA, 22 bp, Homo sapiens
tgaaatcttcactaagtctctt

SEQ ID NO: 56288 - DNA, 22 bp, Homo sapiens
caggtgagaggcggtcctgcat

SEQ ID NO: 56289 - DNA, 22 bp, Homo sapiens
tgttcagaacaaaggtaaatga

SEQ ID NO: 56290 - DNA, 22 bp, Homo sapiens
catccgcatgcaagtgctgtcc

SEQ ID NO: 56291 - DNA, 22 bp, Homo sapiens
tcgcccaggctggaagtgcagt

SEQ ID NO: 56292 - DNA, 22 bp, Homo sapiens
tcccaagtactaccaatctaat

SEQ ID NO: 56293 - DNA, 22 bp, Homo sapiens
ctggcctaggaatggttttccg

SEQ ID NO: 56294 - DNA, 16 bp, Homo sapiens
atgctgctattagagg

SEQ ID NO: 56295 - DNA, 22 bp, Homo sapiens
agtgagagtattaatgtgaact

SEQ ID NO: 56296 - DNA, 22 bp, Homo sapiens
tgagtgaggctgggcagtccct

SEQ ID NO: 56297 - DNA, 22 bp, Homo sapiens
ggggccttggatctgtgccccg

SEQ ID NO: 56298 - DNA, 22 bp, Homo sapiens
tggtggctaccaggtcctgggg

SEQ ID NO: 56299 - DNA, 22 bp, Homo sapiens
cctggcaggtggcgccctcggc

SEQ ID NO: 56300 - DNA, 22 bp, Homo sapiens
gcaggtctatcaggctgcaggt

SEQ ID NO: 56301 - DNA, 22 bp, Homo sapiens
gacagctgcatcctcagacaca

SEQ ID NO: 56302 - DNA, 22 bp, Homo sapiens
gcagtggcatgatgtgggctca

SEQ ID NO: 56303 - DNA, 22 bp, Homo sapiens
cccaggaggcagagcttgcagt

SEQ ID NO: 56304 - DNA, 22 bp, Homo sapiens
tacaaaaaattgatactgacga

SEQ ID NO: 56305 - DNA, 22 bp, Homo sapiens
gaggtaacactgttcagtgggc

SEQ ID NO: 56306 - DNA, 22 bp, Homo sapiens
tcctcagaatcacctggcagct

SEQ ID NO: 56307 - DNA, 22 bp, Homo sapiens
tgactcaagagcctgactcatc

SEQ ID NO: 56308 - DNA, 22 bp, Homo sapiens
acccacgaagatgagcggcatg

SEQ ID NO: 56309 - DNA, 22 bp, Homo sapiens
tagatctgatacaattcatctg

SEQ ID NO: 56310 - DNA, 22 bp, Homo sapiens
tgacctattagatttccttgcc

SEQ ID NO: 56311 - DNA, 22 bp, Homo sapiens
tgatctaggttggcttcaactg

SEQ ID NO: 56312 - DNA, 22 bp, Homo sapiens
tggggccatctcacccactgtt

SEQ ID NO: 56313 - DNA, 22 bp, Homo sapiens
tgggaggccaaggcaggcggat

SEQ ID NO: 56314 - DNA, 22 bp, Homo sapiens
aaggctgagacagcacaggtcc

SEQ ID NO: 56315 - DNA, 22 bp, Homo sapiens
cccaggagttggaggctgcagt

SEQ ID NO: 56316 - DNA, 22 bp, Homo sapiens
cccaggaggtggaggctgcagt

SEQ ID NO: 56317 - DNA, 22 bp, Homo sapiens
tctcctggtacccttcctagca

SEQ ID NO: 56318 - DNA, 22 bp, Homo sapiens
aatgtcaaaggctatacattca

SEQ ID NO: 56319 - DNA, 22 bp, Homo sapiens
atgatggctaggctggttttga

SEQ ID NO: 56320 - DNA, 22 bp, Homo sapiens
tcctggtgctgacacccatagc

SEQ ID NO: 56321 - DNA, 22 bp, Homo sapiens
caggccagggttgagaagagaa

SEQ ID NO: 56322 - DNA, 22 bp, Homo sapiens
cagccccacacggtctagctct

SEQ ID NO: 56323 - DNA, 16 bp, Homo sapiens
tgggtgggaggagcgg

SEQ ID NO: 56324 - DNA, 22 bp, Homo sapiens
gtgcaaacatcatagagtgtac

SEQ ID NO: 56325 - DNA, 22 bp, Homo sapiens
aagaggttgtctgtgatgagtt

SEQ ID NO: 56326 - DNA, 21 bp, Homo sapiens
cctcaaagatgatggggtttc

SEQ ID NO: 56327 - DNA, 22 bp, Homo sapiens
gcctcctgagtagctgggattg

SEQ ID NO: 56328 - DNA, 22 bp, Homo sapiens
gaatttaagaggatgaatctgt

SEQ ID NO: 56329 - DNA, 17 bp, Homo sapiens
aggaggccctggcgttt

SEQ ID NO: 56330 - DNA, 22 bp, Homo sapiens
agtccaggcattccagccattc

SEQ ID NO: 56331 - DNA, 22 bp, Homo sapiens
atcagagtgtaagttctttcct

SEQ ID NO: 56332 - DNA, 22 bp, Homo sapiens
gtcaggactctgacccgtcccg

SEQ ID NO: 56333 - DNA, 22 bp, Homo sapiens
tgggcagggagctggaaccaca

SEQ ID NO: 56334 - DNA, 22 bp, Homo sapiens
ggagaccagaaggaagcttcga

SEQ ID NO: 56335 - DNA, 22 bp, Homo sapiens
gggttgaggcggatgtcggcgg

SEQ ID NO: 56336 - DNA, 22 bp, Homo sapiens
gcggggggaggaacatcttgca

SEQ ID NO: 56337 - DNA, 22 bp, Homo sapiens
cccaggcttttctcttgcccca

SEQ ID NO: 56338 - DNA, 22 bp, Homo sapiens
tcaacaccacaatttcttaact

SEQ ID NO: 56339 - DNA, 22 bp, Homo sapiens
caaatgaatatttccatgggtt

SEQ ID NO: 56340 - DNA, 22 bp, Homo sapiens
cccacgtcgaacttgctccaga

SEQ ID NO: 56341 - DNA, 22 bp, Homo sapiens
actgcacttcagcctgggtgac

SEQ ID NO: 56342 - DNA, 22 bp, Homo sapiens
gaccatcctggccaacgtggta

SEQ ID NO: 56343 - DNA, 22 bp, Homo sapiens
tttattggatatttacaagata

SEQ ID NO: 56344 - DNA, 22 bp, Homo sapiens
tgacttgtctctttgggagaca

SEQ ID NO: 56345 - DNA, 22 bp, Homo sapiens
tcaagcaaagtttagctggtta

SEQ ID NO: 56346 - DNA, 22 bp, Homo sapiens
ggcagggcaggaaagtcaggaa

SEQ ID NO: 56347 - DNA, 22 bp, Homo sapiens
aatatttcttctaaagcccttt

SEQ ID NO: 56348 - DNA, 22 bp, Homo sapiens
tccagggccatctccatgaggc

SEQ ID NO: 56349 - DNA, 22 bp, Homo sapiens
taagaaatttagttatagaatg

SEQ ID NO: 56350 - DNA, 22 bp, Homo sapiens
tgcctccaacagcccatcctag

SEQ ID NO: 56351 - DNA, 22 bp, Homo sapiens
tgccgcagtgcggggagggccc

SEQ ID NO: 56352 - DNA, 21 bp, Homo sapiens
agcgtcaatatcgtcaacagg

SEQ ID NO: 56353 - DNA, 22 bp, Homo sapiens
cagtctctaaatcaatctgaat

SEQ ID NO: 56354 - DNA, 22 bp, Homo sapiens
cggggccctggggctgaaggtc

SEQ ID NO: 56355 - DNA, 22 bp, Homo sapiens
gcaggcaggcttccttgaactg

SEQ ID NO: 56356 - DNA, 22 bp, Homo sapiens
tcctccccaaagcccagcctgg

SEQ ID NO: 56357 - DNA, 22 bp, Homo sapiens
tcaccaggctggagtgcagtgg

SEQ ID NO: 56358 - DNA, 22 bp, Homo sapiens
ccctgggattcaatttcactct

SEQ ID NO: 56359 - DNA, 19 bp, Homo sapiens
gataggcagccatgagccc

SEQ ID NO: 56360 - DNA, 22 bp, Homo sapiens
caagccattctcctgcctcagc

SEQ ID NO: 56361 - DNA, 23 bp, Homo sapiens
cgcccagcctcagtgacctgggc

SEQ ID NO: 56362 - DNA, 22 bp, Homo sapiens
ttgaatctgggtacttgtaata

SEQ ID NO: 56363 - DNA, 22 bp, Homo sapiens
atgttctacagatggaaagggg

SEQ ID NO: 56364 - DNA, 22 bp, Homo sapiens
aagatattcaaagatttattag

SEQ ID NO: 56365 - DNA, 22 bp, Homo sapiens
ttgcaattgctatggagagcgt

SEQ ID NO: 56366 - DNA, 22 bp, Homo sapiens
ctcggaatggaacaacagcggt

SEQ ID NO: 56367 - DNA, 22 bp, Homo sapiens
tggcttccccggagtgacatgt

SEQ ID NO: 56368 - DNA, 22 bp, Homo sapiens
attgcactccggcctgggtgac

SEQ ID NO: 56369 - DNA, 22 bp, Homo sapiens
agcccttggtattttccgatcc

SEQ ID NO: 56370 - DNA, 19 bp, Homo sapiens
agggaatccggctgaggga

SEQ ID NO: 56371 - DNA, 19 bp, Homo sapiens
atgtacccagtgtcaatcc

SEQ ID NO: 56372 - DNA, 22 bp, Homo sapiens
gcccagcccagaaaggttcgga

SEQ ID NO: 56373 - DNA, 21 bp, Homo sapiens
acacaggcagtgtcccgaggt

SEQ ID NO: 56374 - DNA, 22 bp, Homo sapiens
ttcatataccttgcgtttcaca

SEQ ID NO: 56375 - DNA, 22 bp, Homo sapiens
cagagctggtgtgtcctggcat

SEQ ID NO: 56376 - DNA, 22 bp, Homo sapiens
ctccatatgttcagttatgcag

SEQ ID NO: 56377 - DNA, 22 bp, Homo sapiens
cccaggaggtcgaagctgcagt

SEQ ID NO: 56378 - DNA, 22 bp, Homo sapiens
cccagaaggtcgaggctgcagt

SEQ ID NO: 56379 - DNA, 22 bp, Homo sapiens
catgagatttgggaggggccag

SEQ ID NO: 56380 - DNA, 22 bp, Homo sapiens
atgctttctcttagttcattga

SEQ ID NO: 56381 - DNA, 22 bp, Homo sapiens
gtcagaggggcagctgccaggc

SEQ ID NO: 56382 - DNA, 22 bp, Homo sapiens
ctgaattatttaaggtgaaggg

SEQ ID NO: 56383 - DNA, 22 bp, Homo sapiens
tgttgcccaggttctctcctgc

SEQ ID NO: 56384 - DNA, 20 bp, Homo sapiens
ttcgctgggagtggccaggc

SEQ ID NO: 56385 - DNA, 22 bp, Homo sapiens
ggatgttctggggttctcttgt

SEQ ID NO: 56386 - DNA, 22 bp, Homo sapiens
ccggtcccaggtgccccggtga

SEQ ID NO: 56387 - DNA, 22 bp, Homo sapiens
agaggcaggaggttgacttgag

SEQ ID NO: 56388 - DNA, 22 bp, Homo sapiens
ccaggctgctgttggtgtccgc

SEQ ID NO: 56389 - DNA, 22 bp, Homo sapiens
gctaggagtggtgggtcaagga

SEQ ID NO: 56390 - DNA, 21 bp, Homo sapiens
tctgccagctgaagaggtgga

SEQ ID NO: 56391 - DNA, 22 bp, Homo sapiens
cagcctgtcggctccttcattc

SEQ ID NO: 56392 - DNA, 20 bp, Homo sapiens
acctcctggcgggcatcctc

SEQ ID NO: 56393 - DNA, 22 bp, Homo sapiens
gggcaggggtcagtggccccaa

SEQ ID NO: 56394 - DNA, 17 bp, Homo sapiens
cttcccaccatctcctg

SEQ ID NO: 56395 - DNA, 22 bp, Homo sapiens
ggcctcttatctggctcctgca

SEQ ID NO: 56396 - DNA, 21 bp, Homo sapiens
tgctccaggagggggcagtcc

SEQ ID NO: 56397 - DNA, 22 bp, Homo sapiens
atacaaaaattagccgggagta

SEQ ID NO: 56398 - DNA, 22 bp, Homo sapiens
accctcaacaaattcactctat

SEQ ID NO: 56399 - DNA, 19 bp, Homo sapiens
tcctgcccaccagccaggg

SEQ ID NO: 56400 - DNA, 22 bp, Homo sapiens
agcgccactgcactccagcctg

SEQ ID NO: 56401 - DNA, 22 bp, Homo sapiens
ggccagcctggggctcccagac

SEQ ID NO: 56402 - DNA, 22 bp, Homo sapiens
gccaggcgggtctcaaactcct

SEQ ID NO: 56403 - DNA, 22 bp, Homo sapiens
aggccacggcgggtggattact

SEQ ID NO: 56404 - DNA, 22 bp, Homo sapiens
aggacagagggaccagagccca

SEQ ID NO: 56405 - DNA, 22 bp, Homo sapiens
tggttcctcaagcgctggcggc

SEQ ID NO: 56406 - DNA, 23 bp, Homo sapiens
gcagaggagcaagctggacacca

SEQ ID NO: 56407 - DNA, 22 bp, Homo sapiens
ctcataaggagctcacaaccta

SEQ ID NO: 56408 - DNA, 14 bp, Homo sapiens
gcaggcggatcact

SEQ ID NO: 56409 - DNA, 22 bp, Homo sapiens
tcaggaggcggaggttgcagtg

SEQ ID NO: 56410 - DNA, 22 bp, Homo sapiens
gggagtgggtttggcctaggcc

SEQ ID NO: 56411 - DNA, 22 bp, Homo sapiens
ccctcccaggagtggccagaga

SEQ ID NO: 56412 - DNA, 22 bp, Homo sapiens
tgaggcaggagttcaggctgcg

SEQ ID NO: 56413 - DNA, 22 bp, Homo sapiens
aaaaatcacttttataggcagc

SEQ ID NO: 56414 - DNA, 22 bp, Homo sapiens
gacaggaggcagagctcaggtg

SEQ ID NO: 56415 - DNA, 22 bp, Homo sapiens
aggcaacttttggggatgatgg

SEQ ID NO: 56416 - DNA, 18 bp, Homo sapiens
gcagctagccaggggggc

SEQ ID NO: 56417 - DNA, 22 bp, Homo sapiens
aggagctcagctaagttggaga

SEQ ID NO: 56418 - DNA, 22 bp, Homo sapiens
cagctgctgttcagttttgttt

SEQ ID NO: 56419 - DNA, 22 bp, Homo sapiens
aggtatatattctggtccttat

SEQ ID NO: 56420 - DNA, 22 bp, Homo sapiens
cactccagcctcagtgacagag

SEQ ID NO: 56421 - DNA, 20 bp, Homo sapiens
tttcttgtcggctgttgctg

SEQ ID NO: 56422 - DNA, 22 bp, Homo sapiens
gggtctcctaatggaggatgac

SEQ ID NO: 56423 - DNA, 22 bp, Homo sapiens
agagctaagaaacagaattgct

SEQ ID NO: 56424 - DNA, 22 bp, Homo sapiens
agtgcattcctggggaagaagc

SEQ ID NO: 56425 - DNA, 22 bp, Homo sapiens
gaggccaactttggagaacagg

SEQ ID NO: 56426 - DNA, 22 bp, Homo sapiens
accagcctggccaacatggcaa

SEQ ID NO: 56427 - DNA, 21 bp, Homo sapiens
aggtgctggcgccccaggaga

SEQ ID NO: 56428 - DNA, 22 bp, Homo sapiens
ctagcctgggatttgaacttat

SEQ ID NO: 56429 - DNA, 22 bp, Homo sapiens
aagtgctgggattacaggcatg

SEQ ID NO: 56430 - DNA, 22 bp, Homo sapiens
ccttcccacattccttacatgc

SEQ ID NO: 56431 - DNA, 22 bp, Homo sapiens
tgagacaggcttccttcttggg

SEQ ID NO: 56432 - DNA, 22 bp, Homo sapiens
ggaggtgactggatcatgggca

SEQ ID NO: 56433 - DNA, 23 bp, Homo sapiens
cagtctgcagcccacttgggcag

SEQ ID NO: 56434 - DNA, 22 bp, Homo sapiens
aagcccttggcgcacaccgggc

SEQ ID NO: 56435 - DNA, 22 bp, Homo sapiens
taggtgcaggtcacaagggatg

SEQ ID NO: 56436 - DNA, 22 bp, Homo sapiens
tctcagctcatggcagccttga

SEQ ID NO: 56437 - DNA, 22 bp, Homo sapiens
gctggcagacttcctctggaac

SEQ ID NO: 56438 - DNA, 22 bp, Homo sapiens
ctcctgagctctgaggaagctt

SEQ ID NO: 56439 - DNA, 22 bp, Homo sapiens
ccctggaggttgaggctgcagt

SEQ ID NO: 56440 - DNA, 22 bp, Homo sapiens
tgctgttagtaaggaacatgac

SEQ ID NO: 56441 - DNA, 22 bp, Homo sapiens
ctacccttaagtttctgtgggg

SEQ ID NO: 56442 - DNA, 19 bp, Homo sapiens
agggttacccgctgccacc

SEQ ID NO: 56443 - DNA, 22 bp, Homo sapiens
tggaggagaccgcattttattt

SEQ ID NO: 56444 - DNA, 22 bp, Homo sapiens
gcccctgcctttgaacctggag

SEQ ID NO: 56445 - DNA, 22 bp, Homo sapiens
tcccaggccacacttggggaac

SEQ ID NO: 56446 - DNA, 22 bp, Homo sapiens
tttaatgtagcgtgaaatgatt

SEQ ID NO: 56447 - DNA, 22 bp, Homo sapiens
tgcctgatgcaggagtatcaga

SEQ ID NO: 56448 - DNA, 22 bp, Homo sapiens
gggccatgagaggttcatcaac

SEQ ID NO: 56449 - DNA, 22 bp, Homo sapiens
actgcgctccagcctgggtgac

SEQ ID NO: 56450 - DNA, 22 bp, Homo sapiens
tctcgacagcctggcacagtgg

SEQ ID NO: 56451 - DNA, 22 bp, Homo sapiens
cccaggaggttgaggctgcagt

SEQ ID NO: 56452 - DNA, 22 bp, Homo sapiens
tatacactgttgttgggagtct

SEQ ID NO: 56453 - DNA, 22 bp, Homo sapiens
gaagggaactgggtctccttgt

SEQ ID NO: 56454 - DNA, 22 bp, Homo sapiens
gccctgagaagaagtcggaggg

SEQ ID NO: 56455 - DNA, 22 bp, Homo sapiens
ggcttctctccagtatgcattc

SEQ ID NO: 56456 - DNA, 22 bp, Homo sapiens
tcaccaggctagagtgcagtgg

SEQ ID NO: 56457 - DNA, 22 bp, Homo sapiens
tttacttcatttccagtgagga

SEQ ID NO: 56458 - DNA, 22 bp, Homo sapiens
cttctgagatgttgttttacag

SEQ ID NO: 56459 - DNA, 22 bp, Homo sapiens
gcgagcctctggagtcctctgg

SEQ ID NO: 56460 - DNA, 22 bp, Homo sapiens
ctgcagggagaggggacagcct

SEQ ID NO: 56461 - DNA, 22 bp, Homo sapiens
acagcagcaatagcagtgacat

SEQ ID NO: 56462 - DNA, 22 bp, Homo sapiens
cgggcaaggcgagactaggccc

SEQ ID NO: 56463 - DNA, 22 bp, Homo sapiens
atgattgaccatctgctgggct

SEQ ID NO: 56464 - DNA, 22 bp, Homo sapiens
ctggctcctgtttaaccagctg

SEQ ID NO: 56465 - DNA, 22 bp, Homo sapiens
ttcaggaagtgctgcctggtgt

SEQ ID NO: 56466 - DNA, 22 bp, Homo sapiens
cccaggaggcctgcctggccgg

SEQ ID NO: 56467 - DNA, 22 bp, Homo sapiens
atcatcatgcccacttgagact

SEQ ID NO: 56468 - DNA, 22 bp, Homo sapiens
tactttaatatatgtgaagttc

SEQ ID NO: 56469 - DNA, 21 bp, Homo sapiens
gtggttctagagaaacagaat

SEQ ID NO: 56470 - DNA, 22 bp, Homo sapiens
caggctggagttcagtggtgtg

SEQ ID NO: 56471 - DNA, 22 bp, Homo sapiens
ttgtccgtggtgagttcgcatt

SEQ ID NO: 56472 - DNA, 22 bp, Homo sapiens
tccagggagagccgctgctcca

SEQ ID NO: 56473 - DNA, 22 bp, Homo sapiens
gggctagcctcttccctgctcc

SEQ ID NO: 56474 - DNA, 22 bp, Homo sapiens
caggctgaagtgcagtggtgtg

SEQ ID NO: 56475 - DNA, 22 bp, Homo sapiens
tgtcttcagcagtcatctgggg

SEQ ID NO: 56476 - DNA, 22 bp, Homo sapiens
agaaggggcccaaggatgtcag

SEQ ID NO: 56477 - DNA, 22 bp, Homo sapiens
atctccgccatcgcgaacgcct

SEQ ID NO: 56478 - DNA, 22 bp, Homo sapiens
ctaggctggagtgcagtggcac

SEQ ID NO: 56479 - DNA, 22 bp, Homo sapiens
gcctgtgacccagggcccagga

SEQ ID NO: 56480 - DNA, 22 bp, Homo sapiens
aatggcaaggaaaccgttacca

SEQ ID NO: 56481 - DNA, 22 bp, Homo sapiens
aacccgggaggcagaggttgtg

SEQ ID NO: 56482 - DNA, 22 bp, Homo sapiens
gcaggctgtctaaagttagagt

SEQ ID NO: 56483 - DNA, 22 bp, Homo sapiens
aggagatggagctcagtgggca

SEQ ID NO: 56484 - DNA, 22 bp, Homo sapiens
gccctagcgccagctcagcacc

SEQ ID NO: 56485 - DNA, 22 bp, Homo sapiens
ggcaaaaaccataattactttt

SEQ ID NO: 56486 - DNA, 22 bp, Homo sapiens
gaagcctcaacatctctgcgtc

SEQ ID NO: 56487 - DNA, 22 bp, Homo sapiens
ggggcaggagcccttcttcagc

SEQ ID NO: 56488 - DNA, 22 bp, Homo sapiens
tctcctggagcccagatgctgg

SEQ ID NO: 56489 - DNA, 22 bp, Homo sapiens
gttacagtcaggagatattttg

SEQ ID NO: 56490 - DNA, 18 bp, Homo sapiens
gcctgagggtcaagtgtg

SEQ ID NO: 56491 - DNA, 22 bp, Homo sapiens
aagcctggcacattggagtctg

SEQ ID NO: 56492 - DNA, 22 bp, Homo sapiens
ggcgctcagtgttgccccagag

SEQ ID NO: 56493 - DNA, 22 bp, Homo sapiens
tgtcttcgctacaatgaaaagg

SEQ ID NO: 56494 - DNA, 22 bp, Homo sapiens
ataaaatttgctactgttaaat

SEQ ID NO: 56495 - DNA, 22 bp, Homo sapiens
tcactacaacctccgcctcctg

SEQ ID NO: 56496 - DNA, 22 bp, Homo sapiens
cagggatggcgctggctgcccg

SEQ ID NO: 56497 - DNA, 22 bp, Homo sapiens
gtgctccctccttcctcaagga

SEQ ID NO: 56498 - DNA, 22 bp, Homo sapiens
tgggggacaccagtctctctct

SEQ ID NO: 56499 - DNA, 22 bp, Homo sapiens
gctgcagctcgccttccggcct

SEQ ID NO: 56500 - DNA, 22 bp, Homo sapiens
atggtttattagctgcacaggc

SEQ ID NO: 56501 - DNA, 19 bp, Homo sapiens
ggggcctgtgatggtcaca

SEQ ID NO: 56502 - DNA, 22 bp, Homo sapiens
ggccaggcgatgacccctccac

SEQ ID NO: 56503 - DNA, 22 bp, Homo sapiens
tccctcatctcacatgtgtgtg

SEQ ID NO: 56504 - DNA, 22 bp, Homo sapiens
cccagctcttcaagtcaccccc

SEQ ID NO: 56505 - DNA, 22 bp, Homo sapiens
gctgcgagctcttgttctgaga

SEQ ID NO: 56506 - DNA, 22 bp, Homo sapiens
gtagctctgtttaaagttcttt

SEQ ID NO: 56507 - DNA, 22 bp, Homo sapiens
cacccaggctggagagcagtgg

SEQ ID NO: 56508 - DNA, 22 bp, Homo sapiens
ggtgccaggctgtagtcagggt

SEQ ID NO: 56509 - DNA, 22 bp, Homo sapiens
cctagagctctgctttatctaa

SEQ ID NO: 56510 - DNA, 22 bp, Homo sapiens
ccaggaggcggaaggtacagtg

SEQ ID NO: 56511 - DNA, 22 bp, Homo sapiens
ttcttctaaatgtgcttattaa

SEQ ID NO: 56512 - DNA, 22 bp, Homo sapiens
ctgctaaacctctctgagagct

SEQ ID NO: 56513 - DNA, 22 bp, Homo sapiens
catgtgaattccaaagctaggt

SEQ ID NO: 56514 - DNA, 22 bp, Homo sapiens
aagtgctgggattacaagcgtg

SEQ ID NO: 56515 - DNA, 22 bp, Homo sapiens
cagccctcctaccctgccaggc

SEQ ID NO: 56516 - DNA, 22 bp, Homo sapiens
ttctgccatctgcagaagggga

SEQ ID NO: 56517 - DNA, 22 bp, Homo sapiens
aaagggaagttgcacatgttcc

SEQ ID NO: 56518 - DNA, 22 bp, Homo sapiens
ctggaaggcagaggttgcagtg

SEQ ID NO: 56519 - DNA, 22 bp, Homo sapiens
ggctttctgtctgcgtctgtgt

SEQ ID NO: 56520 - DNA, 22 bp, Homo sapiens
cttctggcgttggaggtctgag

SEQ ID NO: 56521 - DNA, 22 bp, Homo sapiens
tgcactccaggctgggtgacag

SEQ ID NO: 56522 - DNA, 19 bp, Homo sapiens
gcccacggccctgctctgc

SEQ ID NO: 56523 - DNA, 22 bp, Homo sapiens
ctgtccctgagcaactcctgtt

SEQ ID NO: 56524 - DNA, 22 bp, Homo sapiens
tggacaacatagtgagacctca

SEQ ID NO: 56525 - DNA, 22 bp, Homo sapiens
tctgagctccatgcaggaggct

SEQ ID NO: 56526 - DNA, 22 bp, Homo sapiens
aagcactttatgtcaatgtcct

SEQ ID NO: 56527 - DNA, 22 bp, Homo sapiens
ctggcaggagcattcacagagg

SEQ ID NO: 56528 - DNA, 22 bp, Homo sapiens
ggctgggcaggtctgcacaggg

SEQ ID NO: 56529 - DNA, 22 bp, Homo sapiens
ctctttggatagaattacaaag

SEQ ID NO: 56530 - DNA, 22 bp, Homo sapiens
gtcctgtgagattcatgctcaa

SEQ ID NO: 56531 - DNA, 22 bp, Homo sapiens
gggcggggggagctggaatgaa

SEQ ID NO: 56532 - DNA, 22 bp, Homo sapiens
tagctgaattgtgggagaccta

SEQ ID NO: 56533 - DNA, 22 bp, Homo sapiens
ctgctcagtaatagtcctatct

SEQ ID NO: 56534 - DNA, 22 bp, Homo sapiens
gagcccaggcagaggttgcagt

SEQ ID NO: 56535 - DNA, 22 bp, Homo sapiens
ttgtgaatagtgccgctataaa

SEQ ID NO: 56536 - DNA, 20 bp, Homo sapiens
tttcaccatcttggccaggc

SEQ ID NO: 56537 - DNA, 22 bp, Homo sapiens
tacctcaagttccaggaaagcg

SEQ ID NO: 56538 - DNA, 22 bp, Homo sapiens
tctgacattagattaattggaa

SEQ ID NO: 56539 - DNA, 22 bp, Homo sapiens
ctcttagtaatgccatgaagca

SEQ ID NO: 56540 - DNA, 22 bp, Homo sapiens
cactgcccaccaagtggctggt

SEQ ID NO: 56541 - DNA, 22 bp, Homo sapiens
atccccctcttggatggcggca

SEQ ID NO: 56542 - DNA, 22 bp, Homo sapiens
tcaagcaattctcctgcctcag

SEQ ID NO: 56543 - DNA, 22 bp, Homo sapiens
catccagtgggacagagaaacc

SEQ ID NO: 56544 - DNA, 22 bp, Homo sapiens
ccgggttgaggttcccatagat

SEQ ID NO: 56545 - DNA, 22 bp, Homo sapiens
tgtgaccctctccgatgggcag

SEQ ID NO: 56546 - DNA, 22 bp, Homo sapiens
ctatgaccccagcatgaataag

SEQ ID NO: 56547 - DNA, 22 bp, Homo sapiens
acgcctgtaatcccagcacttt

SEQ ID NO: 56548 - DNA, 22 bp, Homo sapiens
gcttcaggctgaattcctccta

SEQ ID NO: 56549 - DNA, 23 bp, Homo sapiens
ggagcctccggtgtgtgagaggc

SEQ ID NO: 56550 - DNA, 22 bp, Homo sapiens
ctgcaccgtgtctcgggctgcc

SEQ ID NO: 56551 - DNA, 22 bp, Homo sapiens
tgtaccgcaaatgctgctgcct

SEQ ID NO: 56552 - DNA, 22 bp, Homo sapiens
tccaagatctacagcagtttag

SEQ ID NO: 56553 - DNA, 22 bp, Homo sapiens
agaacgtggaatgtggctcctt

SEQ ID NO: 56554 - DNA, 22 bp, Homo sapiens
ggagcagggaattacagcgcag

SEQ ID NO: 56555 - DNA, 22 bp, Homo sapiens
atccctgtgacgagcatcccta

SEQ ID NO: 56556 - DNA, 22 bp, Homo sapiens
gttcaagaccagcctggccaac

SEQ ID NO: 56557 - DNA, 22 bp, Homo sapiens
tgggggctgggatgtcactttc

SEQ ID NO: 56558 - DNA, 22 bp, Homo sapiens
ccctgctgtcaggtgctgggag

SEQ ID NO: 56559 - DNA, 22 bp, Homo sapiens
ctgtggctctcagaggctgctg

SEQ ID NO: 56560 - DNA, 22 bp, Homo sapiens
tcctcggctgggccccaggctt

SEQ ID NO: 56561 - DNA, 22 bp, Homo sapiens
ccagaagcagagcctgaggcag

SEQ ID NO: 56562 - DNA, 22 bp, Homo sapiens
tgggactcactcttttggccag

SEQ ID NO: 56563 - DNA, 22 bp, Homo sapiens
caggctgctgacaggcttggag

SEQ ID NO: 56564 - DNA, 22 bp, Homo sapiens
gaccctctagatggaagcactg

SEQ ID NO: 56565 - DNA, 22 bp, Homo sapiens
gcaggcattagcccccatggct

SEQ ID NO: 56566 - DNA, 22 bp, Homo sapiens
tgggagaaagaaccctgagtga

SEQ ID NO: 56567 - DNA, 22 bp, Homo sapiens
actctggccatcttggaccttg

SEQ ID NO: 56568 - DNA, 22 bp, Homo sapiens
cccagcaggtcggtgctgcctg

SEQ ID NO: 56569 - DNA, 22 bp, Homo sapiens
gctcatgactgtaatcccagca

SEQ ID NO: 56570 - DNA, 22 bp, Homo sapiens
ccaggttggagttcagtggcgc

SEQ ID NO: 56571 - DNA, 22 bp, Homo sapiens
taagtcgtggatgattcttcgg

SEQ ID NO: 56572 - DNA, 22 bp, Homo sapiens
ccaggagttggaagctgccatg

SEQ ID NO: 56573 - DNA, 22 bp, Homo sapiens
gaaggagccgagctcttcccca

SEQ ID NO: 56574 - DNA, 22 bp, Homo sapiens
caggaaggggctcactctggcc

SEQ ID NO: 56575 - DNA, 22 bp, Homo sapiens
tttgatccgttgctggtgagga

SEQ ID NO: 56576 - DNA, 22 bp, Homo sapiens
ttcccacagtgactccagagaa

SEQ ID NO: 56577 - DNA, 22 bp, Homo sapiens
cagtggctggttagggacagga

SEQ ID NO: 56578 - DNA, 22 bp, Homo sapiens
ggaaaagtgttaaggtgttgat

SEQ ID NO: 56579 - DNA, 22 bp, Homo sapiens
cggccaggcacagtggcccacg

SEQ ID NO: 56580 - DNA, 22 bp, Homo sapiens
ctgggcagctgtatcagggagt

SEQ ID NO: 56581 - DNA, 22 bp, Homo sapiens
gccatcatatcccctgtgacct

SEQ ID NO: 56582 - DNA, 22 bp, Homo sapiens
ctggccagatgttacgtccaat

SEQ ID NO: 56583 - DNA, 22 bp, Homo sapiens
tctgcaggaagctggcggctga

SEQ ID NO: 56584 - DNA, 22 bp, Homo sapiens
gaggtgggcggatcacaaggtc

SEQ ID NO: 56585 - DNA, 22 bp, Homo sapiens
agtcccaacagcttacaaggaa

SEQ ID NO: 56586 - DNA, 22 bp, Homo sapiens
gaattcttttctttctgaaagt

SEQ ID NO: 56587 - DNA, 22 bp, Homo sapiens
acacggcactttaggaaggggc

SEQ ID NO: 56588 - DNA, 22 bp, Homo sapiens
acttttaaatgagtttcagttg

SEQ ID NO: 56589 - DNA, 20 bp, Homo sapiens
ctgccgaccacagccatgga

SEQ ID NO: 56590 - DNA, 22 bp, Homo sapiens
taaatcttctacatcatcataa

SEQ ID NO: 56591 - DNA, 22 bp, Homo sapiens
agctggtgtgccagttccagtt

SEQ ID NO: 56592 - DNA, 22 bp, Homo sapiens
aggaaggactccatggtccgtc

SEQ ID NO: 56593 - DNA, 22 bp, Homo sapiens
ccagggtggcgtagatgctggg

SEQ ID NO: 56594 - DNA, 22 bp, Homo sapiens
gccagggttgccaatgggggca

SEQ ID NO: 56595 - DNA, 22 bp, Homo sapiens
agctcctgaaaatccagactgg

SEQ ID NO: 56596 - DNA, 22 bp, Homo sapiens
ccaggtgtgctctgcagtggat

SEQ ID NO: 56597 - DNA, 22 bp, Homo sapiens
gcctccccaagcagcagggatt

SEQ ID NO: 56598 - DNA, 22 bp, Homo sapiens
gctgctctcagagctcatgctg

SEQ ID NO: 56599 - DNA, 22 bp, Homo sapiens
caggctggagtgcagtggcgcc

SEQ ID NO: 56600 - DNA, 22 bp, Homo sapiens
agagtggctctgctgggcacag

SEQ ID NO: 56601 - DNA, 22 bp, Homo sapiens
tagaacctccacaggacctcca

SEQ ID NO: 56602 - DNA, 22 bp, Homo sapiens
cagcagcccacgcgtgctgtcc

SEQ ID NO: 56603 - DNA, 22 bp, Homo sapiens
tttgaggttagctagcagatca

SEQ ID NO: 56604 - DNA, 22 bp, Homo sapiens
aggaatgtgaaacaggtggctg

SEQ ID NO: 56605 - DNA, 22 bp, Homo sapiens
agaaaacataggagacaggaaa

SEQ ID NO: 56606 - DNA, 22 bp, Homo sapiens
gcaaaaagtagtgctggttagg

SEQ ID NO: 56607 - DNA, 22 bp, Homo sapiens
aagaatgagctcaaagatctta

SEQ ID NO: 56608 - DNA, 20 bp, Homo sapiens
gtctccactgggggttaacc

SEQ ID NO: 56609 - DNA, 22 bp, Homo sapiens
aaccccaaaacctctgaagtgg

SEQ ID NO: 56610 - DNA, 22 bp, Homo sapiens
tctaaattactttgggcagtat

SEQ ID NO: 56611 - DNA, 22 bp, Homo sapiens
tccaggctttggggcaggagcg

SEQ ID NO: 56612 - DNA, 22 bp, Homo sapiens
aaggaggttatcccagtggact

SEQ ID NO: 56613 - DNA, 22 bp, Homo sapiens
ggggagatgcttaggtccgggg

SEQ ID NO: 56614 - DNA, 22 bp, Homo sapiens
tggaagaatatgggggtacaga

SEQ ID NO: 56615 - DNA, 20 bp, Homo sapiens
tcacatcctctcccaacatg

SEQ ID NO: 56616 - DNA, 22 bp, Homo sapiens
aggagccagtggagttcctgcc

SEQ ID NO: 56617 - DNA, 22 bp, Homo sapiens
ggctgggctccgggagcatgcg

SEQ ID NO: 56618 - DNA, 22 bp, Homo sapiens
cccaggctggagtgcagtggcg

SEQ ID NO: 56619 - DNA, 22 bp, Homo sapiens
gtacaaatgcaggtttgttaca

SEQ ID NO: 56620 - DNA, 23 bp, Homo sapiens
gttttacaggtgagaaaatggag

SEQ ID NO: 56621 - DNA, 22 bp, Homo sapiens
aaattcttttgtgcggtgaagt

SEQ ID NO: 56622 - DNA, 22 bp, Homo sapiens
ctgcggctctgcgggcagctgg

SEQ ID NO: 56623 - DNA, 22 bp, Homo sapiens
atggtgtttataggcaaagatc

SEQ ID NO: 56624 - DNA, 22 bp, Homo sapiens
gattcactcatattttacgttt

SEQ ID NO: 56625 - DNA, 22 bp, Homo sapiens
atggccgcctgtccttcccgcc

SEQ ID NO: 56626 - DNA, 22 bp, Homo sapiens
ctccaggctcgtccaagatcga

SEQ ID NO: 56627 - DNA, 22 bp, Homo sapiens
gtttcactgcaaactgactttt

SEQ ID NO: 56628 - DNA, 22 bp, Homo sapiens
ttccccttgggctgtggaggag

SEQ ID NO: 56629 - DNA, 22 bp, Homo sapiens
ttaaattttagaaacagactct

SEQ ID NO: 56630 - DNA, 22 bp, Homo sapiens
aggtgactggtttatctggcag

SEQ ID NO: 56631 - DNA, 22 bp, Homo sapiens
aagccctggacggcccttcccc

SEQ ID NO: 56632 - DNA, 22 bp, Homo sapiens
ttaataaagtatgaattggaaa

SEQ ID NO: 56633 - DNA, 22 bp, Homo sapiens
ttatgggagcaattggggaggt

SEQ ID NO: 56634 - DNA, 22 bp, Homo sapiens
gacaggcttccactatgttgcc

SEQ ID NO: 56635 - DNA, 22 bp, Homo sapiens
gtcttgatctcctgaccttgtg

SEQ ID NO: 56636 - DNA, 22 bp, Homo sapiens
tgttgattagtgtttagactta

SEQ ID NO: 56637 - DNA, 22 bp, Homo sapiens
ctgggcaaattgtgccagctat

SEQ ID NO: 56638 - DNA, 22 bp, Homo sapiens
cacattccttacattcatagag

SEQ ID NO: 56639 - DNA, 22 bp, Homo sapiens
gctccagtgaccatcgttttag

SEQ ID NO: 56640 - DNA, 22 bp, Homo sapiens
cgtctggcttctccacggtaaa

SEQ ID NO: 56641 - DNA, 22 bp, Homo sapiens
acacttggagcaacacttatgg

SEQ ID NO: 56642 - DNA, 22 bp, Homo sapiens
gatgggcgtggcgcgtttggtg

SEQ ID NO: 56643 - DNA, 22 bp, Homo sapiens
aggccttaccatagctgtagca

SEQ ID NO: 56644 - DNA, 22 bp, Homo sapiens
gtaggccatggtggttgtctct

SEQ ID NO: 56645 - DNA, 22 bp, Homo sapiens
tggctgtgtccctgtccagagt

SEQ ID NO: 56646 - DNA, 22 bp, Homo sapiens
agggagcaaaggtttcagggtt

SEQ ID NO: 56647 - DNA, 22 bp, Homo sapiens
actttatttcctattgcatcca

SEQ ID NO: 56648 - DNA, 22 bp, Homo sapiens
cacgttaacagctaacagatga

SEQ ID NO: 56649 - DNA, 22 bp, Homo sapiens
cccaggctggagtgtaatggtg

SEQ ID NO: 56650 - DNA, 22 bp, Homo sapiens
acagtccagcctagtatgtata

SEQ ID NO: 56651 - DNA, 22 bp, Homo sapiens
gagggggctagcgcagtgccca

SEQ ID NO: 56652 - DNA, 21 bp, Homo sapiens
caaaagagactgattcttgga

SEQ ID NO: 56653 - DNA, 22 bp, Homo sapiens
gaggctgaggcggatggatcac

SEQ ID NO: 56654 - DNA, 22 bp, Homo sapiens
aaaagcaattgcagttcttgcc

SEQ ID NO: 56655 - DNA, 22 bp, Homo sapiens
gagcaggaaggccagaagggtc

SEQ ID NO: 56656 - DNA, 22 bp, Homo sapiens
cggccaagccggggccccgaag

SEQ ID NO: 56657 - DNA, 20 bp, Homo sapiens
ggtcactgtggctgcaggat

SEQ ID NO: 56658 - DNA, 22 bp, Homo sapiens
attgtaaatagtgccacaataa

SEQ ID NO: 56659 - DNA, 22 bp, Homo sapiens
aacccgggaggcggaggttgtg

SEQ ID NO: 56660 - DNA, 22 bp, Homo sapiens
ctggcaggtggaggttgcagtg

SEQ ID NO: 56661 - DNA, 22 bp, Homo sapiens
gcaggaggttgagccaggactg

SEQ ID NO: 56662 - DNA, 22 bp, Homo sapiens
cttgtcagccaattgtggattt

SEQ ID NO: 56663 - DNA, 22 bp, Homo sapiens
agagtgtaccaaatatcctaca

SEQ ID NO: 56664 - DNA, 22 bp, Homo sapiens
ggactgggaatcagggagatgc

SEQ ID NO: 56665 - DNA, 22 bp, Homo sapiens
ctgggaggcggaggttgcagtg

SEQ ID NO: 56666 - DNA, 22 bp, Homo sapiens
gctcccaggatgaggagccagg

SEQ ID NO: 56667 - DNA, 22 bp, Homo sapiens
aagtgattgttccgttgagtgt

SEQ ID NO: 56668 - DNA, 22 bp, Homo sapiens
ttgtcgggcttacgcagggcca

SEQ ID NO: 56669 - DNA, 22 bp, Homo sapiens
aggtaaacaggagaaaatgaga

SEQ ID NO: 56670 - DNA, 22 bp, Homo sapiens
gaattttattactagtcaactg

SEQ ID NO: 56671 - DNA, 22 bp, Homo sapiens
ttacatgtttatgtggtacatg

SEQ ID NO: 56672 - DNA, 22 bp, Homo sapiens
tcctgtgatattgtttgttata

SEQ ID NO: 56673 - DNA, 22 bp, Homo sapiens
tggcactgaagctggaaagcct

SEQ ID NO: 56674 - DNA, 22 bp, Homo sapiens
ggtgctggacacgtggcactcc

SEQ ID NO: 56675 - DNA, 22 bp, Homo sapiens
cccacacacatttatgatagga

SEQ ID NO: 56676 - DNA, 22 bp, Homo sapiens
gtcagtaggaacctagggtcaa

SEQ ID NO: 56677 - DNA, 22 bp, Homo sapiens
gggtccagtagttggtggccgt

SEQ ID NO: 56678 - DNA, 22 bp, Homo sapiens
gggaggcacgaggcgcgcagtg

SEQ ID NO: 56679 - DNA, 22 bp, Homo sapiens
agaggctgcacttgctcatgat

SEQ ID NO: 56680 - DNA, 21 bp, Homo sapiens
tctgatggtagatgagatgtg

SEQ ID NO: 56681 - DNA, 22 bp, Homo sapiens
actgggctcaagtgattgtcct

SEQ ID NO: 56682 - DNA, 22 bp, Homo sapiens
gcggcaggagtaaaggaggaag

SEQ ID NO: 56683 - DNA, 22 bp, Homo sapiens
aggtttctttatgctgctagaa

SEQ ID NO: 56684 - DNA, 22 bp, Homo sapiens
tggtacaatcacagctcactgt

SEQ ID NO: 56685 - DNA, 22 bp, Homo sapiens
gactttctgatgtaaacattta

SEQ ID NO: 56686 - DNA, 22 bp, Homo sapiens
agcctattccaggatgagctca

SEQ ID NO: 56687 - DNA, 22 bp, Homo sapiens
acaggcacctgccaccacatct

SEQ ID NO: 56688 - DNA, 22 bp, Homo sapiens
ggagctcctggcagtgacagag

SEQ ID NO: 56689 - DNA, 22 bp, Homo sapiens
actgggccaggtgtgggtgagt

SEQ ID NO: 56690 - DNA, 22 bp, Homo sapiens
atacagggacatccagtttttc

SEQ ID NO: 56691 - DNA, 22 bp, Homo sapiens
ctggtgtggactccgcgcggag

SEQ ID NO: 56692 - DNA, 22 bp, Homo sapiens
gggcggatcatttgaggtcagg

SEQ ID NO: 56693 - DNA, 20 bp, Homo sapiens
aaaatatgtataactcttct

SEQ ID NO: 56694 - DNA, 22 bp, Homo sapiens
atgtttaaagggttgagaaata

SEQ ID NO: 56695 - DNA, 22 bp, Homo sapiens
atgaggcaggagtgcagtggca

SEQ ID NO: 56696 - DNA, 22 bp, Homo sapiens
caggagctcagatgacatctca

SEQ ID NO: 56697 - DNA, 20 bp, Homo sapiens
ataaaataactgccacaaga

SEQ ID NO: 56698 - DNA, 22 bp, Homo sapiens
tccaccatgtaacaagctctgt

SEQ ID NO: 56699 - DNA, 22 bp, Homo sapiens
acccaggctggcgtgcagtggc

SEQ ID NO: 56700 - DNA, 22 bp, Homo sapiens
gggttcttatagtatcagagct

SEQ ID NO: 56701 - DNA, 22 bp, Homo sapiens
tttggtaagtacccacctgggt

SEQ ID NO: 56702 - DNA, 22 bp, Homo sapiens
tgagagcaacacgcagtagtat

SEQ ID NO: 56703 - DNA, 22 bp, Homo sapiens
gtgacaggccactgcggctctg

SEQ ID NO: 56704 - DNA, 22 bp, Homo sapiens
cacagcctcctctggctcacgg

SEQ ID NO: 56705 - DNA, 22 bp, Homo sapiens
tgggaaggggagctggaaagga

SEQ ID NO: 56706 - DNA, 22 bp, Homo sapiens
ctcctccacccgctggggccca

SEQ ID NO: 56707 - DNA, 22 bp, Homo sapiens
tgcaataactactttaatgttg

SEQ ID NO: 56708 - DNA, 22 bp, Homo sapiens
gtagtctgaacagtaattttgt

SEQ ID NO: 56709 - DNA, 22 bp, Homo sapiens
gtgctggggagataggaagaga

SEQ ID NO: 56710 - DNA, 23 bp, Homo sapiens
agagtgcagagatatgcttgtgt

SEQ ID NO: 56711 - DNA, 22 bp, Homo sapiens
aaatatcttaggagtatatgag

SEQ ID NO: 56712 - DNA, 22 bp, Homo sapiens
gctcagaggcacgacctcttgg

SEQ ID NO: 56713 - DNA, 21 bp, Homo sapiens
ctcccagggtgactgttcaac

SEQ ID NO: 56714 - DNA, 22 bp, Homo sapiens
caaggtgccatgctgggcgggg

SEQ ID NO: 56715 - DNA, 22 bp, Homo sapiens
aagctcctttggctcgagatct

SEQ ID NO: 56716 - DNA, 22 bp, Homo sapiens
ctccccgagagaggttgtccgc

SEQ ID NO: 56717 - DNA, 22 bp, Homo sapiens
aaaatcctgctgactcgagatg

SEQ ID NO: 56718 - DNA, 22 bp, Homo sapiens
ctgaggaggctaatttgaggat

SEQ ID NO: 56719 - DNA, 23 bp, Homo sapiens
actcgtggaattctctgcgatcg

SEQ ID NO: 56720 - DNA, 20 bp, Homo sapiens
aggaaaaatggaaactggag

SEQ ID NO: 56721 - DNA, 22 bp, Homo sapiens
ttggatccatctcaggcatagg

SEQ ID NO: 56722 - DNA, 22 bp, Homo sapiens
aggggatggagctggaaggcag

SEQ ID NO: 56723 - DNA, 22 bp, Homo sapiens
ttcctggtctatttagaattgc

SEQ ID NO: 56724 - DNA, 22 bp, Homo sapiens
gaccaagatacagcatcataga

SEQ ID NO: 56725 - DNA, 22 bp, Homo sapiens
tgaagactcagaagctaagata

SEQ ID NO: 56726 - DNA, 22 bp, Homo sapiens
atttcatactaaggctcaaaaa

SEQ ID NO: 56727 - DNA, 22 bp, Homo sapiens
tagaactaagagttatcattta

SEQ ID NO: 56728 - DNA, 14 bp, Homo sapiens
gcaggcagatcacc

SEQ ID NO: 56729 - DNA, 22 bp, Homo sapiens
gtccagttgtatgtccagtgtc

SEQ ID NO: 56730 - DNA, 22 bp, Homo sapiens
gcctcctggggtgccatcatct

SEQ ID NO: 56731 - DNA, 22 bp, Homo sapiens
atacaatgattggttctcaccc

SEQ ID NO: 56732 - DNA, 22 bp, Homo sapiens
ataatacatggttgatcttttc

SEQ ID NO: 56733 - DNA, 22 bp, Homo sapiens
agcaagatttttcaggttagta

SEQ ID NO: 56734 - DNA, 22 bp, Homo sapiens
gtcatcttgctgttttagatct

SEQ ID NO: 56735 - DNA, 22 bp, Homo sapiens
aggaggcagtctgtcccttagc

SEQ ID NO: 56736 - DNA, 22 bp, Homo sapiens
tgcccagagcctgagaggatta

SEQ ID NO: 56737 - DNA, 22 bp, Homo sapiens
atttacaggtagaattttaagt

SEQ ID NO: 56738 - DNA, 22 bp, Homo sapiens
tttgaaatgtatcagtataggt

SEQ ID NO: 56739 - DNA, 22 bp, Homo sapiens
agctggtgctcggggagctggc

SEQ ID NO: 56740 - DNA, 22 bp, Homo sapiens
ctctcgccagcggggctgcgct

SEQ ID NO: 56741 - DNA, 22 bp, Homo sapiens
ttccacggggctccccgctctt

SEQ ID NO: 56742 - DNA, 22 bp, Homo sapiens
agatgctgctccacaggccagg

SEQ ID NO: 56743 - DNA, 22 bp, Homo sapiens
aggggctcctttgtgctgcgtc

SEQ ID NO: 56744 - DNA, 22 bp, Homo sapiens
gcgggccaccttggagagcgct

SEQ ID NO: 56745 - DNA, 22 bp, Homo sapiens
tgttcctctgaacttcttccaa

SEQ ID NO: 56746 - DNA, 22 bp, Homo sapiens
gctggaggatggactggaagaa

SEQ ID NO: 56747 - DNA, 22 bp, Homo sapiens
agcagcagtatccttccccggc

SEQ ID NO: 56748 - DNA, 22 bp, Homo sapiens
tccaaatgagctctgccttcca

SEQ ID NO: 56749 - DNA, 22 bp, Homo sapiens
ctctgtagaaagagcccaggtg

SEQ ID NO: 56750 - DNA, 22 bp, Homo sapiens
ttgcccagagtcacccagctca

SEQ ID NO: 56751 - DNA, 22 bp, Homo sapiens
caagatcttcctcaatagacct

SEQ ID NO: 56752 - DNA, 22 bp, Homo sapiens
cgagagatgggttggcaggggc

SEQ ID NO: 56753 - DNA, 22 bp, Homo sapiens
atgagaaagttaatcatcatga

SEQ ID NO: 56754 - DNA, 22 bp, Homo sapiens
gagctgggcctgcgagtgctgc

SEQ ID NO: 56755 - DNA, 21 bp, Homo sapiens
ggcaagaaacacaatcaagta

SEQ ID NO: 56756 - DNA, 22 bp, Homo sapiens
cccaggaggtcaaggctgcagt

SEQ ID NO: 56757 - DNA, 22 bp, Homo sapiens
ccactgcactccagccttggca

SEQ ID NO: 56758 - DNA, 22 bp, Homo sapiens
gccctcctgagctagcacgtgt

SEQ ID NO: 56759 - DNA, 22 bp, Homo sapiens
ggtccccccatggtgagcactg

SEQ ID NO: 56760 - DNA, 19 bp, Homo sapiens
cttgaaactactgttgaga

SEQ ID NO: 56761 - DNA, 22 bp, Homo sapiens
agttatgtcctcagcaaatcaa

SEQ ID NO: 56762 - DNA, 22 bp, Homo sapiens
tctgtgctaggcagcctggccc

SEQ ID NO: 56763 - DNA, 22 bp, Homo sapiens
gcaaaagtacagccggatttct

SEQ ID NO: 56764 - DNA, 22 bp, Homo sapiens
aagcagcacagcaatgactcta

SEQ ID NO: 56765 - DNA, 22 bp, Homo sapiens
gagccaggggtcagctccgagg

SEQ ID NO: 56766 - DNA, 22 bp, Homo sapiens
aacactctctgttggtaaggct

SEQ ID NO: 56767 - DNA, 22 bp, Homo sapiens
tcaccagctctgcctcgccagt

SEQ ID NO: 56768 - DNA, 22 bp, Homo sapiens
ccagcatccatgctccctcggg

SEQ ID NO: 56769 - DNA, 22 bp, Homo sapiens
cctggaggcggaggttgcagtg

SEQ ID NO: 56770 - DNA, 22 bp, Homo sapiens
cactgcactccatcctgggaaa

SEQ ID NO: 56771 - DNA, 22 bp, Homo sapiens
acaggatcgccctgttgcccag

SEQ ID NO: 56772 - DNA, 22 bp, Homo sapiens
taatactgtatactgcaaattt

SEQ ID NO: 56773 - DNA, 22 bp, Homo sapiens
gccaggaaagggaattccctga

SEQ ID NO: 56774 - DNA, 22 bp, Homo sapiens
aagtcagacagctgagctgcct

SEQ ID NO: 56775 - DNA, 19 bp, Homo sapiens
ctctgggcaagtcacttaa

SEQ ID NO: 56776 - DNA, 22 bp, Homo sapiens
ggtgacctcacctggtcccacc

SEQ ID NO: 56777 - DNA, 22 bp, Homo sapiens
tccgggaggcagaggttgcagt

SEQ ID NO: 56778 - DNA, 22 bp, Homo sapiens
acccatacacacatatttatgt

SEQ ID NO: 56779 - DNA, 22 bp, Homo sapiens
tagcagtgtctaggtaggccat

SEQ ID NO: 56780 - DNA, 22 bp, Homo sapiens
acggcttcttgactgtgggttg

SEQ ID NO: 56781 - DNA, 22 bp, Homo sapiens
aggccaggaatccttgtcccag

SEQ ID NO: 56782 - DNA, 22 bp, Homo sapiens
tggaaacacccacgcatgcata

SEQ ID NO: 56783 - DNA, 22 bp, Homo sapiens
cagggggctcaaaggagagtgc

SEQ ID NO: 56784 - DNA, 22 bp, Homo sapiens
gcctcctgtcccaggctgagga

SEQ ID NO: 56785 - DNA, 22 bp, Homo sapiens
tctgttgcaatgtgcatggtga

SEQ ID NO: 56786 - DNA, 22 bp, Homo sapiens
tcatggggccacagctgccagc

SEQ ID NO: 56787 - DNA, 22 bp, Homo sapiens
cttctttcaagaatggattagg

SEQ ID NO: 56788 - DNA, 22 bp, Homo sapiens
ttatttaatgtgatctgaagag

SEQ ID NO: 56789 - DNA, 22 bp, Homo sapiens
ctggagagaatgtggaatgatt

SEQ ID NO: 56790 - DNA, 22 bp, Homo sapiens
gaggctgaggttgcagtgagct

SEQ ID NO: 56791 - DNA, 20 bp, Homo sapiens
ctgtggaattttaccatgcg

SEQ ID NO: 56792 - DNA, 22 bp, Homo sapiens
tcatcataatatggaatcttgt

SEQ ID NO: 56793 - DNA, 22 bp, Homo sapiens
gtaatctcagctacttgggagg

SEQ ID NO: 56794 - DNA, 22 bp, Homo sapiens
tgtggaaggggccccatgacca

SEQ ID NO: 56795 - DNA, 22 bp, Homo sapiens
catgcctgcctggtgggcgtgg

SEQ ID NO: 56796 - DNA, 22 bp, Homo sapiens
gtgggggcaggcagtgctagga

SEQ ID NO: 56797 - DNA, 19 bp, Homo sapiens
agagtattgaatttgccct

SEQ ID NO: 56798 - DNA, 22 bp, Homo sapiens
agcccaggtccagttcactgca

SEQ ID NO: 56799 - DNA, 22 bp, Homo sapiens
agggaaattaatgtgagcaatg

SEQ ID NO: 56800 - DNA, 22 bp, Homo sapiens
acatttatataactcactagga

SEQ ID NO: 56801 - DNA, 22 bp, Homo sapiens
tggggagtgatgcctcggataa

SEQ ID NO: 56802 - DNA, 22 bp, Homo sapiens
gtggcccatcacgtttcgcctt

SEQ ID NO: 56803 - DNA, 22 bp, Homo sapiens
attctaaatcagagagctctgt

SEQ ID NO: 56804 - DNA, 22 bp, Homo sapiens
gggctgagacgatggggtcttc

SEQ ID NO: 56805 - DNA, 22 bp, Homo sapiens
acaaacagagttgaaaaatagg

SEQ ID NO: 56806 - DNA, 22 bp, Homo sapiens
tacaagatgacaggtgcatgat

SEQ ID NO: 56807 - DNA, 22 bp, Homo sapiens
tatccaattcaccattgatggg

SEQ ID NO: 56808 - DNA, 22 bp, Homo sapiens
tgttgatttgtgggctgcaaaa

SEQ ID NO: 56809 - DNA, 22 bp, Homo sapiens
actgcactccagcctgggtaac

SEQ ID NO: 56810 - DNA, 22 bp, Homo sapiens
agtcggaagctgtgcgtaaatc

SEQ ID NO: 56811 - DNA, 22 bp, Homo sapiens
ctgcagtatgagctacccaggt

SEQ ID NO: 56812 - DNA, 22 bp, Homo sapiens
aatgttacgatcaacaacacat

SEQ ID NO: 56813 - DNA, 22 bp, Homo sapiens
gaccctgtttctacaaataatt

SEQ ID NO: 56814 - DNA, 22 bp, Homo sapiens
gaaagacatagttgcaagatgg

SEQ ID NO: 56815 - DNA, 22 bp, Homo sapiens
gagatttccatattttgtaaca

SEQ ID NO: 56816 - DNA, 20 bp, Homo sapiens
gtctccactgggggttaacc

SEQ ID NO: 56817 - DNA, 22 bp, Homo sapiens
tggacaacatagtgagacctca

SEQ ID NO: 56818 - DNA, 22 bp, Homo sapiens
acagacaagtagttcagacaag

SEQ ID NO: 56819 - DNA, 22 bp, Homo sapiens
ttcatcttgatggcttcctaat

SEQ ID NO: 56820 - DNA, 22 bp, Homo sapiens
cttagatgaagtcacagaaccc

SEQ ID NO: 56821 - DNA, 22 bp, Homo sapiens
agcctggtttaagcattttata

SEQ ID NO: 56822 - DNA, 22 bp, Homo sapiens
tctaatcctatggtggggaggg

SEQ ID NO: 56823 - DNA, 22 bp, Homo sapiens
ttagctcagaaaatttaaactt

SEQ ID NO: 56824 - DNA, 22 bp, Homo sapiens
ataatacatggttgatcttttc

SEQ ID NO: 56825 - DNA, 22 bp, Homo sapiens
atccaccctgtggtggctttct

SEQ ID NO: 56826 - DNA, 20 bp, Homo sapiens
gtgcaatggctcagtctcag

SEQ ID NO: 56827 - DNA, 22 bp, Homo sapiens
atatgcagtctcttgcccttct

SEQ ID NO: 56828 - DNA, 22 bp, Homo sapiens
tcccagagctctggaggttgga

SEQ ID NO: 56829 - DNA, 21 bp, Homo sapiens
tcctgtaagcttgggtggctc

SEQ ID NO: 56830 - DNA, 22 bp, Homo sapiens
ggagtgactcacagctgggaca

SEQ ID NO: 56831 - DNA, 22 bp, Homo sapiens
gtccaagagtcaagaagggggc

SEQ ID NO: 56832 - DNA, 22 bp, Homo sapiens
gttgaggtgatgccagccctgc

SEQ ID NO: 56833 - DNA, 22 bp, Homo sapiens
catctgctgttccttggactca

SEQ ID NO: 56834 - DNA, 22 bp, Homo sapiens
attaagactgcccatgttttta

SEQ ID NO: 56835 - DNA, 22 bp, Homo sapiens
caatttctaacattccatggat

SEQ ID NO: 56836 - DNA, 22 bp, Homo sapiens
accctcaacaaattcactctat

SEQ ID NO: 56837 - DNA, 22 bp, Homo sapiens
ttaataaagtatgaattggaaa

SEQ ID NO: 56838 - DNA, 22 bp, Homo sapiens
gtaatctcagctacttgggagg

SEQ ID NO: 56839 - DNA, 22 bp, Homo sapiens
tctttctacatcatttgcttct

SEQ ID NO: 56840 - DNA, 22 bp, Homo sapiens
ctcaggagttggaggctacagt

SEQ ID NO: 56841 - DNA, 22 bp, Homo sapiens
tacaaaaaattgatactgacga

SEQ ID NO: 56842 - DNA, 22 bp, Homo sapiens
tgtctcatctcttaaccccact

SEQ ID NO: 56843 - DNA, 22 bp, Homo sapiens
gcggtagctcaagcttgtaatc

SEQ ID NO: 56844 - DNA, 22 bp, Homo sapiens
tgtgcctactgatagagccaag

SEQ ID NO: 56845 - DNA, 22 bp, Homo sapiens
ccggctactcgggaggctgacg

SEQ ID NO: 56846 - DNA, 22 bp, Homo sapiens
agggaaattaatgtgagcaatg

SEQ ID NO: 56847 - DNA, 22 bp, Homo sapiens
ctgtaatcccagctacctggga

SEQ ID NO: 56848 - DNA, 19 bp, Homo sapiens
catggtgaaaccccgtctc

SEQ ID NO: 56849 - DNA, 22 bp, Homo sapiens
ggtggttcacgcctataatccc

SEQ ID NO: 56850 - DNA, 22 bp, Homo sapiens
ttttctgtttgcttcaagacat

SEQ ID NO: 56851 - DNA, 22 bp, Homo sapiens
ctgggcctggggctgttgagag

SEQ ID NO: 56852 - DNA, 22 bp, Homo sapiens
atacaaagtattaatcctggat

SEQ ID NO: 56853 - DNA, 22 bp, Homo sapiens
tccctagtcgcatctgtggaga

SEQ ID NO: 56854 - DNA, 22 bp, Homo sapiens
ggttccccaggcggcccttgga

SEQ ID NO: 56855 - DNA, 22 bp, Homo sapiens
agccaggatggtctcgatcggc

SEQ ID NO: 56856 - DNA, 22 bp, Homo sapiens
ctacattaaattggcttactta

SEQ ID NO: 56857 - DNA, 22 bp, Homo sapiens
tgtaagtagtaatggaaggaca

SEQ ID NO: 56858 - DNA, 23 bp, Homo sapiens
ttgcttagagacctcctcatcag

SEQ ID NO: 56859 - DNA, 22 bp, Homo sapiens
tgagatgaataactcctgctaa

SEQ ID NO: 56860 - DNA, 22 bp, Homo sapiens
ttcttcatgggttcttttagga

SEQ ID NO: 56861 - DNA, 22 bp, Homo sapiens
aagactgtgtctatggctactc

SEQ ID NO: 56862 - DNA, 22 bp, Homo sapiens
ataaaaactgacccatcctttg

SEQ ID NO: 56863 - DNA, 22 bp, Homo sapiens
atacctgtgtatccacaagcgt

SEQ ID NO: 56864 - DNA, 22 bp, Homo sapiens
caatagtaaattacggaggaga

SEQ ID NO: 56865 - DNA, 22 bp, Homo sapiens
ctgtaatcccagctactcggga

SEQ ID NO: 56866 - DNA, 21 bp, Homo sapiens
tgcaatccagcctgggcgaca

SEQ ID NO: 56867 - DNA, 22 bp, Homo sapiens
aaagttctctatggtgtaaaaa

SEQ ID NO: 56868 - DNA, 22 bp, Homo sapiens
gtgttaaccagctaaactttgc

SEQ ID NO: 56869 - DNA, 22 bp, Homo sapiens
cctgcttaacattgccatgaca

SEQ ID NO: 56870 - DNA, 22 bp, Homo sapiens
ttgtcttttgtgggaaatatgg

SEQ ID NO: 56871 - DNA, 22 bp, Homo sapiens
ttccagctaactcacatccctt

SEQ ID NO: 56872 - DNA, 22 bp, Homo sapiens
ttctagtgtccttggacttgct

SEQ ID NO: 56873 - DNA, 22 bp, Homo sapiens
ggttccacctggcgaggggtat

SEQ ID NO: 56874 - DNA, 22 bp, Homo sapiens
ttcatagtgtttccttccagtg

SEQ ID NO: 56875 - DNA, 22 bp, Homo sapiens
actgcactcctgcctgggtaac

SEQ ID NO: 56876 - DNA, 22 bp, Homo sapiens
tggctaacaaggtgaaaccccg

SEQ ID NO: 56877 - DNA, 22 bp, Homo sapiens
tactgtactgcagttctgcaaa

SEQ ID NO: 56878 - DNA, 22 bp, Homo sapiens
agaaaatttaaagagacacaca

SEQ ID NO: 56879 - DNA, 16 bp, Homo sapiens
tgggtgggaggagcgg

SEQ ID NO: 56880 - DNA, 22 bp, Homo sapiens
tgagccatgggactccaaggga

SEQ ID NO: 56881 - DNA, 22 bp, Homo sapiens
ctgattgagaaggaaggggatc

SEQ ID NO: 56882 - DNA, 22 bp, Homo sapiens
ctgccaggattctgtgaacccc

SEQ ID NO: 56883 - DNA, 22 bp, Homo sapiens
aagtgctgggattataggcatg

SEQ ID NO: 56884 - DNA, 22 bp, Homo sapiens
tctgctctgtggcttcagctaa

SEQ ID NO: 56885 - DNA, 22 bp, Homo sapiens
aaaagttattgatgcaggacaa

SEQ ID NO: 56886 - DNA, 22 bp, Homo sapiens
aggtaaatgtcagagcctttaa

SEQ ID NO: 56887 - DNA, 22 bp, Homo sapiens
tggaatgcagtgggagcttacc

SEQ ID NO: 56888 - DNA, 22 bp, Homo sapiens
aagcccttggcgcacaccgggc

SEQ ID NO: 56889 - DNA, 22 bp, Homo sapiens
tgtctgcctgcgggccggcaca

SEQ ID NO: 56890 - DNA, 22 bp, Homo sapiens
tatctgatacaacagaataaca

SEQ ID NO: 56891 - DNA, 22 bp, Homo sapiens
aagatgcggttgaccatggtgt

SEQ ID NO: 56892 - DNA, 22 bp, Homo sapiens
tgaccactgtagccacttaaga

SEQ ID NO: 56893 - DNA, 22 bp, Homo sapiens
ttggcttttatgcagcttaggt

SEQ ID NO: 56894 - DNA, 22 bp, Homo sapiens
aaatgcacaaagattttgcact

SEQ ID NO: 56895 - DNA, 22 bp, Homo sapiens
cttaattggcttatttcctcaa

SEQ ID NO: 56896 - DNA, 22 bp, Homo sapiens
tcactgcaatctcagcctcctg

SEQ ID NO: 56897 - DNA, 22 bp, Homo sapiens
tttcccagcctcagctcagcag

SEQ ID NO: 56898 - DNA, 22 bp, Homo sapiens
agaggaggctctgggatcgtcc

SEQ ID NO: 56899 - DNA, 22 bp, Homo sapiens
ggggccgaccgcggttcaggcc

SEQ ID NO: 56900 - DNA, 22 bp, Homo sapiens
tgccctctttctgtacagctcc

SEQ ID NO: 56901 - DNA, 22 bp, Homo sapiens
ggctagggatctagaccaggac

SEQ ID NO: 56902 - DNA, 22 bp, Homo sapiens
atggagttctgccagcgctgct

SEQ ID NO: 56903 - DNA, 17 bp, Homo sapiens
tgcatgtcctttgttcc

SEQ ID NO: 56904 - DNA, 22 bp, Homo sapiens
agtggagacaggacagtcgata

SEQ ID NO: 56905 - DNA, 22 bp, Homo sapiens
ctgcatccatgttgctgcaaag

SEQ ID NO: 56906 - DNA, 22 bp, Homo sapiens
cactgcactccagcttgggcaa

SEQ ID NO: 56907 - DNA, 22 bp, Homo sapiens
ctggagagaatgtggaatgatt

SEQ ID NO: 56908 - DNA, 22 bp, Homo sapiens
aaacttttttaggttcataggc

SEQ ID NO: 56909 - DNA, 22 bp, Homo sapiens
gatctggaatctgaaggctgag

SEQ ID NO: 56910 - DNA, 22 bp, Homo sapiens
cctcagctcccatgagatctgc

SEQ ID NO: 56911 - DNA, 22 bp, Homo sapiens
tttctcttcactgtgtgcctca

SEQ ID NO: 56912 - DNA, 20 bp, Homo sapiens
tttgagaccagtctgcccaa

SEQ ID NO: 56913 - DNA, 21 bp, Homo sapiens
agctgcctccacttctgaggc

SEQ ID NO: 56914 - DNA, 22 bp, Homo sapiens
aggtggagaagagatgggcagt

SEQ ID NO: 56915 - DNA, 21 bp, Homo sapiens
taaacataaccttgtatggct

SEQ ID NO: 56916 - DNA, 22 bp, Homo sapiens
gtcccctgtccagggccagcca

SEQ ID NO: 56917 - DNA, 22 bp, Homo sapiens
tgaggcaggagaatcaccggaa

SEQ ID NO: 56918 - DNA, 22 bp, Homo sapiens
ccctcaggtgaaaggaaaaatt

SEQ ID NO: 56919 - DNA, 22 bp, Homo sapiens
ccctgttgggaagagagatggc

SEQ ID NO: 56920 - DNA, 22 bp, Homo sapiens
cactgcactccagcctcggtga

SEQ ID NO: 56921 - DNA, 22 bp, Homo sapiens
ggtcaggagcccttggccccct

SEQ ID NO: 56922 - DNA, 22 bp, Homo sapiens
aggaaaatggaccagagttgtt

SEQ ID NO: 56923 - DNA, 22 bp, Homo sapiens
agagagcccgggccagggcaca

SEQ ID NO: 56924 - DNA, 22 bp, Homo sapiens
tcacccaggctggagtgtagtg

SEQ ID NO: 56925 - DNA, 22 bp, Homo sapiens
gacaggaggcagagctcaggtg

SEQ ID NO: 56926 - DNA, 22 bp, Homo sapiens
cccacacacatttatgatagga

SEQ ID NO: 56927 - DNA, 22 bp, Homo sapiens
cactctgcagctgaagggctgg

SEQ ID NO: 56928 - DNA, 22 bp, Homo sapiens
gcaagacctatctagttgctgt

SEQ ID NO: 56929 - DNA, 20 bp, Homo sapiens
caagggtttgcattggcttt

SEQ ID NO: 56930 - DNA, 22 bp, Homo sapiens
taccagggaacagggatattaa

SEQ ID NO: 56931 - DNA, 19 bp, Homo sapiens
tccaaagaagttcacattt

SEQ ID NO: 56932 - DNA, 22 bp, Homo sapiens
caggaaggggctcactctggcc

SEQ ID NO: 56933 - DNA, 22 bp, Homo sapiens
agggccagcactcctggcagga

SEQ ID NO: 56934 - DNA, 22 bp, Homo sapiens
ctgatctcaagtgatccaccca

SEQ ID NO: 56935 - DNA, 22 bp, Homo sapiens
ctgctttgcatagctgccagag

SEQ ID NO: 56936 - DNA, 22 bp, Homo sapiens
gagtggggggtccgtctcagtg

SEQ ID NO: 56937 - DNA, 22 bp, Homo sapiens
tagcacagcttcttgatgtcac

SEQ ID NO: 56938 - DNA, 22 bp, Homo sapiens
ccttcccatgcagcctgtctga

SEQ ID NO: 56939 - DNA, 18 bp, Homo sapiens
ccgggctttggtgacaca

SEQ ID NO: 56940 - DNA, 22 bp, Homo sapiens
gcggggggcaggcagtacgttg

SEQ ID NO: 56941 - DNA, 22 bp, Homo sapiens
aagttactggcaagggctgcag

SEQ ID NO: 56942 - DNA, 20 bp, Homo sapiens
tgtcattcttctttcacagg

SEQ ID NO: 56943 - DNA, 22 bp, Homo sapiens
tcctcggctgggccccaggctt

SEQ ID NO: 56944 - DNA, 22 bp, Homo sapiens
tgggaagctgcattttaacaag

SEQ ID NO: 56945 - DNA, 22 bp, Homo sapiens
cactgcactccagcctgggtga

SEQ ID NO: 56946 - DNA, 22 bp, Homo sapiens
tgcgttgcgctcctgcagcagg

SEQ ID NO: 56947 - DNA, 22 bp, Homo sapiens
aaggccctggcaggaagcagga

SEQ ID NO: 56948 - DNA, 22 bp, Homo sapiens
tttcaggacacctttaaaaacg

SEQ ID NO: 56949 - DNA, 22 bp, Homo sapiens
tgtgttgtgacattcttggatg

SEQ ID NO: 56950 - DNA, 22 bp, Homo sapiens
agctttacctgccttggggcac

SEQ ID NO: 56951 - DNA, 22 bp, Homo sapiens
ggcctggcagagcgcgcggctg

SEQ ID NO: 56952 - DNA, 22 bp, Homo sapiens
tcaaatgttccctgtactggcc

SEQ ID NO: 56953 - DNA, 22 bp, Homo sapiens
cctcacctcagtctgggcctca

SEQ ID NO: 56954 - DNA, 22 bp, Homo sapiens
gcccagctgcaccctggtgggt

SEQ ID NO: 56955 - DNA, 22 bp, Homo sapiens
agaagcattggaccaggggccc

SEQ ID NO: 56956 - DNA, 22 bp, Homo sapiens
ttttctaacatctagtaatttg

SEQ ID NO: 56957 - DNA, 22 bp, Homo sapiens
cttctgagatgttgttttacag

SEQ ID NO: 56958 - DNA, 22 bp, Homo sapiens
tgctgagcgcatccggcggccg

SEQ ID NO: 56959 - DNA, 22 bp, Homo sapiens
tggaagctcaaggcagggtgag

SEQ ID NO: 56960 - DNA, 22 bp, Homo sapiens
ctccaggctcgtccaagatcga

SEQ ID NO: 56961 - DNA, 22 bp, Homo sapiens
ttggagtgacagatgaggaaac

SEQ ID NO: 56962 - DNA, 22 bp, Homo sapiens
gcccttacagggtggtcagcca

SEQ ID NO: 56963 - DNA, 20 bp, Homo sapiens
taagcatagttgtcagggtc

SEQ ID NO: 56964 - DNA, 22 bp, Homo sapiens
ttttcatttttgtagatgcaag

SEQ ID NO: 56965 - DNA, 22 bp, Homo sapiens
gcagggtctgaggccacagagg

SEQ ID NO: 56966 - DNA, 22 bp, Homo sapiens
cttttcattgtttgtacatgca

SEQ ID NO: 56967 - DNA, 22 bp, Homo sapiens
gaggtgggcggatcacaaggtc

SEQ ID NO: 56968 - DNA, 22 bp, Homo sapiens
gatgctgagaggtggagggaac

SEQ ID NO: 56969 - DNA, 21 bp, Homo sapiens
aaactgaccttgcctgagaca

SEQ ID NO: 56970 - DNA, 22 bp, Homo sapiens
tgagctgtgtcttggtgagagt

SEQ ID NO: 56971 - DNA, 22 bp, Homo sapiens
ttatcacttatgagctttttgc

SEQ ID NO: 56972 - DNA, 22 bp, Homo sapiens
cctgggccctcaccgccggtgg

SEQ ID NO: 56973 - DNA, 22 bp, Homo sapiens
tccttgtaaaggagctctaaca

SEQ ID NO: 56974 - DNA, 22 bp, Homo sapiens
ccagcatccatgctccctcggg

SEQ ID NO: 56975 - DNA, 22 bp, Homo sapiens
aactcactttgtggcttctgaa

SEQ ID NO: 56976 - DNA, 22 bp, Homo sapiens
ccccgaggctggagtgcagtgg

SEQ ID NO: 56977 - DNA, 22 bp, Homo sapiens
aggagctgtcagagtgccagag

SEQ ID NO: 56978 - DNA, 22 bp, Homo sapiens
cctccccacagcccaggagact

SEQ ID NO: 56979 - DNA, 22 bp, Homo sapiens
gctgtatgtgaggccacagtga

SEQ ID NO: 56980 - DNA, 19 bp, Homo sapiens
cgcctggcaggccctgcgc

SEQ ID NO: 56981 - DNA, 22 bp, Homo sapiens
tgatgggaggtgctgcaggacc

SEQ ID NO: 56982 - DNA, 22 bp, Homo sapiens
atgtaaactactgactacacta

SEQ ID NO: 56983 - DNA, 22 bp, Homo sapiens
acaaagtgctgacattacaggc

SEQ ID NO: 56984 - DNA, 22 bp, Homo sapiens
gggaggttctgttcgcacttga

SEQ ID NO: 56985 - DNA, 22 bp, Homo sapiens
tgaccaatactgtggatgccag

SEQ ID NO: 56986 - DNA, 22 bp, Homo sapiens
ccaaagtgctaggattacaggt

SEQ ID NO: 56987 - DNA, 22 bp, Homo sapiens
aagagactgtaaaggcgtgagt

SEQ ID NO: 56988 - DNA, 22 bp, Homo sapiens
aattttctggtgtgtaatgaag

SEQ ID NO: 56989 - DNA, 22 bp, Homo sapiens
caggttggagatctgtctatgg

SEQ ID NO: 56990 - DNA, 22 bp, Homo sapiens
ggaggggatttagtagatgcta

SEQ ID NO: 56991 - DNA, 22 bp, Homo sapiens
gctaggttggggaagttctcct

SEQ ID NO: 56992 - DNA, 22 bp, Homo sapiens
ttgcttgggctggagtgcaatg

SEQ ID NO: 56993 - DNA, 22 bp, Homo sapiens
ttcaaatgatggcagtcctggc

SEQ ID NO: 56994 - DNA, 22 bp, Homo sapiens
cagtggcgtgatctctgctcac

SEQ ID NO: 56995 - DNA, 22 bp, Homo sapiens
gacctccgtgtacacctcccag

SEQ ID NO: 56996 - DNA, 22 bp, Homo sapiens
tgtctattaattccacataaaa

SEQ ID NO: 56997 - DNA, 22 bp, Homo sapiens
ccagagctgattcctgggactt

SEQ ID NO: 56998 - DNA, 22 bp, Homo sapiens
gggaagagggagctggaatgat

SEQ ID NO: 56999 - DNA, 22 bp, Homo sapiens
actcccttggtggagaatgcaa

SEQ ID NO: 57000 - DNA, 22 bp, Homo sapiens
tcactgcaacctctgcctcttg

SEQ ID NO: 57001 - DNA, 22 bp, Homo sapiens
caaggtgccatgctgggcgggg

SEQ ID NO: 57002 - DNA, 22 bp, Homo sapiens
tgtgaagaattaatgtgaatca

SEQ ID NO: 57003 - DNA, 22 bp, Homo sapiens
aagtcgtggcaggcttgcacga

SEQ ID NO: 57004 - DNA, 22 bp, Homo sapiens
cagtcacaagcgtacctaattt

SEQ ID NO: 57005 - DNA, 22 bp, Homo sapiens
atcatgacatacttttgagaag

SEQ ID NO: 57006 - DNA, 22 bp, Homo sapiens
gaccttgtgatctgcccacctt

SEQ ID NO: 57007 - DNA, 22 bp, Homo sapiens
agctggtgctcggggagctggc

SEQ ID NO: 57008 - DNA, 22 bp, Homo sapiens
agaggccggccgagcccatggg

SEQ ID NO: 57009 - DNA, 22 bp, Homo sapiens
cagcagcccacgcgtgctgtcc

SEQ ID NO: 57010 - DNA, 22 bp, Homo sapiens
agggcagagctgtctaaatggc

SEQ ID NO: 57011 - DNA, 22 bp, Homo sapiens
acgtggcggccgccgtgagcgg

SEQ ID NO: 57012 - DNA, 22 bp, Homo sapiens
tgtcacagtttgtactttatag

SEQ ID NO: 57013 - DNA, 22 bp, Homo sapiens
ttccacattccttacattcata

SEQ ID NO: 57014 - DNA, 22 bp, Homo sapiens
tgcagtggcgccatctcagctc

SEQ ID NO: 57015 - DNA, 22 bp, Homo sapiens
acaaacagagttgaaaaatagg

SEQ ID NO: 57016 - DNA, 22 bp, Homo sapiens
aagcttcctgcatgggactgct

SEQ ID NO: 57017 - DNA, 22 bp, Homo sapiens
ttaagtaacttgtccaaatgag

SEQ ID NO: 57018 - DNA, 22 bp, Homo sapiens
tgatgaccgccaacgtttaggt

SEQ ID NO: 57019 - DNA, 22 bp, Homo sapiens
gagaaatatggctcagttccac

SEQ ID NO: 57020 - DNA, 22 bp, Homo sapiens
ccctgtgggaactcctgagttg

SEQ ID NO: 57021 - DNA, 22 bp, Homo sapiens
aatcacttagaacccaggaagt

SEQ ID NO: 57022 - DNA, 22 bp, Homo sapiens
tgggtggcagcttcagcatgtt

SEQ ID NO: 57023 - DNA, 21 bp, Homo sapiens
acagcctccatctcctgggct

SEQ ID NO: 57024 - DNA, 22 bp, Homo sapiens
tgagctgtctgaatggtgagga

SEQ ID NO: 57025 - DNA, 22 bp, Homo sapiens
aagaggttgtctgtgatgagtt

SEQ ID NO: 57026 - DNA, 22 bp, Homo sapiens
acgatgatgaaagagaacattc

SEQ ID NO: 57027 - DNA, 22 bp, Homo sapiens
tgtgagttcttagaaagtcagt

SEQ ID NO: 57028 - DNA, 22 bp, Homo sapiens
tgagagcctgtgttcaaatgcc

SEQ ID NO: 57029 - DNA, 22 bp, Homo sapiens
ttaggctgttcttgtgttgtta

SEQ ID NO: 57030 - DNA, 20 bp, Homo sapiens
tgtttgtgtggggccttggc

SEQ ID NO: 57031 - DNA, 22 bp, Homo sapiens
gcaggcagaggtggaggagaca

SEQ ID NO: 57032 - DNA, 20 bp, Homo sapiens
tttgaatgtaaagcatgtca

SEQ ID NO: 57033 - DNA, 22 bp, Homo sapiens
gattgcgtctgtgtcaccttca

SEQ ID NO: 57034 - DNA, 22 bp, Homo sapiens
acccacgaagatgagcggcatg

SEQ ID NO: 57035 - DNA, 22 bp, Homo sapiens
gagatgggcgagaaggtggact

SEQ ID NO: 57036 - DNA, 18 bp, Homo sapiens
gcagctagccaggggggc

SEQ ID NO: 57037 - DNA, 22 bp, Homo sapiens
agtcttcccagaggaggtgcca

SEQ ID NO: 57038 - DNA, 22 bp, Homo sapiens
cctgtcataatgtccgatgtca

SEQ ID NO: 57039 - DNA, 22 bp, Homo sapiens
atttcccagggcctgggatttg

SEQ ID NO: 57040 - DNA, 22 bp, Homo sapiens
agaaatatgctgattagatgaa

SEQ ID NO: 57041 - DNA, 22 bp, Homo sapiens
gcagaagcacaggtgacgggcc

SEQ ID NO: 57042 - DNA, 22 bp, Homo sapiens
tgccaggcgtggtggtgcgcac

SEQ ID NO: 57043 - DNA, 22 bp, Homo sapiens
tttatagtagcatgatttataa

SEQ ID NO: 57044 - DNA, 22 bp, Homo sapiens
ctgaatccacacaaggtgatgg

SEQ ID NO: 57045 - DNA, 22 bp, Homo sapiens
taacagtatatttaccaaacct

SEQ ID NO: 57046 - DNA, 22 bp, Homo sapiens
tagactggtgaattagggggaa

SEQ ID NO: 57047 - DNA, 22 bp, Homo sapiens
tgtgttcagaatttgctgcttt

SEQ ID NO: 57048 - DNA, 22 bp, Homo sapiens
ttgggctgaaccctgcagctga

SEQ ID NO: 57049 - DNA, 22 bp, Homo sapiens
tggcctcggcatccagcaagag

SEQ ID NO: 57050 - DNA, 19 bp, Homo sapiens
cccaggaagcggaggttgc

SEQ ID NO: 57051 - DNA, 22 bp, Homo sapiens
ggctgatgggcatgagctgtca

SEQ ID NO: 57052 - DNA, 22 bp, Homo sapiens
ttgaccactgaatggttctgaa

SEQ ID NO: 57053 - DNA, 22 bp, Homo sapiens
tcttagaaattccccagtggct

SEQ ID NO: 57054 - DNA, 22 bp, Homo sapiens
gttccaggtggtcacagagctc

SEQ ID NO: 57055 - DNA, 22 bp, Homo sapiens
cctgcttaacattgccatgaca

SEQ ID NO: 57056 - DNA, 20 bp, Homo sapiens
gctctgtggtttgagtctcc

SEQ ID NO: 57057 - DNA, 22 bp, Homo sapiens
ctgtcctggggaaagccagccc

SEQ ID NO: 57058 - DNA, 21 bp, Homo sapiens
gttcaaatcctgacactacac

SEQ ID NO: 57059 - DNA, 22 bp, Homo sapiens
ttacactttaaatccagcttgt

SEQ ID NO: 57060 - DNA, 22 bp, Homo sapiens
gctgatagactgaatgttggga

SEQ ID NO: 57061 - DNA, 22 bp, Homo sapiens
ccggctcggcgaccaggctgaa

SEQ ID NO: 57062 - DNA, 22 bp, Homo sapiens
gagccaggggtcagctccgagg

SEQ ID NO: 57063 - DNA, 21 bp, Homo sapiens
gttcttgcaggatttccttcc

SEQ ID NO: 57064 - DNA, 22 bp, Homo sapiens
tatgttgcaccaacctaataat

SEQ ID NO: 57065 - DNA, 22 bp, Homo sapiens
ttgagggtctggatctgctgct

SEQ ID NO: 57066 - DNA, 22 bp, Homo sapiens
cacccaggcaaggattctgcaa

SEQ ID NO: 57067 - DNA, 22 bp, Homo sapiens
ctgctgtttctcaaaattaagt

SEQ ID NO: 57068 - DNA, 22 bp, Homo sapiens
tgctccagcaccaagagctcca

SEQ ID NO: 57069 - DNA, 22 bp, Homo sapiens
gtgcatgtgtctttatagtagc

SEQ ID NO: 57070 - DNA, 22 bp, Homo sapiens
gggagaggttacccgagcaact

SEQ ID NO: 57071 - DNA, 22 bp, Homo sapiens
ccacagtcctggcttctgtctg

SEQ ID NO: 57072 - DNA, 22 bp, Homo sapiens
agagcacagccaccatttacaa

SEQ ID NO: 57073 - DNA, 22 bp, Homo sapiens
ctgctttggacaactattcttg

SEQ ID NO: 57074 - DNA, 22 bp, Homo sapiens
gccccagcctcccgagtagctg

SEQ ID NO: 57075 - DNA, 22 bp, Homo sapiens
gatatcatgggaaggtgtactt

SEQ ID NO: 57076 - DNA, 22 bp, Homo sapiens
tcagtgatttctggggtgaggg

SEQ ID NO: 57077 - DNA, 22 bp, Homo sapiens
aagaggtagcagtcacaaaaga

SEQ ID NO: 57078 - DNA, 22 bp, Homo sapiens
tgcctaggctggagtgcaatgg

SEQ ID NO: 57079 - DNA, 22 bp, Homo sapiens
ctcccagccttcgccagtctga

SEQ ID NO: 57080 - DNA, 22 bp, Homo sapiens
cccgggttgtccgcgcgtccgg

SEQ ID NO: 57081 - DNA, 22 bp, Homo sapiens
gcctgtgtggatgcgccggtgc

SEQ ID NO: 57082 - DNA, 22 bp, Homo sapiens
ggaggcagaatagagtgtgggt

SEQ ID NO: 57083 - DNA, 22 bp, Homo sapiens
cccaggagttagaggttgtggt

SEQ ID NO: 57084 - DNA, 22 bp, Homo sapiens
cactgcaacctccacctcctgg

SEQ ID NO: 57085 - DNA, 22 bp, Homo sapiens
tatattgagatttgagcattgt

SEQ ID NO: 57086 - DNA, 22 bp, Homo sapiens
accgcagtgacgtgggacttcc

SEQ ID NO: 57087 - DNA, 22 bp, Homo sapiens
aaggaggttatcccagtggact

SEQ ID NO: 57088 - DNA, 20 bp, Homo sapiens
acgcacacgcgggggcgtgc

SEQ ID NO: 57089 - DNA, 22 bp, Homo sapiens
cgcccaggctggagtgcagtga

SEQ ID NO: 57090 - DNA, 21 bp, Homo sapiens
tctcttcctccgcgccgccgc

SEQ ID NO: 57091 - DNA, 22 bp, Homo sapiens
gccgtccacctcgatggccact

SEQ ID NO: 57092 - DNA, 22 bp, Homo sapiens
tctgacattttgagaatgacat

SEQ ID NO: 57093 - DNA, 22 bp, Homo sapiens
catgagatctgcagggatgggc

SEQ ID NO: 57094 - DNA, 22 bp, Homo sapiens
cccagggagagcgcggaggcgg

SEQ ID NO: 57095 - DNA, 22 bp, Homo sapiens
tcagccagccagctacaggctt

SEQ ID NO: 57096 - DNA, 22 bp, Homo sapiens
gagggagggactagcattctct

SEQ ID NO: 57097 - DNA, 22 bp, Homo sapiens
ccggagtgtctggcctgctggg

SEQ ID NO: 57098 - DNA, 22 bp, Homo sapiens
cgggcaaggcgagactaggccc

SEQ ID NO: 57099 - DNA, 22 bp, Homo sapiens
agacacttcatgtaagtggaat

SEQ ID NO: 57100 - DNA, 22 bp, Homo sapiens
cacccaggctggagtgcagtgg

SEQ ID NO: 57101 - DNA, 22 bp, Homo sapiens
aaggtgggtggatcacgaggtc

SEQ ID NO: 57102 - DNA, 22 bp, Homo sapiens
aggacaaaggaccagatctgga

SEQ ID NO: 57103 - DNA, 22 bp, Homo sapiens
agatcacagtggcaactccctt

SEQ ID NO: 57104 - DNA, 22 bp, Homo sapiens
aggcaaggtgctacagacagtg

SEQ ID NO: 57105 - DNA, 22 bp, Homo sapiens
tcttcacgccaagtgcccctca

SEQ ID NO: 57106 - DNA, 22 bp, Homo sapiens
tacccaaggccctttcaatttc

SEQ ID NO: 57107 - DNA, 22 bp, Homo sapiens
ctttggcaatgtcattttcaat

SEQ ID NO: 57108 - DNA, 22 bp, Homo sapiens
gcaagacatgtctaaggtttaa

SEQ ID NO: 57109 - DNA, 22 bp, Homo sapiens
tgacttgtctctttgggagaca

SEQ ID NO: 57110 - DNA, 22 bp, Homo sapiens
taaggcaggaactggctgtttt

SEQ ID NO: 57111 - DNA, 19 bp, Homo sapiens
aggcttcaggccacatgct

SEQ ID NO: 57112 - DNA, 22 bp, Homo sapiens
tggcactgagcagccgcggcag

SEQ ID NO: 57113 - DNA, 22 bp, Homo sapiens
gtctctatcatagctgaaccct

SEQ ID NO: 57114 - DNA, 22 bp, Homo sapiens
aacagctttgtatacagtaact

SEQ ID NO: 57115 - DNA, 22 bp, Homo sapiens
agcccaggctggagtgcagtgg

SEQ ID NO: 57116 - DNA, 22 bp, Homo sapiens
tattgacagtgactattggtag

SEQ ID NO: 57117 - DNA, 22 bp, Homo sapiens
cactgggcgtgtcctgggtgag

SEQ ID NO: 57118 - DNA, 22 bp, Homo sapiens
aagattttcagtgcctaaaaca

SEQ ID NO: 57119 - DNA, 22 bp, Homo sapiens
gcacatgaggctgtctttgtct

SEQ ID NO: 57120 - DNA, 22 bp, Homo sapiens
cactgcccaccaagtggctggt

SEQ ID NO: 57121 - DNA, 22 bp, Homo sapiens
cctgattcagtggtgcccagag

SEQ ID NO: 57122 - DNA, 22 bp, Homo sapiens
agacagggtgatcgcttgagcc

SEQ ID NO: 57123 - DNA, 22 bp, Homo sapiens
ccatgaattcactccatgctag

SEQ ID NO: 57124 - DNA, 22 bp, Homo sapiens
atatattttttgagacagagtc

SEQ ID NO: 57125 - DNA, 22 bp, Homo sapiens
tgtgaaagatactaggcagagg

SEQ ID NO: 57126 - DNA, 22 bp, Homo sapiens
ctggcaagaaatatatatctta

SEQ ID NO: 57127 - DNA, 23 bp, Homo sapiens
agctctgctcgggcatgccctgc

SEQ ID NO: 57128 - DNA, 22 bp, Homo sapiens
ggccaattccaggagccggcgg

SEQ ID NO: 57129 - DNA, 22 bp, Homo sapiens
tgctggaagggtcggcgtgggc

SEQ ID NO: 57130 - DNA, 22 bp, Homo sapiens
gagcctggagctggaacgaagc

SEQ ID NO: 57131 - DNA, 22 bp, Homo sapiens
ccggcgaccgctgtcggaggcg

SEQ ID NO: 57132 - DNA, 22 bp, Homo sapiens
aagctgcagcacagagaggtgg

SEQ ID NO: 57133 - DNA, 22 bp, Homo sapiens
gcagcagtgctttggaatcctg

SEQ ID NO: 57134 - DNA, 22 bp, Homo sapiens
ggtgacggggcccaggtttcct

SEQ ID NO: 57135 - DNA, 22 bp, Homo sapiens
gtggggtagatctttctcagga

SEQ ID NO: 57136 - DNA, 22 bp, Homo sapiens
tgggaagaggagcactggaatg

SEQ ID NO: 57137 - DNA, 22 bp, Homo sapiens
tatcagcgtgcaaatctttgga

SEQ ID NO: 57138 - DNA, 20 bp, Homo sapiens
tttcttgtcggctgttgctg

SEQ ID NO: 57139 - DNA, 22 bp, Homo sapiens
gcctcaaatgtggagcactatt

SEQ ID NO: 57140 - DNA, 22 bp, Homo sapiens
ctgaggtgtgaaatggtggcaa

SEQ ID NO: 57141 - DNA, 22 bp, Homo sapiens
cgctgcagaagcgtgttcagga

SEQ ID NO: 57142 - DNA, 23 bp, Homo sapiens
tgagtgtgaaaatcctggagatg

SEQ ID NO: 57143 - DNA, 22 bp, Homo sapiens
tcctcctgtctaccagttcctg

SEQ ID NO: 57144 - DNA, 22 bp, Homo sapiens
aggctcagatccttgtgtcctg

SEQ ID NO: 57145 - DNA, 22 bp, Homo sapiens
cctggcaggtggcgccctcggc

SEQ ID NO: 57146 - DNA, 22 bp, Homo sapiens
gaatatcccgctatgcaaagta

SEQ ID NO: 57147 - DNA, 19 bp, Homo sapiens
atcccaaggagctgggact

SEQ ID NO: 57148 - DNA, 22 bp, Homo sapiens
tggagacacaggaccagactgc

SEQ ID NO: 57149 - DNA, 22 bp, Homo sapiens
aaaggctttaaaatgtacatat

SEQ ID NO: 57150 - DNA, 23 bp, Homo sapiens
ccagtgattgcctggaaggaggt

SEQ ID NO: 57151 - DNA, 22 bp, Homo sapiens
tccgggcaactgaagggaggtt

SEQ ID NO: 57152 - DNA, 22 bp, Homo sapiens
aaaagtaattgtggtttttgct

SEQ ID NO: 57153 - DNA, 22 bp, Homo sapiens
gtcgtggagctcacagtgtgcc

SEQ ID NO: 57154 - DNA, 19 bp, Homo sapiens
gcagacaggtccagagagg

SEQ ID NO: 57155 - DNA, 21 bp, Homo sapiens
agatcctggggtctggggagg

SEQ ID NO: 57156 - DNA, 22 bp, Homo sapiens
cacccaggctggagagcagtgg

SEQ ID NO: 57157 - DNA, 22 bp, Homo sapiens
tgtggggatcttctagcttttc

SEQ ID NO: 57158 - DNA, 22 bp, Homo sapiens
gcggcccgagcaggacgggtgg

SEQ ID NO: 57159 - DNA, 22 bp, Homo sapiens
gatcctgggcccttctgggtca

SEQ ID NO: 57160 - DNA, 23 bp, Homo sapiens
ttgcttagagacctcctcatcag

SEQ ID NO: 57161 - DNA, 22 bp, Homo sapiens
gaattcttttctttctgaaagt

SEQ ID NO: 57162 - DNA, 22 bp, Homo sapiens
ccagggtggcgtagatgctggg

SEQ ID NO: 57163 - DNA, 22 bp, Homo sapiens
gtagctctgtttaaagttcttt

SEQ ID NO: 57164 - DNA, 22 bp, Homo sapiens
gggcagagactcagaaacagaa

SEQ ID NO: 57165 - DNA, 22 bp, Homo sapiens
caaatgtataaatgtactttct

SEQ ID NO: 57166 - DNA, 22 bp, Homo sapiens
gctgcagtgagccaagatcgtg

SEQ ID NO: 57167 - DNA, 22 bp, Homo sapiens
tttctggcagcgggacaggggt

SEQ ID NO: 57168 - DNA, 22 bp, Homo sapiens
ggtcccaggttgacagggagac

SEQ ID NO: 57169 - DNA, 22 bp, Homo sapiens
tgatcaaaacattactccacca

SEQ ID NO: 57170 - DNA, 22 bp, Homo sapiens
ttctccgctaagttctctgcag

SEQ ID NO: 57171 - DNA, 22 bp, Homo sapiens
ttggaggcaatgggaaggaggc

SEQ ID NO: 57172 - DNA, 22 bp, Homo sapiens
gagaaagcttctttcccacagg

SEQ ID NO: 57173 - DNA, 21 bp, Homo sapiens
tggtacaccttgcctgtcaga

SEQ ID NO: 57174 - DNA, 22 bp, Homo sapiens
tcgaatggcaaggaaagaggct

SEQ ID NO: 57175 - DNA, 22 bp, Homo sapiens
gcacatgagaagctggcgatgc

SEQ ID NO: 57176 - DNA, 23 bp, Homo sapiens
cagtctgcagcccacttgggcag

SEQ ID NO: 57177 - DNA, 22 bp, Homo sapiens
cagaccagaaggaagccgacaa

SEQ ID NO: 57178 - DNA, 22 bp, Homo sapiens
gtggctcacgcctgtaatccca

SEQ ID NO: 57179 - DNA, 22 bp, Homo sapiens
agtggcaggatctcggttcact

SEQ ID NO: 57180 - DNA, 20 bp, Homo sapiens
aaacgagccatcattctggt

SEQ ID NO: 57181 - DNA, 22 bp, Homo sapiens
atgatccaaagccacaggggca

SEQ ID NO: 57182 - DNA, 22 bp, Homo sapiens
ccagtgtgcattatcatgtgtc

SEQ ID NO: 57183 - DNA, 22 bp, Homo sapiens
ggctttgacatgctgaattaaa

SEQ ID NO: 57184 - DNA, 22 bp, Homo sapiens
gctctctgcagcctccttggag

SEQ ID NO: 57185 - DNA, 22 bp, Homo sapiens
cctcagacccctgctgagcttc

SEQ ID NO: 57186 - DNA, 22 bp, Homo sapiens
ctgggtggcagagcctgcagtg

SEQ ID NO: 57187 - DNA, 22 bp, Homo sapiens
ctggcctggcgcagtggctcac

SEQ ID NO: 57188 - DNA, 22 bp, Homo sapiens
caatagtgtctgcttgtttcta

SEQ ID NO: 57189 - DNA, 22 bp, Homo sapiens
tcccgcccttgtacttgccgag

SEQ ID NO: 57190 - DNA, 22 bp, Homo sapiens
agtgaaaacctaatcatgcagt

SEQ ID NO: 57191 - DNA, 22 bp, Homo sapiens
tcactgcaacctctgcctgcca

SEQ ID NO: 57192 - DNA, 22 bp, Homo sapiens
ctgggaggtggaggttgcattg

SEQ ID NO: 57193 - DNA, 22 bp, Homo sapiens
gcgagcctctggagtcctctgg

SEQ ID NO: 57194 - DNA, 19 bp, Homo sapiens
ccagagagctaggtacaga

SEQ ID NO: 57195 - DNA, 22 bp, Homo sapiens
atagagtgatgtaaggtatgtg

SEQ ID NO: 57196 - DNA, 22 bp, Homo sapiens
aggctgtgtgctccttatgaga

SEQ ID NO: 57197 - DNA, 22 bp, Homo sapiens
caaagtgctaggattataggtg

SEQ ID NO: 57198 - DNA, 22 bp, Homo sapiens
tacgcctgtaatcccagcactt

SEQ ID NO: 57199 - DNA, 22 bp, Homo sapiens
tggatctcggcaatgcgggact

SEQ ID NO: 57200 - DNA, 22 bp, Homo sapiens
gaatcccaatctgttattgaca

SEQ ID NO: 57201 - DNA, 22 bp, Homo sapiens
tttgaggttagctagcagatca

SEQ ID NO: 57202 - DNA, 22 bp, Homo sapiens
ttatttttaaaagttcacacag

SEQ ID NO: 57203 - DNA, 22 bp, Homo sapiens
cccgtgtggatgcgctggtgct

SEQ ID NO: 57204 - DNA, 22 bp, Homo sapiens
ctgggaggcagaggttgtagtg

SEQ ID NO: 57205 - DNA, 22 bp, Homo sapiens
tttctataaaaagtgctaggat

SEQ ID NO: 57206 - DNA, 22 bp, Homo sapiens
aatctgttgatgcaaacctccc

SEQ ID NO: 57207 - DNA, 22 bp, Homo sapiens
gaggcaggcagattgcttgagg

SEQ ID NO: 57208 - DNA, 22 bp, Homo sapiens
cccaggaggtggagcttgcagt

SEQ ID NO: 57209 - DNA, 22 bp, Homo sapiens
agttattactctttaacatatt

SEQ ID NO: 57210 - DNA, 16 bp, Homo sapiens
aggctcagaggctgga

SEQ ID NO: 57211 - DNA, 22 bp, Homo sapiens
gtcaggactctgacccgtcccg

SEQ ID NO: 57212 - DNA, 22 bp, Homo sapiens
ggagactgatctgagtgataac

SEQ ID NO: 57213 - DNA, 22 bp, Homo sapiens
ttctgtgaatcttttttcccac

SEQ ID NO: 57214 - DNA, 22 bp, Homo sapiens
gtcaccttgaacaggctactca

SEQ ID NO: 57215 - DNA, 22 bp, Homo sapiens
tttgaagactactgggagtgaa

SEQ ID NO: 57216 - DNA, 22 bp, Homo sapiens
tcagtgcagggtgggagagaga

SEQ ID NO: 57217 - DNA, 18 bp, Homo sapiens
atgagaggtgtcagaaga

SEQ ID NO: 57218 - DNA, 22 bp, Homo sapiens
tgctgctccccagcacacagca

SEQ ID NO: 57219 - DNA, 22 bp, Homo sapiens
ggagaagaggagctggaagcct

SEQ ID NO: 57220 - DNA, 22 bp, Homo sapiens
caggaggacatactggctcaca

SEQ ID NO: 57221 - DNA, 22 bp, Homo sapiens
ttcgactctgtgcctgaagagc

SEQ ID NO: 57222 - DNA, 22 bp, Homo sapiens
ggctggtgttgagtgcctgtag

SEQ ID NO: 57223 - DNA, 22 bp, Homo sapiens
tgataaacttagaaagaatgtt

SEQ ID NO: 57224 - DNA, 22 bp, Homo sapiens
gccgggttcaagccattctcct

SEQ ID NO: 57225 - DNA, 22 bp, Homo sapiens
tctcgctctgtcgcccaggctg

SEQ ID NO: 57226 - DNA, 22 bp, Homo sapiens
gttacagtcaggagatattttg

SEQ ID NO: 57227 - DNA, 22 bp, Homo sapiens
tgatctggtcctactgtgggca

SEQ ID NO: 57228 - DNA, 22 bp, Homo sapiens
aatcagaccgttctggctgtcc

SEQ ID NO: 57229 - DNA, 22 bp, Homo sapiens
aatggcaagagccacagaggcg

SEQ ID NO: 57230 - DNA, 22 bp, Homo sapiens
agccacacagcttaatgacaga

SEQ ID NO: 57231 - DNA, 18 bp, Homo sapiens
gcctgagggtcaagtgtg

SEQ ID NO: 57232 - DNA, 22 bp, Homo sapiens
gctgctctccaagcctccttga

SEQ ID NO: 57233 - DNA, 22 bp, Homo sapiens
acacttctttgtcacctgcttc

SEQ ID NO: 57234 - DNA, 22 bp, Homo sapiens
gcgccccatctacagtactttt

SEQ ID NO: 57235 - DNA, 22 bp, Homo sapiens
ttgagcaggatggctatgcaca

SEQ ID NO: 57236 - DNA, 20 bp, Homo sapiens
tcaggtgacacacgtggcac

SEQ ID NO: 57237 - DNA, 22 bp, Homo sapiens
tagcataacaggtaagagtgag

SEQ ID NO: 57238 - DNA, 22 bp, Homo sapiens
ggaggtggagctggaagttcca

SEQ ID NO: 57239 - DNA, 22 bp, Homo sapiens
tgttccagatttagccaaccga

SEQ ID NO: 57240 - DNA, 22 bp, Homo sapiens
gggactggagtagaggccggtg

SEQ ID NO: 57241 - DNA, 22 bp, Homo sapiens
ttattagagtgctttgagaaag

SEQ ID NO: 57242 - DNA, 22 bp, Homo sapiens
gtttctctgtctgttacattgg

SEQ ID NO: 57243 - DNA, 22 bp, Homo sapiens
atttactcgtgcttcattgaat

SEQ ID NO: 57244 - DNA, 22 bp, Homo sapiens
agaccactaaaactttctctat

SEQ ID NO: 57245 - DNA, 22 bp, Homo sapiens
ctgtccccacccaaatctcatc

SEQ ID NO: 57246 - DNA, 22 bp, Homo sapiens
actgcacttcaccctgggtgac

SEQ ID NO: 57247 - DNA, 22 bp, Homo sapiens
ggcctcttatctggctcctgca

SEQ ID NO: 57248 - DNA, 22 bp, Homo sapiens
caggaggattgcttgaggccag

SEQ ID NO: 57249 - DNA, 22 bp, Homo sapiens
tcccaccttccgtggaacccgt

SEQ ID NO: 57250 - DNA, 22 bp, Homo sapiens
ggcaggaggtgagtggcgggtg

SEQ ID NO: 57251 - DNA, 22 bp, Homo sapiens
tgccacagacaggacagaacag

SEQ ID NO: 57252 - DNA, 22 bp, Homo sapiens
cagctgttcattgttgccaccc

SEQ ID NO: 57253 - DNA, 22 bp, Homo sapiens
tggtggggccagacttcagctc

SEQ ID NO: 57254 - DNA, 22 bp, Homo sapiens
ttttcctggagatggagttgtt

SEQ ID NO: 57255 - DNA, 22 bp, Homo sapiens
ttgagtgtactttagtcatctg

SEQ ID NO: 57256 - DNA, 22 bp, Homo sapiens
tgatctttggtaatctggcaca

SEQ ID NO: 57257 - DNA, 22 bp, Homo sapiens
aaggaaagctgtggttctgaga

SEQ ID NO: 57258 - DNA, 22 bp, Homo sapiens
ccaggctgctgttggtgtccgc

SEQ ID NO: 57259 - DNA, 22 bp, Homo sapiens
gatggcctcatggctgcaggcc

SEQ ID NO: 57260 - DNA, 22 bp, Homo sapiens
aacagcttgctgcaccttaata

SEQ ID NO: 57261 - DNA, 19 bp, Homo sapiens
gatttaaacgtggctctat

SEQ ID NO: 57262 - DNA, 22 bp, Homo sapiens
gaggccactgtccctgccttcc

SEQ ID NO: 57263 - DNA, 22 bp, Homo sapiens
gactggaaagcctgtcctcaga

SEQ ID NO: 57264 - DNA, 22 bp, Homo sapiens
cacagctgaagtagccatgtgg

SEQ ID NO: 57265 - DNA, 22 bp, Homo sapiens
tgacctattagatttccttgcc

SEQ ID NO: 57266 - DNA, 22 bp, Homo sapiens
atccaccctgtggtggctttct

SEQ ID NO: 57267 - DNA, 22 bp, Homo sapiens
tcctagttctctgccagtcgct

SEQ ID NO: 57268 - DNA, 22 bp, Homo sapiens
ggtaacttagctcatggctgtg

SEQ ID NO: 57269 - DNA, 22 bp, Homo sapiens
ttagcttttgagaatgatttct

SEQ ID NO: 57270 - DNA, 22 bp, Homo sapiens
ctacaaaagtaattgtggtttt

SEQ ID NO: 57271 - DNA, 22 bp, Homo sapiens
tttgaagggcacgacaatagtt

SEQ ID NO: 57272 - DNA, 19 bp, Homo sapiens
acacagggatcagagggtt

SEQ ID NO: 57273 - DNA, 22 bp, Homo sapiens
agggctctgagtgggaaagagg

SEQ ID NO: 57274 - DNA, 16 bp, Homo sapiens
gcgcctcctcggcctc

SEQ ID NO: 57275 - DNA, 22 bp, Homo sapiens
tcacaatatttatcttccaatt

SEQ ID NO: 57276 - DNA, 22 bp, Homo sapiens
gactttgtgccaaacgccagaa

SEQ ID NO: 57277 - DNA, 22 bp, Homo sapiens
gtggcagagccaaggctggagc

SEQ ID NO: 57278 - DNA, 17 bp, Homo sapiens
aggaggccctggcgttt

SEQ ID NO: 57279 - DNA, 22 bp, Homo sapiens
gcccaggctggagtgcagtggt

SEQ ID NO: 57280 - DNA, 22 bp, Homo sapiens
actgtgtgtttgtctagcacag

SEQ ID NO: 57281 - DNA, 22 bp, Homo sapiens
tcagggctgcagaagaggcagg

SEQ ID NO: 57282 - DNA, 22 bp, Homo sapiens
tacttttagcctatttgattct

SEQ ID NO: 57283 - DNA, 21 bp, Homo sapiens
tctgccagctgaagaggtgga

SEQ ID NO: 57284 - DNA, 22 bp, Homo sapiens
tctctcttttttgaacccgctc

SEQ ID NO: 57285 - DNA, 22 bp, Homo sapiens
gcgagggcacgcggttgaaggc

SEQ ID NO: 57286 - DNA, 22 bp, Homo sapiens
attgttcaatgtaataattttg

SEQ ID NO: 57287 - DNA, 22 bp, Homo sapiens
gggctgtgaggtgagaacttac

SEQ ID NO: 57288 - DNA, 22 bp, Homo sapiens
tgagcacatttcacatgacagg

SEQ ID NO: 57289 - DNA, 22 bp, Homo sapiens
tgagagttctctcttcaggtgg

SEQ ID NO: 57290 - DNA, 22 bp, Homo sapiens
gggccctgcgactcgcggcgga

SEQ ID NO: 57291 - DNA, 22 bp, Homo sapiens
aagtcattggtagcttgatagg

SEQ ID NO: 57292 - DNA, 22 bp, Homo sapiens
ggccactgctctccagcctggg

SEQ ID NO: 57293 - DNA, 22 bp, Homo sapiens
tgtcaccatgcgaggctaattt

SEQ ID NO: 57294 - DNA, 22 bp, Homo sapiens
tctgaaaactccatgagctcgt

SEQ ID NO: 57295 - DNA, 22 bp, Homo sapiens
tccagcccaggctggagtgtag

SEQ ID NO: 57296 - DNA, 22 bp, Homo sapiens
cattcatctatcaaatggtacc

SEQ ID NO: 57297 - DNA, 22 bp, Homo sapiens
acagagcaataacagggagagg

SEQ ID NO: 57298 - DNA, 22 bp, Homo sapiens
ttgtgggatctccctgttgctc

SEQ ID NO: 57299 - DNA, 23 bp, Homo sapiens
ggaagctcacgtagtcctgcact

SEQ ID NO: 57300 - DNA, 22 bp, Homo sapiens
ccaaagtgctgagattacaggt

SEQ ID NO: 57301 - DNA, 22 bp, Homo sapiens
atgccactgcactccagcctgg

SEQ ID NO: 57302 - DNA, 22 bp, Homo sapiens
tcctcagcttttatttcacttg

SEQ ID NO: 57303 - DNA, 22 bp, Homo sapiens
ttccggaaggttctctagaatt

SEQ ID NO: 57304 - DNA, 22 bp, Homo sapiens
gcagagctcatgcctgcacctc

SEQ ID NO: 57305 - DNA, 21 bp, Homo sapiens
ggcaagaaacacaatcaagta

SEQ ID NO: 57306 - DNA, 22 bp, Homo sapiens
ggagtgagagagtttaaggtca

SEQ ID NO: 57307 - DNA, 22 bp, Homo sapiens
cccaactactctcaggcagctt

SEQ ID NO: 57308 - DNA, 22 bp, Homo sapiens
ggcctgtaatcccagctactca

SEQ ID NO: 57309 - DNA, 22 bp, Homo sapiens
ctcggaatggaacaacagcggt

SEQ ID NO: 57310 - DNA, 22 bp, Homo sapiens
tcaaaattaaaccaacgtccag

SEQ ID NO: 57311 - DNA, 22 bp, Homo sapiens
ctatacagcagcttactagtta

SEQ ID NO: 57312 - DNA, 22 bp, Homo sapiens
ctggctgggagcgagctgctca

SEQ ID NO: 57313 - DNA, 22 bp, Homo sapiens
agccagggtctctcgctctgtt

SEQ ID NO: 57314 - DNA, 22 bp, Homo sapiens
cactgcactccagcccgggcaa

SEQ ID NO: 57315 - DNA, 22 bp, Homo sapiens
ctggggtcagggatcagagagc

SEQ ID NO: 57316 - DNA, 22 bp, Homo sapiens
gtgagactcgcctttgtgtagc

SEQ ID NO: 57317 - DNA, 22 bp, Homo sapiens
tgaggcaggtggattacaaggt

SEQ ID NO: 57318 - DNA, 22 bp, Homo sapiens
gctgaggtggaggaaggagacc

SEQ ID NO: 57319 - DNA, 22 bp, Homo sapiens
cggaggttgaggctgcagtgag

SEQ ID NO: 57320 - DNA, 22 bp, Homo sapiens
tcttgggggactttggcatgga

SEQ ID NO: 57321 - DNA, 22 bp, Homo sapiens
tgaggcactccaggatgctgtt

SEQ ID NO: 57322 - DNA, 21 bp, Homo sapiens
tgttttccaccttgaggcaag

SEQ ID NO: 57323 - DNA, 22 bp, Homo sapiens
cagctgctgttcagttttgttt

SEQ ID NO: 57324 - DNA, 22 bp, Homo sapiens
cagccctcctaccctgccaggc

SEQ ID NO: 57325 - DNA, 22 bp, Homo sapiens
ttccagctaactcacatccctt

SEQ ID NO: 57326 - DNA, 22 bp, Homo sapiens
ggagtgactcacagctgggaca

SEQ ID NO: 57327 - DNA, 22 bp, Homo sapiens
attgcactccagcctgggtgac

SEQ ID NO: 57328 - DNA, 22 bp, Homo sapiens
ggggaaggaaagttattagcag

SEQ ID NO: 57329 - DNA, 22 bp, Homo sapiens
tctctcaggctggagtgcagtg

SEQ ID NO: 57330 - DNA, 17 bp, Homo sapiens
gcccgcggcccggggtg

SEQ ID NO: 57331 - DNA, 22 bp, Homo sapiens
gtccaagagtcaagaagggggc

SEQ ID NO: 57332 - DNA, 22 bp, Homo sapiens
ggtagaaggggaagaggtccat

SEQ ID NO: 57333 - DNA, 23 bp, Homo sapiens
caggagatggctgctgtgtcagc

SEQ ID NO: 57334 - DNA, 22 bp, Homo sapiens
ggcgccagcactgcagcgcctc

SEQ ID NO: 57335 - DNA, 22 bp, Homo sapiens
ggacctgaacataaaacgaggc

SEQ ID NO: 57336 - DNA, 22 bp, Homo sapiens
ccactgtggaaagcagttcaga

SEQ ID NO: 57337 - DNA, 22 bp, Homo sapiens
aattgaaaatattgtagaccat

SEQ ID NO: 57338 - DNA, 22 bp, Homo sapiens
tctgttgactcctagcagccat

SEQ ID NO: 57339 - DNA, 22 bp, Homo sapiens
atgggatgatcacctgagctca

SEQ ID NO: 57340 - DNA, 22 bp, Homo sapiens
ttgcccaggctggagtgcagta

SEQ ID NO: 57341 - DNA, 22 bp, Homo sapiens
ggtccccgtggaggctggagcg

SEQ ID NO: 57342 - DNA, 22 bp, Homo sapiens
atgtgggccgtgcgggtgtcct

SEQ ID NO: 57343 - DNA, 22 bp, Homo sapiens
ccgcaaggcagaggttgcagtg

SEQ ID NO: 57344 - DNA, 22 bp, Homo sapiens
ctcactgcaagctccgcctccc

SEQ ID NO: 57345 - DNA, 22 bp, Homo sapiens
ttgatgagaccattgccgcgtc

SEQ ID NO: 57346 - DNA, 22 bp, Homo sapiens
aagccgggcctgagaaatgaca

SEQ ID NO: 57347 - DNA, 22 bp, Homo sapiens
atagggcctaaaaagtattgct

SEQ ID NO: 57348 - DNA, 22 bp, Homo sapiens
tctttgaccaaattatcctgtt

SEQ ID NO: 57349 - DNA, 22 bp, Homo sapiens
tctcctggagcccagatgctgg

SEQ ID NO: 57350 - DNA, 22 bp, Homo sapiens
cagtgcagccaaggacaggcac

SEQ ID NO: 57351 - DNA, 22 bp, Homo sapiens
aaggtatatctgatccatgagg

SEQ ID NO: 57352 - DNA, 22 bp, Homo sapiens
cttagagatgggttttacttag

SEQ ID NO: 57353 - DNA, 22 bp, Homo sapiens
agtactgtcagcagggtgttga

SEQ ID NO: 57354 - DNA, 22 bp, Homo sapiens
gggtgtagaaagaaccctctgg

SEQ ID NO: 57355 - DNA, 22 bp, Homo sapiens
tggttaagtccagaaaggaagc

SEQ ID NO: 57356 - DNA, 22 bp, Homo sapiens
tgcatattatgtgtatctgtct

SEQ ID NO: 57357 - DNA, 22 bp, Homo sapiens
gcggcgcctgggacccgccagc

SEQ ID NO: 57358 - DNA, 19 bp, Homo sapiens
atctgccttagtgctgctg

SEQ ID NO: 57359 - DNA, 22 bp, Homo sapiens
atgcggagccccaagcttgaag

SEQ ID NO: 57360 - DNA, 20 bp, Homo sapiens
caggtccagcacgtgcacgg

SEQ ID NO: 57361 - DNA, 22 bp, Homo sapiens
ggtgtgtctgccaggaactgca

SEQ ID NO: 57362 - DNA, 22 bp, Homo sapiens
gtagcagagggcccaggtaact

SEQ ID NO: 57363 - DNA, 22 bp, Homo sapiens
ccctgctgtcaggtgctgggag

SEQ ID NO: 57364 - DNA, 22 bp, Homo sapiens
attttctatgttgtaattgtta

SEQ ID NO: 57365 - DNA, 22 bp, Homo sapiens
gaggaggcttccgggaggcacg

SEQ ID NO: 57366 - DNA, 22 bp, Homo sapiens
gagctgaaggagaaagcagggg

SEQ ID NO: 57367 - DNA, 22 bp, Homo sapiens
ggctcaatgcaacttctgcctc

SEQ ID NO: 57368 - DNA, 22 bp, Homo sapiens
ttccagagagttattcccctgg

SEQ ID NO: 57369 - DNA, 22 bp, Homo sapiens
aaggccttgccgaaggatgcca

SEQ ID NO: 57370 - DNA, 22 bp, Homo sapiens
atcatccaagcgtagttcttct

SEQ ID NO: 57371 - DNA, 22 bp, Homo sapiens
aggagaagccaagttgtgagca

SEQ ID NO: 57372 - DNA, 22 bp, Homo sapiens
gaggggcacagtaaagggtccc

SEQ ID NO: 57373 - DNA, 22 bp, Homo sapiens
tatttaataaaactatggcatg

SEQ ID NO: 57374 - DNA, 22 bp, Homo sapiens
aaagtgcaaggattacaggcat

SEQ ID NO: 57375 - DNA, 22 bp, Homo sapiens
caattgtcagtgctgtttaaat

SEQ ID NO: 57376 - DNA, 22 bp, Homo sapiens
aacgcccgtggttgccaaggta

SEQ ID NO: 57377 - DNA, 22 bp, Homo sapiens
cccaggaggtcgaagctgcagt

SEQ ID NO: 57378 - DNA, 22 bp, Homo sapiens
cccagaaggtcgaggctgcagt

SEQ ID NO: 57379 - DNA, 22 bp, Homo sapiens
agtgctatcgagttctaatgct

SEQ ID NO: 57380 - DNA, 22 bp, Homo sapiens
atgttatgtctgggaaggggta

SEQ ID NO: 57381 - DNA, 22 bp, Homo sapiens
tcactgcagcctctgcctcccg

SEQ ID NO: 57382 - DNA, 22 bp, Homo sapiens
ctgtgcgtaagtagccaaaata

SEQ ID NO: 57383 - DNA, 22 bp, Homo sapiens
ctgagggtcaacttgattgtat

SEQ ID NO: 57384 - DNA, 22 bp, Homo sapiens
gctcccaccgccgctatgggta

SEQ ID NO: 57385 - DNA, 22 bp, Homo sapiens
ctctttggatagaattacaaag

SEQ ID NO: 57386 - DNA, 22 bp, Homo sapiens
tgcctgcctaggaagctgtgaa

SEQ ID NO: 57387 - DNA, 22 bp, Homo sapiens
ccctctctgctgcatagaggaa

SEQ ID NO: 57388 - DNA, 22 bp, Homo sapiens
gcaggaggttgagccaggactg

SEQ ID NO: 57389 - DNA, 22 bp, Homo sapiens
ggaagggcaaaagagatgaact

SEQ ID NO: 57390 - DNA, 22 bp, Homo sapiens
tttatagtagcatgatttatag

SEQ ID NO: 57391 - DNA, 22 bp, Homo sapiens
aaagattaaatcaaattggtca

SEQ ID NO: 57392 - DNA, 22 bp, Homo sapiens
gggagctggagctggaagactc

SEQ ID NO: 57393 - DNA, 22 bp, Homo sapiens
tttacaacccaagtccagagag

SEQ ID NO: 57394 - DNA, 22 bp, Homo sapiens
gtagtcccagctaccccggagg

SEQ ID NO: 57395 - DNA, 22 bp, Homo sapiens
gctaatcaatgttaaggctgtg

SEQ ID NO: 57396 - DNA, 22 bp, Homo sapiens
gcaggtctgttgattacagtca

SEQ ID NO: 57397 - DNA, 22 bp, Homo sapiens
tcactcaggctggagtgcagtg

SEQ ID NO: 57398 - DNA, 22 bp, Homo sapiens
ggtgtctatgattcagtttatg

SEQ ID NO: 57399 - DNA, 22 bp, Homo sapiens
gtacactccccctgtgaagttg

SEQ ID NO: 57400 - DNA, 22 bp, Homo sapiens
ccattgcactccatcctgggca

SEQ ID NO: 57401 - DNA, 22 bp, Homo sapiens
agacaaagaaaccgtagaagca

SEQ ID NO: 57402 - DNA, 22 bp, Homo sapiens
agctggaagtgcatttctcact

SEQ ID NO: 57403 - DNA, 22 bp, Homo sapiens
cacctgtacagggccgggctgg

SEQ ID NO: 57404 - DNA, 22 bp, Homo sapiens
cctgaggatgccagcatgggtg

SEQ ID NO: 57405 - DNA, 22 bp, Homo sapiens
cccagggaggcccaggctctgc

SEQ ID NO: 57406 - DNA, 22 bp, Homo sapiens
aaattgtaatgacttcacttga

SEQ ID NO: 57407 - DNA, 22 bp, Homo sapiens
ctctgcaagtccagcccctggc

SEQ ID NO: 57408 - DNA, 22 bp, Homo sapiens
ccagcagccaccttctcgaaat

SEQ ID NO: 57409 - DNA, 22 bp, Homo sapiens
tgcttctgactaagctgcatga

SEQ ID NO: 57410 - DNA, 22 bp, Homo sapiens
ccgaggtcctggacttggccct

SEQ ID NO: 57411 - DNA, 22 bp, Homo sapiens
ttacatgtttatgggggtacat

SEQ ID NO: 57412 - DNA, 22 bp, Homo sapiens
gcccagagtttgaagatacagt

SEQ ID NO: 57413 - DNA, 19 bp, Homo sapiens
actgtagcactgcagtata

SEQ ID NO: 57414 - DNA, 22 bp, Homo sapiens
cagtgggtcctgcgtctgccag

SEQ ID NO: 57415 - DNA, 22 bp, Homo sapiens
gcgtctcatcctcccgctaatt

SEQ ID NO: 57416 - DNA, 22 bp, Homo sapiens
tcactgcaagctcctcctcctg

SEQ ID NO: 57417 - DNA, 22 bp, Homo sapiens
gtggagggtgattgccggctgt

SEQ ID NO: 57418 - DNA, 22 bp, Homo sapiens
ctggcttttttcccattatgca

SEQ ID NO: 57419 - DNA, 22 bp, Homo sapiens
tatttccttgagacggagtctc

SEQ ID NO: 57420 - DNA, 22 bp, Homo sapiens
ttgttcttgtctttgccttcac

SEQ ID NO: 57421 - DNA, 22 bp, Homo sapiens
acagatgttgcttgtcattctc

SEQ ID NO: 57422 - DNA, 22 bp, Homo sapiens
agcgtgaattagttggtacaca

SEQ ID NO: 57423 - DNA, 22 bp, Homo sapiens
taactctgaatcctcacagcag

SEQ ID NO: 57424 - DNA, 22 bp, Homo sapiens
gagtagaactggttatctaata

SEQ ID NO: 57425 - DNA, 22 bp, Homo sapiens
cacatttttactgccaacttaa

SEQ ID NO: 57426 - DNA, 22 bp, Homo sapiens
ttccacaatggttaagctcgtt

SEQ ID NO: 57427 - DNA, 22 bp, Homo sapiens
taaatcttctacatcatcataa

SEQ ID NO: 57428 - DNA, 18 bp, Homo sapiens
tggcgatggtcatttttc

SEQ ID NO: 57429 - DNA, 22 bp, Homo sapiens
atgccactgcactccagcctag

SEQ ID NO: 57430 - DNA, 22 bp, Homo sapiens
gggaggcagtgctggaggctgg

SEQ ID NO: 57431 - DNA, 22 bp, Homo sapiens
ggcggcttattcactctgggga

SEQ ID NO: 57432 - DNA, 22 bp, Homo sapiens
tgagacgaagtcttgctctgtt

SEQ ID NO: 57433 - DNA, 21 bp, Homo sapiens
tagcccttctccacctcgccc

SEQ ID NO: 57434 - DNA, 22 bp, Homo sapiens
tccttcagcctcccagctcaaa

SEQ ID NO: 57435 - DNA, 23 bp, Homo sapiens
tcaagcaattctcctgcctcggc

SEQ ID NO: 57436 - DNA, 22 bp, Homo sapiens
atcaaatacaaagggcataagg

SEQ ID NO: 57437 - DNA, 22 bp, Homo sapiens
ggcggaggttgcagtaagccga

SEQ ID NO: 57438 - DNA, 22 bp, Homo sapiens
caaagtgctaggattacaggcc

SEQ ID NO: 57439 - DNA, 22 bp, Homo sapiens
ctactttaacatggaggcactt

SEQ ID NO: 57440 - DNA, 22 bp, Homo sapiens
tgactacaacctccacctcccg

SEQ ID NO: 57441 - DNA, 22 bp, Homo sapiens
gtcttttgctagccagagagct

SEQ ID NO: 57442 - DNA, 22 bp, Homo sapiens
ctgtctgtagacatttttggtt

SEQ ID NO: 57443 - DNA, 22 bp, Homo sapiens
cggcatgggcgtccccctcact

SEQ ID NO: 57444 - DNA, 22 bp, Homo sapiens
gtagggttggagagcacaacca

SEQ ID NO: 57445 - DNA, 22 bp, Homo sapiens
ctggcccaggtggtcgttgagg

SEQ ID NO: 57446 - DNA, 22 bp, Homo sapiens
atatatttgagaatattcatga

SEQ ID NO: 57447 - DNA, 22 bp, Homo sapiens
ggcatgcatgttgttttaggtg

SEQ ID NO: 57448 - DNA, 22 bp, Homo sapiens
gccacctggtggcatcttctgg

SEQ ID NO: 57449 - DNA, 22 bp, Homo sapiens
gctgcagacttctcatctcatt

SEQ ID NO: 57450 - DNA, 22 bp, Homo sapiens
gtgacaggccactgcggctctg

SEQ ID NO: 57451 - DNA, 22 bp, Homo sapiens
actttaaaactgatcatcagag

SEQ ID NO: 57452 - DNA, 22 bp, Homo sapiens
tcttgcacttcatgaatatgtt

SEQ ID NO: 57453 - DNA, 19 bp, Homo sapiens
ttctggtctggaatcaagg

SEQ ID NO: 57454 - DNA, 22 bp, Homo sapiens
gcccagtagttcaaggttgcag

SEQ ID NO: 57455 - DNA, 22 bp, Homo sapiens
tctgtcttagccatctcaggct

SEQ ID NO: 57456 - DNA, 22 bp, Homo sapiens
tagggcaatatttcccagaaaa

SEQ ID NO: 57457 - DNA, 22 bp, Homo sapiens
agggttcagtgaggtgtactcc

SEQ ID NO: 57458 - DNA, 22 bp, Homo sapiens
taaaggtagtgtgacatattgt

SEQ ID NO: 57459 - DNA, 22 bp, Homo sapiens
cccaggccctggcagagcttgt

SEQ ID NO: 57460 - DNA, 22 bp, Homo sapiens
tgtgggtttgtagttaagttct

SEQ ID NO: 57461 - DNA, 23 bp, Homo sapiens
ctcaaccctagtaagggagtagg

SEQ ID NO: 57462 - DNA, 22 bp, Homo sapiens
ccctctacagggaagcgctttc

SEQ ID NO: 57463 - DNA, 22 bp, Homo sapiens
ctcactgcaacctctgcctccc

SEQ ID NO: 57464 - DNA, 22 bp, Homo sapiens
attgacctgattgttcctggaa

SEQ ID NO: 57465 - DNA, 22 bp, Homo sapiens
ctcagggccaaggatgctgttg

SEQ ID NO: 57466 - DNA, 22 bp, Homo sapiens
gcaggagaacaaagcaagctgc

SEQ ID NO: 57467 - DNA, 22 bp, Homo sapiens
tgaggaaacttacaaggcagaa

SEQ ID NO: 57468 - DNA, 22 bp, Homo sapiens
ctctccattccctacagttttc

SEQ ID NO: 57469 - DNA, 22 bp, Homo sapiens
acactccagggagggagggaat

SEQ ID NO: 57470 - DNA, 17 bp, Homo sapiens
gagattttcgtcctgaa

SEQ ID NO: 57471 - DNA, 22 bp, Homo sapiens
tgtgtcagaaggcaatggggat

SEQ ID NO: 57472 - DNA, 22 bp, Homo sapiens
tgcgccatgtgctctcggccct

SEQ ID NO: 57473 - DNA, 22 bp, Homo sapiens
atgatactctaggtgatttaca

SEQ ID NO: 57474 - DNA, 23 bp, Homo sapiens
agaaagtcatggccaggtttgat

SEQ ID NO: 57475 - DNA, 22 bp, Homo sapiens
gccactgagcccggccattgtt

SEQ ID NO: 57476 - DNA, 22 bp, Homo sapiens
cgcgctctccttctggcaccca

SEQ ID NO: 57477 - DNA, 21 bp, Homo sapiens
gctcctggtgctgcgtggcgc

SEQ ID NO: 57478 - DNA, 22 bp, Homo sapiens
cccaggaggcctgcctggccgg

SEQ ID NO: 57479 - DNA, 22 bp, Homo sapiens
aggtcaagggagctgagggcca

SEQ ID NO: 57480 - DNA, 22 bp, Homo sapiens
agcccggcttccccggttgcta

SEQ ID NO: 57481 - DNA, 22 bp, Homo sapiens
aagtggactaatacaaggacta

SEQ ID NO: 57482 - DNA, 22 bp, Homo sapiens
ggggcagagaataaaaacctaa

SEQ ID NO: 57483 - DNA, 22 bp, Homo sapiens
ggcgcacaatgtgcaggtttgt

SEQ ID NO: 57484 - DNA, 22 bp, Homo sapiens
ctcctgggaaaggctggacaca

SEQ ID NO: 57485 - DNA, 22 bp, Homo sapiens
cgtgccactgcactctagcctg

SEQ ID NO: 57486 - DNA, 22 bp, Homo sapiens
tgacatttcctagtgctttgtg

SEQ ID NO: 57487 - DNA, 22 bp, Homo sapiens
acaggcttacaggctgcaagta

SEQ ID NO: 57488 - DNA, 22 bp, Homo sapiens
tgcacgtgtgagcattcacatg

SEQ ID NO: 57489 - DNA, 22 bp, Homo sapiens
cccagcaggaggaggttgcagt

SEQ ID NO: 57490 - DNA, 22 bp, Homo sapiens
gcttggaagtaggattgggaga

SEQ ID NO: 57491 - DNA, 21 bp, Homo sapiens
cgcagagcgaacttgcggcgc

SEQ ID NO: 57492 - DNA, 22 bp, Homo sapiens
tggcacaggatctcagcggcca

SEQ ID NO: 57493 - DNA, 22 bp, Homo sapiens
atgcagtggcttcagtgtcagt

SEQ ID NO: 57494 - DNA, 20 bp, Homo sapiens
acgtggccaccagtggctta

SEQ ID NO: 57495 - DNA, 22 bp, Homo sapiens
ctcactgcaagctccacctctt

SEQ ID NO: 57496 - DNA, 22 bp, Homo sapiens
accaggcccgctgctatggtgg

SEQ ID NO: 57497 - DNA, 22 bp, Homo sapiens
cctcggaggcggaggctgcagt

SEQ ID NO: 57498 - DNA, 22 bp, Homo sapiens
ctgtgctccctctggcgccccg

SEQ ID NO: 57499 - DNA, 22 bp, Homo sapiens
catttacatttaaggttaatat

SEQ ID NO: 57500 - DNA, 22 bp, Homo sapiens
gaccctgtttctacaaataatt

SEQ ID NO: 57501 - DNA, 22 bp, Homo sapiens
atgaattgtccgatgttgtgca

SEQ ID NO: 57502 - DNA, 22 bp, Homo sapiens
cacagctgtgagaagggagcct

SEQ ID NO: 57503 - DNA, 21 bp, Homo sapiens
gttgtggttggggctgcagct

SEQ ID NO: 57504 - DNA, 22 bp, Homo sapiens
tgcttgtgacagaactgtgtcc

SEQ ID NO: 57505 - DNA, 22 bp, Homo sapiens
tctagcaagctcgtgctcaagg

SEQ ID NO: 57506 - DNA, 22 bp, Homo sapiens
gcccagcacctctctcagggtt

SEQ ID NO: 57507 - DNA, 22 bp, Homo sapiens
acatcctcccgatctactggct

SEQ ID NO: 57508 - DNA, 22 bp, Homo sapiens
aatgccagtgtgttgattccag

SEQ ID NO: 57509 - DNA, 21 bp, Homo sapiens
aggcttggatctagacaggcc

SEQ ID NO: 57510 - DNA, 22 bp, Homo sapiens
tcaggtccaagatggccatcca

SEQ ID NO: 57511 - DNA, 22 bp, Homo sapiens
gggtaaatctcttttcatggct

SEQ ID NO: 57512 - DNA, 20 bp, Homo sapiens
aactcctagcctcaagtgat

SEQ ID NO: 57513 - DNA, 22 bp, Homo sapiens
tggagaataggggccactggtg

SEQ ID NO: 57514 - DNA, 22 bp, Homo sapiens
gggattacagatgtgagccatt

SEQ ID NO: 57515 - DNA, 22 bp, Homo sapiens
aagtgatgctacgactttgaca

SEQ ID NO: 57516 - DNA, 22 bp, Homo sapiens
tgtctctgtgactccttccgcc

SEQ ID NO: 57517 - DNA, 22 bp, Homo sapiens
cgtgagcaaaatggacactccc

SEQ ID NO: 57518 - DNA, 22 bp, Homo sapiens
gtcggccacgcaggtgcggtag

SEQ ID NO: 57519 - DNA, 22 bp, Homo sapiens
ctgccttttaaagccagtgtta

SEQ ID NO: 57520 - DNA, 22 bp, Homo sapiens
ttgaggtcttcaggatcaggct

SEQ ID NO: 57521 - DNA, 22 bp, Homo sapiens
agaatgggggctacaggccaca

SEQ ID NO: 57522 - DNA, 22 bp, Homo sapiens
ccacagaattctgtctccagga

SEQ ID NO: 57523 - DNA, 22 bp, Homo sapiens
cgggcagcggcgtggccatggt

SEQ ID NO: 57524 - DNA, 20 bp, Homo sapiens
gggtgtgtgcagggcctggt

SEQ ID NO: 57525 - DNA, 21 bp, Homo sapiens
tctgatggtagatgagatgtg

SEQ ID NO: 57526 - DNA, 22 bp, Homo sapiens
tgattcatcagaataggagttt

SEQ ID NO: 57527 - DNA, 22 bp, Homo sapiens
ctgagatggagtttcgctcttc

SEQ ID NO: 57528 - DNA, 20 bp, Homo sapiens
ttcatgggagcaaagaggcc

SEQ ID NO: 57529 - DNA, 22 bp, Homo sapiens
gagcccaggaagtggaggctga

SEQ ID NO: 57530 - DNA, 22 bp, Homo sapiens
gcaggctgtctaaagttagagt

SEQ ID NO: 57531 - DNA, 22 bp, Homo sapiens
atgtgagtgctatgatagacag

SEQ ID NO: 57532 - DNA, 22 bp, Homo sapiens
tttgctattgtgaatagtgcca

SEQ ID NO: 57533 - DNA, 22 bp, Homo sapiens
gccctgccctctcggcactcgc

SEQ ID NO: 57534 - DNA, 22 bp, Homo sapiens
cagcttggaggaggatctaaga

SEQ ID NO: 57535 - DNA, 22 bp, Homo sapiens
tgtgcctactgatagagccaag

SEQ ID NO: 57536 - DNA, 22 bp, Homo sapiens
agcccagaggctgggcgtgcat

SEQ ID NO: 57537 - DNA, 22 bp, Homo sapiens
tcaccttgtgatctccctgcct

SEQ ID NO: 57538 - DNA, 22 bp, Homo sapiens
gctccctggtagccatgctctc

SEQ ID NO: 57539 - DNA, 22 bp, Homo sapiens
ctcggcaggtggaggttgtagt

SEQ ID NO: 57540 - DNA, 22 bp, Homo sapiens
gagcctcgtggcggccactgcg

SEQ ID NO: 57541 - DNA, 22 bp, Homo sapiens
gaggtaggtgtaggaggcctgc

SEQ ID NO: 57542 - DNA, 22 bp, Homo sapiens
gaggcagaagttgcagtgagca

SEQ ID NO: 57543 - DNA, 22 bp, Homo sapiens
gtgcaaccatcaccactgactc

SEQ ID NO: 57544 - DNA, 22 bp, Homo sapiens
gggctgcatcagcaggacccgg

SEQ ID NO: 57545 - DNA, 22 bp, Homo sapiens
tgagaacggatactaagggctg

SEQ ID NO: 57546 - DNA, 22 bp, Homo sapiens
tcatcagaggcatctggcaagg

SEQ ID NO: 57547 - DNA, 22 bp, Homo sapiens
ggatgttgattgaatggccatt

SEQ ID NO: 57548 - DNA, 21 bp, Homo sapiens
gaccccagaccagcagacaca

SEQ ID NO: 57549 - DNA, 22 bp, Homo sapiens
gaaccacaatgtgaagaaggag

SEQ ID NO: 57550 - DNA, 22 bp, Homo sapiens
tcgcccaggctggaagtgcagt

SEQ ID NO: 57551 - DNA, 22 bp, Homo sapiens
aaggagcgcttagggggcagaa

SEQ ID NO: 57552 - DNA, 22 bp, Homo sapiens
attggtagttttgtatttctct

SEQ ID NO: 57553 - DNA, 22 bp, Homo sapiens
tagccgggtgttgtgtcatgca

SEQ ID NO: 57554 - DNA, 22 bp, Homo sapiens
tgaatgtgatgctaaacatatg

SEQ ID NO: 57555 - DNA, 22 bp, Homo sapiens
agtctacaaagggaagcccttt

SEQ ID NO: 57556 - DNA, 22 bp, Homo sapiens
tattattgacatttacttggtg

SEQ ID NO: 57557 - DNA, 22 bp, Homo sapiens
ccagaggagttgaggctttggg

SEQ ID NO: 57558 - DNA, 22 bp, Homo sapiens
tcactgaaacctccacctctcg

SEQ ID NO: 57559 - DNA, 22 bp, Homo sapiens
gagcccgagcgcgtacccggcg

SEQ ID NO: 57560 - DNA, 22 bp, Homo sapiens
gtgagagattgattgtagcggc

SEQ ID NO: 57561 - DNA, 22 bp, Homo sapiens
atcttcccaggctggggagagg

SEQ ID NO: 57562 - DNA, 22 bp, Homo sapiens
aaggggtgcaagttaatcagca

SEQ ID NO: 57563 - DNA, 22 bp, Homo sapiens
aagtcacactagacaactgagg

SEQ ID NO: 57564 - DNA, 21 bp, Homo sapiens
ccaccaggtcttctgctcggg

SEQ ID NO: 57565 - DNA, 18 bp, Homo sapiens
aggtttggtggaaacata

SEQ ID NO: 57566 - DNA, 19 bp, Homo sapiens
ggggcctgtgatggtcaca

SEQ ID NO: 57567 - DNA, 22 bp, Homo sapiens
tcatggggccacagctgccagc

SEQ ID NO: 57568 - DNA, 22 bp, Homo sapiens
accctcaacaaattcactctat

SEQ ID NO: 57569 - DNA, 23 bp, Homo sapiens
tgctggagaagcaaagttctgag

SEQ ID NO: 57570 - DNA, 22 bp, Homo sapiens
tgagccgtggtctctgagggtg

SEQ ID NO: 57571 - DNA, 22 bp, Homo sapiens
gggaagatagtgttgagggccc

SEQ ID NO: 57572 - DNA, 22 bp, Homo sapiens
agtagatttctgctgaagcttt

SEQ ID NO: 57573 - DNA, 22 bp, Homo sapiens
tggggagtgatgcctcggataa

SEQ ID NO: 57574 - DNA, 22 bp, Homo sapiens
aacttagtgagccactcttgca

SEQ ID NO: 57575 - DNA, 22 bp, Homo sapiens
gctgtctcatacaaggccctgc

SEQ ID NO: 57576 - DNA, 22 bp, Homo sapiens
attgtctctgaatttccagctg

SEQ ID NO: 57577 - DNA, 22 bp, Homo sapiens
cggatcctcagtcgtgcgggag

SEQ ID NO: 57578 - DNA, 22 bp, Homo sapiens
atgctaaggcccaggagaaaat

SEQ ID NO: 57579 - DNA, 22 bp, Homo sapiens
tgtacttgaacttgactgtaga

SEQ ID NO: 57580 - DNA, 22 bp, Homo sapiens
tgggaggccgaggcaggtggat

SEQ ID NO: 57581 - DNA, 22 bp, Homo sapiens
gcaccaccaccatcggcacctc

SEQ ID NO: 57582 - DNA, 22 bp, Homo sapiens
tgagcctgagttcaaggctgca

SEQ ID NO: 57583 - DNA, 22 bp, Homo sapiens
gctcaggtagatggggttgtcc

SEQ ID NO: 57584 - DNA, 22 bp, Homo sapiens
tgtaggagtccaatcaggagac

SEQ ID NO: 57585 - DNA, 22 bp, Homo sapiens
aactaatacattaatacatgtg

SEQ ID NO: 57586 - DNA, 22 bp, Homo sapiens
gtcactcaggctggagttcagt

SEQ ID NO: 57587 - DNA, 22 bp, Homo sapiens
gtttcgtcaggcttattctatc

SEQ ID NO: 57588 - DNA, 22 bp, Homo sapiens
ttcctttctctggactgcagcc

SEQ ID NO: 57589 - DNA, 22 bp, Homo sapiens
cagagggttgatgtgaggctta

SEQ ID NO: 57590 - DNA, 22 bp, Homo sapiens
tgagcaggcgcagcaggaggtc

SEQ ID NO: 57591 - DNA, 22 bp, Homo sapiens
gtaggtcagacataagaggaca

SEQ ID NO: 57592 - DNA, 22 bp, Homo sapiens
ccaggaggttgaggctgcagtg

SEQ ID NO: 57593 - DNA, 22 bp, Homo sapiens
gaaaggagagggttaaggagct

SEQ ID NO: 57594 - DNA, 22 bp, Homo sapiens
ggcttctctccagtatgcattc

SEQ ID NO: 57595 - DNA, 22 bp, Homo sapiens
catggcactgagcaggtatgca

SEQ ID NO: 57596 - DNA, 22 bp, Homo sapiens
accactgcccatggtgaaaact

SEQ ID NO: 57597 - DNA, 22 bp, Homo sapiens
acctggaggcagaggttgcagt

SEQ ID NO: 57598 - DNA, 22 bp, Homo sapiens
atgaggcaggtggaggctgcca

SEQ ID NO: 57599 - DNA, 22 bp, Homo sapiens
acattaaacttgcttggctgta

SEQ ID NO: 57600 - DNA, 17 bp, Homo sapiens
gctactggttacctcta

SEQ ID NO: 57601 - DNA, 22 bp, Homo sapiens
ggagagtggattccagctgtat

SEQ ID NO: 57602 - DNA, 22 bp, Homo sapiens
gagtctctgaccagggtgccaa

SEQ ID NO: 57603 - DNA, 22 bp, Homo sapiens
gggcggatcacctgaggtcagg

SEQ ID NO: 57604 - DNA, 20 bp, Homo sapiens
gtctccactgggggttaacc

SEQ ID NO: 57605 - DNA, 22 bp, Homo sapiens
ttatttaaaagtggtaagattc

SEQ ID NO: 57606 - DNA, 22 bp, Homo sapiens
ctagttctagatccctgaggaa

SEQ ID NO: 57607 - DNA, 22 bp, Homo sapiens
gcttggccagcagccgggatgc

SEQ ID NO: 57608 - DNA, 22 bp, Homo sapiens
gcctccagcccacgcaggcctg

SEQ ID NO: 57609 - DNA, 22 bp, Homo sapiens
gccagatttacagatttgccct

SEQ ID NO: 57610 - DNA, 22 bp, Homo sapiens
cctcgcggcactcgggccggat

SEQ ID NO: 57611 - DNA, 22 bp, Homo sapiens
cccaggaattggaggctgcagt

SEQ ID NO: 57612 - DNA, 22 bp, Homo sapiens
tccaccatgtaacaagctctgt

SEQ ID NO: 57613 - DNA, 22 bp, Homo sapiens
agataaagtccaaactgtgtag

SEQ ID NO: 57614 - DNA, 17 bp, Homo sapiens
cttcccaccatctcctg

SEQ ID NO: 57615 - DNA, 22 bp, Homo sapiens
taggctgggaagaaagattctc

SEQ ID NO: 57616 - DNA, 22 bp, Homo sapiens
cttgcagtttaggtcctctgtg

SEQ ID NO: 57617 - DNA, 22 bp, Homo sapiens
cccagcagtagagctcatatgg

SEQ ID NO: 57618 - DNA, 22 bp, Homo sapiens
attttttgttaactcaggatag

SEQ ID NO: 57619 - DNA, 22 bp, Homo sapiens
aggattgtgcctccagtcagaa

SEQ ID NO: 57620 - DNA, 22 bp, Homo sapiens
atgtttaaagggttgagaaata

SEQ ID NO: 57621 - DNA, 22 bp, Homo sapiens
aaggcaggatgggaaaagattt

SEQ ID NO: 57622 - DNA, 22 bp, Homo sapiens
aagaatgagctcaaagatctta

SEQ ID NO: 57623 - DNA, 22 bp, Homo sapiens
agggaaatctcagctctaaaat

SEQ ID NO: 57624 - DNA, 22 bp, Homo sapiens
atacaaaaattagccgggagta

SEQ ID NO: 57625 - DNA, 22 bp, Homo sapiens
tgggaagggtcaacagctggaa

SEQ ID NO: 57626 - DNA, 20 bp, Homo sapiens
ggccggggagctctccaggg

SEQ ID NO: 57627 - DNA, 22 bp, Homo sapiens
cggggacacactggcagctcct

SEQ ID NO: 57628 - DNA, 22 bp, Homo sapiens
cactgcacttcagcctgggtga

SEQ ID NO: 57629 - DNA, 22 bp, Homo sapiens
caatagtaaattacggaggaga

SEQ ID NO: 57630 - DNA, 22 bp, Homo sapiens
ccagaaaaatcctcccttgtcc

SEQ ID NO: 57631 - DNA, 22 bp, Homo sapiens
cctcccctcagacagagactgg

SEQ ID NO: 57632 - DNA, 21 bp, Homo sapiens
cttccccaggctggtctgtat

SEQ ID NO: 57633 - DNA, 21 bp, Homo sapiens
agcctcaggttgttggttctt

SEQ ID NO: 57634 - DNA, 22 bp, Homo sapiens
tggcccagtatgtataatctta

SEQ ID NO: 57635 - DNA, 22 bp, Homo sapiens
ctcaggacccggtccaggtggg

SEQ ID NO: 57636 - DNA, 22 bp, Homo sapiens
taatggattaacgtccctgtcg

SEQ ID NO: 57637 - DNA, 22 bp, Homo sapiens
cctgagcttacaatttaagaac

SEQ ID NO: 57638 - DNA, 22 bp, Homo sapiens
cggagcctgcttgttgcagctg

SEQ ID NO: 57639 - DNA, 22 bp, Homo sapiens
tagccgggtgtggtggaactcc

SEQ ID NO: 57640 - DNA, 22 bp, Homo sapiens
ttgtatagcccagagagtgaga

SEQ ID NO: 57641 - DNA, 22 bp, Homo sapiens
ggctcctgggggtgctcctgcc

SEQ ID NO: 57642 - DNA, 22 bp, Homo sapiens
ttccctaatgtctaacgctatt

SEQ ID NO: 57643 - DNA, 22 bp, Homo sapiens
actttatttcctattgcatcca

SEQ ID NO: 57644 - DNA, 21 bp, Homo sapiens
caaaagagactgattcttgga

SEQ ID NO: 57645 - DNA, 22 bp, Homo sapiens
aggaagttagtaaattatgtgc

SEQ ID NO: 57646 - DNA, 22 bp, Homo sapiens
tagcacagggctcctcaaccca

SEQ ID NO: 57647 - DNA, 22 bp, Homo sapiens
ggtgggagagctctgtctccag

SEQ ID NO: 57648 - DNA, 22 bp, Homo sapiens
ctgagcctcctgcttctatttc

SEQ ID NO: 57649 - DNA, 22 bp, Homo sapiens
accagcacttccagaggtcagg

SEQ ID NO: 57650 - DNA, 22 bp, Homo sapiens
aagctgttgttcatcctgaatt

SEQ ID NO: 57651 - DNA, 22 bp, Homo sapiens
ttcagcagtgcagacacccagt

SEQ ID NO: 57652 - DNA, 22 bp, Homo sapiens
cccaggaggcagagcttgcagt

SEQ ID NO: 57653 - DNA, 22 bp, Homo sapiens
gaggctgaggttgcagtgagcc

SEQ ID NO: 57654 - DNA, 22 bp, Homo sapiens
tctctagtctcctttaacctga

SEQ ID NO: 57655 - DNA, 22 bp, Homo sapiens
accccagaggcggaggctgcag

SEQ ID NO: 57656 - DNA, 22 bp, Homo sapiens
tgatctaggttggcttcaactg

SEQ ID NO: 57657 - DNA, 22 bp, Homo sapiens
tgttcagaacaaaggtaaatga

SEQ ID NO: 57658 - DNA, 22 bp, Homo sapiens
taagagaatgttgtggctaggt

SEQ ID NO: 57659 - DNA, 22 bp, Homo sapiens
atccccctcttggatggcggca

SEQ ID NO: 57660 - DNA, 19 bp, Homo sapiens
gagaaagcaggcacagcac

SEQ ID NO: 57661 - DNA, 22 bp, Homo sapiens
catagcggtattccacgtggtt

SEQ ID NO: 57662 - DNA, 22 bp, Homo sapiens
ctgtggctcaggcctgtaagcc

SEQ ID NO: 57663 - DNA, 21 bp, Homo sapiens
tggctaaaccctagtaaatta

SEQ ID NO: 57664 - DNA, 22 bp, Homo sapiens
tagggtagtaccatgctgccag

SEQ ID NO: 57665 - DNA, 22 bp, Homo sapiens
gccttgatctgctgtgtttgag

SEQ ID NO: 57666 - DNA, 22 bp, Homo sapiens
gagagagctctgtgcctgggat

SEQ ID NO: 57667 - DNA, 23 bp, Homo sapiens
gggtccagccaattccaaggaaa

SEQ ID NO: 57668 - DNA, 22 bp, Homo sapiens
agcttgtgtttttctaagtatc

SEQ ID NO: 57669 - DNA, 22 bp, Homo sapiens
ggctgggcctctccctcagctg

SEQ ID NO: 57670 - DNA, 22 bp, Homo sapiens
gcctccccaagcagcagggatt

SEQ ID NO: 57671 - DNA, 22 bp, Homo sapiens
ggcgtttcaccatgttgaccag

SEQ ID NO: 57672 - DNA, 22 bp, Homo sapiens
actgtaacctcaaactcctggg

SEQ ID NO: 57673 - DNA, 22 bp, Homo sapiens
ggccgccctttccacggtttct

SEQ ID NO: 57674 - DNA, 22 bp, Homo sapiens
ggtgagcagctgtctgtatgga

SEQ ID NO: 57675 - DNA, 22 bp, Homo sapiens
accagcctggccaacatggtga

SEQ ID NO: 57676 - DNA, 22 bp, Homo sapiens
tctcatggagtcaggagcagaa

SEQ ID NO: 57677 - DNA, 22 bp, Homo sapiens
caggccggggcggcgccatctt

SEQ ID NO: 57678 - DNA, 22 bp, Homo sapiens
acagaagcctttggccatttga

SEQ ID NO: 57679 - DNA, 22 bp, Homo sapiens
caggctggagtgcagtggcgcc

SEQ ID NO: 57680 - DNA, 22 bp, Homo sapiens
attgaaaataaggccagaaaca

SEQ ID NO: 57681 - DNA, 22 bp, Homo sapiens
tctttgctccacactctagaga

SEQ ID NO: 57682 - DNA, 22 bp, Homo sapiens
ggcatagatttctttaggttta

SEQ ID NO: 57683 - DNA, 22 bp, Homo sapiens
tgtgttaaggtgcatctagtgc

SEQ ID NO: 57684 - DNA, 22 bp, Homo sapiens
acccagtctggagtgcagtgac

SEQ ID NO: 57685 - DNA, 22 bp, Homo sapiens
agctacagtcggaaggacagac

SEQ ID NO: 57686 - DNA, 22 bp, Homo sapiens
tggaatggaaacaaactgagga

SEQ ID NO: 57687 - DNA, 22 bp, Homo sapiens
tcctttgcttctgtcattctcc

SEQ ID NO: 57688 - DNA, 22 bp, Homo sapiens
gtctgctcatgctaccgcgggc

SEQ ID NO: 57689 - DNA, 18 bp, Homo sapiens
tcactgggtgtatgtggc

SEQ ID NO: 57690 - DNA, 22 bp, Homo sapiens
cacccaggttggagtgcagtgg

SEQ ID NO: 57691 - DNA, 22 bp, Homo sapiens
ttcagcttgctgactgcggcag

SEQ ID NO: 57692 - DNA, 22 bp, Homo sapiens
agagctaagaaacagaattgct

SEQ ID NO: 57693 - DNA, 22 bp, Homo sapiens
tctgtagtaggttgtagttctt

SEQ ID NO: 57694 - DNA, 22 bp, Homo sapiens
atgggtaaagcaggaagagagt

SEQ ID NO: 57695 - DNA, 22 bp, Homo sapiens
gctcactgcaacctccgccttc

SEQ ID NO: 57696 - DNA, 22 bp, Homo sapiens
ctgtggctctttagttgagcac

SEQ ID NO: 57697 - DNA, 22 bp, Homo sapiens
agctgaacgtgcttctgcagca

SEQ ID NO: 57698 - DNA, 22 bp, Homo sapiens
attgtgtcctcattgaccttca

SEQ ID NO: 57699 - DNA, 22 bp, Homo sapiens
gtagaccatttatctggggagt

SEQ ID NO: 57700 - DNA, 22 bp, Homo sapiens
gtgttgatgacattttagaaac

SEQ ID NO: 57701 - DNA, 23 bp, Homo sapiens
ctggggctttcaaatctgggcag

SEQ ID NO: 57702 - DNA, 22 bp, Homo sapiens
actacagtgtgataagaggggc

SEQ ID NO: 57703 - DNA, 22 bp, Homo sapiens
agtgcaggccccaggccaggcc

SEQ ID NO: 57704 - DNA, 22 bp, Homo sapiens
tatctattatgttctatgtgtc

SEQ ID NO: 57705 - DNA, 22 bp, Homo sapiens
ctagttgaagaggctgtcatca

SEQ ID NO: 57706 - DNA, 22 bp, Homo sapiens
gatgtagacacttggaggctta

SEQ ID NO: 57707 - DNA, 22 bp, Homo sapiens
acagacaagtagttcagacaag

SEQ ID NO: 57708 - DNA, 22 bp, Homo sapiens
cgttaataggtgcaaggtaagg

SEQ ID NO: 57709 - DNA, 20 bp, Homo sapiens
gggcagtggcgctatctcag

SEQ ID NO: 57710 - DNA, 22 bp, Homo sapiens
tccacgtgagcttcgtgtgcag

SEQ ID NO: 57711 - DNA, 22 bp, Homo sapiens
caggtggcagtgcctgcattct

SEQ ID NO: 57712 - DNA, 22 bp, Homo sapiens
ctgagccaaggggacagtgaca

SEQ ID NO: 57713 - DNA, 22 bp, Homo sapiens
gacctcatgatccacctgcctt

SEQ ID NO: 57714 - DNA, 23 bp, Homo sapiens
ggcctcagtgatgatgggttaaa

SEQ ID NO: 57715 - DNA, 22 bp, Homo sapiens
atgccactgcgctccagcctgg

SEQ ID NO: 57716 - DNA, 22 bp, Homo sapiens
gggggagagacgagcggctctg

SEQ ID NO: 57717 - DNA, 22 bp, Homo sapiens
ggaactcctgctccaagcagct

SEQ ID NO: 57718 - DNA, 22 bp, Homo sapiens
aggctggagtgcagttgcatga

SEQ ID NO: 57719 - DNA, 22 bp, Homo sapiens
gagcagtaggagaaccctgagc

SEQ ID NO: 57720 - DNA, 22 bp, Homo sapiens
tttcctcttctggcaggcaggg

SEQ ID NO: 57721 - DNA, 22 bp, Homo sapiens
ttaccaaatgaaatagagattt

SEQ ID NO: 57722 - DNA, 22 bp, Homo sapiens
ttgcccaggctggagtgcagtg

SEQ ID NO: 57723 - DNA, 22 bp, Homo sapiens
atggctgcctgggcgctggccg

SEQ ID NO: 57724 - DNA, 22 bp, Homo sapiens
acccgatgttggtgctctagta

SEQ ID NO: 57725 - DNA, 22 bp, Homo sapiens
acaatgctccctgtagtcagga

SEQ ID NO: 57726 - DNA, 22 bp, Homo sapiens
agccccttgtgggcgcacagca

SEQ ID NO: 57727 - DNA, 22 bp, Homo sapiens
cgtgtggtcccggcaaggcaag

SEQ ID NO: 57728 - DNA, 22 bp, Homo sapiens
gttgcagatgtggaactcgtgc

SEQ ID NO: 57729 - DNA, 22 bp, Homo sapiens
gtgacaatattagctcaggggc

SEQ ID NO: 57730 - DNA, 22 bp, Homo sapiens
ggtcagaggtcccagaagaagc

SEQ ID NO: 57731 - DNA, 22 bp, Homo sapiens
ctctgtggtggagtgggtcacc

SEQ ID NO: 57732 - DNA, 22 bp, Homo sapiens
ccctgccttgtctgggctaggt

SEQ ID NO: 57733 - DNA, 22 bp, Homo sapiens
tttccatgtgtactggccagaa

SEQ ID NO: 57734 - DNA, 22 bp, Homo sapiens
cccaggaggcggaggttgcagt

SEQ ID NO: 57735 - DNA, 22 bp, Homo sapiens
aggtcacccgtttgactatcca

SEQ ID NO: 57736 - DNA, 22 bp, Homo sapiens
ctttgcttgacactgtgattgt

SEQ ID NO: 57737 - DNA, 22 bp, Homo sapiens
tgtcaccttgctcatcctcgga

SEQ ID NO: 57738 - DNA, 22 bp, Homo sapiens
tgtggactcgcatggctgaggc

SEQ ID NO: 57739 - DNA, 22 bp, Homo sapiens
tctgagaatggtggatgtggtg

SEQ ID NO: 57740 - DNA, 22 bp, Homo sapiens
aacattgaacttggcacaccca

SEQ ID NO: 57741 - DNA, 22 bp, Homo sapiens
tacactgtttgaactgtggtcg

SEQ ID NO: 57742 - DNA, 22 bp, Homo sapiens
ttccgctgtttagttgaagttt

SEQ ID NO: 57743 - DNA, 22 bp, Homo sapiens
gtacaaatgcaggtttgttaca

SEQ ID NO: 57744 - DNA, 22 bp, Homo sapiens
cagtctctaaatcaatctgaat

SEQ ID NO: 57745 - DNA, 22 bp, Homo sapiens
ccgcggggcgtgggctcttacc

SEQ ID NO: 57746 - DNA, 21 bp, Homo sapiens
agaaggcaaaagcagacatct

SEQ ID NO: 57747 - DNA, 22 bp, Homo sapiens
gtagatgagctcacatgacctt

SEQ ID NO: 57748 - DNA, 20 bp, Homo sapiens
tgttgattggtgtcatctca

SEQ ID NO: 57749 - DNA, 22 bp, Homo sapiens
taaattgagattattagggtaa

SEQ ID NO: 57750 - DNA, 22 bp, Homo sapiens
tgggcagggagctggaaccaca

SEQ ID NO: 57751 - DNA, 22 bp, Homo sapiens
cacagcctcctctggctcacgg

SEQ ID NO: 57752 - DNA, 22 bp, Homo sapiens
gggctgggattgcttgctgtga

SEQ ID NO: 57753 - DNA, 22 bp, Homo sapiens
ggaggcggaggctgcagtgagc

SEQ ID NO: 57754 - DNA, 22 bp, Homo sapiens
tgagtagagaattcagctaagg

SEQ ID NO: 57755 - DNA, 22 bp, Homo sapiens
tccagggagagccgctgctcca

SEQ ID NO: 57756 - DNA, 22 bp, Homo sapiens
acaaagtgaattgcatcgagtt

SEQ ID NO: 57757 - DNA, 22 bp, Homo sapiens
ttgtcccaggacttgcatagat

SEQ ID NO: 57758 - DNA, 22 bp, Homo sapiens
tgcttttagctagtaactagta

SEQ ID NO: 57759 - DNA, 20 bp, Homo sapiens
ggcctcggacttcatcgtag

SEQ ID NO: 57760 - DNA, 22 bp, Homo sapiens
taacctgttaagggctgaccca

SEQ ID NO: 57761 - DNA, 22 bp, Homo sapiens
cccacgtcgaacttgctccaga

SEQ ID NO: 57762 - DNA, 18 bp, Homo sapiens
gatcgggggcgccccaag

SEQ ID NO: 57763 - DNA, 22 bp, Homo sapiens
tgaggcaggaggttgagaactg

SEQ ID NO: 57764 - DNA, 22 bp, Homo sapiens
ttctcccatctcagtcttacat

SEQ ID NO: 57765 - DNA, 22 bp, Homo sapiens
gacagtgaacaggttcccactg

SEQ ID NO: 57766 - DNA, 22 bp, Homo sapiens
ggaggctgaggcaggcggatca

SEQ ID NO: 57767 - DNA, 22 bp, Homo sapiens
tgagtggacacctgcttcttta

SEQ ID NO: 57768 - DNA, 22 bp, Homo sapiens
tggagaattctatgttgagggg

SEQ ID NO: 57769 - DNA, 22 bp, Homo sapiens
tcttctatcctcagcccctgcc

SEQ ID NO: 57770 - DNA, 22 bp, Homo sapiens
ttttcagaattagcataccatt

SEQ ID NO: 57771 - DNA, 22 bp, Homo sapiens
ttaaacatttatggaggcagca

SEQ ID NO: 57772 - DNA, 22 bp, Homo sapiens
tatgaggtaggtattatactta

SEQ ID NO: 57773 - DNA, 22 bp, Homo sapiens
tgtgtctgtgtatacacggcat

SEQ ID NO: 57774 - DNA, 22 bp, Homo sapiens
gtcacaaagcgcggtggtcggt

SEQ ID NO: 57775 - DNA, 22 bp, Homo sapiens
ctcattgcccagatccccacag

SEQ ID NO: 57776 - DNA, 22 bp, Homo sapiens
tccgaggccaaagctgtgaata

SEQ ID NO: 57777 - DNA, 22 bp, Homo sapiens
agggctggagccacagctggga

SEQ ID NO: 57778 - DNA, 22 bp, Homo sapiens
ggggatggaggcgtgtggtcct

SEQ ID NO: 57779 - DNA, 22 bp, Homo sapiens
tccagatgctgcacattcctga

SEQ ID NO: 57780 - DNA, 22 bp, Homo sapiens
gcctcctgtcccaggctgagga

SEQ ID NO: 57781 - DNA, 22 bp, Homo sapiens
gcggtagctcaagcttgtaatc

SEQ ID NO: 57782 - DNA, 22 bp, Homo sapiens
agcttagtggttgtatgagtta

SEQ ID NO: 57783 - DNA, 22 bp, Homo sapiens
ggaactgaatgtctcggtataa

SEQ ID NO: 57784 - DNA, 21 bp, Homo sapiens
cagagctgtccaaaccctgac

SEQ ID NO: 57785 - DNA, 22 bp, Homo sapiens
gagaggtggaggttgcagtgag

SEQ ID NO: 57786 - DNA, 22 bp, Homo sapiens
agagaagagtcttgtcaaatta

SEQ ID NO: 57787 - DNA, 22 bp, Homo sapiens
gtctcccaaactctgatggtcc

SEQ ID NO: 57788 - DNA, 22 bp, Homo sapiens
cgggcgcactccgggcagctgt

SEQ ID NO: 57789 - DNA, 22 bp, Homo sapiens
ttttctcttccctctggacctg

SEQ ID NO: 57790 - DNA, 22 bp, Homo sapiens
gtagcccacctggggagggcga

SEQ ID NO: 57791 - DNA, 22 bp, Homo sapiens
ccagcttgaagatgtgctggtt

SEQ ID NO: 57792 - DNA, 22 bp, Homo sapiens
ggcaagagggcagatggagtgc

SEQ ID NO: 57793 - DNA, 22 bp, Homo sapiens
gcagagccatgggaggtttttg

SEQ ID NO: 57794 - DNA, 22 bp, Homo sapiens
ctagggtgtgcagattttgcct

SEQ ID NO: 57795 - DNA, 22 bp, Homo sapiens
tttattggatatttacaagata

SEQ ID NO: 57796 - DNA, 22 bp, Homo sapiens
atatgggggggcgtgcagagga

SEQ ID NO: 57797 - DNA, 22 bp, Homo sapiens
atatgcagtctcttgcccttct

SEQ ID NO: 57798 - DNA, 19 bp, Homo sapiens
ttttggaaatgtgaacagc

SEQ ID NO: 57799 - DNA, 22 bp, Homo sapiens
tgatatgtaactactccttata

SEQ ID NO: 57800 - DNA, 22 bp, Homo sapiens
tatttcttttcgtgacttattg

SEQ ID NO: 57801 - DNA, 19 bp, Homo sapiens
agggaatccggctgaggga

SEQ ID NO: 57802 - DNA, 22 bp, Homo sapiens
tgtgtctcaagtcagagcatca

SEQ ID NO: 57803 - DNA, 22 bp, Homo sapiens
ctcactgcaagctctgcctcca

SEQ ID NO: 57804 - DNA, 22 bp, Homo sapiens
gagtcacatactatgtaataga

SEQ ID NO: 57805 - DNA, 21 bp, Homo sapiens
tgaaggggtggcagtgtgctt

SEQ ID NO: 57806 - DNA, 22 bp, Homo sapiens
cactgcactccagcttgggtga

SEQ ID NO: 57807 - DNA, 17 bp, Homo sapiens
cgggcatggagggcagg

SEQ ID NO: 57808 - DNA, 22 bp, Homo sapiens
agcattccacactgaagtctgc

SEQ ID NO: 57809 - DNA, 22 bp, Homo sapiens
tgctccatgcgctcggccggcg

SEQ ID NO: 57810 - DNA, 22 bp, Homo sapiens
cacctctcatttctacagattc

SEQ ID NO: 57811 - DNA, 22 bp, Homo sapiens
accgtgtctgacactttgggcg

SEQ ID NO: 57812 - DNA, 22 bp, Homo sapiens
tgctgtgttactgagatccggc

SEQ ID NO: 57813 - DNA, 22 bp, Homo sapiens
tccggactcacctgacaatggc

SEQ ID NO: 57814 - DNA, 22 bp, Homo sapiens
atatccagcagcaggtgagtat

SEQ ID NO: 57815 - DNA, 21 bp, Homo sapiens
cctcaaagatgatggggtttc

SEQ ID NO: 57816 - DNA, 22 bp, Homo sapiens
ttgaggtccccagtacccactg

SEQ ID NO: 57817 - DNA, 22 bp, Homo sapiens
acctagaatttaaaacattgct

SEQ ID NO: 57818 - DNA, 22 bp, Homo sapiens
tgtctggtgggttgacaggcag

SEQ ID NO: 57819 - DNA, 22 bp, Homo sapiens
agctcaatgcaacctccgcctc

SEQ ID NO: 57820 - DNA, 22 bp, Homo sapiens
tggctcactgtagccttgacct

SEQ ID NO: 57821 - DNA, 22 bp, Homo sapiens
ctgctctgctgatcagtgtctc

SEQ ID NO: 57822 - DNA, 22 bp, Homo sapiens
ttcccacattctttacattcat

SEQ ID NO: 57823 - DNA, 22 bp, Homo sapiens
gcagtggcatgatgtgggctca

SEQ ID NO: 57824 - DNA, 22 bp, Homo sapiens
aaattagtgcaccaggttgaag

SEQ ID NO: 57825 - DNA, 22 bp, Homo sapiens
attgtggtgtcagttataggca

SEQ ID NO: 57826 - DNA, 22 bp, Homo sapiens
agggctgcccagtgtgagagct

SEQ ID NO: 57827 - DNA, 22 bp, Homo sapiens
gcacagagagggaaggtaactt

SEQ ID NO: 57828 - DNA, 22 bp, Homo sapiens
ttatgggagcaattggggaggt

SEQ ID NO: 57829 - DNA, 23 bp, Homo sapiens
acagcaagaggaccagatgtgag

SEQ ID NO: 57830 - DNA, 22 bp, Homo sapiens
agatacattgcacgatgcagat

SEQ ID NO: 57831 - DNA, 22 bp, Homo sapiens
tgtctttgttattgtggacagg

SEQ ID NO: 57832 - DNA, 22 bp, Homo sapiens
gctggagaggatcccaaagcca

SEQ ID NO: 57833 - DNA, 22 bp, Homo sapiens
atgccactgcacttcagcctgg

SEQ ID NO: 57834 - DNA, 22 bp, Homo sapiens
cagtggccaacttcctgcctct

SEQ ID NO: 57835 - DNA, 22 bp, Homo sapiens
tgacagtgaacaggttaccact

SEQ ID NO: 57836 - DNA, 22 bp, Homo sapiens
agctacctgatccttcttctga

SEQ ID NO: 57837 - DNA, 22 bp, Homo sapiens
cctgccctgctcactgtcggta

SEQ ID NO: 57838 - DNA, 22 bp, Homo sapiens
tcgggctcgctctcctagcgga

SEQ ID NO: 57839 - DNA, 22 bp, Homo sapiens
gggtgctttggctcacgcctgt

SEQ ID NO: 57840 - DNA, 22 bp, Homo sapiens
tcactgcaacctctgcctcccg

SEQ ID NO: 57841 - DNA, 22 bp, Homo sapiens
ttccactctacacactgctggc

SEQ ID NO: 57842 - DNA, 22 bp, Homo sapiens
tgttttaagctctagaagggga

SEQ ID NO: 57843 - DNA, 22 bp, Homo sapiens
gcgagaaactaagtgccctttg

SEQ ID NO: 57844 - DNA, 22 bp, Homo sapiens
ttataagactgtagtgagtatt

SEQ ID NO: 57845 - DNA, 22 bp, Homo sapiens
ctgagatggagttttgctcttg

SEQ ID NO: 57846 - DNA, 22 bp, Homo sapiens
gccctgagaagaagtcggaggg

SEQ ID NO: 57847 - DNA, 22 bp, Homo sapiens
cctagatgggatggcggccggg

SEQ ID NO: 57848 - DNA, 22 bp, Homo sapiens
tccgggggtggtagatttcctt

SEQ ID NO: 57849 - DNA, 22 bp, Homo sapiens
ttagtctctttgcattgccata

SEQ ID NO: 57850 - DNA, 22 bp, Homo sapiens
tgaagctttaggatgggttcat

SEQ ID NO: 57851 - DNA, 22 bp, Homo sapiens
aaattagtcatgttgtattact

SEQ ID NO: 57852 - DNA, 22 bp, Homo sapiens
aaaatcctgctgactcgagatg

SEQ ID NO: 57853 - DNA, 22 bp, Homo sapiens
agctgccccgaggcggcgggaa

SEQ ID NO: 57854 - DNA, 22 bp, Homo sapiens
aaaaatcacttttataggcagc

SEQ ID NO: 57855 - DNA, 23 bp, Homo sapiens
cttcacaggttcaggggattaag

SEQ ID NO: 57856 - DNA, 22 bp, Homo sapiens
ttgcctgtgtcagcaggtggaa

SEQ ID NO: 57857 - DNA, 22 bp, Homo sapiens
tcacagctctgtcaattttata

SEQ ID NO: 57858 - DNA, 22 bp, Homo sapiens
agtcacagggggcccctgcaac

SEQ ID NO: 57859 - DNA, 22 bp, Homo sapiens
taattgtaaagtagtagtacag

SEQ ID NO: 57860 - DNA, 22 bp, Homo sapiens
ttagccaggggagcagcttgtc

SEQ ID NO: 57861 - DNA, 22 bp, Homo sapiens
atgatgaagcatggttacactg

SEQ ID NO: 57862 - DNA, 22 bp, Homo sapiens
caatcactctgcaacattcctg

SEQ ID NO: 57863 - DNA, 22 bp, Homo sapiens
ctggcagatagtaagtgatcaa

SEQ ID NO: 57864 - DNA, 22 bp, Homo sapiens
ccagactgcttgcttcccagcc

SEQ ID NO: 57865 - DNA, 22 bp, Homo sapiens
gcaaagaatgcagatttgcctc

SEQ ID NO: 57866 - DNA, 22 bp, Homo sapiens
gctggaggatggactggaagaa

SEQ ID NO: 57867 - DNA, 22 bp, Homo sapiens
gtggctcacgtctgtcatctca

SEQ ID NO: 57868 - DNA, 22 bp, Homo sapiens
ggggtcggggcatagccactta

SEQ ID NO: 57869 - DNA, 22 bp, Homo sapiens
actgcactccagcctgggtaac

SEQ ID NO: 57870 - DNA, 22 bp, Homo sapiens
actgcactccaacctgggtgac

SEQ ID NO: 57871 - DNA, 22 bp, Homo sapiens
tggacaggcaagcaagacatac

SEQ ID NO: 57872 - DNA, 22 bp, Homo sapiens
tggccaccaccaatacttgcct

SEQ ID NO: 57873 - DNA, 21 bp, Homo sapiens
tcactagtgccttctgtcatt

SEQ ID NO: 57874 - DNA, 22 bp, Homo sapiens
gggctgtaggagctggaatggg

SEQ ID NO: 57875 - DNA, 22 bp, Homo sapiens
tgctcatcaacatgatgatcat

SEQ ID NO: 57876 - DNA, 22 bp, Homo sapiens
ccaggagttggaggctgcagtg

SEQ ID NO: 57877 - DNA, 22 bp, Homo sapiens
ccagaagtcaagtaagatgaag

SEQ ID NO: 57878 - DNA, 22 bp, Homo sapiens
ttcacagtggtagtgcatttag

SEQ ID NO: 57879 - DNA, 22 bp, Homo sapiens
cgccaggcttggtagctcatgc

SEQ ID NO: 57880 - DNA, 22 bp, Homo sapiens
ggcctcgcggcttctggtggct

SEQ ID NO: 57881 - DNA, 22 bp, Homo sapiens
attgcactccagccctgctgac

SEQ ID NO: 57882 - DNA, 22 bp, Homo sapiens
catgctgtgtgttttagctcca

SEQ ID NO: 57883 - DNA, 22 bp, Homo sapiens
ctgggctcaagtgatccaccca

SEQ ID NO: 57884 - DNA, 22 bp, Homo sapiens
cttcctcctccatctcgaaggc

SEQ ID NO: 57885 - DNA, 22 bp, Homo sapiens
ggggccttttctgaatgtggaa

SEQ ID NO: 57886 - DNA, 22 bp, Homo sapiens
tgaacatgctgttgatggcctg

SEQ ID NO: 57887 - DNA, 22 bp, Homo sapiens
tagatttgtttccttctctcca

SEQ ID NO: 57888 - DNA, 22 bp, Homo sapiens
ttcctcaggctgctttcacata

SEQ ID NO: 57889 - DNA, 22 bp, Homo sapiens
aaggctgagacagcacaggtcc

SEQ ID NO: 57890 - DNA, 22 bp, Homo sapiens
atggggctgttctctgccctgc

SEQ ID NO: 57891 - DNA, 22 bp, Homo sapiens
gaatgcagatggctggtgtatg

SEQ ID NO: 57892 - DNA, 22 bp, Homo sapiens
aggactgggtgcagagggcatc

SEQ ID NO: 57893 - DNA, 22 bp, Homo sapiens
cagggggctcaaaggagagtgc

SEQ ID NO: 57894 - DNA, 22 bp, Homo sapiens
aggggagagttaatgtgaatgt

SEQ ID NO: 57895 - DNA, 22 bp, Homo sapiens
agcctgcgatcccacctggcct

SEQ ID NO: 57896 - DNA, 22 bp, Homo sapiens
gccacctcggctttctctgctc

SEQ ID NO: 57897 - DNA, 22 bp, Homo sapiens
aggaattgtgttgtagtggaga

SEQ ID NO: 57898 - DNA, 21 bp, Homo sapiens
aggcaccacatctccctcccc

SEQ ID NO: 57899 - DNA, 22 bp, Homo sapiens
attgagaagaaaatctaatata

SEQ ID NO: 57900 - DNA, 22 bp, Homo sapiens
caggcgggcaggtgcggcccct

SEQ ID NO: 57901 - DNA, 22 bp, Homo sapiens
tgtgaatggacaattaaatcta

SEQ ID NO: 57902 - DNA, 22 bp, Homo sapiens
ctatggtctggaccgaggtcct

SEQ ID NO: 57903 - DNA, 22 bp, Homo sapiens
tgaactgtacatccctaaccta

SEQ ID NO: 57904 - DNA, 22 bp, Homo sapiens
taagggttcagaatgcagtggt

SEQ ID NO: 57905 - DNA, 22 bp, Homo sapiens
tctggagataagcagcaatgaa

SEQ ID NO: 57906 - DNA, 22 bp, Homo sapiens
atgaaaacggaccagagctatt

SEQ ID NO: 57907 - DNA, 22 bp, Homo sapiens
agaggcaggaggttgacttgag

SEQ ID NO: 57908 - DNA, 22 bp, Homo sapiens
gtcacctcgctgtcttcctgag

SEQ ID NO: 57909 - DNA, 22 bp, Homo sapiens
tctaaacttgtaaacaagcata

SEQ ID NO: 57910 - DNA, 22 bp, Homo sapiens
ctagggtcaggggcctgcgtcg

SEQ ID NO: 57911 - DNA, 22 bp, Homo sapiens
gttaaggatcttgagatgagga

SEQ ID NO: 57912 - DNA, 22 bp, Homo sapiens
acaattctgatggtttcccagt

SEQ ID NO: 57913 - DNA, 22 bp, Homo sapiens
gacagacacaattgatccatga

SEQ ID NO: 57914 - DNA, 22 bp, Homo sapiens
gaataatcatgaaattcagtga

SEQ ID NO: 57915 - DNA, 22 bp, Homo sapiens
tgttaaaccagttttgcatcat

SEQ ID NO: 57916 - DNA, 22 bp, Homo sapiens
tttcactcagctctcattgtct

SEQ ID NO: 57917 - DNA, 22 bp, Homo sapiens
gccagccagaaacgtcacactg

SEQ ID NO: 57918 - DNA, 23 bp, Homo sapiens
catctagcatccagtgagtagtg

SEQ ID NO: 57919 - DNA, 22 bp, Homo sapiens
tgtgctctgactttctcctggt

SEQ ID NO: 57920 - DNA, 22 bp, Homo sapiens
tttgtgaataggttggcttcca

SEQ ID NO: 57921 - DNA, 21 bp, Homo sapiens
gggcagaggggcctcctgggt

SEQ ID NO: 57922 - DNA, 22 bp, Homo sapiens
ttcccttaaattatggcatcta

SEQ ID NO: 57923 - DNA, 22 bp, Homo sapiens
ctctggaccctcctgctgagag

SEQ ID NO: 57924 - DNA, 22 bp, Homo sapiens
tcttaagcagagaagaagttga

SEQ ID NO: 57925 - DNA, 22 bp, Homo sapiens
caagcttgtttctcctgggggt

SEQ ID NO: 57926 - DNA, 22 bp, Homo sapiens
aagtaaatatctgtagtcttta

SEQ ID NO: 57927 - DNA, 22 bp, Homo sapiens
ggccagcctggggctcccagac

SEQ ID NO: 57928 - DNA, 22 bp, Homo sapiens
ctccaacgaggctggggtacaa

SEQ ID NO: 57929 - DNA, 22 bp, Homo sapiens
tgggccgtggagcactctgaga

SEQ ID NO: 57930 - DNA, 20 bp, Homo sapiens
tctcgcactcggagcagccg

SEQ ID NO: 57931 - DNA, 22 bp, Homo sapiens
gagcccaggcagaggttgcagt

SEQ ID NO: 57932 - DNA, 22 bp, Homo sapiens
agaacctctggatacagtttaa

SEQ ID NO: 57933 - DNA, 19 bp, Homo sapiens
ccatggcaatgatctgatg

SEQ ID NO: 57934 - DNA, 22 bp, Homo sapiens
acttttcttatcagaaaggcca

SEQ ID NO: 57935 - DNA, 22 bp, Homo sapiens
tagagctggccgggacagctgg

SEQ ID NO: 57936 - DNA, 22 bp, Homo sapiens
aacccgggaggcagaggttgtg

SEQ ID NO: 57937 - DNA, 22 bp, Homo sapiens
cccagcaggtcggtgctgcctg

SEQ ID NO: 57938 - DNA, 22 bp, Homo sapiens
tgggggacaccagtctctctct

SEQ ID NO: 57939 - DNA, 22 bp, Homo sapiens
gcgagtgccgagagggcagggc

SEQ ID NO: 57940 - DNA, 22 bp, Homo sapiens
agtcttagaactacagtgccta

SEQ ID NO: 57941 - DNA, 22 bp, Homo sapiens
gaatgctaagcatgtgggagtt

SEQ ID NO: 57942 - DNA, 22 bp, Homo sapiens
gagccaggtcgggccgcggcga

SEQ ID NO: 57943 - DNA, 22 bp, Homo sapiens
caatttctaacattccatggat

SEQ ID NO: 57944 - DNA, 22 bp, Homo sapiens
agaacagaggccttatgtttca

SEQ ID NO: 57945 - DNA, 19 bp, Homo sapiens
gcccacggccctgctctgc

SEQ ID NO: 57946 - DNA, 22 bp, Homo sapiens
ttattttaccttcctctgagct

SEQ ID NO: 57947 - DNA, 22 bp, Homo sapiens
ctgggaggcggaggttgcagtg

SEQ ID NO: 57948 - DNA, 19 bp, Homo sapiens
aggagcactgccagcacca

SEQ ID NO: 57949 - DNA, 22 bp, Homo sapiens
agacggattacctgaggtcagg

SEQ ID NO: 57950 - DNA, 22 bp, Homo sapiens
tgatcagcatcttcccagctcg

SEQ ID NO: 57951 - DNA, 22 bp, Homo sapiens
tcactgcaacctccacctcccg

SEQ ID NO: 57952 - DNA, 22 bp, Homo sapiens
tctgtgttgagaaggatcatga

SEQ ID NO: 57953 - DNA, 22 bp, Homo sapiens
tgtttgagttctagcgcattta

SEQ ID NO: 57954 - DNA, 22 bp, Homo sapiens
gctgtagtgaatggccgcgttc

SEQ ID NO: 57955 - DNA, 22 bp, Homo sapiens
gtgcctgcaggtgccggcttca

SEQ ID NO: 57956 - DNA, 22 bp, Homo sapiens
tcagtgcacccaattctctcca

SEQ ID NO: 57957 - DNA, 22 bp, Homo sapiens
aggagagctggtgtctggaatc

SEQ ID NO: 57958 - DNA, 22 bp, Homo sapiens
gactacaggtgtgtgccaccat

SEQ ID NO: 57959 - DNA, 22 bp, Homo sapiens
ggctgagttgagaggattactt

SEQ ID NO: 57960 - DNA, 22 bp, Homo sapiens
gccctgggcaaggttctggcca

SEQ ID NO: 57961 - DNA, 22 bp, Homo sapiens
ccttttgctctcccatccagaa

SEQ ID NO: 57962 - DNA, 22 bp, Homo sapiens
aggctgaggcaagaggatcact

SEQ ID NO: 57963 - DNA, 22 bp, Homo sapiens
aggcaggaggatcatggatgca

SEQ ID NO: 57964 - DNA, 22 bp, Homo sapiens
gagagtctaggaacctcatata

SEQ ID NO: 57965 - DNA, 20 bp, Homo sapiens
tgaggcccagcagagtcggg

SEQ ID NO: 57966 - DNA, 22 bp, Homo sapiens
aacagtgtttttcttcagcact

SEQ ID NO: 57967 - DNA, 22 bp, Homo sapiens
tcatctgaagattgctgttcaa

SEQ ID NO: 57968 - DNA, 22 bp, Homo sapiens
gactacaggccggcatcagaga

SEQ ID NO: 57969 - DNA, 22 bp, Homo sapiens
aggctagaggcttctggcttca

SEQ ID NO: 57970 - DNA, 22 bp, Homo sapiens
tctcctggtacccttcctagca

SEQ ID NO: 57971 - DNA, 22 bp, Homo sapiens
gagcatcgctgagatcccagac

SEQ ID NO: 57972 - DNA, 22 bp, Homo sapiens
ccaggagttggaagctgccatg

SEQ ID NO: 57973 - DNA, 22 bp, Homo sapiens
gagctgggcctgcgagtgctgc

SEQ ID NO: 57974 - DNA, 22 bp, Homo sapiens
tgtccaggttagcttcaaacac

SEQ ID NO: 57975 - DNA, 17 bp, Homo sapiens
gctccagaattctagtc

SEQ ID NO: 57976 - DNA, 22 bp, Homo sapiens
tccagtatcaaagtcctagtcc

SEQ ID NO: 57977 - DNA, 22 bp, Homo sapiens
taattataacagttacatctta

SEQ ID NO: 57978 - DNA, 22 bp, Homo sapiens
ggtctcatctttcagcgtcgag

SEQ ID NO: 57979 - DNA, 22 bp, Homo sapiens
gcccagcgagcagaggtggacg

SEQ ID NO: 57980 - DNA, 22 bp, Homo sapiens
gcctcctgagtagctgggattg

SEQ ID NO: 57981 - DNA, 22 bp, Homo sapiens
gccatcatatcccctgtgacct

SEQ ID NO: 57982 - DNA, 22 bp, Homo sapiens
agccggccatgtggtcttgtgc

SEQ ID NO: 57983 - DNA, 22 bp, Homo sapiens
gggagcttaagacagttccaat

SEQ ID NO: 57984 - DNA, 22 bp, Homo sapiens
tcaccaggctagagtgcagtgg

SEQ ID NO: 57985 - DNA, 22 bp, Homo sapiens
aaagaaatagatggcatttaaa

SEQ ID NO: 57986 - DNA, 22 bp, Homo sapiens
caggccagggttgagaagagaa

SEQ ID NO: 57987 - DNA, 22 bp, Homo sapiens
gacaggtgctaagggacctggc

SEQ ID NO: 57988 - DNA, 22 bp, Homo sapiens
tcgcgggttgcacatggccatc

SEQ ID NO: 57989 - DNA, 22 bp, Homo sapiens
ttcttctttccaattacatggt

SEQ ID NO: 57990 - DNA, 23 bp, Homo sapiens
aatatcaaggtgatgttcccaga

SEQ ID NO: 57991 - DNA, 19 bp, Homo sapiens
agggttacccgctgccacc

SEQ ID NO: 57992 - DNA, 21 bp, Homo sapiens
cagggccaatcctgacctcta

SEQ ID NO: 57993 - DNA, 22 bp, Homo sapiens
tgacagtgcgggtacatcatag

SEQ ID NO: 57994 - DNA, 22 bp, Homo sapiens
tagcagcaaagcaggatctgct

SEQ ID NO: 57995 - DNA, 22 bp, Homo sapiens
tgggtagagtgctgacaatgcc

SEQ ID NO: 57996 - DNA, 20 bp, Homo sapiens
ccagagctgatggctgcccg

SEQ ID NO: 57997 - DNA, 22 bp, Homo sapiens
ccaggctggagtgcagtggcac

SEQ ID NO: 57998 - DNA, 22 bp, Homo sapiens
gacccaggggcagggagaaagt

SEQ ID NO: 57999 - DNA, 22 bp, Homo sapiens
ttctgcagtgttaacaatgtca

SEQ ID NO: 58000 - DNA, 20 bp, Homo sapiens
gctgaggtggaggaaggaga

SEQ ID NO: 58001 - DNA, 22 bp, Homo sapiens
ttgtgtgtactggttatgggca

SEQ ID NO: 58002 - DNA, 22 bp, Homo sapiens
cgctgctccgccttgtccatat

SEQ ID NO: 58003 - DNA, 17 bp, Homo sapiens
cagtcgaggaggacctg

SEQ ID NO: 58004 - DNA, 22 bp, Homo sapiens
cttgggaggcagaggttgcagt

SEQ ID NO: 58005 - DNA, 22 bp, Homo sapiens
tgaagttgttaaggttgccatt

SEQ ID NO: 58006 - DNA, 22 bp, Homo sapiens
ctgcttctagcaccaagtccct

SEQ ID NO: 58007 - DNA, 22 bp, Homo sapiens
agaagccaccagctgaggaaga

SEQ ID NO: 58008 - DNA, 22 bp, Homo sapiens
atgtatatgcatgcattcaaag

SEQ ID NO: 58009 - DNA, 22 bp, Homo sapiens
gggaaggaaagttattagcaga

SEQ ID NO: 58010 - DNA, 22 bp, Homo sapiens
cccaggccccagggcttgtcag

SEQ ID NO: 58011 - DNA, 22 bp, Homo sapiens
gtgtatgttctacttaatatta

SEQ ID NO: 58012 - DNA, 22 bp, Homo sapiens
ttcccacagtgactccagagaa

SEQ ID NO: 58013 - DNA, 22 bp, Homo sapiens
tgggagcagttgcatctccagt

SEQ ID NO: 58014 - DNA, 22 bp, Homo sapiens
caggaagctgtgaaggagacgg

SEQ ID NO: 58015 - DNA, 22 bp, Homo sapiens
gctcccaggatgaggagccagg

SEQ ID NO: 58016 - DNA, 23 bp, Homo sapiens
gacagagtgagaccttgtcttac

SEQ ID NO: 58017 - DNA, 22 bp, Homo sapiens
gtggagaggaacccagctctgt

SEQ ID NO: 58018 - DNA, 22 bp, Homo sapiens
gcagtggggcaatcatagctca

SEQ ID NO: 58019 - DNA, 22 bp, Homo sapiens
aggggagccagggctgcgagtt

SEQ ID NO: 58020 - DNA, 22 bp, Homo sapiens
tcacaaatgtttgcatgtgtct

SEQ ID NO: 58021 - DNA, 22 bp, Homo sapiens
gaggcagaggttgttgcagtga

SEQ ID NO: 58022 - DNA, 22 bp, Homo sapiens
aagtgctgggattacaggcatg

SEQ ID NO: 58023 - DNA, 19 bp, Homo sapiens
ctctgggcaagtcacttaa

SEQ ID NO: 58024 - DNA, 19 bp, Homo sapiens
tctgaagaattagagagca

SEQ ID NO: 58025 - DNA, 22 bp, Homo sapiens
tgctgctgaggctaaagtatag

SEQ ID NO: 58026 - DNA, 22 bp, Homo sapiens
tatactctgagaaacgtgtcac

SEQ ID NO: 58027 - DNA, 22 bp, Homo sapiens
ggagctgttcaggactgcttca

SEQ ID NO: 58028 - DNA, 22 bp, Homo sapiens
ggcgccgcactcggtgcagccg

SEQ ID NO: 58029 - DNA, 22 bp, Homo sapiens
aaagatcacgtcccaggactcg

SEQ ID NO: 58030 - DNA, 22 bp, Homo sapiens
agcaagatttttcaggttagta

SEQ ID NO: 58031 - DNA, 22 bp, Homo sapiens
ttgacctatgtttcttcatctg

SEQ ID NO: 58032 - DNA, 22 bp, Homo sapiens
gggagctgagctggaagagaat

SEQ ID NO: 58033 - DNA, 22 bp, Homo sapiens
gctgggttttcttccgggccta

SEQ ID NO: 58034 - DNA, 22 bp, Homo sapiens
ttctttgcccatgtttcctaag

SEQ ID NO: 58035 - DNA, 22 bp, Homo sapiens
tggaggccagaggtactgggac

SEQ ID NO: 58036 - DNA, 22 bp, Homo sapiens
catgtaaagaatttcacacaag

SEQ ID NO: 58037 - DNA, 22 bp, Homo sapiens
aagccctggacggcccttcccc

SEQ ID NO: 58038 - DNA, 22 bp, Homo sapiens
ccaggaggtggagattgcagtg

SEQ ID NO: 58039 - DNA, 22 bp, Homo sapiens
ccacgtccagctaattttcgta

SEQ ID NO: 58040 - DNA, 22 bp, Homo sapiens
gtgggggcaggcagtgctagga

SEQ ID NO: 58041 - DNA, 22 bp, Homo sapiens
cccaggctggagtgtaatggtg

SEQ ID NO: 58042 - DNA, 22 bp, Homo sapiens
cctgcacagccggacccctgct

SEQ ID NO: 58043 - DNA, 22 bp, Homo sapiens
gtggcagaccttcccttctcct

SEQ ID NO: 58044 - DNA, 22 bp, Homo sapiens
cacactgtctttatgagctgta

SEQ ID NO: 58045 - DNA, 22 bp, Homo sapiens
tcccacacagcccgctcaccgg

SEQ ID NO: 58046 - DNA, 22 bp, Homo sapiens
cctacagttatattcttgattg

SEQ ID NO: 58047 - DNA, 22 bp, Homo sapiens
gccaggcgggtctcaaactcct

SEQ ID NO: 58048 - DNA, 22 bp, Homo sapiens
gcttctcaattctcaccctcca

SEQ ID NO: 58049 - DNA, 23 bp, Homo sapiens
actgagccagggcctgggtcagc

SEQ ID NO: 58050 - DNA, 22 bp, Homo sapiens
gaggggagcccccatcctccag

SEQ ID NO: 58051 - DNA, 22 bp, Homo sapiens
ggtggcagtagcactgggcctg

SEQ ID NO: 58052 - DNA, 22 bp, Homo sapiens
ctccatatgttcagttatgcag

SEQ ID NO: 58053 - DNA, 22 bp, Homo sapiens
cttgatctacatagtgaaaccc

SEQ ID NO: 58054 - DNA, 22 bp, Homo sapiens
atttctctgcagtgttcggaat

SEQ ID NO: 58055 - DNA, 22 bp, Homo sapiens
gctgatgtatatagtgattgag

SEQ ID NO: 58056 - DNA, 22 bp, Homo sapiens
gggggaagaaagaacatggcat

SEQ ID NO: 58057 - DNA, 22 bp, Homo sapiens
accagaagctggagcacaagga

SEQ ID NO: 58058 - DNA, 22 bp, Homo sapiens
cattccttaacgtggggagtct

SEQ ID NO: 58059 - DNA, 22 bp, Homo sapiens
ttctcttacattttctcagcct

SEQ ID NO: 58060 - DNA, 22 bp, Homo sapiens
aaaagcaattgcgggttttgcc

SEQ ID NO: 58061 - DNA, 22 bp, Homo sapiens
ccaggagtgcagggatggtatc

SEQ ID NO: 58062 - DNA, 22 bp, Homo sapiens
cccaggaggcagatgttgcagt

SEQ ID NO: 58063 - DNA, 22 bp, Homo sapiens
gaggggctgccctggtgtcagg

SEQ ID NO: 58064 - DNA, 18 bp, Homo sapiens
catgggtgacaggtggat

SEQ ID NO: 58065 - DNA, 22 bp, Homo sapiens
ttgaggcctgctggaaggtgtt

SEQ ID NO: 58066 - DNA, 22 bp, Homo sapiens
gtggtgtaggtcacagttagga

SEQ ID NO: 58067 - DNA, 22 bp, Homo sapiens
ctgaggctggagtgcagtggtg

SEQ ID NO: 58068 - DNA, 22 bp, Homo sapiens
aactcctctctggtggttcgtc

SEQ ID NO: 58069 - DNA, 22 bp, Homo sapiens
tctgtcacccagagtgcagtgg

SEQ ID NO: 58070 - DNA, 22 bp, Homo sapiens
actcagtacatctggagttggc

SEQ ID NO: 58071 - DNA, 22 bp, Homo sapiens
gcaccacatcaatgaggggagc

SEQ ID NO: 58072 - DNA, 18 bp, Homo sapiens
gaggatggaaggagatgc

SEQ ID NO: 58073 - DNA, 22 bp, Homo sapiens
ccaggaggcggaggttgcagcg

SEQ ID NO: 58074 - DNA, 22 bp, Homo sapiens
ttgcactccagcccgagcaaca

SEQ ID NO: 58075 - DNA, 22 bp, Homo sapiens
cagtaatagaggctttgagtct

SEQ ID NO: 58076 - DNA, 22 bp, Homo sapiens
tggctcatgcctgtaatcttag

SEQ ID NO: 58077 - DNA, 22 bp, Homo sapiens
aattatggtcactgttcctggg

SEQ ID NO: 58078 - DNA, 22 bp, Homo sapiens
gtcaccagtgctaagaggtgga

SEQ ID NO: 58079 - DNA, 22 bp, Homo sapiens
gaggccaaggtgggcagatcac

SEQ ID NO: 58080 - DNA, 22 bp, Homo sapiens
atctccgccatcgcgaacgcct

SEQ ID NO: 58081 - DNA, 22 bp, Homo sapiens
tcactgcaacctccgcctgctg

SEQ ID NO: 58082 - DNA, 22 bp, Homo sapiens
ggaggacaggggctgcagcaca

SEQ ID NO: 58083 - DNA, 22 bp, Homo sapiens
gttttgaatactactagaactt

SEQ ID NO: 58084 - DNA, 22 bp, Homo sapiens
tctgagccagggtctcctccct

SEQ ID NO: 58085 - DNA, 20 bp, Homo sapiens
tgacatagctcttggggtgc

SEQ ID NO: 58086 - DNA, 22 bp, Homo sapiens
ctcctgaattgtccctcacagc

SEQ ID NO: 58087 - DNA, 22 bp, Homo sapiens
ctcgggcttgaggctgtttacc

SEQ ID NO: 58088 - DNA, 21 bp, Homo sapiens
ggcctcccggaccgcagcgcc

SEQ ID NO: 58089 - DNA, 22 bp, Homo sapiens
atccatttgacataatttcagc

SEQ ID NO: 58090 - DNA, 22 bp, Homo sapiens
gcagactgtatcaatgtcagta

SEQ ID NO: 58091 - DNA, 22 bp, Homo sapiens
gggcggggtggctcatgcctgt

SEQ ID NO: 58092 - DNA, 22 bp, Homo sapiens
gtgcggatcggtgtcctccaaa

SEQ ID NO: 58093 - DNA, 22 bp, Homo sapiens
agttttcattaccatgctgcaa

SEQ ID NO: 58094 - DNA, 22 bp, Homo sapiens
aaggatgattggtaatgacact

SEQ ID NO: 58095 - DNA, 22 bp, Homo sapiens
ctcaggacggccgggggagcct

SEQ ID NO: 58096 - DNA, 22 bp, Homo sapiens
caaaccacactcagcgtatcgg

SEQ ID NO: 58097 - DNA, 22 bp, Homo sapiens
ggtcagccttggatttggtagc

SEQ ID NO: 58098 - DNA, 22 bp, Homo sapiens
aggtagttttgacttcatggct

SEQ ID NO: 58099 - DNA, 22 bp, Homo sapiens
ctgggaggcagaggttgcagtg

SEQ ID NO: 58100 - DNA, 22 bp, Homo sapiens
agcactgatttaaactggattt

SEQ ID NO: 58101 - DNA, 22 bp, Homo sapiens
gggtggtggccagcagtgggca

SEQ ID NO: 58102 - DNA, 22 bp, Homo sapiens
cgtcccgggttcacgccattct

SEQ ID NO: 58103 - DNA, 22 bp, Homo sapiens
tcccagagctctggaggttgga

SEQ ID NO: 58104 - DNA, 22 bp, Homo sapiens
ttctacagtgactgcagccata

SEQ ID NO: 58105 - DNA, 22 bp, Homo sapiens
tggtacacatgtccaaggtcag

SEQ ID NO: 58106 - DNA, 22 bp, Homo sapiens
gggaagtgatggagccaggatt

SEQ ID NO: 58107 - DNA, 22 bp, Homo sapiens
gcatggcttcggggtgctgcct

SEQ ID NO: 58108 - DNA, 22 bp, Homo sapiens
ggggtgggcgtgcagggacacc

SEQ ID NO: 58109 - DNA, 21 bp, Homo sapiens
tgcaatccagcctgggcgaca

SEQ ID NO: 58110 - DNA, 22 bp, Homo sapiens
aagaggtaaccatagcaaccac

SEQ ID NO: 58111 - DNA, 22 bp, Homo sapiens
gaagattgaaggctgggaatta

SEQ ID NO: 58112 - DNA, 22 bp, Homo sapiens
tgtaccactctactaagggttc

SEQ ID NO: 58113 - DNA, 23 bp, Homo sapiens
ggagtgcaatggcgccatctcgg

SEQ ID NO: 58114 - DNA, 22 bp, Homo sapiens
tgatattttatgagctttcata

SEQ ID NO: 58115 - DNA, 22 bp, Homo sapiens
ggttcccggatctccgagtccc

SEQ ID NO: 58116 - DNA, 22 bp, Homo sapiens
ttgtgaatagtgccgctataaa

SEQ ID NO: 58117 - DNA, 22 bp, Homo sapiens
gccttgccgctcagcagtgggg

SEQ ID NO: 58118 - DNA, 22 bp, Homo sapiens
acaggatcgccctgttgcccag

SEQ ID NO: 58119 - DNA, 21 bp, Homo sapiens
gagagctaacagtgacagctc

SEQ ID NO: 58120 - DNA, 22 bp, Homo sapiens
cttcttgctgggggcctcagtg

SEQ ID NO: 58121 - DNA, 22 bp, Homo sapiens
tttggtattgcacactgtcttc

SEQ ID NO: 58122 - DNA, 22 bp, Homo sapiens
atgttgtgtttgactgttaccc

SEQ ID NO: 58123 - DNA, 22 bp, Homo sapiens
agttgctgggaaagatttcagt

SEQ ID NO: 58124 - DNA, 22 bp, Homo sapiens
tgaagaaacgcagagaggtagg

SEQ ID NO: 58125 - DNA, 22 bp, Homo sapiens
gcccagatctcctgaccctcag

SEQ ID NO: 58126 - DNA, 22 bp, Homo sapiens
agggaagaggaccagagtctct

SEQ ID NO: 58127 - DNA, 22 bp, Homo sapiens
gctggcagacttcctctggaac

SEQ ID NO: 58128 - DNA, 23 bp, Homo sapiens
cagagctggctcagagctgcctg

SEQ ID NO: 58129 - DNA, 22 bp, Homo sapiens
gcaggtggatcacctgaggtca

SEQ ID NO: 58130 - DNA, 17 bp, Homo sapiens
acttcccacccctccag

SEQ ID NO: 58131 - DNA, 20 bp, Homo sapiens
caaatccctgctctgtgctg

SEQ ID NO: 58132 - DNA, 22 bp, Homo sapiens
ggttgtagttggaggttgtata

SEQ ID NO: 58133 - DNA, 22 bp, Homo sapiens
aaagaggcaatcaatgtagcaa

SEQ ID NO: 58134 - DNA, 22 bp, Homo sapiens
atgggttcaagtgattctcctg

SEQ ID NO: 58135 - DNA, 22 bp, Homo sapiens
cgcaccactgaattccagcctg

SEQ ID NO: 58136 - DNA, 22 bp, Homo sapiens
catcatcaaaagtgacagagaa

SEQ ID NO: 58137 - DNA, 22 bp, Homo sapiens
ttctctgcctcacaggtctaag

SEQ ID NO: 58138 - DNA, 22 bp, Homo sapiens
tctcatctgccatttgcaggag

SEQ ID NO: 58139 - DNA, 22 bp, Homo sapiens
actggacagaggaaatatggag

SEQ ID NO: 58140 - DNA, 22 bp, Homo sapiens
accagcctggccaacatggcaa

SEQ ID NO: 58141 - DNA, 22 bp, Homo sapiens
aaagagccgctgatgtcagccc

SEQ ID NO: 58142 - DNA, 22 bp, Homo sapiens
cagcagagaaattacatatttg

SEQ ID NO: 58143 - DNA, 22 bp, Homo sapiens
tggggccatctcacccactgtt

SEQ ID NO: 58144 - DNA, 22 bp, Homo sapiens
agcctattccaggatgagctca

SEQ ID NO: 58145 - DNA, 22 bp, Homo sapiens
taggttttcctaaaattctggt

SEQ ID NO: 58146 - DNA, 22 bp, Homo sapiens
gagagtctagtgcacctagttt

SEQ ID NO: 58147 - DNA, 22 bp, Homo sapiens
ctcatcagaaatacctgacaaa

SEQ ID NO: 58148 - DNA, 20 bp, Homo sapiens
cagcagtggatgagagtttt

SEQ ID NO: 58149 - DNA, 22 bp, Homo sapiens
gtggcctggctggcaccacctc

SEQ ID NO: 58150 - DNA, 22 bp, Homo sapiens
agtggactcttcccagtgcttg

SEQ ID NO: 58151 - DNA, 22 bp, Homo sapiens
tgtccaggctaaagtgcagtgg

SEQ ID NO: 58152 - DNA, 22 bp, Homo sapiens
attaaagctatccagtcatgaa

SEQ ID NO: 58153 - DNA, 22 bp, Homo sapiens
gggcaggggtcagtggccccaa

SEQ ID NO: 58154 - DNA, 22 bp, Homo sapiens
tgctgggctggggcctcagacc

SEQ ID NO: 58155 - DNA, 22 bp, Homo sapiens
tgagtgtggggaatgtcatgag

SEQ ID NO: 58156 - DNA, 22 bp, Homo sapiens
tccttaggaaaatgatgagggg

SEQ ID NO: 58157 - DNA, 22 bp, Homo sapiens
ctgaagagaaagggagctcttc

SEQ ID NO: 58158 - DNA, 22 bp, Homo sapiens
tgtgaacttactgtccccacag

SEQ ID NO: 58159 - DNA, 22 bp, Homo sapiens
tgcctagttctgtatttacagt

SEQ ID NO: 58160 - DNA, 22 bp, Homo sapiens
catctgtaaagtaggaatattg

SEQ ID NO: 58161 - DNA, 22 bp, Homo sapiens
acgggccttctcttcaggcgag

SEQ ID NO: 58162 - DNA, 22 bp, Homo sapiens
ccattgtaaattctgtggaagt

SEQ ID NO: 58163 - DNA, 22 bp, Homo sapiens
tagatgtgttgcctggagttgt

SEQ ID NO: 58164 - DNA, 22 bp, Homo sapiens
agtggctgagtgactgtgactc

SEQ ID NO: 58165 - DNA, 22 bp, Homo sapiens
aaagctgtcaaggcaggaggct

SEQ ID NO: 58166 - DNA, 21 bp, Homo sapiens
ttgctgttttcccaatgcagt

SEQ ID NO: 58167 - DNA, 22 bp, Homo sapiens
tttttagtagaggtgggtttca

SEQ ID NO: 58168 - DNA, 22 bp, Homo sapiens
ccatcacagtccccatcgtgat

SEQ ID NO: 58169 - DNA, 22 bp, Homo sapiens
tgagccaggagtttgaggctgt

SEQ ID NO: 58170 - DNA, 22 bp, Homo sapiens
agcactgtgagcaccagcacgc

SEQ ID NO: 58171 - DNA, 22 bp, Homo sapiens
atgctatgtaactggcagatag

SEQ ID NO: 58172 - DNA, 22 bp, Homo sapiens
ggctgggcaggtctgcacaggg

SEQ ID NO: 58173 - DNA, 22 bp, Homo sapiens
ttgtctaatgagctccacttca

SEQ ID NO: 58174 - DNA, 22 bp, Homo sapiens
tggtacaatcacagctcactgt

SEQ ID NO: 58175 - DNA, 22 bp, Homo sapiens
cattgcaacttcaaactcctgg

SEQ ID NO: 58176 - DNA, 22 bp, Homo sapiens
tccccagcttgctacttctgct

SEQ ID NO: 58177 - DNA, 22 bp, Homo sapiens
ggctccaccctgcttccagaag

SEQ ID NO: 58178 - DNA, 22 bp, Homo sapiens
ggagacagggttgaaccacgca

SEQ ID NO: 58179 - DNA, 22 bp, Homo sapiens
taggtagctttggcgtttcttg

SEQ ID NO: 58180 - DNA, 22 bp, Homo sapiens
tcaaatgctgtattgtagtaat

SEQ ID NO: 58181 - DNA, 22 bp, Homo sapiens
agagggtgggcacgtgatggat

SEQ ID NO: 58182 - DNA, 22 bp, Homo sapiens
tttgcttgattaggatatggaa

SEQ ID NO: 58183 - DNA, 22 bp, Homo sapiens
aagtgctgggattacaggtgtc

SEQ ID NO: 58184 - DNA, 22 bp, Homo sapiens
aatgttacgatcaacaacacat

SEQ ID NO: 58185 - DNA, 22 bp, Homo sapiens
atctggttcttcttaggcatca

SEQ ID NO: 58186 - DNA, 22 bp, Homo sapiens
agatggggtttcatcatgttgg

SEQ ID NO: 58187 - DNA, 22 bp, Homo sapiens
accatgttggccaagctggtct

SEQ ID NO: 58188 - DNA, 22 bp, Homo sapiens
gtggggacgggatggctcactg

SEQ ID NO: 58189 - DNA, 22 bp, Homo sapiens
tctcagggctcagagctcaggc

SEQ ID NO: 58190 - DNA, 15 bp, Homo sapiens
tggcccacccgttga

SEQ ID NO: 58191 - DNA, 22 bp, Homo sapiens
gttgtgattgtagctaaactag

SEQ ID NO: 58192 - DNA, 22 bp, Homo sapiens
ctcactgcaacctccgcctcct

SEQ ID NO: 58193 - DNA, 22 bp, Homo sapiens
aggagggtgggaagcagtttta

SEQ ID NO: 58194 - DNA, 22 bp, Homo sapiens
ttacaattacttgatctcagct

SEQ ID NO: 58195 - DNA, 22 bp, Homo sapiens
cccggacagaggggcagagtgt

SEQ ID NO: 58196 - DNA, 22 bp, Homo sapiens
aggtattattagcatctctatt

SEQ ID NO: 58197 - DNA, 22 bp, Homo sapiens
cagccacttgtgatgctgggga

SEQ ID NO: 58198 - DNA, 22 bp, Homo sapiens
gcaaaagtacagccggatttct

SEQ ID NO: 58199 - DNA, 22 bp, Homo sapiens
gggtctcctaatggaggatgac

SEQ ID NO: 58200 - DNA, 23 bp, Homo sapiens
tgagctgggcctgcaggggtctc

SEQ ID NO: 58201 - DNA, 22 bp, Homo sapiens
ctggaaggcggaggttgtagtg

SEQ ID NO: 58202 - DNA, 22 bp, Homo sapiens
gttgcctaggctggagtgcagt

SEQ ID NO: 58203 - DNA, 22 bp, Homo sapiens
atgctctctgtcctgctcagag

SEQ ID NO: 58204 - DNA, 22 bp, Homo sapiens
tggggagaaatgtctttgttcc

SEQ ID NO: 58205 - DNA, 22 bp, Homo sapiens
gctgaggctcctcgggaggaca

SEQ ID NO: 58206 - DNA, 22 bp, Homo sapiens
aaatgcaacgggctttccttat

SEQ ID NO: 58207 - DNA, 22 bp, Homo sapiens
gctggtagacctcactgcactc

SEQ ID NO: 58208 - DNA, 22 bp, Homo sapiens
tcctcagaatcacctggcagct

SEQ ID NO: 58209 - DNA, 22 bp, Homo sapiens
gaagaaggtggcccaggggtag

SEQ ID NO: 58210 - DNA, 22 bp, Homo sapiens
agaacctcaattatttttgcac

SEQ ID NO: 58211 - DNA, 22 bp, Homo sapiens
tcttcctgtcaatgagaattaa

SEQ ID NO: 58212 - DNA, 22 bp, Homo sapiens
agaggggcccggttctccgtct

SEQ ID NO: 58213 - DNA, 22 bp, Homo sapiens
tggaagaatatgggggtacaga

SEQ ID NO: 58214 - DNA, 22 bp, Homo sapiens
attttctctttgtatatgctag

SEQ ID NO: 58215 - DNA, 22 bp, Homo sapiens
aggaattcaagaccagctgggc

SEQ ID NO: 58216 - DNA, 22 bp, Homo sapiens
tgaggctccttgtagagagtgg

SEQ ID NO: 58217 - DNA, 22 bp, Homo sapiens
aggggtgacacatatcagtgca

SEQ ID NO: 58218 - DNA, 22 bp, Homo sapiens
gcggggggaggaacatcttgca

SEQ ID NO: 58219 - DNA, 22 bp, Homo sapiens
ttagatttacaagcactgttta

SEQ ID NO: 58220 - DNA, 22 bp, Homo sapiens
gatttagtggcccttggtacac

SEQ ID NO: 58221 - DNA, 22 bp, Homo sapiens
caggagatgacagggaagaacc

SEQ ID NO: 58222 - DNA, 22 bp, Homo sapiens
ggtttgacagcttggggctgtc

SEQ ID NO: 58223 - DNA, 22 bp, Homo sapiens
ggtgaggggctcctctgcccgg

SEQ ID NO: 58224 - DNA, 22 bp, Homo sapiens
gcctggagaaaggaaggtggga

SEQ ID NO: 58225 - DNA, 22 bp, Homo sapiens
cactgcactccagcactccagc

SEQ ID NO: 58226 - DNA, 22 bp, Homo sapiens
tactcttttagccccacagaga

SEQ ID NO: 58227 - DNA, 22 bp, Homo sapiens
aagatacagacagagccaaaat

SEQ ID NO: 58228 - DNA, 22 bp, Homo sapiens
gtaggccatggtggttgtctct

SEQ ID NO: 58229 - DNA, 22 bp, Homo sapiens
actgcaacacctcctgggttca

SEQ ID NO: 58230 - DNA, 22 bp, Homo sapiens
tggggcagttaataaacattct

SEQ ID NO: 58231 - DNA, 22 bp, Homo sapiens
tgtgacaagcattgtatattgg

SEQ ID NO: 58232 - DNA, 22 bp, Homo sapiens
tcaccttgtgatccgcccacct

SEQ ID NO: 58233 - DNA, 22 bp, Homo sapiens
tggaaatgtttcttgagctcag

SEQ ID NO: 58234 - DNA, 22 bp, Homo sapiens
cagctgcccctccagggctggg

SEQ ID NO: 58235 - DNA, 22 bp, Homo sapiens
ttgagcccaggaggcctgggtg

SEQ ID NO: 58236 - DNA, 21 bp, Homo sapiens
acacaagcactcgtacatacg

SEQ ID NO: 58237 - DNA, 22 bp, Homo sapiens
catttctgggagacatgctaga

SEQ ID NO: 58238 - DNA, 22 bp, Homo sapiens
tataaactcctcttgcattcct

SEQ ID NO: 58239 - DNA, 22 bp, Homo sapiens
gattgagtctgaggatgctgca

SEQ ID NO: 58240 - DNA, 22 bp, Homo sapiens
acatttatataactcactagga

SEQ ID NO: 58241 - DNA, 22 bp, Homo sapiens
ctgaggcctctcccactccagc

SEQ ID NO: 58242 - DNA, 22 bp, Homo sapiens
aactctatttaccctactaaac

SEQ ID NO: 58243 - DNA, 19 bp, Homo sapiens
taggaccctggtggccccc

SEQ ID NO: 58244 - DNA, 22 bp, Homo sapiens
atagaatatgacttttagatcc

SEQ ID NO: 58245 - DNA, 22 bp, Homo sapiens
ttagctcagaaaatttaaactt

SEQ ID NO: 58246 - DNA, 22 bp, Homo sapiens
gatgctgagagattggagacta

SEQ ID NO: 58247 - DNA, 22 bp, Homo sapiens
ttgaaaagttttgaaacactct

SEQ ID NO: 58248 - DNA, 20 bp, Homo sapiens
tgagacccgctgacaagttc

SEQ ID NO: 58249 - DNA, 22 bp, Homo sapiens
ttggatccatctcaggcatagg

SEQ ID NO: 58250 - DNA, 17 bp, Homo sapiens
tccttcagtgcctctgc

SEQ ID NO: 58251 - DNA, 22 bp, Homo sapiens
gtagtctgaacagtaattttgt

SEQ ID NO: 58252 - DNA, 22 bp, Homo sapiens
gcagcgaggtgatgaaatagct

SEQ ID NO: 58253 - DNA, 22 bp, Homo sapiens
cctgtcacctaggtactgagca

SEQ ID NO: 58254 - DNA, 22 bp, Homo sapiens
tcttcccccgtgctccagtgca

SEQ ID NO: 58255 - DNA, 22 bp, Homo sapiens
gagaaatgcatgcatgtcatca

SEQ ID NO: 58256 - DNA, 22 bp, Homo sapiens
tttctcatggaacatcgtttag

SEQ ID NO: 58257 - DNA, 22 bp, Homo sapiens
tgcctccctggcaagtctctcc

SEQ ID NO: 58258 - DNA, 22 bp, Homo sapiens
gggcggggggagctggaatgaa

SEQ ID NO: 58259 - DNA, 22 bp, Homo sapiens
ggagctcctggcagtgacagag

SEQ ID NO: 58260 - DNA, 22 bp, Homo sapiens
tccagcttataggtagatttaa

SEQ ID NO: 58261 - DNA, 22 bp, Homo sapiens
agtgcattcctggggaagaagc

SEQ ID NO: 58262 - DNA, 18 bp, Homo sapiens
ggtgagggagctggaagc

SEQ ID NO: 58263 - DNA, 22 bp, Homo sapiens
ggagaggggaacttgttgcttg

SEQ ID NO: 58264 - DNA, 22 bp, Homo sapiens
tctgttgcaatgtgcatggtga

SEQ ID NO: 58265 - DNA, 22 bp, Homo sapiens
atgcacacgtaccctacaaggc

SEQ ID NO: 58266 - DNA, 22 bp, Homo sapiens
cctgagagcattccacactgaa

SEQ ID NO: 58267 - DNA, 22 bp, Homo sapiens
ttctccacccactcttttgttg

SEQ ID NO: 58268 - DNA, 22 bp, Homo sapiens
ttgctcttgaaaattgatgctg

SEQ ID NO: 58269 - DNA, 22 bp, Homo sapiens
gcacatccaatgattgttttga

SEQ ID NO: 58270 - DNA, 22 bp, Homo sapiens
atggatggaactctgctgtggt

SEQ ID NO: 58271 - DNA, 22 bp, Homo sapiens
gcgctcagaaaagattttcttc

SEQ ID NO: 58272 - DNA, 22 bp, Homo sapiens
gaagagtggttatccctgctgt

SEQ ID NO: 58273 - DNA, 22 bp, Homo sapiens
atgagttgaagctacaagaggc

SEQ ID NO: 58274 - DNA, 22 bp, Homo sapiens
cttaatctcacctgcaaagtcc

SEQ ID NO: 58275 - DNA, 22 bp, Homo sapiens
ttttccttcatatcccttatgt

SEQ ID NO: 58276 - DNA, 22 bp, Homo sapiens
gtttacttgtgccttggcttaa

SEQ ID NO: 58277 - DNA, 22 bp, Homo sapiens
tgcgcctctaatctcgggcgtc

SEQ ID NO: 58278 - DNA, 22 bp, Homo sapiens
agtcggaagctgtgcgtaaatc

SEQ ID NO: 58279 - DNA, 22 bp, Homo sapiens
ccaggctggagtgcaatggcgt

SEQ ID NO: 58280 - DNA, 22 bp, Homo sapiens
tcggggtctttgacacgctctg

SEQ ID NO: 58281 - DNA, 22 bp, Homo sapiens
ttcatagtgtttccttccagtg

SEQ ID NO: 58282 - DNA, 22 bp, Homo sapiens
ccagagtcccttgcagctcagt

SEQ ID NO: 58283 - DNA, 22 bp, Homo sapiens
taggccacagagaggagatttc

SEQ ID NO: 58284 - DNA, 19 bp, Homo sapiens
tgagggtgagctttggaga

SEQ ID NO: 58285 - DNA, 22 bp, Homo sapiens
agtatgtcagagtgaaaatggt

SEQ ID NO: 58286 - DNA, 21 bp, Homo sapiens
ctggccactgcacctcttcct

SEQ ID NO: 58287 - DNA, 22 bp, Homo sapiens
attggtggtgaggacatgccag

SEQ ID NO: 58288 - DNA, 23 bp, Homo sapiens
cgggttcacgccattctcctgcc

SEQ ID NO: 58289 - DNA, 22 bp, Homo sapiens
agtgctgggctatctactgcta

SEQ ID NO: 58290 - DNA, 22 bp, Homo sapiens
caggaagaccagggctgtggct

SEQ ID NO: 58291 - DNA, 23 bp, Homo sapiens
acagtcgtaggtatccttttcct

SEQ ID NO: 58292 - DNA, 22 bp, Homo sapiens
cctggaagttggaggttgcagt

SEQ ID NO: 58293 - DNA, 22 bp, Homo sapiens
agatacattgttctaagcattg

SEQ ID NO: 58294 - DNA, 22 bp, Homo sapiens
gcttttgaggtcctgctcagcc

SEQ ID NO: 58295 - DNA, 22 bp, Homo sapiens
cagtagatttggtaaactagga

SEQ ID NO: 58296 - DNA, 22 bp, Homo sapiens
ataccaccatctatgaaaggta

SEQ ID NO: 58297 - DNA, 22 bp, Homo sapiens
gggtcgggcaggcgccctcgtc

SEQ ID NO: 58298 - DNA, 22 bp, Homo sapiens
tcacgtgagggacctgtgtctg

SEQ ID NO: 58299 - DNA, 22 bp, Homo sapiens
gggtccctggaattacttgaca

SEQ ID NO: 58300 - DNA, 19 bp, Homo sapiens
tcctggggaggggcatggc

SEQ ID NO: 58301 - DNA, 22 bp, Homo sapiens
gatggtgcaggtgaagtgctgg

SEQ ID NO: 58302 - DNA, 19 bp, Homo sapiens
tccagatgatatggattac

SEQ ID NO: 58303 - DNA, 22 bp, Homo sapiens
acagtccagcctagtatgtata

SEQ ID NO: 58304 - DNA, 22 bp, Homo sapiens
acccagccatgttcagttctct

SEQ ID NO: 58305 - DNA, 22 bp, Homo sapiens
ggtcgctgtgtaggttcagcta

SEQ ID NO: 58306 - DNA, 22 bp, Homo sapiens
tgtgtgattgcaggagatgtgg

SEQ ID NO: 58307 - DNA, 22 bp, Homo sapiens
tcccacaggtggagcttgcagt

SEQ ID NO: 58308 - DNA, 22 bp, Homo sapiens
tagcccctgcctttgaacctgg

SEQ ID NO: 58309 - DNA, 22 bp, Homo sapiens
cagcacatgctcatcagggaag

SEQ ID NO: 58310 - DNA, 22 bp, Homo sapiens
agcccaggagtttgaggctgtg

SEQ ID NO: 58311 - DNA, 22 bp, Homo sapiens
ctggcaggtggaggttgcagtg

SEQ ID NO: 58312 - DNA, 22 bp, Homo sapiens
gggccatgagaggttcatcaac

SEQ ID NO: 58313 - DNA, 22 bp, Homo sapiens
agcagcagtatccttccccggc

SEQ ID NO: 58314 - DNA, 23 bp, Homo sapiens
aaaacagcttcctccagtggctc

SEQ ID NO: 58315 - DNA, 22 bp, Homo sapiens
aaaccggggcctttccacaatg

SEQ ID NO: 58316 - DNA, 22 bp, Homo sapiens
caggctgatcagggctgggatg

SEQ ID NO: 58317 - DNA, 22 bp, Homo sapiens
agcagcagtgttctggaattct

SEQ ID NO: 58318 - DNA, 22 bp, Homo sapiens
ggcagagcttgcagtgagccga

SEQ ID NO: 58319 - DNA, 22 bp, Homo sapiens
tcccccaggctggagtgcagtg

SEQ ID NO: 58320 - DNA, 22 bp, Homo sapiens
actcatgtcctaggagtaaagc

SEQ ID NO: 58321 - DNA, 22 bp, Homo sapiens
tggcacgacaattggcaccaat

SEQ ID NO: 58322 - DNA, 17 bp, Homo sapiens
tgtatttatcatgtcag

SEQ ID NO: 58323 - DNA, 22 bp, Homo sapiens
ctccttctgggcctggcagtgg

SEQ ID NO: 58324 - DNA, 22 bp, Homo sapiens
acgtagcactgagagatgcagg

SEQ ID NO: 58325 - DNA, 22 bp, Homo sapiens
tcgcaccattgcactccagcca

SEQ ID NO: 58326 - DNA, 17 bp, Homo sapiens
aggtgggtggatcacct

SEQ ID NO: 58327 - DNA, 22 bp, Homo sapiens
aggggatgcctagtggagtctc

SEQ ID NO: 58328 - DNA, 22 bp, Homo sapiens
tgcctaggctggagtgtagtgg

SEQ ID NO: 58329 - DNA, 17 bp, Homo sapiens
gggcagggactcctggg

SEQ ID NO: 58330 - DNA, 22 bp, Homo sapiens
ggtgacctcacctggtcccacc

SEQ ID NO: 58331 - DNA, 22 bp, Homo sapiens
atgacaagagtgttcagggaga

SEQ ID NO: 58332 - DNA, 22 bp, Homo sapiens
gtctatgatattttgttatagc

SEQ ID NO: 58333 - DNA, 22 bp, Homo sapiens
ctcactgcaagttccacctacc

SEQ ID NO: 58334 - DNA, 22 bp, Homo sapiens
ttgatcaaatcagctactgagg

SEQ ID NO: 58335 - DNA, 22 bp, Homo sapiens
tttgatccgttgctggtgagga

SEQ ID NO: 58336 - DNA, 22 bp, Homo sapiens
ggcaatatggtgaaaccccatc

SEQ ID NO: 58337 - DNA, 22 bp, Homo sapiens
cactccagcctcagtgacagag

SEQ ID NO: 58338 - DNA, 22 bp, Homo sapiens
tcctgagataaatctcatgtga

SEQ ID NO: 58339 - DNA, 22 bp, Homo sapiens
tcacccaggctggagtgcagtg

SEQ ID NO: 58340 - DNA, 22 bp, Homo sapiens
tctcccaggcaggagtgcagtg

SEQ ID NO: 58341 - DNA, 23 bp, Homo sapiens
actgattcttgaagttgacaagt

SEQ ID NO: 58342 - DNA, 22 bp, Homo sapiens
tgagatcattgacttgttcctg

SEQ ID NO: 58343 - DNA, 22 bp, Homo sapiens
agcctggcctgggcaggcacat

SEQ ID NO: 58344 - DNA, 22 bp, Homo sapiens
tttgtcttatccaatctctcag

SEQ ID NO: 58345 - DNA, 22 bp, Homo sapiens
tcctgccttgcctgggacatca

SEQ ID NO: 58346 - DNA, 22 bp, Homo sapiens
taagcattgtttctgaggatgg

SEQ ID NO: 58347 - DNA, 22 bp, Homo sapiens
tggaagggagctggaatttgga

SEQ ID NO: 58348 - DNA, 22 bp, Homo sapiens
atctgagtcaaatatttcattt

SEQ ID NO: 58349 - DNA, 22 bp, Homo sapiens
ttcttctccgaggagggctggt

SEQ ID NO: 58350 - DNA, 21 bp, Homo sapiens
tccttcagtctagatgattgt

SEQ ID NO: 58351 - DNA, 22 bp, Homo sapiens
ctgcattgatcaggcagaatct

SEQ ID NO: 58352 - DNA, 22 bp, Homo sapiens
taaatacttagttttgtgtcta

SEQ ID NO: 58353 - DNA, 22 bp, Homo sapiens
gggaggctctgctcagcccccg

SEQ ID NO: 58354 - DNA, 22 bp, Homo sapiens
gcctgctcccagttggcgcctc

SEQ ID NO: 58355 - DNA, 22 bp, Homo sapiens
acagttaataagtagtaagtca

SEQ ID NO: 58356 - DNA, 22 bp, Homo sapiens
aggccaggaatccttgtcccag

SEQ ID NO: 58357 - DNA, 22 bp, Homo sapiens
tcagcctgctccaagtgctgcc

SEQ ID NO: 58358 - DNA, 22 bp, Homo sapiens
aaacatctactgtaggctggag

SEQ ID NO: 58359 - DNA, 22 bp, Homo sapiens
ctctcctattgtgtggtaagga

SEQ ID NO: 58360 - DNA, 22 bp, Homo sapiens
aatcacacaaaggcaacttttg

SEQ ID NO: 58361 - DNA, 22 bp, Homo sapiens
cttagatgaagtcacagaaccc

SEQ ID NO: 58362 - DNA, 22 bp, Homo sapiens
gagggggctagcgcagtgccca

SEQ ID NO: 58363 - DNA, 20 bp, Homo sapiens
aggaaaaatggaaactggag

SEQ ID NO: 58364 - DNA, 22 bp, Homo sapiens
atttcagcagcccatgtttgga

SEQ ID NO: 58365 - DNA, 22 bp, Homo sapiens
ggcctctcttgggacagctgtc

SEQ ID NO: 58366 - DNA, 22 bp, Homo sapiens
cagcagcattgctctggattcc

SEQ ID NO: 58367 - DNA, 22 bp, Homo sapiens
caggctggagtgcagtggtgcc

SEQ ID NO: 58368 - DNA, 18 bp, Homo sapiens
actctgcggaggccccag

SEQ ID NO: 58369 - DNA, 22 bp, Homo sapiens
tttgtttgccacacaaaacagt

SEQ ID NO: 58370 - DNA, 22 bp, Homo sapiens
tggttgcctctcagagattccg

SEQ ID NO: 58371 - DNA, 22 bp, Homo sapiens
atacaatgattggttctcaccc

SEQ ID NO: 58372 - DNA, 22 bp, Homo sapiens
gctgcagctgtaggacacaatt

SEQ ID NO: 58373 - DNA, 22 bp, Homo sapiens
atggccaggcacctctggctga

SEQ ID NO: 58374 - DNA, 22 bp, Homo sapiens
cttcccaccaaagcccttgttg

SEQ ID NO: 58375 - DNA, 22 bp, Homo sapiens
tagattcagatatttaggacaa

SEQ ID NO: 58376 - DNA, 22 bp, Homo sapiens
tctttgctattgtgaatagtgc

SEQ ID NO: 58377 - DNA, 22 bp, Homo sapiens
aggtggggaggagtgtctcttt

SEQ ID NO: 58378 - DNA, 22 bp, Homo sapiens
gtgtgtctcccaagaaggccca

SEQ ID NO: 58379 - DNA, 22 bp, Homo sapiens
ctggcaggttatagagctgccc

SEQ ID NO: 58380 - DNA, 22 bp, Homo sapiens
ctgcgtgcatgtctgcgtgcat

SEQ ID NO: 58381 - DNA, 22 bp, Homo sapiens
gctgtggcctggcgcagagctg

SEQ ID NO: 58382 - DNA, 23 bp, Homo sapiens
ggctgggagctccgggtgcacgt

SEQ ID NO: 58383 - DNA, 22 bp, Homo sapiens
atattgaaccctacagactgta

SEQ ID NO: 58384 - DNA, 22 bp, Homo sapiens
gcagcctgggcaacagagtgag

SEQ ID NO: 58385 - DNA, 22 bp, Homo sapiens
ttatttaatgtgatctgaagag

SEQ ID NO: 58386 - DNA, 22 bp, Homo sapiens
tttaaaaaactagtctgagtct

SEQ ID NO: 58387 - DNA, 22 bp, Homo sapiens
gcagaggacacaggagggcaag

SEQ ID NO: 58388 - DNA, 20 bp, Homo sapiens
gacatgtctttctcacacaa

SEQ ID NO: 58389 - DNA, 22 bp, Homo sapiens
tcttaattctgtgtcttcacta

SEQ ID NO: 58390 - DNA, 22 bp, Homo sapiens
cgagtgtccctaccatttccta

SEQ ID NO: 58391 - DNA, 21 bp, Homo sapiens
ttaaagcctccctcataagga

SEQ ID NO: 58392 - DNA, 22 bp, Homo sapiens
acaggtcctcaagtcagctggg

SEQ ID NO: 58393 - DNA, 22 bp, Homo sapiens
gatcgggtgggttctgccatca

SEQ ID NO: 58394 - DNA, 22 bp, Homo sapiens
tgccatggcctagacctgtgat

SEQ ID NO: 58395 - DNA, 21 bp, Homo sapiens
tacaatgcacaggagagcctc

SEQ ID NO: 58396 - DNA, 22 bp, Homo sapiens
agatttctgggcttcaccacct

SEQ ID NO: 58397 - DNA, 22 bp, Homo sapiens
tcggagctgtagatgaaaccct

SEQ ID NO: 58398 - DNA, 22 bp, Homo sapiens
ggaggcccagaaggaagcccag

SEQ ID NO: 58399 - DNA, 22 bp, Homo sapiens
tattgtccaataggatgttcct

SEQ ID NO: 58400 - DNA, 22 bp, Homo sapiens
tctaccctgcggtcttggggca

SEQ ID NO: 58401 - DNA, 22 bp, Homo sapiens
cggaagagggacagcgccagcc

SEQ ID NO: 58402 - DNA, 22 bp, Homo sapiens
cagcagtgtacaaggtgtcaga

SEQ ID NO: 58403 - DNA, 22 bp, Homo sapiens
gaatgcttggaacctgaagttc

SEQ ID NO: 58404 - DNA, 22 bp, Homo sapiens
cagtgcccgccgccgttcctgg

SEQ ID NO: 58405 - DNA, 22 bp, Homo sapiens
ccaggagttggaggttgcagtg

SEQ ID NO: 58406 - DNA, 22 bp, Homo sapiens
tgccatagcaatggtaagctga

SEQ ID NO: 58407 - DNA, 22 bp, Homo sapiens
tggccagctttgactgtaaacc

SEQ ID NO: 58408 - DNA, 22 bp, Homo sapiens
tccctgatgccttgatccgtgg

SEQ ID NO: 58409 - DNA, 22 bp, Homo sapiens
gcctggccgggtcttggatttt

SEQ ID NO: 58410 - DNA, 22 bp, Homo sapiens
ttggaacatgccggggtccagg

SEQ ID NO: 58411 - DNA, 18 bp, Homo sapiens
tgtccctgcaaataacat

SEQ ID NO: 58412 - DNA, 22 bp, Homo sapiens
ccccaggacgtggccctcatag

SEQ ID NO: 58413 - DNA, 22 bp, Homo sapiens
gagctctgactgctgggtgaca

SEQ ID NO: 58414 - DNA, 22 bp, Homo sapiens
tggctacctgatttcttttcag

SEQ ID NO: 58415 - DNA, 22 bp, Homo sapiens
agctgctgagccaggctgatgt

SEQ ID NO: 58416 - DNA, 22 bp, Homo sapiens
tggttgtggtcctccacatcgc

SEQ ID NO: 58417 - DNA, 22 bp, Homo sapiens
ttccatttggcacttcactgag

SEQ ID NO: 58418 - DNA, 22 bp, Homo sapiens
ttgtgaatagtgccgcaataaa

SEQ ID NO: 58419 - DNA, 23 bp, Homo sapiens
tatgaactgcattgctggtgtgt

SEQ ID NO: 58420 - DNA, 22 bp, Homo sapiens
tgcactactgtgatacacagcc

SEQ ID NO: 58421 - DNA, 22 bp, Homo sapiens
cctgggcctctcaaagtgctgg

SEQ ID NO: 58422 - DNA, 22 bp, Homo sapiens
tgcaccctcatcagtcaaatgg

SEQ ID NO: 58423 - DNA, 22 bp, Homo sapiens
ttctcaaagtgtgctccctgga

SEQ ID NO: 58424 - DNA, 22 bp, Homo sapiens
tctgtgagaaccagtgccaggg

SEQ ID NO: 58425 - DNA, 22 bp, Homo sapiens
agggcgacaatggagagcgttt

SEQ ID NO: 58426 - DNA, 22 bp, Homo sapiens
tggtgcaaaactaattgcggtt

SEQ ID NO: 58427 - DNA, 22 bp, Homo sapiens
gtgggccactgggaggcaaggg

SEQ ID NO: 58428 - DNA, 23 bp, Homo sapiens
ttgcatagacatcctcatagatt

SEQ ID NO: 58429 - DNA, 22 bp, Homo sapiens
agggatggagtgcggcccggac

SEQ ID NO: 58430 - DNA, 22 bp, Homo sapiens
ccaaagtgctgggattacaggt

SEQ ID NO: 58431 - DNA, 22 bp, Homo sapiens
tgcctgatgcaggagtatcaga

SEQ ID NO: 58432 - DNA, 22 bp, Homo sapiens
acccggagtcggaggttgcagt

SEQ ID NO: 58433 - DNA, 22 bp, Homo sapiens
agagggatcaccctgtttctgg

SEQ ID NO: 58434 - DNA, 22 bp, Homo sapiens
tttcacagaggaggaagctgag

SEQ ID NO: 58435 - DNA, 22 bp, Homo sapiens
gggcctcaggttctggagaagg

SEQ ID NO: 58436 - DNA, 22 bp, Homo sapiens
ccaggaggcggaggttgcagtg

SEQ ID NO: 58437 - DNA, 22 bp, Homo sapiens
attgcactccggcctgggtgac

SEQ ID NO: 58438 - DNA, 22 bp, Homo sapiens
tccagggccatctccatgaggc

SEQ ID NO: 58439 - DNA, 22 bp, Homo sapiens
aggaaataagggacaagacaaa

SEQ ID NO: 58440 - DNA, 22 bp, Homo sapiens
ctgcatgtttacatttttgaga

SEQ ID NO: 58441 - DNA, 22 bp, Homo sapiens
tggcgcgacgtgccccctgctt

SEQ ID NO: 58442 - DNA, 22 bp, Homo sapiens
tctttcttgtgggtgccctttt

SEQ ID NO: 58443 - DNA, 22 bp, Homo sapiens
tcaccgccttgcccggccgggc

SEQ ID NO: 58444 - DNA, 22 bp, Homo sapiens
gcctgcagggcctgggcctacc

SEQ ID NO: 58445 - DNA, 22 bp, Homo sapiens
gtgtggctgaaatcaaggcagg

SEQ ID NO: 58446 - DNA, 22 bp, Homo sapiens
acgcccggtctccatagttttt

SEQ ID NO: 58447 - DNA, 22 bp, Homo sapiens
ctccagattccgtttattcagg

SEQ ID NO: 58448 - DNA, 22 bp, Homo sapiens
tttacctttgtgggtctccctc

SEQ ID NO: 58449 - DNA, 22 bp, Homo sapiens
ggtgctggacacgtggcactcc

SEQ ID NO: 58450 - DNA, 22 bp, Homo sapiens
ttgaggtcatctgaagtactag

SEQ ID NO: 58451 - DNA, 22 bp, Homo sapiens
attcacagggggagaagggtat

SEQ ID NO: 58452 - DNA, 22 bp, Homo sapiens
tcataaattctggtgctgtgag

SEQ ID NO: 58453 - DNA, 22 bp, Homo sapiens
gagcaggtgcctgtagctctct

SEQ ID NO: 58454 - DNA, 22 bp, Homo sapiens
atatgggtcatgtgatgttcaa

SEQ ID NO: 58455 - DNA, 22 bp, Homo sapiens
agaggctgcacttgctcatgat

SEQ ID NO: 58456 - DNA, 22 bp, Homo sapiens
aggcaagggggcgccaccttcc

SEQ ID NO: 58457 - DNA, 19 bp, Homo sapiens
cataatacagtggatctga

SEQ ID NO: 58458 - DNA, 22 bp, Homo sapiens
ctcgcatgccctgcctcatcca

SEQ ID NO: 58459 - DNA, 22 bp, Homo sapiens
ggagtgactctcggggccacta

SEQ ID NO: 58460 - DNA, 22 bp, Homo sapiens
agggagcattgtgacatatcac

SEQ ID NO: 58461 - DNA, 22 bp, Homo sapiens
agagcggggatagttaatattc

SEQ ID NO: 58462 - DNA, 22 bp, Homo sapiens
ggaaggggtgggtgagcctcag

SEQ ID NO: 58463 - DNA, 22 bp, Homo sapiens
aggctatttccactcttctcat

SEQ ID NO: 58464 - DNA, 22 bp, Homo sapiens
tgctttgtgacagattagtttt

SEQ ID NO: 58465 - DNA, 22 bp, Homo sapiens
tatctatgtgctctgacctctc

SEQ ID NO: 58466 - DNA, 22 bp, Homo sapiens
gctctagtaggaatgtccctct

SEQ ID NO: 58467 - DNA, 22 bp, Homo sapiens
tccactgctacaacctcccaga

SEQ ID NO: 58468 - DNA, 22 bp, Homo sapiens
cgaggcggcggaagtgcccgta

SEQ ID NO: 58469 - DNA, 22 bp, Homo sapiens
catgcacttacctgaaattcaa

SEQ ID NO: 58470 - DNA, 22 bp, Homo sapiens
actcctacatattagcattaac

SEQ ID NO: 58471 - DNA, 22 bp, Homo sapiens
gaattttattactagtcaactg

SEQ ID NO: 58472 - DNA, 22 bp, Homo sapiens
agtgagtttagggtgcaggtgt

SEQ ID NO: 58473 - DNA, 22 bp, Homo sapiens
tctcagaacctcagtttgctct

SEQ ID NO: 58474 - DNA, 23 bp, Homo sapiens
aggatatgacttgtctgccaacc

SEQ ID NO: 58475 - DNA, 22 bp, Homo sapiens
tccaactttctcctccggcttg

SEQ ID NO: 58476 - DNA, 20 bp, Homo sapiens
tgttctgtcgtctttcttca

SEQ ID NO: 58477 - DNA, 18 bp, Homo sapiens
gaaagatgaacttttttc

SEQ ID NO: 58478 - DNA, 22 bp, Homo sapiens
ggtgccaggctgtagtcagggt

SEQ ID NO: 58479 - DNA, 22 bp, Homo sapiens
tttgagatggagtcttgctctg

SEQ ID NO: 58480 - DNA, 22 bp, Homo sapiens
ttcaccctggaccagaaattgg

SEQ ID NO: 58481 - DNA, 22 bp, Homo sapiens
tgtccagctcgagacactatct

SEQ ID NO: 58482 - DNA, 22 bp, Homo sapiens
caaagctggaaaaggaggctgg

SEQ ID NO: 58483 - DNA, 22 bp, Homo sapiens
tcccagaaccctgccaggtcct

SEQ ID NO: 58484 - DNA, 22 bp, Homo sapiens
ggttggacactaggtaggagcg

SEQ ID NO: 58485 - DNA, 22 bp, Homo sapiens
gagctactgaaatattgatttt

SEQ ID NO: 58486 - DNA, 22 bp, Homo sapiens
tcactgcaacctccacctcctg

SEQ ID NO: 58487 - DNA, 22 bp, Homo sapiens
aggtgggcggattcatgaggtc

SEQ ID NO: 58488 - DNA, 19 bp, Homo sapiens
aggctaaagagtcttgcgt

SEQ ID NO: 58489 - DNA, 22 bp, Homo sapiens
ttgagactgccttgtcgtctgc

SEQ ID NO: 58490 - DNA, 22 bp, Homo sapiens
agcagcttgaggctggattcca

SEQ ID NO: 58491 - DNA, 22 bp, Homo sapiens
cttgtagacccctggactcacg

SEQ ID NO: 58492 - DNA, 22 bp, Homo sapiens
gctgccttgccctcttcccata

SEQ ID NO: 58493 - DNA, 22 bp, Homo sapiens
gccaggctgaggctctggaaga

SEQ ID NO: 58494 - DNA, 22 bp, Homo sapiens
acagcacttgggttttcctgtt

SEQ ID NO: 58495 - DNA, 22 bp, Homo sapiens
aagtcagacagctgagctgcct

SEQ ID NO: 58496 - DNA, 22 bp, Homo sapiens
agaaggggcccaaggatgtcag

SEQ ID NO: 58497 - DNA, 22 bp, Homo sapiens
tatctgttaaaacaagctttaa

SEQ ID NO: 58498 - DNA, 22 bp, Homo sapiens
tgtcttcagcagtcatctgggg

SEQ ID NO: 58499 - DNA, 22 bp, Homo sapiens
aaaatcttgtgacttaggaagg

SEQ ID NO: 58500 - DNA, 22 bp, Homo sapiens
agggggctccttggtgtgcaga

SEQ ID NO: 58501 - DNA, 22 bp, Homo sapiens
ccaggaggcagaagttgcagtg

SEQ ID NO: 58502 - DNA, 22 bp, Homo sapiens
ccgggagcaggcgccaccgcca

SEQ ID NO: 58503 - DNA, 22 bp, Homo sapiens
ctgagctcaagcgatcctccca

SEQ ID NO: 58504 - DNA, 21 bp, Homo sapiens
caatggcgagatcttggctca

SEQ ID NO: 58505 - DNA, 22 bp, Homo sapiens
agaagtatcaggaagattctca

SEQ ID NO: 58506 - DNA, 22 bp, Homo sapiens
cgctggaaattgccgttggctt

SEQ ID NO: 58507 - DNA, 22 bp, Homo sapiens
atggctagcaccgcgttgctgg

SEQ ID NO: 58508 - DNA, 22 bp, Homo sapiens
cggccaggcacagtggcccacg

SEQ ID NO: 58509 - DNA, 22 bp, Homo sapiens
gagccaggttggaggctgcagt

SEQ ID NO: 58510 - DNA, 22 bp, Homo sapiens
ttggcataccttagtggtggag

SEQ ID NO: 58511 - DNA, 22 bp, Homo sapiens
gctccgtgggcattgctaggtg

SEQ ID NO: 58512 - DNA, 22 bp, Homo sapiens
cggagtcttgctatgttgccca

SEQ ID NO: 58513 - DNA, 22 bp, Homo sapiens
aaatatcttaggagtatatgag

SEQ ID NO: 58514 - DNA, 22 bp, Homo sapiens
cccaggaggcagagatagcagt

SEQ ID NO: 58515 - DNA, 22 bp, Homo sapiens
tttcttctatgtgtgatatttt

SEQ ID NO: 58516 - DNA, 22 bp, Homo sapiens
tgtcctgtaggaggcagaacaa

SEQ ID NO: 58517 - DNA, 22 bp, Homo sapiens
tgtaagtagtaatggaaggaca

SEQ ID NO: 58518 - DNA, 22 bp, Homo sapiens
aagtcacttcttaggaaaggag

SEQ ID NO: 58519 - DNA, 22 bp, Homo sapiens
cagtggaggccttgggaccttt

SEQ ID NO: 58520 - DNA, 22 bp, Homo sapiens
accaggggatggttggcactgt

SEQ ID NO: 58521 - DNA, 22 bp, Homo sapiens
gggcctgtgtgttcaggagcct

SEQ ID NO: 58522 - DNA, 22 bp, Homo sapiens
tgtggtgccgagagtctggacg

SEQ ID NO: 58523 - DNA, 22 bp, Homo sapiens
acccaggctggagtgcagtgat

SEQ ID NO: 58524 - DNA, 23 bp, Homo sapiens
cgcccagcctcagtgacctgggc

SEQ ID NO: 58525 - DNA, 22 bp, Homo sapiens
tgtctgttattggtgtataaga

SEQ ID NO: 58526 - DNA, 22 bp, Homo sapiens
ggcagggcaggaaagtcaggaa

SEQ ID NO: 58527 - DNA, 22 bp, Homo sapiens
ttctcacagaagcacgaagcct

SEQ ID NO: 58528 - DNA, 22 bp, Homo sapiens
gggggcttggcccggtctggtt

SEQ ID NO: 58529 - DNA, 22 bp, Homo sapiens
actgcacttcagcctgggtgac

SEQ ID NO: 58530 - DNA, 22 bp, Homo sapiens
cggctcactgcagctccgcctc

SEQ ID NO: 58531 - DNA, 17 bp, Homo sapiens
ggctgcagtccaggagg

SEQ ID NO: 58532 - DNA, 19 bp, Homo sapiens
gggcaaagtgatcgtcctg

SEQ ID NO: 58533 - DNA, 22 bp, Homo sapiens
cccaccagtacagatggtagat

SEQ ID NO: 58534 - DNA, 22 bp, Homo sapiens
acaagcgggccacagtgctggt

SEQ ID NO: 58535 - DNA, 22 bp, Homo sapiens
actgttgaagtgccagcttgat

SEQ ID NO: 58536 - DNA, 22 bp, Homo sapiens
tgcagattcaaatgaaatgcaa

SEQ ID NO: 58537 - DNA, 22 bp, Homo sapiens
cacgcacgctgggtggaggcgc

SEQ ID NO: 58538 - DNA, 22 bp, Homo sapiens
ggttttatcctacccacacagc

SEQ ID NO: 58539 - DNA, 22 bp, Homo sapiens
gcttctggtgaggcctcaggaa

SEQ ID NO: 58540 - DNA, 22 bp, Homo sapiens
aaagcctcccaggttatgagta

SEQ ID NO: 58541 - DNA, 21 bp, Homo sapiens
tttcttaggctctaaaatgac

SEQ ID NO: 58542 - DNA, 23 bp, Homo sapiens
aggtaggttattgctgctacctg

SEQ ID NO: 58543 - DNA, 22 bp, Homo sapiens
gggccctgggattcagagcaag

SEQ ID NO: 58544 - DNA, 22 bp, Homo sapiens
aagttgttgttgaggtgggtaa

SEQ ID NO: 58545 - DNA, 22 bp, Homo sapiens
agatgctgctccacaggccagg

SEQ ID NO: 58546 - DNA, 22 bp, Homo sapiens
ttgggtgctgtcatggggcacg

SEQ ID NO: 58547 - DNA, 22 bp, Homo sapiens
cactgctacctctgcctcccgg

SEQ ID NO: 58548 - DNA, 22 bp, Homo sapiens
gggcaggaacaaatcaaatgat

SEQ ID NO: 58549 - DNA, 22 bp, Homo sapiens
cggccaagccggggccccgaag

SEQ ID NO: 58550 - DNA, 22 bp, Homo sapiens
agaggccgggtgcctgctcaga

SEQ ID NO: 58551 - DNA, 22 bp, Homo sapiens
tctagttctagatccctgagga

SEQ ID NO: 58552 - DNA, 22 bp, Homo sapiens
gaatttcctctaaacccctgag

SEQ ID NO: 58553 - DNA, 22 bp, Homo sapiens
aatggctctgatgttgttgtga

SEQ ID NO: 58554 - DNA, 22 bp, Homo sapiens
tggctgagttacgaacagagca

SEQ ID NO: 58555 - DNA, 22 bp, Homo sapiens
agcacctgtcaagtccaggctg

SEQ ID NO: 58556 - DNA, 22 bp, Homo sapiens
attaagtgactaaagtaatgct

SEQ ID NO: 58557 - DNA, 20 bp, Homo sapiens
ggcagagggcctgggagaag

SEQ ID NO: 58558 - DNA, 20 bp, Homo sapiens
atggggtgagtgacgccctc

SEQ ID NO: 58559 - DNA, 22 bp, Homo sapiens
ttgtaacaggtactaaataact

SEQ ID NO: 58560 - DNA, 22 bp, Homo sapiens
gccaggttgctgacgacgatct

SEQ ID NO: 58561 - DNA, 22 bp, Homo sapiens
tttgggcaggcttttccctaga

SEQ ID NO: 58562 - DNA, 22 bp, Homo sapiens
ttccttacattcatatggcttc

SEQ ID NO: 58563 - DNA, 22 bp, Homo sapiens
catctgctgttccttggactca

SEQ ID NO: 58564 - DNA, 22 bp, Homo sapiens
aaacccagggttttgtcttccc

SEQ ID NO: 58565 - DNA, 22 bp, Homo sapiens
actgcacttcagcctgggtgtc

SEQ ID NO: 58566 - DNA, 22 bp, Homo sapiens
tttaatcaggcaaagcataata

SEQ ID NO: 58567 - DNA, 22 bp, Homo sapiens
tagtgtctcttcctgtttgaaa

SEQ ID NO: 58568 - DNA, 23 bp, Homo sapiens
cctgcctccccatcagttataca

SEQ ID NO: 58569 - DNA, 22 bp, Homo sapiens
agctggaattacaggcacgcac

SEQ ID NO: 58570 - DNA, 22 bp, Homo sapiens
aaaatggtctcagctggcacca

SEQ ID NO: 58571 - DNA, 22 bp, Homo sapiens
tcgtgaggctctgcatcgcaca

SEQ ID NO: 58572 - DNA, 22 bp, Homo sapiens
aggggtgaaagagggccctcaa

SEQ ID NO: 58573 - DNA, 22 bp, Homo sapiens
tacagcctggcactaccctggg

SEQ ID NO: 58574 - DNA, 19 bp, Homo sapiens
gactcacaccttccgctgt

SEQ ID NO: 58575 - DNA, 22 bp, Homo sapiens
agctcattgcaacctccgcctc

SEQ ID NO: 58576 - DNA, 22 bp, Homo sapiens
agcctggcggtcgtcggtcagg

SEQ ID NO: 58577 - DNA, 21 bp, Homo sapiens
gccatttcacacagacatttg

SEQ ID NO: 58578 - DNA, 20 bp, Homo sapiens
ggggcccaagccctcttgcc

SEQ ID NO: 58579 - DNA, 19 bp, Homo sapiens
aggaatggaattaattctg

SEQ ID NO: 58580 - DNA, 22 bp, Homo sapiens
acattacctggcatttgatctt

SEQ ID NO: 58581 - DNA, 22 bp, Homo sapiens
tgctgtgaggttgagaaggaag

SEQ ID NO: 58582 - DNA, 20 bp, Homo sapiens
aaaatatgtataactcttct

SEQ ID NO: 58583 - DNA, 22 bp, Homo sapiens
tcctccagttccttggtttcag

SEQ ID NO: 58584 - DNA, 21 bp, Homo sapiens
gaacccagcagcagtgctctg

SEQ ID NO: 58585 - DNA, 22 bp, Homo sapiens
tgggagaaagaaccctgagtga

SEQ ID NO: 58586 - DNA, 22 bp, Homo sapiens
ggcgtggggccttctgcccgct

SEQ ID NO: 58587 - DNA, 21 bp, Homo sapiens
ctggaggcaggtggtgccagg

SEQ ID NO: 58588 - DNA, 22 bp, Homo sapiens
ccgcccacactaaatatgagcg

SEQ ID NO: 58589 - DNA, 22 bp, Homo sapiens
gctcaagccttctgcccacctc

SEQ ID NO: 58590 - DNA, 22 bp, Homo sapiens
aaccagctaacatgtggaatga

SEQ ID NO: 58591 - DNA, 22 bp, Homo sapiens
ggagcatgcgctctgtgaccga

SEQ ID NO: 58592 - DNA, 22 bp, Homo sapiens
ggaggcggaagttgcagtgagc

SEQ ID NO: 58593 - DNA, 22 bp, Homo sapiens
ttgtgctcctatgagaatctaa

SEQ ID NO: 58594 - DNA, 22 bp, Homo sapiens
ttaaatattatgttgtctgcaa

SEQ ID NO: 58595 - DNA, 22 bp, Homo sapiens
cgccccggacgtctgaccaaac

SEQ ID NO: 58596 - DNA, 20 bp, Homo sapiens
atgctttcttgtgtgctgct

SEQ ID NO: 58597 - DNA, 22 bp, Homo sapiens
acccagggctcaagcgtaggca

SEQ ID NO: 58598 - DNA, 22 bp, Homo sapiens
gggcagccccagcgcgttggct

SEQ ID NO: 58599 - DNA, 22 bp, Homo sapiens
agcaggagtttgatgcttttat

SEQ ID NO: 58600 - DNA, 22 bp, Homo sapiens
ttgtttccataattaagtgtga

SEQ ID NO: 58601 - DNA, 22 bp, Homo sapiens
cactgcactccagcctgcgcaa

SEQ ID NO: 58602 - DNA, 22 bp, Homo sapiens
gaagccttgaactgcaaacccc

SEQ ID NO: 58603 - DNA, 22 bp, Homo sapiens
cacccaggctggattgcagtgg

SEQ ID NO: 58604 - DNA, 22 bp, Homo sapiens
tggtcgaccagttggaaagtaa

SEQ ID NO: 58605 - DNA, 23 bp, Homo sapiens
aaacttgctatggctgaaatcat

SEQ ID NO: 58606 - DNA, 22 bp, Homo sapiens
ttgcttcttagatattcctctc

SEQ ID NO: 58607 - DNA, 22 bp, Homo sapiens
ggggcccctcggacacgtgcgg

SEQ ID NO: 58608 - DNA, 19 bp, Homo sapiens
gccttcccaccacccgtcc

SEQ ID NO: 58609 - DNA, 22 bp, Homo sapiens
tctagctctgcttatcatggct

SEQ ID NO: 58610 - DNA, 22 bp, Homo sapiens
tgacagagtgacactcttgtct

SEQ ID NO: 58611 - DNA, 22 bp, Homo sapiens
tcaggaggcggaggttgcagtg

SEQ ID NO: 58612 - DNA, 22 bp, Homo sapiens
gtctgaatacgtacttgtgaag

SEQ ID NO: 58613 - DNA, 23 bp, Homo sapiens
tcagaacagttcttggtgcatag

SEQ ID NO: 58614 - DNA, 22 bp, Homo sapiens
ggctcactgcaacctctgcctc

SEQ ID NO: 58615 - DNA, 22 bp, Homo sapiens
tagaggctttcagcggtaggtc

SEQ ID NO: 58616 - DNA, 22 bp, Homo sapiens
acagcccagctctttctctgca

SEQ ID NO: 58617 - DNA, 22 bp, Homo sapiens
cttatagtatgatgttgagaat

SEQ ID NO: 58618 - DNA, 22 bp, Homo sapiens
ataaaaactgacccatcctttg

SEQ ID NO: 58619 - DNA, 22 bp, Homo sapiens
cgcgaggtggaggttgcagtga

SEQ ID NO: 58620 - DNA, 22 bp, Homo sapiens
aggccctattcaatggggccca

SEQ ID NO: 58621 - DNA, 22 bp, Homo sapiens
tgttgatttgtgggctgcaaaa

SEQ ID NO: 58622 - DNA, 23 bp, Homo sapiens
actgcagtcttgatctcctgggc

SEQ ID NO: 58623 - DNA, 22 bp, Homo sapiens
ccggtcccaggtgccccggtga

SEQ ID NO: 58624 - DNA, 22 bp, Homo sapiens
aggcgcacagggtgttgatgtg

SEQ ID NO: 58625 - DNA, 22 bp, Homo sapiens
ccctcccaggagtggccagaga

SEQ ID NO: 58626 - DNA, 22 bp, Homo sapiens
agaaaacataggagacaggaaa

SEQ ID NO: 58627 - DNA, 22 bp, Homo sapiens
gctcatgactgtaatcccagca

SEQ ID NO: 58628 - DNA, 22 bp, Homo sapiens
ttttggctctgtctgtatcttt

SEQ ID NO: 58629 - DNA, 22 bp, Homo sapiens
acaggggaatttactgtcatta

SEQ ID NO: 58630 - DNA, 22 bp, Homo sapiens
gtgttaaccagctaaactttgc

SEQ ID NO: 58631 - DNA, 22 bp, Homo sapiens
gtgcatgtcggggtgcatgtca

SEQ ID NO: 58632 - DNA, 22 bp, Homo sapiens
cctgcacatgtgtgcgcctgta

SEQ ID NO: 58633 - DNA, 22 bp, Homo sapiens
ctgcagggagaggggacagcct

SEQ ID NO: 58634 - DNA, 22 bp, Homo sapiens
ctgtatttcttggacagttgct

SEQ ID NO: 58635 - DNA, 22 bp, Homo sapiens
tgtctccaccatcatcttacca

SEQ ID NO: 58636 - DNA, 22 bp, Homo sapiens
tcccggcgctgggaggtgggtc

SEQ ID NO: 58637 - DNA, 22 bp, Homo sapiens
agatttatgtggtcacactcag

SEQ ID NO: 58638 - DNA, 22 bp, Homo sapiens
agtggccagcagcctagcctag

SEQ ID NO: 58639 - DNA, 22 bp, Homo sapiens
gtaatctcagctacttgggagg

SEQ ID NO: 58640 - DNA, 22 bp, Homo sapiens
ggtggctgcaatggctaacttc

SEQ ID NO: 58641 - DNA, 22 bp, Homo sapiens
gacaattgcttttgccgaataa

SEQ ID NO: 58642 - DNA, 22 bp, Homo sapiens
gtgcgtcctgggggctgggtcg

SEQ ID NO: 58643 - DNA, 22 bp, Homo sapiens
tctgctcagccgatctgctccg

SEQ ID NO: 58644 - DNA, 22 bp, Homo sapiens
gctcactgcaacctccacctcc

SEQ ID NO: 58645 - DNA, 22 bp, Homo sapiens
attgtgaatagtgccgcagtaa

SEQ ID NO: 58646 - DNA, 22 bp, Homo sapiens
aagtggcagttcaggaagcaga

SEQ ID NO: 58647 - DNA, 22 bp, Homo sapiens
gtggagagagataagcctggtc

SEQ ID NO: 58648 - DNA, 22 bp, Homo sapiens
agagtactgcctcagttatgaa

SEQ ID NO: 58649 - DNA, 22 bp, Homo sapiens
ctgtaatcccagctactcggga

SEQ ID NO: 58650 - DNA, 22 bp, Homo sapiens
aggagccagtggagttcctgcc

SEQ ID NO: 58651 - DNA, 22 bp, Homo sapiens
aagagaattctggttttcctat

SEQ ID NO: 58652 - DNA, 22 bp, Homo sapiens
ggcctttgcgtccacgccgctt

SEQ ID NO: 58653 - DNA, 22 bp, Homo sapiens
ggagaccagaaggaagcttcga

SEQ ID NO: 58654 - DNA, 22 bp, Homo sapiens
gctagtgcagggaaatctttgg

SEQ ID NO: 58655 - DNA, 22 bp, Homo sapiens
ctttaaggtgatgagagatgct

SEQ ID NO: 58656 - DNA, 18 bp, Homo sapiens
ccctcttgcacaaagcaa

SEQ ID NO: 58657 - DNA, 22 bp, Homo sapiens
ggtgggagccaacacccttctg

SEQ ID NO: 58658 - DNA, 22 bp, Homo sapiens
tgactcagtacatctggagttg

SEQ ID NO: 58659 - DNA, 22 bp, Homo sapiens
tggatgctgtaggacacgctct

SEQ ID NO: 58660 - DNA, 18 bp, Homo sapiens
atggtctcatactgggag

SEQ ID NO: 58661 - DNA, 22 bp, Homo sapiens
cccaggaggttgaggctgcagt

SEQ ID NO: 58662 - DNA, 22 bp, Homo sapiens
atccccctgtatctggaagaat

SEQ ID NO: 58663 - DNA, 22 bp, Homo sapiens
tttcagatggaggtttaggaca

SEQ ID NO: 58664 - DNA, 22 bp, Homo sapiens
gaggagggagctggaagctctt

SEQ ID NO: 58665 - DNA, 19 bp, Homo sapiens
gctggatggatcctggagt

SEQ ID NO: 58666 - DNA, 22 bp, Homo sapiens
cttttgattgagcagtttcaaa

SEQ ID NO: 58667 - DNA, 22 bp, Homo sapiens
cgcgctgcagacagcggaggcc

SEQ ID NO: 58668 - DNA, 22 bp, Homo sapiens
ctcctccacccgctggggccca

SEQ ID NO: 58669 - DNA, 19 bp, Homo sapiens
tccaggggctccacctcct

SEQ ID NO: 58670 - DNA, 22 bp, Homo sapiens
ttgggctcaggagtttgagacc

SEQ ID NO: 58671 - DNA, 22 bp, Homo sapiens
ctcctgagctctgaggaagctt

SEQ ID NO: 58672 - DNA, 22 bp, Homo sapiens
atgattgaccatctgctgggct

SEQ ID NO: 58673 - DNA, 22 bp, Homo sapiens
caggagctcaagaccaccctgg

SEQ ID NO: 58674 - DNA, 22 bp, Homo sapiens
tagagcattatgacaaccccat

SEQ ID NO: 58675 - DNA, 22 bp, Homo sapiens
atggtttattagctgcacaggc

SEQ ID NO: 58676 - DNA, 22 bp, Homo sapiens
tgtctcatctcttaaccccact

SEQ ID NO: 58677 - DNA, 22 bp, Homo sapiens
cgcggtggcggcctccagcgcc

SEQ ID NO: 58678 - DNA, 22 bp, Homo sapiens
gaagcctcaacatctctgcgtc

SEQ ID NO: 58679 - DNA, 22 bp, Homo sapiens
ccaatgatggtgcccacgatga

SEQ ID NO: 58680 - DNA, 22 bp, Homo sapiens
actgcaacctccacctcctggg

SEQ ID NO: 58681 - DNA, 22 bp, Homo sapiens
tagagatggggtcttgctatga

SEQ ID NO: 58682 - DNA, 22 bp, Homo sapiens
ccaaagtgctaggattacaggc

SEQ ID NO: 58683 - DNA, 22 bp, Homo sapiens
tttccagagggtgctcagggcg

SEQ ID NO: 58684 - DNA, 22 bp, Homo sapiens
agcccttagtacatttctcaag

SEQ ID NO: 58685 - DNA, 22 bp, Homo sapiens
tcttcatgtcatggtatattga

SEQ ID NO: 58686 - DNA, 20 bp, Homo sapiens
gttaggaggttggacatgga

SEQ ID NO: 58687 - DNA, 22 bp, Homo sapiens
ccttgctcaagctagtgacggg

SEQ ID NO: 58688 - DNA, 22 bp, Homo sapiens
tgaccctgagagctgaatggct

SEQ ID NO: 58689 - DNA, 22 bp, Homo sapiens
gagcactgatttatttttgtct

SEQ ID NO: 58690 - DNA, 22 bp, Homo sapiens
tagctgggactactggccctgc

SEQ ID NO: 58691 - DNA, 21 bp, Homo sapiens
tcttttctcagctttgtggtt

SEQ ID NO: 58692 - DNA, 22 bp, Homo sapiens
tagcccaggctggagtgcaggg

SEQ ID NO: 58693 - DNA, 22 bp, Homo sapiens
gttaggtagaagtttactttga

SEQ ID NO: 58694 - DNA, 22 bp, Homo sapiens
actgcactccagcctcggggtc

SEQ ID NO: 58695 - DNA, 22 bp, Homo sapiens
agggaagaaaatccatcgctgc

SEQ ID NO: 58696 - DNA, 22 bp, Homo sapiens
caaagtgctgggattacaggtg

SEQ ID NO: 58697 - DNA, 22 bp, Homo sapiens
tcgtctgtgaaattgggataag

SEQ ID NO: 58698 - DNA, 22 bp, Homo sapiens
caaaatgcatctgagaccaggc

SEQ ID NO: 58699 - DNA, 22 bp, Homo sapiens
gggttggatcctggtggctgcc

SEQ ID NO: 58700 - DNA, 23 bp, Homo sapiens
tcctcgcaggagggagatgatgc

SEQ ID NO: 58701 - DNA, 22 bp, Homo sapiens
tcctggtcttcaggttgcaaaa

SEQ ID NO: 58702 - DNA, 22 bp, Homo sapiens
gatgtgtttccaggatttgttt

SEQ ID NO: 58703 - DNA, 22 bp, Homo sapiens
acgcctgtaatcccagcacttt

SEQ ID NO: 58704 - DNA, 22 bp, Homo sapiens
tgcgggttggtggcatatgcag

SEQ ID NO: 58705 - DNA, 22 bp, Homo sapiens
aagcctaggcctactctggttt

SEQ ID NO: 58706 - DNA, 22 bp, Homo sapiens
tgcctcagctgaggccgctcca

SEQ ID NO: 58707 - DNA, 22 bp, Homo sapiens
aatccaggtggcggaggttgtg

SEQ ID NO: 58708 - DNA, 22 bp, Homo sapiens
aggtgtctggacttgtgaagca

SEQ ID NO: 58709 - DNA, 23 bp, Homo sapiens
caccactttctccttctccttgg

SEQ ID NO: 58710 - DNA, 22 bp, Homo sapiens
gcagctattgtctcctgggccc

SEQ ID NO: 58711 - DNA, 19 bp, Homo sapiens
tggctctgtcgaaggcaca

SEQ ID NO: 58712 - DNA, 22 bp, Homo sapiens
gtgtcctttccgggcctggagg

SEQ ID NO: 58713 - DNA, 22 bp, Homo sapiens
gtggctcacacctgtaatccca

SEQ ID NO: 58714 - DNA, 20 bp, Homo sapiens
ttgttagaggaatgccatag

SEQ ID NO: 58715 - DNA, 22 bp, Homo sapiens
gttgaggagcaagcatgtgtct

SEQ ID NO: 58716 - DNA, 22 bp, Homo sapiens
ttcattcttttacatgtgaata

SEQ ID NO: 58717 - DNA, 22 bp, Homo sapiens
aagccaggttccatggaggagc

SEQ ID NO: 58718 - DNA, 22 bp, Homo sapiens
gctgcgccggatcccacgttcc

SEQ ID NO: 58719 - DNA, 22 bp, Homo sapiens
agtgaggggcagctgagtgggc

SEQ ID NO: 58720 - DNA, 22 bp, Homo sapiens
aatgagatggaattcccgccta

SEQ ID NO: 58721 - DNA, 22 bp, Homo sapiens
ggggtactggctggagccccac

SEQ ID NO: 58722 - DNA, 22 bp, Homo sapiens
gcccgcgccagcctctccatct

SEQ ID NO: 58723 - DNA, 22 bp, Homo sapiens
attgcacttcagcctgggtgac

SEQ ID NO: 58724 - DNA, 22 bp, Homo sapiens
gaaagacatagttgcaagatgg

SEQ ID NO: 58725 - DNA, 22 bp, Homo sapiens
ggcgctcagtgttgccccagag

SEQ ID NO: 58726 - DNA, 22 bp, Homo sapiens
gcctggccaacgtggtgaaacc

SEQ ID NO: 58727 - DNA, 22 bp, Homo sapiens
ccacgcatccctccacagagag

SEQ ID NO: 58728 - DNA, 22 bp, Homo sapiens
gtcagtgtcttaacagagatta

SEQ ID NO: 58729 - DNA, 22 bp, Homo sapiens
tatgccactgctctccatccta

SEQ ID NO: 58730 - DNA, 22 bp, Homo sapiens
acaggtgcatgctaccatgtct

SEQ ID NO: 58731 - DNA, 22 bp, Homo sapiens
attgtactacaccatagtactg

SEQ ID NO: 58732 - DNA, 22 bp, Homo sapiens
atcaacatgtcataaagtgaaa

SEQ ID NO: 58733 - DNA, 22 bp, Homo sapiens
agccaggatggtctcgatcggc

SEQ ID NO: 58734 - DNA, 22 bp, Homo sapiens
ggcagcactgcagcttgttggg

SEQ ID NO: 58735 - DNA, 22 bp, Homo sapiens
tcgtgatctgtccacctcggcc

SEQ ID NO: 58736 - DNA, 22 bp, Homo sapiens
ccttctagcaaatcaacataaa

SEQ ID NO: 58737 - DNA, 22 bp, Homo sapiens
cgagagatgggttggcaggggc

SEQ ID NO: 58738 - DNA, 22 bp, Homo sapiens
atgttggagtcgtaaggcatgg

SEQ ID NO: 58739 - DNA, 22 bp, Homo sapiens
gtgatctgccagcctcagcctc

SEQ ID NO: 58740 - DNA, 22 bp, Homo sapiens
actgccaatggtagtttgatgg

SEQ ID NO: 58741 - DNA, 22 bp, Homo sapiens
actgatcaagggtttaatttta

SEQ ID NO: 58742 - DNA, 20 bp, Homo sapiens
ctgtaactgtcccttttgcc

SEQ ID NO: 58743 - DNA, 22 bp, Homo sapiens
agagctgtgtttagtagttacg

SEQ ID NO: 58744 - DNA, 22 bp, Homo sapiens
aggtggaaatggctttcctagg

SEQ ID NO: 58745 - DNA, 22 bp, Homo sapiens
cccaggaggtggaggctgcagt

SEQ ID NO: 58746 - DNA, 22 bp, Homo sapiens
gtgctccctccttcctcaagga

SEQ ID NO: 58747 - DNA, 22 bp, Homo sapiens
tctgactttggacagtggcgaa

SEQ ID NO: 58748 - DNA, 19 bp, Homo sapiens
ggtatatgggcctcacttg

SEQ ID NO: 58749 - DNA, 22 bp, Homo sapiens
cagaagactgcagggaagggac

SEQ ID NO: 58750 - DNA, 22 bp, Homo sapiens
gctgtgtatcagatgccacggg

SEQ ID NO: 58751 - DNA, 22 bp, Homo sapiens
tgctagtgtgtgagatgttcaa

SEQ ID NO: 58752 - DNA, 22 bp, Homo sapiens
gagcaggaaggccagaagggtc

SEQ ID NO: 58753 - DNA, 22 bp, Homo sapiens
cttgacactgtcactcaggcca

SEQ ID NO: 58754 - DNA, 22 bp, Homo sapiens
aggctggagtgcagtggtgtga

SEQ ID NO: 58755 - DNA, 22 bp, Homo sapiens
cctgcagacacttgtccagcaa

SEQ ID NO: 58756 - DNA, 22 bp, Homo sapiens
cggggttcatccatgctgtggc

SEQ ID NO: 58757 - DNA, 22 bp, Homo sapiens
caggggcgggtaaaaggcctcc

SEQ ID NO: 58758 - DNA, 22 bp, Homo sapiens
ttgtgctcctgtgagaatctag

SEQ ID NO: 58759 - DNA, 22 bp, Homo sapiens
acttcttcttcagctgggggat

SEQ ID NO: 58760 - DNA, 22 bp, Homo sapiens
acggcttcttgactgtgggttg

SEQ ID NO: 58761 - DNA, 22 bp, Homo sapiens
cctttcccgctttgagggcaag

SEQ ID NO: 58762 - DNA, 22 bp, Homo sapiens
tggaggctggagtgcagtggcg

SEQ ID NO: 58763 - DNA, 22 bp, Homo sapiens
tcattccctcattgttcactgg

SEQ ID NO: 58764 - DNA, 22 bp, Homo sapiens
caggctggagttcagtggtgtg

SEQ ID NO: 58765 - DNA, 22 bp, Homo sapiens
ggaaggcagaggtgtcgtgggg

SEQ ID NO: 58766 - DNA, 22 bp, Homo sapiens
tgagcttccctcctgcactaca

SEQ ID NO: 58767 - DNA, 22 bp, Homo sapiens
gttcagatttgactggtttctc

SEQ ID NO: 58768 - DNA, 22 bp, Homo sapiens
tgaggcaggagttcaggctgcg

SEQ ID NO: 58769 - DNA, 23 bp, Homo sapiens
aagtggttttgaacccggaccct

SEQ ID NO: 58770 - DNA, 22 bp, Homo sapiens
cggctgggttcggctgcaggcc

SEQ ID NO: 58771 - DNA, 22 bp, Homo sapiens
tcgagctctggagccaaggatg

SEQ ID NO: 58772 - DNA, 22 bp, Homo sapiens
agcataagttggtacagccact

SEQ ID NO: 58773 - DNA, 22 bp, Homo sapiens
tgtgcccaacgtgcaggtttgt

SEQ ID NO: 58774 - DNA, 22 bp, Homo sapiens
aaaagtcttggggaaggccagg

SEQ ID NO: 58775 - DNA, 22 bp, Homo sapiens
aggaggggttctcgggtgctga

SEQ ID NO: 58776 - DNA, 22 bp, Homo sapiens
gctcactgcaacctctgcctcc

SEQ ID NO: 58777 - DNA, 22 bp, Homo sapiens
tgtatattctgcctaaaagctt

SEQ ID NO: 58778 - DNA, 22 bp, Homo sapiens
atagtggggacaggatggttgg

SEQ ID NO: 58779 - DNA, 22 bp, Homo sapiens
gcggggcccggacccagcctct

SEQ ID NO: 58780 - DNA, 22 bp, Homo sapiens
cagaggaacgtttggattgatt

SEQ ID NO: 58781 - DNA, 22 bp, Homo sapiens
ttttaagttggattgctaagta

SEQ ID NO: 58782 - DNA, 22 bp, Homo sapiens
ggccctgggccctctagcttgt

SEQ ID NO: 58783 - DNA, 22 bp, Homo sapiens
ccaggcaggcgatggtgcagtg

SEQ ID NO: 58784 - DNA, 22 bp, Homo sapiens
ttcctgggattattgtcaagca

SEQ ID NO: 58785 - DNA, 22 bp, Homo sapiens
aattgcactttagcaatggtga

SEQ ID NO: 58786 - DNA, 22 bp, Homo sapiens
gaaggaagtcattagtgcagac

SEQ ID NO: 58787 - DNA, 21 bp, Homo sapiens
ggagtttttctggaagggact

SEQ ID NO: 58788 - DNA, 22 bp, Homo sapiens
ggcccaggctggagtgcagtgg

SEQ ID NO: 58789 - DNA, 22 bp, Homo sapiens
cagccagtgtgaccgaggagga

SEQ ID NO: 58790 - DNA, 22 bp, Homo sapiens
ccaggaggtggaggttgcggtg

SEQ ID NO: 58791 - DNA, 22 bp, Homo sapiens
agggaaattaatgtgagcaatg

SEQ ID NO: 58792 - DNA, 22 bp, Homo sapiens
ccagtgtgcaatctctggctta

SEQ ID NO: 58793 - DNA, 22 bp, Homo sapiens
ccggcgggcagcggcagtgagc

SEQ ID NO: 58794 - DNA, 22 bp, Homo sapiens
ataatacatggttgatcttttc

SEQ ID NO: 58795 - DNA, 22 bp, Homo sapiens
gccatgcttggtatgctgtgag

SEQ ID NO: 58796 - DNA, 22 bp, Homo sapiens
cgacgggctcggtccgcttcct

SEQ ID NO: 58797 - DNA, 22 bp, Homo sapiens
gcacctgcctgggactgaagat

SEQ ID NO: 58798 - DNA, 22 bp, Homo sapiens
gggtaggcaaagcaatgacgtt

SEQ ID NO: 58799 - DNA, 22 bp, Homo sapiens
acacatcctgaccaagttcagg

SEQ ID NO: 58800 - DNA, 22 bp, Homo sapiens
gagcccaggagtttgatgctgc

SEQ ID NO: 58801 - DNA, 17 bp, Homo sapiens
aatctgtttacagtcag

SEQ ID NO: 58802 - DNA, 22 bp, Homo sapiens
acacttggagcaacacttatgg

SEQ ID NO: 58803 - DNA, 22 bp, Homo sapiens
tgcctgttgcccacctgataaa

SEQ ID NO: 58804 - DNA, 22 bp, Homo sapiens
ttggaaacgtcaccttttcctt

SEQ ID NO: 58805 - DNA, 22 bp, Homo sapiens
aaggagtggggcatatcacaga

SEQ ID NO: 58806 - DNA, 22 bp, Homo sapiens
gtgagcagagatcgcgtgattg

SEQ ID NO: 58807 - DNA, 22 bp, Homo sapiens
tcccagattcctgctcttatat

SEQ ID NO: 58808 - DNA, 22 bp, Homo sapiens
tctccgatcacaggttttcaat

SEQ ID NO: 58809 - DNA, 22 bp, Homo sapiens
cgtcacttcttagtctattttc

SEQ ID NO: 58810 - DNA, 22 bp, Homo sapiens
ctgaacttattgagtgcttgct

SEQ ID NO: 58811 - DNA, 22 bp, Homo sapiens
aaactgaggctcccgagggtgt

SEQ ID NO: 58812 - DNA, 18 bp, Homo sapiens
ccctgccagctcccagca

SEQ ID NO: 58813 - DNA, 22 bp, Homo sapiens
ggcctgggctccgggagttact

SEQ ID NO: 58814 - DNA, 22 bp, Homo sapiens
ctgcagtatgagctacccaggt

SEQ ID NO: 58815 - DNA, 22 bp, Homo sapiens
caggaggttgagggtgcagtga

SEQ ID NO: 58816 - DNA, 22 bp, Homo sapiens
ttcctggtctatttagaattgc

SEQ ID NO: 58817 - DNA, 22 bp, Homo sapiens
caaagtgctgggattataggca

SEQ ID NO: 58818 - DNA, 22 bp, Homo sapiens
aaggaattcaaattttctctgg

SEQ ID NO: 58819 - DNA, 22 bp, Homo sapiens
aggaaataggaccagacaaagc

SEQ ID NO: 58820 - DNA, 22 bp, Homo sapiens
cacactgtctttcagaatggtt

SEQ ID NO: 58821 - DNA, 22 bp, Homo sapiens
agaaaatgtgaacttgtgaatt

SEQ ID NO: 58822 - DNA, 22 bp, Homo sapiens
aaaaaattatcatagttcctga

SEQ ID NO: 58823 - DNA, 22 bp, Homo sapiens
attgcactccagcctgggggac

SEQ ID NO: 58824 - DNA, 22 bp, Homo sapiens
gttctgagtcctcctttgaagg

SEQ ID NO: 58825 - DNA, 22 bp, Homo sapiens
accttcaggtgagcacacagat

SEQ ID NO: 58826 - DNA, 19 bp, Homo sapiens
gcataaatacactattgtc

SEQ ID NO: 58827 - DNA, 22 bp, Homo sapiens
tgaaatgtgttctagtgttttg

SEQ ID NO: 58828 - DNA, 22 bp, Homo sapiens
gggacgacaggctctgtggtag

SEQ ID NO: 58829 - DNA, 22 bp, Homo sapiens
cctgagtagctggaattaaagg

SEQ ID NO: 58830 - DNA, 22 bp, Homo sapiens
gtgcgcttcttcctgagccagg

SEQ ID NO: 58831 - DNA, 22 bp, Homo sapiens
cgagagttagctaggagtcaca

SEQ ID NO: 58832 - DNA, 22 bp, Homo sapiens
aggtctcttgctgtctctgggc

SEQ ID NO: 58833 - DNA, 22 bp, Homo sapiens
tacaaaaaattgatactgacga

SEQ ID NO: 58834 - DNA, 22 bp, Homo sapiens
accctccccaagaggtcgtgcc

SEQ ID NO: 58835 - DNA, 22 bp, Homo sapiens
tgtagctctccagccagcaagg

SEQ ID NO: 58836 - DNA, 22 bp, Homo sapiens
tagctcaaaggttaagtgtgga

SEQ ID NO: 58837 - DNA, 22 bp, Homo sapiens
ctggctggagtgcaggtgagtg

SEQ ID NO: 58838 - DNA, 22 bp, Homo sapiens
cagcagcagtggctgcagaaca

SEQ ID NO: 58839 - DNA, 22 bp, Homo sapiens
tggattcacaccattctcctgc

SEQ ID NO: 58840 - DNA, 22 bp, Homo sapiens
aatcagaaattgagggtctggt

SEQ ID NO: 58841 - DNA, 22 bp, Homo sapiens
atgaattgaggaaaacagtcgt

SEQ ID NO: 58842 - DNA, 22 bp, Homo sapiens
gttaaggctgagcaggacactg

SEQ ID NO: 58843 - DNA, 22 bp, Homo sapiens
cccattcatcctcgcttccttc

SEQ ID NO: 58844 - DNA, 22 bp, Homo sapiens
tggcactgaagctggaaagcct

SEQ ID NO: 58845 - DNA, 22 bp, Homo sapiens
cttgaggctgcactccagggcc

SEQ ID NO: 58846 - DNA, 22 bp, Homo sapiens
ctgaggggtcgtgggagcccag

SEQ ID NO: 58847 - DNA, 22 bp, Homo sapiens
ggagagcttggagtgcgatttt

SEQ ID NO: 58848 - DNA, 22 bp, Homo sapiens
gtagggctcagtaaatactttg

SEQ ID NO: 58849 - DNA, 21 bp, Homo sapiens
gcagcagtgttctagaatact

SEQ ID NO: 58850 - DNA, 21 bp, Homo sapiens
ggccgccgccttgtgctctgc

SEQ ID NO: 58851 - DNA, 22 bp, Homo sapiens
ctcattgcaacctccgcctccc

SEQ ID NO: 58852 - DNA, 20 bp, Homo sapiens
tgtttactctagagggtaga

SEQ ID NO: 58853 - DNA, 18 bp, Homo sapiens
tgagaggctattttttgc

SEQ ID NO: 58854 - DNA, 22 bp, Homo sapiens
tggctgtgtccctgtccagagt

SEQ ID NO: 58855 - DNA, 22 bp, Homo sapiens
ggcaaggggtcaggctgagaca

SEQ ID NO: 58856 - DNA, 22 bp, Homo sapiens
ttctagtgtccttggacttgct

SEQ ID NO: 58857 - DNA, 22 bp, Homo sapiens
atggccctaatgagttggtgtt

SEQ ID NO: 58858 - DNA, 22 bp, Homo sapiens
accccaggaagtggaggtcatg

SEQ ID NO: 58859 - DNA, 22 bp, Homo sapiens
agacactgttctcacatgcttg

SEQ ID NO: 58860 - DNA, 22 bp, Homo sapiens
cccagagcatgtgctgcctttg

SEQ ID NO: 58861 - DNA, 22 bp, Homo sapiens
agacccaggattggggctgccg

SEQ ID NO: 58862 - DNA, 22 bp, Homo sapiens
taggtttactgaattagtggaa

SEQ ID NO: 58863 - DNA, 22 bp, Homo sapiens
ataaaagatcccttctgagctc

SEQ ID NO: 58864 - DNA, 22 bp, Homo sapiens
ctgaaggatgtgtggtgggagt

SEQ ID NO: 58865 - DNA, 22 bp, Homo sapiens
gttgagtgggttaggatgctga

SEQ ID NO: 58866 - DNA, 22 bp, Homo sapiens
tcattgccatggcatttgcaga

SEQ ID NO: 58867 - DNA, 22 bp, Homo sapiens
ctcactgcaagctcagcctccc

SEQ ID NO: 58868 - DNA, 22 bp, Homo sapiens
caccagcagcggtgtgagggtg

SEQ ID NO: 58869 - DNA, 22 bp, Homo sapiens
atttagaactttgtttgccaat

SEQ ID NO: 58870 - DNA, 22 bp, Homo sapiens
tccgggagctgaacgtcttgcg

SEQ ID NO: 58871 - DNA, 22 bp, Homo sapiens
gggcagagagctggaactcctt

SEQ ID NO: 58872 - DNA, 22 bp, Homo sapiens
cggggccctggggctgaaggtc

SEQ ID NO: 58873 - DNA, 22 bp, Homo sapiens
gtgctttgtcttcaggatcata

SEQ ID NO: 58874 - DNA, 22 bp, Homo sapiens
tgtacacatggtgtacactccc

SEQ ID NO: 58875 - DNA, 22 bp, Homo sapiens
tggagggcatgctgtccatggg

SEQ ID NO: 58876 - DNA, 22 bp, Homo sapiens
aggtttctttatgctgctagaa

SEQ ID NO: 58877 - DNA, 19 bp, Homo sapiens
gcctcatttccacctcccc

SEQ ID NO: 58878 - DNA, 22 bp, Homo sapiens
gctgctgcttgaaggctcggag

SEQ ID NO: 58879 - DNA, 22 bp, Homo sapiens
gtctttatttgagattgtcatt

SEQ ID NO: 58880 - DNA, 22 bp, Homo sapiens
tctttgctattgtgagtagtgc

SEQ ID NO: 58881 - DNA, 22 bp, Homo sapiens
tttgcttgttcaagatttctgt

SEQ ID NO: 58882 - DNA, 22 bp, Homo sapiens
cacttcattgggaccagggctg

SEQ ID NO: 58883 - DNA, 22 bp, Homo sapiens
cttgcctttgtcttcaaaggct

SEQ ID NO: 58884 - DNA, 22 bp, Homo sapiens
agtgttgtcaaacggctcagca

SEQ ID NO: 58885 - DNA, 22 bp, Homo sapiens
gtcctgacggctgattggcctg

SEQ ID NO: 58886 - DNA, 22 bp, Homo sapiens
tagtttcatctccaccctgccc

SEQ ID NO: 58887 - DNA, 21 bp, Homo sapiens
tcctgtaagcttgggtggctc

SEQ ID NO: 58888 - DNA, 22 bp, Homo sapiens
ctttatgaaaacctgaattatg

SEQ ID NO: 58889 - DNA, 22 bp, Homo sapiens
gagggtggtggcttaaggtgct

SEQ ID NO: 58890 - DNA, 22 bp, Homo sapiens
gatgcgggcccgctccactgcc

SEQ ID NO: 58891 - DNA, 22 bp, Homo sapiens
tcaagagttggtcaaatccaaa

SEQ ID NO: 58892 - DNA, 22 bp, Homo sapiens
gccagggttcgaatccgtatgg

SEQ ID NO: 58893 - DNA, 22 bp, Homo sapiens
tttgagtgcccatgtttcccag

SEQ ID NO: 58894 - DNA, 22 bp, Homo sapiens
acaggcacctgccaccacatct

SEQ ID NO: 58895 - DNA, 22 bp, Homo sapiens
tgtgtcccttggaacctcagct

SEQ ID NO: 58896 - DNA, 22 bp, Homo sapiens
ccacccttgggttcggaggccg

SEQ ID NO: 58897 - DNA, 16 bp, Homo sapiens
gcagaggaaaggggag

SEQ ID NO: 58898 - DNA, 22 bp, Homo sapiens
actctggccatcttggaccttg

SEQ ID NO: 58899 - DNA, 22 bp, Homo sapiens
tgagaattacaaatgagtcaca

SEQ ID NO: 58900 - DNA, 22 bp, Homo sapiens
acacagggctgcgcctgacccc

SEQ ID NO: 58901 - DNA, 22 bp, Homo sapiens
cagcccaggactgcaggtgttt

SEQ ID NO: 58902 - DNA, 22 bp, Homo sapiens
tgtgcacaatgtgcaggtttgt

SEQ ID NO: 58903 - DNA, 22 bp, Homo sapiens
caggcagggagctggaaaggat

SEQ ID NO: 58904 - DNA, 22 bp, Homo sapiens
ctgggaagaagggacaacagcg

SEQ ID NO: 58905 - DNA, 22 bp, Homo sapiens
cacagtcctgccagagggcctt

SEQ ID NO: 58906 - DNA, 22 bp, Homo sapiens
aggaaagcttggcaaactaaat

SEQ ID NO: 58907 - DNA, 22 bp, Homo sapiens
aatctgagggaacttgaactcc

SEQ ID NO: 58908 - DNA, 22 bp, Homo sapiens
cctcgacctccccaggctcagg

SEQ ID NO: 58909 - DNA, 22 bp, Homo sapiens
tcatcataatatggaatcttgt

SEQ ID NO: 58910 - DNA, 22 bp, Homo sapiens
acagtcaaatgtctatcttctt

SEQ ID NO: 58911 - DNA, 22 bp, Homo sapiens
gtgaccatcatctcagctagtt

SEQ ID NO: 58912 - DNA, 22 bp, Homo sapiens
tccttgtaacgttgggctgggg

SEQ ID NO: 58913 - DNA, 22 bp, Homo sapiens
ggacaagcctgtgagtgggttt

SEQ ID NO: 58914 - DNA, 22 bp, Homo sapiens
gaggctgaggttgcagtgagct

SEQ ID NO: 58915 - DNA, 22 bp, Homo sapiens
ttgtgagtagtgccgcaataaa

SEQ ID NO: 58916 - DNA, 22 bp, Homo sapiens
tcatcagggatattggcctgaa

SEQ ID NO: 58917 - DNA, 22 bp, Homo sapiens
ctgggaggcggagcttgcagtg

SEQ ID NO: 58918 - DNA, 22 bp, Homo sapiens
tggcacagactgggccaaggaa

SEQ ID NO: 58919 - DNA, 22 bp, Homo sapiens
tgcactccaggctgggtgacag

SEQ ID NO: 58920 - DNA, 22 bp, Homo sapiens
aacactctctgttggtaaggct

SEQ ID NO: 58921 - DNA, 22 bp, Homo sapiens
tggcagtggcgggactcagggc

SEQ ID NO: 58922 - DNA, 22 bp, Homo sapiens
gagacacaggcacagaagaggc

SEQ ID NO: 58923 - DNA, 18 bp, Homo sapiens
tggaggaaaaatctcatg

SEQ ID NO: 58924 - DNA, 22 bp, Homo sapiens
tggggtacttgtatcaaagcac

SEQ ID NO: 58925 - DNA, 22 bp, Homo sapiens
aggccagcctcaggcagggacc

SEQ ID NO: 58926 - DNA, 20 bp, Homo sapiens
cttctggctggtcaaggact

SEQ ID NO: 58927 - DNA, 22 bp, Homo sapiens
cggctggtgtcgggcacagcaa

SEQ ID NO: 58928 - DNA, 22 bp, Homo sapiens
tggcttccccggagtgacatgt

SEQ ID NO: 58929 - DNA, 22 bp, Homo sapiens
tccgggaggcagaggttgcagt

SEQ ID NO: 58930 - DNA, 22 bp, Homo sapiens
ccaaagaaacccaagctcaggg

SEQ ID NO: 58931 - DNA, 22 bp, Homo sapiens
taatatctacttcatagagttt

SEQ ID NO: 58932 - DNA, 22 bp, Homo sapiens
gtgtggtcgaagttctcccgga

SEQ ID NO: 58933 - DNA, 22 bp, Homo sapiens
tcgaactcatagtcgtagctgt

SEQ ID NO: 58934 - DNA, 22 bp, Homo sapiens
gtggagacctcctaggatgtgt

SEQ ID NO: 58935 - DNA, 22 bp, Homo sapiens
gtatttggaaaccaccagtgcc

SEQ ID NO: 58936 - DNA, 22 bp, Homo sapiens
gtcactgtatccaggttccagc

SEQ ID NO: 58937 - DNA, 22 bp, Homo sapiens
agcgctgtgggcgtgcgaggag

SEQ ID NO: 58938 - DNA, 22 bp, Homo sapiens
ctccgcagcgggccaatccgga

SEQ ID NO: 58939 - DNA, 22 bp, Homo sapiens
gccggggctggggagagacatg

SEQ ID NO: 58940 - DNA, 22 bp, Homo sapiens
aacccaggagacaggttgcagt

SEQ ID NO: 58941 - DNA, 22 bp, Homo sapiens
aatttgttataacttgggctga

SEQ ID NO: 58942 - DNA, 22 bp, Homo sapiens
acacagagccaaaccatatcac

SEQ ID NO: 58943 - DNA, 22 bp, Homo sapiens
ctccagttggccccagttggtt

SEQ ID NO: 58944 - DNA, 22 bp, Homo sapiens
actgggccaggtgtgggtgagt

SEQ ID NO: 58945 - DNA, 22 bp, Homo sapiens
gggatgcagactacagggctta

SEQ ID NO: 58946 - DNA, 22 bp, Homo sapiens
cgcccaggctggagtgcagtgg

SEQ ID NO: 58947 - DNA, 22 bp, Homo sapiens
tgtatgaggcatacatcaggca

SEQ ID NO: 58948 - DNA, 22 bp, Homo sapiens
tcagaacatgtttgagtaagac

SEQ ID NO: 58949 - DNA, 22 bp, Homo sapiens
ctggcaggagcattcacagagg

SEQ ID NO: 58950 - DNA, 22 bp, Homo sapiens
aaacactcatgtgttactctcc

SEQ ID NO: 58951 - DNA, 22 bp, Homo sapiens
tagcacagagcttttaaacttc

SEQ ID NO: 58952 - DNA, 22 bp, Homo sapiens
atacctgtgtatccacaagcgt

SEQ ID NO: 58953 - DNA, 22 bp, Homo sapiens
tctcccaagcctggcaggggca

SEQ ID NO: 58954 - DNA, 20 bp, Homo sapiens
ctgggtggcaagcaaggggg

SEQ ID NO: 58955 - DNA, 22 bp, Homo sapiens
ggtgcagaggagccagctgggg

SEQ ID NO: 58956 - DNA, 22 bp, Homo sapiens
ccaggctggagtatagtggcgc

SEQ ID NO: 58957 - DNA, 22 bp, Homo sapiens
cttgctttcagtctcggcctca

SEQ ID NO: 58958 - DNA, 22 bp, Homo sapiens
tgagcctgggagatggaggctg

SEQ ID NO: 58959 - DNA, 22 bp, Homo sapiens
ggctgggctccgggagcatgcg

SEQ ID NO: 58960 - DNA, 22 bp, Homo sapiens
ggtgacgaatccatagcatcga

SEQ ID NO: 58961 - DNA, 22 bp, Homo sapiens
tttaatgtagcgtgaaatgatt

SEQ ID NO: 58962 - DNA, 22 bp, Homo sapiens
tgaacgcaggtccacatggctc

SEQ ID NO: 58963 - DNA, 22 bp, Homo sapiens
aaggctgaggcagtgaggcaga

SEQ ID NO: 58964 - DNA, 17 bp, Homo sapiens
catccgtgagctcggca

SEQ ID NO: 58965 - DNA, 22 bp, Homo sapiens
tggttggatggctcttgtggct

SEQ ID NO: 58966 - DNA, 16 bp, Homo sapiens
gcaggcagatcacatg

SEQ ID NO: 58967 - DNA, 22 bp, Homo sapiens
cccatgcaccctctaagaagga

SEQ ID NO: 58968 - DNA, 22 bp, Homo sapiens
acctgcaggcacaggtgtgcgc

SEQ ID NO: 58969 - DNA, 23 bp, Homo sapiens
ccaagactgttaggagtggggag

SEQ ID NO: 58970 - DNA, 22 bp, Homo sapiens
aggtgggcgctgctcccgctgg

SEQ ID NO: 58971 - DNA, 22 bp, Homo sapiens
caggctggagtgcagtggcgct

SEQ ID NO: 58972 - DNA, 22 bp, Homo sapiens
tgccgcagtgcggggagggccc

SEQ ID NO: 58973 - DNA, 22 bp, Homo sapiens
tacatgctccttatgagaatct

SEQ ID NO: 58974 - DNA, 22 bp, Homo sapiens
tgcctctgaggaagattgtgtt

SEQ ID NO: 58975 - DNA, 22 bp, Homo sapiens
gggacaatggaggcctctctcc

SEQ ID NO: 58976 - DNA, 22 bp, Homo sapiens
gaagtttttgtagagacagggt

SEQ ID NO: 58977 - DNA, 22 bp, Homo sapiens
gaggtggatgttgcagtgagct

SEQ ID NO: 58978 - DNA, 22 bp, Homo sapiens
tgccgtggggctgaggctggag

SEQ ID NO: 58979 - DNA, 22 bp, Homo sapiens
acaggggattgattggaagtct

SEQ ID NO: 58980 - DNA, 22 bp, Homo sapiens
cacttgttggtggtgaaatcac

SEQ ID NO: 58981 - DNA, 22 bp, Homo sapiens
aacccgggaggtggaggttatg

SEQ ID NO: 58982 - DNA, 22 bp, Homo sapiens
agggtgaatctcacaactctta

SEQ ID NO: 58983 - DNA, 22 bp, Homo sapiens
aaatcggttggttcaaggtaat

SEQ ID NO: 58984 - DNA, 22 bp, Homo sapiens
gcacttcaccactgtcctggtt

SEQ ID NO: 58985 - DNA, 22 bp, Homo sapiens
aggctgagataggtggatcatt

SEQ ID NO: 58986 - DNA, 22 bp, Homo sapiens
gaggcaggaggattgcttgagc

SEQ ID NO: 58987 - DNA, 22 bp, Homo sapiens
tggtattctttctgtagatcat

SEQ ID NO: 58988 - DNA, 22 bp, Homo sapiens
agctgattccactttttcccca

SEQ ID NO: 58989 - DNA, 22 bp, Homo sapiens
aatatttcttctaaagcccttt

SEQ ID NO: 58990 - DNA, 22 bp, Homo sapiens
tggcccgaagatccgagggtca

SEQ ID NO: 58991 - DNA, 22 bp, Homo sapiens
ctggaaggcagaggttgcagtg

SEQ ID NO: 58992 - DNA, 22 bp, Homo sapiens
tcctccccaaagcccagcctgg

SEQ ID NO: 58993 - DNA, 22 bp, Homo sapiens
gtatcacttttgagagtgagaa

SEQ ID NO: 58994 - DNA, 22 bp, Homo sapiens
cccaggggttcaaggctgcagt

SEQ ID NO: 58995 - DNA, 22 bp, Homo sapiens
gggggggtcttcagacctcaga

SEQ ID NO: 58996 - DNA, 22 bp, Homo sapiens
caggaacagggtgtcctggcag

SEQ ID NO: 58997 - DNA, 22 bp, Homo sapiens
tacaagatgacaggtgcatgat

SEQ ID NO: 58998 - DNA, 22 bp, Homo sapiens
gaaagtgctctctctatacaca

SEQ ID NO: 58999 - DNA, 19 bp, Homo sapiens
gactccaactttaagcatg

SEQ ID NO: 59000 - DNA, 22 bp, Homo sapiens
tgtgagttattttcaggagttt

SEQ ID NO: 59001 - DNA, 22 bp, Homo sapiens
gagtgtgtcggtcagcgtggcg

SEQ ID NO: 59002 - DNA, 22 bp, Homo sapiens
ccaggtagccaaggggtctggg

SEQ ID NO: 59003 - DNA, 22 bp, Homo sapiens
cctgggaggctgaggctgcagt

SEQ ID NO: 59004 - DNA, 23 bp, Homo sapiens
tgttccagatacgccttttcctc

SEQ ID NO: 59005 - DNA, 22 bp, Homo sapiens
gaagctgagctgaggcatgttg

SEQ ID NO: 59006 - DNA, 22 bp, Homo sapiens
tacaggcatgtagcatggtgat

SEQ ID NO: 59007 - DNA, 22 bp, Homo sapiens
gaagaggttcaacgtggtcatc

SEQ ID NO: 59008 - DNA, 22 bp, Homo sapiens
actgtgaacggactgaagccca

SEQ ID NO: 59009 - DNA, 22 bp, Homo sapiens
ctgtatctgtgttggatgagtt

SEQ ID NO: 59010 - DNA, 22 bp, Homo sapiens
gaccatcctggccaacgtggta

SEQ ID NO: 59011 - DNA, 22 bp, Homo sapiens
ccacctgagataagagagctca

SEQ ID NO: 59012 - DNA, 22 bp, Homo sapiens
tgacaggcaggacagaggtgtg

SEQ ID NO: 59013 - DNA, 22 bp, Homo sapiens
aggagggagcttaagccaggca

SEQ ID NO: 59014 - DNA, 22 bp, Homo sapiens
cagtgacgtaaactgcatgtgc

SEQ ID NO: 59015 - DNA, 22 bp, Homo sapiens
tacagaagcttttgaaaagatg

SEQ ID NO: 59016 - DNA, 22 bp, Homo sapiens
tcccagctactctagaggctga

SEQ ID NO: 59017 - DNA, 21 bp, Homo sapiens
ctacttaagtaggggattagg

SEQ ID NO: 59018 - DNA, 23 bp, Homo sapiens
ttggcaaagcctatgaagtcctc

SEQ ID NO: 59019 - DNA, 22 bp, Homo sapiens
gctgacccctacaggttgtgtt

SEQ ID NO: 59020 - DNA, 22 bp, Homo sapiens
ctacccttaagtttctgtgggg

SEQ ID NO: 59021 - DNA, 22 bp, Homo sapiens
acgcagtttgtggacatttttt

SEQ ID NO: 59022 - DNA, 22 bp, Homo sapiens
gcagggcacaaggacgcacagg

SEQ ID NO: 59023 - DNA, 22 bp, Homo sapiens
ccaaagtgctgggattacaggc

SEQ ID NO: 59024 - DNA, 22 bp, Homo sapiens
ctgggggcagcaagaagccatg

SEQ ID NO: 59025 - DNA, 22 bp, Homo sapiens
ggaggcggaggttgcagtgagc

SEQ ID NO: 59026 - DNA, 22 bp, Homo sapiens
atctattttaaatggcagtaaa

SEQ ID NO: 59027 - DNA, 22 bp, Homo sapiens
tgaaggggttcagcatgggggt

SEQ ID NO: 59028 - DNA, 22 bp, Homo sapiens
actgcaaagggaagccctttct

SEQ ID NO: 59029 - DNA, 22 bp, Homo sapiens
attgataaattgcaatggggct

SEQ ID NO: 59030 - DNA, 22 bp, Homo sapiens
ggaggtggaggttgcagtgagc

SEQ ID NO: 59031 - DNA, 22 bp, Homo sapiens
ggaggcggaggttgcagtgagt

SEQ ID NO: 59032 - DNA, 22 bp, Homo sapiens
cgcccaggctggagagcagtgg

SEQ ID NO: 59033 - DNA, 22 bp, Homo sapiens
acagaactgggaaatgcacata

SEQ ID NO: 59034 - DNA, 22 bp, Homo sapiens
tgtcttcgctacaatgaaaagg

SEQ ID NO: 59035 - DNA, 22 bp, Homo sapiens
tgggattcaccatgggcttcag

SEQ ID NO: 59036 - DNA, 22 bp, Homo sapiens
ctgtccctgagcaactcctgtt

SEQ ID NO: 59037 - DNA, 22 bp, Homo sapiens
ttcatcttgatggcttcctaat

SEQ ID NO: 59038 - DNA, 22 bp, Homo sapiens
ttatttgtggcatatgagacga

SEQ ID NO: 59039 - DNA, 22 bp, Homo sapiens
taaaatttgtccctgagtgttg

SEQ ID NO: 59040 - DNA, 22 bp, Homo sapiens
tggtggctcacacctgtaatcc

SEQ ID NO: 59041 - DNA, 22 bp, Homo sapiens
ctgcactgacttccccggctgc

SEQ ID NO: 59042 - DNA, 22 bp, Homo sapiens
agcctagggttctgatgtcact

SEQ ID NO: 59043 - DNA, 22 bp, Homo sapiens
ctttttcactgtgtcctcacac

SEQ ID NO: 59044 - DNA, 22 bp, Homo sapiens
ttgcatagtgctgaggttcggg

SEQ ID NO: 59045 - DNA, 22 bp, Homo sapiens
gcccagagttcaaggctgcagt

SEQ ID NO: 59046 - DNA, 22 bp, Homo sapiens
ttgtcgggcttacgcagggcca

SEQ ID NO: 59047 - DNA, 22 bp, Homo sapiens
aggtcaagagtaaatttgggta

SEQ ID NO: 59048 - DNA, 22 bp, Homo sapiens
ctcgttgctgaagccaaagtca

SEQ ID NO: 59049 - DNA, 22 bp, Homo sapiens
ttggagaggcagtcttgctctg

SEQ ID NO: 59050 - DNA, 22 bp, Homo sapiens
aatgtgagccaatgcccgtggg

SEQ ID NO: 59051 - DNA, 22 bp, Homo sapiens
tggtggctcacgtctgtaatct

SEQ ID NO: 59052 - DNA, 22 bp, Homo sapiens
caaagtgctggaattacaggtg

SEQ ID NO: 59053 - DNA, 22 bp, Homo sapiens
gaccagtcattactcatgccct

SEQ ID NO: 59054 - DNA, 22 bp, Homo sapiens
gacccggctccaggcccagcag

SEQ ID NO: 59055 - DNA, 22 bp, Homo sapiens
ttaataaagtatgaattggaaa

SEQ ID NO: 59056 - DNA, 22 bp, Homo sapiens
cactgaacaacaaatagtgaat

SEQ ID NO: 59057 - DNA, 22 bp, Homo sapiens
cagccccatggtgtgctccagc

SEQ ID NO: 59058 - DNA, 22 bp, Homo sapiens
cacagagatggtctggcaggtg

SEQ ID NO: 59059 - DNA, 22 bp, Homo sapiens
tgagcctgggtggtcgaggctg

SEQ ID NO: 59060 - DNA, 22 bp, Homo sapiens
cctgcctactgagttttatatt

SEQ ID NO: 59061 - DNA, 22 bp, Homo sapiens
cccagttgttgccggctctgga

SEQ ID NO: 59062 - DNA, 22 bp, Homo sapiens
tgtttacagctgatcaggcatc

SEQ ID NO: 59063 - DNA, 22 bp, Homo sapiens
gggaggttgaggctgcagtgag

SEQ ID NO: 59064 - DNA, 22 bp, Homo sapiens
tctgagctgggtcttgacagct

SEQ ID NO: 59065 - DNA, 22 bp, Homo sapiens
agtgtggagcatcgagggcaga

SEQ ID NO: 59066 - DNA, 22 bp, Homo sapiens
ttcttcatgggttcttttagga

SEQ ID NO: 59067 - DNA, 22 bp, Homo sapiens
tacagaggaggggattttaata

SEQ ID NO: 59068 - DNA, 22 bp, Homo sapiens
tagggggctttgctgcttgaca

SEQ ID NO: 59069 - DNA, 20 bp, Homo sapiens
gccgactgccttgtgagcct

SEQ ID NO: 59070 - DNA, 22 bp, Homo sapiens
tcttgccacttcatcccctttc

SEQ ID NO: 59071 - DNA, 22 bp, Homo sapiens
attgggatgccggctgataaga

SEQ ID NO: 59072 - DNA, 22 bp, Homo sapiens
ccagtgtatttttgggacctgc

SEQ ID NO: 59073 - DNA, 22 bp, Homo sapiens
gggttggcatcagggttctgtg

SEQ ID NO: 59074 - DNA, 22 bp, Homo sapiens
tacctcaagttccaggaaagcg

SEQ ID NO: 59075 - DNA, 22 bp, Homo sapiens
aagcagatctgatagggccctg

SEQ ID NO: 59076 - DNA, 22 bp, Homo sapiens
tggttttagggaatcaatctat

SEQ ID NO: 59077 - DNA, 22 bp, Homo sapiens
atgtcttctctgtaggtaaatt

SEQ ID NO: 59078 - DNA, 22 bp, Homo sapiens
tgaagactcagaagctaagata

SEQ ID NO: 59079 - DNA, 22 bp, Homo sapiens
gcctccggagtcacagtgtctt

SEQ ID NO: 59080 - DNA, 22 bp, Homo sapiens
ccacagtctatgcaacaaggtc

SEQ ID NO: 59081 - DNA, 22 bp, Homo sapiens
ggcgtgggcgaggtgctctatc

SEQ ID NO: 59082 - DNA, 17 bp, Homo sapiens
ctggagcagacaaaagg

SEQ ID NO: 59083 - DNA, 22 bp, Homo sapiens
aagaaatgctgatgttggatgg

SEQ ID NO: 59084 - DNA, 22 bp, Homo sapiens
atttttctctttccactgagat

SEQ ID NO: 59085 - DNA, 22 bp, Homo sapiens
agtgactggtgtgaagttaaat

SEQ ID NO: 59086 - DNA, 21 bp, Homo sapiens
tggcggggacttgtggctgcc

SEQ ID NO: 59087 - DNA, 22 bp, Homo sapiens
ggcctgcctcacagtcagcacc

SEQ ID NO: 59088 - DNA, 22 bp, Homo sapiens
gcgtggcttagagtggggtacc

SEQ ID NO: 59089 - DNA, 22 bp, Homo sapiens
atgatggctaggctggttttga

SEQ ID NO: 59090 - DNA, 22 bp, Homo sapiens
gcctccggagttgcagtgtctt

SEQ ID NO: 59091 - DNA, 22 bp, Homo sapiens
tcaggcagtagaattgcttgaa

SEQ ID NO: 59092 - DNA, 22 bp, Homo sapiens
acgcccagactcccatactttg

SEQ ID NO: 59093 - DNA, 22 bp, Homo sapiens
tcagtgccatgggcagacaggc

SEQ ID NO: 59094 - DNA, 22 bp, Homo sapiens
caaagtgctaggattacaggcg

SEQ ID NO: 59095 - DNA, 22 bp, Homo sapiens
agtccgtggccagactcaagag

SEQ ID NO: 59096 - DNA, 22 bp, Homo sapiens
ttgtggttaaccgcacattttt

SEQ ID NO: 59097 - DNA, 22 bp, Homo sapiens
tggcatctttgtcccagaagct

SEQ ID NO: 59098 - DNA, 22 bp, Homo sapiens
ctcagctcattgtggatccggt

SEQ ID NO: 59099 - DNA, 22 bp, Homo sapiens
tataaagagtctcaaagaagtt

SEQ ID NO: 59100 - DNA, 22 bp, Homo sapiens
cctctgtgtctccaagaggcct

SEQ ID NO: 59101 - DNA, 22 bp, Homo sapiens
gagagaagggggatatgagcct

SEQ ID NO: 59102 - DNA, 22 bp, Homo sapiens
gagagcaggaggcagcgggacg

SEQ ID NO: 59103 - DNA, 22 bp, Homo sapiens
ccaggctggagtgcaatggcat

SEQ ID NO: 59104 - DNA, 22 bp, Homo sapiens
gtccccgacgtttggcttgatg

SEQ ID NO: 59105 - DNA, 22 bp, Homo sapiens
cagagctgtccaaaccctgaca

SEQ ID NO: 59106 - DNA, 22 bp, Homo sapiens
tgcctgtggaaaggctggtgct

SEQ ID NO: 59107 - DNA, 22 bp, Homo sapiens
aaattgcaaaagtacttttagg

SEQ ID NO: 59108 - DNA, 22 bp, Homo sapiens
aacccaggagttggaggctgtg

SEQ ID NO: 59109 - DNA, 22 bp, Homo sapiens
gatagtcacctcccttaacttt

SEQ ID NO: 59110 - DNA, 23 bp, Homo sapiens
gggggccgtcctggggattatag

SEQ ID NO: 59111 - DNA, 22 bp, Homo sapiens
cttgtattaggaagaatgcttt

SEQ ID NO: 59112 - DNA, 22 bp, Homo sapiens
cctactctgagcgcctccgcat

SEQ ID NO: 59113 - DNA, 22 bp, Homo sapiens
ctagcctgggatttgaacttat

SEQ ID NO: 59114 - DNA, 22 bp, Homo sapiens
tcatcttcctcatttctccagg

SEQ ID NO: 59115 - DNA, 22 bp, Homo sapiens
tatccaattcaccattgatggg

SEQ ID NO: 59116 - DNA, 22 bp, Homo sapiens
aggagcagaccgtagtcctgca

SEQ ID NO: 59117 - DNA, 22 bp, Homo sapiens
ccaggggggcgtagatgctggg

SEQ ID NO: 59118 - DNA, 19 bp, Homo sapiens
ctgtccttggctgcactgt

SEQ ID NO: 59119 - DNA, 22 bp, Homo sapiens
agaaagtgcttccctttggact

SEQ ID NO: 59120 - DNA, 22 bp, Homo sapiens
aaaccgggtccagatcttcagg

SEQ ID NO: 59121 - DNA, 22 bp, Homo sapiens
cacatgaaggctggggtcgtga

SEQ ID NO: 59122 - DNA, 22 bp, Homo sapiens
aacctcaaactcttgggcttaa

SEQ ID NO: 59123 - DNA, 22 bp, Homo sapiens
attataggcttgagccaccgtg

SEQ ID NO: 59124 - DNA, 22 bp, Homo sapiens
gcctcactgcagccccaggaag

SEQ ID NO: 59125 - DNA, 22 bp, Homo sapiens
agaagcagaaactgggcttgtg

SEQ ID NO: 59126 - DNA, 22 bp, Homo sapiens
agccaagcactcaactcctgga

SEQ ID NO: 59127 - DNA, 22 bp, Homo sapiens
tgaggcaggagaatcacatgaa

SEQ ID NO: 59128 - DNA, 22 bp, Homo sapiens
ttgcaattgctatggagagcgt

SEQ ID NO: 59129 - DNA, 22 bp, Homo sapiens
attctcataggagcgtgaacct

SEQ ID NO: 59130 - DNA, 22 bp, Homo sapiens
cattgctttgtgcatatttaaa

SEQ ID NO: 59131 - DNA, 22 bp, Homo sapiens
aagtgtgtgagcctgtcaggct

SEQ ID NO: 59132 - DNA, 22 bp, Homo sapiens
tctcagctcatggcagccttga

SEQ ID NO: 59133 - DNA, 22 bp, Homo sapiens
aggagatggagctcagtgggca

SEQ ID NO: 59134 - DNA, 17 bp, Homo sapiens
ttcttttctgagccttg

SEQ ID NO: 59135 - DNA, 22 bp, Homo sapiens
agggaagcagcagccgcctgtc

SEQ ID NO: 59136 - DNA, 22 bp, Homo sapiens
tggctaaaccctagtaaattaa

SEQ ID NO: 59137 - DNA, 22 bp, Homo sapiens
tgcaatccccgcctcaacagga

SEQ ID NO: 59138 - DNA, 22 bp, Homo sapiens
tgctggaggccagaagtctgag

SEQ ID NO: 59139 - DNA, 22 bp, Homo sapiens
ctcctggaggatagtgactggg

SEQ ID NO: 59140 - DNA, 22 bp, Homo sapiens
aacagaatattttgcctttctc

SEQ ID NO: 59141 - DNA, 22 bp, Homo sapiens
aagaggtttaactgactcacag

SEQ ID NO: 59142 - DNA, 22 bp, Homo sapiens
taatggttttttggagactgct

SEQ ID NO: 59143 - DNA, 22 bp, Homo sapiens
ctttaattgtagctcccataat

SEQ ID NO: 59144 - DNA, 22 bp, Homo sapiens
gaggctgaggcaggaggatcac

SEQ ID NO: 59145 - DNA, 22 bp, Homo sapiens
tttagattgtgacctcccccca

SEQ ID NO: 59146 - DNA, 22 bp, Homo sapiens
gcaggtggatcaccacgtcagg

SEQ ID NO: 59147 - DNA, 23 bp, Homo sapiens
tgtgggcgcattgtaagggtagc

SEQ ID NO: 59148 - DNA, 22 bp, Homo sapiens
agaagtataactatttgctttc

SEQ ID NO: 59149 - DNA, 22 bp, Homo sapiens
agtgcagtggttaggagccagg

SEQ ID NO: 59150 - DNA, 22 bp, Homo sapiens
ttgctgacctttgctctccgtt

SEQ ID NO: 59151 - DNA, 22 bp, Homo sapiens
aacaattactaccaaggcctgt

SEQ ID NO: 59152 - DNA, 22 bp, Homo sapiens
tcacttgaacctgggaggcaga

SEQ ID NO: 59153 - DNA, 22 bp, Homo sapiens
tagatgaccttgtgttaggcaa

SEQ ID NO: 59154 - DNA, 22 bp, Homo sapiens
agtgctgtctccttcccccggg

SEQ ID NO: 59155 - DNA, 23 bp, Homo sapiens
aggaaagcattcatttttaccat

SEQ ID NO: 59156 - DNA, 22 bp, Homo sapiens
gagacctcttggtatcgctagg

SEQ ID NO: 59157 - DNA, 22 bp, Homo sapiens
acactgcagatgaaagcataag

SEQ ID NO: 59158 - DNA, 22 bp, Homo sapiens
gcagcaacgcggccctactgct

SEQ ID NO: 59159 - DNA, 22 bp, Homo sapiens
cagtggcctctggctttgctgt

SEQ ID NO: 59160 - DNA, 22 bp, Homo sapiens
cttctcggggttcccgcgccct

SEQ ID NO: 59161 - DNA, 21 bp, Homo sapiens
cagaggcctatcacagactcc

SEQ ID NO: 59162 - DNA, 22 bp, Homo sapiens
agtcccaacagcttacaaggaa

SEQ ID NO: 59163 - DNA, 22 bp, Homo sapiens
gataccagacagggagggagaa

SEQ ID NO: 59164 - DNA, 22 bp, Homo sapiens
agtgggtgtagtcttcctcctg

SEQ ID NO: 59165 - DNA, 22 bp, Homo sapiens
ctcactgcaagctctgcctccc

SEQ ID NO: 59166 - DNA, 22 bp, Homo sapiens
cacagggcttctcatggggtgc

SEQ ID NO: 59167 - DNA, 20 bp, Homo sapiens
ttctccagtgcggtagccat

SEQ ID NO: 59168 - DNA, 22 bp, Homo sapiens
gttcacagtttctaatcccagc

SEQ ID NO: 59169 - DNA, 22 bp, Homo sapiens
tgcgatggcgtagacaaatccc

SEQ ID NO: 59170 - DNA, 22 bp, Homo sapiens
ggtgtagctctgtgtcccactg

SEQ ID NO: 59171 - DNA, 23 bp, Homo sapiens
ctcaccaagcgccgccgctgtgt

SEQ ID NO: 59172 - DNA, 22 bp, Homo sapiens
tttgcttcacaagtatggttct

SEQ ID NO: 59173 - DNA, 22 bp, Homo sapiens
tctatgcttgagacagatgggg

SEQ ID NO: 59174 - DNA, 22 bp, Homo sapiens
caaagcaggaagctcctgacag

SEQ ID NO: 59175 - DNA, 22 bp, Homo sapiens
ctgtccatattcaaggggtagg

SEQ ID NO: 59176 - DNA, 22 bp, Homo sapiens
tccttgactgtgaggaactagc

SEQ ID NO: 59177 - DNA, 22 bp, Homo sapiens
aagacttgaccaggttgaaggc

SEQ ID NO: 59178 - DNA, 22 bp, Homo sapiens
aagatattcaaagatttattag

SEQ ID NO: 59179 - DNA, 22 bp, Homo sapiens
aggctgtgtggataatattggg

SEQ ID NO: 59180 - DNA, 22 bp, Homo sapiens
tcactgcaagctctgccttccg

SEQ ID NO: 59181 - DNA, 22 bp, Homo sapiens
gggtacttaatatttacggggt

SEQ ID NO: 59182 - DNA, 22 bp, Homo sapiens
cttccgtgtcagttccaggtgg

SEQ ID NO: 59183 - DNA, 22 bp, Homo sapiens
aagaataagaggatttagaaca

SEQ ID NO: 59184 - DNA, 22 bp, Homo sapiens
tcttcctggatgggggttgatg

SEQ ID NO: 59185 - DNA, 22 bp, Homo sapiens
aacccgggaggcggaggttgtg

SEQ ID NO: 59186 - DNA, 22 bp, Homo sapiens
ctacttgttcactgtaggtcgc

SEQ ID NO: 59187 - DNA, 22 bp, Homo sapiens
atacaaaatatatactggagac

SEQ ID NO: 59188 - DNA, 22 bp, Homo sapiens
gggagagtagctggaaggttct

SEQ ID NO: 59189 - DNA, 22 bp, Homo sapiens
tcattgagttgcacttttacta

SEQ ID NO: 59190 - DNA, 22 bp, Homo sapiens
ttaccacagtgcctgtctaatg

SEQ ID NO: 59191 - DNA, 22 bp, Homo sapiens
tatcactacacctggctaatta

SEQ ID NO: 59192 - DNA, 22 bp, Homo sapiens
ccctggaggcggagcttgcagt

SEQ ID NO: 59193 - DNA, 22 bp, Homo sapiens
cactgcactccagcctgggtca

SEQ ID NO: 59194 - DNA, 22 bp, Homo sapiens
gattccacagcttcgaggtctt

SEQ ID NO: 59195 - DNA, 22 bp, Homo sapiens
gtctccttgtggatctcaagga

SEQ ID NO: 59196 - DNA, 22 bp, Homo sapiens
aaagcagaggttgcagtgagct

SEQ ID NO: 59197 - DNA, 22 bp, Homo sapiens
cttgtgcatttcattcctcagg

SEQ ID NO: 59198 - DNA, 22 bp, Homo sapiens
tcacatctaattccatttctgc

SEQ ID NO: 59199 - DNA, 22 bp, Homo sapiens
gttattgaggtggagtctcact

SEQ ID NO: 59200 - DNA, 22 bp, Homo sapiens
aagcacctgcaccggtcgcctt

SEQ ID NO: 59201 - DNA, 22 bp, Homo sapiens
ggtgagaaagggattcctgttc

SEQ ID NO: 59202 - DNA, 22 bp, Homo sapiens
gatataggttcatagtgttaca

SEQ ID NO: 59203 - DNA, 22 bp, Homo sapiens
ctaaagtgccaggaatacaggt

SEQ ID NO: 59204 - DNA, 22 bp, Homo sapiens
tgtggcttaagaatgcctttaa

SEQ ID NO: 59205 - DNA, 18 bp, Homo sapiens
acttcccagatgagggga

SEQ ID NO: 59206 - DNA, 22 bp, Homo sapiens
tctgctggaaaaccagggaatt

SEQ ID NO: 59207 - DNA, 22 bp, Homo sapiens
ccccacaactcatgttgaaact

SEQ ID NO: 59208 - DNA, 21 bp, Homo sapiens
attctttgatgtgcaataagt

SEQ ID NO: 59209 - DNA, 22 bp, Homo sapiens
tctgttttgcataatgttcttt

SEQ ID NO: 59210 - DNA, 22 bp, Homo sapiens
gggccccaagaacctcctcctg

SEQ ID NO: 59211 - DNA, 20 bp, Homo sapiens
tgctggaaattgttctagga

SEQ ID NO: 59212 - DNA, 23 bp, Homo sapiens
ggttccaggaacacagcctgatg

SEQ ID NO: 59213 - DNA, 22 bp, Homo sapiens
taggatttaataaaagaataga

SEQ ID NO: 59214 - DNA, 22 bp, Homo sapiens
gcagctgacatctggctgggcc

SEQ ID NO: 59215 - DNA, 22 bp, Homo sapiens
gccaatgacagtctcagttctg

SEQ ID NO: 59216 - DNA, 22 bp, Homo sapiens
atgttattgatgcctgaggctt

SEQ ID NO: 59217 - DNA, 22 bp, Homo sapiens
gctgtgtccaggtgggggtgac

SEQ ID NO: 59218 - DNA, 22 bp, Homo sapiens
acttattagacatcttcattgt

SEQ ID NO: 59219 - DNA, 21 bp, Homo sapiens
tctctttctggaagcttccct

SEQ ID NO: 59220 - DNA, 22 bp, Homo sapiens
tgtcatctgcgggtggcactgc

SEQ ID NO: 59221 - DNA, 22 bp, Homo sapiens
tttcttaggctctaaaatgact

SEQ ID NO: 59222 - DNA, 22 bp, Homo sapiens
cctcttctaggacgtccttgtg

SEQ ID NO: 59223 - DNA, 18 bp, Homo sapiens
taggttacagccagccag

SEQ ID NO: 59224 - DNA, 22 bp, Homo sapiens
tcacttcccagacggggtggca

SEQ ID NO: 59225 - DNA, 22 bp, Homo sapiens
tgggaaggggagctggaaagga

SEQ ID NO: 59226 - DNA, 22 bp, Homo sapiens
cttcctctgtggccagagtgta

SEQ ID NO: 59227 - DNA, 22 bp, Homo sapiens
tcactgcaagctccacctcccg

SEQ ID NO: 59228 - DNA, 22 bp, Homo sapiens
atgtgtattacctcgattgtga

SEQ ID NO: 59229 - DNA, 22 bp, Homo sapiens
agtgctgtcagttttatagata

SEQ ID NO: 59230 - DNA, 23 bp, Homo sapiens
aaataggagtatctggatcatga

SEQ ID NO: 59231 - DNA, 22 bp, Homo sapiens
atggtggacgggagacaggact

SEQ ID NO: 59232 - DNA, 22 bp, Homo sapiens
aagcatttcaggtagagatatt

SEQ ID NO: 59233 - DNA, 22 bp, Homo sapiens
aagagggaaattgttggctgct

SEQ ID NO: 59234 - DNA, 22 bp, Homo sapiens
ccagaccctccattcaagctcc

SEQ ID NO: 59235 - DNA, 22 bp, Homo sapiens
aaagtgctgggattccaggcgt

SEQ ID NO: 59236 - DNA, 22 bp, Homo sapiens
gctgaaggcccggaggacaggg

SEQ ID NO: 59237 - DNA, 22 bp, Homo sapiens
gtcttgatctcctgaccttgtg

SEQ ID NO: 59238 - DNA, 22 bp, Homo sapiens
ttactttaagggtgtcttatta

SEQ ID NO: 59239 - DNA, 22 bp, Homo sapiens
acaccatactcatgttggttcc

SEQ ID NO: 59240 - DNA, 22 bp, Homo sapiens
gggctaaatgcagaaatgcaga

SEQ ID NO: 59241 - DNA, 22 bp, Homo sapiens
aataaaatggtcagttttctca

SEQ ID NO: 59242 - DNA, 22 bp, Homo sapiens
gtgtcaataaatagcggtgtgg

SEQ ID NO: 59243 - DNA, 22 bp, Homo sapiens
ttacttaaacagaaatgcagaa

SEQ ID NO: 59244 - DNA, 22 bp, Homo sapiens
gcaaatgctaaagtgtagagac

SEQ ID NO: 59245 - DNA, 22 bp, Homo sapiens
gcccagcccagaaaggttcgga

SEQ ID NO: 59246 - DNA, 22 bp, Homo sapiens
catataaatacaacatgtgtta

SEQ ID NO: 59247 - DNA, 22 bp, Homo sapiens
taacaatacccattctaattac

SEQ ID NO: 59248 - DNA, 22 bp, Homo sapiens
atggaaggctttatgactcaaa

SEQ ID NO: 59249 - DNA, 21 bp, Homo sapiens
ttgttcctatctgcctcctgc

SEQ ID NO: 59250 - DNA, 22 bp, Homo sapiens
actgcactccagcctgggtgat

SEQ ID NO: 59251 - DNA, 22 bp, Homo sapiens
tgatatgcatgtaagggagaca

SEQ ID NO: 59252 - DNA, 22 bp, Homo sapiens
tctggcttcgcagctcccagcc

SEQ ID NO: 59253 - DNA, 22 bp, Homo sapiens
tgtttcctttctggtgagcata

SEQ ID NO: 59254 - DNA, 22 bp, Homo sapiens
ggcatcgtcctgggcataggga

SEQ ID NO: 59255 - DNA, 22 bp, Homo sapiens
gggtggagagaaagaaacgtga

SEQ ID NO: 59256 - DNA, 22 bp, Homo sapiens
agcaactgggctcattttttaa

SEQ ID NO: 59257 - DNA, 22 bp, Homo sapiens
cgccggcttgaggcaggcggca

SEQ ID NO: 59258 - DNA, 22 bp, Homo sapiens
aggctccctgaatcgcccgttc

SEQ ID NO: 59259 - DNA, 22 bp, Homo sapiens
tcagtgttaatcagtggtacct

SEQ ID NO: 59260 - DNA, 22 bp, Homo sapiens
tgtggcacatacacaggagggc

SEQ ID NO: 59261 - DNA, 22 bp, Homo sapiens
acatatgcgatcataggatgca

SEQ ID NO: 59262 - DNA, 22 bp, Homo sapiens
tctgcaacagtgccctgtaaat

SEQ ID NO: 59263 - DNA, 22 bp, Homo sapiens
tgtgtttctgagaatcccacct

SEQ ID NO: 59264 - DNA, 22 bp, Homo sapiens
gtgcaaaagtaattgtggtttt

SEQ ID NO: 59265 - DNA, 22 bp, Homo sapiens
tgtgccatgaggctctgatatg

SEQ ID NO: 59266 - DNA, 22 bp, Homo sapiens
atattacacacggtatcacggg

SEQ ID NO: 59267 - DNA, 22 bp, Homo sapiens
actgcaacctccgcctgccagg

SEQ ID NO: 59268 - DNA, 22 bp, Homo sapiens
aaccaccattctctcctcttcc

SEQ ID NO: 59269 - DNA, 22 bp, Homo sapiens
tctcaagcttgttggtatgttt

SEQ ID NO: 59270 - DNA, 22 bp, Homo sapiens
tcttttgtgattctttagttac

SEQ ID NO: 59271 - DNA, 22 bp, Homo sapiens
tacagctgcaagggtttctggg

SEQ ID NO: 59272 - DNA, 22 bp, Homo sapiens
gcccagccacagtcactttcat

SEQ ID NO: 59273 - DNA, 22 bp, Homo sapiens
ccagagctgcaggtaaaatgct

SEQ ID NO: 59274 - DNA, 22 bp, Homo sapiens
gaggctgaggcggatggatcac

SEQ ID NO: 59275 - DNA, 22 bp, Homo sapiens
cactgcactccatcctgggaaa

SEQ ID NO: 59276 - DNA, 22 bp, Homo sapiens
tgggcaggggccctgcttccgt

SEQ ID NO: 59277 - DNA, 22 bp, Homo sapiens
gcgaatctcagctggtgctgcg

SEQ ID NO: 59278 - DNA, 22 bp, Homo sapiens
cagtgcttttaaaacaacatca

SEQ ID NO: 59279 - DNA, 22 bp, Homo sapiens
gcgggccaccttggagagcgct

SEQ ID NO: 59280 - DNA, 22 bp, Homo sapiens
tgttattctagtggatcacgtc

SEQ ID NO: 59281 - DNA, 22 bp, Homo sapiens
caggcactgtgctgagctctgc

SEQ ID NO: 59282 - DNA, 22 bp, Homo sapiens
tttacagcagcatgatttataa

SEQ ID NO: 59283 - DNA, 22 bp, Homo sapiens
tacagtgcttggtatctagtaa

SEQ ID NO: 59284 - DNA, 22 bp, Homo sapiens
cagggatggcgctggctgcccg

SEQ ID NO: 59285 - DNA, 22 bp, Homo sapiens
gccagcagcttcttctcatcct

SEQ ID NO: 59286 - DNA, 22 bp, Homo sapiens
tggctcctcacgtcctcagagc

SEQ ID NO: 59287 - DNA, 22 bp, Homo sapiens
gttgaaatcctaaccccctagt

SEQ ID NO: 59288 - DNA, 22 bp, Homo sapiens
aagtgctgggattacaggtgtg

SEQ ID NO: 59289 - DNA, 22 bp, Homo sapiens
gtgctgacaggagcctggcggt

SEQ ID NO: 59290 - DNA, 22 bp, Homo sapiens
atttgtgggactataatgcagg

SEQ ID NO: 59291 - DNA, 23 bp, Homo sapiens
aggatgtaggatgtatggcagag

SEQ ID NO: 59292 - DNA, 22 bp, Homo sapiens
ctggtgtggactccgcgcggag

SEQ ID NO: 59293 - DNA, 22 bp, Homo sapiens
aggggctcctttgtgctgcgtc

SEQ ID NO: 59294 - DNA, 22 bp, Homo sapiens
ttatgatttgccacagattggt

SEQ ID NO: 59295 - DNA, 22 bp, Homo sapiens
ggggaccctcaggactgcgtct

SEQ ID NO: 59296 - DNA, 19 bp, Homo sapiens
gctgaggtggaggaaggag

SEQ ID NO: 59297 - DNA, 22 bp, Homo sapiens
tgttgcccaggttctctcctgc

SEQ ID NO: 59298 - DNA, 20 bp, Homo sapiens
gggcaaggaaacagccccca

SEQ ID NO: 59299 - DNA, 22 bp, Homo sapiens
attcatcaactgatagccatag

SEQ ID NO: 59300 - DNA, 22 bp, Homo sapiens
gacggagctggttgctgcggct

SEQ ID NO: 59301 - DNA, 22 bp, Homo sapiens
agaaactctggaagaactttta

SEQ ID NO: 59302 - DNA, 18 bp, Homo sapiens
taggagagaatttattta

SEQ ID NO: 59303 - DNA, 22 bp, Homo sapiens
gggcggatcatttgaggtcagg

SEQ ID NO: 59304 - DNA, 22 bp, Homo sapiens
ggccctggcagccacgaaagcc

SEQ ID NO: 59305 - DNA, 22 bp, Homo sapiens
tcccagtttttctccactaagg

SEQ ID NO: 59306 - DNA, 22 bp, Homo sapiens
aggaagatgtgcaaagttggaa

SEQ ID NO: 59307 - DNA, 22 bp, Homo sapiens
tgagccaagatcatgccgttgt

SEQ ID NO: 59308 - DNA, 22 bp, Homo sapiens
tttctgagaaattaaacacttt

SEQ ID NO: 59309 - DNA, 18 bp, Homo sapiens
gaggtagataagattttc

SEQ ID NO: 59310 - DNA, 22 bp, Homo sapiens
tttacacagaggacactgggct

SEQ ID NO: 59311 - DNA, 22 bp, Homo sapiens
gtggcatgaaagcatctgtgat

SEQ ID NO: 59312 - DNA, 22 bp, Homo sapiens
aacttggctaccagcgttaaat

SEQ ID NO: 59313 - DNA, 22 bp, Homo sapiens
gctcttgtcaaaaattagttga

SEQ ID NO: 59314 - DNA, 22 bp, Homo sapiens
aatgcaatgcagcacctccttg

SEQ ID NO: 59315 - DNA, 22 bp, Homo sapiens
attcatcagctaatggacattt

SEQ ID NO: 59316 - DNA, 22 bp, Homo sapiens
ctgggagtggtgacagctctcg

SEQ ID NO: 59317 - DNA, 22 bp, Homo sapiens
aggtcaccatggcatgctccac

SEQ ID NO: 59318 - DNA, 22 bp, Homo sapiens
ccaaagtgctggggttacaggc

SEQ ID NO: 59319 - DNA, 21 bp, Homo sapiens
cactccacttagaacagggtt

SEQ ID NO: 59320 - DNA, 22 bp, Homo sapiens
gaggtggctgcttgctgggaaa

SEQ ID NO: 59321 - DNA, 22 bp, Homo sapiens
caggaaagggatgggctgccac

SEQ ID NO: 59322 - DNA, 22 bp, Homo sapiens
gcccaggctggagtgcagtggc

SEQ ID NO: 59323 - DNA, 22 bp, Homo sapiens
ggagtgaatcactagatgcaga

SEQ ID NO: 59324 - DNA, 22 bp, Homo sapiens
cccaggaggcgcaggttgcggt

SEQ ID NO: 59325 - DNA, 22 bp, Homo sapiens
ccctgcctacagggttttcttt

SEQ ID NO: 59326 - DNA, 22 bp, Homo sapiens
agagtgtaccaaatatcctaca

SEQ ID NO: 59327 - DNA, 22 bp, Homo sapiens
gctgctttgtctgtaaaatgga

SEQ ID NO: 59328 - DNA, 22 bp, Homo sapiens
catgatctggtcctactgtggg

SEQ ID NO: 59329 - DNA, 22 bp, Homo sapiens
tttttgggtccaggctgtatct

SEQ ID NO: 59330 - DNA, 22 bp, Homo sapiens
atcactgtgtatgtatatgcag

SEQ ID NO: 59331 - DNA, 22 bp, Homo sapiens
aaggcaaaagaggtgtcatcac

SEQ ID NO: 59332 - DNA, 22 bp, Homo sapiens
gtcccataagtagtgcaacttg

SEQ ID NO: 59333 - DNA, 22 bp, Homo sapiens
ccgggcgggggctctcgtcacc

SEQ ID NO: 59334 - DNA, 22 bp, Homo sapiens
atggggagctcaccacctgttt

SEQ ID NO: 59335 - DNA, 22 bp, Homo sapiens
gttggctatgagagctttagtg

SEQ ID NO: 59336 - DNA, 22 bp, Homo sapiens
gtggattacaagacagttgaga

SEQ ID NO: 59337 - DNA, 22 bp, Homo sapiens
gcacggctaatttttgtatttt

SEQ ID NO: 59338 - DNA, 22 bp, Homo sapiens
gttactcctggttgagcttggt

SEQ ID NO: 59339 - DNA, 22 bp, Homo sapiens
gtttggggagttcctttaggcc

SEQ ID NO: 59340 - DNA, 20 bp, Homo sapiens
cagcctgcatcatctgcagc

SEQ ID NO: 59341 - DNA, 22 bp, Homo sapiens
gagatggagtctttttctgtca

SEQ ID NO: 59342 - DNA, 22 bp, Homo sapiens
ctatgaccccagcatgaataag

SEQ ID NO: 59343 - DNA, 22 bp, Homo sapiens
agcctgggcaacagagcaaaac

SEQ ID NO: 59344 - DNA, 22 bp, Homo sapiens
gcaccaggtgcagccgggcccc

SEQ ID NO: 59345 - DNA, 22 bp, Homo sapiens
ttttggccacatccttttgagt

SEQ ID NO: 59346 - DNA, 22 bp, Homo sapiens
attctcaaaacataacttcact

SEQ ID NO: 59347 - DNA, 22 bp, Homo sapiens
ggaagaaaggtggacaacaggt

SEQ ID NO: 59348 - DNA, 22 bp, Homo sapiens
gggttaaagagcccaatgtatg

SEQ ID NO: 59349 - DNA, 22 bp, Homo sapiens
gacaattagatcattcctttga

SEQ ID NO: 59350 - DNA, 22 bp, Homo sapiens
ctctgcctgtctcatcctgcaa

SEQ ID NO: 59351 - DNA, 22 bp, Homo sapiens
tcctgggtccatggcagccgaa

SEQ ID NO: 59352 - DNA, 22 bp, Homo sapiens
ttgaagactaatttagataatg

SEQ ID NO: 59353 - DNA, 22 bp, Homo sapiens
acaggggcaagggctcacggcc

SEQ ID NO: 59354 - DNA, 22 bp, Homo sapiens
aggcaatcccctgaggatactt

SEQ ID NO: 59355 - DNA, 22 bp, Homo sapiens
gcaccgccttggaccgcccgct

SEQ ID NO: 59356 - DNA, 22 bp, Homo sapiens
acacatggtctacttcttctca

SEQ ID NO: 59357 - DNA, 22 bp, Homo sapiens
aggggaggtgtccccaaatctc

SEQ ID NO: 59358 - DNA, 22 bp, Homo sapiens
gggcatggtggcaggcacctgt

SEQ ID NO: 59359 - DNA, 20 bp, Homo sapiens
gaaatgtacacattaccaca

SEQ ID NO: 59360 - DNA, 22 bp, Homo sapiens
tttaagaagttatgttataaat

SEQ ID NO: 59361 - DNA, 22 bp, Homo sapiens
agatgtgtttctagttcctgca

SEQ ID NO: 59362 - DNA, 22 bp, Homo sapiens
ctgggcagctgtatcagggagt

SEQ ID NO: 59363 - DNA, 22 bp, Homo sapiens
atttacaggtagaattttaagt

SEQ ID NO: 59364 - DNA, 22 bp, Homo sapiens
atcacagggtgaggattagacc

SEQ ID NO: 59365 - DNA, 22 bp, Homo sapiens
tgcgggtcccagggtcacaggc

SEQ ID NO: 59366 - DNA, 22 bp, Homo sapiens
ttccgagggctcggcggccgcc

SEQ ID NO: 59367 - DNA, 22 bp, Homo sapiens
gcagctggaagtgacactctgt

SEQ ID NO: 59368 - DNA, 22 bp, Homo sapiens
gataatccactctgctgacttt

SEQ ID NO: 59369 - DNA, 22 bp, Homo sapiens
cgtgtacagtctatcttttttc

SEQ ID NO: 59370 - DNA, 22 bp, Homo sapiens
gttcaagaccagcctggccaac

SEQ ID NO: 59371 - DNA, 22 bp, Homo sapiens
tgtccttcttgtcttgcccaaa

SEQ ID NO: 59372 - DNA, 23 bp, Homo sapiens
ggggcctgcaccggtctgcgcgg

SEQ ID NO: 59373 - DNA, 22 bp, Homo sapiens
agtgttagattcttactcagtt

SEQ ID NO: 59374 - DNA, 22 bp, Homo sapiens
tccattatacttctgattcaaa

SEQ ID NO: 59375 - DNA, 22 bp, Homo sapiens
cccaggaggtggagttcacagt

SEQ ID NO: 59376 - DNA, 22 bp, Homo sapiens
ggcggctactcctcctggtgag

SEQ ID NO: 59377 - DNA, 22 bp, Homo sapiens
aggctgtagtgcatgtgctatg

SEQ ID NO: 59378 - DNA, 22 bp, Homo sapiens
gttttagataaagctgtccttg

SEQ ID NO: 59379 - DNA, 22 bp, Homo sapiens
tgctcgaggtccccaccggctc

SEQ ID NO: 59380 - DNA, 22 bp, Homo sapiens
ggtggttcacgcctataatccc

SEQ ID NO: 59381 - DNA, 22 bp, Homo sapiens
acagattcactgcactggccat

SEQ ID NO: 59382 - DNA, 22 bp, Homo sapiens
ctggaggtgcttcgctggccac

SEQ ID NO: 59383 - DNA, 22 bp, Homo sapiens
ggggcaggagcccttcttcagc

SEQ ID NO: 59384 - DNA, 22 bp, Homo sapiens
ttctttcagaacacaagtgatt

SEQ ID NO: 59385 - DNA, 22 bp, Homo sapiens
tttgtggcaggagcggagaccg

SEQ ID NO: 59386 - DNA, 22 bp, Homo sapiens
gtccacagctctgaggtctccc

SEQ ID NO: 59387 - DNA, 22 bp, Homo sapiens
ggggcattgtgtctgggttcct

SEQ ID NO: 59388 - DNA, 22 bp, Homo sapiens
aagtgctgagactacaggcatg

SEQ ID NO: 59389 - DNA, 23 bp, Homo sapiens
gtgcatgtgtctttacagtagca

SEQ ID NO: 59390 - DNA, 22 bp, Homo sapiens
catccaggctgaagtgcagtgg

SEQ ID NO: 59391 - DNA, 22 bp, Homo sapiens
tgtccaggctggagtgcagtgg

SEQ ID NO: 59392 - DNA, 22 bp, Homo sapiens
agtcaaggtggaccagaaaaat

SEQ ID NO: 59393 - DNA, 22 bp, Homo sapiens
ctaggctggagtgcagtggcac

SEQ ID NO: 59394 - DNA, 22 bp, Homo sapiens
tccctagtcgcatctgtggaga

SEQ ID NO: 59395 - DNA, 22 bp, Homo sapiens
acagtatagggcttatattgta

SEQ ID NO: 59396 - DNA, 22 bp, Homo sapiens
caggctggagtgcagtggggcg

SEQ ID NO: 59397 - DNA, 22 bp, Homo sapiens
aggtgggtgcctatgtatgtat

SEQ ID NO: 59398 - DNA, 22 bp, Homo sapiens
gtgagaaatgacaaatgtgtcg

SEQ ID NO: 59399 - DNA, 22 bp, Homo sapiens
aaggagaaatggtagatgtgca

SEQ ID NO: 59400 - DNA, 22 bp, Homo sapiens
tggcaccatcaaggctgagaac

SEQ ID NO: 59401 - DNA, 22 bp, Homo sapiens
gcgggcgggggttcccaggtct

SEQ ID NO: 59402 - DNA, 22 bp, Homo sapiens
atgccacttcattccagcctcg

SEQ ID NO: 59403 - DNA, 22 bp, Homo sapiens
cccaggctggagtgcagtggcg

SEQ ID NO: 59404 - DNA, 22 bp, Homo sapiens
aagaggagaaaggctggctttg

SEQ ID NO: 59405 - DNA, 22 bp, Homo sapiens
gctgccaatccagctgtgggag

SEQ ID NO: 59406 - DNA, 17 bp, Homo sapiens
gtaaggcttgcagatgc

SEQ ID NO: 59407 - DNA, 22 bp, Homo sapiens
attctggacaaggcaagctcct

SEQ ID NO: 59408 - DNA, 22 bp, Homo sapiens
aataaacaaatccttccttccc

SEQ ID NO: 59409 - DNA, 22 bp, Homo sapiens
tcacccaggctggactgcagtg

SEQ ID NO: 59410 - DNA, 22 bp, Homo sapiens
tacttttcctggaaccactgct

SEQ ID NO: 59411 - DNA, 22 bp, Homo sapiens
actccacaccacgggggccgcc

SEQ ID NO: 59412 - DNA, 22 bp, Homo sapiens
taggtttcagaggtgccgggaa

SEQ ID NO: 59413 - DNA, 22 bp, Homo sapiens
gctggctgacagatttggggtg

SEQ ID NO: 59414 - DNA, 14 bp, Homo sapiens
gcaggcggatcact

SEQ ID NO: 59415 - DNA, 22 bp, Homo sapiens
ggctgtggcagctggaagtggt

SEQ ID NO: 59416 - DNA, 22 bp, Homo sapiens
atgccaggaacaaacagtggtg

SEQ ID NO: 59417 - DNA, 22 bp, Homo sapiens
gactttctgatgtaaacattta

SEQ ID NO: 59418 - DNA, 22 bp, Homo sapiens
aagactgtgtctatggctactc

SEQ ID NO: 59419 - DNA, 22 bp, Homo sapiens
ccaggaggcggaaggtacagtg

SEQ ID NO: 59420 - DNA, 22 bp, Homo sapiens
ggatgttctggggttctcttgt

SEQ ID NO: 59421 - DNA, 22 bp, Homo sapiens
agttgggtttgtgtcagttgca

SEQ ID NO: 59422 - DNA, 22 bp, Homo sapiens
ttacctaaaatagctcaattta

SEQ ID NO: 59423 - DNA, 22 bp, Homo sapiens
ttaagtgcaaaaatgaaagtat

SEQ ID NO: 59424 - DNA, 20 bp, Homo sapiens
agcagagtgcccatcccgga

SEQ ID NO: 59425 - DNA, 22 bp, Homo sapiens
tagctaccattattgagcacct

SEQ ID NO: 59426 - DNA, 22 bp, Homo sapiens
aggggatggagctggaaggcag

SEQ ID NO: 59427 - DNA, 22 bp, Homo sapiens
cagcctggtccccggctcaccc

SEQ ID NO: 59428 - DNA, 20 bp, Homo sapiens
tttctgtgagaaacactgtt

SEQ ID NO: 59429 - DNA, 22 bp, Homo sapiens
cagatgtacatgaagggcaatg

SEQ ID NO: 59430 - DNA, 23 bp, Homo sapiens
actcgtggaattctctgcgatcg

SEQ ID NO: 59431 - DNA, 22 bp, Homo sapiens
tttctttatcatagcatctttg

SEQ ID NO: 59432 - DNA, 22 bp, Homo sapiens
ccacaggggcccacgagccgct

SEQ ID NO: 59433 - DNA, 22 bp, Homo sapiens
ggagtagctgcattccgagcac

SEQ ID NO: 59434 - DNA, 22 bp, Homo sapiens
actttcttggtcccatgtttga

SEQ ID NO: 59435 - DNA, 22 bp, Homo sapiens
atacaaagtattaatcctggat

SEQ ID NO: 59436 - DNA, 22 bp, Homo sapiens
ggagagggtaggggtcctgccc

SEQ ID NO: 59437 - DNA, 22 bp, Homo sapiens
gctggggaggcagcagagaaca

SEQ ID NO: 59438 - DNA, 22 bp, Homo sapiens
ctgtacttttgcaggtcacagc

SEQ ID NO: 59439 - DNA, 22 bp, Homo sapiens
taaatgttgtaagtacatctaa

SEQ ID NO: 59440 - DNA, 22 bp, Homo sapiens
tggaaaactttggtggtgaggg

SEQ ID NO: 59441 - DNA, 22 bp, Homo sapiens
ccaagctacttaggagtctgag

SEQ ID NO: 59442 - DNA, 22 bp, Homo sapiens
cggggaagcggttctggcggta

SEQ ID NO: 59443 - DNA, 22 bp, Homo sapiens
agtgaatgtccccgcgggtcag

SEQ ID NO: 59444 - DNA, 22 bp, Homo sapiens
attcacatttagcctctgacat

SEQ ID NO: 59445 - DNA, 22 bp, Homo sapiens
cctcggctgggccttggccact

SEQ ID NO: 59446 - DNA, 22 bp, Homo sapiens
acctggacacctgctgtcatct

SEQ ID NO: 59447 - DNA, 22 bp, Homo sapiens
tgctggtaccgcgcctccgcca

SEQ ID NO: 59448 - DNA, 22 bp, Homo sapiens
taagaaatttagttatagaatg

SEQ ID NO: 59449 - DNA, 22 bp, Homo sapiens
tcccgtaggttgctgtagtcgg

SEQ ID NO: 59450 - DNA, 22 bp, Homo sapiens
ggaggaggggtgactgaatgct

SEQ ID NO: 59451 - DNA, 22 bp, Homo sapiens
gctgtctgtcttcacatctcgc

SEQ ID NO: 59452 - DNA, 22 bp, Homo sapiens
tgagggaatattgatagatccg

SEQ ID NO: 59453 - DNA, 22 bp, Homo sapiens
acatgtttaagtttgttatatg

SEQ ID NO: 59454 - DNA, 22 bp, Homo sapiens
gcttcggggtccaagcgcgtgt

SEQ ID NO: 59455 - DNA, 22 bp, Homo sapiens
gatgatcatctgtaaagttaga

SEQ ID NO: 59456 - DNA, 22 bp, Homo sapiens
ggccggggcctgctcgcctgtg

SEQ ID NO: 59457 - DNA, 22 bp, Homo sapiens
catgtgaattccaaagctaggt

SEQ ID NO: 59458 - DNA, 22 bp, Homo sapiens
tgttttaagggtcaactgtcac

SEQ ID NO: 59459 - DNA, 22 bp, Homo sapiens
tcctgggatcaagtgatcctcc

SEQ ID NO: 59460 - DNA, 22 bp, Homo sapiens
aagagggctgcaatcttattgc

SEQ ID NO: 59461 - DNA, 22 bp, Homo sapiens
atgcccaatgtcacaatttttg

SEQ ID NO: 59462 - DNA, 22 bp, Homo sapiens
gatttttatataaagtgagaaa

SEQ ID NO: 59463 - DNA, 22 bp, Homo sapiens
tgtagtagcattcacgaagtgt

SEQ ID NO: 59464 - DNA, 22 bp, Homo sapiens
gggccaccccactgcccacgct

SEQ ID NO: 59465 - DNA, 22 bp, Homo sapiens
gcaggcaggcttccttgaactg

SEQ ID NO: 59466 - DNA, 18 bp, Homo sapiens
actctttctgcccacagg

SEQ ID NO: 59467 - DNA, 22 bp, Homo sapiens
tgaggcaggaggattgcaggat

SEQ ID NO: 59468 - DNA, 22 bp, Homo sapiens
catgtctgtgtacacatgcaca

SEQ ID NO: 59469 - DNA, 22 bp, Homo sapiens
gaggctggacgtgcatttctac

SEQ ID NO: 59470 - DNA, 22 bp, Homo sapiens
tcacagagttaaaagtttcttt

SEQ ID NO: 59471 - DNA, 22 bp, Homo sapiens
ttgtcttttgtgggaaatatgg

SEQ ID NO: 59472 - DNA, 22 bp, Homo sapiens
actctgctctgtatttcactgt

SEQ ID NO: 59473 - DNA, 22 bp, Homo sapiens
gctcactgcctgggcaacaaga

SEQ ID NO: 59474 - DNA, 22 bp, Homo sapiens
tcttcattttacaggcagacct

SEQ ID NO: 59475 - DNA, 22 bp, Homo sapiens
tgagctgtatattgttttaata

SEQ ID NO: 59476 - DNA, 23 bp, Homo sapiens
atgacactcctgtgcgcaccctg

SEQ ID NO: 59477 - DNA, 22 bp, Homo sapiens
ggtgactggtttatctggcagt

SEQ ID NO: 59478 - DNA, 22 bp, Homo sapiens
ggggtctgggcttagctggaat

SEQ ID NO: 59479 - DNA, 22 bp, Homo sapiens
caggtgagaggcggtcctgcat

SEQ ID NO: 59480 - DNA, 22 bp, Homo sapiens
ttattgaaggaactgaaataaa

SEQ ID NO: 59481 - DNA, 22 bp, Homo sapiens
ctgccgtgtttttcatgttaaa

SEQ ID NO: 59482 - DNA, 22 bp, Homo sapiens
ctgagaacatcattcagatatt

SEQ ID NO: 59483 - DNA, 22 bp, Homo sapiens
gtccaaaagagccagccgggcg

SEQ ID NO: 59484 - DNA, 22 bp, Homo sapiens
ctccaggccatggctgcggagg

SEQ ID NO: 59485 - DNA, 22 bp, Homo sapiens
ctgtaatcccagctacctggga

SEQ ID NO: 59486 - DNA, 22 bp, Homo sapiens
tcaggggcttgaggtgcatgtc

SEQ ID NO: 59487 - DNA, 18 bp, Homo sapiens
cccggctaatttttggta

SEQ ID NO: 59488 - DNA, 22 bp, Homo sapiens
tgtctcttttcaagctaccctt

SEQ ID NO: 59489 - DNA, 22 bp, Homo sapiens
ctggagggctgcagcgaggctg

SEQ ID NO: 59490 - DNA, 22 bp, Homo sapiens
cacccaggctggagtgcagtga

SEQ ID NO: 59491 - DNA, 22 bp, Homo sapiens
cacccaggctggaatgcagtgg

SEQ ID NO: 59492 - DNA, 22 bp, Homo sapiens
tagtggatgttcagagatttga

SEQ ID NO: 59493 - DNA, 22 bp, Homo sapiens
catagagtgatgtaaggtatgt

SEQ ID NO: 59494 - DNA, 21 bp, Homo sapiens
tcgtgcagcagctgaggcttg

SEQ ID NO: 59495 - DNA, 22 bp, Homo sapiens
agctggaattacaggagcccat

SEQ ID NO: 59496 - DNA, 22 bp, Homo sapiens
ctgccctggggggcctccttgc

SEQ ID NO: 59497 - DNA, 22 bp, Homo sapiens
actgggcctacccagattggca

SEQ ID NO: 59498 - DNA, 22 bp, Homo sapiens
tacaacaatttccacattagaa

SEQ ID NO: 59499 - DNA, 23 bp, Homo sapiens
cagagctggcttcatgggtgtgc

SEQ ID NO: 59500 - DNA, 22 bp, Homo sapiens
agggaattcactggaacgccct

SEQ ID NO: 59501 - DNA, 22 bp, Homo sapiens
gtgcacatcgtgcaggtttgtt

SEQ ID NO: 59502 - DNA, 20 bp, Homo sapiens
tcacatcctctcccaacatg

SEQ ID NO: 59503 - DNA, 22 bp, Homo sapiens
tcactgcactccagcctgggca

SEQ ID NO: 59504 - DNA, 22 bp, Homo sapiens
ctgaggggatgtttttgacgga

SEQ ID NO: 59505 - DNA, 22 bp, Homo sapiens
actgcactcctgcctgggtaac

SEQ ID NO: 59506 - DNA, 22 bp, Homo sapiens
taagcctgcatgaaccatgaga

SEQ ID NO: 59507 - DNA, 22 bp, Homo sapiens
tccgggttttacactcacatca

SEQ ID NO: 59508 - DNA, 22 bp, Homo sapiens
taacctctctgtgcctcagttt

SEQ ID NO: 59509 - DNA, 20 bp, Homo sapiens
gggcagagccagccagtccc

SEQ ID NO: 59510 - DNA, 22 bp, Homo sapiens
tctaatcctatggtggggaggg

SEQ ID NO: 59511 - DNA, 22 bp, Homo sapiens
agatgaatccacacatggcaaa

SEQ ID NO: 59512 - DNA, 22 bp, Homo sapiens
acagtctgtcccccaggtgcta

SEQ ID NO: 59513 - DNA, 22 bp, Homo sapiens
ttttttgttgggtagaacggaa

SEQ ID NO: 59514 - DNA, 22 bp, Homo sapiens
aagcacaatgaacatcttagat

SEQ ID NO: 59515 - DNA, 22 bp, Homo sapiens
ctggggaacgcagcgagcagcg

SEQ ID NO: 59516 - DNA, 22 bp, Homo sapiens
gggctagcctcttccctgctcc

SEQ ID NO: 59517 - DNA, 22 bp, Homo sapiens
aaaatatgtataactcttctgc

SEQ ID NO: 59518 - DNA, 22 bp, Homo sapiens
tgtttcttacgtttttagaggc

SEQ ID NO: 59519 - DNA, 22 bp, Homo sapiens
acccaggctggagtgcagtggg

SEQ ID NO: 59520 - DNA, 22 bp, Homo sapiens
ttatacagggagtttccctgca

SEQ ID NO: 59521 - DNA, 22 bp, Homo sapiens
tttctaatctgattctcctacc

SEQ ID NO: 59522 - DNA, 22 bp, Homo sapiens
catccctgtcgtcaagtctctg

SEQ ID NO: 59523 - DNA, 22 bp, Homo sapiens
gctcgcgccgcaccggtccacc

SEQ ID NO: 59524 - DNA, 22 bp, Homo sapiens
gaaaattattgaaaatggctct

SEQ ID NO: 59525 - DNA, 22 bp, Homo sapiens
ccaggcagcctgctccattctg

SEQ ID NO: 59526 - DNA, 22 bp, Homo sapiens
gctgctctcagagctcatgctg

SEQ ID NO: 59527 - DNA, 22 bp, Homo sapiens
cgggttcacgccattctcctgc

SEQ ID NO: 59528 - DNA, 22 bp, Homo sapiens
tcactacaacctccgcctcctg

SEQ ID NO: 59529 - DNA, 22 bp, Homo sapiens
ataaaatttgctactgttaaat

SEQ ID NO: 59530 - DNA, 22 bp, Homo sapiens
tcgctgaggctgcacggctgcc

SEQ ID NO: 59531 - DNA, 22 bp, Homo sapiens
aggctctcaccctctgaccaga

SEQ ID NO: 59532 - DNA, 22 bp, Homo sapiens
ctgggcacagcgttgggctctt

SEQ ID NO: 59533 - DNA, 22 bp, Homo sapiens
tggagagttctgtagatatcta

SEQ ID NO: 59534 - DNA, 21 bp, Homo sapiens
gggcctggctgcgcaggacgg

SEQ ID NO: 59535 - DNA, 22 bp, Homo sapiens
aaggtccttttgcagtgtgatc

SEQ ID NO: 59536 - DNA, 18 bp, Homo sapiens
cagggctgtggggtcact

SEQ ID NO: 59537 - DNA, 22 bp, Homo sapiens
gaaggtggcgagcggattgctg

SEQ ID NO: 59538 - DNA, 22 bp, Homo sapiens
acccaggctggcgtgcagtggc

SEQ ID NO: 59539 - DNA, 22 bp, Homo sapiens
gggttcagtccctcttgctact

SEQ ID NO: 59540 - DNA, 22 bp, Homo sapiens
gtgattttctcctcctagaagt

SEQ ID NO: 59541 - DNA, 22 bp, Homo sapiens
gattcactcatattttacgttt

SEQ ID NO: 59542 - DNA, 22 bp, Homo sapiens
ggcgcccccttcaaacagagca

SEQ ID NO: 59543 - DNA, 22 bp, Homo sapiens
cagaggctggcggccgccccga

SEQ ID NO: 59544 - DNA, 18 bp, Homo sapiens
agctccatctgtcagcat

SEQ ID NO: 59545 - DNA, 17 bp, Homo sapiens
gaggccaaggcaggcgg

SEQ ID NO: 59546 - DNA, 22 bp, Homo sapiens
tgggggtgtcctggtgcacaca

SEQ ID NO: 59547 - DNA, 22 bp, Homo sapiens
acccccaagaggggccttcagc

SEQ ID NO: 59548 - DNA, 22 bp, Homo sapiens
gtcagaggggcagctgccaggc

SEQ ID NO: 59549 - DNA, 18 bp, Homo sapiens
tcctttctccctcatctt

SEQ ID NO: 59550 - DNA, 22 bp, Homo sapiens
ctgggctagaaggaccaggatg

SEQ ID NO: 59551 - DNA, 22 bp, Homo sapiens
tacatttataaggcttctctgt

SEQ ID NO: 59552 - DNA, 22 bp, Homo sapiens
gacccttagaatgtgatcttat

SEQ ID NO: 59553 - DNA, 22 bp, Homo sapiens
tcttgggcatgtgtttgatttc

SEQ ID NO: 59554 - DNA, 22 bp, Homo sapiens
tctgtgctaggcagcctggccc

SEQ ID NO: 59555 - DNA, 22 bp, Homo sapiens
ctctcgccagcggggctgcgct

SEQ ID NO: 59556 - DNA, 22 bp, Homo sapiens
tgagctgtagcagatgctgttg

SEQ ID NO: 59557 - DNA, 22 bp, Homo sapiens
cttatttgcccatgtttcttta

SEQ ID NO: 59558 - DNA, 22 bp, Homo sapiens
cgctgataaacgtcacgttccc

SEQ ID NO: 59559 - DNA, 23 bp, Homo sapiens
gttttacaggtgagaaaatggag

SEQ ID NO: 59560 - DNA, 22 bp, Homo sapiens
tccccaagcaggcaatctcccg

SEQ ID NO: 59561 - DNA, 22 bp, Homo sapiens
ttgtgaatggtgccgcaataaa

SEQ ID NO: 59562 - DNA, 19 bp, Homo sapiens
gtgtccatggagcatggag

SEQ ID NO: 59563 - DNA, 22 bp, Homo sapiens
gaaagagaacctgggcctagat

SEQ ID NO: 59564 - DNA, 22 bp, Homo sapiens
ctggcctcggcagcaggaacag

SEQ ID NO: 59565 - DNA, 22 bp, Homo sapiens
attctaatggcagagactcctg

SEQ ID NO: 59566 - DNA, 22 bp, Homo sapiens
aggtacatggggtgtgtgcacg

SEQ ID NO: 59567 - DNA, 23 bp, Homo sapiens
atcattaacagtgcaggggtagg

SEQ ID NO: 59568 - DNA, 22 bp, Homo sapiens
gggcagccgcgtgacctgccag

SEQ ID NO: 59569 - DNA, 22 bp, Homo sapiens
cagcatgaatgtgttcgtaggg

SEQ ID NO: 59570 - DNA, 22 bp, Homo sapiens
caggctggagtgcaatgacgcc

SEQ ID NO: 59571 - DNA, 18 bp, Homo sapiens
cagctgccagctcatgga

SEQ ID NO: 59572 - DNA, 22 bp, Homo sapiens
actgtgtgccaggcgctggtct

SEQ ID NO: 59573 - DNA, 22 bp, Homo sapiens
gtgaaatatttaacgtccaggt

SEQ ID NO: 59574 - DNA, 22 bp, Homo sapiens
ttatagcagcatgatttacaat

SEQ ID NO: 59575 - DNA, 22 bp, Homo sapiens
tcaaagtccttgctttttctgt

SEQ ID NO: 59576 - DNA, 22 bp, Homo sapiens
gcttccacctactaaatgccac

SEQ ID NO: 59577 - DNA, 21 bp, Homo sapiens
tgctccaggagggggcagtcc

SEQ ID NO: 59578 - DNA, 22 bp, Homo sapiens
actgaataaggtgaatgctctg

SEQ ID NO: 59579 - DNA, 22 bp, Homo sapiens
actgggcctgattgggtcggag

SEQ ID NO: 59580 - DNA, 22 bp, Homo sapiens
agaggacagagtgctggattta

SEQ ID NO: 59581 - DNA, 22 bp, Homo sapiens
tcacaactgggtgtcttcatca

SEQ ID NO: 59582 - DNA, 22 bp, Homo sapiens
tagcaaaggatgactatgtacc

SEQ ID NO: 59583 - DNA, 22 bp, Homo sapiens
tccacaaggcagctcctccagg

SEQ ID NO: 59584 - DNA, 22 bp, Homo sapiens
gaatgaacaaatgtggtggaga

SEQ ID NO: 59585 - DNA, 22 bp, Homo sapiens
tagaagaaagtgaagctgggga

SEQ ID NO: 59586 - DNA, 22 bp, Homo sapiens
agtggaccagaagactgaagct

SEQ ID NO: 59587 - DNA, 16 bp, Homo sapiens
atgctgctattagagg

SEQ ID NO: 59588 - DNA, 22 bp, Homo sapiens
tgcacgtgggctctctgctctt

SEQ ID NO: 59589 - DNA, 22 bp, Homo sapiens
agaaagtgcttccctttggtga

SEQ ID NO: 59590 - DNA, 22 bp, Homo sapiens
cacgggagacgtgatcttggac

SEQ ID NO: 59591 - DNA, 22 bp, Homo sapiens
aaactgctttccacagtggcta

SEQ ID NO: 59592 - DNA, 22 bp, Homo sapiens
atgccactgcacttcagcttgg

SEQ ID NO: 59593 - DNA, 22 bp, Homo sapiens
tgagcttgcagtgccagccttg

SEQ ID NO: 59594 - DNA, 22 bp, Homo sapiens
tgttgattagtgtttagactta

SEQ ID NO: 59595 - DNA, 22 bp, Homo sapiens
gcccaggaggagaggctgcagt

SEQ ID NO: 59596 - DNA, 21 bp, Homo sapiens
tgactgaggcttcttcacaca

SEQ ID NO: 59597 - DNA, 22 bp, Homo sapiens
gcagggaggtttgctgacctgg

SEQ ID NO: 59598 - DNA, 22 bp, Homo sapiens
cagatgtcatttcccatgcagc

SEQ ID NO: 59599 - DNA, 22 bp, Homo sapiens
ctcgggtaccatgctaggcact

SEQ ID NO: 59600 - DNA, 22 bp, Homo sapiens
atgaaatatcttgaagaaattc

SEQ ID NO: 59601 - DNA, 22 bp, Homo sapiens
gcccaggaggcagaggttgtgg

SEQ ID NO: 59602 - DNA, 22 bp, Homo sapiens
acccgggaggcaggagtcatag

SEQ ID NO: 59603 - DNA, 22 bp, Homo sapiens
caggaaggcgcggctgtgcctg

SEQ ID NO: 59604 - DNA, 22 bp, Homo sapiens
agtcaaagatgaccgagttcct

SEQ ID NO: 59605 - DNA, 22 bp, Homo sapiens
aagccctggcgggtggagggcc

SEQ ID NO: 59606 - DNA, 22 bp, Homo sapiens
gtgcaaacatcatagagtgtac

SEQ ID NO: 59607 - DNA, 22 bp, Homo sapiens
gtggatggccctgcacacaggt

SEQ ID NO: 59608 - DNA, 22 bp, Homo sapiens
cgagcatgatgacggctgtggc

SEQ ID NO: 59609 - DNA, 22 bp, Homo sapiens
atattgttagtaatatttcgaa

SEQ ID NO: 59610 - DNA, 22 bp, Homo sapiens
ggtagactgtcaaacactagcc

SEQ ID NO: 59611 - DNA, 22 bp, Homo sapiens
tgatttcaagccagggggcgtt

SEQ ID NO: 59612 - DNA, 22 bp, Homo sapiens
acttgccccagaattgctgctg

SEQ ID NO: 59613 - DNA, 22 bp, Homo sapiens
agtaatcaatttttcggtggat

SEQ ID NO: 59614 - DNA, 22 bp, Homo sapiens
agctgtcaccaggagccggacc

SEQ ID NO: 59615 - DNA, 22 bp, Homo sapiens
cagggtgctgcaccatccctca

SEQ ID NO: 59616 - DNA, 22 bp, Homo sapiens
ctgtcaggttggtctcagagct

SEQ ID NO: 59617 - DNA, 22 bp, Homo sapiens
ggtgacagtggttaaaatttgt

SEQ ID NO: 59618 - DNA, 22 bp, Homo sapiens
ggacagaaaccatatgagtgta

SEQ ID NO: 59619 - DNA, 22 bp, Homo sapiens
acaactttgacccttgttctta

SEQ ID NO: 59620 - DNA, 20 bp, Homo sapiens
tgtccccaccaaaatttcat

SEQ ID NO: 59621 - DNA, 22 bp, Homo sapiens
aggatcagggtggtggaagtca

SEQ ID NO: 59622 - DNA, 22 bp, Homo sapiens
cctgctcaacgaatatggcgat

SEQ ID NO: 59623 - DNA, 22 bp, Homo sapiens
gaggccacggaagggagctgtg

SEQ ID NO: 59624 - DNA, 21 bp, Homo sapiens
aaggacgaggttttgattaca

SEQ ID NO: 59625 - DNA, 22 bp, Homo sapiens
gttatataagacaaatcagagt

SEQ ID NO: 59626 - DNA, 22 bp, Homo sapiens
ggacacgtggctgaaggcggcc

SEQ ID NO: 59627 - DNA, 20 bp, Homo sapiens
gctgaggggtctatggcata

SEQ ID NO: 59628 - DNA, 22 bp, Homo sapiens
atgcacctgaactccatcagct

SEQ ID NO: 59629 - DNA, 22 bp, Homo sapiens
cccagcgagtttgccggtgaac

SEQ ID NO: 59630 - DNA, 22 bp, Homo sapiens
gggcttggcacatgggctcagc

SEQ ID NO: 59631 - DNA, 22 bp, Homo sapiens
tatgtgtttgacaccctgcaag

SEQ ID NO: 59632 - DNA, 21 bp, Homo sapiens
gtgcggatgccgtcattgtca

SEQ ID NO: 59633 - DNA, 22 bp, Homo sapiens
atgtctgtttgctgagcccggc

SEQ ID NO: 59634 - DNA, 22 bp, Homo sapiens
tcctgaagaaggcagatatttg

SEQ ID NO: 59635 - DNA, 22 bp, Homo sapiens
gctgtcttgctcactcttgcag

SEQ ID NO: 59636 - DNA, 22 bp, Homo sapiens
ggcatctggatctgcttctccc

SEQ ID NO: 59637 - DNA, 22 bp, Homo sapiens
cacctcaggcagcaaagtctca

SEQ ID NO: 59638 - DNA, 22 bp, Homo sapiens
ccctggcagtgctcctttagac

SEQ ID NO: 59639 - DNA, 22 bp, Homo sapiens
tccacgctgtgtgaccttgggc

SEQ ID NO: 59640 - DNA, 22 bp, Homo sapiens
tggtatgtaaattgtaactcaa

SEQ ID NO: 59641 - DNA, 22 bp, Homo sapiens
aggtgactggtttatctggcag

SEQ ID NO: 59642 - DNA, 22 bp, Homo sapiens
tagggtacatgtgcacaacatg

SEQ ID NO: 59643 - DNA, 22 bp, Homo sapiens
ggcttttgtttcagctctgcta

SEQ ID NO: 59644 - DNA, 22 bp, Homo sapiens
aggggaatgggtagactgttga

SEQ ID NO: 59645 - DNA, 21 bp, Homo sapiens
ttagaagctaatgcagctggt

SEQ ID NO: 59646 - DNA, 22 bp, Homo sapiens
cttcagctgcagttatgtttag

SEQ ID NO: 59647 - DNA, 22 bp, Homo sapiens
tcaagcaaagtttagctggtta

SEQ ID NO: 59648 - DNA, 22 bp, Homo sapiens
gtgggctgcccttgaggtcagc

SEQ ID NO: 59649 - DNA, 22 bp, Homo sapiens
ttaggatttgaaaaggggcaga

SEQ ID NO: 59650 - DNA, 22 bp, Homo sapiens
gctcactgcaagctccgcctcc

SEQ ID NO: 59651 - DNA, 22 bp, Homo sapiens
gcactgcaggtgggtggagagg

SEQ ID NO: 59652 - DNA, 23 bp, Homo sapiens
ttctgggctgtggaagcctcggg

SEQ ID NO: 59653 - DNA, 22 bp, Homo sapiens
tggggatcataaattgatggag

SEQ ID NO: 59654 - DNA, 22 bp, Homo sapiens
ctggagcaaaagtgactcctct

SEQ ID NO: 59655 - DNA, 22 bp, Homo sapiens
cttctcttcctttgtcaactga

SEQ ID NO: 59656 - DNA, 22 bp, Homo sapiens
cacagagctggaaaggctgggc

SEQ ID NO: 59657 - DNA, 22 bp, Homo sapiens
cccgactagctgggattacagg

SEQ ID NO: 59658 - DNA, 22 bp, Homo sapiens
tccttaggcaatttgggagagt

SEQ ID NO: 59659 - DNA, 22 bp, Homo sapiens
tgttcttgagcctttagaccta

SEQ ID NO: 59660 - DNA, 22 bp, Homo sapiens
agcctctctgttagtcactggg

SEQ ID NO: 59661 - DNA, 22 bp, Homo sapiens
tgagccagaggaggctgtgtgg

SEQ ID NO: 59662 - DNA, 22 bp, Homo sapiens
tgtgtggattcatctcaaagag

SEQ ID NO: 59663 - DNA, 22 bp, Homo sapiens
aagaagcaggtcacagacaggg

SEQ ID NO: 59664 - DNA, 22 bp, Homo sapiens
gatggaggagatggcagggtgc

SEQ ID NO: 59665 - DNA, 22 bp, Homo sapiens
gtggatggagctggaagccatt

SEQ ID NO: 59666 - DNA, 22 bp, Homo sapiens
caatccatcaattacacaggct

SEQ ID NO: 59667 - DNA, 22 bp, Homo sapiens
acggggctagagaaggtttctt

SEQ ID NO: 59668 - DNA, 22 bp, Homo sapiens
agaggaagtaatcaggacctgc

SEQ ID NO: 59669 - DNA, 22 bp, Homo sapiens
aaggcaaggcttccagctcccc

SEQ ID NO: 59670 - DNA, 22 bp, Homo sapiens
atgagaaagttaatcatcatga

SEQ ID NO: 59671 - DNA, 22 bp, Homo sapiens
caaagggaaaagccatgtgggc

SEQ ID NO: 59672 - DNA, 22 bp, Homo sapiens
tgggaggccaaggcaggcggat

SEQ ID NO: 59673 - DNA, 22 bp, Homo sapiens
ctctgcctcagtgatttcttta

SEQ ID NO: 59674 - DNA, 22 bp, Homo sapiens
ttttatctgtgacatctggcag

SEQ ID NO: 59675 - DNA, 21 bp, Homo sapiens
ggtgctcgctgatgaggagtg

SEQ ID NO: 59676 - DNA, 22 bp, Homo sapiens
cctgccagagcagcttgtcctc

SEQ ID NO: 59677 - DNA, 22 bp, Homo sapiens
agccctggtttgcagcatttgc

SEQ ID NO: 59678 - DNA, 22 bp, Homo sapiens
aaaagtaattgcggtttttgct

SEQ ID NO: 59679 - DNA, 22 bp, Homo sapiens
tgaactcctgacctcatgatcc

SEQ ID NO: 59680 - DNA, 22 bp, Homo sapiens
tgggctgtggagcacctttgca

SEQ ID NO: 59681 - DNA, 22 bp, Homo sapiens
gtggctgcagcggctgtggaga

SEQ ID NO: 59682 - DNA, 22 bp, Homo sapiens
gtgcgggcctgggggtttctct

SEQ ID NO: 59683 - DNA, 22 bp, Homo sapiens
gctggtgagcaaaggagaagga

SEQ ID NO: 59684 - DNA, 22 bp, Homo sapiens
gtttctggcgccggggcaggcc

SEQ ID NO: 59685 - DNA, 22 bp, Homo sapiens
catccatagcttgatctgttcc

SEQ ID NO: 59686 - DNA, 22 bp, Homo sapiens
ttttaatactgctattgtagga

SEQ ID NO: 59687 - DNA, 22 bp, Homo sapiens
ggaaatgacttggtgcttcgtt

SEQ ID NO: 59688 - DNA, 22 bp, Homo sapiens
ggctgtgtggccgtgggctcta

SEQ ID NO: 59689 - DNA, 22 bp, Homo sapiens
ctctggaggtggaggttgcagt

SEQ ID NO: 59690 - DNA, 22 bp, Homo sapiens
atgttctacagatggaaagggg

SEQ ID NO: 59691 - DNA, 22 bp, Homo sapiens
gcacagccacgtaatgtggtca

SEQ ID NO: 59692 - DNA, 22 bp, Homo sapiens
ggctccctgcaacctccgcctc

SEQ ID NO: 59693 - DNA, 22 bp, Homo sapiens
tattgagaccagtgcttgctta

SEQ ID NO: 59694 - DNA, 22 bp, Homo sapiens
caaagtgctgggattacaggct

SEQ ID NO: 59695 - DNA, 22 bp, Homo sapiens
gaaactctcgcatcctgggaac

SEQ ID NO: 59696 - DNA, 22 bp, Homo sapiens
aatatttccaaggcctgtcagg

SEQ ID NO: 59697 - DNA, 22 bp, Homo sapiens
atacaccaccttggatctttca

SEQ ID NO: 59698 - DNA, 22 bp, Homo sapiens
gtgcgccagctcaaggggaggc

SEQ ID NO: 59699 - DNA, 22 bp, Homo sapiens
tctgcaacattcctctccccac

SEQ ID NO: 59700 - DNA, 22 bp, Homo sapiens
tgagacaggcttccttcttggg

SEQ ID NO: 59701 - DNA, 21 bp, Homo sapiens
aagaggaagcattatggcata

SEQ ID NO: 59702 - DNA, 22 bp, Homo sapiens
gaggccaactttggagaacagg

SEQ ID NO: 59703 - DNA, 22 bp, Homo sapiens
accgggctaatttttgtatctt

SEQ ID NO: 59704 - DNA, 22 bp, Homo sapiens
aattacagtcggagcagcactg

SEQ ID NO: 59705 - DNA, 22 bp, Homo sapiens
agatcggctttgcagacctcat

SEQ ID NO: 59706 - DNA, 23 bp, Homo sapiens
gcagaggagcaagctggacacca

SEQ ID NO: 59707 - DNA, 22 bp, Homo sapiens
atgtttttggaaatgggaacat

SEQ ID NO: 59708 - DNA, 22 bp, Homo sapiens
ttttctgtttgcttcaagacat

SEQ ID NO: 59709 - DNA, 22 bp, Homo sapiens
aataaacaaaggacaaggaggt

SEQ ID NO: 59710 - DNA, 23 bp, Homo sapiens
tcggtgggcgtggaggccgaggc

SEQ ID NO: 59711 - DNA, 22 bp, Homo sapiens
tggctaacaaggtgaaaccccg

SEQ ID NO: 59712 - DNA, 19 bp, Homo sapiens
catggtgaaaccccgtctc

SEQ ID NO: 59713 - DNA, 22 bp, Homo sapiens
tggacaacatagtgagacctca

SEQ ID NO: 59714 - DNA, 22 bp, Homo sapiens
taggctgggggtaggaattgag

SEQ ID NO: 59715 - DNA, 22 bp, Homo sapiens
actcatgtaagcggaatgtagt

SEQ ID NO: 59716 - DNA, 22 bp, Homo sapiens
gcttaattctggctcagtttcc

SEQ ID NO: 59717 - DNA, 22 bp, Homo sapiens
tggtaatggttctcttgctata

SEQ ID NO: 59718 - DNA, 23 bp, Homo sapiens
gcctgggagttgcgatctgcccg

SEQ ID NO: 59719 - DNA, 22 bp, Homo sapiens
gctcactgcaagctctgcctcc

SEQ ID NO: 59720 - DNA, 22 bp, Homo sapiens
cagtggctggttagggacagga

SEQ ID NO: 59721 - DNA, 22 bp, Homo sapiens
agtgggccggacagcccaggcc

SEQ ID NO: 59722 - DNA, 23 bp, Homo sapiens
caaaatgctatgtgcccaatgca

SEQ ID NO: 59723 - DNA, 22 bp, Homo sapiens
ggtgttgcagttgaagactggt

SEQ ID NO: 59724 - DNA, 22 bp, Homo sapiens
tggtagtgactcccccagggct

SEQ ID NO: 59725 - DNA, 22 bp, Homo sapiens
gctggccacagatccccaggga

SEQ ID NO: 59726 - DNA, 22 bp, Homo sapiens
gccttgtttcattacacgtggt

SEQ ID NO: 59727 - DNA, 22 bp, Homo sapiens
tgtcagtgtctatgaagaattt

SEQ ID NO: 59728 - DNA, 22 bp, Homo sapiens
gatttgtggtgtgaggaagagc

SEQ ID NO: 59729 - DNA, 22 bp, Homo sapiens
aatgccttggagagcctagagg

SEQ ID NO: 59730 - DNA, 22 bp, Homo sapiens
ccagatatcactgccgtgttgt

SEQ ID NO: 59731 - DNA, 22 bp, Homo sapiens
cagagctggtgtgtcctggcat

SEQ ID NO: 59732 - DNA, 22 bp, Homo sapiens
cccaggaggcagaagttgcagt

SEQ ID NO: 59733 - DNA, 22 bp, Homo sapiens
gaggtggccaagcgaggaaggg

SEQ ID NO: 59734 - DNA, 22 bp, Homo sapiens
gctgctaagcgtttctgttcca

SEQ ID NO: 59735 - DNA, 22 bp, Homo sapiens
tccaagatctacagcagtttag

SEQ ID NO: 59736 - DNA, 22 bp, Homo sapiens
gcaaatacatgttgagcaccta

SEQ ID NO: 59737 - DNA, 22 bp, Homo sapiens
ggctcacgcaattatcccggcc

SEQ ID NO: 59738 - DNA, 22 bp, Homo sapiens
ccctttagcccctgcagagact

SEQ ID NO: 59739 - DNA, 22 bp, Homo sapiens
ttgctctgactggagtgcagtg

SEQ ID NO: 59740 - DNA, 22 bp, Homo sapiens
actcccagaacatgctcttctt

SEQ ID NO: 59741 - DNA, 22 bp, Homo sapiens
tgctcattggcgatctgaggga

SEQ ID NO: 59742 - DNA, 22 bp, Homo sapiens
aagggggcggcagccagtggaa

SEQ ID NO: 59743 - DNA, 22 bp, Homo sapiens
acaggggacctaggaccctcgg

SEQ ID NO: 59744 - DNA, 22 bp, Homo sapiens
gggagtgggtttggcctaggcc

SEQ ID NO: 59745 - DNA, 22 bp, Homo sapiens
tctggctctggagtccacctgc

SEQ ID NO: 59746 - DNA, 22 bp, Homo sapiens
tgagaaattacttcagtgatgg

SEQ ID NO: 59747 - DNA, 22 bp, Homo sapiens
tatggctaattctttactgacc

SEQ ID NO: 59748 - DNA, 22 bp, Homo sapiens
tgagtagatccaagactgtcct

SEQ ID NO: 59749 - DNA, 22 bp, Homo sapiens
aagacactcattatcactggtt

SEQ ID NO: 59750 - DNA, 22 bp, Homo sapiens
gagcacagtaaagcagtgtcac

SEQ ID NO: 59751 - DNA, 22 bp, Homo sapiens
tacgttttaaacacggagccag

SEQ ID NO: 59752 - DNA, 22 bp, Homo sapiens
aaagttctctatggtgtaaaaa

SEQ ID NO: 59753 - DNA, 22 bp, Homo sapiens
tgagatgaataactcctgctaa

SEQ ID NO: 59754 - DNA, 22 bp, Homo sapiens
ttggagatatcacaccttcaca

SEQ ID NO: 59755 - DNA, 22 bp, Homo sapiens
tgggtgctctgcgaccgtaggg

SEQ ID NO: 59756 - DNA, 22 bp, Homo sapiens
tcaccaggctggagtgcagtgg

SEQ ID NO: 59757 - DNA, 22 bp, Homo sapiens
gcccagtggtaaaagcaggcct

SEQ ID NO: 59758 - DNA, 22 bp, Homo sapiens
caggtgcctcaggatgagacaa

SEQ ID NO: 59759 - DNA, 22 bp, Homo sapiens
atttaagggatttggagaccaa

SEQ ID NO: 59760 - DNA, 22 bp, Homo sapiens
ggagttgattttggatatatta

SEQ ID NO: 59761 - DNA, 22 bp, Homo sapiens
ccaccagctgcatatgcacgta

SEQ ID NO: 59762 - DNA, 19 bp, Homo sapiens
tgtgactggttgtctcgct

SEQ ID NO: 59763 - DNA, 21 bp, Homo sapiens
ggtgacacgtggccccgctct

SEQ ID NO: 59764 - DNA, 22 bp, Homo sapiens
gctcccagtctgatggaggaga

SEQ ID NO: 59765 - DNA, 22 bp, Homo sapiens
taaagggtaggttttactgtaa

SEQ ID NO: 59766 - DNA, 22 bp, Homo sapiens
tgatttatgcattatactgttg

SEQ ID NO: 59767 - DNA, 22 bp, Homo sapiens
gtggcttggaccagtcacagtg

SEQ ID NO: 59768 - DNA, 22 bp, Homo sapiens
ttggccatctaagcccagccac

SEQ ID NO: 59769 - DNA, 22 bp, Homo sapiens
aaggctcggcaatgtgcggctc

SEQ ID NO: 59770 - DNA, 22 bp, Homo sapiens
aagcctggcacattggagtctg

SEQ ID NO: 59771 - DNA, 22 bp, Homo sapiens
caggagctcagatgacatctca

SEQ ID NO: 59772 - DNA, 22 bp, Homo sapiens
aagctggagtgcagtgcaatgg

SEQ ID NO: 59773 - DNA, 22 bp, Homo sapiens
tttgtagcagcatgatttataa

SEQ ID NO: 59774 - DNA, 22 bp, Homo sapiens
agcaggaaggggatgatgggca

SEQ ID NO: 59775 - DNA, 22 bp, Homo sapiens
ccctggaggttgaggctgcagt

SEQ ID NO: 59776 - DNA, 22 bp, Homo sapiens
tcagcctccgaaagtgctggga

SEQ ID NO: 59777 - DNA, 22 bp, Homo sapiens
cccccaaagtttgcacggataa

SEQ ID NO: 59778 - DNA, 22 bp, Homo sapiens
acatttttcacatttgtagggt

SEQ ID NO: 59779 - DNA, 22 bp, Homo sapiens
ggaggtgggctaaggactctct

SEQ ID NO: 59780 - DNA, 22 bp, Homo sapiens
ctctgtagaaagagcccaggtg

SEQ ID NO: 59781 - DNA, 22 bp, Homo sapiens
ctctctgggcccagttggcacc

SEQ ID NO: 59782 - DNA, 22 bp, Homo sapiens
ataaagctattcctctcttttt

SEQ ID NO: 59783 - DNA, 22 bp, Homo sapiens
cactctcagcataatgaatgtg

SEQ ID NO: 59784 - DNA, 22 bp, Homo sapiens
tgagcccagagatctgagctat

SEQ ID NO: 59785 - DNA, 22 bp, Homo sapiens
tcaggagtgccagtaccttttg

SEQ ID NO: 59786 - DNA, 22 bp, Homo sapiens
taatgcacatagaagtacttag

SEQ ID NO: 59787 - DNA, 23 bp, Homo sapiens
aatgggtgcaactatccatgaca

SEQ ID NO: 59788 - DNA, 22 bp, Homo sapiens
tcactgcaagctcagcctcccg

SEQ ID NO: 59789 - DNA, 22 bp, Homo sapiens
gaccctctagatggaagcactg

SEQ ID NO: 59790 - DNA, 22 bp, Homo sapiens
atatagacagatgacagggata

SEQ ID NO: 59791 - DNA, 23 bp, Homo sapiens
aggttatgattatagagcgagga

SEQ ID NO: 59792 - DNA, 22 bp, Homo sapiens
atgtttttaaatagacttacag

SEQ ID NO: 59793 - DNA, 16 bp, Homo sapiens
ccacctgcagctctca

SEQ ID NO: 59794 - DNA, 22 bp, Homo sapiens
acccaggctggagtgcagtggc

SEQ ID NO: 59795 - DNA, 22 bp, Homo sapiens
gcttagtcaattataaataggc

SEQ ID NO: 59796 - DNA, 19 bp, Homo sapiens
agtcctggcctgggggacc

SEQ ID NO: 59797 - DNA, 22 bp, Homo sapiens
ttcaacagacccttctttcttt

SEQ ID NO: 59798 - DNA, 22 bp, Homo sapiens
tgggcgacagagcaagactccg

SEQ ID NO: 59799 - DNA, 22 bp, Homo sapiens
gttgaggtgatgccagccctgc

SEQ ID NO: 59800 - DNA, 19 bp, Homo sapiens
catctggatgattctcctg

SEQ ID NO: 59801 - DNA, 22 bp, Homo sapiens
tcttggccactaccacctggag

SEQ ID NO: 59802 - DNA, 22 bp, Homo sapiens
tcatctaagagtcttacattta

SEQ ID NO: 59803 - DNA, 22 bp, Homo sapiens
cagggccagcgtctcgggctat

SEQ ID NO: 59804 - DNA, 22 bp, Homo sapiens
tcaccaccagaagagctattct

SEQ ID NO: 59805 - DNA, 22 bp, Homo sapiens
gaatttaagaggatgaatctgt

SEQ ID NO: 59806 - DNA, 22 bp, Homo sapiens
gctactgattgaccttggagag

SEQ ID NO: 59807 - DNA, 22 bp, Homo sapiens
ctacattaaattggcttactta

SEQ ID NO: 59808 - DNA, 21 bp, Homo sapiens
ctctgaatcctgcttctcagt

SEQ ID NO: 59809 - DNA, 18 bp, Homo sapiens
ttcacaagggcttggttt

SEQ ID NO: 59810 - DNA, 22 bp, Homo sapiens
ttctcttttcaccagttgctaa

SEQ ID NO: 59811 - DNA, 22 bp, Homo sapiens
tctgagctccatgcaggaggct

SEQ ID NO: 59812 - DNA, 22 bp, Homo sapiens
cccagctcttcaagtcaccccc

SEQ ID NO: 59813 - DNA, 22 bp, Homo sapiens
ttctcatgaaactcgcttcctc

SEQ ID NO: 59814 - DNA, 22 bp, Homo sapiens
tcactgcactccagcctgggtg

SEQ ID NO: 59815 - DNA, 22 bp, Homo sapiens
cttgagtcatataaagacagag

SEQ ID NO: 59816 - DNA, 22 bp, Homo sapiens
attgtctctgaattttcagctg

SEQ ID NO: 59817 - DNA, 19 bp, Homo sapiens
gggcttggggctgaagcct

SEQ ID NO: 59818 - DNA, 22 bp, Homo sapiens
ggcttcagtggccagagatgat

SEQ ID NO: 59819 - DNA, 22 bp, Homo sapiens
cattaaacaaccttgaatcaat

SEQ ID NO: 59820 - DNA, 22 bp, Homo sapiens
ttagggttacaccagcctcctg

SEQ ID NO: 59821 - DNA, 22 bp, Homo sapiens
acaaggcactttatgaagagga

SEQ ID NO: 59822 - DNA, 22 bp, Homo sapiens
tgggcttaggtcggaggcggcc

SEQ ID NO: 59823 - DNA, 22 bp, Homo sapiens
atagacgcggccgctgatgcag

SEQ ID NO: 59824 - DNA, 22 bp, Homo sapiens
cccaggaggtcaaggctgcagt

SEQ ID NO: 59825 - DNA, 22 bp, Homo sapiens
ttctttgaatagatgttcccag

SEQ ID NO: 59826 - DNA, 19 bp, Homo sapiens
agataagagttgactgtgg

SEQ ID NO: 59827 - DNA, 22 bp, Homo sapiens
gctcccaccttaaccttcacat

SEQ ID NO: 59828 - DNA, 22 bp, Homo sapiens
ctgagctcacgccattctcctt

SEQ ID NO: 59829 - DNA, 22 bp, Homo sapiens
ccctcccagatgggcttgaggt

SEQ ID NO: 59830 - DNA, 22 bp, Homo sapiens
gctcggtggccagcctgaggcc

SEQ ID NO: 59831 - DNA, 22 bp, Homo sapiens
tcagcctggcaggatggcctgg

SEQ ID NO: 59832 - DNA, 22 bp, Homo sapiens
ggctcactgcaacttccgcctc

SEQ ID NO: 59833 - DNA, 22 bp, Homo sapiens
gagccccaccctagacattctg

SEQ ID NO: 59834 - DNA, 22 bp, Homo sapiens
agcctgggccctgcctcttctc

SEQ ID NO: 59835 - DNA, 22 bp, Homo sapiens
tgcaataactactttaatgttg

SEQ ID NO: 59836 - DNA, 22 bp, Homo sapiens
ttccagttcactccatttctgg

SEQ ID NO: 59837 - DNA, 18 bp, Homo sapiens
tccctcagaattatagaa

SEQ ID NO: 59838 - DNA, 22 bp, Homo sapiens
tggcaatgttagcaaagcattt

SEQ ID NO: 59839 - DNA, 20 bp, Homo sapiens
aagcagtgaggtgaggagtg

SEQ ID NO: 59840 - DNA, 22 bp, Homo sapiens
gctgcagggagctggaaggctc

SEQ ID NO: 59841 - DNA, 22 bp, Homo sapiens
ctgggcctggggctgttgagag

SEQ ID NO: 59842 - DNA, 22 bp, Homo sapiens
tctggtgtcagtattctttgaa

SEQ ID NO: 59843 - DNA, 22 bp, Homo sapiens
actaggggctcaggcccaggga

SEQ ID NO: 59844 - DNA, 22 bp, Homo sapiens
ttcctggtcactgctgttccct

SEQ ID NO: 59845 - DNA, 22 bp, Homo sapiens
tttatgtagttacggactatca

SEQ ID NO: 59846 - DNA, 22 bp, Homo sapiens
ctggccagatgttacgtccaat

SEQ ID NO: 59847 - DNA, 22 bp, Homo sapiens
tctggcttccctctgttctggg

SEQ ID NO: 59848 - DNA, 22 bp, Homo sapiens
gaggttggggctgcagtgagct

SEQ ID NO: 59849 - DNA, 22 bp, Homo sapiens
ccggctactcgggaggctgacg

SEQ ID NO: 59850 - DNA, 20 bp, Homo sapiens
ttcaggaataagatagcagc

SEQ ID NO: 59851 - DNA, 22 bp, Homo sapiens
caggctgaagtgcagtggtgtg

SEQ ID NO: 59852 - DNA, 22 bp, Homo sapiens
tagaaaagccccagctggaggg

SEQ ID NO: 59853 - DNA, 22 bp, Homo sapiens
cctcttcaggcactcgaaggcc

SEQ ID NO: 59854 - DNA, 22 bp, Homo sapiens
aactatgttaataagtttcatt

SEQ ID NO: 59855 - DNA, 22 bp, Homo sapiens
tggagccagagcgcagcctggg

SEQ ID NO: 59856 - DNA, 22 bp, Homo sapiens
ggccttggttccaaagcaggca

SEQ ID NO: 59857 - DNA, 22 bp, Homo sapiens
cctagagctctgctttatctaa

SEQ ID NO: 59858 - DNA, 22 bp, Homo sapiens
atccccactgctgctggtgtag

SEQ ID NO: 59859 - DNA, 18 bp, Homo sapiens
tgtagagccaggtttgcc

SEQ ID NO: 59860 - DNA, 22 bp, Homo sapiens
tgggatgccctgaccctctgga

SEQ ID NO: 59861 - DNA, 22 bp, Homo sapiens
ggttccccaggcggcccttgga

SEQ ID NO: 59862 - DNA, 22 bp, Homo sapiens
gtgtaagtatctttgtatcttt

SEQ ID NO: 59863 - DNA, 22 bp, Homo sapiens
ttggctgtgcagatcttgccta

SEQ ID NO: 59864 - DNA, 22 bp, Homo sapiens
ttaagggccattatggatgggt

SEQ ID NO: 59865 - DNA, 22 bp, Homo sapiens
tgacaatgaggccctccacaaa

SEQ ID NO: 59866 - DNA, 22 bp, Homo sapiens
caggggcggtggctcacgcctg

SEQ ID NO: 59867 - DNA, 23 bp, Homo sapiens
actctcaggttctttccagcagg

SEQ ID NO: 59868 - DNA, 22 bp, Homo sapiens
gcgtctcaaggcccccaggcca

SEQ ID NO: 59869 - DNA, 22 bp, Homo sapiens
ctcaggagttggaggctacagt

SEQ ID NO: 59870 - DNA, 22 bp, Homo sapiens
gggcgccgtgggaaacagccgg

SEQ ID NO: 59871 - DNA, 22 bp, Homo sapiens
taagtcgtggatgattcttcgg

SEQ ID NO: 59872 - DNA, 22 bp, Homo sapiens
cttatcagattatctgggctgt

SEQ ID NO: 59873 - DNA, 22 bp, Homo sapiens
tgcagaaacaagccatcattca

SEQ ID NO: 59874 - DNA, 22 bp, Homo sapiens
ccaggagctggagggtgcagtg

SEQ ID NO: 59875 - DNA, 22 bp, Homo sapiens
ccgggcctcgggacaccgggta

SEQ ID NO: 59876 - DNA, 22 bp, Homo sapiens
tgtgactggttgtcccgctttc

SEQ ID NO: 59877 - DNA, 20 bp, Homo sapiens
ttcgctgggagtggccaggc

SEQ ID NO: 59878 - DNA, 22 bp, Homo sapiens
acagcagcaatagcagtgacat

SEQ ID NO: 59879 - DNA, 22 bp, Homo sapiens
agcgccactgcactccagcctg

SEQ ID NO: 59880 - DNA, 23 bp, Homo sapiens
tgaggcaggcggatcacgaggtc

SEQ ID NO: 59881 - DNA, 22 bp, Homo sapiens
tagcagtgtctaggtaggccat

SEQ ID NO: 59882 - DNA, 22 bp, Homo sapiens
actattagcatatcatgaatgg

SEQ ID NO: 59883 - DNA, 23 bp, Homo sapiens
aaactacaacgccaggcactgag

SEQ ID NO: 59884 - DNA, 22 bp, Homo sapiens
agtccaaagcagatgagggcca

SEQ ID NO: 59885 - DNA, 22 bp, Homo sapiens
aaggatacttttagagcctgag

SEQ ID NO: 59886 - DNA, 22 bp, Homo sapiens
gagcgattgcgggggtcagagg

SEQ ID NO: 59887 - DNA, 22 bp, Homo sapiens
gaggtgggtgtatcacaggtca

SEQ ID NO: 59888 - DNA, 22 bp, Homo sapiens
gcccgcagagatctttaacaaa

SEQ ID NO: 59889 - DNA, 22 bp, Homo sapiens
gcaggatgagtgagtacattta

SEQ ID NO: 59890 - DNA, 22 bp, Homo sapiens
tcacccctccattctctcatgt

SEQ ID NO: 59891 - DNA, 22 bp, Homo sapiens
acccaggagacggaggtgcagt

SEQ ID NO: 59892 - DNA, 22 bp, Homo sapiens
aatgtgttgaataaattgtgcc

SEQ ID NO: 59893 - DNA, 22 bp, Homo sapiens
cgcagggccgcgagcgggacca

SEQ ID NO: 59894 - DNA, 19 bp, Homo sapiens
tcctgcctggggccgcctg

SEQ ID NO: 59895 - DNA, 17 bp, Homo sapiens
tggctctgtcctcagct

SEQ ID NO: 59896 - DNA, 22 bp, Homo sapiens
gcaggcagatcacctgtcagga

SEQ ID NO: 59897 - DNA, 22 bp, Homo sapiens
caggctggagtacaattgtgtg

SEQ ID NO: 59898 - DNA, 21 bp, Homo sapiens
gtggttctagagaaacagaat

SEQ ID NO: 59899 - DNA, 22 bp, Homo sapiens
ggaattgtctagtactcacggc

SEQ ID NO: 59900 - DNA, 22 bp, Homo sapiens
gaatgtgtactgagtgcccctt

SEQ ID NO: 59901 - DNA, 22 bp, Homo sapiens
gatgtgtttgtttctggaggag

SEQ ID NO: 59902 - DNA, 22 bp, Homo sapiens
atatatgcgcaggcacccagct

SEQ ID NO: 59903 - DNA, 22 bp, Homo sapiens
ctggcctaggaatggttttccg

SEQ ID NO: 59904 - DNA, 22 bp, Homo sapiens
gggtaggccgtgggtcaccagg

SEQ ID NO: 59905 - DNA, 22 bp, Homo sapiens
ctaggtgatccactgctctctt

SEQ ID NO: 59906 - DNA, 22 bp, Homo sapiens
ttggagagtgatattcagatgc

SEQ ID NO: 59907 - DNA, 22 bp, Homo sapiens
gtggaggagaggcgccttgcgg

SEQ ID NO: 59908 - DNA, 22 bp, Homo sapiens
actgcactccagcctgggtgac

SEQ ID NO: 59909 - DNA, 22 bp, Homo sapiens
atcatgttttaattagcaaact

SEQ ID NO: 59910 - DNA, 22 bp, Homo sapiens
ggttgcaaactcctgggatcaa

SEQ ID NO: 59911 - DNA, 22 bp, Homo sapiens
acattcagaatcttgtagcagt

SEQ ID NO: 59912 - DNA, 22 bp, Homo sapiens
gcgtttgttttgctggcgccag

SEQ ID NO: 59913 - DNA, 22 bp, Homo sapiens
caggcagaagaagtggaaggac

SEQ ID NO: 59914 - DNA, 22 bp, Homo sapiens
accatgtcatttattggccaaa

SEQ ID NO: 59915 - DNA, 22 bp, Homo sapiens
aggatgagccgcgcaagctgac

SEQ ID NO: 59916 - DNA, 20 bp, Homo sapiens
gccaacgcgctggggctgcc

SEQ ID NO: 59917 - DNA, 22 bp, Homo sapiens
gatggcacacagacatccccgc

SEQ ID NO: 59918 - DNA, 22 bp, Homo sapiens
aggtgcttggctcgtgcacaca

SEQ ID NO: 59919 - DNA, 22 bp, Homo sapiens
gttgagtgttgtgcatgcacca

SEQ ID NO: 59920 - DNA, 22 bp, Homo sapiens
gaggcacagagtaggtgcacac

SEQ ID NO: 59921 - DNA, 22 bp, Homo sapiens
tctgtagcttcttgagaggcca

SEQ ID NO: 59922 - DNA, 22 bp, Homo sapiens
tgacttcctgcactcaggtgat

SEQ ID NO: 59923 - DNA, 23 bp, Homo sapiens
aacgacagctacaggcatcccac

SEQ ID NO: 59924 - DNA, 22 bp, Homo sapiens
agtggcctggagccccgcctgg

SEQ ID NO: 59925 - DNA, 23 bp, Homo sapiens
ggagcctccggtgtgtgagaggc

SEQ ID NO: 59926 - DNA, 22 bp, Homo sapiens
catgagataatttttctccagt

SEQ ID NO: 59927 - DNA, 22 bp, Homo sapiens
ttcctggaaattatgctcacct

SEQ ID NO: 59928 - DNA, 22 bp, Homo sapiens
atgattgaaaatgacattgcca

SEQ ID NO: 59929 - DNA, 18 bp, Homo sapiens
gaccccgggatctgtcga

SEQ ID NO: 59930 - DNA, 22 bp, Homo sapiens
tccagcagtccatgtgagacac

SEQ ID NO: 59931 - DNA, 22 bp, Homo sapiens
ctatggtgatagaaatcagaat

SEQ ID NO: 59932 - DNA, 22 bp, Homo sapiens
tactgtactgcagttctgcaaa

SEQ ID NO: 59933 - DNA, 22 bp, Homo sapiens
tgttatcctcagctcacctcta

SEQ ID NO: 59934 - DNA, 22 bp, Homo sapiens
tggaggttgggatgcttgtgat

SEQ ID NO: 59935 - DNA, 19 bp, Homo sapiens
gttttgcaggcagagggga

SEQ ID NO: 59936 - DNA, 22 bp, Homo sapiens
gaggcagaggttgcagtgagct

SEQ ID NO: 59937 - DNA, 22 bp, Homo sapiens
tgctcgccccacatgccctcat

SEQ ID NO: 59938 - DNA, 22 bp, Homo sapiens
ttggcgcccaggacgccgccgc

SEQ ID NO: 59939 - DNA, 22 bp, Homo sapiens
ctgggaggcggaggttgtagtg

SEQ ID NO: 59940 - DNA, 22 bp, Homo sapiens
gcccaggagttcaagtctagtg

SEQ ID NO: 59941 - DNA, 22 bp, Homo sapiens
tagatctgatacaattcatctg

SEQ ID NO: 59942 - DNA, 22 bp, Homo sapiens
cagggtgccaaagaacaaatat

SEQ ID NO: 59943 - DNA, 22 bp, Homo sapiens
tcccagcgcggggggaggatcc

SEQ ID NO: 59944 - DNA, 22 bp, Homo sapiens
cactaggctggagtgcagtggc

SEQ ID NO: 59945 - DNA, 22 bp, Homo sapiens
tcttgaattgtactcccataag

SEQ ID NO: 59946 - DNA, 22 bp, Homo sapiens
gagccaggaggcagagactgca

SEQ ID NO: 59947 - DNA, 22 bp, Homo sapiens
cactctcacatgccctgtcagt

SEQ ID NO: 59948 - DNA, 22 bp, Homo sapiens
cctttgatttcccccgtctcag

SEQ ID NO: 59949 - DNA, 22 bp, Homo sapiens
actaaagctcacagagttgaac

SEQ ID NO: 59950 - DNA, 22 bp, Homo sapiens
ctcttcctagtgtgcagcgtgg

SEQ ID NO: 59951 - DNA, 22 bp, Homo sapiens
caggatatttacgttctgctac

SEQ ID NO: 59952 - DNA, 22 bp, Homo sapiens
tctttctacatcatttgcttct

SEQ ID NO: 59953 - DNA, 22 bp, Homo sapiens
aggctcccaagcactgacccca

SEQ ID NO: 59954 - DNA, 22 bp, Homo sapiens
tcaccgaggctggagtgcagtg

SEQ ID NO: 59955 - DNA, 22 bp, Homo sapiens
gaccttcttgctgtgtcctaac

SEQ ID NO: 59956 - DNA, 22 bp, Homo sapiens
tgtgtgagtaaggctgagagag

SEQ ID NO: 59957 - DNA, 22 bp, Homo sapiens
ttgcaaatcagaagtatagatt

SEQ ID NO: 59958 - DNA, 22 bp, Homo sapiens
gagctcatccccatggtccgtc

SEQ ID NO: 59959 - DNA, 22 bp, Homo sapiens
agggactatttacccatctcac

SEQ ID NO: 59960 - DNA, 22 bp, Homo sapiens
tggaacaagggcgtggcggtcg

SEQ ID NO: 59961 - DNA, 22 bp, Homo sapiens
tccagctgaggtggcctctgtg

SEQ ID NO: 59962 - DNA, 22 bp, Homo sapiens
ccagatgtccctctcaggtttg

SEQ ID NO: 59963 - DNA, 22 bp, Homo sapiens
cggccgcgtccagggccgccag

SEQ ID NO: 59964 - DNA, 22 bp, Homo sapiens
tccagctgttccatcagctctt

SEQ ID NO: 59965 - DNA, 21 bp, Homo sapiens
tcacgtggtcacatgagcttt

SEQ ID NO: 59966 - DNA, 22 bp, Homo sapiens
cagaggtagcatgctgtggctt

SEQ ID NO: 59967 - DNA, 22 bp, Homo sapiens
agcccaggtccagttcactgca

SEQ ID NO: 59968 - DNA, 22 bp, Homo sapiens
acttttaaatgagtttcagttg

SEQ ID NO: 59969 - DNA, 22 bp, Homo sapiens
ggtgtccgcgctgtagaaggtc

SEQ ID NO: 59970 - DNA, 22 bp, Homo sapiens
taattataacatgctttctggc

SEQ ID NO: 59971 - DNA, 22 bp, Homo sapiens
ttcctagggcagagccgctggg

SEQ ID NO: 59972 - DNA, 22 bp, Homo sapiens
gagctgagaagcagcgcttgat

SEQ ID NO: 59973 - DNA, 21 bp, Homo sapiens
acctgagctccacctcctgcc

SEQ ID NO: 59974 - DNA, 22 bp, Homo sapiens
gtggtgagattgctggatcaaa

SEQ ID NO: 59975 - DNA, 22 bp, Homo sapiens
cccaggcttttctcttgcccca

SEQ ID NO: 59976 - DNA, 22 bp, Homo sapiens
cctggagagctcgggccaggca

SEQ ID NO: 59977 - DNA, 22 bp, Homo sapiens
aaggagtctgggccattcagag

SEQ ID NO: 59978 - DNA, 22 bp, Homo sapiens
aatgcaccttggcagggattca

SEQ ID NO: 59979 - DNA, 22 bp, Homo sapiens
ggcctcacccatcggtgccttt

SEQ ID NO: 59980 - DNA, 22 bp, Homo sapiens
tcctcagtcacggtagcacatt

SEQ ID NO: 59981 - DNA, 22 bp, Homo sapiens
atcctagaatcagcccttgctg

SEQ ID NO: 59982 - DNA, 22 bp, Homo sapiens
gcaaacaaggacatacatcctg

SEQ ID NO: 59983 - DNA, 22 bp, Homo sapiens
cagccccacacggtctagctct

SEQ ID NO: 59984 - DNA, 22 bp, Homo sapiens
actccacatttgaacacagttc

SEQ ID NO: 59985 - DNA, 22 bp, Homo sapiens
tactgtgtgcccagccgagctg

SEQ ID NO: 59986 - DNA, 22 bp, Homo sapiens
tttctcctcatgactggttgtg

SEQ ID NO: 59987 - DNA, 17 bp, Homo sapiens
aatgtccttggaccaca

SEQ ID NO: 59988 - DNA, 22 bp, Homo sapiens
ggctgcaggttggttggcagct

SEQ ID NO: 59989 - DNA, 22 bp, Homo sapiens
cctgtggcgggggccagtgcct

SEQ ID NO: 59990 - DNA, 22 bp, Homo sapiens
tccttagacaaagagtgggctt

SEQ ID NO: 59991 - DNA, 20 bp, Homo sapiens
ataaaataactgccacaaga

SEQ ID NO: 59992 - DNA, 22 bp, Homo sapiens
cagggcctcctaaggcatctaa

SEQ ID NO: 59993 - DNA, 22 bp, Homo sapiens
atgccactgcgctctagcctgg

SEQ ID NO: 59994 - DNA, 22 bp, Homo sapiens
ccagcctggttcagaattggct

SEQ ID NO: 59995 - DNA, 23 bp, Homo sapiens
attttttgtctttgtaactagat

SEQ ID NO: 59996 - DNA, 22 bp, Homo sapiens
gcagcctcaaactccccagctc

SEQ ID NO: 59997 - DNA, 22 bp, Homo sapiens
atcttctcatgtgtaatgaggt

SEQ ID NO: 59998 - DNA, 22 bp, Homo sapiens
ctgagatctttatacgaggcac

SEQ ID NO: 59999 - DNA, 22 bp, Homo sapiens
tggatggctgtggtctttgccc

SEQ ID NO: 60000 - DNA, 22 bp, Homo sapiens
tgtacaatgctgaggtttgggg

SEQ ID NO: 60001 - DNA, 22 bp, Homo sapiens
cctgcctatgagacgttttgcc

SEQ ID NO: 60002 - DNA, 22 bp, Homo sapiens
ttcattttctttcacgctgctg

SEQ ID NO: 60003 - DNA, 22 bp, Homo sapiens
ctgtggctctcagaggctgctg

SEQ ID NO: 60004 - DNA, 22 bp, Homo sapiens
aacttaggaaaataaggcatga

SEQ ID NO: 60005 - DNA, 22 bp, Homo sapiens
gggttgaggcggatgtcggcgg

SEQ ID NO: 60006 - DNA, 22 bp, Homo sapiens
agcccaggttgaggctgcagtg

SEQ ID NO: 60007 - DNA, 22 bp, Homo sapiens
aaggggtgagcagaggcttcgc

SEQ ID NO: 60008 - DNA, 22 bp, Homo sapiens
tgtgcctgttcccactttgcct

SEQ ID NO: 60009 - DNA, 22 bp, Homo sapiens
catgtgtgtctccaccagctgc

SEQ ID NO: 60010 - DNA, 22 bp, Homo sapiens
aatggaatacctaggtggccca

SEQ ID NO: 60011 - DNA, 22 bp, Homo sapiens
gggccggagctgggtcccgcgc

SEQ ID NO: 60012 - DNA, 22 bp, Homo sapiens
agccagggacgctgcaggctac

SEQ ID NO: 60013 - DNA, 22 bp, Homo sapiens
ggagaggcttccagagtcgtgc

SEQ ID NO: 60014 - DNA, 22 bp, Homo sapiens
caagggaattgtgtgtgagagg

SEQ ID NO: 60015 - DNA, 22 bp, Homo sapiens
aacccagggtggaggttgcagt

SEQ ID NO: 60016 - DNA, 19 bp, Homo sapiens
agagtattgaatttgccct

SEQ ID NO: 60017 - DNA, 22 bp, Homo sapiens
caagtctgacctctgggtgaag

SEQ ID NO: 60018 - DNA, 22 bp, Homo sapiens
aggtaaagacagtgaaagaggg

SEQ ID NO: 60019 - DNA, 22 bp, Homo sapiens
tgtgggagaaggaagcaagctg

SEQ ID NO: 60020 - DNA, 22 bp, Homo sapiens
gcaggcggaggttgcagtgagc

SEQ ID NO: 60021 - DNA, 22 bp, Homo sapiens
aggacagagggaccagagccca

SEQ ID NO: 60022 - DNA, 22 bp, Homo sapiens
tgttgagtatatacctacaagt

SEQ ID NO: 60023 - DNA, 22 bp, Homo sapiens
ggcaaagccctgcctggttcaa

SEQ ID NO: 60024 - DNA, 22 bp, Homo sapiens
tttgattgtcacctaccttgca

SEQ ID NO: 60025 - DNA, 22 bp, Homo sapiens
tttgttttcaatgtgtcattca

SEQ ID NO: 60026 - DNA, 22 bp, Homo sapiens
cccaggagttggaggctgcagt

SEQ ID NO: 60027 - DNA, 22 bp, Homo sapiens
ctctgcaacttctagcagtgtc

SEQ ID NO: 60028 - DNA, 22 bp, Homo sapiens
tccaggctttggggcaggagcg

SEQ ID NO: 60029 - DNA, 22 bp, Homo sapiens
taacatttaaatttttcacata

SEQ ID NO: 60030 - DNA, 22 bp, Homo sapiens
agaatagaattctcatagaatt

SEQ ID NO: 60031 - DNA, 22 bp, Homo sapiens
cttaactctacactgcacttta

SEQ ID NO: 60032 - DNA, 22 bp, Homo sapiens
agctggtgtgccagttccagtt

SEQ ID NO: 60033 - DNA, 22 bp, Homo sapiens
cccaggggttctgagcagcagc

SEQ ID NO: 60034 - DNA, 19 bp, Homo sapiens
acccagcccaggagtggca

SEQ ID NO: 60035 - DNA, 22 bp, Homo sapiens
tgggactcactcttttggccag

SEQ ID NO: 60036 - DNA, 22 bp, Homo sapiens
tggcaccagggaacaagcattt

SEQ ID NO: 60037 - DNA, 22 bp, Homo sapiens
ttagtttataattcatttctgt

SEQ ID NO: 60038 - DNA, 22 bp, Homo sapiens
tgtcctcatcctccagtctgtc

SEQ ID NO: 60039 - DNA, 22 bp, Homo sapiens
gcttctcgggcctgatgtcgtc

SEQ ID NO: 60040 - DNA, 22 bp, Homo sapiens
gggagctgaaggagccggcggg

SEQ ID NO: 60041 - DNA, 22 bp, Homo sapiens
tttattctgtgctacatgaaga

SEQ ID NO: 60042 - DNA, 17 bp, Homo sapiens
tggtccaggtggagcca

SEQ ID NO: 60043 - DNA, 22 bp, Homo sapiens
ccagcagagcatggggaggaag

SEQ ID NO: 60044 - DNA, 22 bp, Homo sapiens
atcccgaacctctacttctttc

SEQ ID NO: 60045 - DNA, 22 bp, Homo sapiens
caaatactacgattcttgcagt

SEQ ID NO: 60046 - DNA, 22 bp, Homo sapiens
gttgtgaatagtgccgcaataa

SEQ ID NO: 60047 - DNA, 22 bp, Homo sapiens
caccaggctggagtgcagtggc

SEQ ID NO: 60048 - DNA, 22 bp, Homo sapiens
cagatctgtggtatctctattt

SEQ ID NO: 60049 - DNA, 22 bp, Homo sapiens
gggacatctttctagtcagggt

SEQ ID NO: 60050 - DNA, 22 bp, Homo sapiens
cggtcaggtgcagcgttggcac

SEQ ID NO: 60051 - DNA, 19 bp, Homo sapiens
ccctcttgcacaaagcaaa

SEQ ID NO: 60052 - DNA, 22 bp, Homo sapiens
aacagaatgcaggggatgctgc

SEQ ID NO: 60053 - DNA, 20 bp, Homo sapiens
tatttctgggcaaccattta

SEQ ID NO: 60054 - DNA, 22 bp, Homo sapiens
tccagctctgctgtgcgccggt

SEQ ID NO: 60055 - DNA, 22 bp, Homo sapiens
cctggaggcggaggttgcagtg

SEQ ID NO: 60056 - DNA, 22 bp, Homo sapiens
cttgcctacttgtcaaccagca

SEQ ID NO: 60057 - DNA, 19 bp, Homo sapiens
ttcagcattatattctagc

SEQ ID NO: 60058 - DNA, 22 bp, Homo sapiens
atgagctcatccgagtcacact

SEQ ID NO: 60059 - DNA, 21 bp, Homo sapiens
cccgcacagcggtaggccgcc

SEQ ID NO: 60060 - DNA, 22 bp, Homo sapiens
tgtcttcaggagtaaatatcat

SEQ ID NO: 60061 - DNA, 22 bp, Homo sapiens
atcacaaaggtctcagagcaca

SEQ ID NO: 60062 - DNA, 22 bp, Homo sapiens
gtcagactgcactcaaggacag

SEQ ID NO: 60063 - DNA, 19 bp, Homo sapiens
ctgctgccggagactcgtc

SEQ ID NO: 60064 - DNA, 22 bp, Homo sapiens
gggctgagacgatggggtcttc

SEQ ID NO: 60065 - DNA, 21 bp, Homo sapiens
tgtaagtttcatctgaattgg

SEQ ID NO: 60066 - DNA, 22 bp, Homo sapiens
ttcttctcagggtcccacatgg

SEQ ID NO: 60067 - DNA, 18 bp, Homo sapiens
acacttcctggtggtgtg

SEQ ID NO: 60068 - DNA, 22 bp, Homo sapiens
cctctgtgtgatgcgcaaagta

SEQ ID NO: 60069 - DNA, 22 bp, Homo sapiens
accattgccccctagtgtctgt

SEQ ID NO: 60070 - DNA, 22 bp, Homo sapiens
agctcctgaaaatccagactgg

SEQ ID NO: 60071 - DNA, 22 bp, Homo sapiens
cagcctgccgtcagccaggtag

SEQ ID NO: 60072 - DNA, 22 bp, Homo sapiens
cagggtttcaccatgttagcag

SEQ ID NO: 60073 - DNA, 22 bp, Homo sapiens
ctccaccccgtgccggtgctgg

SEQ ID NO: 60074 - DNA, 22 bp, Homo sapiens
tctttgttattgtgaatagggt

SEQ ID NO: 60075 - DNA, 22 bp, Homo sapiens
ggagagcagggaggctgctctg

SEQ ID NO: 60076 - DNA, 22 bp, Homo sapiens
agcctggtttaagcattttata

SEQ ID NO: 60077 - DNA, 22 bp, Homo sapiens
tccgcccgcacgtatggagtgg

SEQ ID NO: 60078 - DNA, 22 bp, Homo sapiens
actggggtttaggcctgggcaa

SEQ ID NO: 60079 - DNA, 22 bp, Homo sapiens
cttgaatgtcctgtggcaaagt

SEQ ID NO: 60080 - DNA, 22 bp, Homo sapiens
tcttggattttaatggatcaaa

SEQ ID NO: 60081 - DNA, 22 bp, Homo sapiens
cttgtagaattgaaatggtctc

SEQ ID NO: 60082 - DNA, 22 bp, Homo sapiens
tgtcatagtgtggtagcagtgg

SEQ ID NO: 60083 - DNA, 22 bp, Homo sapiens
taggtttaggagtgaaggtgaa

SEQ ID NO: 60084 - DNA, 22 bp, Homo sapiens
attgtaaatagtgccacaataa

SEQ ID NO: 60085 - DNA, 22 bp, Homo sapiens
gccgggaccaaggccacggagc

SEQ ID NO: 60086 - DNA, 22 bp, Homo sapiens
aaatgtaagtctttgtttctta

SEQ ID NO: 60087 - DNA, 22 bp, Homo sapiens
tctgacattagattaattggaa

SEQ ID NO: 60088 - DNA, 22 bp, Homo sapiens
acacccaggctggcgtgcagtg

SEQ ID NO: 60089 - DNA, 22 bp, Homo sapiens
tccggtccgggtactcctctct

SEQ ID NO: 60090 - DNA, 22 bp, Homo sapiens
tcactgcacttcagcttgggca

SEQ ID NO: 60091 - DNA, 22 bp, Homo sapiens
acacggcactttaggaaggggc

SEQ ID NO: 60092 - DNA, 22 bp, Homo sapiens
gtcctggggattatagagtgtt

SEQ ID NO: 60093 - DNA, 22 bp, Homo sapiens
aggtagaaggaccagaatttat

SEQ ID NO: 60094 - DNA, 22 bp, Homo sapiens
ggagtgaagtggcgcgatctcg

SEQ ID NO: 60095 - DNA, 21 bp, Homo sapiens
ccagagcctgagaggattatg

SEQ ID NO: 60096 - DNA, 22 bp, Homo sapiens
atcatcctagaaggaagctagg

SEQ ID NO: 60097 - DNA, 22 bp, Homo sapiens
ggaggctgagaggtcgcagtgg

SEQ ID NO: 60098 - DNA, 22 bp, Homo sapiens
caggagtgtctccacacagcaa

SEQ ID NO: 60099 - DNA, 23 bp, Homo sapiens
ttaaacactagttcgagtagcat

SEQ ID NO: 60100 - DNA, 22 bp, Homo sapiens
gagctcattcattcattgcctg

SEQ ID NO: 60101 - DNA, 22 bp, Homo sapiens
atgcattgtcaggcaatttcat

SEQ ID NO: 60102 - DNA, 22 bp, Homo sapiens
ggtaccaccaattcagctgcca

SEQ ID NO: 60103 - DNA, 22 bp, Homo sapiens
gtgtttggtcagacgtccgggg

SEQ ID NO: 60104 - DNA, 22 bp, Homo sapiens
ggtttgttggggtccaggccca

SEQ ID NO: 60105 - DNA, 18 bp, Homo sapiens
tctgccccagccgcactg

SEQ ID NO: 60106 - DNA, 22 bp, Homo sapiens
tactaggaagcagctgcattgg

SEQ ID NO: 60107 - DNA, 22 bp, Homo sapiens
gttgctcaggcaggagtacagt

SEQ ID NO: 60108 - DNA, 22 bp, Homo sapiens
ggatgtcgaggatggggtagca

SEQ ID NO: 60109 - DNA, 22 bp, Homo sapiens
ggggccttggatctgtgccccg

SEQ ID NO: 60110 - DNA, 22 bp, Homo sapiens
tgtccccacccaaatctcatct

SEQ ID NO: 60111 - DNA, 22 bp, Homo sapiens
agtggagcttttcctatcagag

SEQ ID NO: 60112 - DNA, 22 bp, Homo sapiens
cccgagcctcggtttcttttct

SEQ ID NO: 60113 - DNA, 22 bp, Homo sapiens
cctaggagttcgaagctgcagt

SEQ ID NO: 60114 - DNA, 22 bp, Homo sapiens
ttttcctttgattcccagatgt

SEQ ID NO: 60115 - DNA, 22 bp, Homo sapiens
cagagagaatcttggcagctga

SEQ ID NO: 60116 - DNA, 22 bp, Homo sapiens
tgaaatgattatatggtgtttg

SEQ ID NO: 60117 - DNA, 16 bp, Homo sapiens
aggtggagaagttcac

SEQ ID NO: 60118 - DNA, 22 bp, Homo sapiens
cactgcactccagcctgggaga

SEQ ID NO: 60119 - DNA, 22 bp, Homo sapiens
ctctggagtgtctggccagggt

SEQ ID NO: 60120 - DNA, 22 bp, Homo sapiens
ctggaaggagcccgggcggatc

SEQ ID NO: 60121 - DNA, 22 bp, Homo sapiens
aagacacaatgtagcccagcac

SEQ ID NO: 60122 - DNA, 22 bp, Homo sapiens
cacctgccaaatggggatgctg

SEQ ID NO: 60123 - DNA, 22 bp, Homo sapiens
tttctcggcagagatgatgggc

SEQ ID NO: 60124 - DNA, 22 bp, Homo sapiens
ttctgattgctgatgaggccca

SEQ ID NO: 60125 - DNA, 22 bp, Homo sapiens
aaagggaagttgcacatgttcc

SEQ ID NO: 60126 - DNA, 19 bp, Homo sapiens
ttcacattggaagaagtag

SEQ ID NO: 60127 - DNA, 22 bp, Homo sapiens
gcaggtggatcacctgaggtca

SEQ ID NO: 60128 - DNA, 22 bp, Homo sapiens
aggcaatcccctgaggatactt

SEQ ID NO: 60129 - DNA, 22 bp, Homo sapiens
gtggagaggaacccagctctgt

SEQ ID NO: 60130 - DNA, 22 bp, Homo sapiens
agagggatcaccctgtttctgg

SEQ ID NO: 60131 - DNA, 22 bp, Homo sapiens
ggcgccagcactgcagcgcctc

SEQ ID NO: 60132 - DNA, 22 bp, Homo sapiens
cctgagtagctggaattaaagg

SEQ ID NO: 60133 - DNA, 22 bp, Homo sapiens
gccggggctggggagagacatg

SEQ ID NO: 60134 - DNA, 22 bp, Homo sapiens
tgtgaatggacaattaaatcta

SEQ ID NO: 60135 - DNA, 22 bp, Homo sapiens
gggtccagtagttggtggccgt

SEQ ID NO: 60136 - DNA, 22 bp, Homo sapiens
caggctggagtgcaatgacgcc

SEQ ID NO: 60137 - DNA, 22 bp, Homo sapiens
tagattcagatatttaggacaa

SEQ ID NO: 60138 - DNA, 22 bp, Homo sapiens
ggcaggtcaggtccatgaccaa

SEQ ID NO: 60139 - DNA, 22 bp, Homo sapiens
tacctcaagttccaggaaagcg

SEQ ID NO: 60140 - DNA, 22 bp, Homo sapiens
aagggctctgtgcttgtcccat

SEQ ID NO: 60141 - DNA, 22 bp, Homo sapiens
ggcgctcagtgttgccccagag

SEQ ID NO: 60142 - DNA, 22 bp, Homo sapiens
ggtgagaaagggattcctgttc

SEQ ID NO: 60143 - DNA, 22 bp, Homo sapiens
agctgattccactttttcccca

SEQ ID NO: 60144 - DNA, 22 bp, Homo sapiens
tgaatgtgatgctaaacatatg

SEQ ID NO: 60145 - DNA, 22 bp, Homo sapiens
cctactctgagcgcctccgcat

SEQ ID NO: 60146 - DNA, 22 bp, Homo sapiens
ggatgtcgaggatggggtagca

SEQ ID NO: 60147 - DNA, 22 bp, Homo sapiens
gggctagcctcttccctgctcc

SEQ ID NO: 60148 - DNA, 22 bp, Homo sapiens
aggtcaagagtaaatttgggta

SEQ ID NO: 60149 - DNA, 22 bp, Homo sapiens
tgccctggctcttcttgttcca

SEQ ID NO: 60150 - DNA, 22 bp, Homo sapiens
gtggtgtttgagctgccaggga

SEQ ID NO: 60151 - DNA, 22 bp, Homo sapiens
agtgctatcgagttctaatgct

SEQ ID NO: 60152 - DNA, 22 bp, Homo sapiens
atacctgtgtatccacaagcgt

SEQ ID NO: 60153 - DNA, 22 bp, Homo sapiens
ttattttaccttcctctgagct

SEQ ID NO: 60154 - DNA, 22 bp, Homo sapiens
ctgggctagaaggaccaggatg

SEQ ID NO: 60155 - DNA, 22 bp, Homo sapiens
aaatcggttggttcaaggtaat

SEQ ID NO: 60156 - DNA, 22 bp, Homo sapiens
gaggcagtccagtgggtaagaa

SEQ ID NO: 60157 - DNA, 22 bp, Homo sapiens
ataggtccaaggagaggtcttt

SEQ ID NO: 60158 - DNA, 22 bp, Homo sapiens
ggtcccaggttgacagggagac

SEQ ID NO: 60159 - DNA, 22 bp, Homo sapiens
gagctcattcattcattgcctg

SEQ ID NO: 60160 - DNA, 22 bp, Homo sapiens
caggggcggtggctcacgcctg

SEQ ID NO: 60161 - DNA, 22 bp, Homo sapiens
tgagtcatgggcttgaggttac

SEQ ID NO: 60162 - DNA, 22 bp, Homo sapiens
tactgtgtgcccagccgagctg

SEQ ID NO: 60163 - DNA, 22 bp, Homo sapiens
caggctggagtgcagtggcgcc

SEQ ID NO: 60164 - DNA, 22 bp, Homo sapiens
gagccaggttggaggctgcagt

SEQ ID NO: 60165 - DNA, 22 bp, Homo sapiens
gttgaggtgatgccagccctgc

SEQ ID NO: 60166 - DNA, 22 bp, Homo sapiens
tgaggcaggtggattacaaggt

SEQ ID NO: 60167 - DNA, 22 bp, Homo sapiens
gcaggtccagtcaccagagaga

SEQ ID NO: 60168 - DNA, 22 bp, Homo sapiens
gcgggcgggggttcccaggtct

SEQ ID NO: 60169 - DNA, 22 bp, Homo sapiens
atttttctctttccactgagat

SEQ ID NO: 60170 - DNA, 22 bp, Homo sapiens
ggaactcctgctccaagcagct

SEQ ID NO: 60171 - DNA, 22 bp, Homo sapiens
cgcaccactgaattccagcctg

SEQ ID NO: 60172 - DNA, 22 bp, Homo sapiens
tggttaagtccagaaaggaagc

SEQ ID NO: 60173 - DNA, 22 bp, Homo sapiens
tcaaaaagttgaagagttgggg

SEQ ID NO: 60174 - DNA, 22 bp, Homo sapiens
tacagtcacattctgaggtctt

SEQ ID NO: 60175 - DNA, 22 bp, Homo sapiens
aggatgagccgcgcaagctgac

SEQ ID NO: 60176 - DNA, 22 bp, Homo sapiens
ccaagtagttgagactacaggt

SEQ ID NO: 60177 - DNA, 22 bp, Homo sapiens
ctggaaggcggaggttgtagtg

SEQ ID NO: 60178 - DNA, 22 bp, Homo sapiens
ggggttaacagtattgctcatg

SEQ ID NO: 60179 - DNA, 22 bp, Homo sapiens
ggccttggttccaaagcaggca

SEQ ID NO: 60180 - DNA, 22 bp, Homo sapiens
caggctggagtgcagtggggcg

SEQ ID NO: 60181 - DNA, 22 bp, Homo sapiens
tccacagtggttgaactagtaa

SEQ ID NO: 60182 - DNA, 22 bp, Homo sapiens
cgaggcggcggaagtgcccgta

SEQ ID NO: 60183 - DNA, 22 bp, Homo sapiens
tcactacaacctccgcctcctg

SEQ ID NO: 60184 - DNA, 22 bp, Homo sapiens
aattacagtcggagcagcactg

SEQ ID NO: 60185 - DNA, 23 bp, Homo sapiens
aaataggagtatctggatcatga

SEQ ID NO: 60186 - DNA, 22 bp, Homo sapiens
ttttggctctgtctgtatcttt

SEQ ID NO: 60187 - DNA, 22 bp, Homo sapiens
ttatttaaaagtggtaagattc

SEQ ID NO: 60188 - DNA, 22 bp, Homo sapiens
tttagattgtgacctcccccca

SEQ ID NO: 60189 - DNA, 22 bp, Homo sapiens
tcctgggatcaagtgatcctcc

SEQ ID NO: 60190 - DNA, 22 bp, Homo sapiens
ctctgcaacttctagcagtgtc

SEQ ID NO: 60191 - DNA, 22 bp, Homo sapiens
gcaaggtctttcagaaaggaaa

SEQ ID NO: 60192 - DNA, 22 bp, Homo sapiens
aggacaaaggaccagatctgga

SEQ ID NO: 60193 - DNA, 22 bp, Homo sapiens
ccaggagttggaagctgccatg

SEQ ID NO: 60194 - DNA, 22 bp, Homo sapiens
ggagcagggaattacagcgcag

SEQ ID NO: 60195 - DNA, 22 bp, Homo sapiens
ccaggctgctgttggtgtccgc

SEQ ID NO: 60196 - DNA, 21 bp, Homo sapiens
cactccacttagaacagggtt

SEQ ID NO: 60197 - DNA, 20 bp, Homo sapiens
ttgttgagctcttcaaagaa

SEQ ID NO: 60198 - DNA, 21 bp, Homo sapiens
caaaagagactgattcttgga

SEQ ID NO: 60199 - DNA, 22 bp, Homo sapiens
gagcccgagcgcgtacccggcg

SEQ ID NO: 60200 - DNA, 22 bp, Homo sapiens
gatgcgggcccgctccactgcc

SEQ ID NO: 60201 - DNA, 22 bp, Homo sapiens
gtgctccctccttcctcaagga

SEQ ID NO: 60202 - DNA, 22 bp, Homo sapiens
gcggggcccggacccagcctct

SEQ ID NO: 60203 - DNA, 20 bp, Homo sapiens
gggcagagccagccagtccc

SEQ ID NO: 60204 - DNA, 22 bp, Homo sapiens
gagctcatccccatggtccgtc

SEQ ID NO: 60205 - DNA, 22 bp, Homo sapiens
ggtgccaggctgtagtcagggt

SEQ ID NO: 60206 - DNA, 22 bp, Homo sapiens
gtatagaaacccagaaagatag

SEQ ID NO: 60207 - DNA, 22 bp, Homo sapiens
taactctgaatcctcacagcag

SEQ ID NO: 60208 - DNA, 22 bp, Homo sapiens
tttaagtaataaagtagcagct

SEQ ID NO: 60209 - DNA, 22 bp, Homo sapiens
caccaaagtcgcttctgtcgtc

SEQ ID NO: 60210 - DNA, 22 bp, Homo sapiens
gggcggggtggctcatgcctgt

SEQ ID NO: 60211 - DNA, 22 bp, Homo sapiens
caggcaggtcagtgaagaagga

SEQ ID NO: 60212 - DNA, 22 bp, Homo sapiens
gaggttcattcagctctgtcac

SEQ ID NO: 60213 - DNA, 22 bp, Homo sapiens
attttctctttgtatatgctag

SEQ ID NO: 60214 - DNA, 23 bp, Homo sapiens
gcctgggagttgcgatctgcccg

SEQ ID NO: 60215 - DNA, 22 bp, Homo sapiens
cagtggcgtgatctctgctcac

SEQ ID NO: 60216 - DNA, 22 bp, Homo sapiens
caagtctgacctctgggtgaag

SEQ ID NO: 60217 - DNA, 22 bp, Homo sapiens
aagatattcaaagatttattag

SEQ ID NO: 60218 - DNA, 22 bp, Homo sapiens
tgagtggacacctgcttcttta

SEQ ID NO: 60219 - DNA, 22 bp, Homo sapiens
gcagaggacacaggagggcaag

SEQ ID NO: 60220 - DNA, 22 bp, Homo sapiens
gagtgcaatggcatgatctggg

SEQ ID NO: 60221 - DNA, 22 bp, Homo sapiens
gtgctggggagataggaagaga

SEQ ID NO: 60222 - DNA, 22 bp, Homo sapiens
tgtctcatctcttaaccccact

SEQ ID NO: 60223 - DNA, 22 bp, Homo sapiens
gaagccttgaactgcaaacccc

SEQ ID NO: 60224 - DNA, 22 bp, Homo sapiens
agggccagcactcctggcagga

SEQ ID NO: 60225 - DNA, 22 bp, Homo sapiens
agaaatcctgatggagtctgaa

SEQ ID NO: 60226 - DNA, 22 bp, Homo sapiens
agccagggtctctcgctctgtt

SEQ ID NO: 60227 - DNA, 22 bp, Homo sapiens
ccaggagttggaggctgcagtg

SEQ ID NO: 60228 - DNA, 22 bp, Homo sapiens
aggaatggtgctcagcagaaat

SEQ ID NO: 60229 - DNA, 22 bp, Homo sapiens
ccttttgctctcccatccagaa

SEQ ID NO: 60230 - DNA, 22 bp, Homo sapiens
tcaccgaggctggagtgcagtg

SEQ ID NO: 60231 - DNA, 22 bp, Homo sapiens
atggtgtttataggcaaagatc

SEQ ID NO: 60232 - DNA, 22 bp, Homo sapiens
tgtgttcagaatttgctgcttt

SEQ ID NO: 60233 - DNA, 23 bp, Homo sapiens
gggtccagccaattccaaggaaa

SEQ ID NO: 60234 - DNA, 22 bp, Homo sapiens
tgcctagttctgtatttacagt

SEQ ID NO: 60235 - DNA, 22 bp, Homo sapiens
gctgcagggagctggaaggctc

SEQ ID NO: 60236 - DNA, 22 bp, Homo sapiens
tccttagacaaagagtgggctt

SEQ ID NO: 60237 - DNA, 22 bp, Homo sapiens
tagtttcatctccaccctgccc

SEQ ID NO: 60238 - DNA, 22 bp, Homo sapiens
tgattttctccattgtaaattc

SEQ ID NO: 60239 - DNA, 22 bp, Homo sapiens
tcagtgttaatcagtggtacct

SEQ ID NO: 60240 - DNA, 18 bp, Homo sapiens
actctttctgcccacagg

SEQ ID NO: 60241 - DNA, 22 bp, Homo sapiens
ggtgttcaaatgaacacatgca

SEQ ID NO: 60242 - DNA, 22 bp, Homo sapiens
gagccaggtcgggccgcggcga

SEQ ID NO: 60243 - DNA, 20 bp, Homo sapiens
ataaaataactgccacaaga

SEQ ID NO: 60244 - DNA, 22 bp, Homo sapiens
tcgtgatctgtccacctcggcc

SEQ ID NO: 60245 - DNA, 22 bp, Homo sapiens
cgggttcacgccattctcctgc

SEQ ID NO: 60246 - DNA, 22 bp, Homo sapiens
atgttctacagatggaaagggg

SEQ ID NO: 60247 - DNA, 22 bp, Homo sapiens
tggagaattctatgttgagggg

SEQ ID NO: 60248 - DNA, 22 bp, Homo sapiens
tcattgccatggcatttgcaga

SEQ ID NO: 60249 - DNA, 23 bp, Homo sapiens
gttttacaggtgagaaaatggag

SEQ ID NO: 60250 - DNA, 22 bp, Homo sapiens
agtccaggcattccagccattc

SEQ ID NO: 60251 - DNA, 22 bp, Homo sapiens
gaggtggatgttgcagtgagct

SEQ ID NO: 60252 - DNA, 22 bp, Homo sapiens
aggtgggcgctgctcccgctgg

SEQ ID NO: 60253 - DNA, 21 bp, Homo sapiens
agctgcctccacttctgaggc

SEQ ID NO: 60254 - DNA, 22 bp, Homo sapiens
gcagctattgtctcctgggccc

SEQ ID NO: 60255 - DNA, 22 bp, Homo sapiens
gtagatgagctcacatgacctt

SEQ ID NO: 60256 - DNA, 21 bp, Homo sapiens
aagaggaagcattatggcata

SEQ ID NO: 60257 - DNA, 22 bp, Homo sapiens
cagcaggaggtgagtagcaggt

SEQ ID NO: 60258 - DNA, 18 bp, Homo sapiens
atggtctcatactgggag

SEQ ID NO: 60259 - DNA, 22 bp, Homo sapiens
tcactgcaacctccacctcctg

SEQ ID NO: 60260 - DNA, 22 bp, Homo sapiens
ggtgtccgcgctgtagaaggtc

SEQ ID NO: 60261 - DNA, 22 bp, Homo sapiens
ttgagcccaggaggcctgggtg

SEQ ID NO: 60262 - DNA, 18 bp, Homo sapiens
ccctgccagctcccagca

SEQ ID NO: 60263 - DNA, 22 bp, Homo sapiens
tagtcccggaactccttcaggt

SEQ ID NO: 60264 - DNA, 22 bp, Homo sapiens
caagtagaacagagctaccttg

SEQ ID NO: 60265 - DNA, 22 bp, Homo sapiens
ttttaatactgctattgtagga

SEQ ID NO: 60266 - DNA, 22 bp, Homo sapiens
tggatatccttgttaactttct

SEQ ID NO: 60267 - DNA, 22 bp, Homo sapiens
accatgttggccaagctggtct

SEQ ID NO: 60268 - DNA, 22 bp, Homo sapiens
ggcagggcaggaaagtcaggaa

SEQ ID NO: 60269 - DNA, 22 bp, Homo sapiens
atgccactgcacttcagcctgg

SEQ ID NO: 60270 - DNA, 22 bp, Homo sapiens
tctacctggagtccgttgttaa

SEQ ID NO: 60271 - DNA, 22 bp, Homo sapiens
cagggtgctgcaccatccctca

SEQ ID NO: 60272 - DNA, 22 bp, Homo sapiens
atgaggcaggtggaggctgcca

SEQ ID NO: 60273 - DNA, 22 bp, Homo sapiens
ggccactgctctccagcctggg

SEQ ID NO: 60274 - DNA, 22 bp, Homo sapiens
tcgaactcatagtcgtagctgt

SEQ ID NO: 60275 - DNA, 20 bp, Homo sapiens
tcagccttgaatgcttgaaa

SEQ ID NO: 60276 - DNA, 22 bp, Homo sapiens
gtagctctgtttaaagttcttt

SEQ ID NO: 60277 - DNA, 22 bp, Homo sapiens
gcggggggcaggcagtacgttg

SEQ ID NO: 60278 - DNA, 22 bp, Homo sapiens
gccatcatatcccctgtgacct

SEQ ID NO: 60279 - DNA, 22 bp, Homo sapiens
ccctggaggttgaggctgcagt

SEQ ID NO: 60280 - DNA, 22 bp, Homo sapiens
atgccacttcattccagcctcg

SEQ ID NO: 60281 - DNA, 22 bp, Homo sapiens
tgaagctttaggatgggttcat

SEQ ID NO: 60282 - DNA, 22 bp, Homo sapiens
aataaacaaaggacaaggaggt

SEQ ID NO: 60283 - DNA, 22 bp, Homo sapiens
atcttggggaatcctctgtgta

SEQ ID NO: 60284 - DNA, 22 bp, Homo sapiens
tgaggcaggagaatcacatgaa

SEQ ID NO: 60285 - DNA, 23 bp, Homo sapiens
gcaagagacagagcatcctgttc

SEQ ID NO: 60286 - DNA, 22 bp, Homo sapiens
ctgccctggggggcctccttgc

SEQ ID NO: 60287 - DNA, 22 bp, Homo sapiens
gtccaagagtcaagaagggggc

SEQ ID NO: 60288 - DNA, 22 bp, Homo sapiens
ctgtggctcaggcctgtaagcc

SEQ ID NO: 60289 - DNA, 22 bp, Homo sapiens
aggaaataggaccagacaaagc

SEQ ID NO: 60290 - DNA, 22 bp, Homo sapiens
atgcagccccctggtgcccggg

SEQ ID NO: 60291 - DNA, 22 bp, Homo sapiens
aaattacagccttgggtagctt

SEQ ID NO: 60292 - DNA, 22 bp, Homo sapiens
gcttccacctactaaatgccac

SEQ ID NO: 60293 - DNA, 22 bp, Homo sapiens
tgctcatcaacatgatgatcat

SEQ ID NO: 60294 - DNA, 22 bp, Homo sapiens
ttccgctgtttagttgaagttt

SEQ ID NO: 60295 - DNA, 22 bp, Homo sapiens
ggcaggactgatcagtgggatg

SEQ ID NO: 60296 - DNA, 22 bp, Homo sapiens
gaggaggcttccgggaggcacg

SEQ ID NO: 60297 - DNA, 22 bp, Homo sapiens
tgcacgtgggctctctgctctt

SEQ ID NO: 60298 - DNA, 22 bp, Homo sapiens
atgggttcaagtgattctcctg

SEQ ID NO: 60299 - DNA, 22 bp, Homo sapiens
gcaccgccttggaccgcccgct

SEQ ID NO: 60300 - DNA, 22 bp, Homo sapiens
agtaatcaatttttcggtggat

SEQ ID NO: 60301 - DNA, 22 bp, Homo sapiens
cattgcaacttcaaactcctgg

SEQ ID NO: 60302 - DNA, 23 bp, Homo sapiens
ctcaccaagcgccgccgctgtgt

SEQ ID NO: 60303 - DNA, 21 bp, Homo sapiens
tggcggggacttgtggctgcc

SEQ ID NO: 60304 - DNA, 22 bp, Homo sapiens
gggcgcatcacctgaggtcagg

SEQ ID NO: 60305 - DNA, 22 bp, Homo sapiens
tctggtgtcagtattctttgaa

SEQ ID NO: 60306 - DNA, 22 bp, Homo sapiens
ttacctaaaatagctcaattta

SEQ ID NO: 60307 - DNA, 22 bp, Homo sapiens
caggctggagttcagtggtgtg

SEQ ID NO: 60308 - DNA, 22 bp, Homo sapiens
tctcgctctgtcgcccaggctg

SEQ ID NO: 60309 - DNA, 17 bp, Homo sapiens
ttaaggtggatcagcac

SEQ ID NO: 60310 - DNA, 22 bp, Homo sapiens
aataaaatggtcagttttctca

SEQ ID NO: 60311 - DNA, 22 bp, Homo sapiens
aggtcaccatggcatgctccac

SEQ ID NO: 60312 - DNA, 22 bp, Homo sapiens
ggtccccgtggaggctggagcg

SEQ ID NO: 60313 - DNA, 22 bp, Homo sapiens
tttgtcttatccaatctctcag

SEQ ID NO: 60314 - DNA, 22 bp, Homo sapiens
cagggatggcgctggctgcccg

SEQ ID NO: 60315 - DNA, 22 bp, Homo sapiens
cttatcagattatctgggctgt

SEQ ID NO: 60316 - DNA, 22 bp, Homo sapiens
attggccatttgcatgtattat

SEQ ID NO: 60317 - DNA, 22 bp, Homo sapiens
tgtgtgattgcaggagatgtgg

SEQ ID NO: 60318 - DNA, 22 bp, Homo sapiens
cggagtcttgctatgttgccca

SEQ ID NO: 60319 - DNA, 22 bp, Homo sapiens
tcttgcacttcatgaatatgtt

SEQ ID NO: 60320 - DNA, 22 bp, Homo sapiens
catccaggctgaagtgcagtgg

SEQ ID NO: 60321 - DNA, 22 bp, Homo sapiens
ggggccttggatctgtgccccg

SEQ ID NO: 60322 - DNA, 22 bp, Homo sapiens
caggctggagtacaattgtgtg

SEQ ID NO: 60323 - DNA, 23 bp, Homo sapiens
aggatgtaggatgtatggcagag

SEQ ID NO: 60324 - DNA, 22 bp, Homo sapiens
ctatgaccccagcatgaataag

SEQ ID NO: 60325 - DNA, 22 bp, Homo sapiens
ccgggttgaggttcccatagat

SEQ ID NO: 60326 - DNA, 22 bp, Homo sapiens
aatggctctgatgttgttgtga

SEQ ID NO: 60327 - DNA, 22 bp, Homo sapiens
caggctggagtgcagtggcgct

SEQ ID NO: 60328 - DNA, 22 bp, Homo sapiens
ttgtgagtagtgccgcaataaa

SEQ ID NO: 60329 - DNA, 22 bp, Homo sapiens
gactgtggggaagcagatgcca

SEQ ID NO: 60330 - DNA, 22 bp, Homo sapiens
gcaaatacatgttgagcaccta

SEQ ID NO: 60331 - DNA, 22 bp, Homo sapiens
ttccagctaactcacatccctt

SEQ ID NO: 60332 - DNA, 22 bp, Homo sapiens
ttgcactccagcccgagcaaca

SEQ ID NO: 60333 - DNA, 22 bp, Homo sapiens
gtctgctcatgctaccgcgggc

SEQ ID NO: 60334 - DNA, 22 bp, Homo sapiens
gagagtctagtgcacctagttt

SEQ ID NO: 60335 - DNA, 22 bp, Homo sapiens
atgccactgcactccagcctag

SEQ ID NO: 60336 - DNA, 22 bp, Homo sapiens
aaccaccattctctcctcttcc

SEQ ID NO: 60337 - DNA, 22 bp, Homo sapiens
gagccaggggtcagctccgagg

SEQ ID NO: 60338 - DNA, 22 bp, Homo sapiens
actgcaacctccgcctgccagg

SEQ ID NO: 60339 - DNA, 22 bp, Homo sapiens
atgccactgcgctctagcctgg

SEQ ID NO: 60340 - DNA, 19 bp, Homo sapiens
agggaatccggctgaggga

SEQ ID NO: 60341 - DNA, 22 bp, Homo sapiens
atagggcctaaaaagtattgct

SEQ ID NO: 60342 - DNA, 22 bp, Homo sapiens
agaaaatgtgaacttgtgaatt

SEQ ID NO: 60343 - DNA, 22 bp, Homo sapiens
tgaactcctgacctcatgatcc

SEQ ID NO: 60344 - DNA, 23 bp, Homo sapiens
ttgggcaaatcactaacgtctcc

SEQ ID NO: 60345 - DNA, 22 bp, Homo sapiens
gcccttctgctgttaggtagcc

SEQ ID NO: 60346 - DNA, 22 bp, Homo sapiens
gcttcaaactgagcttcaagtg

SEQ ID NO: 60347 - DNA, 22 bp, Homo sapiens
acaggtcctcaagtcagctggg

SEQ ID NO: 60348 - DNA, 22 bp, Homo sapiens
cgtctggcttctccacggtaaa

SEQ ID NO: 60349 - DNA, 22 bp, Homo sapiens
tgactacaacctccacctcccg

SEQ ID NO: 60350 - DNA, 22 bp, Homo sapiens
gaagaaagatcaaatagtttcc

SEQ ID NO: 60351 - DNA, 22 bp, Homo sapiens
ctcctctttagccccagctgga

SEQ ID NO: 60352 - DNA, 22 bp, Homo sapiens
acctgcaggcacaggtgtgcgc

SEQ ID NO: 60353 - DNA, 22 bp, Homo sapiens
tgccgctccaggtctcgcggtg

SEQ ID NO: 60354 - DNA, 22 bp, Homo sapiens
gcatctaaataaacgtgggagt

SEQ ID NO: 60355 - DNA, 22 bp, Homo sapiens
tcgcccaggctggaagtgcagt

SEQ ID NO: 60356 - DNA, 22 bp, Homo sapiens
gaggcaggaggattgcttgagc

SEQ ID NO: 60357 - DNA, 22 bp, Homo sapiens
ctgtatctgtgttggatgagtt

SEQ ID NO: 60358 - DNA, 22 bp, Homo sapiens
ccattgtaaattctgtggaagt

SEQ ID NO: 60359 - DNA, 22 bp, Homo sapiens
tgggcaggggccctgcttccgt

SEQ ID NO: 60360 - DNA, 22 bp, Homo sapiens
tggagggcatgctgtccatggg

SEQ ID NO: 60361 - DNA, 22 bp, Homo sapiens
ggccactgacctacatctgggg

SEQ ID NO: 60362 - DNA, 22 bp, Homo sapiens
gccagcagcttcttctcatcct

SEQ ID NO: 60363 - DNA, 22 bp, Homo sapiens
tggggagaaatgtctttgttcc

SEQ ID NO: 60364 - DNA, 22 bp, Homo sapiens
tcacttagatggggatcatcac

SEQ ID NO: 60365 - DNA, 22 bp, Homo sapiens
aggactgggtgcagagggcatc

SEQ ID NO: 60366 - DNA, 22 bp, Homo sapiens
ggcatcttgttgctcaaatcta

SEQ ID NO: 60367 - DNA, 22 bp, Homo sapiens
aaagcagaggttgcagtgagct

SEQ ID NO: 60368 - DNA, 22 bp, Homo sapiens
gaccttgtgatccacccgcttt

SEQ ID NO: 60369 - DNA, 22 bp, Homo sapiens
agccagggacgctgcaggctac

SEQ ID NO: 60370 - DNA, 22 bp, Homo sapiens
agtgggtgtagtcttcctcctg

SEQ ID NO: 60371 - DNA, 22 bp, Homo sapiens
ggccggggcctgctcgcctgtg

SEQ ID NO: 60372 - DNA, 22 bp, Homo sapiens
agtgcaggccccaggccaggcc

SEQ ID NO: 60373 - DNA, 22 bp, Homo sapiens
aacagtgtttttcttcagcact

SEQ ID NO: 60374 - DNA, 22 bp, Homo sapiens
ctggcctggcgcagtggctcac

SEQ ID NO: 60375 - DNA, 22 bp, Homo sapiens
ttgctttcccaaggcagaacat

SEQ ID NO: 60376 - DNA, 22 bp, Homo sapiens
agatggggtttcatcatgttgg

SEQ ID NO: 60377 - DNA, 22 bp, Homo sapiens
ttccacattccttacattcata

SEQ ID NO: 60378 - DNA, 22 bp, Homo sapiens
gtggattacaagacagttgaga

SEQ ID NO: 60379 - DNA, 22 bp, Homo sapiens
agaaaacataggagacaggaaa

SEQ ID NO: 60380 - DNA, 22 bp, Homo sapiens
gaatttcctctaaacccctgag

SEQ ID NO: 60381 - DNA, 22 bp, Homo sapiens
agtccgtggccagactcaagag

SEQ ID NO: 60382 - DNA, 22 bp, Homo sapiens
tgcactccaggctgggtgacag

SEQ ID NO: 60383 - DNA, 22 bp, Homo sapiens
aggtgactggtttatctggcag

SEQ ID NO: 60384 - DNA, 22 bp, Homo sapiens
aaacttttttaggttcataggc

SEQ ID NO: 60385 - DNA, 20 bp, Homo sapiens
aactcctagcctcaagtgat

SEQ ID NO: 60386 - DNA, 23 bp, Homo sapiens
gctcatcaggcttagagtcaagg

SEQ ID NO: 60387 - DNA, 21 bp, Homo sapiens
cgcagagcgaacttgcggcgc

SEQ ID NO: 60388 - DNA, 23 bp, Homo sapiens
tgaggcaggcggatcacgaggtc

SEQ ID NO: 60389 - DNA, 22 bp, Homo sapiens
agattgtcattgacgatgagca

SEQ ID NO: 60390 - DNA, 22 bp, Homo sapiens
ttgtgaatggtgccgcaataaa

SEQ ID NO: 60391 - DNA, 22 bp, Homo sapiens
tgtggggatcttctagcttttc

SEQ ID NO: 60392 - DNA, 22 bp, Homo sapiens
ctccagttggccccagttggtt

SEQ ID NO: 60393 - DNA, 22 bp, Homo sapiens
tgtttctgtatgatcaatattg

SEQ ID NO: 60394 - DNA, 22 bp, Homo sapiens
aggaggggttctcgggtgctga

SEQ ID NO: 60395 - DNA, 22 bp, Homo sapiens
tcactcaggctggagtgcagtg

SEQ ID NO: 60396 - DNA, 22 bp, Homo sapiens
atggagttctgccagcgctgct

SEQ ID NO: 60397 - DNA, 22 bp, Homo sapiens
tcccagagctctggaggttgga

SEQ ID NO: 60398 - DNA, 22 bp, Homo sapiens
catctgctgttccttggactca

SEQ ID NO: 60399 - DNA, 22 bp, Homo sapiens
ctggaaggagcccgggcggatc

SEQ ID NO: 60400 - DNA, 19 bp, Homo sapiens
tggctctgtcgaaggcaca

SEQ ID NO: 60401 - DNA, 22 bp, Homo sapiens
acaaacagagttgaaaaatagg

SEQ ID NO: 60402 - DNA, 22 bp, Homo sapiens
gggcggggggagctggaatgaa

SEQ ID NO: 60403 - DNA, 20 bp, Homo sapiens
caggtccagcacgtgcacgg

SEQ ID NO: 60404 - DNA, 22 bp, Homo sapiens
gagagcaggaggcagcgggacg

SEQ ID NO: 60405 - DNA, 22 bp, Homo sapiens
cccgactagctgggattacagg

SEQ ID NO: 60406 - DNA, 22 bp, Homo sapiens
ggctccaccctgcttccagaag

SEQ ID NO: 60407 - DNA, 22 bp, Homo sapiens
attgcactccagcctgggggac

SEQ ID NO: 60408 - DNA, 22 bp, Homo sapiens
agtactgtcagcagggtgttga

SEQ ID NO: 60409 - DNA, 22 bp, Homo sapiens
gcccgcgccagcctctccatct

SEQ ID NO: 60410 - DNA, 22 bp, Homo sapiens
actggacagaggaaatatggag

SEQ ID NO: 60411 - DNA, 17 bp, Homo sapiens
tggtccaggtggagcca

SEQ ID NO: 60412 - DNA, 22 bp, Homo sapiens
caggcagggagctggaaaggat

SEQ ID NO: 60413 - DNA, 22 bp, Homo sapiens
taagaaatttagttatagaatg

SEQ ID NO: 60414 - DNA, 22 bp, Homo sapiens
atgccactgcactccagcctgg

SEQ ID NO: 60415 - DNA, 22 bp, Homo sapiens
gttgagtgggttaggatgctga

SEQ ID NO: 60416 - DNA, 22 bp, Homo sapiens
aaggagtctgggccattcagag

SEQ ID NO: 60417 - DNA, 22 bp, Homo sapiens
agaggccggccgagcccatggg

SEQ ID NO: 60418 - DNA, 22 bp, Homo sapiens
tgaggcaggagttcaggctgcg

SEQ ID NO: 60419 - DNA, 19 bp, Homo sapiens
gactccaactttaagcatg

SEQ ID NO: 60420 - DNA, 22 bp, Homo sapiens
caggcgggcaggtgcggcccct

SEQ ID NO: 60421 - DNA, 22 bp, Homo sapiens
aaaaatcacttttataggcagc

SEQ ID NO: 60422 - DNA, 22 bp, Homo sapiens
atgaggcaggagtgcagtggca

SEQ ID NO: 60423 - DNA, 22 bp, Homo sapiens
atgtgggccgtgcgggtgtcct

SEQ ID NO: 60424 - DNA, 22 bp, Homo sapiens
agaggcaggaggttgacttgag

SEQ ID NO: 60425 - DNA, 22 bp, Homo sapiens
agaggcagtatacaatccgagc

SEQ ID NO: 60426 - DNA, 22 bp, Homo sapiens
tgaggcaggagaatcaccggaa

SEQ ID NO: 60427 - DNA, 22 bp, Homo sapiens
gctggccacagatccccaggga

SEQ ID NO: 60428 - DNA, 22 bp, Homo sapiens
atgttgagagctgagatcagcc

SEQ ID NO: 60429 - DNA, 22 bp, Homo sapiens
gaatgctacttgactcagctca

SEQ ID NO: 60430 - DNA, 22 bp, Homo sapiens
tgacctattagatttccttgcc

SEQ ID NO: 60431 - DNA, 22 bp, Homo sapiens
tccgggagctgaacgtcttgcg

SEQ ID NO: 60432 - DNA, 22 bp, Homo sapiens
aggtattattagcatctctatt

SEQ ID NO: 60433 - DNA, 22 bp, Homo sapiens
tttgaggttagctagcagatca

SEQ ID NO: 60434 - DNA, 22 bp, Homo sapiens
ctgtggctctttagttgagcac

SEQ ID NO: 60435 - DNA, 22 bp, Homo sapiens
tctgttttgcataatgttcttt

SEQ ID NO: 60436 - DNA, 22 bp, Homo sapiens
tgaggcaggaggttgagaactg

SEQ ID NO: 60437 - DNA, 22 bp, Homo sapiens
ctcggaatggaacaacagcggt

SEQ ID NO: 60438 - DNA, 22 bp, Homo sapiens
aagctgttgttcatcctgaatt

SEQ ID NO: 60439 - DNA, 22 bp, Homo sapiens
tctgcatattgttaatggaatg

SEQ ID NO: 60440 - DNA, 22 bp, Homo sapiens
aggtggagaagagatgggcagt

SEQ ID NO: 60441 - DNA, 22 bp, Homo sapiens
tgacttgtctctttgggagaca

SEQ ID NO: 60442 - DNA, 22 bp, Homo sapiens
atccaccctgtggtggctttct

SEQ ID NO: 60443 - DNA, 21 bp, Homo sapiens
ggcaagaaacacaatcaagta

SEQ ID NO: 60444 - DNA, 22 bp, Homo sapiens
atccccctgtatctggaagaat

SEQ ID NO: 60445 - DNA, 20 bp, Homo sapiens
tcacatcctctcccaacatg

SEQ ID NO: 60446 - DNA, 22 bp, Homo sapiens
agcgtgaattagttggtacaca

SEQ ID NO: 60447 - DNA, 22 bp, Homo sapiens
tgggctttgagctcggtcacct

SEQ ID NO: 60448 - DNA, 22 bp, Homo sapiens
cactgcaacctccacctcctgg

SEQ ID NO: 60449 - DNA, 22 bp, Homo sapiens
tgacttcctgcactcaggtgat

SEQ ID NO: 60450 - DNA, 22 bp, Homo sapiens
gaggcaggcagattgcttgagg

SEQ ID NO: 60451 - DNA, 22 bp, Homo sapiens
agcctggtttaagcattttata

SEQ ID NO: 60452 - DNA, 22 bp, Homo sapiens
atgaccagccgagataaacaga

SEQ ID NO: 60453 - DNA, 22 bp, Homo sapiens
gtggtgtaggtcacagttagga

SEQ ID NO: 60454 - DNA, 22 bp, Homo sapiens
gcggcaggagtaaaggaggaag

SEQ ID NO: 60455 - DNA, 20 bp, Homo sapiens
aaaatatgtataactcttct

SEQ ID NO: 60456 - DNA, 22 bp, Homo sapiens
agagagcccgggccagggcaca

SEQ ID NO: 60457 - DNA, 22 bp, Homo sapiens
agatcacagtggcaactccctt

SEQ ID NO: 60458 - DNA, 22 bp, Homo sapiens
tctcgatctcctgaccttgtga

SEQ ID NO: 60459 - DNA, 22 bp, Homo sapiens
gtagtcccagctaccccggagg

SEQ ID NO: 60460 - DNA, 17 bp, Homo sapiens
cttgttgagctcgttcc

SEQ ID NO: 60461 - DNA, 22 bp, Homo sapiens
ctggaaggcagaggttgcagtg

SEQ ID NO: 60462 - DNA, 22 bp, Homo sapiens
aagacttgaccaggttgaaggc

SEQ ID NO: 60463 - DNA, 19 bp, Homo sapiens
cgcctggcaggccctgcgc

SEQ ID NO: 60464 - DNA, 22 bp, Homo sapiens
attgcacttcagcctgggtgac

SEQ ID NO: 60465 - DNA, 22 bp, Homo sapiens
acccgggaggcaggagtcatag

SEQ ID NO: 60466 - DNA, 22 bp, Homo sapiens
cgccggcttgaggcaggcggca

SEQ ID NO: 60467 - DNA, 22 bp, Homo sapiens
tcaggtccaagatggccatcca

SEQ ID NO: 60468 - DNA, 22 bp, Homo sapiens
agacaaagaaaccgtagaagca

SEQ ID NO: 60469 - DNA, 22 bp, Homo sapiens
gtgaaatatttaacgtccaggt

SEQ ID NO: 60470 - DNA, 22 bp, Homo sapiens
cagtgggtcctgcgtctgccag

SEQ ID NO: 60471 - DNA, 22 bp, Homo sapiens
attggtagttttgtatttctct

SEQ ID NO: 60472 - DNA, 22 bp, Homo sapiens
ctcctgggaaaggctggacaca

SEQ ID NO: 60473 - DNA, 22 bp, Homo sapiens
gatggcctcatggctgcaggcc

SEQ ID NO: 60474 - DNA, 22 bp, Homo sapiens
gccacctggtggcatcttctgg

SEQ ID NO: 60475 - DNA, 22 bp, Homo sapiens
ggaggcagaatagagtgtgggt

SEQ ID NO: 60476 - DNA, 22 bp, Homo sapiens
attgcactccggcctgggtgac

SEQ ID NO: 60477 - DNA, 22 bp, Homo sapiens
atccccctcttggatggcggca

SEQ ID NO: 60478 - DNA, 22 bp, Homo sapiens
gggacatctttctagtcagggt

SEQ ID NO: 60479 - DNA, 22 bp, Homo sapiens
gttctgagtcctcctttgaagg

SEQ ID NO: 60480 - DNA, 22 bp, Homo sapiens
tgaggcaggacttgcataaagt

SEQ ID NO: 60481 - DNA, 22 bp, Homo sapiens
ttgagggtctggatctgctgct

SEQ ID NO: 60482 - DNA, 22 bp, Homo sapiens
attataggcttgagccaccgtg

SEQ ID NO: 60483 - DNA, 22 bp, Homo sapiens
gcccagtggtaaaagcaggcct

SEQ ID NO: 60484 - DNA, 22 bp, Homo sapiens
gagcaggtgcctgtagctctct

SEQ ID NO: 60485 - DNA, 22 bp, Homo sapiens
ggagagggtaggggtcctgccc

SEQ ID NO: 60486 - DNA, 22 bp, Homo sapiens
gccctcctggcaggcagtgatg

SEQ ID NO: 60487 - DNA, 22 bp, Homo sapiens
caggtgcctcaggatgagacaa

SEQ ID NO: 60488 - DNA, 22 bp, Homo sapiens
gggacaatggaggcctctctcc

SEQ ID NO: 60489 - DNA, 22 bp, Homo sapiens
ttcaccctggaccagaaattgg

SEQ ID NO: 60490 - DNA, 22 bp, Homo sapiens
atgccactgcgctccagcctgg

SEQ ID NO: 60491 - DNA, 22 bp, Homo sapiens
gcatatgatcacgtgtgtcggt

SEQ ID NO: 60492 - DNA, 22 bp, Homo sapiens
tgcctaggctggaatgcagtgg

SEQ ID NO: 60493 - DNA, 22 bp, Homo sapiens
caggtagaggctgccatcagct

SEQ ID NO: 60494 - DNA, 22 bp, Homo sapiens
attgcactccagcctgggtgac

SEQ ID NO: 60495 - DNA, 22 bp, Homo sapiens
tccacagtggttgaactagttt

SEQ ID NO: 60496 - DNA, 22 bp, Homo sapiens
caggccagggttgagaagagaa

SEQ ID NO: 60497 - DNA, 20 bp, Homo sapiens
ggccggggagctctccaggg

SEQ ID NO: 60498 - DNA, 22 bp, Homo sapiens
ggcgtggggccttctgcccgct

SEQ ID NO: 60499 - DNA, 22 bp, Homo sapiens
tctttgctattgtgagtagtgc

SEQ ID NO: 60500 - DNA, 22 bp, Homo sapiens
aaaaaattatcatagttcctga

SEQ ID NO: 60501 - DNA, 22 bp, Homo sapiens
cgtcatcacggcaagcatctcc

SEQ ID NO: 60502 - DNA, 21 bp, Homo sapiens
gggcagaggggcctcctgggt

SEQ ID NO: 60503 - DNA, 22 bp, Homo sapiens
aaggcaggatgggaaaagattt

SEQ ID NO: 60504 - DNA, 22 bp, Homo sapiens
ggcaaggtgctacagacagtga

SEQ ID NO: 60505 - DNA, 22 bp, Homo sapiens
ttttcatttttgtagatgcaag

SEQ ID NO: 60506 - DNA, 22 bp, Homo sapiens
agagcggggatagttaatattc

SEQ ID NO: 60507 - DNA, 22 bp, Homo sapiens
actgttttctgtaaagggccag

SEQ ID NO: 60508 - DNA, 22 bp, Homo sapiens
agcaggagtttgatgcttttat

SEQ ID NO: 60509 - DNA, 22 bp, Homo sapiens
gaggcctcagcctgccctgaac

SEQ ID NO: 60510 - DNA, 22 bp, Homo sapiens
actgccaatggtagtttgatgg

SEQ ID NO: 60511 - DNA, 22 bp, Homo sapiens
gaccttgtgatctgcccacctt

SEQ ID NO: 60512 - DNA, 22 bp, Homo sapiens
agagctaagaaacagaattgct

SEQ ID NO: 60513 - DNA, 22 bp, Homo sapiens
gggtccaggcggcatagttgta

SEQ ID NO: 60514 - DNA, 22 bp, Homo sapiens
atggaaggctttatgactcaaa

SEQ ID NO: 60515 - DNA, 22 bp, Homo sapiens
aacgtcctcacctgtaacttgg

SEQ ID NO: 60516 - DNA, 22 bp, Homo sapiens
gtcctggggattatagagtgtt

SEQ ID NO: 60517 - DNA, 22 bp, Homo sapiens
gctgtgtatcagatgccacggg

SEQ ID NO: 60518 - DNA, 22 bp, Homo sapiens
gcacggctaatttttgtatttt

SEQ ID NO: 60519 - DNA, 22 bp, Homo sapiens
ctccttctgggcctggcagtgg

SEQ ID NO: 60520 - DNA, 22 bp, Homo sapiens
ggcctcacccatcggtgccttt

SEQ ID NO: 60521 - DNA, 22 bp, Homo sapiens
tgttatcctcagctcacctcta

SEQ ID NO: 60522 - DNA, 22 bp, Homo sapiens
tttaaaaaactagtctgagtct

SEQ ID NO: 60523 - DNA, 18 bp, Homo sapiens
cagggctgtggggtcact

SEQ ID NO: 60524 - DNA, 22 bp, Homo sapiens
atacagggacatccagtttttc

SEQ ID NO: 60525 - DNA, 22 bp, Homo sapiens
cttgatgagtcagaactgaagg

SEQ ID NO: 60526 - DNA, 22 bp, Homo sapiens
ttctcccatctcagtcttacat

SEQ ID NO: 60527 - DNA, 22 bp, Homo sapiens
tgcaagtaattccagctactga

SEQ ID NO: 60528 - DNA, 22 bp, Homo sapiens
tgaggcaggaggattgcaggat

SEQ ID NO: 60529 - DNA, 22 bp, Homo sapiens
gggagaggttacccgagcaact

SEQ ID NO: 60530 - DNA, 22 bp, Homo sapiens
tcacttcccagacggggtggca

SEQ ID NO: 60531 - DNA, 22 bp, Homo sapiens
tggccaccaccaatacttgcct

SEQ ID NO: 60532 - DNA, 22 bp, Homo sapiens
aagaaatgtgaatattgaatag

SEQ ID NO: 60533 - DNA, 22 bp, Homo sapiens
cccgagtgtctactcactccca

SEQ ID NO: 60534 - DNA, 22 bp, Homo sapiens
aagatacagacagagccaaaat

SEQ ID NO: 60535 - DNA, 22 bp, Homo sapiens
cctcttctaggacgtccttgtg

SEQ ID NO: 60536 - DNA, 22 bp, Homo sapiens
tacatgctccttatgagaatct

SEQ ID NO: 60537 - DNA, 22 bp, Homo sapiens
ccggcgggcagcggcagtgagc

SEQ ID NO: 60538 - DNA, 23 bp, Homo sapiens
gcagccatgttcccgtctcagct

SEQ ID NO: 60539 - DNA, 22 bp, Homo sapiens
tggaggctggagtgcagtggcg

SEQ ID NO: 60540 - DNA, 22 bp, Homo sapiens
ataaaagatcccttctgagctc

SEQ ID NO: 60541 - DNA, 22 bp, Homo sapiens
ggcctttgcgtccacgccgctt

SEQ ID NO: 60542 - DNA, 22 bp, Homo sapiens
taagcctgcatgaaccatgaga

SEQ ID NO: 60543 - DNA, 22 bp, Homo sapiens
tctgtggcccaagtgatggctg

SEQ ID NO: 60544 - DNA, 22 bp, Homo sapiens
tcctcagcttttatttcacttg

SEQ ID NO: 60545 - DNA, 22 bp, Homo sapiens
cagggtgacaagtggcaaggag

SEQ ID NO: 60546 - DNA, 22 bp, Homo sapiens
gctgaggctcctcgggaggaca

SEQ ID NO: 60547 - DNA, 22 bp, Homo sapiens
tttaatgtagcgtgaaatgatt

SEQ ID NO: 60548 - DNA, 22 bp, Homo sapiens
accctactaaatgtggtatgtc

SEQ ID NO: 60549 - DNA, 22 bp, Homo sapiens
aggctagaggcttctggcttca

SEQ ID NO: 60550 - DNA, 22 bp, Homo sapiens
tgtgttgtgacattcttggatg

SEQ ID NO: 60551 - DNA, 21 bp, Homo sapiens
atctcgggcttctcgcccagc

SEQ ID NO: 60552 - DNA, 22 bp, Homo sapiens
cctggggccccgagccagaagc

SEQ ID NO: 60553 - DNA, 22 bp, Homo sapiens
tggggtacttgtatcaaagcac

SEQ ID NO: 60554 - DNA, 22 bp, Homo sapiens
ttgtgaatagtgccgcaataaa

SEQ ID NO: 60555 - DNA, 22 bp, Homo sapiens
cctttgatttcccccgtctcag

SEQ ID NO: 60556 - DNA, 22 bp, Homo sapiens
agaacagaggccttatgtttca

SEQ ID NO: 60557 - DNA, 22 bp, Homo sapiens
ctcttcctagtgtgcagcgtgg

SEQ ID NO: 60558 - DNA, 22 bp, Homo sapiens
tcactgcaacctccacctcccg

SEQ ID NO: 60559 - DNA, 22 bp, Homo sapiens
ggctcctgggggtgctcctgcc

SEQ ID NO: 60560 - DNA, 22 bp, Homo sapiens
ggagaagaggagctggaagcct

SEQ ID NO: 60561 - DNA, 22 bp, Homo sapiens
ccttgctcaagctagtgacggg

SEQ ID NO: 60562 - DNA, 23 bp, Homo sapiens
catcatgcaatcttgggatttct

SEQ ID NO: 60563 - DNA, 21 bp, Homo sapiens
gggcctggctgcgcaggacgg

SEQ ID NO: 60564 - DNA, 22 bp, Homo sapiens
ttcctgggattattgtcaagca

SEQ ID NO: 60565 - DNA, 22 bp, Homo sapiens
cggtcaggtgcagcgttggcac

SEQ ID NO: 60566 - DNA, 22 bp, Homo sapiens
tttgggcaggcttttccctaga

SEQ ID NO: 60567 - DNA, 22 bp, Homo sapiens
ggcgcacaatgtgcaggtttgt

SEQ ID NO: 60568 - DNA, 22 bp, Homo sapiens
gggaaatctcgtcctctattta

SEQ ID NO: 60569 - DNA, 22 bp, Homo sapiens
atgagctagaaaaccatgtgga

SEQ ID NO: 60570 - DNA, 22 bp, Homo sapiens
ctggcaggttatagagctgccc

SEQ ID NO: 60571 - DNA, 22 bp, Homo sapiens
caggctggagtgcagtggtgcc

SEQ ID NO: 60572 - DNA, 22 bp, Homo sapiens
gctgggttttcttccgggccta

SEQ ID NO: 60573 - DNA, 22 bp, Homo sapiens
acttcttcttcagctgggggat

SEQ ID NO: 60574 - DNA, 23 bp, Homo sapiens
ggagtgcaatggcgccatctcgg

SEQ ID NO: 60575 - DNA, 22 bp, Homo sapiens
atgctatgtaactggcagatag

SEQ ID NO: 60576 - DNA, 22 bp, Homo sapiens
ctgtggctctcagaggctgctg

SEQ ID NO: 60577 - DNA, 22 bp, Homo sapiens
ttgaaaagttttgaaacactct

SEQ ID NO: 60578 - DNA, 22 bp, Homo sapiens
gtccccgacgtttggcttgatg

SEQ ID NO: 60579 - DNA, 22 bp, Homo sapiens
atgccactgcacttcagcttgg

SEQ ID NO: 60580 - DNA, 22 bp, Homo sapiens
tctcccaggcaggagtgcagtg

SEQ ID NO: 60581 - DNA, 22 bp, Homo sapiens
caaggtagttctggtcattgac

SEQ ID NO: 60582 - DNA, 22 bp, Homo sapiens
ggttggtaactccctgtgcagt

SEQ ID NO: 60583 - DNA, 22 bp, Homo sapiens
acaaagtgctgacattacaggc

SEQ ID NO: 60584 - DNA, 22 bp, Homo sapiens
tgggcagggagctggaaccaca

SEQ ID NO: 60585 - DNA, 22 bp, Homo sapiens
tttcttctatgtgtgatatttt

SEQ ID NO: 60586 - DNA, 22 bp, Homo sapiens
atatatttgagaatattcatga

SEQ ID NO: 60587 - DNA, 22 bp, Homo sapiens
gaccatcctggccaacgtggta

SEQ ID NO: 60588 - DNA, 22 bp, Homo sapiens
cccaggctggagtgcagtggcg

SEQ ID NO: 60589 - DNA, 22 bp, Homo sapiens
agtatgtcagagtgaaaatggt

SEQ ID NO: 60590 - DNA, 22 bp, Homo sapiens
agtgaggggcagctgagtgggc

SEQ ID NO: 60591 - DNA, 22 bp, Homo sapiens
gggattacagatgtgagccatt

SEQ ID NO: 60592 - DNA, 22 bp, Homo sapiens
cagtggcgtgatctctgctcac

SEQ ID NO: 60593 - DNA, 22 bp, Homo sapiens
cggctcactgcagctccgcctc

SEQ ID NO: 60594 - DNA, 22 bp, Homo sapiens
cctgagtagctggaattaaagg

SEQ ID NO: 60595 - DNA, 22 bp, Homo sapiens
tgaatgtgatgctaaacatatg

SEQ ID NO: 60596 - DNA, 22 bp, Homo sapiens
tggaagctcaaggcagggtgag

SEQ ID NO: 60597 - DNA, 22 bp, Homo sapiens
gtatgtctatagtttttaaata

SEQ ID NO: 60598 - DNA, 22 bp, Homo sapiens
cctagagctctgctttatctaa

SEQ ID NO: 60599 - DNA, 22 bp, Homo sapiens
gcacggctaatttttgtatttt

SEQ ID NO: 60600 - DNA, 20 bp, Homo sapiens
gtgcaatggcaccatctcag

SEQ ID NO: 60601 - DNA, 22 bp, Homo sapiens
gttgtgaatagtgccgcaataa

SEQ ID NO: 60602 - DNA, 22 bp, Homo sapiens
taacaatacccattctaattac

SEQ ID NO: 60603 - DNA, 22 bp, Homo sapiens
ccagatatcactgccgtgttgt

SEQ ID NO: 60604 - DNA, 22 bp, Homo sapiens
tggacacaaagatcaaatattg

SEQ ID NO: 60605 - DNA, 22 bp, Homo sapiens
tccaccatgtaacaagctctgt

SEQ ID NO: 60606 - DNA, 22 bp, Homo sapiens
ttccatatctgttgcatatcat

SEQ ID NO: 60607 - DNA, 20 bp, Homo sapiens
ttgttagaggaatgccatag

SEQ ID NO: 60608 - DNA, 22 bp, Homo sapiens
ttgtgaatagtgccgctataaa

SEQ ID NO: 60609 - DNA, 22 bp, Homo sapiens
ttgtgaatggtgccgcaataaa

SEQ ID NO: 60610 - DNA, 22 bp, Homo sapiens
gagcagtaggagaaccctgagc

SEQ ID NO: 60611 - DNA, 22 bp, Homo sapiens
gccgggttcaagccattctcct

SEQ ID NO: 60612 - DNA, 22 bp, Homo sapiens
attataggcttgagccaccgtg

SEQ ID NO: 60613 - DNA, 22 bp, Homo sapiens
tgcagattcaaatgaaatgcaa

SEQ ID NO: 60614 - DNA, 23 bp, Homo sapiens
ggagtgcaatggcgccatctcgg

SEQ ID NO: 60615 - DNA, 22 bp, Homo sapiens
tccattatacttctgattcaaa

SEQ ID NO: 60616 - DNA, 22 bp, Homo sapiens
atacaaagtattgatcctgagt

SEQ ID NO: 60617 - DNA, 22 bp, Homo sapiens
gctgtatgtgaggccacagtga

SEQ ID NO: 60618 - DNA, 22 bp, Homo sapiens
tcactgcaacctccacctcccg

SEQ ID NO: 60619 - DNA, 22 bp, Homo sapiens
acgcccagactcccatactttg

SEQ ID NO: 60620 - DNA, 22 bp, Homo sapiens
ttgcacagaatgacaatatgta

SEQ ID NO: 60621 - DNA, 22 bp, Homo sapiens
gatgtgtttccaggatttgttt

SEQ ID NO: 60622 - DNA, 22 bp, Homo sapiens
ctcattgcaacctccgcctccc

SEQ ID NO: 60623 - DNA, 22 bp, Homo sapiens
agtgctatcgagttctaatgct

SEQ ID NO: 60624 - DNA, 22 bp, Homo sapiens
tagcataacaggtaagagtgag

SEQ ID NO: 60625 - DNA, 22 bp, Homo sapiens
ttacaaagtttaaggtggcact

SEQ ID NO: 60626 - DNA, 22 bp, Homo sapiens
acccaggctggagtgcagtggg

SEQ ID NO: 60627 - DNA, 22 bp, Homo sapiens
atgcagtggcttcagtgtcagt

SEQ ID NO: 60628 - DNA, 22 bp, Homo sapiens
actgcaaagggaagccctttct

SEQ ID NO: 60629 - DNA, 22 bp, Homo sapiens
tcgcccaggctggaagtgcagt

SEQ ID NO: 60630 - DNA, 22 bp, Homo sapiens
cttagagatgggttttacttag

SEQ ID NO: 60631 - DNA, 22 bp, Homo sapiens
cccaggctggagtgtaatggtg

SEQ ID NO: 60632 - DNA, 22 bp, Homo sapiens
actgcaacctccacctcctggg

SEQ ID NO: 60633 - DNA, 23 bp, Homo sapiens
ctatttctcatagttcaggtctt

SEQ ID NO: 60634 - DNA, 18 bp, Homo sapiens
cccggctaatttttggta

SEQ ID NO: 60635 - DNA, 16 bp, Homo sapiens
ccacctgcagctctca

SEQ ID NO: 60636 - DNA, 22 bp, Homo sapiens
gagctactgaaatattgatttt

SEQ ID NO: 60637 - DNA, 17 bp, Homo sapiens
tccttcagtgcctctgc

SEQ ID NO: 60638 - DNA, 22 bp, Homo sapiens
accctcaacaaattcactctat

SEQ ID NO: 60639 - DNA, 22 bp, Homo sapiens
atgaccagccgagataaacaga

SEQ ID NO: 60640 - DNA, 22 bp, Homo sapiens
agatgtgtttctagttcctgca

SEQ ID NO: 60641 - DNA, 22 bp, Homo sapiens
tgcctgatgcaggagtatcaga

SEQ ID NO: 60642 - DNA, 22 bp, Homo sapiens
tcctgaagaaggcagatatttg

SEQ ID NO: 60643 - DNA, 22 bp, Homo sapiens
cagcagagaaattacatatttg

SEQ ID NO: 60644 - DNA, 22 bp, Homo sapiens
cctttcctgtgtccttttaagg

SEQ ID NO: 60645 - DNA, 22 bp, Homo sapiens
tttgtgaataggttggcttcca

SEQ ID NO: 60646 - DNA, 22 bp, Homo sapiens
tttcaccatcttggccaggctg

SEQ ID NO: 60647 - DNA, 22 bp, Homo sapiens
gctgggttttcttccgggccta

SEQ ID NO: 60648 - DNA, 22 bp, Homo sapiens
ccatgaattcactccatgctag

SEQ ID NO: 60649 - DNA, 22 bp, Homo sapiens
tgttatcctcagctcacctcta

SEQ ID NO: 60650 - DNA, 22 bp, Homo sapiens
tcactacaacctccgcctcctg

SEQ ID NO: 60651 - DNA, 22 bp, Homo sapiens
gagcactgatttatttttgtct

SEQ ID NO: 60652 - DNA, 22 bp, Homo sapiens
agatcacagtggcaactccctt

SEQ ID NO: 60653 - DNA, 22 bp, Homo sapiens
tgccatagcaatggtaagctga

SEQ ID NO: 60654 - DNA, 22 bp, Homo sapiens
tctcgctctgtcgcccaggctg

SEQ ID NO: 60655 - DNA, 22 bp, Homo sapiens
agcccggcttccccggttgcta

SEQ ID NO: 60656 - DNA, 22 bp, Homo sapiens
tatttcttttcgtgacttattg

SEQ ID NO: 60657 - DNA, 22 bp, Homo sapiens
cggagtcttgctatgttgccca

SEQ ID NO: 60658 - DNA, 21 bp, Homo sapiens
aaactgaccttgcctgagaca

SEQ ID NO: 60659 - DNA, 22 bp, Homo sapiens
tgacttcctgcactcaggtgat

SEQ ID NO: 60660 - DNA, 22 bp, Homo sapiens
tttgaagggcacgacaatagtt

SEQ ID NO: 60661 - DNA, 22 bp, Homo sapiens
tgtgaatggacaattaaatcta

SEQ ID NO: 60662 - DNA, 22 bp, Homo sapiens
acacggcactttaggaaggggc

SEQ ID NO: 60663 - DNA, 22 bp, Homo sapiens
atctccgccatcgcgaacgcct

SEQ ID NO: 60664 - DNA, 23 bp, Homo sapiens
atgtttgcagtaacccatcctgg

SEQ ID NO: 60665 - DNA, 23 bp, Homo sapiens
tcctcgcaggagggagatgatgc

SEQ ID NO: 60666 - DNA, 22 bp, Homo sapiens
cactgcaacctccacctcctgg

SEQ ID NO: 60667 - DNA, 22 bp, Homo sapiens
ggatgttgattgaatggccatt

SEQ ID NO: 60668 - DNA, 22 bp, Homo sapiens
ggtgacctcacctggtcccacc

SEQ ID NO: 60669 - DNA, 22 bp, Homo sapiens
atcctttcatctggtaatatat

SEQ ID NO: 60670 - DNA, 22 bp, Homo sapiens
catgtgaattccaaagctaggt

SEQ ID NO: 60671 - DNA, 22 bp, Homo sapiens
agtggaccagaagactgaagct

SEQ ID NO: 60672 - DNA, 22 bp, Homo sapiens
tctttcattctagtctgaggtt

SEQ ID NO: 60673 - DNA, 20 bp, Homo sapiens
tttgagaccagtctgcccaa

SEQ ID NO: 60674 - DNA, 22 bp, Homo sapiens
tcactgcaacctccacctcctg

SEQ ID NO: 60675 - DNA, 22 bp, Homo sapiens
acccaggctggagtgcagtgat

SEQ ID NO: 60676 - DNA, 22 bp, Homo sapiens
cacccaggctggagtgcagtgg

SEQ ID NO: 60677 - DNA, 22 bp, Homo sapiens
aggctatttccactcttctcat

SEQ ID NO: 60678 - DNA, 22 bp, Homo sapiens
taacagtatatttaccaaacct

SEQ ID NO: 60679 - DNA, 22 bp, Homo sapiens
gatttttatataaagtgagaaa

SEQ ID NO: 60680 - DNA, 22 bp, Homo sapiens
acgcccggtctccatagttttt

SEQ ID NO: 60681 - DNA, 17 bp, Homo sapiens
tcggtttgccaggcttc

SEQ ID NO: 60682 - DNA, 22 bp, Homo sapiens
cttaatctcacctgcaaagtcc

SEQ ID NO: 60683 - DNA, 22 bp, Homo sapiens
acccaggctggcgtgcagtggc

SEQ ID NO: 60684 - DNA, 22 bp, Homo sapiens
tgagaacggatactaagggctg

SEQ ID NO: 60685 - DNA, 22 bp, Homo sapiens
aaaagcaattgcagttcttgcc

SEQ ID NO: 60686 - DNA, 22 bp, Homo sapiens
tctgcaacagtgccctgtaaat

SEQ ID NO: 60687 - DNA, 22 bp, Homo sapiens
ttgtgaatagtgccgcaataaa

SEQ ID NO: 60688 - DNA, 22 bp, Homo sapiens
atgttggccaggctggtcttga

SEQ ID NO: 60689 - DNA, 22 bp, Homo sapiens
aaatgtaagtctttgtttctta

SEQ ID NO: 60690 - DNA, 22 bp, Homo sapiens
ggctcactgcaacttccgcctc

SEQ ID NO: 60691 - DNA, 22 bp, Homo sapiens
ccgaggtcctggacttggccct

SEQ ID NO: 60692 - DNA, 22 bp, Homo sapiens
atgaaatatcttgaagaaattc

SEQ ID NO: 60693 - DNA, 22 bp, Homo sapiens
atacaaagtattaatcctggat

SEQ ID NO: 60694 - DNA, 22 bp, Homo sapiens
tgaagctttaggatgggttcat

SEQ ID NO: 60695 - DNA, 22 bp, Homo sapiens
actgcaacacctcctgggttca

SEQ ID NO: 60696 - DNA, 22 bp, Homo sapiens
tgtctcatctcttaaccccact

SEQ ID NO: 60697 - DNA, 22 bp, Homo sapiens
ctatgaccccagcatgaataag

SEQ ID NO: 60698 - DNA, 21 bp, Homo sapiens
gcagcagtgttctagaatact

SEQ ID NO: 60699 - DNA, 22 bp, Homo sapiens
agggaagcagcagccgcctgtc

SEQ ID NO: 60700 - DNA, 21 bp, Homo sapiens
tccttcagtctagatgattgt

SEQ ID NO: 60701 - DNA, 22 bp, Homo sapiens
accttcaggtgagcacacagat

SEQ ID NO: 60702 - DNA, 22 bp, Homo sapiens
tcaccgaggctggagtgcagtg

SEQ ID NO: 60703 - DNA, 22 bp, Homo sapiens
acatatgcgatcataggatgca

SEQ ID NO: 60704 - DNA, 22 bp, Homo sapiens
attgtgaatagtgccgcagtaa

SEQ ID NO: 60705 - DNA, 22 bp, Homo sapiens
ggagtagctgcattccgagcac

SEQ ID NO: 60706 - DNA, 22 bp, Homo sapiens
acccaggctggagtgcagtggc

SEQ ID NO: 60707 - DNA, 22 bp, Homo sapiens
cacccaggttggagtgcagtgg

SEQ ID NO: 60708 - DNA, 22 bp, Homo sapiens
agcattccacactgaagtctgc

SEQ ID NO: 60709 - DNA, 22 bp, Homo sapiens
ggtcgctgtgtaggttcagcta

SEQ ID NO: 60710 - DNA, 21 bp, Homo sapiens
tagcccttctccacctcgccc

SEQ ID NO: 60711 - DNA, 22 bp, Homo sapiens
cgggttcacgccattctcctgc

SEQ ID NO: 60712 - DNA, 22 bp, Homo sapiens
tttgttttcaatgtgtcattca

SEQ ID NO: 60713 - DNA, 22 bp, Homo sapiens
ttctcttttcaccagttgctaa

SEQ ID NO: 60714 - DNA, 22 bp, Homo sapiens
gtgacaatattagctcaggggc

SEQ ID NO: 60715 - DNA, 22 bp, Homo sapiens
ccaccgccatggcgttgtacag

SEQ ID NO: 60716 - DNA, 22 bp, Homo sapiens
cgtcccgggttcacgccattct

SEQ ID NO: 60717 - DNA, 22 bp, Homo sapiens
ctagttctagatccctgaggaa

SEQ ID NO: 60718 - DNA, 22 bp, Homo sapiens
tgttttaagggtcaactgtcac

SEQ ID NO: 60719 - DNA, 22 bp, Homo sapiens
ggaggaggggtgactgaatgct

SEQ ID NO: 60720 - DNA, 22 bp, Homo sapiens
gcgtctcaaggcccccaggcca

SEQ ID NO: 60721 - DNA, 22 bp, Homo sapiens
atctgagtcaaatatttcattt

SEQ ID NO: 60722 - DNA, 22 bp, Homo sapiens
gccaggcgggtctcaaactcct

SEQ ID NO: 60723 - DNA, 22 bp, Homo sapiens
ttgtcttttgtgggaaatatgg

SEQ ID NO: 60724 - DNA, 22 bp, Homo sapiens
ttgcatagtgctgaggttcggg

SEQ ID NO: 60725 - DNA, 22 bp, Homo sapiens
cagatgtacatgaagggcaatg

SEQ ID NO: 60726 - DNA, 20 bp, Homo sapiens
aactcctagcctcaagtgat

SEQ ID NO: 60727 - DNA, 22 bp, Homo sapiens
gtagagttgagtagtggtaaca

SEQ ID NO: 60728 - DNA, 22 bp, Homo sapiens
ttttcatttttgtagatgcaag

SEQ ID NO: 60729 - DNA, 22 bp, Homo sapiens
tttaatcataagaaggaaaata

SEQ ID NO: 60730 - DNA, 20 bp, Homo sapiens
tttcaccatcttggccaggc

SEQ ID NO: 60731 - DNA, 22 bp, Homo sapiens
tccctagtcgcatctgtggaga

SEQ ID NO: 60732 - DNA, 22 bp, Homo sapiens
gaaagacatagttgcaagatgg

SEQ ID NO: 60733 - DNA, 22 bp, Homo sapiens
gaattttattactagtcaactg

SEQ ID NO: 60734 - DNA, 22 bp, Homo sapiens
tgggaagctgcattttaacaag

SEQ ID NO: 60735 - DNA, 22 bp, Homo sapiens
ttgtggttaaccgcacattttt

SEQ ID NO: 60736 - DNA, 22 bp, Homo sapiens
cacccaggctggagtgcagtga

SEQ ID NO: 60737 - DNA, 22 bp, Homo sapiens
aacgcccgtggttgccaaggta

SEQ ID NO: 60738 - DNA, 22 bp, Homo sapiens
cttgcctttgtcttcaaaggct

SEQ ID NO: 60739 - DNA, 22 bp, Homo sapiens
tggtatgaccgtggtgcaagca

SEQ ID NO: 60740 - DNA, 22 bp, Homo sapiens
cccgactagctgggattacagg

SEQ ID NO: 60741 - DNA, 22 bp, Homo sapiens
atgttgtgtttgactgttaccc

SEQ ID NO: 60742 - DNA, 22 bp, Homo sapiens
agaagcattggaccaggggccc

SEQ ID NO: 60743 - DNA, 22 bp, Homo sapiens
caggagatgacagggaagaacc

SEQ ID NO: 60744 - DNA, 22 bp, Homo sapiens
cgcaccactgaattccagcctg

SEQ ID NO: 60745 - DNA, 22 bp, Homo sapiens
ccacgtccagctaattttcgta

SEQ ID NO: 60746 - DNA, 22 bp, Homo sapiens
gccatcatatcccctgtgacct

SEQ ID NO: 60747 - DNA, 22 bp, Homo sapiens
cactgctacctctgcctcccgg

SEQ ID NO: 60748 - DNA, 22 bp, Homo sapiens
tgaagactcagaagctaagata

SEQ ID NO: 60749 - DNA, 22 bp, Homo sapiens
cagtcaccttgaggactcagac

SEQ ID NO: 60750 - DNA, 20 bp, Homo sapiens
tgggatcgaatcaagtctgt

SEQ ID NO: 60751 - DNA, 22 bp, Homo sapiens
tgggcagggagctggaaccaca

SEQ ID NO: 60752 - DNA, 22 bp, Homo sapiens
cagggccagggacacgctgtca

SEQ ID NO: 60753 - DNA, 22 bp, Homo sapiens
acatttatataactcactagga

SEQ ID NO: 60754 - DNA, 22 bp, Homo sapiens
gccgggttcaagccattctcct

SEQ ID NO: 60755 - DNA, 22 bp, Homo sapiens
tgtctgggagactgatcacccg

SEQ ID NO: 60756 - DNA, 22 bp, Homo sapiens
tgtgctctgactttctcctggt

SEQ ID NO: 60757 - DNA, 22 bp, Homo sapiens
agctggagatgagtgacgtgcc

SEQ ID NO: 60758 - DNA, 22 bp, Homo sapiens
gggtggtggccagcagtgggca

SEQ ID NO: 60759 - DNA, 22 bp, Homo sapiens
tggcccgaagatccgagggtca

SEQ ID NO: 60760 - DNA, 22 bp, Homo sapiens
tgggttagattccgcgaagcag

SEQ ID NO: 60761 - DNA, 22 bp, Homo sapiens
tcactgcaacctccacctcctg

SEQ ID NO: 60762 - DNA, 22 bp, Homo sapiens
ttcactggtcctttataggaac

SEQ ID NO: 60763 - DNA, 22 bp, Homo sapiens
tgagccagaggaggctgtgtgg

SEQ ID NO: 60764 - DNA, 22 bp, Homo sapiens
aaagcagaggttgcagtgagct

SEQ ID NO: 60765 - DNA, 22 bp, Homo sapiens
gcttggccagcagccgggatgc

SEQ ID NO: 60766 - DNA, 22 bp, Homo sapiens
ctggggaacgcagcgagcagcg

SEQ ID NO: 60767 - DNA, 22 bp, Homo sapiens
gagacgtggcctttgcctgagc

SEQ ID NO: 60768 - DNA, 22 bp, Homo sapiens
ctgggaggcagaggttgcagtg

SEQ ID NO: 60769 - DNA, 22 bp, Homo sapiens
gggaagatagtgttgagggccc

SEQ ID NO: 60770 - DNA, 22 bp, Homo sapiens
tctcctggagcccagatgctgg

SEQ ID NO: 60771 - DNA, 22 bp, Homo sapiens
cgtaggtggctcagcacctggg

SEQ ID NO: 60772 - DNA, 22 bp, Homo sapiens
tgagcctgagttcaaggctgca

SEQ ID NO: 60773 - DNA, 22 bp, Homo sapiens
gctctctgcagcctccttggag

SEQ ID NO: 60774 - DNA, 22 bp, Homo sapiens
gcttcaggctgaattcctccta

SEQ ID NO: 60775 - DNA, 22 bp, Homo sapiens
agcaggaaggggatgatgggca

SEQ ID NO: 60776 - DNA, 22 bp, Homo sapiens
ctgggcagctgtatcagggagt

SEQ ID NO: 60777 - DNA, 22 bp, Homo sapiens
gccctcctggcaggcagtgatg

SEQ ID NO: 60778 - DNA, 22 bp, Homo sapiens
cccagcaggaggaggttgcagt

SEQ ID NO: 60779 - DNA, 22 bp, Homo sapiens
tggtattctttctgtagatcat

SEQ ID NO: 60780 - DNA, 22 bp, Homo sapiens
gaggggcacagtaaagggtccc

SEQ ID NO: 60781 - DNA, 22 bp, Homo sapiens
cccaggcttttctcttgcccca

SEQ ID NO: 60782 - DNA, 23 bp, Homo sapiens
ccaagactgttaggagtggggag

SEQ ID NO: 60783 - DNA, 22 bp, Homo sapiens
gcagagctcatgcctgcacctc

SEQ ID NO: 60784 - DNA, 22 bp, Homo sapiens
acactgtgtgacttctgagact

SEQ ID NO: 60785 - DNA, 22 bp, Homo sapiens
agctgctgagccaggctgatgt

SEQ ID NO: 60786 - DNA, 22 bp, Homo sapiens
ggcatagatttctttaggttta

SEQ ID NO: 60787 - DNA, 22 bp, Homo sapiens
gctgggctgcgtcggggaagcc

SEQ ID NO: 60788 - DNA, 22 bp, Homo sapiens
ctttggtcaattgctgcgggga

SEQ ID NO: 60789 - DNA, 22 bp, Homo sapiens
tcctcagaatcacctggcagct

SEQ ID NO: 60790 - DNA, 22 bp, Homo sapiens
gggccatgagaggttcatcaac

SEQ ID NO: 60791 - DNA, 22 bp, Homo sapiens
agccaggatggtctcgatcggc

SEQ ID NO: 60792 - DNA, 22 bp, Homo sapiens
acctcctggcctcaagcaatcc

SEQ ID NO: 60793 - DNA, 22 bp, Homo sapiens
cagtggctggttagggacagga

SEQ ID NO: 60794 - DNA, 22 bp, Homo sapiens
acaaagtgctgacattacaggc

SEQ ID NO: 60795 - DNA, 22 bp, Homo sapiens
ccaggtgtgctctgcagtggat

SEQ ID NO: 60796 - DNA, 22 bp, Homo sapiens
agccagtgcagctggaaattca

SEQ ID NO: 60797 - DNA, 21 bp, Homo sapiens
cagggccaatcctgacctcta

SEQ ID NO: 60798 - DNA, 22 bp, Homo sapiens
cacccaggttggagtgcagtgg

SEQ ID NO: 60799 - DNA, 22 bp, Homo sapiens
ggtgctggacacgtggcactcc

SEQ ID NO: 60800 - DNA, 22 bp, Homo sapiens
ccaggcaggcgatggtgcagtg

SEQ ID NO: 60801 - DNA, 22 bp, Homo sapiens
tgagatggagtctcgctctgtt

SEQ ID NO: 60802 - DNA, 22 bp, Homo sapiens
ctgggttggggttacatgactg

SEQ ID NO: 60803 - DNA, 22 bp, Homo sapiens
ctggaaggcagaggttgcagtg

SEQ ID NO: 60804 - DNA, 22 bp, Homo sapiens
ggggcaggagcccttcttcagc

SEQ ID NO: 60805 - DNA, 22 bp, Homo sapiens
aggtggggaggagtgtctcttt

SEQ ID NO: 60806 - DNA, 22 bp, Homo sapiens
cacccaggctggagagcagtgg

SEQ ID NO: 60807 - DNA, 22 bp, Homo sapiens
gcccaggagttcaagtctagtg

SEQ ID NO: 60808 - DNA, 22 bp, Homo sapiens
cctggggtcacttgcagccgca

SEQ ID NO: 60809 - DNA, 22 bp, Homo sapiens
gggaagagggagctggaatgat

SEQ ID NO: 60810 - DNA, 22 bp, Homo sapiens
gttggggtgctataaaaatgat

SEQ ID NO: 60811 - DNA, 22 bp, Homo sapiens
cagcctgtagtctggtccaggt

SEQ ID NO: 60812 - DNA, 22 bp, Homo sapiens
gtgtgtccaaggcacggatgac

SEQ ID NO: 60813 - DNA, 16 bp, Homo sapiens
tgggtgggaggagcgg

SEQ ID NO: 60814 - DNA, 22 bp, Homo sapiens
ggaggacaggggctgcagcaca

SEQ ID NO: 60815 - DNA, 22 bp, Homo sapiens
acagtctgtcccccaggtgcta

SEQ ID NO: 60816 - DNA, 22 bp, Homo sapiens
gggaaggccttgtcagcggatt

SEQ ID NO: 60817 - DNA, 22 bp, Homo sapiens
aggacgctctcgctgaacttct

SEQ ID NO: 60818 - DNA, 22 bp, Homo sapiens
gaaaagagacagggtgggtgat

SEQ ID NO: 60819 - DNA, 22 bp, Homo sapiens
gtagttctgcagtgtcacctga

SEQ ID NO: 60820 - DNA, 22 bp, Homo sapiens
agctttggcatctgactagccg

SEQ ID NO: 60821 - DNA, 22 bp, Homo sapiens
gctgcagacttctcatctcatt

SEQ ID NO: 60822 - DNA, 22 bp, Homo sapiens
gccggggctggggagagacatg

SEQ ID NO: 60823 - DNA, 22 bp, Homo sapiens
tgtgggtggcatcgtcctggcc

SEQ ID NO: 60824 - DNA, 22 bp, Homo sapiens
tcagcctgctccaagtgctgcc

SEQ ID NO: 60825 - DNA, 22 bp, Homo sapiens
tgtcagggatttccaactcccc

SEQ ID NO: 60826 - DNA, 22 bp, Homo sapiens
gtggctgcagcggctgtggaga

SEQ ID NO: 60827 - DNA, 22 bp, Homo sapiens
tagcataacaggtaagagtgag

SEQ ID NO: 60828 - DNA, 22 bp, Homo sapiens
cagcgtgggatttggaaaccag

SEQ ID NO: 60829 - DNA, 22 bp, Homo sapiens
aatttcggttcaaggcccagtt

SEQ ID NO: 60830 - DNA, 22 bp, Homo sapiens
ggccactgacctacatctgggg

SEQ ID NO: 60831 - DNA, 22 bp, Homo sapiens
ttgctcagtggcagggctggta

SEQ ID NO: 60832 - DNA, 19 bp, Homo sapiens
ggcatggggtccggggacc

SEQ ID NO: 60833 - DNA, 22 bp, Homo sapiens
ggagctcctggcagtgacagag

SEQ ID NO: 60834 - DNA, 22 bp, Homo sapiens
cagagggttgatgtgaggctta

SEQ ID NO: 60835 - DNA, 22 bp, Homo sapiens
ataatacatggttgatcttttc

SEQ ID NO: 60836 - DNA, 22 bp, Homo sapiens
tcgcccaggctggaagtgcagt

SEQ ID NO: 60837 - DNA, 22 bp, Homo sapiens
gctgatcacatttccaaaaccc

SEQ ID NO: 60838 - DNA, 22 bp, Homo sapiens
cgggaaggtggaggttgcagtg

SEQ ID NO: 60839 - DNA, 22 bp, Homo sapiens
aggggaggtgtccccaaatctc

SEQ ID NO: 60840 - DNA, 22 bp, Homo sapiens
ctagggtgtgcagattttgcct

SEQ ID NO: 60841 - DNA, 22 bp, Homo sapiens
tgggaagaggagcactggaatg

SEQ ID NO: 60842 - DNA, 22 bp, Homo sapiens
tcctgggatcaagtgatcctcc

SEQ ID NO: 60843 - DNA, 22 bp, Homo sapiens
agaaagagatgaatgctttaag

SEQ ID NO: 60844 - DNA, 22 bp, Homo sapiens
cagggcctcctaaggcatctaa

SEQ ID NO: 60845 - DNA, 22 bp, Homo sapiens
aatggctctgatgttgttgtga

SEQ ID NO: 60846 - DNA, 22 bp, Homo sapiens
aggctgaggcaagaggatcact

SEQ ID NO: 60847 - DNA, 22 bp, Homo sapiens
cggggaagcggttctggcggta

SEQ ID NO: 60848 - DNA, 22 bp, Homo sapiens
ggagcagggaattacagcgcag

SEQ ID NO: 60849 - DNA, 22 bp, Homo sapiens
cagcctggtccccggctcaccc

SEQ ID NO: 60850 - DNA, 22 bp, Homo sapiens
caggagctcaagaccaccctgg

SEQ ID NO: 60851 - DNA, 22 bp, Homo sapiens
tgtgggagaaggaagcaagctg

SEQ ID NO: 60852 - DNA, 22 bp, Homo sapiens
cggaggttgaggctgcagtgag

SEQ ID NO: 60853 - DNA, 22 bp, Homo sapiens
gagacacaggcacagaagaggc

SEQ ID NO: 60854 - DNA, 22 bp, Homo sapiens
gggtaaatctcttttcatggct

SEQ ID NO: 60855 - DNA, 22 bp, Homo sapiens
gaggaggcttccgggaggcacg

SEQ ID NO: 60856 - DNA, 22 bp, Homo sapiens
tgcagtggcgccatctcagctc

SEQ ID NO: 60857 - DNA, 22 bp, Homo sapiens
tcacccaggctggagtgcagtg

SEQ ID NO: 60858 - DNA, 22 bp, Homo sapiens
cctggagagctcgggccaggca

SEQ ID NO: 60859 - DNA, 22 bp, Homo sapiens
ctggcaggagcattcacagagg

SEQ ID NO: 60860 - DNA, 21 bp, Homo sapiens
agaaggcaaaagcagacatct

SEQ ID NO: 60861 - DNA, 22 bp, Homo sapiens
agtcacagggggcccctgcaac

SEQ ID NO: 60862 - DNA, 22 bp, Homo sapiens
gggacaatggaggcctctctcc

SEQ ID NO: 60863 - DNA, 22 bp, Homo sapiens
tccagggagagccgctgctcca

SEQ ID NO: 60864 - DNA, 22 bp, Homo sapiens
ggggatggaggcgtgtggtcct

SEQ ID NO: 60865 - DNA, 22 bp, Homo sapiens
cgcaggtgaaagaggctgggca

SEQ ID NO: 60866 - DNA, 22 bp, Homo sapiens
acgcccagactcccatactttg

SEQ ID NO: 60867 - DNA, 22 bp, Homo sapiens
aatgttacgatcaacaacacat

SEQ ID NO: 60868 - DNA, 22 bp, Homo sapiens
actgcaacctccgcctgccagg

SEQ ID NO: 60869 - DNA, 22 bp, Homo sapiens
cccaggaggtggagcttgcagt

SEQ ID NO: 60870 - DNA, 22 bp, Homo sapiens
tagaaaagccccagctggaggg

SEQ ID NO: 60871 - DNA, 22 bp, Homo sapiens
cagcctgccgtcagccaggtag

SEQ ID NO: 60872 - DNA, 22 bp, Homo sapiens
ggctttgggggtgtccaagaaa

SEQ ID NO: 60873 - DNA, 22 bp, Homo sapiens
ccccaggacgtggccctcatag

SEQ ID NO: 60874 - DNA, 22 bp, Homo sapiens
ctgggaggcggaggttgcagtg

SEQ ID NO: 60875 - DNA, 22 bp, Homo sapiens
catgtaaagaatttcacacaag

SEQ ID NO: 60876 - DNA, 19 bp, Homo sapiens
ttcagcattatattctagc

SEQ ID NO: 60877 - DNA, 22 bp, Homo sapiens
agcgaggtgagtcctccagctc

SEQ ID NO: 60878 - DNA, 22 bp, Homo sapiens
gccaggctgaggctctggaaga

SEQ ID NO: 60879 - DNA, 22 bp, Homo sapiens
cagtcacaagcgtacctaattt

SEQ ID NO: 60880 - DNA, 22 bp, Homo sapiens
ggagaagaggagctggaagcct

SEQ ID NO: 60881 - DNA, 22 bp, Homo sapiens
ctgggctagaaggaccaggatg

SEQ ID NO: 60882 - DNA, 22 bp, Homo sapiens
aggctctgtcaggcggagcagc

SEQ ID NO: 60883 - DNA, 22 bp, Homo sapiens
actggacagaggaaatatggag

SEQ ID NO: 60884 - DNA, 22 bp, Homo sapiens
cactgcactccagcccgggcaa

SEQ ID NO: 60885 - DNA, 16 bp, Homo sapiens
tggggatggggaagag

SEQ ID NO: 60886 - DNA, 22 bp, Homo sapiens
cagtggcgtgatctctgctcac

SEQ ID NO: 60887 - DNA, 23 bp, Homo sapiens
aggtaggttattgctgctacctg

SEQ ID NO: 60888 - DNA, 22 bp, Homo sapiens
agggaagaaaatccatcgctgc

SEQ ID NO: 60889 - DNA, 22 bp, Homo sapiens
tgtgtctcaagtcagagcatca

SEQ ID NO: 60890 - DNA, 22 bp, Homo sapiens
tgggaggccaaggcaggcggat

SEQ ID NO: 60891 - DNA, 22 bp, Homo sapiens
ttaggatttgaaaaggggcaga

SEQ ID NO: 60892 - DNA, 22 bp, Homo sapiens
caggtgtcggtcaggcggtttt

SEQ ID NO: 60893 - DNA, 22 bp, Homo sapiens
gaggaggcagcctatcccttag

SEQ ID NO: 60894 - DNA, 22 bp, Homo sapiens
aaaaatcacttttataggcagc

SEQ ID NO: 60895 - DNA, 22 bp, Homo sapiens
aacagtgtttttcttcagcact

SEQ ID NO: 60896 - DNA, 22 bp, Homo sapiens
gagctgggcctgcgagtgctgc

SEQ ID NO: 60897 - DNA, 22 bp, Homo sapiens
agagctgggtggacttgtagtt

SEQ ID NO: 60898 - DNA, 22 bp, Homo sapiens
gggagtgggtttggcctaggcc

SEQ ID NO: 60899 - DNA, 22 bp, Homo sapiens
cccagggagagcgcggaggcgg

SEQ ID NO: 60900 - DNA, 22 bp, Homo sapiens
ccagcctggttcagaattggct

SEQ ID NO: 60901 - DNA, 22 bp, Homo sapiens
tcagacaactctggaggctggc

SEQ ID NO: 60902 - DNA, 22 bp, Homo sapiens
gcgctaggcaagtcctttcaac

SEQ ID NO: 60903 - DNA, 22 bp, Homo sapiens
tgttatctgagcaacgtcgacg

SEQ ID NO: 60904 - DNA, 22 bp, Homo sapiens
aggcaaggtgctacagacagtg

SEQ ID NO: 60905 - DNA, 22 bp, Homo sapiens
gcccagcacctctctcagggtt

SEQ ID NO: 60906 - DNA, 22 bp, Homo sapiens
cccagcagtagagctcatatgg

SEQ ID NO: 60907 - DNA, 22 bp, Homo sapiens
aacccgggaggcagaggttgtg

SEQ ID NO: 60908 - DNA, 22 bp, Homo sapiens
tggccgggaagggacagtgtgg

SEQ ID NO: 60909 - DNA, 22 bp, Homo sapiens
caggctggagtgcaatgacgcc

SEQ ID NO: 60910 - DNA, 22 bp, Homo sapiens
ctctgctgtgccgccagggcct

SEQ ID NO: 60911 - DNA, 22 bp, Homo sapiens
aggctgtgtgctccttatgaga

SEQ ID NO: 60912 - DNA, 22 bp, Homo sapiens
agcatttatcttttgtttgagt

SEQ ID NO: 60913 - DNA, 22 bp, Homo sapiens
cgtggggcgggtggacacttgc

SEQ ID NO: 60914 - DNA, 22 bp, Homo sapiens
ctggcaagaaatatatatctta

SEQ ID NO: 60915 - DNA, 22 bp, Homo sapiens
gagcaggaaggccagaagggtc

SEQ ID NO: 60916 - DNA, 22 bp, Homo sapiens
aacctcaaactcttgggcttaa

SEQ ID NO: 60917 - DNA, 22 bp, Homo sapiens
caggaagaccagggctgtggct

SEQ ID NO: 60918 - DNA, 22 bp, Homo sapiens
aacccagggtggaggttgcagt

SEQ ID NO: 60919 - DNA, 22 bp, Homo sapiens
cacctcaggcagcaaagtctca

SEQ ID NO: 60920 - DNA, 22 bp, Homo sapiens
caggaaagggatgggctgccac

SEQ ID NO: 60921 - DNA, 20 bp, Homo sapiens
acgtggccaccagtggctta

SEQ ID NO: 60922 - DNA, 22 bp, Homo sapiens
agtcaggggatctagacttgaa

SEQ ID NO: 60923 - DNA, 22 bp, Homo sapiens
atcccaggcggcacaggttgca

SEQ ID NO: 60924 - DNA, 22 bp, Homo sapiens
agacaaagaaaccgtagaagca

SEQ ID NO: 60925 - DNA, 22 bp, Homo sapiens
ggaggtggaggttgcagtgagc

SEQ ID NO: 60926 - DNA, 22 bp, Homo sapiens
cccaggctggagtgtaatggtg

SEQ ID NO: 60927 - DNA, 22 bp, Homo sapiens
tttgatccgttgctggtgagga

SEQ ID NO: 60928 - DNA, 23 bp, Homo sapiens
tgttccagatacgccttttcctc

SEQ ID NO: 60929 - DNA, 22 bp, Homo sapiens
catggcagctcctccagtgtga

SEQ ID NO: 60930 - DNA, 22 bp, Homo sapiens
cccaggaggcgcaggttgcggt

SEQ ID NO: 60931 - DNA, 22 bp, Homo sapiens
cacagctgaagtagccatgtgg

SEQ ID NO: 60932 - DNA, 22 bp, Homo sapiens
gagcctggagctggaacgaagc

SEQ ID NO: 60933 - DNA, 22 bp, Homo sapiens
atggccaggcacctctggctga

SEQ ID NO: 60934 - DNA, 23 bp, Homo sapiens
cccagaccttgtgctgcccttgg

SEQ ID NO: 60935 - DNA, 22 bp, Homo sapiens
actgcactcctgcctgggtaac

SEQ ID NO: 60936 - DNA, 22 bp, Homo sapiens
tgcctcagctgaggccgctcca

SEQ ID NO: 60937 - DNA, 22 bp, Homo sapiens
gaggtgtcatcaggcagctctg

SEQ ID NO: 60938 - DNA, 22 bp, Homo sapiens
taggctaggctgaaggttttgg

SEQ ID NO: 60939 - DNA, 22 bp, Homo sapiens
gcagcaacgcggccctactgct

SEQ ID NO: 60940 - DNA, 22 bp, Homo sapiens
ggagaggcttccagagtcgtgc

SEQ ID NO: 60941 - DNA, 22 bp, Homo sapiens
cccagttgttgccggctctgga

SEQ ID NO: 60942 - DNA, 22 bp, Homo sapiens
cccaggaggtggagttcacagt

SEQ ID NO: 60943 - DNA, 22 bp, Homo sapiens
tcacagctcactgtagcctcga

SEQ ID NO: 60944 - DNA, 22 bp, Homo sapiens
accctaataatcacagactagt

SEQ ID NO: 60945 - DNA, 22 bp, Homo sapiens
tgtcctcatcctccagtctgtc

SEQ ID NO: 60946 - DNA, 22 bp, Homo sapiens
cctgggaggctgaggctgcagt

SEQ ID NO: 60947 - DNA, 19 bp, Homo sapiens
agggaatccggctgaggga

SEQ ID NO: 60948 - DNA, 22 bp, Homo sapiens
tcacagagttaaaagtttcttt

SEQ ID NO: 60949 - DNA, 22 bp, Homo sapiens
cagggccagcgtctcgggctat

SEQ ID NO: 60950 - DNA, 22 bp, Homo sapiens
ggctgggctccgggagcatgcg

SEQ ID NO: 60951 - DNA, 23 bp, Homo sapiens
aatgggtgcaactatccatgaca

SEQ ID NO: 60952 - DNA, 22 bp, Homo sapiens
attataggcttgagccaccgtg

SEQ ID NO: 60953 - DNA, 22 bp, Homo sapiens
tgtaagtagtaatggaaggaca

SEQ ID NO: 60954 - DNA, 22 bp, Homo sapiens
ggccgctctccggtgtggatct

SEQ ID NO: 60955 - DNA, 22 bp, Homo sapiens
tgtaatattgtagtgacagtac

SEQ ID NO: 60956 - DNA, 22 bp, Homo sapiens
tgggcaggggccctgcttccgt

SEQ ID NO: 60957 - DNA, 22 bp, Homo sapiens
tctagttctagatccctgagga

SEQ ID NO: 60958 - DNA, 22 bp, Homo sapiens
gctgaggtggaggaaggagacc

SEQ ID NO: 60959 - DNA, 22 bp, Homo sapiens
cagagagaatcttggcagctga

SEQ ID NO: 60960 - DNA, 22 bp, Homo sapiens
cctaggagttcgaagctgcagt

SEQ ID NO: 60961 - DNA, 22 bp, Homo sapiens
ccgcccacactaaatatgagcg

SEQ ID NO: 60962 - DNA, 22 bp, Homo sapiens
cgctgcagaagcgtgttcagga

SEQ ID NO: 60963 - DNA, 22 bp, Homo sapiens
gctgctgggatcctgggtctca

SEQ ID NO: 60964 - DNA, 22 bp, Homo sapiens
tggaagacaatttgaaaacatt

SEQ ID NO: 60965 - DNA, 22 bp, Homo sapiens
cagcagagaaattacatatttg

SEQ ID NO: 60966 - DNA, 20 bp, Homo sapiens
gctgaggtggaggaaggaga

SEQ ID NO: 60967 - DNA, 22 bp, Homo sapiens
gccagtggtcactgaggaagaa

SEQ ID NO: 60968 - DNA, 22 bp, Homo sapiens
tgacatgtatatcttacgctat

SEQ ID NO: 60969 - DNA, 21 bp, Homo sapiens
gcccacagtgaggaggatccc

SEQ ID NO: 60970 - DNA, 22 bp, Homo sapiens
cttctacacgtggctgtgccaa

SEQ ID NO: 60971 - DNA, 22 bp, Homo sapiens
ggatgctctgtctcttgctgtt

SEQ ID NO: 60972 - DNA, 22 bp, Homo sapiens
aacccgggaggcggaggttgtg

SEQ ID NO: 60973 - DNA, 22 bp, Homo sapiens
ggttggtaactccctgtgcagt

SEQ ID NO: 60974 - DNA, 22 bp, Homo sapiens
gcatgtgtctttatagcagcat

SEQ ID NO: 60975 - DNA, 22 bp, Homo sapiens
tgctttggacccagggagcgga

SEQ ID NO: 60976 - DNA, 22 bp, Homo sapiens
aggacagagggaccagagccca

SEQ ID NO: 60977 - DNA, 22 bp, Homo sapiens
caggaggattgcttgaggccag

SEQ ID NO: 60978 - DNA, 22 bp, Homo sapiens
aacccgggaggtggaggttatg

SEQ ID NO: 60979 - DNA, 20 bp, Homo sapiens
tcagccattccttacctttc

SEQ ID NO: 60980 - DNA, 22 bp, Homo sapiens
caggtggtcaggcaaggacacg

SEQ ID NO: 60981 - DNA, 22 bp, Homo sapiens
gcctcctgtcccaggctgagga

SEQ ID NO: 60982 - DNA, 22 bp, Homo sapiens
catgtgtcttgctgccctccat

SEQ ID NO: 60983 - DNA, 23 bp, Homo sapiens
ttgtcctctggatcggtttggtt

SEQ ID NO: 60984 - DNA, 22 bp, Homo sapiens
gaagattgaaggctgggaatta

SEQ ID NO: 60985 - DNA, 22 bp, Homo sapiens
aggcgcacagggtgttgatgtg

SEQ ID NO: 60986 - DNA, 22 bp, Homo sapiens
gctgggttttcttccgggccta

SEQ ID NO: 60987 - DNA, 22 bp, Homo sapiens
cccagcaggtcggtgctgcctg

SEQ ID NO: 60988 - DNA, 22 bp, Homo sapiens
tcagaattgtggagaaagggga

SEQ ID NO: 60989 - DNA, 22 bp, Homo sapiens
ttatttgtggcatatgagacga

SEQ ID NO: 60990 - DNA, 22 bp, Homo sapiens
ggcagggcaggaaagtcaggaa

SEQ ID NO: 60991 - DNA, 22 bp, Homo sapiens
ttccagagagttattcccctgg

SEQ ID NO: 60992 - DNA, 22 bp, Homo sapiens
tgtgctggagatcagcttattt

SEQ ID NO: 60993 - DNA, 22 bp, Homo sapiens
cccaggaggcagatgttgcagt

SEQ ID NO: 60994 - DNA, 22 bp, Homo sapiens
gcgtctcaaggcccccaggcca

SEQ ID NO: 60995 - DNA, 22 bp, Homo sapiens
gcccaggaggcagaggttgtgg

SEQ ID NO: 60996 - DNA, 22 bp, Homo sapiens
cccaggaggcagagcttgcagt

SEQ ID NO: 60997 - DNA, 22 bp, Homo sapiens
tcgctgaggctgcacggctgcc

SEQ ID NO: 60998 - DNA, 22 bp, Homo sapiens
agaggctgcacttgctcatgat

SEQ ID NO: 60999 - DNA, 22 bp, Homo sapiens
cactgcactccagcctgggtca

SEQ ID NO: 61000 - DNA, 22 bp, Homo sapiens
ctgccaggattctgtgaacccc

SEQ ID NO: 61001 - DNA, 22 bp, Homo sapiens
ctggccagatgttacgtccaat

SEQ ID NO: 61002 - DNA, 22 bp, Homo sapiens
aggactgggtgcagagggcatc

SEQ ID NO: 61003 - DNA, 23 bp, Homo sapiens
gcctgggagttgcgatctgcccg

SEQ ID NO: 61004 - DNA, 20 bp, Homo sapiens
tgcagcacgggccctttcca

SEQ ID NO: 61005 - DNA, 22 bp, Homo sapiens
tctcgctctgtcgcccaggctg

SEQ ID NO: 61006 - DNA, 22 bp, Homo sapiens
cccaggggttctgagcagcagc

SEQ ID NO: 61007 - DNA, 22 bp, Homo sapiens
gacccaggggcagggagaaagt

SEQ ID NO: 61008 - DNA, 22 bp, Homo sapiens
gggccagtgaacaatgagggaa

SEQ ID NO: 61009 - DNA, 21 bp, Homo sapiens
tgctccaggagggggcagtcc

SEQ ID NO: 61010 - DNA, 22 bp, Homo sapiens
gtggatggccctgcacacaggt

SEQ ID NO: 61011 - DNA, 20 bp, Homo sapiens
ggtggccgtagcgggcggcg

SEQ ID NO: 61012 - DNA, 22 bp, Homo sapiens
gcagggcacaaggacgcacagg

SEQ ID NO: 61013 - DNA, 22 bp, Homo sapiens
gccagggttcgaatccgtatgg

SEQ ID NO: 61014 - DNA, 22 bp, Homo sapiens
acccagccatgttcagttctct

SEQ ID NO: 61015 - DNA, 22 bp, Homo sapiens
cccaggaggtcaaggctgcagt

SEQ ID NO: 61016 - DNA, 22 bp, Homo sapiens
ctgggaggtggaggttgcattg

SEQ ID NO: 61017 - DNA, 19 bp, Homo sapiens
acccagcccaggagtggca

SEQ ID NO: 61018 - DNA, 22 bp, Homo sapiens
tggtggggccagacttcagctc

SEQ ID NO: 61019 - DNA, 22 bp, Homo sapiens
ggctcactgcaacttccgcctc

SEQ ID NO: 61020 - DNA, 22 bp, Homo sapiens
tgcgggttggtggcatatgcag

SEQ ID NO: 61021 - DNA, 22 bp, Homo sapiens
tttgaggttagctagcagatca

SEQ ID NO: 61022 - DNA, 22 bp, Homo sapiens
caggctggagtgcagtggggcg

SEQ ID NO: 61023 - DNA, 22 bp, Homo sapiens
agggtgaatctcacaactctta

SEQ ID NO: 61024 - DNA, 20 bp, Homo sapiens
cagcctgcatcatctgcagc

SEQ ID NO: 61025 - DNA, 22 bp, Homo sapiens
ctggagggctgcagcgaggctg

SEQ ID NO: 61026 - DNA, 22 bp, Homo sapiens
ctgggaggcggagcttgcagtg

SEQ ID NO: 61027 - DNA, 22 bp, Homo sapiens
gaggtaggtgtaggaggcctgc

SEQ ID NO: 61028 - DNA, 22 bp, Homo sapiens
ctgctctgctgatcagtgtctc

SEQ ID NO: 61029 - DNA, 22 bp, Homo sapiens
atagagtgatgtaaggtatgtg

SEQ ID NO: 61030 - DNA, 22 bp, Homo sapiens
cacagacagtgtccctttgttg

SEQ ID NO: 61031 - DNA, 22 bp, Homo sapiens
acaggggcaagggctcacggcc

SEQ ID NO: 61032 - DNA, 22 bp, Homo sapiens
cggaagagggacagcgccagcc

SEQ ID NO: 61033 - DNA, 22 bp, Homo sapiens
gcagctggaagtgacactctgt

SEQ ID NO: 61034 - DNA, 22 bp, Homo sapiens
cccaggaggcagaagttgcagt

SEQ ID NO: 61035 - DNA, 22 bp, Homo sapiens
tgctgggggtagctctgcgtag

SEQ ID NO: 61036 - DNA, 22 bp, Homo sapiens
agctggggctgtggttgtgatt

SEQ ID NO: 61037 - DNA, 22 bp, Homo sapiens
gctcatgactgtaatcccagca

SEQ ID NO: 61038 - DNA, 22 bp, Homo sapiens
tggcgcgacgtgccccctgctt

SEQ ID NO: 61039 - DNA, 22 bp, Homo sapiens
ctgtcctggggaaagccagccc

SEQ ID NO: 61040 - DNA, 22 bp, Homo sapiens
gctgaggctcctcgggaggaca

SEQ ID NO: 61041 - DNA, 22 bp, Homo sapiens
ggtgcagaggagccagctgggg

SEQ ID NO: 61042 - DNA, 22 bp, Homo sapiens
tgactacaacctccacctcccg

SEQ ID NO: 61043 - DNA, 22 bp, Homo sapiens
ttgtcttttgtgggaaatatgg

SEQ ID NO: 61044 - DNA, 16 bp, Homo sapiens
ccacctgcagctctca

SEQ ID NO: 61045 - DNA, 22 bp, Homo sapiens
aggctgagataggtggatcatt

SEQ ID NO: 61046 - DNA, 22 bp, Homo sapiens
actcatgtcctaggagtaaagc

SEQ ID NO: 61047 - DNA, 22 bp, Homo sapiens
ctcctgagctctgaggaagctt

SEQ ID NO: 61048 - DNA, 22 bp, Homo sapiens
taaagattgctcaaaactgtga

SEQ ID NO: 61049 - DNA, 22 bp, Homo sapiens
gcaggaggttgagccaggactg

SEQ ID NO: 61050 - DNA, 22 bp, Homo sapiens
gctggggaggcagcagagaaca

SEQ ID NO: 61051 - DNA, 22 bp, Homo sapiens
tacaacaatttccacattagaa

SEQ ID NO: 61052 - DNA, 22 bp, Homo sapiens
cggctcactgcagctccgcctc

SEQ ID NO: 61053 - DNA, 22 bp, Homo sapiens
agctggtgctcggggagctggc

SEQ ID NO: 61054 - DNA, 22 bp, Homo sapiens
ggttgcaaactcctgggatcaa

SEQ ID NO: 61055 - DNA, 23 bp, Homo sapiens
tcggtgggcgtggaggccgaggc

SEQ ID NO: 61056 - DNA, 22 bp, Homo sapiens
gacaggtgctaagggacctggc

SEQ ID NO: 61057 - DNA, 22 bp, Homo sapiens
tcagtgttaatcagtggtacct

SEQ ID NO: 61058 - DNA, 22 bp, Homo sapiens
ggacagaaaccatatgagtgta

SEQ ID NO: 61059 - DNA, 22 bp, Homo sapiens
ttaaatattatgttgtctgcaa

SEQ ID NO: 61060 - DNA, 22 bp, Homo sapiens
accatgttggccaagctggtct

SEQ ID NO: 61061 - DNA, 22 bp, Homo sapiens
tgctcgaggtccccaccggctc

SEQ ID NO: 61062 - DNA, 22 bp, Homo sapiens
ggaggagcatgagagggtagtg

SEQ ID NO: 61063 - DNA, 22 bp, Homo sapiens
tgcttacgagctattttcactt

SEQ ID NO: 61064 - DNA, 22 bp, Homo sapiens
atacaaaaattagccgggagta

SEQ ID NO: 61065 - DNA, 22 bp, Homo sapiens
gagctcatccccatggtccgtc

SEQ ID NO: 61066 - DNA, 22 bp, Homo sapiens
tttcaggacacctttaaaaacg

SEQ ID NO: 61067 - DNA, 22 bp, Homo sapiens
tagctgggactactggccctgc

SEQ ID NO: 61068 - DNA, 22 bp, Homo sapiens
gcccagcccagaaaggttcgga

SEQ ID NO: 61069 - DNA, 22 bp, Homo sapiens
ggctgggcaggtctgcacaggg

SEQ ID NO: 61070 - DNA, 22 bp, Homo sapiens
tattattgacatttacttggtg

SEQ ID NO: 61071 - DNA, 22 bp, Homo sapiens
cgcagggccgcgagcgggacca

SEQ ID NO: 61072 - DNA, 22 bp, Homo sapiens
ccaggagctggagggtgcagtg

SEQ ID NO: 61073 - DNA, 22 bp, Homo sapiens
tggagggcatgctgtccatggg

SEQ ID NO: 61074 - DNA, 22 bp, Homo sapiens
agctcttacatttaggtctatg

SEQ ID NO: 61075 - DNA, 22 bp, Homo sapiens
aaaatatgtataactcttctgc

SEQ ID NO: 61076 - DNA, 22 bp, Homo sapiens
cagctggcgactctcctcgatg

SEQ ID NO: 61077 - DNA, 22 bp, Homo sapiens
tttgtagcagcatgatttataa

SEQ ID NO: 61078 - DNA, 22 bp, Homo sapiens
gggccctgggattcagagcaag

SEQ ID NO: 61079 - DNA, 22 bp, Homo sapiens
caggctggagttcagtggtgtg

SEQ ID NO: 61080 - DNA, 18 bp, Homo sapiens
tcttccaacactgacacc

SEQ ID NO: 61081 - DNA, 22 bp, Homo sapiens
caaggtgccatgctgggcgggg

SEQ ID NO: 61082 - DNA, 22 bp, Homo sapiens
gagagcaggaggcagcgggacg

SEQ ID NO: 61083 - DNA, 22 bp, Homo sapiens
ccaggctggagtgcagtggcac

SEQ ID NO: 61084 - DNA, 22 bp, Homo sapiens
tattcatagtaaacaaaagtgg

SEQ ID NO: 61085 - DNA, 22 bp, Homo sapiens
cagcccaggactgcaggtgttt

SEQ ID NO: 61086 - DNA, 22 bp, Homo sapiens
gaggccacggaagggagctgtg

SEQ ID NO: 61087 - DNA, 22 bp, Homo sapiens
ttcctagggcagagccgctggg

SEQ ID NO: 61088 - DNA, 22 bp, Homo sapiens
taccagggaacagggatattaa

SEQ ID NO: 61089 - DNA, 22 bp, Homo sapiens
ctcagctgcagcctggctggca

SEQ ID NO: 61090 - DNA, 22 bp, Homo sapiens
gcttctggtgaggcctcaggaa

SEQ ID NO: 61091 - DNA, 22 bp, Homo sapiens
acctggacacctgctgtcatct

SEQ ID NO: 61092 - DNA, 21 bp, Homo sapiens
cactccacttagaacagggtt

SEQ ID NO: 61093 - DNA, 22 bp, Homo sapiens
catgtgtccacccttgaacaca

SEQ ID NO: 61094 - DNA, 22 bp, Homo sapiens
cactgcccaccaagtggctggt

SEQ ID NO: 61095 - DNA, 22 bp, Homo sapiens
cagcctgtcggctccttcattc

SEQ ID NO: 61096 - DNA, 22 bp, Homo sapiens
tgtctggtgggttgacaggcag

SEQ ID NO: 61097 - DNA, 22 bp, Homo sapiens
gtgtgtcccttggaacctcagc

SEQ ID NO: 61098 - DNA, 22 bp, Homo sapiens
gggcataacgggcagccaggtg

SEQ ID NO: 61099 - DNA, 22 bp, Homo sapiens
gttggctatgagagctttagtg

SEQ ID NO: 61100 - DNA, 22 bp, Homo sapiens
ccagtgtgcattatcatgtgtc

SEQ ID NO: 61101 - DNA, 22 bp, Homo sapiens
gggttggatcctggtggctgcc

SEQ ID NO: 61102 - DNA, 22 bp, Homo sapiens
actggggtttaggcctgggcaa

SEQ ID NO: 61103 - DNA, 22 bp, Homo sapiens
cagtggccaacttcctgcctct

SEQ ID NO: 61104 - DNA, 22 bp, Homo sapiens
cactgcacttcagcctgggtga

SEQ ID NO: 61105 - DNA, 22 bp, Homo sapiens
ccctgccttgtctgggctaggt

SEQ ID NO: 61106 - DNA, 22 bp, Homo sapiens
atagaatatgacttttagatcc

SEQ ID NO: 61107 - DNA, 22 bp, Homo sapiens
tcacccaggctggactgcagtg

SEQ ID NO: 61108 - DNA, 22 bp, Homo sapiens
cccaggaggttgaggctgcagt

SEQ ID NO: 61109 - DNA, 22 bp, Homo sapiens
gggaggcacgaggcgcgcagtg

SEQ ID NO: 61110 - DNA, 22 bp, Homo sapiens
gctgcagggagctggaaggctc

SEQ ID NO: 61111 - DNA, 22 bp, Homo sapiens
gcctgcagggcctgggcctacc

SEQ ID NO: 61112 - DNA, 22 bp, Homo sapiens
cacccaggctggagtgcagtgg

SEQ ID NO: 61113 - DNA, 22 bp, Homo sapiens
gcccaggaggagaggctgcagt

SEQ ID NO: 61114 - DNA, 22 bp, Homo sapiens
ctggcaggttatagagctgccc

SEQ ID NO: 61115 - DNA, 22 bp, Homo sapiens
cagtggaggccttgggaccttt

SEQ ID NO: 61116 - DNA, 22 bp, Homo sapiens
ggaggtggagctggaagttcca

SEQ ID NO: 61117 - DNA, 22 bp, Homo sapiens
ttctagtgtccttggacttgct

SEQ ID NO: 61118 - DNA, 22 bp, Homo sapiens
gttgcagatgtggaactcgtgc

SEQ ID NO: 61119 - DNA, 21 bp, Homo sapiens
gttctacagttttagaattcc

SEQ ID NO: 61120 - DNA, 22 bp, Homo sapiens
ggggtcggggcatagccactta

SEQ ID NO: 61121 - DNA, 22 bp, Homo sapiens
tccagcagtccatgtgagacac

SEQ ID NO: 61122 - DNA, 22 bp, Homo sapiens
tcggggtctttgacacgctctg

SEQ ID NO: 61123 - DNA, 19 bp, Homo sapiens
tcctgcctggggccgcctg

SEQ ID NO: 61124 - DNA, 22 bp, Homo sapiens
gattcactcatattttacgttt

SEQ ID NO: 61125 - DNA, 22 bp, Homo sapiens
gcccagccacagtcactttcat

SEQ ID NO: 61126 - DNA, 22 bp, Homo sapiens
aaagatcacgtcccaggactcg

SEQ ID NO: 61127 - DNA, 22 bp, Homo sapiens
gcagtgccgaaggtagtggttg

SEQ ID NO: 61128 - DNA, 22 bp, Homo sapiens
tggatggctgtggtctttgccc

SEQ ID NO: 61129 - DNA, 22 bp, Homo sapiens
gagtggctattgatccgtgatg

SEQ ID NO: 61130 - DNA, 22 bp, Homo sapiens
agcccaggagtttgaggctgtg

SEQ ID NO: 61131 - DNA, 22 bp, Homo sapiens
ttatgatttgccacagattggt

SEQ ID NO: 61132 - DNA, 22 bp, Homo sapiens
gataccagacagggagggagaa

SEQ ID NO: 61133 - DNA, 22 bp, Homo sapiens
gcctccagcccacgcaggcctg

SEQ ID NO: 61134 - DNA, 22 bp, Homo sapiens
aggctagaggcttctggcttca

SEQ ID NO: 61135 - DNA, 22 bp, Homo sapiens
aggtggcagatgggggtgctcg

SEQ ID NO: 61136 - DNA, 22 bp, Homo sapiens
ccaggaggcggaggttgcagtg

SEQ ID NO: 61137 - DNA, 22 bp, Homo sapiens
ggctcacgcaattatcccggcc

SEQ ID NO: 61138 - DNA, 22 bp, Homo sapiens
ccaggaggcggaaggtacagtg

SEQ ID NO: 61139 - DNA, 22 bp, Homo sapiens
ttcctggaaattatgctcacct

SEQ ID NO: 61140 - DNA, 21 bp, Homo sapiens
ctcccagggtgactgttcaac

SEQ ID NO: 61141 - DNA, 22 bp, Homo sapiens
agaggaagtaatcaggacctgc

SEQ ID NO: 61142 - DNA, 22 bp, Homo sapiens
cagggtttcaccatgttagcag

SEQ ID NO: 61143 - DNA, 22 bp, Homo sapiens
ttgcatagtgctgaggttcggg

SEQ ID NO: 61144 - DNA, 22 bp, Homo sapiens
agcccaggttgaggctgcagtg

SEQ ID NO: 61145 - DNA, 22 bp, Homo sapiens
gctctgagtcacactgccctgt

SEQ ID NO: 61146 - DNA, 22 bp, Homo sapiens
gctggaggatggactggaagaa

SEQ ID NO: 61147 - DNA, 22 bp, Homo sapiens
gggtccagtagttggtggccgt

SEQ ID NO: 61148 - DNA, 22 bp, Homo sapiens
caggaaggggctcactctggcc

SEQ ID NO: 61149 - DNA, 22 bp, Homo sapiens
caggctggagtgcagtggcgcc

SEQ ID NO: 61150 - DNA, 22 bp, Homo sapiens
ttggagatatcacaccttcaca

SEQ ID NO: 61151 - DNA, 19 bp, Homo sapiens
gcagacaggtccagagagg

SEQ ID NO: 61152 - DNA, 22 bp, Homo sapiens
cctgagtagctggaattaaagg

SEQ ID NO: 61153 - DNA, 22 bp, Homo sapiens
cccaggagttggaggctgcagt

SEQ ID NO: 61154 - DNA, 22 bp, Homo sapiens
ctgggctcaagtgatccaccca

SEQ ID NO: 61155 - DNA, 22 bp, Homo sapiens
atctggttcttcttaggcatca

SEQ ID NO: 61156 - DNA, 22 bp, Homo sapiens
cagggggctcaaaggagagtgc

SEQ ID NO: 61157 - DNA, 22 bp, Homo sapiens
aggagcaccattgtgctggtgt

SEQ ID NO: 61158 - DNA, 22 bp, Homo sapiens
aggggcgtgctcttccccgacg

SEQ ID NO: 61159 - DNA, 22 bp, Homo sapiens
tgcacgtgggctctctgctctt

SEQ ID NO: 61160 - DNA, 22 bp, Homo sapiens
atatatttgagaatattcatga

SEQ ID NO: 61161 - DNA, 22 bp, Homo sapiens
agagtgtaccaaatatcctaca

SEQ ID NO: 61162 - DNA, 22 bp, Homo sapiens
cccaggaggcggaggttgcagt

SEQ ID NO: 61163 - DNA, 22 bp, Homo sapiens
cactgcactccatcctgggaaa

SEQ ID NO: 61164 - DNA, 22 bp, Homo sapiens
ctaggtgatccactgctctctt

SEQ ID NO: 61165 - DNA, 20 bp, Homo sapiens
ataaaataactgccacaaga

SEQ ID NO: 61166 - DNA, 22 bp, Homo sapiens
tggcttccccggagtgacatgt

SEQ ID NO: 61167 - DNA, 22 bp, Homo sapiens
gtatggcactatcctctctgat

SEQ ID NO: 61168 - DNA, 22 bp, Homo sapiens
cactgcactccagcctgggtga

SEQ ID NO: 61169 - DNA, 22 bp, Homo sapiens
attggtggtgaggacatgccag

SEQ ID NO: 61170 - DNA, 22 bp, Homo sapiens
tggaaagaaagtaaaggcgtat

SEQ ID NO: 61171 - DNA, 22 bp, Homo sapiens
agcccaggtccagttcactgca

SEQ ID NO: 61172 - DNA, 22 bp, Homo sapiens
ctggctcctgtttaaccagctg

SEQ ID NO: 61173 - DNA, 22 bp, Homo sapiens
caggaacagggtgtcctggcag

SEQ ID NO: 61174 - DNA, 22 bp, Homo sapiens
ggattgcaacaagctagtttag

SEQ ID NO: 61175 - DNA, 22 bp, Homo sapiens
ggcaggaggtgagtggcgggtg

SEQ ID NO: 61176 - DNA, 22 bp, Homo sapiens
ccaggaggttgaggctgcagtg

SEQ ID NO: 61177 - DNA, 22 bp, Homo sapiens
gaggggagcccccatcctccag

SEQ ID NO: 61178 - DNA, 22 bp, Homo sapiens
accagcctggccaacatggtga

SEQ ID NO: 61179 - DNA, 19 bp, Homo sapiens
tccaggggctccacctcct

SEQ ID NO: 61180 - DNA, 22 bp, Homo sapiens
acagcagcaatagcagtgacat

SEQ ID NO: 61181 - DNA, 22 bp, Homo sapiens
ctgggaggcggaggttgtagtg

SEQ ID NO: 61182 - DNA, 23 bp, Homo sapiens
aaacttgctatggctgaaatcat

SEQ ID NO: 61183 - DNA, 22 bp, Homo sapiens
cccaggggttcaaggctgcagt

SEQ ID NO: 61184 - DNA, 19 bp, Homo sapiens
aggctaaagagtcttgcgt

SEQ ID NO: 61185 - DNA, 22 bp, Homo sapiens
cgtgctgggtctgcggggccgt

SEQ ID NO: 61186 - DNA, 22 bp, Homo sapiens
gagctcattcattcattgcctg

SEQ ID NO: 61187 - DNA, 22 bp, Homo sapiens
gacagacacaattgatccatga

SEQ ID NO: 61188 - DNA, 21 bp, Homo sapiens
cagaggcctatcacagactcc

SEQ ID NO: 61189 - DNA, 22 bp, Homo sapiens
tgttccagatttagccaaccga

SEQ ID NO: 61190 - DNA, 22 bp, Homo sapiens
ctgggcgcgtcccctgaggcgg

SEQ ID NO: 61191 - DNA, 22 bp, Homo sapiens
gtaaactattctttcaggagct

SEQ ID NO: 61192 - DNA, 22 bp, Homo sapiens
cccaggaggtcgaagctgcagt

SEQ ID NO: 61193 - DNA, 20 bp, Homo sapiens
aactcctagcctcaagtgat

SEQ ID NO: 61194 - DNA, 22 bp, Homo sapiens
ggtggctgcaatggctaacttc

SEQ ID NO: 61195 - DNA, 22 bp, Homo sapiens
agaaacgcctgtgaaattatct

SEQ ID NO: 61196 - DNA, 22 bp, Homo sapiens
tgggaggccgaggcaggtggat

SEQ ID NO: 61197 - DNA, 22 bp, Homo sapiens
ggttccacctggcgaggggtat

SEQ ID NO: 61198 - DNA, 22 bp, Homo sapiens
atatacacatctttttaaatat

SEQ ID NO: 61199 - DNA, 22 bp, Homo sapiens
ggctgggcctctccctcagctg

SEQ ID NO: 61200 - DNA, 22 bp, Homo sapiens
tgagatggagtctcactctgtt

SEQ ID NO: 61201 - DNA, 18 bp, Homo sapiens
cagggctgtggggtcact

SEQ ID NO: 61202 - DNA, 22 bp, Homo sapiens
tgtagatattaattattccttt

SEQ ID NO: 61203 - DNA, 22 bp, Homo sapiens
ccaggggggcgtagatgctggg

SEQ ID NO: 61204 - DNA, 22 bp, Homo sapiens
tgcctgttgcccacctgataaa

SEQ ID NO: 61205 - DNA, 22 bp, Homo sapiens
gatctcaaagcagtgtgggttg

SEQ ID NO: 61206 - DNA, 22 bp, Homo sapiens
caggcagaagaagtggaaggac

SEQ ID NO: 61207 - DNA, 22 bp, Homo sapiens
actgcaacctccacctcctggg

SEQ ID NO: 61208 - DNA, 22 bp, Homo sapiens
ccaggaggtggagattgcagtg

SEQ ID NO: 61209 - DNA, 22 bp, Homo sapiens
gggcagagagctggaactcctt

SEQ ID NO: 61210 - DNA, 22 bp, Homo sapiens
gggaggcagtgctggaggctgg

SEQ ID NO: 61211 - DNA, 22 bp, Homo sapiens
caggaggacatactggctcaca

SEQ ID NO: 61212 - DNA, 22 bp, Homo sapiens
gcaggtggatcacctgaggtca

SEQ ID NO: 61213 - DNA, 22 bp, Homo sapiens
ccaggaggtggaggttgcggtg

SEQ ID NO: 61214 - DNA, 22 bp, Homo sapiens
tcccagaaccctgccaggtcct

SEQ ID NO: 61215 - DNA, 22 bp, Homo sapiens
actaaagctcacagagttgaac

SEQ ID NO: 61216 - DNA, 22 bp, Homo sapiens
tgatcaaaacattactccacca

SEQ ID NO: 61217 - DNA, 22 bp, Homo sapiens
tcctgccttgcctgggacatca

SEQ ID NO: 61218 - DNA, 22 bp, Homo sapiens
cagagctgtccaaaccctgaca

SEQ ID NO: 61219 - DNA, 20 bp, Homo sapiens
gccactgggcaccagcaggg

SEQ ID NO: 61220 - DNA, 22 bp, Homo sapiens
caggctggagtgcagtggtgcc

SEQ ID NO: 61221 - DNA, 22 bp, Homo sapiens
aggtggagaagagatgggcagt

SEQ ID NO: 61222 - DNA, 22 bp, Homo sapiens
cagcaggaggtgagtagcaggt

SEQ ID NO: 61223 - DNA, 22 bp, Homo sapiens
gcacggctaatttttgtatttt

SEQ ID NO: 61224 - DNA, 22 bp, Homo sapiens
attgtgtcctcattgaccttca

SEQ ID NO: 61225 - DNA, 22 bp, Homo sapiens
atacaaaatatatactggagac

SEQ ID NO: 61226 - DNA, 22 bp, Homo sapiens
tcactgcaacctccacctcccg

SEQ ID NO: 61227 - DNA, 22 bp, Homo sapiens
agcagagcaaagctcagaaatg

SEQ ID NO: 61228 - DNA, 22 bp, Homo sapiens
tgagcctgggagatggaggctg

SEQ ID NO: 61229 - DNA, 20 bp, Homo sapiens
gctgaggggtctatggcata

SEQ ID NO: 61230 - DNA, 22 bp, Homo sapiens
agtggcgtcctaggaaaggagg

SEQ ID NO: 61231 - DNA, 22 bp, Homo sapiens
aaggaaagctgtggttctgaga

SEQ ID NO: 61232 - DNA, 22 bp, Homo sapiens
tggcctcggcatccagcaagag

SEQ ID NO: 61233 - DNA, 22 bp, Homo sapiens
ttctgcagtgttaacaatgtca

SEQ ID NO: 61234 - DNA, 22 bp, Homo sapiens
gggtcgggcaggcgccctcgtc

SEQ ID NO: 61235 - DNA, 22 bp, Homo sapiens
cgcgaggtggaggttgcagtga

SEQ ID NO: 61236 - DNA, 22 bp, Homo sapiens
cttagagatgggttttacttag

SEQ ID NO: 61237 - DNA, 22 bp, Homo sapiens
ccagtgtgcaatctctggctta

SEQ ID NO: 61238 - DNA, 22 bp, Homo sapiens
tgctgggctggggcctcagacc

SEQ ID NO: 61239 - DNA, 22 bp, Homo sapiens
actttatttcctattgcatcca

SEQ ID NO: 61240 - DNA, 22 bp, Homo sapiens
actgcactccagcctgggtaac

SEQ ID NO: 61241 - DNA, 22 bp, Homo sapiens
accagcctggccaacatggcaa

SEQ ID NO: 61242 - DNA, 22 bp, Homo sapiens
gatgaggcataaacacagtcac

SEQ ID NO: 61243 - DNA, 22 bp, Homo sapiens
cagtggcctctggctttgctgt

SEQ ID NO: 61244 - DNA, 22 bp, Homo sapiens
aggcggaagatggccccataga

SEQ ID NO: 61245 - DNA, 22 bp, Homo sapiens
gctgcagtgagccaagatcgtg

SEQ ID NO: 61246 - DNA, 22 bp, Homo sapiens
ttaagctagtgaagtccctcaa

SEQ ID NO: 61247 - DNA, 22 bp, Homo sapiens
atctggttttggctgtgtccct

SEQ ID NO: 61248 - DNA, 22 bp, Homo sapiens
aaggagtctgggccattcagag

SEQ ID NO: 61249 - DNA, 22 bp, Homo sapiens
caggccagggttgagaagagaa

SEQ ID NO: 61250 - DNA, 19 bp, Homo sapiens
aggcttcaggccacatgct

SEQ ID NO: 61251 - DNA, 22 bp, Homo sapiens
gtagctctgtttaaagttcttt

SEQ ID NO: 61252 - DNA, 22 bp, Homo sapiens
actgcaaagggaagccctttct

SEQ ID NO: 61253 - DNA, 22 bp, Homo sapiens
gccttgtttctctcccagataa

SEQ ID NO: 61254 - DNA, 22 bp, Homo sapiens
agagtggctctgctgggcacag

SEQ ID NO: 61255 - DNA, 22 bp, Homo sapiens
cccaggaggcagagatagcagt

SEQ ID NO: 61256 - DNA, 22 bp, Homo sapiens
gggaggttgaggctgcagtgag

SEQ ID NO: 61257 - DNA, 22 bp, Homo sapiens
gagaggtggaggttgcagtgag

SEQ ID NO: 61258 - DNA, 22 bp, Homo sapiens
tggtggctaccaggtcctgggg

SEQ ID NO: 61259 - DNA, 22 bp, Homo sapiens
gagccaggggtcagctccgagg

SEQ ID NO: 61260 - DNA, 22 bp, Homo sapiens
ttggaagacaatgctgattctc

SEQ ID NO: 61261 - DNA, 22 bp, Homo sapiens
gggagctgagctggaagagaat

SEQ ID NO: 61262 - DNA, 22 bp, Homo sapiens
ggctttgacatgctgaattaaa

SEQ ID NO: 61263 - DNA, 22 bp, Homo sapiens
caggaagctgtgaaggagacgg

SEQ ID NO: 61264 - DNA, 22 bp, Homo sapiens
tcgcaccattgcactccagcca

SEQ ID NO: 61265 - DNA, 22 bp, Homo sapiens
ggcttcagtggccagagatgat

SEQ ID NO: 61266 - DNA, 23 bp, Homo sapiens
cgcccagcctcagtgacctgggc

SEQ ID NO: 61267 - DNA, 22 bp, Homo sapiens
cggagtcttgctatgttgccca

SEQ ID NO: 61268 - DNA, 22 bp, Homo sapiens
ttgatcaaatcagctactgagg

SEQ ID NO: 61269 - DNA, 22 bp, Homo sapiens
caggagtgtctccacacagcaa

SEQ ID NO: 61270 - DNA, 22 bp, Homo sapiens
cttgggaggcagaggttgcagt

SEQ ID NO: 61271 - DNA, 22 bp, Homo sapiens
tgcctaggctggagtgcaatgg

SEQ ID NO: 61272 - DNA, 22 bp, Homo sapiens
tgtctttgttattgtggacagg

SEQ ID NO: 61273 - DNA, 22 bp, Homo sapiens
gaggtggccaagcgaggaaggg

SEQ ID NO: 61274 - DNA, 22 bp, Homo sapiens
gatttttatataaagtgagaaa

SEQ ID NO: 61275 - DNA, 22 bp, Homo sapiens
tcaggggcttgaggtgcatgtc

SEQ ID NO: 61276 - DNA, 19 bp, Homo sapiens
cccaggaagcggaggttgc

SEQ ID NO: 61277 - DNA, 22 bp, Homo sapiens
ctcctgaattgtccctcacagc

SEQ ID NO: 61278 - DNA, 22 bp, Homo sapiens
tagactggtgaattagggggaa

SEQ ID NO: 61279 - DNA, 22 bp, Homo sapiens
cctctgtgtctccaagaggcct

SEQ ID NO: 61280 - DNA, 22 bp, Homo sapiens
cctgccagagcagcttgtcctc

SEQ ID NO: 61281 - DNA, 22 bp, Homo sapiens
ctgagctcaagcgatcctccca

SEQ ID NO: 61282 - DNA, 20 bp, Homo sapiens
catgtgtcagttctcaccca

SEQ ID NO: 61283 - DNA, 22 bp, Homo sapiens
cccaggaattggaggctgcagt

SEQ ID NO: 61284 - DNA, 22 bp, Homo sapiens
agggaagaggaccagagtctct

SEQ ID NO: 61285 - DNA, 22 bp, Homo sapiens
gaggagggagctggaagctctt

SEQ ID NO: 61286 - DNA, 22 bp, Homo sapiens
gagcctcgtggcggccactgcg

SEQ ID NO: 61287 - DNA, 22 bp, Homo sapiens
tgaacatgctgttgatggcctg

SEQ ID NO: 61288 - DNA, 22 bp, Homo sapiens
ctgggaagaagggacaacagcg

SEQ ID NO: 61289 - DNA, 23 bp, Homo sapiens
tcgttgaatagcaatagcacaac

SEQ ID NO: 61290 - DNA, 22 bp, Homo sapiens
agtggccagcagcctagcctag

SEQ ID NO: 61291 - DNA, 21 bp, Homo sapiens
gaacccagcagcagtgctctg

SEQ ID NO: 61292 - DNA, 22 bp, Homo sapiens
agtccgtcctgtcaagcagctg

SEQ ID NO: 61293 - DNA, 22 bp, Homo sapiens
tttaaaaaactagtctgagtct

SEQ ID NO: 61294 - DNA, 22 bp, Homo sapiens
gacctcatgatccacctgcctt

SEQ ID NO: 61295 - DNA, 22 bp, Homo sapiens
tttgcttcacaagtatggttct

SEQ ID NO: 61296 - DNA, 22 bp, Homo sapiens
cctcgacctccccaggctcagg

SEQ ID NO: 61297 - DNA, 22 bp, Homo sapiens
cgcaccactgaattccagcctg

SEQ ID NO: 61298 - DNA, 18 bp, Homo sapiens
ggtgagggagctggaagc

SEQ ID NO: 61299 - DNA, 22 bp, Homo sapiens
tgagtcagccttggcagcccct

SEQ ID NO: 61300 - DNA, 22 bp, Homo sapiens
gagccaggttggaggctgcagt

SEQ ID NO: 61301 - DNA, 22 bp, Homo sapiens
gcaggtggatcaccacgtcagg

SEQ ID NO: 61302 - DNA, 22 bp, Homo sapiens
agggccagcactcctggcagga

SEQ ID NO: 61303 - DNA, 22 bp, Homo sapiens
cttgcctacttgtcaaccagca

SEQ ID NO: 61304 - DNA, 22 bp, Homo sapiens
gccccagcctcccgagtagctg

SEQ ID NO: 61305 - DNA, 22 bp, Homo sapiens
cacggtggcccacaggtgcaag

SEQ ID NO: 61306 - DNA, 22 bp, Homo sapiens
gttattgaggtggagtctcact

SEQ ID NO: 61307 - DNA, 22 bp, Homo sapiens
gggctgggattgcttgctgtga

SEQ ID NO: 61308 - DNA, 22 bp, Homo sapiens
caggctggagtgcagtggcgct

SEQ ID NO: 61309 - DNA, 22 bp, Homo sapiens
gcaaaagtacagccggatttct

SEQ ID NO: 61310 - DNA, 20 bp, Homo sapiens
agagatggggtatcaccgta

SEQ ID NO: 61311 - DNA, 22 bp, Homo sapiens
tttgattgtcacctaccttgca

SEQ ID NO: 61312 - DNA, 22 bp, Homo sapiens
ttggaaacgtcaccttttcctt

SEQ ID NO: 61313 - DNA, 22 bp, Homo sapiens
aaagcagaactgagagagctgg

SEQ ID NO: 61314 - DNA, 22 bp, Homo sapiens
agctttggttgccatgatctga

SEQ ID NO: 61315 - DNA, 19 bp, Homo sapiens
tcctggggaggggcatggc

SEQ ID NO: 61316 - DNA, 22 bp, Homo sapiens
tgctccagcaccaagagctcca

SEQ ID NO: 61317 - DNA, 22 bp, Homo sapiens
aaacccagggttttgtcttccc

SEQ ID NO: 61318 - DNA, 22 bp, Homo sapiens
ggctcaatgcaacttctgcctc

SEQ ID NO: 61319 - DNA, 22 bp, Homo sapiens
ggttcccggatctccgagtccc

SEQ ID NO: 61320 - DNA, 20 bp, Homo sapiens
ttgagcttttagtacagaca

SEQ ID NO: 61321 - DNA, 22 bp, Homo sapiens
aaggaggcctggcagatgaaga

SEQ ID NO: 61322 - DNA, 22 bp, Homo sapiens
acccagggctcaagcgtaggca

SEQ ID NO: 61323 - DNA, 22 bp, Homo sapiens
aaggtgggtggatcacgaggtc

SEQ ID NO: 61324 - DNA, 22 bp, Homo sapiens
ctacaaaagtaattgtggtttt

SEQ ID NO: 61325 - DNA, 22 bp, Homo sapiens
agcataagttggtacagccact

SEQ ID NO: 61326 - DNA, 22 bp, Homo sapiens
attctacatgatagaagggaga

SEQ ID NO: 61327 - DNA, 22 bp, Homo sapiens
agaagccaccagctgaggaaga

SEQ ID NO: 61328 - DNA, 17 bp, Homo sapiens
gggcagggactcctggg

SEQ ID NO: 61329 - DNA, 22 bp, Homo sapiens
catgctgggtaaaggtggtgaa

SEQ ID NO: 61330 - DNA, 22 bp, Homo sapiens
cccaggaggtggaggctgcagt

SEQ ID NO: 61331 - DNA, 22 bp, Homo sapiens
cgggttcacgccattctcctgc

SEQ ID NO: 61332 - DNA, 22 bp, Homo sapiens
ctctgtggtggagtgggtcacc

SEQ ID NO: 61333 - DNA, 22 bp, Homo sapiens
ggaacagttgcgtcatgggcct

SEQ ID NO: 61334 - DNA, 22 bp, Homo sapiens
gagatgggcgagaaggtggact

SEQ ID NO: 61335 - DNA, 22 bp, Homo sapiens
tctttggtttctgtctctgtaa

SEQ ID NO: 61336 - DNA, 22 bp, Homo sapiens
tcaggaggtccgcccgggaggg

SEQ ID NO: 61337 - DNA, 22 bp, Homo sapiens
cgtgccactgcactctagcctg

SEQ ID NO: 61338 - DNA, 20 bp, Homo sapiens
agcagagtgcccatcccgga

SEQ ID NO: 61339 - DNA, 22 bp, Homo sapiens
cagtgggtcctgcgtctgccag

SEQ ID NO: 61340 - DNA, 22 bp, Homo sapiens
cccaggctggagtgcagtggcg

SEQ ID NO: 61341 - DNA, 22 bp, Homo sapiens
acagacaagtagttcagacaag

SEQ ID NO: 61342 - DNA, 22 bp, Homo sapiens
tgagccaggagtttgaggctgt

SEQ ID NO: 61343 - DNA, 22 bp, Homo sapiens
tcctggcaaagatgttggtgtt

SEQ ID NO: 61344 - DNA, 22 bp, Homo sapiens
tcaggaggcggaggttgcagtg

SEQ ID NO: 61345 - DNA, 22 bp, Homo sapiens
cacccaggctggagtgcagtga

SEQ ID NO: 61346 - DNA, 22 bp, Homo sapiens
ccaggaggcagaagttgcagtg

SEQ ID NO: 61347 - DNA, 22 bp, Homo sapiens
agcagcagtgttctggaattct

SEQ ID NO: 61348 - DNA, 22 bp, Homo sapiens
gagaaagctaaataagttgatt

SEQ ID NO: 61349 - DNA, 22 bp, Homo sapiens
tgttgcccaggttctctcctgc

SEQ ID NO: 61350 - DNA, 22 bp, Homo sapiens
tccagctgaggtggcctctgtg

SEQ ID NO: 61351 - DNA, 22 bp, Homo sapiens
ggagtgtcccgattttccaggt

SEQ ID NO: 61352 - DNA, 22 bp, Homo sapiens
ttaggctgttcttgtgttgtta

SEQ ID NO: 61353 - DNA, 22 bp, Homo sapiens
atgttgtgtttgactgttaccc

SEQ ID NO: 61354 - DNA, 22 bp, Homo sapiens
ctggcctaggaatggttttccg

SEQ ID NO: 61355 - DNA, 22 bp, Homo sapiens
ttgcaattgctatggagagcgt

SEQ ID NO: 61356 - DNA, 22 bp, Homo sapiens
agaagcagaaactgggcttgtg

SEQ ID NO: 61357 - DNA, 22 bp, Homo sapiens
ctgaggagaggtggcctgtgtt

SEQ ID NO: 61358 - DNA, 22 bp, Homo sapiens
gggcaggggtcagtggccccaa

SEQ ID NO: 61359 - DNA, 22 bp, Homo sapiens
acatacttctttacattccata

SEQ ID NO: 61360 - DNA, 22 bp, Homo sapiens
gcgggccaccttggagagcgct

SEQ ID NO: 61361 - DNA, 22 bp, Homo sapiens
acccaggagacggaggtgcagt

SEQ ID NO: 61362 - DNA, 22 bp, Homo sapiens
ccaggaggcggaggttgcagcg

SEQ ID NO: 61363 - DNA, 17 bp, Homo sapiens
ggctgcagtccaggagg

SEQ ID NO: 61364 - DNA, 22 bp, Homo sapiens
aggagctgtcagagtgccagag

SEQ ID NO: 61365 - DNA, 22 bp, Homo sapiens
ctctcgccagcggggctgcgct

SEQ ID NO: 61366 - DNA, 22 bp, Homo sapiens
cgcccacgaagtaggtggcatt

SEQ ID NO: 61367 - DNA, 22 bp, Homo sapiens
ggagatatttgtattctgtctc

SEQ ID NO: 61368 - DNA, 21 bp, Homo sapiens
ggccagtggaattttatgtca

SEQ ID NO: 61369 - DNA, 22 bp, Homo sapiens
tcttcctggatgggggttgatg

SEQ ID NO: 61370 - DNA, 19 bp, Homo sapiens
gctgaggtggaggaaggag

SEQ ID NO: 61371 - DNA, 22 bp, Homo sapiens
ggggtgggcgtgcagggacacc

SEQ ID NO: 61372 - DNA, 22 bp, Homo sapiens
ttgcatcttctggttgagcccc

SEQ ID NO: 61373 - DNA, 22 bp, Homo sapiens
ggaggtgggctaaggactctct

SEQ ID NO: 61374 - DNA, 19 bp, Homo sapiens
gttggcactgaaaatggct

SEQ ID NO: 61375 - DNA, 22 bp, Homo sapiens
cattcattacactcataaggtt

SEQ ID NO: 61376 - DNA, 22 bp, Homo sapiens
gcgagaaactaagtgccctttg

SEQ ID NO: 61377 - DNA, 22 bp, Homo sapiens
gtagggttggagagcacaacca

SEQ ID NO: 61378 - DNA, 22 bp, Homo sapiens
tggaagactcaaggtggtgaat

SEQ ID NO: 61379 - DNA, 22 bp, Homo sapiens
agtgctgggctatctactgcta

SEQ ID NO: 61380 - DNA, 22 bp, Homo sapiens
cactgcactccagcctgggaga

SEQ ID NO: 61381 - DNA, 22 bp, Homo sapiens
cacagagatggtctggcaggtg

SEQ ID NO: 61382 - DNA, 22 bp, Homo sapiens
ccttgctcaagctagtgacggg

SEQ ID NO: 61383 - DNA, 22 bp, Homo sapiens
cagagctggtgtgtcctggcat

SEQ ID NO: 61384 - DNA, 22 bp, Homo sapiens
ctgggaggcagaggttgtagtg

SEQ ID NO: 61385 - DNA, 22 bp, Homo sapiens
aacccaggagacaggttgcagt

SEQ ID NO: 61386 - DNA, 22 bp, Homo sapiens
agcaggagtttgatgcttttat

SEQ ID NO: 61387 - DNA, 22 bp, Homo sapiens
gacaggaggcagagctcaggtg

SEQ ID NO: 61388 - DNA, 22 bp, Homo sapiens
ttatatgtttctgtttggaggc

SEQ ID NO: 61389 - DNA, 22 bp, Homo sapiens
ccgggagcaggcgccaccgcca

SEQ ID NO: 61390 - DNA, 22 bp, Homo sapiens
tccgaggccaaagctgtgaata

SEQ ID NO: 61391 - DNA, 22 bp, Homo sapiens
gcagccagagggggtgtgatca

SEQ ID NO: 61392 - DNA, 17 bp, Homo sapiens
tggtccaggtggagcca

SEQ ID NO: 61393 - DNA, 22 bp, Homo sapiens
agtgcaggccccaggccaggcc

SEQ ID NO: 61394 - DNA, 22 bp, Homo sapiens
tgtgtggattcatctcaaagag

SEQ ID NO: 61395 - DNA, 22 bp, Homo sapiens
cactgcaacctccacctcctgg

SEQ ID NO: 61396 - DNA, 22 bp, Homo sapiens
atgttctacagatggaaagggg

SEQ ID NO: 61397 - DNA, 22 bp, Homo sapiens
tctgctggaaaaccagggaatt

SEQ ID NO: 61398 - DNA, 22 bp, Homo sapiens
gcccagtggtaaaagcaggcct

SEQ ID NO: 61399 - DNA, 22 bp, Homo sapiens
tcttgaattgtactcccataag

SEQ ID NO: 61400 - DNA, 22 bp, Homo sapiens
tccgggcaactgaagggaggtt

SEQ ID NO: 61401 - DNA, 22 bp, Homo sapiens
gagcacagtaaagcagtgtcac

SEQ ID NO: 61402 - DNA, 22 bp, Homo sapiens
aatggccagacagatggctgct

SEQ ID NO: 61403 - DNA, 18 bp, Homo sapiens
cccggctaatttttggta

SEQ ID NO: 61404 - DNA, 22 bp, Homo sapiens
tccaagatctacagcagtttag

SEQ ID NO: 61405 - DNA, 22 bp, Homo sapiens
aaattgtaatgacttcacttga

SEQ ID NO: 61406 - DNA, 22 bp, Homo sapiens
cacagctgtgagaagggagcct

SEQ ID NO: 61407 - DNA, 22 bp, Homo sapiens
gtggtgtaggtcacagttagga

SEQ ID NO: 61408 - DNA, 22 bp, Homo sapiens
ggtgttgcagttgaagactggt

SEQ ID NO: 61409 - DNA, 22 bp, Homo sapiens
tgattcatcagaataggagttt

SEQ ID NO: 61410 - DNA, 22 bp, Homo sapiens
ctgcatccatgttgctgcaaag

SEQ ID NO: 61411 - DNA, 22 bp, Homo sapiens
tagtttcatctccaccctgccc

SEQ ID NO: 61412 - DNA, 22 bp, Homo sapiens
tcagcctggcaggatggcctgg

SEQ ID NO: 61413 - DNA, 22 bp, Homo sapiens
cggggccctggggctgaaggtc

SEQ ID NO: 61414 - DNA, 22 bp, Homo sapiens
gtgcttgacgtgtagccgcccc

SEQ ID NO: 61415 - DNA, 22 bp, Homo sapiens
caggaaggcgcggctgtgcctg

SEQ ID NO: 61416 - DNA, 22 bp, Homo sapiens
gtgctggatgaaataactggaa

SEQ ID NO: 61417 - DNA, 21 bp, Homo sapiens
ctggaggcaggtggtgccagg

SEQ ID NO: 61418 - DNA, 20 bp, Homo sapiens
aaattactgccacacatttc

SEQ ID NO: 61419 - DNA, 22 bp, Homo sapiens
aggtgtctggacttgtgaagca

SEQ ID NO: 61420 - DNA, 22 bp, Homo sapiens
gttcaagaccagcctggccaac

SEQ ID NO: 61421 - DNA, 22 bp, Homo sapiens
tccaggctttggggcaggagcg

SEQ ID NO: 61422 - DNA, 22 bp, Homo sapiens
tcagcctccgaaagtgctggga

SEQ ID NO: 61423 - DNA, 22 bp, Homo sapiens
ggccactgctctccagcctggg

SEQ ID NO: 61424 - DNA, 23 bp, Homo sapiens
gacagagtgagaccttgtcttac

SEQ ID NO: 61425 - DNA, 22 bp, Homo sapiens
gaccagtcattactcatgccct

SEQ ID NO: 61426 - DNA, 22 bp, Homo sapiens
gggagctggagctggaagactc

SEQ ID NO: 61427 - DNA, 22 bp, Homo sapiens
cacatgaaggctggggtcgtga

SEQ ID NO: 61428 - DNA, 22 bp, Homo sapiens
gtgaccatcatctcagctagtt

SEQ ID NO: 61429 - DNA, 22 bp, Homo sapiens
agttattgagtgcagagcaggg

SEQ ID NO: 61430 - DNA, 22 bp, Homo sapiens
aagcagagaatctgggagcgag

SEQ ID NO: 61431 - DNA, 22 bp, Homo sapiens
tttattggatatttacaagata

SEQ ID NO: 61432 - DNA, 22 bp, Homo sapiens
ctgagctcacgccattctcctt

SEQ ID NO: 61433 - DNA, 23 bp, Homo sapiens
actctcaggttctttccagcagg

SEQ ID NO: 61434 - DNA, 22 bp, Homo sapiens
aggggagccagggctgcgagtt

SEQ ID NO: 61435 - DNA, 22 bp, Homo sapiens
gcagtggggcaatcatagctca

SEQ ID NO: 61436 - DNA, 22 bp, Homo sapiens
tgcagaaacaagccatcattca

SEQ ID NO: 61437 - DNA, 22 bp, Homo sapiens
agtggcctggagccccgcctgg

SEQ ID NO: 61438 - DNA, 18 bp, Homo sapiens
atggtctcatactgggag

SEQ ID NO: 61439 - DNA, 22 bp, Homo sapiens
tacaaaaaattgatactgacga

SEQ ID NO: 61440 - DNA, 22 bp, Homo sapiens
agcctagggttctgatgtcact

SEQ ID NO: 61441 - DNA, 22 bp, Homo sapiens
tccaccatgtaacaagctctgt

SEQ ID NO: 61442 - DNA, 21 bp, Homo sapiens
agtagtttagcacagggtttg

SEQ ID NO: 61443 - DNA, 22 bp, Homo sapiens
cagtgatatttatcctactcac

SEQ ID NO: 61444 - DNA, 22 bp, Homo sapiens
taagaaatttagttatagaatg

SEQ ID NO: 61445 - DNA, 21 bp, Homo sapiens
ctacttaagtaggggattagg

SEQ ID NO: 61446 - DNA, 22 bp, Homo sapiens
actttatttcctattgcatcca

SEQ ID NO: 61447 - DNA, 20 bp, Homo sapiens
gccactgggcaccagcaggg

SEQ ID NO: 61448 - DNA, 22 bp, Homo sapiens
aagaaatgtgaatattgaatag

SEQ ID NO: 61449 - DNA, 20 bp, Homo sapiens
tcactgtaacatttgggggg

SEQ ID NO: 61450 - DNA, 22 bp, Homo sapiens
tcaaaatgccgagtgcccaggt

SEQ ID NO: 61451 - DNA, 22 bp, Homo sapiens
gtgaattacatgtatttttaag

SEQ ID NO: 61452 - DNA, 22 bp, Homo sapiens
attgtgaatagtgccgcagtaa

SEQ ID NO: 61453 - DNA, 22 bp, Homo sapiens
cctcatcgtttccagaatgtgg

SEQ ID NO: 61454 - DNA, 22 bp, Homo sapiens
gcttggccagcagccgggatgc

SEQ ID NO: 61455 - DNA, 22 bp, Homo sapiens
tccgaggccaaagctgtgaata

SEQ ID NO: 61456 - DNA, 22 bp, Homo sapiens
tttattctgtgctacatgaaga

SEQ ID NO: 61457 - DNA, 22 bp, Homo sapiens
agctcttacatttaggtctatg

SEQ ID NO: 61458 - DNA, 22 bp, Homo sapiens
agtccgtcctgtcaagcagctg

SEQ ID NO: 61459 - DNA, 22 bp, Homo sapiens
agcagcagtatccttccccggc

SEQ ID NO: 61460 - DNA, 22 bp, Homo sapiens
cactgcactccagcccgggcaa

SEQ ID NO: 61461 - DNA, 21 bp, Homo sapiens
tgctccaggagggggcagtcc

SEQ ID NO: 61462 - DNA, 22 bp, Homo sapiens
ccaggcaggcgatggtgcagtg

SEQ ID NO: 61463 - DNA, 22 bp, Homo sapiens
cacagctgaagtagccatgtgg

SEQ ID NO: 61464 - DNA, 22 bp, Homo sapiens
ggaggcggaggttgcagtgagc

SEQ ID NO: 61465 - DNA, 22 bp, Homo sapiens
ggttccacctggcgaggggtat

SEQ ID NO: 61466 - DNA, 22 bp, Homo sapiens
gacaggtgctaagggacctggc

SEQ ID NO: 61467 - DNA, 22 bp, Homo sapiens
gtaatagtctcaaactcctgga

SEQ ID NO: 61468 - DNA, 22 bp, Homo sapiens
gccctcctggcaggcagtgatg

SEQ ID NO: 61469 - DNA, 22 bp, Homo sapiens
tgactacaacctccacctcccg

SEQ ID NO: 61470 - DNA, 22 bp, Homo sapiens
ggcagggcaggaaagtcaggaa

SEQ ID NO: 61471 - DNA, 22 bp, Homo sapiens
tctagttctagatccctgagga

SEQ ID NO: 61472 - DNA, 22 bp, Homo sapiens
ccccaggacgtggccctcatag

SEQ ID NO: 61473 - DNA, 22 bp, Homo sapiens
gaggccacggaagggagctgtg

SEQ ID NO: 61474 - DNA, 22 bp, Homo sapiens
ctgcagggagaggggacagcct

SEQ ID NO: 61475 - DNA, 22 bp, Homo sapiens
cctggaggcggaggttgcagtg

SEQ ID NO: 61476 - DNA, 22 bp, Homo sapiens
aggctgagataggtggatcatt

SEQ ID NO: 61477 - DNA, 22 bp, Homo sapiens
cacctcaggcagcaaagtctca

SEQ ID NO: 61478 - DNA, 22 bp, Homo sapiens
tgcagtggcgccatctcagctc

SEQ ID NO: 61479 - DNA, 22 bp, Homo sapiens
gcgtccccatcatccagccgta

SEQ ID NO: 61480 - DNA, 22 bp, Homo sapiens
gtggctgcagcggctgtggaga

SEQ ID NO: 61481 - DNA, 19 bp, Homo sapiens
gcagacaggtccagagagg

SEQ ID NO: 61482 - DNA, 22 bp, Homo sapiens
tgggcagggagctggaaccaca

SEQ ID NO: 61483 - DNA, 22 bp, Homo sapiens
ggcttcagtggccagagatgat

SEQ ID NO: 61484 - DNA, 19 bp, Homo sapiens
agggaatccggctgaggga

SEQ ID NO: 61485 - DNA, 22 bp, Homo sapiens
cagtggcgtgatctctgctcac

SEQ ID NO: 61486 - DNA, 22 bp, Homo sapiens
gaggtgtcatcaggcagctctg

SEQ ID NO: 61487 - DNA, 22 bp, Homo sapiens
ttgtgaatggtgccgcaataaa

SEQ ID NO: 61488 - DNA, 19 bp, Homo sapiens
gttggcactgaaaatggct

SEQ ID NO: 61489 - DNA, 22 bp, Homo sapiens
cactgcacttcagcctgggtga

SEQ ID NO: 61490 - DNA, 22 bp, Homo sapiens
cagcagcagtgttctagaatct

SEQ ID NO: 61491 - DNA, 22 bp, Homo sapiens
cctgagtagctggaattaaagg

SEQ ID NO: 61492 - DNA, 22 bp, Homo sapiens
ctgctctgctgatcagtgtctc

SEQ ID NO: 61493 - DNA, 22 bp, Homo sapiens
agcccaggagtttgaggctgtg

SEQ ID NO: 61494 - DNA, 22 bp, Homo sapiens
gccagggttcgaatccgtatgg

SEQ ID NO: 61495 - DNA, 22 bp, Homo sapiens
cggggccctggggctgaaggtc

SEQ ID NO: 61496 - DNA, 22 bp, Homo sapiens
gggcagagagctggaactcctt

SEQ ID NO: 61497 - DNA, 23 bp, Homo sapiens
ccaagactgttaggagtggggag

SEQ ID NO: 61498 - DNA, 22 bp, Homo sapiens
tgcctaggctggagtgcaatgg

SEQ ID NO: 61499 - DNA, 22 bp, Homo sapiens
ccaggagctggagggtgcagtg

SEQ ID NO: 61500 - DNA, 22 bp, Homo sapiens
cactgcactccagcctgggtca

SEQ ID NO: 61501 - DNA, 22 bp, Homo sapiens
gcctgcagggcctgggcctacc

SEQ ID NO: 61502 - DNA, 22 bp, Homo sapiens
actgcaacctccgcctgccagg

SEQ ID NO: 61503 - DNA, 22 bp, Homo sapiens
agtgctgtctccttcccccggg

SEQ ID NO: 61504 - DNA, 22 bp, Homo sapiens
tcgctgaggctgcacggctgcc

SEQ ID NO: 61505 - DNA, 22 bp, Homo sapiens
ctgccaggattctgtgaacccc

SEQ ID NO: 61506 - DNA, 22 bp, Homo sapiens
agcaacctcatgagagtgaaat

SEQ ID NO: 61507 - DNA, 23 bp, Homo sapiens
gacagagtgagaccttgtcttac

SEQ ID NO: 61508 - DNA, 22 bp, Homo sapiens
actcaaatagcaacggtgagaa

SEQ ID NO: 61509 - DNA, 22 bp, Homo sapiens
ccagctttatagcttcaaagga

SEQ ID NO: 61510 - DNA, 22 bp, Homo sapiens
tgacatgtatatcttacgctat

SEQ ID NO: 61511 - DNA, 22 bp, Homo sapiens
ggagtgtcccgattttccaggt

SEQ ID NO: 61512 - DNA, 22 bp, Homo sapiens
cccgtgtgtgcgaggctcccgc

SEQ ID NO: 61513 - DNA, 22 bp, Homo sapiens
cttgcctacttgtcaaccagca

SEQ ID NO: 61514 - DNA, 22 bp, Homo sapiens
cactgcactccatcctgggaaa

SEQ ID NO: 61515 - DNA, 22 bp, Homo sapiens
cactgcccaccaagtggctggt

SEQ ID NO: 61516 - DNA, 22 bp, Homo sapiens
gtgtgtccaaggcacggatgac

SEQ ID NO: 61517 - DNA, 22 bp, Homo sapiens
agtcacagggggcccctgcaac

SEQ ID NO: 61518 - DNA, 22 bp, Homo sapiens
tgctccagcaccaagagctcca

SEQ ID NO: 61519 - DNA, 22 bp, Homo sapiens
agtgctatcgagttctaatgct

SEQ ID NO: 61520 - DNA, 22 bp, Homo sapiens
ttaggatttgaaaaggggcaga

SEQ ID NO: 61521 - DNA, 22 bp, Homo sapiens
tcacagagttaaaagtttcttt

SEQ ID NO: 61522 - DNA, 22 bp, Homo sapiens
acctggaggcagaggttgcagt

SEQ ID NO: 61523 - DNA, 22 bp, Homo sapiens
ttcttttaattgtgggggagtg

SEQ ID NO: 61524 - DNA, 22 bp, Homo sapiens
gattcactcatattttacgttt

SEQ ID NO: 61525 - DNA, 22 bp, Homo sapiens
aaacttttttaggttcataggc

SEQ ID NO: 61526 - DNA, 22 bp, Homo sapiens
acacttggagcaacacttatgg

SEQ ID NO: 61527 - DNA, 22 bp, Homo sapiens
ttgtgaatagtgccgctataaa

SEQ ID NO: 61528 - DNA, 22 bp, Homo sapiens
ccaggggggcgtagatgctggg

SEQ ID NO: 61529 - DNA, 22 bp, Homo sapiens
agcctagggttctgatgtcact

SEQ ID NO: 61530 - DNA, 18 bp, Homo sapiens
atggtctcatactgggag

SEQ ID NO: 61531 - DNA, 22 bp, Homo sapiens
gttggctatgagagctttagtg

SEQ ID NO: 61532 - DNA, 23 bp, Homo sapiens
aggatgtaggatgtatggcagag

SEQ ID NO: 61533 - DNA, 22 bp, Homo sapiens
agcagcttgaggctggattcca

SEQ ID NO: 61534 - DNA, 22 bp, Homo sapiens
cgttaataggtgcaaggtaagg

SEQ ID NO: 61535 - DNA, 22 bp, Homo sapiens
ggaggcggaagttgcagtgagc

SEQ ID NO: 61536 - DNA, 22 bp, Homo sapiens
aactcaaagatgcatgacgctt

SEQ ID NO: 61537 - DNA, 21 bp, Homo sapiens
cctcaagtgcctcctgctgct

SEQ ID NO: 61538 - DNA, 20 bp, Homo sapiens
caggtccagcacgtgcacgg

SEQ ID NO: 61539 - DNA, 22 bp, Homo sapiens
ccagtgtgcaatctctggctta

SEQ ID NO: 61540 - DNA, 22 bp, Homo sapiens
tctcgctctgtcgcccaggctg

SEQ ID NO: 61541 - DNA, 22 bp, Homo sapiens
tttgattgtcacctaccttgca

SEQ ID NO: 61542 - DNA, 22 bp, Homo sapiens
gctgaggctcctcgggaggaca

SEQ ID NO: 61543 - DNA, 22 bp, Homo sapiens
tgggcaggggccctgcttccgt

SEQ ID NO: 61544 - DNA, 22 bp, Homo sapiens
acccaggagacggaggtgcagt

SEQ ID NO: 61545 - DNA, 22 bp, Homo sapiens
gtggggtagatctttctcagga

SEQ ID NO: 61546 - DNA, 22 bp, Homo sapiens
ccctggaggttgaggctgcagt

SEQ ID NO: 61547 - DNA, 22 bp, Homo sapiens
aggactgggtgcagagggcatc

SEQ ID NO: 61548 - DNA, 22 bp, Homo sapiens
ctgggaggcggagcttgcagtg

SEQ ID NO: 61549 - DNA, 20 bp, Homo sapiens
acgtggccaccagtggctta

SEQ ID NO: 61550 - DNA, 22 bp, Homo sapiens
gcatgtgtctttatagcagcat

SEQ ID NO: 61551 - DNA, 22 bp, Homo sapiens
tgtcctcatcctccagtctgtc

SEQ ID NO: 61552 - DNA, 22 bp, Homo sapiens
gaggcagaggttgcagtgagct

SEQ ID NO: 61553 - DNA, 22 bp, Homo sapiens
ggaggcggaggctgcagtgagc

SEQ ID NO: 61554 - DNA, 22 bp, Homo sapiens
cagcccgccctgaactttcggg

SEQ ID NO: 61555 - DNA, 17 bp, Homo sapiens
cactagtagtctctggc

SEQ ID NO: 61556 - DNA, 22 bp, Homo sapiens
ggccgctctccggtgtggatct

SEQ ID NO: 61557 - DNA, 22 bp, Homo sapiens
gcccaggaggagaggctgcagt

SEQ ID NO: 61558 - DNA, 22 bp, Homo sapiens
gcctccagcccacgcaggcctg

SEQ ID NO: 61559 - DNA, 22 bp, Homo sapiens
ttggagatatcacaccttcaca

SEQ ID NO: 61560 - DNA, 22 bp, Homo sapiens
actaggggctcaggcccaggga

SEQ ID NO: 61561 - DNA, 20 bp, Homo sapiens
catgtgtcagttctcaccca

SEQ ID NO: 61562 - DNA, 22 bp, Homo sapiens
cagcagcagtggctgcagaaca

SEQ ID NO: 61563 - DNA, 22 bp, Homo sapiens
acaggggcaagggctcacggcc

SEQ ID NO: 61564 - DNA, 22 bp, Homo sapiens
tcctgggatcaagtgatcctcc

SEQ ID NO: 61565 - DNA, 22 bp, Homo sapiens
ccctggaggcggagcttgcagt

SEQ ID NO: 61566 - DNA, 22 bp, Homo sapiens
agtggcctggagccccgcctgg

SEQ ID NO: 61567 - DNA, 22 bp, Homo sapiens
aatttgtataaaatggtgtttt

SEQ ID NO: 61568 - DNA, 22 bp, Homo sapiens
tcacccaggctggagtgcagtg

SEQ ID NO: 61569 - DNA, 22 bp, Homo sapiens
tactgtactgcagttctgcaaa

SEQ ID NO: 61570 - DNA, 22 bp, Homo sapiens
atacttctttagcatattgaac

SEQ ID NO: 61571 - DNA, 22 bp, Homo sapiens
agaagccaccagctgaggaaga

SEQ ID NO: 61572 - DNA, 22 bp, Homo sapiens
ttgtgaatagtgccgcaataaa

SEQ ID NO: 61573 - DNA, 22 bp, Homo sapiens
aggctgaggcaagaggatcact

SEQ ID NO: 61574 - DNA, 22 bp, Homo sapiens
tgcttttagctagtaactagta

SEQ ID NO: 61575 - DNA, 22 bp, Homo sapiens
gggacaatggaggcctctctcc

SEQ ID NO: 61576 - DNA, 17 bp, Homo sapiens
gggcagggactcctggg

SEQ ID NO: 61577 - DNA, 22 bp, Homo sapiens
tcttagaaattccccagtggct

SEQ ID NO: 61578 - DNA, 20 bp, Homo sapiens
ataaaataactgccacaaga

SEQ ID NO: 61579 - DNA, 22 bp, Homo sapiens
gcccaggaggcagaggttgtgg

SEQ ID NO: 61580 - DNA, 22 bp, Homo sapiens
ctggagggctgcagcgaggctg

SEQ ID NO: 61581 - DNA, 22 bp, Homo sapiens
tgtgtggattcatctcaaagag

SEQ ID NO: 61582 - DNA, 22 bp, Homo sapiens
cactgcactccagcctgggaga

SEQ ID NO: 61583 - DNA, 19 bp, Homo sapiens
cccaggaagcggaggttgc

SEQ ID NO: 61584 - DNA, 22 bp, Homo sapiens
gcgggccaccttggagagcgct

SEQ ID NO: 61585 - DNA, 22 bp, Homo sapiens
ctgagctcaagcgatcctccca

SEQ ID NO: 61586 - DNA, 22 bp, Homo sapiens
tcacccaggctggactgcagtg

SEQ ID NO: 61587 - DNA, 22 bp, Homo sapiens
ccagtgtgcattatcatgtgtc

SEQ ID NO: 61588 - DNA, 22 bp, Homo sapiens
gcaagacctatctagttgctgt

SEQ ID NO: 61589 - DNA, 22 bp, Homo sapiens
gcgctaggcaagtcctttcaac

SEQ ID NO: 61590 - DNA, 22 bp, Homo sapiens
gacccaggggcagggagaaagt

SEQ ID NO: 61591 - DNA, 22 bp, Homo sapiens
gcccaggagttcaagtctagtg

SEQ ID NO: 61592 - DNA, 22 bp, Homo sapiens
cccaggctggagtgcagtggcg

SEQ ID NO: 61593 - DNA, 22 bp, Homo sapiens
accatgttggccaagctggtct

SEQ ID NO: 61594 - DNA, 22 bp, Homo sapiens
cgcggtggcggcctccagcgcc

SEQ ID NO: 61595 - DNA, 22 bp, Homo sapiens
caggagctcaagaccaccctgg

SEQ ID NO: 61596 - DNA, 22 bp, Homo sapiens
agggtgaatctcacaactctta

SEQ ID NO: 61597 - DNA, 22 bp, Homo sapiens
gggcaggggtcagtggccccaa

SEQ ID NO: 61598 - DNA, 22 bp, Homo sapiens
ctcctgaattgtccctcacagc

SEQ ID NO: 61599 - DNA, 22 bp, Homo sapiens
tcctcagaatcacctggcagct

SEQ ID NO: 61600 - DNA, 22 bp, Homo sapiens
gttcaagaccagcctggccaac

SEQ ID NO: 61601 - DNA, 22 bp, Homo sapiens
gggaagatagtgttgagggccc

SEQ ID NO: 61602 - DNA, 22 bp, Homo sapiens
caggtgtcggtcaggcggtttt

SEQ ID NO: 61603 - DNA, 17 bp, Homo sapiens
ggctgcagtccaggagg

SEQ ID NO: 61604 - DNA, 22 bp, Homo sapiens
gcaggtccagtcaccagagaga

SEQ ID NO: 61605 - DNA, 22 bp, Homo sapiens
cccaggctggagtgtaatggtg

SEQ ID NO: 61606 - DNA, 22 bp, Homo sapiens
cacatgaaggctggggtcgtga

SEQ ID NO: 61607 - DNA, 19 bp, Homo sapiens
tccaggggctccacctcct

SEQ ID NO: 61608 - DNA, 22 bp, Homo sapiens
cactgcactccagcctgggtga

SEQ ID NO: 61609 - DNA, 22 bp, Homo sapiens
tccgcccgcacgtatggagtgg

SEQ ID NO: 61610 - DNA, 22 bp, Homo sapiens
ttacctctagctctttgcttgt

SEQ ID NO: 61611 - DNA, 22 bp, Homo sapiens
gatttttatataaagtgagaaa

SEQ ID NO: 61612 - DNA, 22 bp, Homo sapiens
cccaggaggtggagttcacagt

SEQ ID NO: 61613 - DNA, 22 bp, Homo sapiens
cagggtttcaccatgttagcag

SEQ ID NO: 61614 - DNA, 22 bp, Homo sapiens
tagaactaagagttatcattta

SEQ ID NO: 61615 - DNA, 22 bp, Homo sapiens
catgtgtccacccttgaacaca

SEQ ID NO: 61616 - DNA, 22 bp, Homo sapiens
tcccagaaccctgccaggtcct

SEQ ID NO: 61617 - DNA, 22 bp, Homo sapiens
gcaggtggatcacctgaggtca

SEQ ID NO: 61618 - DNA, 22 bp, Homo sapiens
gtgagtaaaggttcattgaatt

SEQ ID NO: 61619 - DNA, 22 bp, Homo sapiens
gggagctggagctggaagactc

SEQ ID NO: 61620 - DNA, 19 bp, Homo sapiens
atgtacccagtgtcaatcc

SEQ ID NO: 61621 - DNA, 22 bp, Homo sapiens
tattattgacatttacttggtg

SEQ ID NO: 61622 - DNA, 22 bp, Homo sapiens
cagggcctcctaaggcatctaa

SEQ ID NO: 61623 - DNA, 23 bp, Homo sapiens
ttgtcctctggatcggtttggtt

SEQ ID NO: 61624 - DNA, 22 bp, Homo sapiens
ttcacagcttaataaggctcag

SEQ ID NO: 61625 - DNA, 22 bp, Homo sapiens
aggacgctctcgctgaacttct

SEQ ID NO: 61626 - DNA, 22 bp, Homo sapiens
gaccagtcattactcatgccct

SEQ ID NO: 61627 - DNA, 22 bp, Homo sapiens
gcctggagaaaggaaggtggga

SEQ ID NO: 61628 - DNA, 22 bp, Homo sapiens
tggcctcggcatccagcaagag

SEQ ID NO: 61629 - DNA, 22 bp, Homo sapiens
caggtggtcaggcaaggacacg

SEQ ID NO: 61630 - DNA, 22 bp, Homo sapiens
aacccaggagacaggttgcagt

SEQ ID NO: 61631 - DNA, 22 bp, Homo sapiens
cagcagcattgctctggattcc

SEQ ID NO: 61632 - DNA, 22 bp, Homo sapiens
ggcaatatggtgaaaccccatc

SEQ ID NO: 61633 - DNA, 22 bp, Homo sapiens
tcctgccttgcctgggacatca

SEQ ID NO: 61634 - DNA, 22 bp, Homo sapiens
agagtactgcctcagttatgaa

SEQ ID NO: 61635 - DNA, 22 bp, Homo sapiens
cgtggggcgggtggacacttgc

SEQ ID NO: 61636 - DNA, 22 bp, Homo sapiens
tccaggctttggggcaggagcg

SEQ ID NO: 61637 - DNA, 22 bp, Homo sapiens
tatttcttttcgtgacttattg

SEQ ID NO: 61638 - DNA, 22 bp, Homo sapiens
caggcagggagctggaaaggat

SEQ ID NO: 61639 - DNA, 22 bp, Homo sapiens
cacccaggctggagtgcagtgg

SEQ ID NO: 61640 - DNA, 22 bp, Homo sapiens
agcaacctgccagtcactcagt

SEQ ID NO: 61641 - DNA, 22 bp, Homo sapiens
ctggggaacgcagcgagcagcg

SEQ ID NO: 61642 - DNA, 22 bp, Homo sapiens
actcaagtcataggcttctttc

SEQ ID NO: 61643 - DNA, 22 bp, Homo sapiens
agcccaggttgaggctgcagtg

SEQ ID NO: 61644 - DNA, 22 bp, Homo sapiens
cagcccaggactgcaggtgttt

SEQ ID NO: 61645 - DNA, 22 bp, Homo sapiens
gagaggtggaggttgcagtgag

SEQ ID NO: 61646 - DNA, 22 bp, Homo sapiens
aagtcattggtagcttgatagg

SEQ ID NO: 61647 - DNA, 22 bp, Homo sapiens
ggggtgggcgtgcagggacacc

SEQ ID NO: 61648 - DNA, 22 bp, Homo sapiens
gtgtgtcccttggaacctcagc

SEQ ID NO: 61649 - DNA, 22 bp, Homo sapiens
acgcccagactcccatactttg

SEQ ID NO: 61650 - DNA, 22 bp, Homo sapiens
ttcttctttccaattacatggt

SEQ ID NO: 61651 - DNA, 22 bp, Homo sapiens
aaggagtctgggccattcagag

SEQ ID NO: 61652 - DNA, 22 bp, Homo sapiens
gaggcagaagttgcagtgagca

SEQ ID NO: 61653 - DNA, 22 bp, Homo sapiens
ttatttgtggcatatgagacga

SEQ ID NO: 61654 - DNA, 22 bp, Homo sapiens
tccagcttataggtagatttaa

SEQ ID NO: 61655 - DNA, 22 bp, Homo sapiens
agcagcagtgttctggaattct

SEQ ID NO: 61656 - DNA, 22 bp, Homo sapiens
tatttaataaaactatggcatg

SEQ ID NO: 61657 - DNA, 19 bp, Homo sapiens
ttcacattggaagaagtag

SEQ ID NO: 61658 - DNA, 22 bp, Homo sapiens
attggtggtgaggacatgccag

SEQ ID NO: 61659 - DNA, 22 bp, Homo sapiens
tagattcagatatttaggacaa

SEQ ID NO: 61660 - DNA, 22 bp, Homo sapiens
aacctcaaactcttgggcttaa

SEQ ID NO: 61661 - DNA, 22 bp, Homo sapiens
gcaggatgagtgagtacattta

SEQ ID NO: 61662 - DNA, 22 bp, Homo sapiens
ctgtaatcccagctacctggga

SEQ ID NO: 61663 - DNA, 23 bp, Homo sapiens
gcctgggagttgcgatctgcccg

SEQ ID NO: 61664 - DNA, 22 bp, Homo sapiens
gttattgaggtggagtctcact

SEQ ID NO: 61665 - DNA, 22 bp, Homo sapiens
caagcgtggctgctctgatgga

SEQ ID NO: 61666 - DNA, 22 bp, Homo sapiens
tcgcccaggctggaagtgcagt

SEQ ID NO: 61667 - DNA, 22 bp, Homo sapiens
gcccagccacagtcactttcat

SEQ ID NO: 61668 - DNA, 22 bp, Homo sapiens
cccaggggttctgagcagcagc

SEQ ID NO: 61669 - DNA, 22 bp, Homo sapiens
gccaggctgaggctctggaaga

SEQ ID NO: 61670 - DNA, 22 bp, Homo sapiens
gataccagacagggagggagaa

SEQ ID NO: 61671 - DNA, 22 bp, Homo sapiens
caaggtgccatgctgggcgggg

SEQ ID NO: 61672 - DNA, 22 bp, Homo sapiens
aggtggagaagagatgggcagt

SEQ ID NO: 61673 - DNA, 22 bp, Homo sapiens
caggaaggcgcggctgtgcctg

SEQ ID NO: 61674 - DNA, 20 bp, Homo sapiens
aactcctagcctcaagtgat

SEQ ID NO: 61675 - DNA, 22 bp, Homo sapiens
attaagtgactaaagtaatgct

SEQ ID NO: 61676 - DNA, 22 bp, Homo sapiens
acccagggctcaagcgtaggca

SEQ ID NO: 61677 - DNA, 22 bp, Homo sapiens
cgcaggtgaaagaggctgggca

SEQ ID NO: 61678 - DNA, 19 bp, Homo sapiens
aggcttcaggccacatgct

SEQ ID NO: 61679 - DNA, 22 bp, Homo sapiens
cctggagagctcgggccaggca

SEQ ID NO: 61680 - DNA, 22 bp, Homo sapiens
cagagctgtccaaaccctgaca

SEQ ID NO: 61681 - DNA, 22 bp, Homo sapiens
tcccgcccttgtacttgccgag

SEQ ID NO: 61682 - DNA, 22 bp, Homo sapiens
tggtggggccagacttcagctc

SEQ ID NO: 61683 - DNA, 23 bp, Homo sapiens
aattatctatttcaaatttagca

SEQ ID NO: 61684 - DNA, 22 bp, Homo sapiens
tagtatagattgaagcagatca

SEQ ID NO: 61685 - DNA, 22 bp, Homo sapiens
cgcagggccgcgagcgggacca

SEQ ID NO: 61686 - DNA, 18 bp, Homo sapiens
gatatggaaggccatgcc

SEQ ID NO: 61687 - DNA, 22 bp, Homo sapiens
caatagtaaattacggaggaga

SEQ ID NO: 61688 - DNA, 22 bp, Homo sapiens
taccagggaacagggatattaa

SEQ ID NO: 61689 - DNA, 22 bp, Homo sapiens
cagtggccaacttcctgcctct

SEQ ID NO: 61690 - DNA, 22 bp, Homo sapiens
attctcaaaacataacttcact

SEQ ID NO: 61691 - DNA, 22 bp, Homo sapiens
gctgcagggagctggaaggctc

SEQ ID NO: 61692 - DNA, 22 bp, Homo sapiens
ttaggctgttcttgtgttgtta

SEQ ID NO: 61693 - DNA, 22 bp, Homo sapiens
cccaggaattggaggctgcagt

SEQ ID NO: 61694 - DNA, 22 bp, Homo sapiens
cacggtggcccacaggtgcaag

SEQ ID NO: 61695 - DNA, 18 bp, Homo sapiens
cagggctgtggggtcact

SEQ ID NO: 61696 - DNA, 22 bp, Homo sapiens
gtagggttggagagcacaacca

SEQ ID NO: 61697 - DNA, 22 bp, Homo sapiens
gcgtctcaaggcccccaggcca

SEQ ID NO: 61698 - DNA, 22 bp, Homo sapiens
ctaggtgatccactgctctctt

SEQ ID NO: 61699 - DNA, 22 bp, Homo sapiens
aggtggggaggagtgtctcttt

SEQ ID NO: 61700 - DNA, 22 bp, Homo sapiens
gagccaggggtcagctccgagg

SEQ ID NO: 61701 - DNA, 21 bp, Homo sapiens
cagaggcctatcacagactcc

SEQ ID NO: 61702 - DNA, 22 bp, Homo sapiens
aatttcggttcaaggcccagtt

SEQ ID NO: 61703 - DNA, 22 bp, Homo sapiens
ctggagggtggagagaagtctc

SEQ ID NO: 61704 - DNA, 22 bp, Homo sapiens
tataccatgtgtgcacactccc

SEQ ID NO: 61705 - DNA, 22 bp, Homo sapiens
cccaggcttttctcttgcccca

SEQ ID NO: 61706 - DNA, 22 bp, Homo sapiens
tcactgcaacctccacctcctg

SEQ ID NO: 61707 - DNA, 22 bp, Homo sapiens
gcaggtggatcaccacgtcagg

SEQ ID NO: 61708 - DNA, 22 bp, Homo sapiens
agatttatgtggtcacactcag

SEQ ID NO: 61709 - DNA, 22 bp, Homo sapiens
catgtgtcttgctgccctccat

SEQ ID NO: 61710 - DNA, 22 bp, Homo sapiens
gggtggtggccagcagtgggca

SEQ ID NO: 61711 - DNA, 22 bp, Homo sapiens
gccggggctggggagagacatg

SEQ ID NO: 61712 - DNA, 22 bp, Homo sapiens
gtgacaggccactgcggctctg

SEQ ID NO: 61713 - DNA, 22 bp, Homo sapiens
cccaggggttcaaggctgcagt

SEQ ID NO: 61714 - DNA, 22 bp, Homo sapiens
accctcaagatggaagcagttt

SEQ ID NO: 61715 - DNA, 22 bp, Homo sapiens
taggctaggctgaaggttttgg

SEQ ID NO: 61716 - DNA, 22 bp, Homo sapiens
ccggtcccaggtgccccggtga

SEQ ID NO: 61717 - DNA, 21 bp, Homo sapiens
gaacccagcagcagtgctctg

SEQ ID NO: 61718 - DNA, 22 bp, Homo sapiens
tgcctcagctgaggccgctcca

SEQ ID NO: 61719 - DNA, 20 bp, Homo sapiens
agcagagtgcccatcccgga

SEQ ID NO: 61720 - DNA, 22 bp, Homo sapiens
gtatgtgaggttggtttccagg

SEQ ID NO: 61721 - DNA, 22 bp, Homo sapiens
ggggcaggagcccttcttcagc

SEQ ID NO: 61722 - DNA, 22 bp, Homo sapiens
gcaccgccttggaccgcccgct

SEQ ID NO: 61723 - DNA, 22 bp, Homo sapiens
ctgtaatcccagctactcggga

SEQ ID NO: 61724 - DNA, 22 bp, Homo sapiens
cggcccgctgcgagtgcaccgt

SEQ ID NO: 61725 - DNA, 22 bp, Homo sapiens
ccaggctggagtgcagtggcac

SEQ ID NO: 61726 - DNA, 22 bp, Homo sapiens
cacccaggctggagagcagtgg

SEQ ID NO: 61727 - DNA, 22 bp, Homo sapiens
cacccaggctggagtgcagtga

SEQ ID NO: 61728 - DNA, 22 bp, Homo sapiens
cagagctggtgtgtcctggcat

SEQ ID NO: 61729 - DNA, 22 bp, Homo sapiens
gccctgccctctcggcactcgc

SEQ ID NO: 61730 - DNA, 22 bp, Homo sapiens
gcagggcacaaggacgcacagg

SEQ ID NO: 61731 - DNA, 22 bp, Homo sapiens
tttattggatatttacaagata

SEQ ID NO: 61732 - DNA, 22 bp, Homo sapiens
gagcactgatttatttttgtct

SEQ ID NO: 61733 - DNA, 22 bp, Homo sapiens
aagcagaatagaggcccttccc

SEQ ID NO: 61734 - DNA, 22 bp, Homo sapiens
cacagacagtgtccctttgttg

SEQ ID NO: 61735 - DNA, 22 bp, Homo sapiens
actggacagaggaaatatggag

SEQ ID NO: 61736 - DNA, 20 bp, Homo sapiens
tgggatcgaatcaagtctgt

SEQ ID NO: 61737 - DNA, 22 bp, Homo sapiens
ggatgctctgtctcttgctgtt

SEQ ID NO: 61738 - DNA, 22 bp, Homo sapiens
ctagggtgtgcagattttgcct

SEQ ID NO: 61739 - DNA, 22 bp, Homo sapiens
cacccaggttggagtgcagtgg

SEQ ID NO: 61740 - DNA, 22 bp, Homo sapiens
ccaggtgtgctctgcagtggat

SEQ ID NO: 61741 - DNA, 22 bp, Homo sapiens
gggtaaatctcttttcatggct

SEQ ID NO: 61742 - DNA, 22 bp, Homo sapiens
tagtggatgttcagagatttga

SEQ ID NO: 61743 - DNA, 22 bp, Homo sapiens
tggcgcgacgtgccccctgctt

SEQ ID NO: 61744 - DNA, 22 bp, Homo sapiens
cccgacctcgcaaagcgcactc

SEQ ID NO: 61745 - DNA, 22 bp, Homo sapiens
attataggcttgagccaccgtg

SEQ ID NO: 61746 - DNA, 22 bp, Homo sapiens
agcagctttcacctccccgcct

SEQ ID NO: 61747 - DNA, 22 bp, Homo sapiens
gacaggaggcagagctcaggtg

SEQ ID NO: 61748 - DNA, 22 bp, Homo sapiens
aacccagggtggaggttgcagt

SEQ ID NO: 61749 - DNA, 22 bp, Homo sapiens
gtggagggtgattgccggctgt

SEQ ID NO: 61750 - DNA, 22 bp, Homo sapiens
tcactgcaacctccacctcccg

SEQ ID NO: 61751 - DNA, 22 bp, Homo sapiens
tcattacaagatttccaatttg

SEQ ID NO: 61752 - DNA, 22 bp, Homo sapiens
ggaggtggaggttgcagtgagc

SEQ ID NO: 61753 - DNA, 22 bp, Homo sapiens
ggaggcggaggttgcagtgagt

SEQ ID NO: 61754 - DNA, 22 bp, Homo sapiens
tgattcatcagaataggagttt

SEQ ID NO: 61755 - DNA, 22 bp, Homo sapiens
cgctgcagaagcgtgttcagga

SEQ ID NO: 61756 - DNA, 22 bp, Homo sapiens
ctgagctcacgccattctcctt

SEQ ID NO: 61757 - DNA, 22 bp, Homo sapiens
aggagctgtcagagtgccagag

SEQ ID NO: 61758 - DNA, 22 bp, Homo sapiens
tcagggattgcaaaattcatcc

SEQ ID NO: 61759 - DNA, 18 bp, Homo sapiens
gaggatggaaggagatgc

SEQ ID NO: 61760 - DNA, 22 bp, Homo sapiens
gacagacacaattgatccatga

SEQ ID NO: 61761 - DNA, 22 bp, Homo sapiens
aggctagaggcttctggcttca

SEQ ID NO: 61762 - DNA, 22 bp, Homo sapiens
actttatttcctattgcatcca

SEQ ID NO: 61763 - DNA, 22 bp, Homo sapiens
ctctccattccctacagttttc

SEQ ID NO: 61764 - DNA, 22 bp, Homo sapiens
aatgttacgatcaacaacacat

SEQ ID NO: 61765 - DNA, 17 bp, Homo sapiens
ttaaggtggatcagcac

SEQ ID NO: 61766 - DNA, 22 bp, Homo sapiens
tgagacgaagtcttgctctgtt

SEQ ID NO: 61767 - DNA, 22 bp, Homo sapiens
ggaggggatttagtagatgcta

SEQ ID NO: 61768 - DNA, 22 bp, Homo sapiens
ctgggggcagcaagaagccatg

SEQ ID NO: 61769 - DNA, 22 bp, Homo sapiens
gaccagtcattactcatgccct

SEQ ID NO: 61770 - DNA, 23 bp, Homo sapiens
aggcgagctcttctccagcacgt

SEQ ID NO: 61771 - DNA, 22 bp, Homo sapiens
agtccaggcattccagccattc

SEQ ID NO: 61772 - DNA, 22 bp, Homo sapiens
tgaggcaggacttgcataaagt

SEQ ID NO: 61773 - DNA, 22 bp, Homo sapiens
attaagactgcccatgttttta

SEQ ID NO: 61774 - DNA, 22 bp, Homo sapiens
aggagcaccattgtgctggtgt

SEQ ID NO: 61775 - DNA, 22 bp, Homo sapiens
gggaaggccttgtcagcggatt

SEQ ID NO: 61776 - DNA, 20 bp, Homo sapiens
ctgggtggcaagcaaggggg

SEQ ID NO: 61777 - DNA, 22 bp, Homo sapiens
gccttgtttcattacacgtggt

SEQ ID NO: 61778 - DNA, 18 bp, Homo sapiens
tccatgcacatagccccc

SEQ ID NO: 61779 - DNA, 22 bp, Homo sapiens
taattataacagttacatctta

SEQ ID NO: 61780 - DNA, 22 bp, Homo sapiens
gagggccctggctggctccagc

SEQ ID NO: 61781 - DNA, 22 bp, Homo sapiens
ccctgctgtcaggtgctgggag

SEQ ID NO: 61782 - DNA, 22 bp, Homo sapiens
gcagtggggcaatcatagctca

SEQ ID NO: 61783 - DNA, 22 bp, Homo sapiens
tgtctcctcggctgtccagcca

SEQ ID NO: 61784 - DNA, 22 bp, Homo sapiens
agcatttatcttttgtttgagt

SEQ ID NO: 61785 - DNA, 22 bp, Homo sapiens
gcccaggaggagaggctgcagt

SEQ ID NO: 61786 - DNA, 22 bp, Homo sapiens
ccaggaggttgaggctgcagtg

SEQ ID NO: 61787 - DNA, 22 bp, Homo sapiens
agccaggatggtctcgatcggc

SEQ ID NO: 61788 - DNA, 22 bp, Homo sapiens
aagtggactaatacaaggacta

SEQ ID NO: 61789 - DNA, 22 bp, Homo sapiens
aagggggcggcagccagtggaa

SEQ ID NO: 61790 - DNA, 22 bp, Homo sapiens
tgaggctccttgtagagagtgg

SEQ ID NO: 61791 - DNA, 22 bp, Homo sapiens
taacaatacccattctaattac

SEQ ID NO: 61792 - DNA, 22 bp, Homo sapiens
atagggcctaaaaagtattgct

SEQ ID NO: 61793 - DNA, 22 bp, Homo sapiens
ggagagcttggagtgcgatttt

SEQ ID NO: 61794 - DNA, 22 bp, Homo sapiens
gcaggctgtctaaagttagagt

SEQ ID NO: 61795 - DNA, 22 bp, Homo sapiens
ctggagagaatgtggaatgatt

SEQ ID NO: 61796 - DNA, 22 bp, Homo sapiens
aactcaaagatgcatgacgctt

SEQ ID NO: 61797 - DNA, 22 bp, Homo sapiens
ttgatgtaggtttatctattgt

SEQ ID NO: 61798 - DNA, 22 bp, Homo sapiens
agacaaagaaaccgtagaagca

SEQ ID NO: 61799 - DNA, 22 bp, Homo sapiens
tagactggtgaattagggggaa

SEQ ID NO: 61800 - DNA, 22 bp, Homo sapiens
cttatttgcccatgtttcttta

SEQ ID NO: 61801 - DNA, 22 bp, Homo sapiens
ggccagaagttggaaaagagcc

SEQ ID NO: 61802 - DNA, 22 bp, Homo sapiens
aagaataagaggatttagaaca

SEQ ID NO: 61803 - DNA, 22 bp, Homo sapiens
aggacaaaggaccagatctgga

SEQ ID NO: 61804 - DNA, 22 bp, Homo sapiens
ccactgtggaaagcagttcaga

SEQ ID NO: 61805 - DNA, 22 bp, Homo sapiens
gaggaggcttccgggaggcacg

SEQ ID NO: 61806 - DNA, 22 bp, Homo sapiens
gtagttctgcagtgtcacctga

SEQ ID NO: 61807 - DNA, 22 bp, Homo sapiens
cggggttcatccatgctgtggc

SEQ ID NO: 61808 - DNA, 22 bp, Homo sapiens
gtaatctcagctacttgggagg

SEQ ID NO: 61809 - DNA, 22 bp, Homo sapiens
ctgggcgcgtcccctgaggcgg

SEQ ID NO: 61810 - DNA, 22 bp, Homo sapiens
cccagttgttgccggctctgga

SEQ ID NO: 61811 - DNA, 22 bp, Homo sapiens
tctgcgcgctgctggtaccgaa

SEQ ID NO: 61812 - DNA, 20 bp, Homo sapiens
gggcaaggaaacagccccca

SEQ ID NO: 61813 - DNA, 22 bp, Homo sapiens
accatgttggccaagctggtct

SEQ ID NO: 61814 - DNA, 22 bp, Homo sapiens
ctgagctcacgccattctcctt

SEQ ID NO: 61815 - DNA, 22 bp, Homo sapiens
ctggcaggttatagagctgccc

SEQ ID NO: 61816 - DNA, 22 bp, Homo sapiens
ccagcctggttcagaattggct

SEQ ID NO: 61817 - DNA, 22 bp, Homo sapiens
ttagggttacaccagcctcctg

SEQ ID NO: 61818 - DNA, 22 bp, Homo sapiens
tctgagacaggaagtggagggt

SEQ ID NO: 61819 - DNA, 22 bp, Homo sapiens
agagaagagtcttgtcaaatta

SEQ ID NO: 61820 - DNA, 22 bp, Homo sapiens
acagagacacggaagctaaaga

SEQ ID NO: 61821 - DNA, 22 bp, Homo sapiens
gaggctgaggcaggaggatcac

SEQ ID NO: 61822 - DNA, 22 bp, Homo sapiens
gtgtttgttcgtgactccaaag

SEQ ID NO: 61823 - DNA, 22 bp, Homo sapiens
gcagctctatgtgatggtaaat

SEQ ID NO: 61824 - DNA, 22 bp, Homo sapiens
cggctcactgcagctccgcctc

SEQ ID NO: 61825 - DNA, 22 bp, Homo sapiens
aacttaggaaaataaggcatga

SEQ ID NO: 61826 - DNA, 22 bp, Homo sapiens
atgattgaaaatgacattgcca

SEQ ID NO: 61827 - DNA, 22 bp, Homo sapiens
aaggtgggtggatcacgaggtc

SEQ ID NO: 61828 - DNA, 22 bp, Homo sapiens
actgggcctgattgggtcggag

SEQ ID NO: 61829 - DNA, 22 bp, Homo sapiens
gctggccacagatccccaggga

SEQ ID NO: 61830 - DNA, 22 bp, Homo sapiens
aataaaatggtcagttttctca

SEQ ID NO: 61831 - DNA, 22 bp, Homo sapiens
gatgatcatctgtaaagttaga

SEQ ID NO: 61832 - DNA, 17 bp, Homo sapiens
tgtagcttctccttctc

SEQ ID NO: 61833 - DNA, 22 bp, Homo sapiens
aggctgaggcaagaggatcact

SEQ ID NO: 61834 - DNA, 22 bp, Homo sapiens
gatggaggagatggcagggtgc

SEQ ID NO: 61835 - DNA, 18 bp, Homo sapiens
ccatcaccctaactagtg

SEQ ID NO: 61836 - DNA, 22 bp, Homo sapiens
ggaggtagcctcaaaagcagct

SEQ ID NO: 61837 - DNA, 23 bp, Homo sapiens
caccactttctccttctccttgg

SEQ ID NO: 61838 - DNA, 22 bp, Homo sapiens
acaaacagagttgaaaaatagg

SEQ ID NO: 61839 - DNA, 22 bp, Homo sapiens
cccaggaggcagagatagcagt

SEQ ID NO: 61840 - DNA, 22 bp, Homo sapiens
ggccctggcagccacgaaagcc

SEQ ID NO: 61841 - DNA, 20 bp, Homo sapiens
atcggcttgcctggaaacaa

SEQ ID NO: 61842 - DNA, 22 bp, Homo sapiens
ggtgccctggaagctgctgcat

SEQ ID NO: 61843 - DNA, 22 bp, Homo sapiens
cgggaaggtggaggttgcagtg

SEQ ID NO: 61844 - DNA, 22 bp, Homo sapiens
atattacacacggtatcacggg

SEQ ID NO: 61845 - DNA, 22 bp, Homo sapiens
ggaggcggaggctgcagtgagc

SEQ ID NO: 61846 - DNA, 22 bp, Homo sapiens
ttctggaaggatgtttctatct

SEQ ID NO: 61847 - DNA, 22 bp, Homo sapiens
ctcactgcaacctctgcctccc

SEQ ID NO: 61848 - DNA, 22 bp, Homo sapiens
tgcctgatgcaggagtatcaga

SEQ ID NO: 61849 - DNA, 22 bp, Homo sapiens
ggctctgcgcctgcggggactt

SEQ ID NO: 61850 - DNA, 22 bp, Homo sapiens
cagtggcgtgatctctgctcac

SEQ ID NO: 61851 - DNA, 17 bp, Homo sapiens
ggctgcagtccaggagg

SEQ ID NO: 61852 - DNA, 22 bp, Homo sapiens
tccaggattgcaggtgcacaac

SEQ ID NO: 61853 - DNA, 22 bp, Homo sapiens
tagtgaatgggggttatgagac

SEQ ID NO: 61854 - DNA, 22 bp, Homo sapiens
cgcaactcagcaacttaactgc

SEQ ID NO: 61855 - DNA, 22 bp, Homo sapiens
cccaggcttttctcttgcccca

SEQ ID NO: 61856 - DNA, 22 bp, Homo sapiens
tcttcccagaggaggtgccagc

SEQ ID NO: 61857 - DNA, 22 bp, Homo sapiens
tcactgcaacctccacctcccg

SEQ ID NO: 61858 - DNA, 22 bp, Homo sapiens
tttctcctcatgactggttgtg

SEQ ID NO: 61859 - DNA, 22 bp, Homo sapiens
gccgtggggagagagggtgcgt

SEQ ID NO: 61860 - DNA, 22 bp, Homo sapiens
ctgggagtggtgacagctctcg

SEQ ID NO: 61861 - DNA, 19 bp, Homo sapiens
gccttcccaccacccgtcc

SEQ ID NO: 61862 - DNA, 17 bp, Homo sapiens
tggctctgtcctcagct

SEQ ID NO: 61863 - DNA, 22 bp, Homo sapiens
gggactggagtagaggccggtg

SEQ ID NO: 61864 - DNA, 22 bp, Homo sapiens
ctgagctcaagcgatcctccca

SEQ ID NO: 61865 - DNA, 22 bp, Homo sapiens
acccagggctcaagcgtaggca

SEQ ID NO: 61866 - DNA, 22 bp, Homo sapiens
caggcaggtcagtgaagaagga

SEQ ID NO: 61867 - DNA, 22 bp, Homo sapiens
aagaaatgtgaatattgaatag

SEQ ID NO: 61868 - DNA, 22 bp, Homo sapiens
tctggagataagcagcaatgaa

SEQ ID NO: 61869 - DNA, 22 bp, Homo sapiens
ggtgaatttgcctcccgactga

SEQ ID NO: 61870 - DNA, 22 bp, Homo sapiens
ttcagagaattggataattcgt

SEQ ID NO: 61871 - DNA, 22 bp, Homo sapiens
atgctttctcttagttcattga

SEQ ID NO: 61872 - DNA, 19 bp, Homo sapiens
aggcttcaggccacatgct

SEQ ID NO: 61873 - DNA, 22 bp, Homo sapiens
caggagtgtctccacacagcaa

SEQ ID NO: 61874 - DNA, 22 bp, Homo sapiens
tcaaatgaagacagttgacttg

SEQ ID NO: 61875 - DNA, 22 bp, Homo sapiens
gagatttccatattttgtaaca

SEQ ID NO: 61876 - DNA, 22 bp, Homo sapiens
caggctggagtgcagtggtgcc

SEQ ID NO: 61877 - DNA, 22 bp, Homo sapiens
gaaaagagacagggtgggtgat

SEQ ID NO: 61878 - DNA, 21 bp, Homo sapiens
attctttgatgtgcaataagt

SEQ ID NO: 61879 - DNA, 22 bp, Homo sapiens
gaggttggggctgcagtgagct

SEQ ID NO: 61880 - DNA, 22 bp, Homo sapiens
gaggggagcccccatcctccag

SEQ ID NO: 61881 - DNA, 18 bp, Homo sapiens
cttgttcttctcttggcg

SEQ ID NO: 61882 - DNA, 22 bp, Homo sapiens
gaggcacagagtaggtgcacac

SEQ ID NO: 61883 - DNA, 22 bp, Homo sapiens
cactgcactccagcctgggtca

SEQ ID NO: 61884 - DNA, 22 bp, Homo sapiens
tttggaaattttcatccagaca

SEQ ID NO: 61885 - DNA, 22 bp, Homo sapiens
aagcagagaatctgggagcgag

SEQ ID NO: 61886 - DNA, 22 bp, Homo sapiens
tggaagactcaaggtggtgaat

SEQ ID NO: 61887 - DNA, 22 bp, Homo sapiens
agcagagcaaagctcagaaatg

SEQ ID NO: 61888 - DNA, 22 bp, Homo sapiens
acctcctggcctcaagcaatcc

SEQ ID NO: 61889 - DNA, 18 bp, Homo sapiens
cagctgccagctcatgga

SEQ ID NO: 61890 - DNA, 22 bp, Homo sapiens
ctctccattccctacagttttc

SEQ ID NO: 61891 - DNA, 23 bp, Homo sapiens
gtgccgacgctccagcaccatcc

SEQ ID NO: 61892 - DNA, 22 bp, Homo sapiens
gtgggccagcttttctcctggg

SEQ ID NO: 61893 - DNA, 23 bp, Homo sapiens
gggtccagccaattccaaggaaa

SEQ ID NO: 61894 - DNA, 22 bp, Homo sapiens
gctgcagggagctggaaggctc

SEQ ID NO: 61895 - DNA, 22 bp, Homo sapiens
cttcagctgcagttatgtttag

SEQ ID NO: 61896 - DNA, 22 bp, Homo sapiens
ggcctctcttgggacagctgtc

SEQ ID NO: 61897 - DNA, 22 bp, Homo sapiens
tcctggcttgtcacatctacgt

SEQ ID NO: 61898 - DNA, 22 bp, Homo sapiens
aagtcagacagctgagctgcct

SEQ ID NO: 61899 - DNA, 22 bp, Homo sapiens
aaggcaggatgggaaaagattt

SEQ ID NO: 61900 - DNA, 22 bp, Homo sapiens
cgtgccctgcgcaagtgctgct

SEQ ID NO: 61901 - DNA, 22 bp, Homo sapiens
ctgggcacagcgttgggctctt

SEQ ID NO: 61902 - DNA, 22 bp, Homo sapiens
gcctgcagggcctgggcctacc

SEQ ID NO: 61903 - DNA, 22 bp, Homo sapiens
gaggctgaggttgcagtgagcc

SEQ ID NO: 61904 - DNA, 19 bp, Homo sapiens
atgtacccagtgtcaatcc

SEQ ID NO: 61905 - DNA, 22 bp, Homo sapiens
ctgccaggattctgtgaacccc

SEQ ID NO: 61906 - DNA, 22 bp, Homo sapiens
tttcaacagatctgtcttcagg

SEQ ID NO: 61907 - DNA, 20 bp, Homo sapiens
gttaggaggttggacatgga

SEQ ID NO: 61908 - DNA, 22 bp, Homo sapiens
acgcccagactcccatactttg

SEQ ID NO: 61909 - DNA, 22 bp, Homo sapiens
actgcaacacctcctgggttca

SEQ ID NO: 61910 - DNA, 22 bp, Homo sapiens
tcaggctcaggttaggggccaa

SEQ ID NO: 61911 - DNA, 22 bp, Homo sapiens
taacatttaaatttttcacata

SEQ ID NO: 61912 - DNA, 22 bp, Homo sapiens
ggcccaggctggagtgcagtgg

SEQ ID NO: 61913 - DNA, 22 bp, Homo sapiens
aagaagagaactggcatcctaa

SEQ ID NO: 61914 - DNA, 22 bp, Homo sapiens
tttgtcttatccaatctctcag

SEQ ID NO: 61915 - DNA, 22 bp, Homo sapiens
gtgtgggctgcagaggcacagc

SEQ ID NO: 61916 - DNA, 22 bp, Homo sapiens
tccagctgttccatcagctctt

SEQ ID NO: 61917 - DNA, 22 bp, Homo sapiens
gcctcctgtcccaggctgagga

SEQ ID NO: 61918 - DNA, 22 bp, Homo sapiens
actcaaatagcaacggtgagaa

SEQ ID NO: 61919 - DNA, 22 bp, Homo sapiens
actgcacttcagcctgggtgtc

SEQ ID NO: 61920 - DNA, 22 bp, Homo sapiens
aaatgcctcattttctctcact

SEQ ID NO: 61921 - DNA, 22 bp, Homo sapiens
gcaggcggaggttgcagtgagc

SEQ ID NO: 61922 - DNA, 20 bp, Homo sapiens
tgaggcccagcagagtcggg

SEQ ID NO: 61923 - DNA, 22 bp, Homo sapiens
aattgcaaattcagacttaaga

SEQ ID NO: 61924 - DNA, 22 bp, Homo sapiens
caatttctaacattccatggat

SEQ ID NO: 61925 - DNA, 17 bp, Homo sapiens
cccgttctcttcgctgg

SEQ ID NO: 61926 - DNA, 22 bp, Homo sapiens
cccaggggttcaaggctgcagt

SEQ ID NO: 61927 - DNA, 22 bp, Homo sapiens
tgggtagtttcccctgccctgc

SEQ ID NO: 61928 - DNA, 22 bp, Homo sapiens
tgcccaggctggagtacagtgg

SEQ ID NO: 61929 - DNA, 22 bp, Homo sapiens
aggtgactggtttatctggcag

SEQ ID NO: 61930 - DNA, 22 bp, Homo sapiens
ttgagcccaggaggcctgggtg

SEQ ID NO: 61931 - DNA, 17 bp, Homo sapiens
tccttcagtgcctctgc

SEQ ID NO: 61932 - DNA, 22 bp, Homo sapiens
tacatgctccttatgagaatct

SEQ ID NO: 61933 - DNA, 22 bp, Homo sapiens
ctctgagtagatagggaacctg

SEQ ID NO: 61934 - DNA, 22 bp, Homo sapiens
ttatatgtttctgtttggaggc

SEQ ID NO: 61935 - DNA, 22 bp, Homo sapiens
aatggccagacagatggctgct

SEQ ID NO: 61936 - DNA, 22 bp, Homo sapiens
aagaagcaggtcacagacaggg

SEQ ID NO: 61937 - DNA, 20 bp, Homo sapiens
gctgaggtggaggaaggaga

SEQ ID NO: 61938 - DNA, 22 bp, Homo sapiens
ggacaccggtcctattggatga

SEQ ID NO: 61939 - DNA, 22 bp, Homo sapiens
ctgtaatcccagctacctggga

SEQ ID NO: 61940 - DNA, 18 bp, Homo sapiens
gctatctctaagatcttt

SEQ ID NO: 61941 - DNA, 22 bp, Homo sapiens
actgcacttcagcctgggtgac

SEQ ID NO: 61942 - DNA, 22 bp, Homo sapiens
tgaggcaggagaatcaccggaa

SEQ ID NO: 61943 - DNA, 22 bp, Homo sapiens
tcacccaggctggactgcagtg

SEQ ID NO: 61944 - DNA, 22 bp, Homo sapiens
acattcagaatcttgtagcagt

SEQ ID NO: 61945 - DNA, 22 bp, Homo sapiens
ccttcccatgcagcctgtctga

SEQ ID NO: 61946 - DNA, 22 bp, Homo sapiens
cactgcactccagcccgggcaa

SEQ ID NO: 61947 - DNA, 22 bp, Homo sapiens
tggaaagaaagtaaaggcgtat

SEQ ID NO: 61948 - DNA, 22 bp, Homo sapiens
tatacgtgcaggtcacagggga

SEQ ID NO: 61949 - DNA, 22 bp, Homo sapiens
cctggagagctcgggccaggca

SEQ ID NO: 61950 - DNA, 22 bp, Homo sapiens
ggagggcagagtcccctgctga

SEQ ID NO: 61951 - DNA, 22 bp, Homo sapiens
gggctgcatcagcaggacccgg

SEQ ID NO: 61952 - DNA, 20 bp, Homo sapiens
tttctgtgagaaacactgtt

SEQ ID NO: 61953 - DNA, 22 bp, Homo sapiens
gggcagagactcagaaacagaa

SEQ ID NO: 61954 - DNA, 19 bp, Homo sapiens
ttcagcattatattctagc

SEQ ID NO: 61955 - DNA, 22 bp, Homo sapiens
tttagcgtagctgacagctaat

SEQ ID NO: 61956 - DNA, 22 bp, Homo sapiens
ctgaggaggctaatttgaggat

SEQ ID NO: 61957 - DNA, 22 bp, Homo sapiens
tggtatgaccgtggtgcaagca

SEQ ID NO: 61958 - DNA, 22 bp, Homo sapiens
agcctagggttctgatgtcact

SEQ ID NO: 61959 - DNA, 22 bp, Homo sapiens
agggtgaatctcacaactctta

SEQ ID NO: 61960 - DNA, 22 bp, Homo sapiens
gggttggatcctggtggctgcc

SEQ ID NO: 61961 - DNA, 22 bp, Homo sapiens
tggtgctgccaggctcctgcca

SEQ ID NO: 61962 - DNA, 22 bp, Homo sapiens
ctacaaaagtaattgtggtttt

SEQ ID NO: 61963 - DNA, 22 bp, Homo sapiens
caaggtgccatgctgggcgggg

SEQ ID NO: 61964 - DNA, 22 bp, Homo sapiens
gcaggcagatcacctgtcagga

SEQ ID NO: 61965 - DNA, 22 bp, Homo sapiens
tgaggcaggagaatcacatgaa

SEQ ID NO: 61966 - DNA, 22 bp, Homo sapiens
ggagaggcttccagagtcgtgc

SEQ ID NO: 61967 - DNA, 22 bp, Homo sapiens
ggtcccaggttgacagggagac

SEQ ID NO: 61968 - DNA, 22 bp, Homo sapiens
cccaggaggttgaggctgcagt

SEQ ID NO: 61969 - DNA, 22 bp, Homo sapiens
tctgctttcttactaaaaatga

SEQ ID NO: 61970 - DNA, 22 bp, Homo sapiens
cgcaccactgaattccagcctg

SEQ ID NO: 61971 - DNA, 22 bp, Homo sapiens
cctgggggccaggaaggtgtga

SEQ ID NO: 61972 - DNA, 19 bp, Homo sapiens
agccagccagcaggtatgc

SEQ ID NO: 61973 - DNA, 22 bp, Homo sapiens
aacccgggaggcagaggttgtg

SEQ ID NO: 61974 - DNA, 22 bp, Homo sapiens
tccttgccctaaatgtctgtgt

SEQ ID NO: 61975 - DNA, 22 bp, Homo sapiens
ggtggcagtagcactgggcctg

SEQ ID NO: 61976 - DNA, 22 bp, Homo sapiens
actgggcctacccagattggca

SEQ ID NO: 61977 - DNA, 22 bp, Homo sapiens
ggctgggctccgggagcatgcg

SEQ ID NO: 61978 - DNA, 22 bp, Homo sapiens
agaggcaggaggttgacttgag

SEQ ID NO: 61979 - DNA, 22 bp, Homo sapiens
cggggccctggggctgaaggtc

SEQ ID NO: 61980 - DNA, 22 bp, Homo sapiens
gtgggggcaggcagtgctagga

SEQ ID NO: 61981 - DNA, 22 bp, Homo sapiens
ggctgagttgagaggattactt

SEQ ID NO: 61982 - DNA, 22 bp, Homo sapiens
cccagcaggtcggtgctgcctg

SEQ ID NO: 61983 - DNA, 22 bp, Homo sapiens
atatatttgagaatattcatga

SEQ ID NO: 61984 - DNA, 22 bp, Homo sapiens
tgtatgaggcatacatcaggca

SEQ ID NO: 61985 - DNA, 22 bp, Homo sapiens
gctggggaggcagcagagaaca

SEQ ID NO: 61986 - DNA, 22 bp, Homo sapiens
tggttcctcaagcgctggcggc

SEQ ID NO: 61987 - DNA, 22 bp, Homo sapiens
aggtgggcggattcatgaggtc

SEQ ID NO: 61988 - DNA, 22 bp, Homo sapiens
gcccaggctggagtgcagtggt

SEQ ID NO: 61989 - DNA, 22 bp, Homo sapiens
tgaggcaggagttcaggctgcg

SEQ ID NO: 61990 - DNA, 22 bp, Homo sapiens
gagagagctctgtgcctgggat

SEQ ID NO: 61991 - DNA, 22 bp, Homo sapiens
aggcaggaggatcatggatgca

SEQ ID NO: 61992 - DNA, 22 bp, Homo sapiens
tagcagcaaagcaggatctgct

SEQ ID NO: 61993 - DNA, 22 bp, Homo sapiens
catgagatttgggaggggccag

SEQ ID NO: 61994 - DNA, 22 bp, Homo sapiens
gcaccgccttggaccgcccgct

SEQ ID NO: 61995 - DNA, 22 bp, Homo sapiens
caccttactccctctggatgcc

SEQ ID NO: 61996 - DNA, 22 bp, Homo sapiens
aagaggttgtctgtgatgagtt

SEQ ID NO: 61997 - DNA, 22 bp, Homo sapiens
tgtgtggattcatctcaaagag

SEQ ID NO: 61998 - DNA, 22 bp, Homo sapiens
gtgaccatcatctcagctagtt

SEQ ID NO: 61999 - DNA, 22 bp, Homo sapiens
ggcttcagtggccagagatgat

SEQ ID NO: 62000 - DNA, 22 bp, Homo sapiens
ctggcaagaaatatatatctta

SEQ ID NO: 62001 - DNA, 22 bp, Homo sapiens
ccagaagcagagcctgaggcag

SEQ ID NO: 62002 - DNA, 22 bp, Homo sapiens
gactgtggggaagcagatgcca

SEQ ID NO: 62003 - DNA, 22 bp, Homo sapiens
tctcgctgaagaagctgcacat

SEQ ID NO: 62004 - DNA, 22 bp, Homo sapiens
ccagcagccaccttctcgaaat

SEQ ID NO: 62005 - DNA, 22 bp, Homo sapiens
tgtgttgtgacattcttggatg

SEQ ID NO: 62006 - DNA, 22 bp, Homo sapiens
acacttggagcaacacttatgg

SEQ ID NO: 62007 - DNA, 22 bp, Homo sapiens
ctgaggggtcgtgggagcccag

SEQ ID NO: 62008 - DNA, 22 bp, Homo sapiens
tggcactgaagctggaaagcct

SEQ ID NO: 62009 - DNA, 22 bp, Homo sapiens
gctctgagtcacactgccctgt

SEQ ID NO: 62010 - DNA, 22 bp, Homo sapiens
tggagaagattggtcaccattc

SEQ ID NO: 62011 - DNA, 22 bp, Homo sapiens
gcagctggaagtgacactctgt

SEQ ID NO: 62012 - DNA, 22 bp, Homo sapiens
gaggcagaagttgcagtgagca

SEQ ID NO: 62013 - DNA, 22 bp, Homo sapiens
cagccctcctaccctgccaggc

SEQ ID NO: 62014 - DNA, 22 bp, Homo sapiens
ttctgggtttacatctgacttc

SEQ ID NO: 62015 - DNA, 22 bp, Homo sapiens
gctgctgcttgaaggctcggag

SEQ ID NO: 62016 - DNA, 22 bp, Homo sapiens
ggcgcacaatgtgcaggtttgt

SEQ ID NO: 62017 - DNA, 22 bp, Homo sapiens
cttgcctttgtcttcaaaggct

SEQ ID NO: 62018 - DNA, 22 bp, Homo sapiens
cactgcccaccaagtggctggt

SEQ ID NO: 62019 - DNA, 22 bp, Homo sapiens
caggaaagggatgggctgccac

SEQ ID NO: 62020 - DNA, 22 bp, Homo sapiens
ttagatttgtagtgagttcaga

SEQ ID NO: 62021 - DNA, 22 bp, Homo sapiens
attgtgaatagtgccgcagtaa

SEQ ID NO: 62022 - DNA, 22 bp, Homo sapiens
ataaaagatcccttctgagctc

SEQ ID NO: 62023 - DNA, 22 bp, Homo sapiens
gcaggagaacaaagcaagctgc

SEQ ID NO: 62024 - DNA, 22 bp, Homo sapiens
gcggggggaggaacatcttgca

SEQ ID NO: 62025 - DNA, 22 bp, Homo sapiens
cagtggaggccttgggaccttt

SEQ ID NO: 62026 - DNA, 22 bp, Homo sapiens
cgcccaggctggagtgcagtgg

SEQ ID NO: 62027 - DNA, 22 bp, Homo sapiens
tgctgggattacagtcatgagc

SEQ ID NO: 62028 - DNA, 22 bp, Homo sapiens
cgccccggacgtctgaccaaac

SEQ ID NO: 62029 - DNA, 22 bp, Homo sapiens
ggaggcggaagttgcagtgagc

SEQ ID NO: 62030 - DNA, 22 bp, Homo sapiens
gggtcgggcaggcgccctcgtc

SEQ ID NO: 62031 - DNA, 22 bp, Homo sapiens
ccaggtaggagagtcaacatgt

SEQ ID NO: 62032 - DNA, 22 bp, Homo sapiens
acgcctgtaatcccagcacttt

SEQ ID NO: 62033 - DNA, 22 bp, Homo sapiens
gcagcctcaaactccccagctc

SEQ ID NO: 62034 - DNA, 21 bp, Homo sapiens
ggccagtggaattttatgtca

SEQ ID NO: 62035 - DNA, 22 bp, Homo sapiens
tcaccagatctctctgtaatgg

SEQ ID NO: 62036 - DNA, 22 bp, Homo sapiens
aggagccagtggagttcctgcc

SEQ ID NO: 62037 - DNA, 22 bp, Homo sapiens
gctgaggtggaggaaggagacc

SEQ ID NO: 62038 - DNA, 22 bp, Homo sapiens
accgggaagtcctgcactgggc

SEQ ID NO: 62039 - DNA, 22 bp, Homo sapiens
atgaggcaggtggaggctgcca

SEQ ID NO: 62040 - DNA, 22 bp, Homo sapiens
cgtgccactgcactctagcctg

SEQ ID NO: 62041 - DNA, 22 bp, Homo sapiens
gctgctgggatcctgggtctca

SEQ ID NO: 62042 - DNA, 22 bp, Homo sapiens
tcagccagccagctacaggctt

SEQ ID NO: 62043 - DNA, 22 bp, Homo sapiens
ttccagctaactcacatccctt

SEQ ID NO: 62044 - DNA, 22 bp, Homo sapiens
atgccactgcacttcagcttgg

SEQ ID NO: 62045 - DNA, 22 bp, Homo sapiens
agccagtgcagctggaaattca

SEQ ID NO: 62046 - DNA, 22 bp, Homo sapiens
gggcaggggtcagtggccccaa

SEQ ID NO: 62047 - DNA, 22 bp, Homo sapiens
ctagggtgtgcagattttgcct

SEQ ID NO: 62048 - DNA, 22 bp, Homo sapiens
gagctactgaaatattgatttt

SEQ ID NO: 62049 - DNA, 22 bp, Homo sapiens
cttgcctacttgtcaaccagca

SEQ ID NO: 62050 - DNA, 22 bp, Homo sapiens
ggagagggtaggggtcctgccc

SEQ ID NO: 62051 - DNA, 22 bp, Homo sapiens
ctggcagagttgggtctcaaat

SEQ ID NO: 62052 - DNA, 22 bp, Homo sapiens
aggccctattcaatggggccca

SEQ ID NO: 62053 - DNA, 22 bp, Homo sapiens
tgccgtggggctgaggctggag

SEQ ID NO: 62054 - DNA, 21 bp, Homo sapiens
caaaagagactgattcttgga

SEQ ID NO: 62055 - DNA, 22 bp, Homo sapiens
tttgtagcagcatgatttataa

SEQ ID NO: 62056 - DNA, 22 bp, Homo sapiens
tgctccagcaccaagagctcca

SEQ ID NO: 62057 - DNA, 22 bp, Homo sapiens
tggcacaggatctcagcggcca

SEQ ID NO: 62058 - DNA, 22 bp, Homo sapiens
tcagaattgtggagaaagggga

SEQ ID NO: 62059 - DNA, 22 bp, Homo sapiens
ttggaaacgtcaccttttcctt

SEQ ID NO: 62060 - DNA, 22 bp, Homo sapiens
ctccagttggccccagttggtt

SEQ ID NO: 62061 - DNA, 22 bp, Homo sapiens
accctcaagatggaagcagttt

SEQ ID NO: 62062 - DNA, 22 bp, Homo sapiens
gagtcgagcagaaagccgtcgg

SEQ ID NO: 62063 - DNA, 22 bp, Homo sapiens
ggggcaggagcccttcttcagc

SEQ ID NO: 62064 - DNA, 22 bp, Homo sapiens
gtggcagagccaaggctggagc

SEQ ID NO: 62065 - DNA, 22 bp, Homo sapiens
cccaggctggagtgtaatggtg

SEQ ID NO: 62066 - DNA, 22 bp, Homo sapiens
cccaggaggtggaggctgcagt

SEQ ID NO: 62067 - DNA, 22 bp, Homo sapiens
aaggaggcctggcagatgaaga

SEQ ID NO: 62068 - DNA, 21 bp, Homo sapiens
gcccacagtgaggaggatccc

SEQ ID NO: 62069 - DNA, 22 bp, Homo sapiens
cactgcactccagctgggtgac

SEQ ID NO: 62070 - DNA, 22 bp, Homo sapiens
cggctggtgtcgggcacagcaa

SEQ ID NO: 62071 - DNA, 22 bp, Homo sapiens
ttttctcttccctctggacctg

SEQ ID NO: 62072 - DNA, 21 bp, Homo sapiens
gttcttgcaggatttccttcc

SEQ ID NO: 62073 - DNA, 22 bp, Homo sapiens
tgatgcctaatatacttcaatt

SEQ ID NO: 62074 - DNA, 22 bp, Homo sapiens
tgctgtgaggttgagaaggaag

SEQ ID NO: 62075 - DNA, 22 bp, Homo sapiens
actgcaacctccgcctgccagg

SEQ ID NO: 62076 - DNA, 22 bp, Homo sapiens
ggaggaggggtgactgaatgct

SEQ ID NO: 62077 - DNA, 22 bp, Homo sapiens
ggttgcaaactcctgggatcaa

SEQ ID NO: 62078 - DNA, 22 bp, Homo sapiens
tgggttagattccgcgaagcag

SEQ ID NO: 62079 - DNA, 22 bp, Homo sapiens
tgttcagaacaaaggtaaatga

SEQ ID NO: 62080 - DNA, 22 bp, Homo sapiens
gccatcatatcccctgtgacct

SEQ ID NO: 62081 - DNA, 22 bp, Homo sapiens
ggtgaggggctcctctgcccgg

SEQ ID NO: 62082 - DNA, 22 bp, Homo sapiens
gctgcagctcgccttccggcct

SEQ ID NO: 62083 - DNA, 22 bp, Homo sapiens
actggggtttaggcctgggcaa

SEQ ID NO: 62084 - DNA, 22 bp, Homo sapiens
gttcaagaccagcctggccaac

SEQ ID NO: 62085 - DNA, 22 bp, Homo sapiens
cagagctggtgtgtcctggcat

SEQ ID NO: 62086 - DNA, 22 bp, Homo sapiens
gttggggtgctataaaaatgat

SEQ ID NO: 62087 - DNA, 22 bp, Homo sapiens
tgcagcaccgtcccactggcta

SEQ ID NO: 62088 - DNA, 22 bp, Homo sapiens
cctgggccctcaccgccggtgg

SEQ ID NO: 62089 - DNA, 22 bp, Homo sapiens
ataaaatttgctactgttaaat

SEQ ID NO: 62090 - DNA, 22 bp, Homo sapiens
tgggaagggtcaacagctggaa

SEQ ID NO: 62091 - DNA, 22 bp, Homo sapiens
tgaggcgtctccctgagctcac

SEQ ID NO: 62092 - DNA, 22 bp, Homo sapiens
atttgtgggactataatgcagg

SEQ ID NO: 62093 - DNA, 22 bp, Homo sapiens
tgctcgccccacatgccctcat

SEQ ID NO: 62094 - DNA, 22 bp, Homo sapiens
tggtggcactgacatcagacac

SEQ ID NO: 62095 - DNA, 23 bp, Homo sapiens
cagagctggcttcatgggtgtgc

SEQ ID NO: 62096 - DNA, 22 bp, Homo sapiens
taccagggaacagggatattaa

SEQ ID NO: 62097 - DNA, 22 bp, Homo sapiens
tctggacaggggcgctttgggg

SEQ ID NO: 62098 - DNA, 22 bp, Homo sapiens
agcaggaaggggatgatgggca

SEQ ID NO: 62099 - DNA, 22 bp, Homo sapiens
tccaggattgtcagccagaagg

SEQ ID NO: 62100 - DNA, 22 bp, Homo sapiens
cagagactggagtgcagtggcg

SEQ ID NO: 62101 - DNA, 22 bp, Homo sapiens
gtcccataagtagtgcaacttg

SEQ ID NO: 62102 - DNA, 22 bp, Homo sapiens
ggacagaaaccatatgagtgta

SEQ ID NO: 62103 - DNA, 22 bp, Homo sapiens
gctcccaccttaaccttcacat

SEQ ID NO: 62104 - DNA, 22 bp, Homo sapiens
ctctggaccctcctgctgagag

SEQ ID NO: 62105 - DNA, 22 bp, Homo sapiens
ccggctactcgggaggctgacg

SEQ ID NO: 62106 - DNA, 22 bp, Homo sapiens
cggtcaggtgcagcgttggcac

SEQ ID NO: 62107 - DNA, 22 bp, Homo sapiens
ggagacagggttgaaccacgca

SEQ ID NO: 62108 - DNA, 22 bp, Homo sapiens
agcccaggtccagttcactgca

SEQ ID NO: 62109 - DNA, 22 bp, Homo sapiens
actgcactccagcctgggtgat

SEQ ID NO: 62110 - DNA, 22 bp, Homo sapiens
gcctggccgggtcttggatttt

SEQ ID NO: 62111 - DNA, 22 bp, Homo sapiens
cacccaggctggagtgcagtga

SEQ ID NO: 62112 - DNA, 22 bp, Homo sapiens
cacccaggctggaatgcagtgg

SEQ ID NO: 62113 - DNA, 22 bp, Homo sapiens
aggctgagataggtggatcatt

SEQ ID NO: 62114 - DNA, 22 bp, Homo sapiens
tactgtactgcagttctgcaaa

SEQ ID NO: 62115 - DNA, 22 bp, Homo sapiens
agttattgagtgcagagcaggg

SEQ ID NO: 62116 - DNA, 22 bp, Homo sapiens
caggaagaccagggctgtggct

SEQ ID NO: 62117 - DNA, 19 bp, Homo sapiens
gccgggcccgggttggccg

SEQ ID NO: 62118 - DNA, 22 bp, Homo sapiens
tccagcagtccatgtgagacac

SEQ ID NO: 62119 - DNA, 22 bp, Homo sapiens
cagcagcattgctctggattcc

SEQ ID NO: 62120 - DNA, 22 bp, Homo sapiens
atggagttctgccagcgctgct

SEQ ID NO: 62121 - DNA, 20 bp, Homo sapiens
aggccccaggtggacactag

SEQ ID NO: 62122 - DNA, 22 bp, Homo sapiens
gcaagacctatctagttgctgt

SEQ ID NO: 62123 - DNA, 22 bp, Homo sapiens
tgcctctgaggaagattgtgtt

SEQ ID NO: 62124 - DNA, 22 bp, Homo sapiens
gttgcagatgtggaactcgtgc

SEQ ID NO: 62125 - DNA, 23 bp, Homo sapiens
atcattactttgataccttttct

SEQ ID NO: 62126 - DNA, 22 bp, Homo sapiens
gaaagacatagttgcaagatgg

SEQ ID NO: 62127 - DNA, 22 bp, Homo sapiens
caggaagctgtgaaggagacgg

SEQ ID NO: 62128 - DNA, 22 bp, Homo sapiens
actgcactccagcctgggtgac

SEQ ID NO: 62129 - DNA, 22 bp, Homo sapiens
gaggccacggaagggagctgtg

SEQ ID NO: 62130 - DNA, 22 bp, Homo sapiens
gagcccaggaagtggaggctga

SEQ ID NO: 62131 - DNA, 22 bp, Homo sapiens
gggagctggagctggaagactc

SEQ ID NO: 62132 - DNA, 22 bp, Homo sapiens
agtgctgtctccttcccccggg

SEQ ID NO: 62133 - DNA, 22 bp, Homo sapiens
ccaggctgctgttggtgtccgc

SEQ ID NO: 62134 - DNA, 22 bp, Homo sapiens
aggggagccagggctgcgagtt

SEQ ID NO: 62135 - DNA, 21 bp, Homo sapiens
cctcaagtgcctcctgctgct

SEQ ID NO: 62136 - DNA, 22 bp, Homo sapiens
cagctgctgttcagttttgttt

SEQ ID NO: 62137 - DNA, 22 bp, Homo sapiens
ctggggaacgcagcgagcagcg

SEQ ID NO: 62138 - DNA, 22 bp, Homo sapiens
tcaatcacgtgttccatgttct

SEQ ID NO: 62139 - DNA, 22 bp, Homo sapiens
tgggcagggagctggaaccaca

SEQ ID NO: 62140 - DNA, 22 bp, Homo sapiens
gaggtaggtgtaggaggcctgc

SEQ ID NO: 62141 - DNA, 22 bp, Homo sapiens
caggaggagggcagccgcctcc

SEQ ID NO: 62142 - DNA, 22 bp, Homo sapiens
tcctagttctctgccagtcgct

SEQ ID NO: 62143 - DNA, 22 bp, Homo sapiens
acatgagactgggtttgtaggg

SEQ ID NO: 62144 - DNA, 22 bp, Homo sapiens
tcgctgaggctgcacggctgcc

SEQ ID NO: 62145 - DNA, 22 bp, Homo sapiens
tgactacaacctccacctcccg

SEQ ID NO: 62146 - DNA, 22 bp, Homo sapiens
tcctgccttgcctgggacatca

SEQ ID NO: 62147 - DNA, 22 bp, Homo sapiens
gcgaggaggggtgctgggcccc

SEQ ID NO: 62148 - DNA, 22 bp, Homo sapiens
agtgccctttacaacttcttga

SEQ ID NO: 62149 - DNA, 22 bp, Homo sapiens
agggagcaaaggtttcagggtt

SEQ ID NO: 62150 - DNA, 22 bp, Homo sapiens
gagctcattcattcattgcctg

SEQ ID NO: 62151 - DNA, 22 bp, Homo sapiens
ctggagggctgcagcgaggctg

SEQ ID NO: 62152 - DNA, 22 bp, Homo sapiens
acaagaagtaaaggtcggatgc

SEQ ID NO: 62153 - DNA, 22 bp, Homo sapiens
agtcttagaactacagtgccta

SEQ ID NO: 62154 - DNA, 22 bp, Homo sapiens
ggtgggagagcttgctttgatg

SEQ ID NO: 62155 - DNA, 22 bp, Homo sapiens
ctgggaggcggaggttgcagtg

SEQ ID NO: 62156 - DNA, 22 bp, Homo sapiens
gctccccaaaagctccaggaaa

SEQ ID NO: 62157 - DNA, 23 bp, Homo sapiens
gatgaggacctacaggtggccag

SEQ ID NO: 62158 - DNA, 22 bp, Homo sapiens
aaaaaattatcatagttcctga

SEQ ID NO: 62159 - DNA, 22 bp, Homo sapiens
tttgttttcaatgtgtcattca

SEQ ID NO: 62160 - DNA, 22 bp, Homo sapiens
atcaacatgtcataaagtgaaa

SEQ ID NO: 62161 - DNA, 22 bp, Homo sapiens
gcacatccaatgattgttttga

SEQ ID NO: 62162 - DNA, 22 bp, Homo sapiens
atgttctacagatggaaagggg

SEQ ID NO: 62163 - DNA, 22 bp, Homo sapiens
cccaggaggcctgcctggccgg

SEQ ID NO: 62164 - DNA, 23 bp, Homo sapiens
atgggccaagcaagacccatgac

SEQ ID NO: 62165 - DNA, 22 bp, Homo sapiens
tcacccaggctggagtgcagtg

SEQ ID NO: 62166 - DNA, 22 bp, Homo sapiens
cctggaggcggaggttgcagtg

SEQ ID NO: 62167 - DNA, 22 bp, Homo sapiens
aggacagagggaccagagccca

SEQ ID NO: 62168 - DNA, 22 bp, Homo sapiens
tgggaagctgcattttaacaag

SEQ ID NO: 62169 - DNA, 22 bp, Homo sapiens
tgtacttgaacttgactgtaga

SEQ ID NO: 62170 - DNA, 22 bp, Homo sapiens
caggcagggagctggaaaggat

SEQ ID NO: 62171 - DNA, 22 bp, Homo sapiens
catgatctggtcctactgtggg

SEQ ID NO: 62172 - DNA, 22 bp, Homo sapiens
gccccagcctcccgagtagctg

SEQ ID NO: 62173 - DNA, 22 bp, Homo sapiens
atggtactggggtcccggagtt

SEQ ID NO: 62174 - DNA, 22 bp, Homo sapiens
atgtttaaagggttgagaaata

SEQ ID NO: 62175 - DNA, 22 bp, Homo sapiens
aatgccttggagagcctagagg

SEQ ID NO: 62176 - DNA, 22 bp, Homo sapiens
gaggctgcagctatcagacatt

SEQ ID NO: 62177 - DNA, 22 bp, Homo sapiens
cccagcaggaggaggttgcagt

SEQ ID NO: 62178 - DNA, 22 bp, Homo sapiens
agagtggctctgctgggcacag

SEQ ID NO: 62179 - DNA, 22 bp, Homo sapiens
atcaagggcgcgtggttcggcg

SEQ ID NO: 62180 - DNA, 22 bp, Homo sapiens
gggccagtgaacaatgagggaa

SEQ ID NO: 62181 - DNA, 22 bp, Homo sapiens
agaaaatttaaagagacacaca

SEQ ID NO: 62182 - DNA, 22 bp, Homo sapiens
aggaaataggaccagacaaagc

SEQ ID NO: 62183 - DNA, 22 bp, Homo sapiens
agatttggcagtataaattctg

SEQ ID NO: 62184 - DNA, 22 bp, Homo sapiens
atatacacatctttttaaatat

SEQ ID NO: 62185 - DNA, 22 bp, Homo sapiens
cactgcactccagcttgggtga

SEQ ID NO: 62186 - DNA, 22 bp, Homo sapiens
atgattagttaccttgatttaa

SEQ ID NO: 62187 - DNA, 22 bp, Homo sapiens
catggtgatttgcgccttctat

SEQ ID NO: 62188 - DNA, 22 bp, Homo sapiens
gtcccctgtccagggccagcca

SEQ ID NO: 62189 - DNA, 22 bp, Homo sapiens
ggctgggcctctccctcagctg

SEQ ID NO: 62190 - DNA, 22 bp, Homo sapiens
acaggcttacaggctgcaagta

SEQ ID NO: 62191 - DNA, 22 bp, Homo sapiens
cccgggaggaggaagttgcagt

SEQ ID NO: 62192 - DNA, 22 bp, Homo sapiens
ggttggtaactccctgtgcagt

SEQ ID NO: 62193 - DNA, 22 bp, Homo sapiens
cagggcctcctaaggcatctaa

SEQ ID NO: 62194 - DNA, 22 bp, Homo sapiens
caggctgctgcctagaatgaca

SEQ ID NO: 62195 - DNA, 22 bp, Homo sapiens
agagctaagaaacagaattgct

SEQ ID NO: 62196 - DNA, 22 bp, Homo sapiens
cggagcctgcttgttgcagctg

SEQ ID NO: 62197 - DNA, 22 bp, Homo sapiens
cacagctgaagtagccatgtgg

SEQ ID NO: 62198 - DNA, 21 bp, Homo sapiens
gctgttcggcggccctcgcgc

SEQ ID NO: 62199 - DNA, 22 bp, Homo sapiens
acctggacacctgctgtcatct

SEQ ID NO: 62200 - DNA, 22 bp, Homo sapiens
gtggatggagctggaagccatt

SEQ ID NO: 62201 - DNA, 22 bp, Homo sapiens
tcctgggatcaagtgatcctcc

SEQ ID NO: 62202 - DNA, 22 bp, Homo sapiens
acagcccagctctttctctgca

SEQ ID NO: 62203 - DNA, 21 bp, Homo sapiens
cgcagagcgaacttgcggcgc

SEQ ID NO: 62204 - DNA, 22 bp, Homo sapiens
gcaggcagaggtggaggagaca

SEQ ID NO: 62205 - DNA, 22 bp, Homo sapiens
tagagtgtcataacagtgccca

SEQ ID NO: 62206 - DNA, 22 bp, Homo sapiens
ttggagagtgatattcagatgc

SEQ ID NO: 62207 - DNA, 19 bp, Homo sapiens
acccagcccaggagtggca

SEQ ID NO: 62208 - DNA, 22 bp, Homo sapiens
accctgctttatgccgtcctct

SEQ ID NO: 62209 - DNA, 22 bp, Homo sapiens
atgccactgcgctccagcctgg

SEQ ID NO: 62210 - DNA, 22 bp, Homo sapiens
agatttatgtggtcacactcag

SEQ ID NO: 62211 - DNA, 22 bp, Homo sapiens
ccattgcactccatcctgggca

SEQ ID NO: 62212 - DNA, 22 bp, Homo sapiens
actttaaaactgatcatcagag

SEQ ID NO: 62213 - DNA, 22 bp, Homo sapiens
gaactttataactgtaaatgtc

SEQ ID NO: 62214 - DNA, 22 bp, Homo sapiens
tgtgggacctcagagggtcccc

SEQ ID NO: 62215 - DNA, 22 bp, Homo sapiens
ccaggcaggcgatggtgcagtg

SEQ ID NO: 62216 - DNA, 22 bp, Homo sapiens
ctggccagatgttacgtccaat

SEQ ID NO: 62217 - DNA, 22 bp, Homo sapiens
aacccagggtggaggttgcagt

SEQ ID NO: 62218 - DNA, 23 bp, Homo sapiens
cagagctggctcagagctgcctg

SEQ ID NO: 62219 - DNA, 22 bp, Homo sapiens
tcagcctgctccaagtgctgcc

SEQ ID NO: 62220 - DNA, 22 bp, Homo sapiens
atgccactgcgctctagcctgg

SEQ ID NO: 62221 - DNA, 22 bp, Homo sapiens
agcccaggagtttgaggctgtg

SEQ ID NO: 62222 - DNA, 22 bp, Homo sapiens
actgccaatggtagtttgatgg

SEQ ID NO: 62223 - DNA, 22 bp, Homo sapiens
gcccagtggtaaaagcaggcct

SEQ ID NO: 62224 - DNA, 22 bp, Homo sapiens
ttcacagcttaataaggctcag

SEQ ID NO: 62225 - DNA, 22 bp, Homo sapiens
agtgagagtattaatgtgaact

SEQ ID NO: 62226 - DNA, 23 bp, Homo sapiens
aaacttgctatggctgaaatcat

SEQ ID NO: 62227 - DNA, 22 bp, Homo sapiens
ttctgtgaatcttttttcccac

SEQ ID NO: 62228 - DNA, 22 bp, Homo sapiens
acgtgcaggatctggttggcga

SEQ ID NO: 62229 - DNA, 22 bp, Homo sapiens
tggtgggctgagtctcatcgga

SEQ ID NO: 62230 - DNA, 22 bp, Homo sapiens
aagcagaatagaggcccttccc

SEQ ID NO: 62231 - DNA, 22 bp, Homo sapiens
ggggtgtggacggctgtgccag

SEQ ID NO: 62232 - DNA, 22 bp, Homo sapiens
ccagcagagcatggggaggaag

SEQ ID NO: 62233 - DNA, 22 bp, Homo sapiens
ccaggaggcggaaggtacagtg

SEQ ID NO: 62234 - DNA, 22 bp, Homo sapiens
cccaggaggtggagttcacagt

SEQ ID NO: 62235 - DNA, 22 bp, Homo sapiens
ggaggtggaggttgcagtgagc

SEQ ID NO: 62236 - DNA, 22 bp, Homo sapiens
ggaggcggaggttgcagtgagt

SEQ ID NO: 62237 - DNA, 22 bp, Homo sapiens
tcctccagttccttggtttcag

SEQ ID NO: 62238 - DNA, 22 bp, Homo sapiens
cactcagctgagccctcagccc

SEQ ID NO: 62239 - DNA, 22 bp, Homo sapiens
tctggctctggagtccacctgc

SEQ ID NO: 62240 - DNA, 18 bp, Homo sapiens
cagggctgtggggtcact

SEQ ID NO: 62241 - DNA, 22 bp, Homo sapiens
gctgtctcatacaaggccctgc

SEQ ID NO: 62242 - DNA, 22 bp, Homo sapiens
ggagatatttgtattctgtctc

SEQ ID NO: 62243 - DNA, 22 bp, Homo sapiens
ggccagcctggggctcccagac

SEQ ID NO: 62244 - DNA, 22 bp, Homo sapiens
gtatgtgaggttggtttccagg

SEQ ID NO: 62245 - DNA, 22 bp, Homo sapiens
actggacagaggaaatatggag

SEQ ID NO: 62246 - DNA, 22 bp, Homo sapiens
tgggccacacacagaagaatca

SEQ ID NO: 62247 - DNA, 22 bp, Homo sapiens
atgccacttcattccagcctcg

SEQ ID NO: 62248 - DNA, 22 bp, Homo sapiens
gagtggggggtccgtctcagtg

SEQ ID NO: 62249 - DNA, 22 bp, Homo sapiens
ctggcttttttcccattatgca

SEQ ID NO: 62250 - DNA, 22 bp, Homo sapiens
ccaggggggcgtagatgctggg

SEQ ID NO: 62251 - DNA, 22 bp, Homo sapiens
gtcaccagtgctaagaggtgga

SEQ ID NO: 62252 - DNA, 22 bp, Homo sapiens
gagctcatccccatggtccgtc

SEQ ID NO: 62253 - DNA, 22 bp, Homo sapiens
tggagataggctgaggcagggc

SEQ ID NO: 62254 - DNA, 22 bp, Homo sapiens
cctgggaggctgaggctgcagt

SEQ ID NO: 62255 - DNA, 22 bp, Homo sapiens
gggaagtgatggagccaggatt

SEQ ID NO: 62256 - DNA, 21 bp, Homo sapiens
agtagtttagcacagggtttg

SEQ ID NO: 62257 - DNA, 22 bp, Homo sapiens
tcccagaaccctgccaggtcct

SEQ ID NO: 62258 - DNA, 16 bp, Homo sapiens
tgggtgggaggagcgg

SEQ ID NO: 62259 - DNA, 22 bp, Homo sapiens
gcagagatctgagaaggctgcc

SEQ ID NO: 62260 - DNA, 22 bp, Homo sapiens
gacccaggggcagggagaaagt

SEQ ID NO: 62261 - DNA, 22 bp, Homo sapiens
tcacttagatggggatcatcac

SEQ ID NO: 62262 - DNA, 21 bp, Homo sapiens
cagggccaatcctgacctcta

SEQ ID NO: 62263 - DNA, 22 bp, Homo sapiens
ggaggagcatgagagggtagtg

SEQ ID NO: 62264 - DNA, 22 bp, Homo sapiens
catggggcccatgtgctccaag

SEQ ID NO: 62265 - DNA, 22 bp, Homo sapiens
gtagcccacctggggagggcga

SEQ ID NO: 62266 - DNA, 22 bp, Homo sapiens
tcaggaggtccgcccgggaggg

SEQ ID NO: 62267 - DNA, 22 bp, Homo sapiens
cagagagaatcttggcagctga

SEQ ID NO: 62268 - DNA, 22 bp, Homo sapiens
gctgtggcctggcgcagagctg

SEQ ID NO: 62269 - DNA, 22 bp, Homo sapiens
tgccgcagtgcggggagggccc

SEQ ID NO: 62270 - DNA, 22 bp, Homo sapiens
ggctgggcaggtctgcacaggg

SEQ ID NO: 62271 - DNA, 22 bp, Homo sapiens
actccacatttgaacacagttc

SEQ ID NO: 62272 - DNA, 19 bp, Homo sapiens
gcctcatttccacctcccc

SEQ ID NO: 62273 - DNA, 22 bp, Homo sapiens
tggatatccttgttaactttct

SEQ ID NO: 62274 - DNA, 22 bp, Homo sapiens
ggcgctcagtgttgccccagag

SEQ ID NO: 62275 - DNA, 22 bp, Homo sapiens
gttactcctggttgagcttggt

SEQ ID NO: 62276 - DNA, 16 bp, Homo sapiens
aggctcagaggctgga

SEQ ID NO: 62277 - DNA, 22 bp, Homo sapiens
aactatgttaataagtttcatt

SEQ ID NO: 62278 - DNA, 22 bp, Homo sapiens
ctggaggccactgtacagattg

SEQ ID NO: 62279 - DNA, 17 bp, Homo sapiens
tggtccaggtggagcca

SEQ ID NO: 62280 - DNA, 22 bp, Homo sapiens
ttcctttctctggactgcagcc

SEQ ID NO: 62281 - DNA, 22 bp, Homo sapiens
taatgtaaacacagagacagaa

SEQ ID NO: 62282 - DNA, 22 bp, Homo sapiens
ctgcagggagaggggacagcct

SEQ ID NO: 62283 - DNA, 22 bp, Homo sapiens
gatttttatataaagtgagaaa

SEQ ID NO: 62284 - DNA, 22 bp, Homo sapiens
ctggcctaggaatggttttccg

SEQ ID NO: 62285 - DNA, 22 bp, Homo sapiens
gtctccccagggccctcttcat

SEQ ID NO: 62286 - DNA, 22 bp, Homo sapiens
tggagaattctatgttgagggg

SEQ ID NO: 62287 - DNA, 22 bp, Homo sapiens
atccatttgacataatttcagc

SEQ ID NO: 62288 - DNA, 22 bp, Homo sapiens
ccaccagctgcatatgcacgta

SEQ ID NO: 62289 - DNA, 22 bp, Homo sapiens
gctgtgcagaggtgagaatcca

SEQ ID NO: 62290 - DNA, 22 bp, Homo sapiens
gggaggcagtgctggaggctgg

SEQ ID NO: 62291 - DNA, 22 bp, Homo sapiens
cagcccaggactgcaggtgttt

SEQ ID NO: 62292 - DNA, 22 bp, Homo sapiens
agcgggtctgcaagccttccct

SEQ ID NO: 62293 - DNA, 22 bp, Homo sapiens
ttggcttttatgcagcttaggt

SEQ ID NO: 62294 - DNA, 23 bp, Homo sapiens
ctcctcgtaactctgtggtgggt

SEQ ID NO: 62295 - DNA, 22 bp, Homo sapiens
tccccagcttgctacttctgct

SEQ ID NO: 62296 - DNA, 22 bp, Homo sapiens
gaggggcacagtaaagggtccc

SEQ ID NO: 62297 - DNA, 23 bp, Homo sapiens
gacagagtgagaccttgtcttac

SEQ ID NO: 62298 - DNA, 23 bp, Homo sapiens
agcaatctgtgtttcagcaagcc

SEQ ID NO: 62299 - DNA, 22 bp, Homo sapiens
tacaaaaaattgatactgacga

SEQ ID NO: 62300 - DNA, 22 bp, Homo sapiens
ccaggctggagtgcagtggcac

SEQ ID NO: 62301 - DNA, 22 bp, Homo sapiens
ctgaggctggagtgcagtggtg

SEQ ID NO: 62302 - DNA, 22 bp, Homo sapiens
ttctagtgtccttggacttgct

SEQ ID NO: 62303 - DNA, 22 bp, Homo sapiens
ccagagtcccttgcagctcagt

SEQ ID NO: 62304 - DNA, 22 bp, Homo sapiens
cttagatgaagtcacagaaccc

SEQ ID NO: 62305 - DNA, 22 bp, Homo sapiens
gctgctctcagagctcatgctg

SEQ ID NO: 62306 - DNA, 22 bp, Homo sapiens
gcagcgaggtgatgaaatagct

SEQ ID NO: 62307 - DNA, 20 bp, Homo sapiens
atggatgaccttggccaggg

SEQ ID NO: 62308 - DNA, 22 bp, Homo sapiens
tagctgggactactggccctgc

SEQ ID NO: 62309 - DNA, 22 bp, Homo sapiens
cacagctgtgagaagggagcct

SEQ ID NO: 62310 - DNA, 20 bp, Homo sapiens
ataaaataactgccacaaga

SEQ ID NO: 62311 - DNA, 22 bp, Homo sapiens
gcgggccaccttggagagcgct

SEQ ID NO: 62312 - DNA, 22 bp, Homo sapiens
caggcagaagaagtggaaggac

SEQ ID NO: 62313 - DNA, 22 bp, Homo sapiens
agtggcctggagccccgcctgg

SEQ ID NO: 62314 - DNA, 22 bp, Homo sapiens
gcccaggaggcagaggttgtgg

SEQ ID NO: 62315 - DNA, 22 bp, Homo sapiens
acccagccatgttcagttctct

SEQ ID NO: 62316 - DNA, 22 bp, Homo sapiens
aactcactttgtggcttctgaa

SEQ ID NO: 62317 - DNA, 22 bp, Homo sapiens
tgccgctccaggtctcgcggtg

SEQ ID NO: 62318 - DNA, 22 bp, Homo sapiens
tgggaaggggagctggaaagga

SEQ ID NO: 62319 - DNA, 22 bp, Homo sapiens
gcctccggagtcacagtgtctt

SEQ ID NO: 62320 - DNA, 22 bp, Homo sapiens
atgctatgtaactggcagatag

SEQ ID NO: 62321 - DNA, 22 bp, Homo sapiens
acccaggccattggcaagagtc

SEQ ID NO: 62322 - DNA, 22 bp, Homo sapiens
cacctcaggcagcaaagtctca

SEQ ID NO: 62323 - DNA, 22 bp, Homo sapiens
ggttccacctggcgaggggtat

SEQ ID NO: 62324 - DNA, 22 bp, Homo sapiens
gggagtgggtttggcctaggcc

SEQ ID NO: 62325 - DNA, 22 bp, Homo sapiens
agcagctcctgtttttgggata

SEQ ID NO: 62326 - DNA, 22 bp, Homo sapiens
tggaagacaatttgaaaacatt

SEQ ID NO: 62327 - DNA, 22 bp, Homo sapiens
ggagagtggattccagctgtat

SEQ ID NO: 62328 - DNA, 22 bp, Homo sapiens
gacaggaggcagagctcaggtg

SEQ ID NO: 62329 - DNA, 22 bp, Homo sapiens
acagcagcaatagcagtgacat

SEQ ID NO: 62330 - DNA, 22 bp, Homo sapiens
cctggggtcacttgcagccgca

SEQ ID NO: 62331 - DNA, 20 bp, Homo sapiens
gggcagtggcgctatctcag

SEQ ID NO: 62332 - DNA, 22 bp, Homo sapiens
gaggcagaggttgcagtgagct

SEQ ID NO: 62333 - DNA, 22 bp, Homo sapiens
ctgtaatcccagctactcggga

SEQ ID NO: 62334 - DNA, 22 bp, Homo sapiens
attctcaaaacataacttcact

SEQ ID NO: 62335 - DNA, 22 bp, Homo sapiens
aacccaggagacaggttgcagt

SEQ ID NO: 62336 - DNA, 22 bp, Homo sapiens
gggagctgaaggagccggcggg

SEQ ID NO: 62337 - DNA, 22 bp, Homo sapiens
tgcactccaggctgggtgacag

SEQ ID NO: 62338 - DNA, 22 bp, Homo sapiens
tgagatgaataactcctgctaa

SEQ ID NO: 62339 - DNA, 22 bp, Homo sapiens
ccccaggacgtggccctcatag

SEQ ID NO: 62340 - DNA, 22 bp, Homo sapiens
ctgggcagctgtatcagggagt

SEQ ID NO: 62341 - DNA, 22 bp, Homo sapiens
gtggtgagattgctggatcaaa

SEQ ID NO: 62342 - DNA, 22 bp, Homo sapiens
actcaagtcataggcttctttc

SEQ ID NO: 62343 - DNA, 22 bp, Homo sapiens
gcagtggcatgatgtgggctca

SEQ ID NO: 62344 - DNA, 22 bp, Homo sapiens
tgcttacgagctattttcactt

SEQ ID NO: 62345 - DNA, 22 bp, Homo sapiens
cagcaggaggtgagtagcaggt

SEQ ID NO: 62346 - DNA, 22 bp, Homo sapiens
cctgggcctctcaaagtgctgg

SEQ ID NO: 62347 - DNA, 19 bp, Homo sapiens
gctgaggtggaggaaggag

SEQ ID NO: 62348 - DNA, 17 bp, Homo sapiens
aatctgtttacagtcag

SEQ ID NO: 62349 - DNA, 20 bp, Homo sapiens
tcagccattccttacctttc

SEQ ID NO: 62350 - DNA, 22 bp, Homo sapiens
tcactgcaacctccacctcctg

SEQ ID NO: 62351 - DNA, 22 bp, Homo sapiens
tgtaggagtccaatcaggagac

SEQ ID NO: 62352 - DNA, 22 bp, Homo sapiens
gcttggccagcagccgggatgc

SEQ ID NO: 62353 - DNA, 22 bp, Homo sapiens
gagggagggactagcattctct

SEQ ID NO: 62354 - DNA, 20 bp, Homo sapiens
aaattactgccacacatttc

SEQ ID NO: 62355 - DNA, 22 bp, Homo sapiens
agaggctgcacttgctcatgat

SEQ ID NO: 62356 - DNA, 18 bp, Homo sapiens
ttgcttcttttctctagg

SEQ ID NO: 62357 - DNA, 22 bp, Homo sapiens
gggtggtggccagcagtgggca

SEQ ID NO: 62358 - DNA, 22 bp, Homo sapiens
tctgcatattgttaatggaatg

SEQ ID NO: 62359 - DNA, 22 bp, Homo sapiens
accctcaacaaattcactctat

SEQ ID NO: 62360 - DNA, 22 bp, Homo sapiens
tatccaattcaccattgatggg

SEQ ID NO: 62361 - DNA, 22 bp, Homo sapiens
cgggcagtgtggctccagagtc

SEQ ID NO: 62362 - DNA, 22 bp, Homo sapiens
gttgtgattgtagctaaactag

SEQ ID NO: 62363 - DNA, 22 bp, Homo sapiens
tagcataacaggtaagagtgag

SEQ ID NO: 62364 - DNA, 22 bp, Homo sapiens
ccaggaggcagaagttgcagtg

SEQ ID NO: 62365 - DNA, 22 bp, Homo sapiens
tggctcctcacgtcctcagagc

SEQ ID NO: 62366 - DNA, 22 bp, Homo sapiens
tctagttctagatccctgagga

SEQ ID NO: 62367 - DNA, 22 bp, Homo sapiens
caaaatgcatctgagaccaggc

SEQ ID NO: 62368 - DNA, 22 bp, Homo sapiens
gctgcagacttctcatctcatt

SEQ ID NO: 62369 - DNA, 22 bp, Homo sapiens
ggtgggagagctctgtctccag

SEQ ID NO: 62370 - DNA, 22 bp, Homo sapiens
acccatccagtgtccctgctag

SEQ ID NO: 62371 - DNA, 23 bp, Homo sapiens
ggagtgcaatggcgccatctcgg

SEQ ID NO: 62372 - DNA, 22 bp, Homo sapiens
agctctgaaagttatgtcgccg

SEQ ID NO: 62373 - DNA, 22 bp, Homo sapiens
gcctccagcccacgcaggcctg

SEQ ID NO: 62374 - DNA, 22 bp, Homo sapiens
tctgctcagccgatctgctccg

SEQ ID NO: 62375 - DNA, 22 bp, Homo sapiens
tcctcctgtctaccagttcctg

SEQ ID NO: 62376 - DNA, 23 bp, Homo sapiens
ttgcagaagcagacgaccataat

SEQ ID NO: 62377 - DNA, 22 bp, Homo sapiens
ggttttcacctccagaatgtgc

SEQ ID NO: 62378 - DNA, 22 bp, Homo sapiens
ggtcacgtgaccgcacctgcct

SEQ ID NO: 62379 - DNA, 22 bp, Homo sapiens
ggctgtggcagctggaagtggt

SEQ ID NO: 62380 - DNA, 23 bp, Homo sapiens
agcagccagagatcctcggccct

SEQ ID NO: 62381 - DNA, 22 bp, Homo sapiens
agggctggagccacagctggga

SEQ ID NO: 62382 - DNA, 22 bp, Homo sapiens
ctggtgtggactccgcgcggag

SEQ ID NO: 62383 - DNA, 22 bp, Homo sapiens
gcctcctgagtagctgggattg

SEQ ID NO: 62384 - DNA, 22 bp, Homo sapiens
agcccaggctggagtgcagtgg

SEQ ID NO: 62385 - DNA, 22 bp, Homo sapiens
aggagatggagctcagtgggca

SEQ ID NO: 62386 - DNA, 22 bp, Homo sapiens
gtctttcttaaacaacagaaca

SEQ ID NO: 62387 - DNA, 22 bp, Homo sapiens
tcacccaggctggagtgtagtg

SEQ ID NO: 62388 - DNA, 22 bp, Homo sapiens
aaagaaatagatggcatttaaa

SEQ ID NO: 62389 - DNA, 22 bp, Homo sapiens
attataggcttgagccaccgtg

SEQ ID NO: 62390 - DNA, 20 bp, Homo sapiens
ggggcccaagccctcttgcc

SEQ ID NO: 62391 - DNA, 22 bp, Homo sapiens
cacctagggtttcgcctttctt

SEQ ID NO: 62392 - DNA, 22 bp, Homo sapiens
tggcacgacaattggcaccaat

SEQ ID NO: 62393 - DNA, 22 bp, Homo sapiens
ctcagctgcagcctggctggca

SEQ ID NO: 62394 - DNA, 22 bp, Homo sapiens
tgctgggggtagctctgcgtag

SEQ ID NO: 62395 - DNA, 22 bp, Homo sapiens
gcagggaggtttgctgacctgg

SEQ ID NO: 62396 - DNA, 22 bp, Homo sapiens
tgcatggacgtgacttggccaa

SEQ ID NO: 62397 - DNA, 22 bp, Homo sapiens
aggagctgtcagagtgccagag

SEQ ID NO: 62398 - DNA, 17 bp, Homo sapiens
cgggcatggagggcagg

SEQ ID NO: 62399 - DNA, 22 bp, Homo sapiens
tgtgggtggcatcgtcctggcc

SEQ ID NO: 62400 - DNA, 22 bp, Homo sapiens
cacccaggttggagtgcagtgg

SEQ ID NO: 62401 - DNA, 22 bp, Homo sapiens
tgtgacactggccatctgggtt

SEQ ID NO: 62402 - DNA, 22 bp, Homo sapiens
tggctccacaggccagggtgtg

SEQ ID NO: 62403 - DNA, 22 bp, Homo sapiens
gctggaggatggactggaagaa

SEQ ID NO: 62404 - DNA, 22 bp, Homo sapiens
aaagttctctatggtgtaaaaa

SEQ ID NO: 62405 - DNA, 22 bp, Homo sapiens
gcaggtggatcacctgaggtca

SEQ ID NO: 62406 - DNA, 22 bp, Homo sapiens
aaaaagtattggccatggttga

SEQ ID NO: 62407 - DNA, 22 bp, Homo sapiens
atagagtgatgtaaggtatgtg

SEQ ID NO: 62408 - DNA, 22 bp, Homo sapiens
tttgaagactactgggagtgaa

SEQ ID NO: 62409 - DNA, 22 bp, Homo sapiens
gaagccttgaactgcaaacccc

SEQ ID NO: 62410 - DNA, 22 bp, Homo sapiens
actgggccaggtgtgggtgagt

SEQ ID NO: 62411 - DNA, 18 bp, Homo sapiens
gaggatggaaggagatgc

SEQ ID NO: 62412 - DNA, 22 bp, Homo sapiens
ggggtcggggcatagccactta

SEQ ID NO: 62413 - DNA, 22 bp, Homo sapiens
tgggtggcagcttcagcatgtt

SEQ ID NO: 62414 - DNA, 21 bp, Homo sapiens
gaccccagaccagcagacaca

SEQ ID NO: 62415 - DNA, 22 bp, Homo sapiens
ttaaatattatgttgtctgcaa

SEQ ID NO: 62416 - DNA, 22 bp, Homo sapiens
agaaggacccggtgggagatga

SEQ ID NO: 62417 - DNA, 22 bp, Homo sapiens
acaggggcaagggctcacggcc

SEQ ID NO: 62418 - DNA, 20 bp, Homo sapiens
aagacaccagtggcagcccc

SEQ ID NO: 62419 - DNA, 23 bp, Homo sapiens
attttttgtctttgtaactagat

SEQ ID NO: 62420 - DNA, 22 bp, Homo sapiens
caggctggagtgcaatgacgcc

SEQ ID NO: 62421 - DNA, 22 bp, Homo sapiens
aatggctctgatgttgttgtga

SEQ ID NO: 62422 - DNA, 22 bp, Homo sapiens
agctgctgagccaggctgatgt

SEQ ID NO: 62423 - DNA, 22 bp, Homo sapiens
tgtttcttacgtttttagaggc

SEQ ID NO: 62424 - DNA, 22 bp, Homo sapiens
cctttcccgctttgagggcaag

SEQ ID NO: 62425 - DNA, 22 bp, Homo sapiens
ctgcagtctacctggattttta

SEQ ID NO: 62426 - DNA, 22 bp, Homo sapiens
ttggagaggcagtcttgctctg

SEQ ID NO: 62427 - DNA, 22 bp, Homo sapiens
ggctagggatctagaccaggac

SEQ ID NO: 62428 - DNA, 22 bp, Homo sapiens
tcgcaccattgcactccagcca

SEQ ID NO: 62429 - DNA, 22 bp, Homo sapiens
ggctgcaggttggttggcagct

SEQ ID NO: 62430 - DNA, 22 bp, Homo sapiens
catccaccgcgtgcacctctac

SEQ ID NO: 62431 - DNA, 22 bp, Homo sapiens
gtgggccactgggaggcaaggg

SEQ ID NO: 62432 - DNA, 22 bp, Homo sapiens
atgcagtggcttcagtgtcagt

SEQ ID NO: 62433 - DNA, 22 bp, Homo sapiens
gtgggctgcccttgaggtcagc

SEQ ID NO: 62434 - DNA, 22 bp, Homo sapiens
gccagggttcgaatccgtatgg

SEQ ID NO: 62435 - DNA, 22 bp, Homo sapiens
actctccttttgatcttcagaa

SEQ ID NO: 62436 - DNA, 22 bp, Homo sapiens
actgcactcctgcctgggtaac

SEQ ID NO: 62437 - DNA, 22 bp, Homo sapiens
agaaatatgctgattagatgaa

SEQ ID NO: 62438 - DNA, 22 bp, Homo sapiens
gagtagaactggttatctaata

SEQ ID NO: 62439 - DNA, 22 bp, Homo sapiens
gttggctatgagagctttagtg

SEQ ID NO: 62440 - DNA, 22 bp, Homo sapiens
ttgtgctctgtgttatttaagg

SEQ ID NO: 62441 - DNA, 21 bp, Homo sapiens
gggcagaggggcctcctgggt

SEQ ID NO: 62442 - DNA, 22 bp, Homo sapiens
tgcagtggcgccatctcagctc

SEQ ID NO: 62443 - DNA, 22 bp, Homo sapiens
agaagccaccagctgaggaaga

SEQ ID NO: 62444 - DNA, 22 bp, Homo sapiens
cgaggaggaaacgcggagaact

SEQ ID NO: 62445 - DNA, 22 bp, Homo sapiens
cagccccacacggtctagctct

SEQ ID NO: 62446 - DNA, 22 bp, Homo sapiens
cccaggagttggaggctgcagt

SEQ ID NO: 62447 - DNA, 22 bp, Homo sapiens
cagcgtgggatttggaaaccag

SEQ ID NO: 62448 - DNA, 22 bp, Homo sapiens
ggaggctgaggcaggcggatca

SEQ ID NO: 62449 - DNA, 19 bp, Homo sapiens
tctcaattctccccactgc

SEQ ID NO: 62450 - DNA, 22 bp, Homo sapiens
atgccactgcacttcagcctgg

SEQ ID NO: 62451 - DNA, 22 bp, Homo sapiens
gataccagacagggagggagaa

SEQ ID NO: 62452 - DNA, 22 bp, Homo sapiens
agaggaagtaatcaggacctgc

SEQ ID NO: 62453 - DNA, 22 bp, Homo sapiens
ctgctctgctgatcagtgtctc

SEQ ID NO: 62454 - DNA, 22 bp, Homo sapiens
cactgcactgcagcctggagac

SEQ ID NO: 62455 - DNA, 22 bp, Homo sapiens
tctgttgcaatgtgcatggtga

SEQ ID NO: 62456 - DNA, 22 bp, Homo sapiens
tttattggatatttacaagata

SEQ ID NO: 62457 - DNA, 22 bp, Homo sapiens
agctggggctgtggttgtgatt

SEQ ID NO: 62458 - DNA, 22 bp, Homo sapiens
agatcacagtggcaactccctt

SEQ ID NO: 62459 - DNA, 22 bp, Homo sapiens
actgcactccagcctcggggtc

SEQ ID NO: 62460 - DNA, 22 bp, Homo sapiens
aggctagaggcttctggcttca

SEQ ID NO: 62461 - DNA, 22 bp, Homo sapiens
tgcctcagctgaggccgctcca

SEQ ID NO: 62462 - DNA, 22 bp, Homo sapiens
attgttgggtctcactcctaga

SEQ ID NO: 62463 - DNA, 22 bp, Homo sapiens
aaaatcctgctgactcgagatg

SEQ ID NO: 62464 - DNA, 22 bp, Homo sapiens
gcacatgagaagctggcgatgc

SEQ ID NO: 62465 - DNA, 22 bp, Homo sapiens
aggactgggtgcagagggcatc

SEQ ID NO: 62466 - DNA, 22 bp, Homo sapiens
aaggtggaggttgcagtgagct

SEQ ID NO: 62467 - DNA, 19 bp, Homo sapiens
ggagccgccgcccttcatt

SEQ ID NO: 62468 - DNA, 22 bp, Homo sapiens
acatgagatttgggtggtgata

SEQ ID NO: 62469 - DNA, 22 bp, Homo sapiens
atacaaaatatatactggagac

SEQ ID NO: 62470 - DNA, 22 bp, Homo sapiens
tgtgaagaattaatgtgaatca

SEQ ID NO: 62471 - DNA, 20 bp, Homo sapiens
agcagagtgcccatcccgga

SEQ ID NO: 62472 - DNA, 22 bp, Homo sapiens
cagccccatggtgtgctccagc

SEQ ID NO: 62473 - DNA, 22 bp, Homo sapiens
tccgggaggcagaggttgcagt

SEQ ID NO: 62474 - DNA, 22 bp, Homo sapiens
acttttaaatgagtttcagttg

SEQ ID NO: 62475 - DNA, 22 bp, Homo sapiens
gggaggcacgaggcgcgcagtg

SEQ ID NO: 62476 - DNA, 22 bp, Homo sapiens
gagggggctagcgcagtgccca

SEQ ID NO: 62477 - DNA, 22 bp, Homo sapiens
ccaggagttggaagctgccatg

SEQ ID NO: 62478 - DNA, 22 bp, Homo sapiens
gggcaccttgggtctcaggcaa

SEQ ID NO: 62479 - DNA, 23 bp, Homo sapiens
agcttttaggtggaaatggcact

SEQ ID NO: 62480 - DNA, 22 bp, Homo sapiens
ccggggtaggccctgaggcagc

SEQ ID NO: 62481 - DNA, 22 bp, Homo sapiens
tctgcaggaagctggcggctga

SEQ ID NO: 62482 - DNA, 22 bp, Homo sapiens
ctgagggtcaacttgattgtat

SEQ ID NO: 62483 - DNA, 22 bp, Homo sapiens
acactgtgtgacttctgagact

SEQ ID NO: 62484 - DNA, 22 bp, Homo sapiens
cggctgggttcggctgcaggcc

SEQ ID NO: 62485 - DNA, 22 bp, Homo sapiens
ttggaatgcacactgagcctgc

SEQ ID NO: 62486 - DNA, 22 bp, Homo sapiens
agagcactttcgagagccggag

SEQ ID NO: 62487 - DNA, 22 bp, Homo sapiens
aaatatcttaggagtatatgag

SEQ ID NO: 62488 - DNA, 18 bp, Homo sapiens
tcactgtgtgtcttgggt

SEQ ID NO: 62489 - DNA, 22 bp, Homo sapiens
ggaggcccagaaggaagcccag

SEQ ID NO: 62490 - DNA, 20 bp, Homo sapiens
gctgaggggtctatggcata

SEQ ID NO: 62491 - DNA, 22 bp, Homo sapiens
ggattgcaacaagctagtttag

SEQ ID NO: 62492 - DNA, 22 bp, Homo sapiens
ccctgctgtgtagcggaggaac

SEQ ID NO: 62493 - DNA, 22 bp, Homo sapiens
tgaggcaggaggattgcaggat

SEQ ID NO: 62494 - DNA, 21 bp, Homo sapiens
ggagtttttctggaagggact

SEQ ID NO: 62495 - DNA, 22 bp, Homo sapiens
tgaaatgtgttctagtgttttg

SEQ ID NO: 62496 - DNA, 22 bp, Homo sapiens
agcccttagtacatttctcaag

SEQ ID NO: 62497 - DNA, 22 bp, Homo sapiens
cagggtttcaccatgttagcag

SEQ ID NO: 62498 - DNA, 22 bp, Homo sapiens
gaggcctgggcaagggggtctg

SEQ ID NO: 62499 - DNA, 23 bp, Homo sapiens
gcctgggagttgcgatctgcccg

SEQ ID NO: 62500 - DNA, 22 bp, Homo sapiens
agaggaggctctgggatcgtcc

SEQ ID NO: 62501 - DNA, 22 bp, Homo sapiens
atccaccctgtggtggctttct

SEQ ID NO: 62502 - DNA, 22 bp, Homo sapiens
cagagctgtccaaaccctgaca

SEQ ID NO: 62503 - DNA, 22 bp, Homo sapiens
ggatgttctggggttctcttgt

SEQ ID NO: 62504 - DNA, 22 bp, Homo sapiens
tccagctgaggtggcctctgtg

SEQ ID NO: 62505 - DNA, 22 bp, Homo sapiens
gctcttgtcaaaaattagttga

SEQ ID NO: 62506 - DNA, 22 bp, Homo sapiens
ctgagcagatgaccagccccag

SEQ ID NO: 62507 - DNA, 22 bp, Homo sapiens
acagagcaataacagggagagg

SEQ ID NO: 62508 - DNA, 22 bp, Homo sapiens
ccaggaggcggaggttgcagcg

SEQ ID NO: 62509 - DNA, 22 bp, Homo sapiens
ggaaggggtgggtgagcctcag

SEQ ID NO: 62510 - DNA, 20 bp, Homo sapiens
gtgcaatggctcagtctcag

SEQ ID NO: 62511 - DNA, 23 bp, Homo sapiens
ccaagactgttaggagtggggag

SEQ ID NO: 62512 - DNA, 22 bp, Homo sapiens
acgcagtttgtggacatttttt

SEQ ID NO: 62513 - DNA, 23 bp, Homo sapiens
gtgtgttcccggagtagctcccg

SEQ ID NO: 62514 - DNA, 22 bp, Homo sapiens
tgcgggttggtggcatatgcag

SEQ ID NO: 62515 - DNA, 22 bp, Homo sapiens
gggcagagagctggaactcctt

SEQ ID NO: 62516 - DNA, 21 bp, Homo sapiens
cagaggcctatcacagactcc

SEQ ID NO: 62517 - DNA, 22 bp, Homo sapiens
agattctaccagagctagtttg

SEQ ID NO: 62518 - DNA, 22 bp, Homo sapiens
gccaggctgaggctctggaaga

SEQ ID NO: 62519 - DNA, 22 bp, Homo sapiens
acaaagccagattctggagcac

SEQ ID NO: 62520 - DNA, 22 bp, Homo sapiens
ttcactgcaacctccgcctccc

SEQ ID NO: 62521 - DNA, 22 bp, Homo sapiens
tcctcagaatcacctggcagct

SEQ ID NO: 62522 - DNA, 22 bp, Homo sapiens
gctgaggctcctcgggaggaca

SEQ ID NO: 62523 - DNA, 22 bp, Homo sapiens
ccggtcccaggtgccccggtga

SEQ ID NO: 62524 - DNA, 22 bp, Homo sapiens
ggatgcacgaaggcgcctcgga

SEQ ID NO: 62525 - DNA, 22 bp, Homo sapiens
ccagtgtgcattatcatgtgtc

SEQ ID NO: 62526 - DNA, 22 bp, Homo sapiens
gtgctggggagataggaagaga

SEQ ID NO: 62527 - DNA, 22 bp, Homo sapiens
cgtcacttcttagtctattttc

SEQ ID NO: 62528 - DNA, 22 bp, Homo sapiens
agctcctgaaaatccagactgg

SEQ ID NO: 62529 - DNA, 22 bp, Homo sapiens
ctcactgcaagctctgcctccc

SEQ ID NO: 62530 - DNA, 22 bp, Homo sapiens
ttgactagaattatttaatcga

SEQ ID NO: 62531 - DNA, 22 bp, Homo sapiens
gccttgccgctcagcagtgggg

SEQ ID NO: 62532 - DNA, 22 bp, Homo sapiens
cgcccaggctggagtgcagtga

SEQ ID NO: 62533 - DNA, 22 bp, Homo sapiens
ctgctgagagccccagctgaga

SEQ ID NO: 62534 - DNA, 22 bp, Homo sapiens
agagggtgggcacgtgatggat

SEQ ID NO: 62535 - DNA, 22 bp, Homo sapiens
ggtgacctcacctggtcccacc

SEQ ID NO: 62536 - DNA, 22 bp, Homo sapiens
gccctcctgagctagcacgtgt

SEQ ID NO: 62537 - DNA, 20 bp, Homo sapiens
gccactgggcaccagcaggg

SEQ ID NO: 62538 - DNA, 22 bp, Homo sapiens
gcctggattccttgtttctcag

SEQ ID NO: 62539 - DNA, 22 bp, Homo sapiens
tgagccaggagtttgaggctgt

SEQ ID NO: 62540 - DNA, 22 bp, Homo sapiens
gagagtctaggaacctcatata

SEQ ID NO: 62541 - DNA, 22 bp, Homo sapiens
gaggctgaggttgcagtgagct

SEQ ID NO: 62542 - DNA, 22 bp, Homo sapiens
gacaggtgctaagggacctggc

SEQ ID NO: 62543 - DNA, 22 bp, Homo sapiens
agctcttacatttaggtctatg

SEQ ID NO: 62544 - DNA, 22 bp, Homo sapiens
gagtgtgtcggtcagcgtggcg

SEQ ID NO: 62545 - DNA, 19 bp, Homo sapiens
tgaacgatgtctcagggca

SEQ ID NO: 62546 - DNA, 22 bp, Homo sapiens
gtgggcatctccttggaagcca

SEQ ID NO: 62547 - DNA, 22 bp, Homo sapiens
gcccggcagtcacacacccagg

SEQ ID NO: 62548 - DNA, 22 bp, Homo sapiens
aatcactgtggccaggtggtgt

SEQ ID NO: 62549 - DNA, 22 bp, Homo sapiens
gtggagaggaacccagctctgt

SEQ ID NO: 62550 - DNA, 22 bp, Homo sapiens
tgagccagaggaggctgtgtgg

SEQ ID NO: 62551 - DNA, 22 bp, Homo sapiens
ctaggtgatccactgctctctt

SEQ ID NO: 62552 - DNA, 22 bp, Homo sapiens
tgggggtgtcctggtgcacaca

SEQ ID NO: 62553 - DNA, 22 bp, Homo sapiens
aacctcaaactcttgggcttaa

SEQ ID NO: 62554 - DNA, 22 bp, Homo sapiens
gctcatgactgtaatcccagca

SEQ ID NO: 62555 - DNA, 22 bp, Homo sapiens
cagtggctggttagggacagga

SEQ ID NO: 62556 - DNA, 23 bp, Homo sapiens
agagcaaggaaatgaggtgtgat

SEQ ID NO: 62557 - DNA, 22 bp, Homo sapiens
actgagcaggagaatcacttta

SEQ ID NO: 62558 - DNA, 22 bp, Homo sapiens
ggtgccaggctgtagtcagggt

SEQ ID NO: 62559 - DNA, 22 bp, Homo sapiens
cccaggctggagtgcagtggcg

SEQ ID NO: 62560 - DNA, 22 bp, Homo sapiens
actgcaacctccacctcctggg

SEQ ID NO: 62561 - DNA, 22 bp, Homo sapiens
gcacatgcatgcatattcctgg

SEQ ID NO: 62562 - DNA, 22 bp, Homo sapiens
gcgcactgggcgcacgcgtagg

SEQ ID NO: 62563 - DNA, 22 bp, Homo sapiens
aaattgcaaaagtacttttagg

SEQ ID NO: 62564 - DNA, 22 bp, Homo sapiens
agtcacagggggcccctgcaac

SEQ ID NO: 62565 - DNA, 22 bp, Homo sapiens
gccagtggtcactgaggaagaa

SEQ ID NO: 62566 - DNA, 22 bp, Homo sapiens
caattctgaggcctgctttgtt

SEQ ID NO: 62567 - DNA, 22 bp, Homo sapiens
gcccaggctggagtgcagtggc

SEQ ID NO: 62568 - DNA, 22 bp, Homo sapiens
gcccaggagttcaagtctagtg

SEQ ID NO: 62569 - DNA, 22 bp, Homo sapiens
gccagcagcttcttctcatcct

SEQ ID NO: 62570 - DNA, 22 bp, Homo sapiens
tgttgatttgtgggctgcaaaa

SEQ ID NO: 62571 - DNA, 22 bp, Homo sapiens
tggcaccatcaaggctgagaac

SEQ ID NO: 62572 - DNA, 22 bp, Homo sapiens
ttttctaacatctagtaatttg

SEQ ID NO: 62573 - DNA, 22 bp, Homo sapiens
caggaaggcgcggctgtgcctg

SEQ ID NO: 62574 - DNA, 22 bp, Homo sapiens
tccaggtgggctgcacccaggc

SEQ ID NO: 62575 - DNA, 22 bp, Homo sapiens
gccggggctggggagagacatg

SEQ ID NO: 62576 - DNA, 22 bp, Homo sapiens
gaggtggccaagcgaggaaggg

SEQ ID NO: 62577 - DNA, 22 bp, Homo sapiens
tccaagatctacagcagtttag

SEQ ID NO: 62578 - DNA, 22 bp, Homo sapiens
ggcgggcagcgtcttgctggcc

SEQ ID NO: 62579 - DNA, 16 bp, Homo sapiens
gcagaggaaaggggag

SEQ ID NO: 62580 - DNA, 22 bp, Homo sapiens
gtagggttggagagcacaacca

SEQ ID NO: 62581 - DNA, 22 bp, Homo sapiens
tcagtatcaatagcgtcacaat

SEQ ID NO: 62582 - DNA, 22 bp, Homo sapiens
agtggcgtcctaggaaaggagg

SEQ ID NO: 62583 - DNA, 22 bp, Homo sapiens
tggcccagtatgtataatctta

SEQ ID NO: 62584 - DNA, 22 bp, Homo sapiens
ctggctctcaggctggtcccca

SEQ ID NO: 62585 - DNA, 23 bp, Homo sapiens
agctctgctcgggcatgccctgc

SEQ ID NO: 62586 - DNA, 22 bp, Homo sapiens
cctgggtttggagcctgcagaa

SEQ ID NO: 62587 - DNA, 22 bp, Homo sapiens
tcggagctgtagatgaaaccct

SEQ ID NO: 62588 - DNA, 22 bp, Homo sapiens
caggccagggttgagaagagaa

SEQ ID NO: 62589 - DNA, 22 bp, Homo sapiens
gtgagccgagtatagttcatag

SEQ ID NO: 62590 - DNA, 22 bp, Homo sapiens
caccctccagctcccgggggct

SEQ ID NO: 62591 - DNA, 22 bp, Homo sapiens
cccaggggttctgagcagcagc

SEQ ID NO: 62592 - DNA, 19 bp, Homo sapiens
tccaggggctccacctcct

SEQ ID NO: 62593 - DNA, 22 bp, Homo sapiens
gctaggagtggtgggtcaagga

SEQ ID NO: 62594 - DNA, 22 bp, Homo sapiens
cacccaggctggagtgcagtgg

SEQ ID NO: 62595 - DNA, 22 bp, Homo sapiens
atatattttttgagacagagtc

SEQ ID NO: 62596 - DNA, 22 bp, Homo sapiens
cagcctggtccccggctcaccc

SEQ ID NO: 62597 - DNA, 22 bp, Homo sapiens
acatacttctttacattccata

SEQ ID NO: 62598 - DNA, 22 bp, Homo sapiens
ccagtgtgcaatctctggctta

SEQ ID NO: 62599 - DNA, 22 bp, Homo sapiens
ttgtcttttgtgggaaatatgg

SEQ ID NO: 62600 - DNA, 23 bp, Homo sapiens
ggctgggagctccgggtgcacgt

SEQ ID NO: 62601 - DNA, 22 bp, Homo sapiens
gagacctcttggtatcgctagg

SEQ ID NO: 62602 - DNA, 22 bp, Homo sapiens
agcataagttggtacagccact

SEQ ID NO: 62603 - DNA, 22 bp, Homo sapiens
ttcaccatgttggccaggctgg

SEQ ID NO: 62604 - DNA, 22 bp, Homo sapiens
tgctcgaggtccccaccggctc

SEQ ID NO: 62605 - DNA, 22 bp, Homo sapiens
ccctcccaggagtggccagaga

SEQ ID NO: 62606 - DNA, 22 bp, Homo sapiens
actgtgaacggactgaagccca

SEQ ID NO: 62607 - DNA, 20 bp, Homo sapiens
ggcagagggcctgggagaag

SEQ ID NO: 62608 - DNA, 22 bp, Homo sapiens
ttccacggggctccccgctctt

SEQ ID NO: 62609 - DNA, 22 bp, Homo sapiens
ccttgctcaagctagtgacggg

SEQ ID NO: 62610 - DNA, 22 bp, Homo sapiens
tcacagagttaaaagtttcttt

SEQ ID NO: 62611 - DNA, 22 bp, Homo sapiens
ttggcgcccaggacgccgccgc

SEQ ID NO: 62612 - DNA, 22 bp, Homo sapiens
ggcagggcaggaaagtcaggaa

SEQ ID NO: 62613 - DNA, 22 bp, Homo sapiens
gctgggctgcgtcggggaagcc

SEQ ID NO: 62614 - DNA, 22 bp, Homo sapiens
cacccaggctggagagcagtgg

SEQ ID NO: 62615 - DNA, 22 bp, Homo sapiens
gctgccaatccagctgtgggag

SEQ ID NO: 62616 - DNA, 22 bp, Homo sapiens
acagacaagtagttcagacaag

SEQ ID NO: 62617 - DNA, 22 bp, Homo sapiens
gcccgcagagatctttaacaaa

SEQ ID NO: 62618 - DNA, 22 bp, Homo sapiens
acaactccttcttgggtcctgg

SEQ ID NO: 62619 - DNA, 22 bp, Homo sapiens
gaggagggagctggaagctctt

SEQ ID NO: 62620 - DNA, 22 bp, Homo sapiens
ataatacatggttgatcttttc

SEQ ID NO: 62621 - DNA, 22 bp, Homo sapiens
ttctgcaggctgtacaagaagc

SEQ ID NO: 62622 - DNA, 22 bp, Homo sapiens
tgaggcaggaggttgagaactg

SEQ ID NO: 62623 - DNA, 22 bp, Homo sapiens
ggtgttgcagttgaagactggt

SEQ ID NO: 62624 - DNA, 22 bp, Homo sapiens
gcctccggagttgcagtgtctt

SEQ ID NO: 62625 - DNA, 19 bp, Homo sapiens
tgaaggacagtgcacatca

SEQ ID NO: 62626 - DNA, 22 bp, Homo sapiens
tacaacaatttccacattagaa

SEQ ID NO: 62627 - DNA, 22 bp, Homo sapiens
aggccgaggcgggcggatcacc

SEQ ID NO: 62628 - DNA, 22 bp, Homo sapiens
tttcctcttctggcaggcaggg

SEQ ID NO: 62629 - DNA, 22 bp, Homo sapiens
tgggattcaccatgggcttcag

SEQ ID NO: 62630 - DNA, 22 bp, Homo sapiens
tctcgctctgtcgcccaggctg

SEQ ID NO: 62631 - DNA, 22 bp, Homo sapiens
cagctggcgactctcctcgatg

SEQ ID NO: 62632 - DNA, 22 bp, Homo sapiens
gcaaagaatgcagatttgcctc

SEQ ID NO: 62633 - DNA, 22 bp, Homo sapiens
ccaagctacttaggagtctgag

SEQ ID NO: 62634 - DNA, 22 bp, Homo sapiens
taatgtataacaaatactcatc

SEQ ID NO: 62635 - DNA, 22 bp, Homo sapiens
ggagtgcggtggcaccatctca

SEQ ID NO: 62636 - DNA, 22 bp, Homo sapiens
gcccagctgcaccctggtgggt

SEQ ID NO: 62637 - DNA, 22 bp, Homo sapiens
cagtgatcgcactcaacagttt

SEQ ID NO: 62638 - DNA, 22 bp, Homo sapiens
gcagagctcatgcctgcacctc

SEQ ID NO: 62639 - DNA, 22 bp, Homo sapiens
tgaggcaggtggattacaaggt

SEQ ID NO: 62640 - DNA, 22 bp, Homo sapiens
gagccaggaggcagagactgca

SEQ ID NO: 62641 - DNA, 22 bp, Homo sapiens
gcatatgatcacgtgtgtcggt

SEQ ID NO: 62642 - DNA, 22 bp, Homo sapiens
gcccagcacctctctcagggtt

SEQ ID NO: 62643 - DNA, 20 bp, Homo sapiens
aactcctagcctcaagtgat

SEQ ID NO: 62644 - DNA, 22 bp, Homo sapiens
catctgtctgcatgctctgggt

SEQ ID NO: 62645 - DNA, 22 bp, Homo sapiens
ttcattttctttcacgctgctg

SEQ ID NO: 62646 - DNA, 22 bp, Homo sapiens
ttccctccatttcattttataa

SEQ ID NO: 62647 - DNA, 22 bp, Homo sapiens
gcagcctgggcaacagagtgag

SEQ ID NO: 62648 - DNA, 22 bp, Homo sapiens
caggctggagttcagtggtgtg

SEQ ID NO: 62649 - DNA, 22 bp, Homo sapiens
gtggagggtgattgccggctgt

SEQ ID NO: 62650 - DNA, 22 bp, Homo sapiens
tggggagtgatgcctcggataa

SEQ ID NO: 62651 - DNA, 23 bp, Homo sapiens
ctcaccaagcgccgccgctgtgt

SEQ ID NO: 62652 - DNA, 22 bp, Homo sapiens
ctttgcttgacactgtgattgt

SEQ ID NO: 62653 - DNA, 22 bp, Homo sapiens
aagccaggttccatggaggagc

SEQ ID NO: 62654 - DNA, 22 bp, Homo sapiens
agcgccgcccctgctggtgttg

SEQ ID NO: 62655 - DNA, 22 bp, Homo sapiens
tgtgtcccttggaacctcagct

SEQ ID NO: 62656 - DNA, 22 bp, Homo sapiens
cccaggaggtcaaggctgcagt

SEQ ID NO: 62657 - DNA, 23 bp, Homo sapiens
aatgggtgcaactatccatgaca

SEQ ID NO: 62658 - DNA, 22 bp, Homo sapiens
aggacttagaacattatgtact

SEQ ID NO: 62659 - DNA, 22 bp, Homo sapiens
gtcagaggggcagctgccaggc

SEQ ID NO: 62660 - DNA, 22 bp, Homo sapiens
ggaggcggaggttgcagtgagc

SEQ ID NO: 62661 - DNA, 22 bp, Homo sapiens
tgggagtgtaaattagttcaac

SEQ ID NO: 62662 - DNA, 22 bp, Homo sapiens
ggagctcctggcagtgacagag

SEQ ID NO: 62663 - DNA, 22 bp, Homo sapiens
gcccagtagttcaaggttgcag

SEQ ID NO: 62664 - DNA, 22 bp, Homo sapiens
ggcatcgtcctgggcataggga

SEQ ID NO: 62665 - DNA, 20 bp, Homo sapiens
acgtggccaccagtggctta

SEQ ID NO: 62666 - DNA, 22 bp, Homo sapiens
gagagtctagtgcacctagttt

SEQ ID NO: 62667 - DNA, 19 bp, Homo sapiens
catctggatgattctcctg

SEQ ID NO: 62668 - DNA, 22 bp, Homo sapiens
gctgggacaacaggtgagcacc

SEQ ID NO: 62669 - DNA, 22 bp, Homo sapiens
caggaggattgcttgaggccag

SEQ ID NO: 62670 - DNA, 22 bp, Homo sapiens
tgattcatcagaataggagttt

SEQ ID NO: 62671 - DNA, 22 bp, Homo sapiens
ggggatggaggcgtgtggtcct

SEQ ID NO: 62672 - DNA, 22 bp, Homo sapiens
agtgaagctggagaaaggcagt

SEQ ID NO: 62673 - DNA, 22 bp, Homo sapiens
agcaggcctgccacctcggggt

SEQ ID NO: 62674 - DNA, 22 bp, Homo sapiens
tccgtggggcctgtggcttccg

SEQ ID NO: 62675 - DNA, 22 bp, Homo sapiens
catgctgggtaaaggtggtgaa

SEQ ID NO: 62676 - DNA, 22 bp, Homo sapiens
cgggttcacgccattctcctgc

SEQ ID NO: 62677 - DNA, 22 bp, Homo sapiens
gtctgctcatgctaccgcgggc

SEQ ID NO: 62678 - DNA, 22 bp, Homo sapiens
tcattgccatggcatttgcaga

SEQ ID NO: 62679 - DNA, 22 bp, Homo sapiens
ctcaggagttggaggctacagt

SEQ ID NO: 62680 - DNA, 22 bp, Homo sapiens
atcttcccaggctggggagagg

SEQ ID NO: 62681 - DNA, 22 bp, Homo sapiens
gacaattgcttttgccgaataa

SEQ ID NO: 62682 - DNA, 22 bp, Homo sapiens
cactgcaacctccacctcctgg

SEQ ID NO: 62683 - DNA, 19 bp, Homo sapiens
gcataaatacactattgtc

SEQ ID NO: 62684 - DNA, 23 bp, Homo sapiens
ctcaaccctagtaagggagtagg

SEQ ID NO: 62685 - DNA, 22 bp, Homo sapiens
gtccaaaagagccagccgggcg

SEQ ID NO: 62686 - DNA, 22 bp, Homo sapiens
aatgaattgcagtactgacttg

SEQ ID NO: 62687 - DNA, 22 bp, Homo sapiens
atgccactgcactccagcctgg

SEQ ID NO: 62688 - DNA, 22 bp, Homo sapiens
tgggaggccgaggcaggtggat

SEQ ID NO: 62689 - DNA, 22 bp, Homo sapiens
ggctgtggagctgcagagttgg

SEQ ID NO: 62690 - DNA, 22 bp, Homo sapiens
ggaggctgagaggtcgcagtgg

SEQ ID NO: 62691 - DNA, 22 bp, Homo sapiens
gggctgggattgcttgctgtga

SEQ ID NO: 62692 - DNA, 22 bp, Homo sapiens
ctggagggtggagagaagtctc

SEQ ID NO: 62693 - DNA, 22 bp, Homo sapiens
agctgccgatgcccagctgcat

SEQ ID NO: 62694 - DNA, 22 bp, Homo sapiens
tgcacgtgggctctctgctctt

SEQ ID NO: 62695 - DNA, 22 bp, Homo sapiens
aagattttcagtgcctaaaaca

SEQ ID NO: 62696 - DNA, 22 bp, Homo sapiens
gcaaaagtacagccggatttct

SEQ ID NO: 62697 - DNA, 22 bp, Homo sapiens
acatttatataactcactagga

SEQ ID NO: 62698 - DNA, 22 bp, Homo sapiens
ttaggctgttcttgtgttgtta

SEQ ID NO: 62699 - DNA, 22 bp, Homo sapiens
gcaccctgtcaaaatggaccaa

SEQ ID NO: 62700 - DNA, 19 bp, Homo sapiens
cccaggaagcggaggttgc

SEQ ID NO: 62701 - DNA, 20 bp, Homo sapiens
gggaagtcccgcctgtcttc

SEQ ID NO: 62702 - DNA, 21 bp, Homo sapiens
tgctccaggagggggcagtcc

SEQ ID NO: 62703 - DNA, 22 bp, Homo sapiens
tctttgctattgtgaatagtgc

SEQ ID NO: 62704 - DNA, 22 bp, Homo sapiens
gattcactcatattttacgttt

SEQ ID NO: 62705 - DNA, 22 bp, Homo sapiens
tgtctattcccccacctccgtt

SEQ ID NO: 62706 - DNA, 22 bp, Homo sapiens
ttgtgaaacattcatggatttg

SEQ ID NO: 62707 - DNA, 22 bp, Homo sapiens
tgtccttatctccaaacaatca

SEQ ID NO: 62708 - DNA, 22 bp, Homo sapiens
tgttgattagtgtttagactta

SEQ ID NO: 62709 - DNA, 22 bp, Homo sapiens
ggcaggactgatcagtgggatg

SEQ ID NO: 62710 - DNA, 23 bp, Homo sapiens
tgaatgtttattctcggtgcaga

SEQ ID NO: 62711 - DNA, 22 bp, Homo sapiens
ctggcaggagcattcacagagg

SEQ ID NO: 62712 - DNA, 22 bp, Homo sapiens
gattgggggtcaggctcaggtc

SEQ ID NO: 62713 - DNA, 22 bp, Homo sapiens
attttctatgttgtaattgtta

SEQ ID NO: 62714 - DNA, 22 bp, Homo sapiens
gtggtgtaggtcacagttagga

SEQ ID NO: 62715 - DNA, 22 bp, Homo sapiens
ggctttgggggtgtccaagaaa

SEQ ID NO: 62716 - DNA, 22 bp, Homo sapiens
ccagctttatagcttcaaagga

SEQ ID NO: 62717 - DNA, 22 bp, Homo sapiens
ttggaagacaatgctgattctc

SEQ ID NO: 62718 - DNA, 22 bp, Homo sapiens
aacccgggaggcggaggttgtg

SEQ ID NO: 62719 - DNA, 22 bp, Homo sapiens
agtccctctgggagcaggactg

SEQ ID NO: 62720 - DNA, 22 bp, Homo sapiens
atgtctgtttgctgagcccggc

SEQ ID NO: 62721 - DNA, 22 bp, Homo sapiens
cagtgggtcctgcgtctgccag

SEQ ID NO: 62722 - DNA, 22 bp, Homo sapiens
ctgaggagaggtggcctgtgtt

SEQ ID NO: 62723 - DNA, 22 bp, Homo sapiens
ccagagctgattcctgggactt

SEQ ID NO: 62724 - DNA, 22 bp, Homo sapiens
agggaaattaatgtgagcaatg

SEQ ID NO: 62725 - DNA, 22 bp, Homo sapiens
ccaggaggcggaggttgcagtg

SEQ ID NO: 62726 - DNA, 23 bp, Homo sapiens
tgaggcaggcggatcacgaggtc

SEQ ID NO: 62727 - DNA, 22 bp, Homo sapiens
ctgtggctctcagaggctgctg

SEQ ID NO: 62728 - DNA, 19 bp, Homo sapiens
tctcacagctctactatgt

SEQ ID NO: 62729 - DNA, 22 bp, Homo sapiens
cttgacactgtcactcaggcca

SEQ ID NO: 62730 - DNA, 22 bp, Homo sapiens
ctctggagtgtctggccagggt

SEQ ID NO: 62731 - DNA, 22 bp, Homo sapiens
tgatatgtccctcgacatcagg

SEQ ID NO: 62732 - DNA, 22 bp, Homo sapiens
aaacccagggttttgtcttccc

SEQ ID NO: 62733 - DNA, 22 bp, Homo sapiens
cactgcactccatcctgggaaa

SEQ ID NO: 62734 - DNA, 23 bp, Homo sapiens
tgacctcatgatccgcccacctc

SEQ ID NO: 62735 - DNA, 22 bp, Homo sapiens
agccggccatgtggtcttgtgc

SEQ ID NO: 62736 - DNA, 20 bp, Homo sapiens
gggcagagccagccagtccc

SEQ ID NO: 62737 - DNA, 22 bp, Homo sapiens
agttttcattaccatgctgcaa

SEQ ID NO: 62738 - DNA, 22 bp, Homo sapiens
gaccttgtgctccgaggcgggc

SEQ ID NO: 62739 - DNA, 22 bp, Homo sapiens
tttaatgtagcgtgaaatgatt

SEQ ID NO: 62740 - DNA, 22 bp, Homo sapiens
ttttaatactgctattgtagga

SEQ ID NO: 62741 - DNA, 23 bp, Homo sapiens
cgcccagcctcagtgacctgggc

SEQ ID NO: 62742 - DNA, 22 bp, Homo sapiens
ttctatttttgtggaactgtag

SEQ ID NO: 62743 - DNA, 22 bp, Homo sapiens
cctggcaggtggcgccctcggc

SEQ ID NO: 62744 - DNA, 22 bp, Homo sapiens
ctctgctgtgccgccagggcct

SEQ ID NO: 62745 - DNA, 22 bp, Homo sapiens
tttctcttcactgtgtgcctca

SEQ ID NO: 62746 - DNA, 22 bp, Homo sapiens
cactgcactccagcctgggtga

SEQ ID NO: 62747 - DNA, 22 bp, Homo sapiens
ggtgggagccaacacccttctg

SEQ ID NO: 62748 - DNA, 23 bp, Homo sapiens
ttaaacactagttcgagtagcat

SEQ ID NO: 62749 - DNA, 22 bp, Homo sapiens
actgcacttcaccctgggtgac

SEQ ID NO: 62750 - DNA, 22 bp, Homo sapiens
cccaggaggtcgaagctgcagt

SEQ ID NO: 62751 - DNA, 22 bp, Homo sapiens
tggaaacacccacgcatgcata

SEQ ID NO: 62752 - DNA, 22 bp, Homo sapiens
ataccaccatctatgaaaggta

SEQ ID NO: 62753 - DNA, 22 bp, Homo sapiens
gctgcagctgtaggacacaatt

SEQ ID NO: 62754 - DNA, 22 bp, Homo sapiens
tggctaacaaggtgaaaccccg

SEQ ID NO: 62755 - DNA, 22 bp, Homo sapiens
ggaggcagaatagagtgtgggt

SEQ ID NO: 62756 - DNA, 18 bp, Homo sapiens
ggtgagggagctggaagc

SEQ ID NO: 62757 - DNA, 22 bp, Homo sapiens
gtgaattacatgtatttttaag

SEQ ID NO: 62758 - DNA, 22 bp, Homo sapiens
ggcagagcttgcagtgagccga

SEQ ID NO: 62759 - DNA, 22 bp, Homo sapiens
aggaggggttctcgggtgctga

SEQ ID NO: 62760 - DNA, 22 bp, Homo sapiens
caggctggagtgcagtggggcg

SEQ ID NO: 62761 - DNA, 22 bp, Homo sapiens
cattacagaatatgtaatgatc

SEQ ID NO: 62762 - DNA, 22 bp, Homo sapiens
ccccagtggaggtgagggtcct

SEQ ID NO: 62763 - DNA, 22 bp, Homo sapiens
cacccaggcaaggattctgcaa

SEQ ID NO: 62764 - DNA, 22 bp, Homo sapiens
cttccccaggacctctgctaaa

SEQ ID NO: 62765 - DNA, 22 bp, Homo sapiens
tgctggacagggcacggcccat

SEQ ID NO: 62766 - DNA, 22 bp, Homo sapiens
ttcagcttgctgactgcggcag

SEQ ID NO: 62767 - DNA, 22 bp, Homo sapiens
atgccactgcactccagcctag

SEQ ID NO: 62768 - DNA, 22 bp, Homo sapiens
acaattctgatggtttcccagt

SEQ ID NO: 62769 - DNA, 22 bp, Homo sapiens
acaatgaagctccactgagctt

SEQ ID NO: 62770 - DNA, 22 bp, Homo sapiens
gagccaggtcgggccgcggcga

SEQ ID NO: 62771 - DNA, 20 bp, Homo sapiens
agcggctggcggaggacacg

SEQ ID NO: 62772 - DNA, 22 bp, Homo sapiens
ctgggttggggttacatgactg

SEQ ID NO: 62773 - DNA, 22 bp, Homo sapiens
ttcctgggattattgtcaagca

SEQ ID NO: 62774 - DNA, 22 bp, Homo sapiens
tgacctcatgatccgcccacct

SEQ ID NO: 62775 - DNA, 22 bp, Homo sapiens
cagccacttgtgatgctgggga

SEQ ID NO: 62776 - DNA, 22 bp, Homo sapiens
gctcactgcaacctccacctcc

SEQ ID NO: 62777 - DNA, 22 bp, Homo sapiens
gggtacagttcttccagtgtca

SEQ ID NO: 62778 - DNA, 22 bp, Homo sapiens
cactgcacttcagcctgggtga

SEQ ID NO: 62779 - DNA, 22 bp, Homo sapiens
gagcacagtaaagcagtgtcac

SEQ ID NO: 62780 - DNA, 22 bp, Homo sapiens
caaatgtataaatgtactttct

SEQ ID NO: 62781 - DNA, 22 bp, Homo sapiens
gcctcctggggtgccatcatct

SEQ ID NO: 62782 - DNA, 22 bp, Homo sapiens
gaatgctaagcatgtgggagtt

SEQ ID NO: 62783 - DNA, 22 bp, Homo sapiens
aagttactggcaagggctgcag

SEQ ID NO: 62784 - DNA, 18 bp, Homo sapiens
tctggaacaacttcatgt

SEQ ID NO: 62785 - DNA, 22 bp, Homo sapiens
ccactgtgcccagcctcatggg

SEQ ID NO: 62786 - DNA, 22 bp, Homo sapiens
ttcttctttccaattacatggt

SEQ ID NO: 62787 - DNA, 22 bp, Homo sapiens
actgcattccagcctgggcaac

SEQ ID NO: 62788 - DNA, 22 bp, Homo sapiens
aggaaggactccatggtccgtc

SEQ ID NO: 62789 - DNA, 22 bp, Homo sapiens
acgtagcactgagagatgcagg

SEQ ID NO: 62790 - DNA, 22 bp, Homo sapiens
ttctcttacattttctcagcct

SEQ ID NO: 62791 - DNA, 22 bp, Homo sapiens
tttagtgcatcagacaccctct

SEQ ID NO: 62792 - DNA, 22 bp, Homo sapiens
tggcgcgacgtgccccctgctt

SEQ ID NO: 62793 - DNA, 22 bp, Homo sapiens
gcgtctcaaggcccccaggcca

SEQ ID NO: 62794 - DNA, 22 bp, Homo sapiens
tctttggtttctgtctctgtaa

SEQ ID NO: 62795 - DNA, 22 bp, Homo sapiens
tttttgggtccaggctgtatct

SEQ ID NO: 62796 - DNA, 22 bp, Homo sapiens
gctgctttgtctgtaaaatgga

SEQ ID NO: 62797 - DNA, 22 bp, Homo sapiens
gagcaggaaggccagaagggtc

SEQ ID NO: 62798 - DNA, 22 bp, Homo sapiens
tgcctaggctggagtgcaatgg

SEQ ID NO: 62799 - DNA, 22 bp, Homo sapiens
cgttttcatgggtagaggttct

SEQ ID NO: 62800 - DNA, 22 bp, Homo sapiens
gaagaggttcaacgtggtcatc

SEQ ID NO: 62801 - DNA, 19 bp, Homo sapiens
catggtgaaaccccgtctc

SEQ ID NO: 62802 - DNA, 22 bp, Homo sapiens
gctgcagtgagccaagatcgtg

SEQ ID NO: 62803 - DNA, 17 bp, Homo sapiens
gggcagggactcctggg

SEQ ID NO: 62804 - DNA, 22 bp, Homo sapiens
ccaggagctggagggtgcagtg

SEQ ID NO: 62805 - DNA, 22 bp, Homo sapiens
tcaccgaggctggagtgcagtg

SEQ ID NO: 62806 - DNA, 22 bp, Homo sapiens
gcccagccacagtcactttcat

SEQ ID NO: 62807 - DNA, 22 bp, Homo sapiens
atggcagcggagctggaaatga

SEQ ID NO: 62808 - DNA, 22 bp, Homo sapiens
agggatggagtgcggcccggac

SEQ ID NO: 62809 - DNA, 22 bp, Homo sapiens
gcagaggacacaggagggcaag

SEQ ID NO: 62810 - DNA, 22 bp, Homo sapiens
caggaggttgagggtgcagtga

SEQ ID NO: 62811 - DNA, 22 bp, Homo sapiens
acccaggagacggaggtgcagt

SEQ ID NO: 62812 - DNA, 22 bp, Homo sapiens
gggagaggttacccgagcaact

SEQ ID NO: 62813 - DNA, 22 bp, Homo sapiens
ctgccgtgtttttcatgttaaa

SEQ ID NO: 62814 - DNA, 22 bp, Homo sapiens
ctcctgaattgtccctcacagc

SEQ ID NO: 62815 - DNA, 22 bp, Homo sapiens
ctcactgcaagctctgcctcca

SEQ ID NO: 62816 - DNA, 22 bp, Homo sapiens
ttgagggtctggatctgctgct

SEQ ID NO: 62817 - DNA, 22 bp, Homo sapiens
agcactgatttaaactggattt

SEQ ID NO: 62818 - DNA, 22 bp, Homo sapiens
ccttacctgattgctggcatcc

SEQ ID NO: 62819 - DNA, 22 bp, Homo sapiens
taagcctgcatgaaccatgaga

SEQ ID NO: 62820 - DNA, 22 bp, Homo sapiens
tttggtaagtacccacctgggt

SEQ ID NO: 62821 - DNA, 22 bp, Homo sapiens
tgagcaggcgcagcaggaggtc

SEQ ID NO: 62822 - DNA, 22 bp, Homo sapiens
cctgagtagctggaattaaagg

SEQ ID NO: 62823 - DNA, 22 bp, Homo sapiens
tccaggctttggggcaggagcg

SEQ ID NO: 62824 - DNA, 22 bp, Homo sapiens
tttattctgtgctacatgaaga

SEQ ID NO: 62825 - DNA, 22 bp, Homo sapiens
ctacccttaagtttctgtgggg

SEQ ID NO: 62826 - DNA, 22 bp, Homo sapiens
cccagcagtagagctcatatgg

SEQ ID NO: 62827 - DNA, 19 bp, Homo sapiens
aggaatggaattaattctg

SEQ ID NO: 62828 - DNA, 22 bp, Homo sapiens
tgggcaaggctggagcctgcag

SEQ ID NO: 62829 - DNA, 18 bp, Homo sapiens
gcctggcttcggagccgc

SEQ ID NO: 62830 - DNA, 22 bp, Homo sapiens
gagaaatgcatgcatgtcatca

SEQ ID NO: 62831 - DNA, 22 bp, Homo sapiens
taaagattgctcaaaactgtga

SEQ ID NO: 62832 - DNA, 22 bp, Homo sapiens
gagccaggttggaggctgcagt

SEQ ID NO: 62833 - DNA, 22 bp, Homo sapiens
gagctgggcctgcgagtgctgc

SEQ ID NO: 62834 - DNA, 22 bp, Homo sapiens
cagagggttgatgtgaggctta

SEQ ID NO: 62835 - DNA, 22 bp, Homo sapiens
ctgatcctcctttaagtagctg

SEQ ID NO: 62836 - DNA, 22 bp, Homo sapiens
acacggcactttaggaaggggc

SEQ ID NO: 62837 - DNA, 22 bp, Homo sapiens
ggctgagtctgtgacccatgcg

SEQ ID NO: 62838 - DNA, 22 bp, Homo sapiens
ctggggtccttgccatgtgtca

SEQ ID NO: 62839 - DNA, 22 bp, Homo sapiens
acatgtttaagtttgttatatg

SEQ ID NO: 62840 - DNA, 22 bp, Homo sapiens
aagcgccatggttcctgcgcag

SEQ ID NO: 62841 - DNA, 22 bp, Homo sapiens
gagctctgactgctgggtgaca

SEQ ID NO: 62842 - DNA, 22 bp, Homo sapiens
acatttttcacatttgtagggt

SEQ ID NO: 62843 - DNA, 22 bp, Homo sapiens
aagaggttgtacctaaagtgtt

SEQ ID NO: 62844 - DNA, 22 bp, Homo sapiens
agctgattccactttttcccca

SEQ ID NO: 62845 - DNA, 22 bp, Homo sapiens
cagagatgtgatccagctgtct

SEQ ID NO: 62846 - DNA, 22 bp, Homo sapiens
tggtatgtaaattgtaactcaa

SEQ ID NO: 62847 - DNA, 22 bp, Homo sapiens
cagcagagaaattacatatttg

SEQ ID NO: 62848 - DNA, 22 bp, Homo sapiens
gagcccaggagtttgatgctgc

SEQ ID NO: 62849 - DNA, 22 bp, Homo sapiens
ccaggaggtggagattgcagtg

SEQ ID NO: 62850 - DNA, 22 bp, Homo sapiens
attgcactccagcctgggggac

SEQ ID NO: 62851 - DNA, 22 bp, Homo sapiens
tacaccattcccaggtggattt

SEQ ID NO: 62852 - DNA, 22 bp, Homo sapiens
tggtacacatgtccaaggtcag

SEQ ID NO: 62853 - DNA, 22 bp, Homo sapiens
aagctgcagcacagagaggtgg

SEQ ID NO: 62854 - DNA, 22 bp, Homo sapiens
tgttgcccaggttctctcctgc

SEQ ID NO: 62855 - DNA, 22 bp, Homo sapiens
ttgcaaatcagaagtatagatt

SEQ ID NO: 62856 - DNA, 22 bp, Homo sapiens
gcagccatcacgatgaactcag

SEQ ID NO: 62857 - DNA, 22 bp, Homo sapiens
ggcaaggggtcaggctgagaca

SEQ ID NO: 62858 - DNA, 22 bp, Homo sapiens
aggagggagcttaagccaggca

SEQ ID NO: 62859 - DNA, 22 bp, Homo sapiens
cccccagctctgctgggtcccg

SEQ ID NO: 62860 - DNA, 22 bp, Homo sapiens
agggactatttacccatctcac

SEQ ID NO: 62861 - DNA, 22 bp, Homo sapiens
ctgggaggcggagcttgcagtg

SEQ ID NO: 62862 - DNA, 22 bp, Homo sapiens
ctcactgcaagctccacctctt

SEQ ID NO: 62863 - DNA, 22 bp, Homo sapiens
tgggaagaggagcactggaatg

SEQ ID NO: 62864 - DNA, 22 bp, Homo sapiens
ccaggagttggaggctgcagtg

SEQ ID NO: 62865 - DNA, 22 bp, Homo sapiens
attaagtgactaaagtaatgct

SEQ ID NO: 62866 - DNA, 22 bp, Homo sapiens
gtggctgcagcggctgtggaga

SEQ ID NO: 62867 - DNA, 22 bp, Homo sapiens
ctggacacactggagtctggca

SEQ ID NO: 62868 - DNA, 22 bp, Homo sapiens
gctgggttttcttccgggccta

SEQ ID NO: 62869 - DNA, 22 bp, Homo sapiens
tataaactcctcttgcattcct

SEQ ID NO: 62870 - DNA, 22 bp, Homo sapiens
atgaggcaggagtgcagtggca

SEQ ID NO: 62871 - DNA, 22 bp, Homo sapiens
tcaggaggcggaggttgcagtg

SEQ ID NO: 62872 - DNA, 22 bp, Homo sapiens
atgaaatatcttgaagaaattc

SEQ ID NO: 62873 - DNA, 22 bp, Homo sapiens
gtaggtcagacataagaggaca

SEQ ID NO: 62874 - DNA, 22 bp, Homo sapiens
aggtgcttggctcgtgcacaca

SEQ ID NO: 62875 - DNA, 22 bp, Homo sapiens
gccaggacctcagatgcagggc

SEQ ID NO: 62876 - DNA, 22 bp, Homo sapiens
ggctcatatcccggccatcatt

SEQ ID NO: 62877 - DNA, 22 bp, Homo sapiens
atggaaggctttatgactcaaa

SEQ ID NO: 62878 - DNA, 22 bp, Homo sapiens
gctcaagacccctctgtgactg

SEQ ID NO: 62879 - DNA, 22 bp, Homo sapiens
gatggtgcaggtgaagtgctgg

SEQ ID NO: 62880 - DNA, 22 bp, Homo sapiens
ttaccacagtgcctgtctaatg

SEQ ID NO: 62881 - DNA, 22 bp, Homo sapiens
cctcgcggcactcgggccggat

SEQ ID NO: 62882 - DNA, 22 bp, Homo sapiens
agtgcaggccccaggccaggcc

SEQ ID NO: 62883 - DNA, 22 bp, Homo sapiens
atggggagctcaccacctgttt

SEQ ID NO: 62884 - DNA, 22 bp, Homo sapiens
ggtgggaggactgtttgaggca

SEQ ID NO: 62885 - DNA, 22 bp, Homo sapiens
ggtaccaccaattcagctgcca

SEQ ID NO: 62886 - DNA, 20 bp, Homo sapiens
acctcctggcgggcatcctc

SEQ ID NO: 62887 - DNA, 21 bp, Homo sapiens
tgactgaggcttcttcacaca

SEQ ID NO: 62888 - DNA, 22 bp, Homo sapiens
ctgggaggcagaggttgcagtg

SEQ ID NO: 62889 - DNA, 22 bp, Homo sapiens
tgtaagtagtaatggaaggaca

SEQ ID NO: 62890 - DNA, 22 bp, Homo sapiens
actgcactccagcctgggtaac

SEQ ID NO: 62891 - DNA, 22 bp, Homo sapiens
actgcactccaacctgggtgac

SEQ ID NO: 62892 - DNA, 21 bp, Homo sapiens
cactccacttagaacagggtt

SEQ ID NO: 62893 - DNA, 22 bp, Homo sapiens
gtgctttgttaagtctgaaatt

SEQ ID NO: 62894 - DNA, 22 bp, Homo sapiens
tgaagttgttaaggttgccatt

SEQ ID NO: 62895 - DNA, 22 bp, Homo sapiens
gctggtagacctcactgcactc

SEQ ID NO: 62896 - DNA, 22 bp, Homo sapiens
caggagctcaagaccaccctgg

SEQ ID NO: 62897 - DNA, 19 bp, Homo sapiens
gagaaagcaggcacagcac

SEQ ID NO: 62898 - DNA, 22 bp, Homo sapiens
gagccaggggtcagctccgagg

SEQ ID NO: 62899 - DNA, 21 bp, Homo sapiens
gaacccagcagcagtgctctg

SEQ ID NO: 62900 - DNA, 22 bp, Homo sapiens
agtgggccggacagcccaggcc

SEQ ID NO: 62901 - DNA, 22 bp, Homo sapiens
aggggaggtgtccccaaatctc

SEQ ID NO: 62902 - DNA, 22 bp, Homo sapiens
tccagcccaggctggagtgtag

SEQ ID NO: 62903 - DNA, 22 bp, Homo sapiens
ttgcaattgctatggagagcgt

SEQ ID NO: 62904 - DNA, 22 bp, Homo sapiens
tcgcccaggctggaagtgcagt

SEQ ID NO: 62905 - DNA, 22 bp, Homo sapiens
taattgtaaagtagtagtacag

SEQ ID NO: 62906 - DNA, 22 bp, Homo sapiens
tggcctcggcatccagcaagag

SEQ ID NO: 62907 - DNA, 22 bp, Homo sapiens
taaatgttgtaagtacatctaa

SEQ ID NO: 62908 - DNA, 22 bp, Homo sapiens
ccagaggtgctctttggaagtg

SEQ ID NO: 62909 - DNA, 22 bp, Homo sapiens
ctggctttgatcagagtgacct

SEQ ID NO: 62910 - DNA, 22 bp, Homo sapiens
agggccagcactcctggcagga

SEQ ID NO: 62911 - DNA, 19 bp, Homo sapiens
agagtattgaatttgccct

SEQ ID NO: 62912 - DNA, 22 bp, Homo sapiens
aggctcagatccttgtgtcctg

SEQ ID NO: 62913 - DNA, 22 bp, Homo sapiens
agcccaggttgaggctgcagtg

SEQ ID NO: 62914 - DNA, 22 bp, Homo sapiens
tctgagaaatttctttgtgatg

SEQ ID NO: 62915 - DNA, 22 bp, Homo sapiens
cactgcactccagcctgggaga

SEQ ID NO: 62916 - DNA, 22 bp, Homo sapiens
gggaggctctgctcagcccccg

SEQ ID NO: 62917 - DNA, 22 bp, Homo sapiens
gagacacaggcacagaagaggc

SEQ ID NO: 62918 - DNA, 22 bp, Homo sapiens
actgattgcattcatagggttt

SEQ ID NO: 62919 - DNA, 22 bp, Homo sapiens
taaccaagcaaactttcattgt

SEQ ID NO: 62920 - DNA, 22 bp, Homo sapiens
ggggtctgggcttagctggaat

SEQ ID NO: 62921 - DNA, 22 bp, Homo sapiens
atggccaggcacctctggctga

SEQ ID NO: 62922 - DNA, 22 bp, Homo sapiens
ggggtgggcgtgcagggacacc

SEQ ID NO: 62923 - DNA, 22 bp, Homo sapiens
atagaatatgacttttagatcc

SEQ ID NO: 62924 - DNA, 22 bp, Homo sapiens
tgtgggagaaggaagcaagctg

SEQ ID NO: 62925 - DNA, 22 bp, Homo sapiens
aggccaggaatccttgtcccag

SEQ ID NO: 62926 - DNA, 22 bp, Homo sapiens
agaggcagtatacaatccgagc

SEQ ID NO: 62927 - DNA, 22 bp, Homo sapiens
ccaggctggagtatagtggcgc

SEQ ID NO: 62928 - DNA, 22 bp, Homo sapiens
ccaggaggtggaggttgcggtg

SEQ ID NO: 62929 - DNA, 22 bp, Homo sapiens
gagtccctgctgtcaggtgctg

SEQ ID NO: 62930 - DNA, 22 bp, Homo sapiens
ctacttgttcactgtaggtcgc

SEQ ID NO: 62931 - DNA, 22 bp, Homo sapiens
tgtagatattaattattccttt

SEQ ID NO: 62932 - DNA, 22 bp, Homo sapiens
tgctgctccccagcacacagca

SEQ ID NO: 62933 - DNA, 22 bp, Homo sapiens
ggagcagggaattacagcgcag

SEQ ID NO: 62934 - DNA, 22 bp, Homo sapiens
cgctgcagaagcgtgttcagga

SEQ ID NO: 62935 - DNA, 22 bp, Homo sapiens
gcttggaagtaggattgggaga

SEQ ID NO: 62936 - DNA, 22 bp, Homo sapiens
gcaggaggttgagccaggactg

SEQ ID NO: 62937 - DNA, 21 bp, Homo sapiens
accctgctttatgccgtcctc

SEQ ID NO: 62938 - DNA, 18 bp, Homo sapiens
actctgcggaggccccag

SEQ ID NO: 62939 - DNA, 22 bp, Homo sapiens
gagatgggcgagaaggtggact

SEQ ID NO: 62940 - DNA, 22 bp, Homo sapiens
tttaaaaaactagtctgagtct

SEQ ID NO: 62941 - DNA, 22 bp, Homo sapiens
aggccagcctcaggcagggacc

SEQ ID NO: 62942 - DNA, 22 bp, Homo sapiens
tagatgtgttgcctggagttgt

SEQ ID NO: 62943 - DNA, 22 bp, Homo sapiens
atacaaaaattagccgggagta

SEQ ID NO: 62944 - DNA, 22 bp, Homo sapiens
cccaggaattggaggctgcagt

SEQ ID NO: 62945 - DNA, 22 bp, Homo sapiens
ggcaggaggtgagtggcgggtg

SEQ ID NO: 62946 - DNA, 22 bp, Homo sapiens
catgtgaattccaaagctaggt

SEQ ID NO: 62947 - DNA, 22 bp, Homo sapiens
tgcagaaacaagccatcattca

SEQ ID NO: 62948 - DNA, 22 bp, Homo sapiens
cagcgtctcgttgtgggcctcg

SEQ ID NO: 62949 - DNA, 22 bp, Homo sapiens
atgaaaacggaccagagctatt

SEQ ID NO: 62950 - DNA, 22 bp, Homo sapiens
tctgcctagaaacagtgtttgc

SEQ ID NO: 62951 - DNA, 22 bp, Homo sapiens
gttgcagatgtggaactcgtgc

SEQ ID NO: 62952 - DNA, 22 bp, Homo sapiens
tgcagaaacaagccatcattca

SEQ ID NO: 62953 - DNA, 22 bp, Homo sapiens
tgcttacgagctattttcactt

SEQ ID NO: 62954 - DNA, 18 bp, Homo sapiens
atgagaggtgtcagaaga

SEQ ID NO: 62955 - DNA, 22 bp, Homo sapiens
cgggcaaggcgagactaggccc

SEQ ID NO: 62956 - DNA, 22 bp, Homo sapiens
acatacttctttacattccata

SEQ ID NO: 62957 - DNA, 22 bp, Homo sapiens
ttatatgtttctgtttggaggc

SEQ ID NO: 62958 - DNA, 22 bp, Homo sapiens
tctgcatattgttaatggaatg

SEQ ID NO: 62959 - DNA, 22 bp, Homo sapiens
cttgcctttgtcttcaaaggct

SEQ ID NO: 62960 - DNA, 22 bp, Homo sapiens
ggctccaccctgcttccagaag

SEQ ID NO: 62961 - DNA, 22 bp, Homo sapiens
tgagccaagatcatgccgttgt

SEQ ID NO: 62962 - DNA, 22 bp, Homo sapiens
aagttactggcaagggctgcag

SEQ ID NO: 62963 - DNA, 22 bp, Homo sapiens
ttggaaacgtcaccttttcctt

SEQ ID NO: 62964 - DNA, 22 bp, Homo sapiens
gagccagactgcctgaagctca

SEQ ID NO: 62965 - DNA, 22 bp, Homo sapiens
gtgctccctccttcctcaagga

SEQ ID NO: 62966 - DNA, 22 bp, Homo sapiens
agcccaggagtttgaggctgtg

SEQ ID NO: 62967 - DNA, 22 bp, Homo sapiens
atagaatatgacttttagatcc

SEQ ID NO: 62968 - DNA, 22 bp, Homo sapiens
actggacagaggaaatatggag

SEQ ID NO: 62969 - DNA, 20 bp, Homo sapiens
aaattactgccacacatttc

SEQ ID NO: 62970 - DNA, 21 bp, Homo sapiens
tggtacaccttgcctgtcaga

SEQ ID NO: 62971 - DNA, 22 bp, Homo sapiens
gcaaaagtacagccggatttct

SEQ ID NO: 62972 - DNA, 22 bp, Homo sapiens
cggccaagccggggccccgaag

SEQ ID NO: 62973 - DNA, 23 bp, Homo sapiens
aggatgtaggatgtatggcagag

SEQ ID NO: 62974 - DNA, 22 bp, Homo sapiens
atatatttgagaatattcatga

SEQ ID NO: 62975 - DNA, 22 bp, Homo sapiens
tgtagatattaattattccttt

SEQ ID NO: 62976 - DNA, 22 bp, Homo sapiens
ctcaagtgtgagttttaaagtc

SEQ ID NO: 62977 - DNA, 22 bp, Homo sapiens
atatacacatctttttaaatat

SEQ ID NO: 62978 - DNA, 22 bp, Homo sapiens
ccctgcctacagggttttcttt

SEQ ID NO: 62979 - DNA, 22 bp, Homo sapiens
ataatacatggttgatcttttc

SEQ ID NO: 62980 - DNA, 22 bp, Homo sapiens
ggccagaagttggaaaagagcc

SEQ ID NO: 62981 - DNA, 22 bp, Homo sapiens
ccctctacagggaagcgctttc

SEQ ID NO: 62982 - DNA, 22 bp, Homo sapiens
agccaagcactcaactcctgga

SEQ ID NO: 62983 - DNA, 22 bp, Homo sapiens
tgagccaagttcacaccattgc

SEQ ID NO: 62984 - DNA, 20 bp, Homo sapiens
acgtggccaccagtggctta

SEQ ID NO: 62985 - DNA, 22 bp, Homo sapiens
gcgggccaccttggagagcgct

SEQ ID NO: 62986 - DNA, 22 bp, Homo sapiens
gctgcagacttctcatctcatt

SEQ ID NO: 62987 - DNA, 22 bp, Homo sapiens
ggagatatttgtattctgtctc

SEQ ID NO: 62988 - DNA, 22 bp, Homo sapiens
gcgagggcacgcggttgaaggc

SEQ ID NO: 62989 - DNA, 22 bp, Homo sapiens
tacaaaaaattgatactgacga

SEQ ID NO: 62990 - DNA, 22 bp, Homo sapiens
ctggcctaggaatggttttccg

SEQ ID NO: 62991 - DNA, 22 bp, Homo sapiens
ccaatgatggtgcccacgatga

SEQ ID NO: 62992 - DNA, 22 bp, Homo sapiens
gagaaatgcatgcatgtcatca

SEQ ID NO: 62993 - DNA, 23 bp, Homo sapiens
ctcctcgtaactctgtggtgggt

SEQ ID NO: 62994 - DNA, 23 bp, Homo sapiens
agcttttaggtggaaatggcact

SEQ ID NO: 62995 - DNA, 22 bp, Homo sapiens
cctgaggatgccagcatgggtg

SEQ ID NO: 62996 - DNA, 20 bp, Homo sapiens
gtctccactgggggttaacc

SEQ ID NO: 62997 - DNA, 22 bp, Homo sapiens
gtgcacatcgtgcaggtttgtt

SEQ ID NO: 62998 - DNA, 22 bp, Homo sapiens
ttccatacgactgaggtctcgg

SEQ ID NO: 62999 - DNA, 22 bp, Homo sapiens
catggcagctcctccagtgtga

SEQ ID NO: 63000 - DNA, 22 bp, Homo sapiens
tccaggctttggggcaggagcg

SEQ ID NO: 63001 - DNA, 22 bp, Homo sapiens
tgttatcagagagaggtgctgt

SEQ ID NO: 63002 - DNA, 22 bp, Homo sapiens
agccagtgcagctggaaattca

SEQ ID NO: 63003 - DNA, 22 bp, Homo sapiens
atccaccctgtggtggctttct

SEQ ID NO: 63004 - DNA, 22 bp, Homo sapiens
agcccaggttgaggctgcagtg

SEQ ID NO: 63005 - DNA, 22 bp, Homo sapiens
cttgctttcagtctcggcctca

SEQ ID NO: 63006 - DNA, 22 bp, Homo sapiens
cgagagatgggttggcaggggc

SEQ ID NO: 63007 - DNA, 22 bp, Homo sapiens
ttgcttcctctagtttcttgaa

SEQ ID NO: 63008 - DNA, 22 bp, Homo sapiens
atagttttaaaacctcaggaag

SEQ ID NO: 63009 - DNA, 22 bp, Homo sapiens
gggagctgaaggagccggcggg

SEQ ID NO: 63010 - DNA, 22 bp, Homo sapiens
ctcgcaagtcgctccggttact

SEQ ID NO: 63011 - DNA, 22 bp, Homo sapiens
aacagtgtttttcttcagcact

SEQ ID NO: 63012 - DNA, 22 bp, Homo sapiens
ctggcaagaaatatatatctta

SEQ ID NO: 63013 - DNA, 22 bp, Homo sapiens
caggagctcaagaccaccctgg

SEQ ID NO: 63014 - DNA, 22 bp, Homo sapiens
gctcccagtctgatggaggaga

SEQ ID NO: 63015 - DNA, 22 bp, Homo sapiens
gcctccagcccacgcaggcctg

SEQ ID NO: 63016 - DNA, 17 bp, Homo sapiens
gtaaggcttgcagatgc

SEQ ID NO: 63017 - DNA, 22 bp, Homo sapiens
gcccagtagttcaaggttgcag

SEQ ID NO: 63018 - DNA, 22 bp, Homo sapiens
ccctggctgcgtgatggatgaa

SEQ ID NO: 63019 - DNA, 17 bp, Homo sapiens
ggctgcagtccaggagg

SEQ ID NO: 63020 - DNA, 22 bp, Homo sapiens
caggagctcagatgacatctca

SEQ ID NO: 63021 - DNA, 22 bp, Homo sapiens
cattgctttgtgcatatttaaa

SEQ ID NO: 63022 - DNA, 22 bp, Homo sapiens
ttcatatttctttaaggacttt

SEQ ID NO: 63023 - DNA, 22 bp, Homo sapiens
ggtgtcagactttgcatatcct

SEQ ID NO: 63024 - DNA, 22 bp, Homo sapiens
gcagtatctatgtgatgggttg

SEQ ID NO: 63025 - DNA, 22 bp, Homo sapiens
tggagaattctatgttgagggg

SEQ ID NO: 63026 - DNA, 22 bp, Homo sapiens
aagcacaatgaacatcttagat

SEQ ID NO: 63027 - DNA, 23 bp, Homo sapiens
tcctcgcaggagggagatgatgc

SEQ ID NO: 63028 - DNA, 22 bp, Homo sapiens
aaattgattaaagtccgtgctt

SEQ ID NO: 63029 - DNA, 20 bp, Homo sapiens
aaaattgctctgcagtcccc

SEQ ID NO: 63030 - DNA, 22 bp, Homo sapiens
atgattgaccatctgctgggct

SEQ ID NO: 63031 - DNA, 21 bp, Homo sapiens
tgctccaggagggggcagtcc

SEQ ID NO: 63032 - DNA, 22 bp, Homo sapiens
tgcacgtgtgagcattcacatg

SEQ ID NO: 63033 - DNA, 22 bp, Homo sapiens
aagaagcattctttcattggtt

SEQ ID NO: 63034 - DNA, 22 bp, Homo sapiens
gactggaaagcctgtcctcaga

SEQ ID NO: 63035 - DNA, 22 bp, Homo sapiens
agctcttacatttaggtctatg

SEQ ID NO: 63036 - DNA, 22 bp, Homo sapiens
ctccaggccatggctgcggagg

SEQ ID NO: 63037 - DNA, 22 bp, Homo sapiens
gtctgctttgtctttcatgata

SEQ ID NO: 63038 - DNA, 22 bp, Homo sapiens
actttatttcctattgcatcca

SEQ ID NO: 63039 - DNA, 22 bp, Homo sapiens
acaatgctccctgtagtcagga

SEQ ID NO: 63040 - DNA, 22 bp, Homo sapiens
gtctttatttgagattgtcatt

SEQ ID NO: 63041 - DNA, 22 bp, Homo sapiens
cacagggcttctcatggggtgc

SEQ ID NO: 63042 - DNA, 22 bp, Homo sapiens
atgattgaaaatgacattgcca

SEQ ID NO: 63043 - DNA, 22 bp, Homo sapiens
tgtgtggattcatctcaaagag

SEQ ID NO: 63044 - DNA, 22 bp, Homo sapiens
tgctgagcgcatccggcggccg

SEQ ID NO: 63045 - DNA, 22 bp, Homo sapiens
ctgctttaaaactgatacatga

SEQ ID NO: 63046 - DNA, 22 bp, Homo sapiens
atagagtgatgtaaggtatgtg

SEQ ID NO: 63047 - DNA, 21 bp, Homo sapiens
ctcccagggtgactgttcaac

SEQ ID NO: 63048 - DNA, 22 bp, Homo sapiens
tcccgggcaggtcgagcgagcc

SEQ ID NO: 63049 - DNA, 21 bp, Homo sapiens
ttagaagctaatgcagctggt

SEQ ID NO: 63050 - DNA, 22 bp, Homo sapiens
agtgaaaacctaatcatgcagt

SEQ ID NO: 63051 - DNA, 22 bp, Homo sapiens
gcacagagagggaaggtaactt

SEQ ID NO: 63052 - DNA, 22 bp, Homo sapiens
cgagcatgatgacggctgtggc

SEQ ID NO: 63053 - DNA, 22 bp, Homo sapiens
ttgctcttgaaaattgatgctg

SEQ ID NO: 63054 - DNA, 22 bp, Homo sapiens
gtgtggaatggagtttttgccc

SEQ ID NO: 63055 - DNA, 22 bp, Homo sapiens
aagaagcaggtcacagacaggg

SEQ ID NO: 63056 - DNA, 22 bp, Homo sapiens
aggacaaaggaccagatctgga

SEQ ID NO: 63057 - DNA, 22 bp, Homo sapiens
atgctaaggcccaggagaaaat

SEQ ID NO: 63058 - DNA, 22 bp, Homo sapiens
tgctggtaccgcgcctccgcca

SEQ ID NO: 63059 - DNA, 22 bp, Homo sapiens
ggcttgaagggaggaaagcagg

SEQ ID NO: 63060 - DNA, 20 bp, Homo sapiens
caagggtttgcattggcttt

SEQ ID NO: 63061 - DNA, 22 bp, Homo sapiens
aaggaaagctgtggttctgaga

SEQ ID NO: 63062 - DNA, 22 bp, Homo sapiens
ccgcaaggcagaggttgcagtg

SEQ ID NO: 63063 - DNA, 22 bp, Homo sapiens
atcatcctagaaggaagctagg

SEQ ID NO: 63064 - DNA, 22 bp, Homo sapiens
aaggagtctgggccattcagag

SEQ ID NO: 63065 - DNA, 22 bp, Homo sapiens
ggctcctgggggtgctcctgcc

SEQ ID NO: 63066 - DNA, 22 bp, Homo sapiens
ggttgcaaactcctgggatcaa

SEQ ID NO: 63067 - DNA, 22 bp, Homo sapiens
catagagtgatgtaaggtatgt

SEQ ID NO: 63068 - DNA, 22 bp, Homo sapiens
agcccaggctggagtgcagtgg

SEQ ID NO: 63069 - DNA, 19 bp, Homo sapiens
gactccaactttaagcatg

SEQ ID NO: 63070 - DNA, 19 bp, Homo sapiens
aggcttcaggccacatgct

SEQ ID NO: 63071 - DNA, 22 bp, Homo sapiens
atttattcctttatggctggag

SEQ ID NO: 63072 - DNA, 22 bp, Homo sapiens
cctggctctgccacttactgcc

SEQ ID NO: 63073 - DNA, 22 bp, Homo sapiens
ttgctgacctttgctctccgtt

SEQ ID NO: 63074 - DNA, 22 bp, Homo sapiens
gcttccgcgatgtcctaggtgg

SEQ ID NO: 63075 - DNA, 22 bp, Homo sapiens
agaaaatttaaagagacacaca

SEQ ID NO: 63076 - DNA, 22 bp, Homo sapiens
ggggccttggatctgtgccccg

SEQ ID NO: 63077 - DNA, 22 bp, Homo sapiens
gtcagatctttggggatgctgt

SEQ ID NO: 63078 - DNA, 22 bp, Homo sapiens
gccatgggcaaatgcagagctg

SEQ ID NO: 63079 - DNA, 22 bp, Homo sapiens
gggagctgagctggaagagaat

SEQ ID NO: 63080 - DNA, 22 bp, Homo sapiens
aggagctgtcagagtgccagag

SEQ ID NO: 63081 - DNA, 22 bp, Homo sapiens
ctgctttagacggctttcgctg

SEQ ID NO: 63082 - DNA, 21 bp, Homo sapiens
acacaggcagtgtcccgaggt

SEQ ID NO: 63083 - DNA, 19 bp, Homo sapiens
actggcacacaggggctgc

SEQ ID NO: 63084 - DNA, 22 bp, Homo sapiens
ttattttaccttcctctgagct

SEQ ID NO: 63085 - DNA, 21 bp, Homo sapiens
aggtgctggcgccccaggaga

SEQ ID NO: 63086 - DNA, 22 bp, Homo sapiens
tatttaataaaactatggcatg

SEQ ID NO: 63087 - DNA, 20 bp, Homo sapiens
aggctgttgacggctgcctc

SEQ ID NO: 63088 - DNA, 23 bp, Homo sapiens
ctggggctttcaaatctgggcag

SEQ ID NO: 63089 - DNA, 22 bp, Homo sapiens
atatattttttgagacagagtc

SEQ ID NO: 63090 - DNA, 21 bp, Homo sapiens
tggtacaccttgcctgtcaga

SEQ ID NO: 63091 - DNA, 22 bp, Homo sapiens
aggaaaatggaccagagttgtt

SEQ ID NO: 63092 - DNA, 22 bp, Homo sapiens
atgccaataaatgttaatatct

SEQ ID NO: 63093 - DNA, 22 bp, Homo sapiens
taagggttcagaatgcagtggt

SEQ ID NO: 63094 - DNA, 22 bp, Homo sapiens
ttactggctgggcctgagggct

SEQ ID NO: 63095 - DNA, 22 bp, Homo sapiens
tcagcttcgcctgaggtatggg

SEQ ID NO: 63096 - DNA, 22 bp, Homo sapiens
tttattctgtgctacatgaaga

SEQ ID NO: 63097 - DNA, 22 bp, Homo sapiens
atatatttgagaatattcatga

SEQ ID NO: 63098 - DNA, 22 bp, Homo sapiens
actgcaaagggaagccctttct

SEQ ID NO: 63099 - DNA, 22 bp, Homo sapiens
agcccaggagtttgaggctgtg

SEQ ID NO: 63100 - DNA, 22 bp, Homo sapiens
actcagtacatctggagttggc

SEQ ID NO: 63101 - DNA, 22 bp, Homo sapiens
tccaggtgacagagacaggata

SEQ ID NO: 63102 - DNA, 22 bp, Homo sapiens
ggcaatagttgtgggttcttta

SEQ ID NO: 63103 - DNA, 22 bp, Homo sapiens
tcagggctgcagaagaggcagg

SEQ ID NO: 63104 - DNA, 22 bp, Homo sapiens
ggcatagatttctttaggttta

SEQ ID NO: 63105 - DNA, 22 bp, Homo sapiens
ttcattcttcagagctgcgctt

SEQ ID NO: 63106 - DNA, 22 bp, Homo sapiens
tggaacaagggcgtggcggtcg

SEQ ID NO: 63107 - DNA, 22 bp, Homo sapiens
ttgtgcttgccctggaggtgcg

SEQ ID NO: 63108 - DNA, 22 bp, Homo sapiens
ttacaaagtttaaggtggcact

SEQ ID NO: 63109 - DNA, 22 bp, Homo sapiens
caatgcattattctcccacttc

SEQ ID NO: 63110 - DNA, 22 bp, Homo sapiens
tgactggattgtcattacgacg

SEQ ID NO: 63111 - DNA, 22 bp, Homo sapiens
tggctaacaaggtgaaaccccg

SEQ ID NO: 63112 - DNA, 22 bp, Homo sapiens
atgcttccagattggtaggggt

SEQ ID NO: 63113 - DNA, 22 bp, Homo sapiens
ggcttagcaactcctgaggctc

SEQ ID NO: 63114 - DNA, 22 bp, Homo sapiens
ctggctctcaggctggtcccca

SEQ ID NO: 63115 - DNA, 22 bp, Homo sapiens
aaaatatgtataactcttctgc

SEQ ID NO: 63116 - DNA, 22 bp, Homo sapiens
gggagctggagctggaagactc

SEQ ID NO: 63117 - DNA, 22 bp, Homo sapiens
tctcagggctcagagctcaggc

SEQ ID NO: 63118 - DNA, 22 bp, Homo sapiens
tccaggatggtgacggtggcca

SEQ ID NO: 63119 - DNA, 22 bp, Homo sapiens
gggttggcatcagggttctgtg

SEQ ID NO: 63120 - DNA, 21 bp, Homo sapiens
cagagctgtccaaaccctgac

SEQ ID NO: 63121 - DNA, 22 bp, Homo sapiens
caggagtccatctggcctggtg

SEQ ID NO: 63122 - DNA, 22 bp, Homo sapiens
tttgctgctgtatatggagccc

SEQ ID NO: 63123 - DNA, 22 bp, Homo sapiens
gtgcttccatctagagggtcac

SEQ ID NO: 63124 - DNA, 22 bp, Homo sapiens
tgttgcacggccttcacagagc

SEQ ID NO: 63125 - DNA, 22 bp, Homo sapiens
gtgcaattcactgttatgtctg

SEQ ID NO: 63126 - DNA, 22 bp, Homo sapiens
aggcaaatgatcctgctccttg

SEQ ID NO: 63127 - DNA, 22 bp, Homo sapiens
gcaaatacatgttgagcaccta

SEQ ID NO: 63128 - DNA, 22 bp, Homo sapiens
ctttaattgtagctcccataat

SEQ ID NO: 63129 - DNA, 22 bp, Homo sapiens
aggtaaatgtcagagcctttaa

SEQ ID NO: 63130 - DNA, 22 bp, Homo sapiens
tgtgcctgttcccactttgcct

SEQ ID NO: 63131 - DNA, 23 bp, Homo sapiens
ctcaccaagcgccgccgctgtgt

SEQ ID NO: 63132 - DNA, 22 bp, Homo sapiens
aggcttcaggtttgctttgcag

SEQ ID NO: 63133 - DNA, 22 bp, Homo sapiens
taaatgttgtaagtacatctaa

SEQ ID NO: 63134 - DNA, 22 bp, Homo sapiens
ttggaacatgccggggtccagg

SEQ ID NO: 63135 - DNA, 18 bp, Homo sapiens
cagggctgtggggtcact

SEQ ID NO: 63136 - DNA, 22 bp, Homo sapiens
ggcttcgcagctcggcagccgc

SEQ ID NO: 63137 - DNA, 22 bp, Homo sapiens
ttggcataccttagtggtggag

SEQ ID NO: 63138 - DNA, 22 bp, Homo sapiens
agatggagtctcactcttgttg

SEQ ID NO: 63139 - DNA, 22 bp, Homo sapiens
cacagagctggaaaggctgggc

SEQ ID NO: 63140 - DNA, 22 bp, Homo sapiens
agaggctgcacttgctcatgat

SEQ ID NO: 63141 - DNA, 22 bp, Homo sapiens
tgctccagcaccaagagctcca

SEQ ID NO: 63142 - DNA, 22 bp, Homo sapiens
caatgctaaaaattctgtacat

SEQ ID NO: 63143 - DNA, 22 bp, Homo sapiens
acggcttcttgactgtgggttg

SEQ ID NO: 63144 - DNA, 22 bp, Homo sapiens
ttacgcagctgctccaggaagc

SEQ ID NO: 63145 - DNA, 22 bp, Homo sapiens
tttctggcagcgggacaggggt

SEQ ID NO: 63146 - DNA, 22 bp, Homo sapiens
gggacatctttctagtcagggt

SEQ ID NO: 63147 - DNA, 22 bp, Homo sapiens
ggttggacactaggtaggagcg

SEQ ID NO: 63148 - DNA, 22 bp, Homo sapiens
cactaggcgccgggtggctgtg

SEQ ID NO: 63149 - DNA, 22 bp, Homo sapiens
cattctgcgatcctcaagcaca

SEQ ID NO: 63150 - DNA, 22 bp, Homo sapiens
tgtacaatgctgaggtttgggg

SEQ ID NO: 63151 - DNA, 18 bp, Homo sapiens
ttgcttcttttctctagg

SEQ ID NO: 63152 - DNA, 22 bp, Homo sapiens
gggttgaggcggatgtcggcgg

SEQ ID NO: 63153 - DNA, 20 bp, Homo sapiens
ttcgctgggagtggccaggc

SEQ ID NO: 63154 - DNA, 20 bp, Homo sapiens
tgtcttccagcaggtgttta

SEQ ID NO: 63155 - DNA, 22 bp, Homo sapiens
ttgcttcttagatattcctctc

SEQ ID NO: 63156 - DNA, 22 bp, Homo sapiens
ggaggtggaggttgcagtgagc

SEQ ID NO: 63157 - DNA, 22 bp, Homo sapiens
ctgggcacagcgttgggctctt

SEQ ID NO: 63158 - DNA, 22 bp, Homo sapiens
tgcacgtgggctctctgctctt

SEQ ID NO: 63159 - DNA, 22 bp, Homo sapiens
aaggctccagtgaatgctggca

SEQ ID NO: 63160 - DNA, 22 bp, Homo sapiens
tcacaggtacagctaatgctac

SEQ ID NO: 63161 - DNA, 22 bp, Homo sapiens
gggcttcagttctgaccatctt

SEQ ID NO: 63162 - DNA, 22 bp, Homo sapiens
tggctccacaggccagggtgtg

SEQ ID NO: 63163 - DNA, 22 bp, Homo sapiens
tttgctttgtttaaaagtggta

SEQ ID NO: 63164 - DNA, 22 bp, Homo sapiens
gatggaggagatggcagggtgc

SEQ ID NO: 63165 - DNA, 22 bp, Homo sapiens
tagaggattttgcatttcatat

SEQ ID NO: 63166 - DNA, 22 bp, Homo sapiens
gctgtgtatcagatgccacggg

SEQ ID NO: 63167 - DNA, 22 bp, Homo sapiens
tacttttagcctatttgattct

SEQ ID NO: 63168 - DNA, 22 bp, Homo sapiens
ttaaattttagaaacagactct

SEQ ID NO: 63169 - DNA, 22 bp, Homo sapiens
ttatttaaaagtggtaagattc

SEQ ID NO: 63170 - DNA, 22 bp, Homo sapiens
gtcactgtatccaggttccagc

SEQ ID NO: 63171 - DNA, 22 bp, Homo sapiens
agcctattccaggatgagctca

SEQ ID NO: 63172 - DNA, 22 bp, Homo sapiens
tcaatcacgtgttccatgttct

SEQ ID NO: 63173 - DNA, 22 bp, Homo sapiens
ttatcacttatgagctttttgc

SEQ ID NO: 63174 - DNA, 22 bp, Homo sapiens
aggacttagaacattatgtact

SEQ ID NO: 63175 - DNA, 22 bp, Homo sapiens
tgttgattagtgtttagactta

SEQ ID NO: 63176 - DNA, 22 bp, Homo sapiens
acaccatactcatgttggttcc

SEQ ID NO: 63177 - DNA, 22 bp, Homo sapiens
ttccatatctgttgcatatcat

SEQ ID NO: 63178 - DNA, 22 bp, Homo sapiens
cccccaaagtttgcacggataa

SEQ ID NO: 63179 - DNA, 22 bp, Homo sapiens
caggcagggagctggaaaggat

SEQ ID NO: 63180 - DNA, 22 bp, Homo sapiens
cccatgaggtggaggttgcagt

SEQ ID NO: 63181 - DNA, 22 bp, Homo sapiens
tttggaaattttcatccagaca

SEQ ID NO: 63182 - DNA, 22 bp, Homo sapiens
tttattctgtgctacatgaaga

SEQ ID NO: 63183 - DNA, 23 bp, Homo sapiens
aattatctatttcaaatttagca

SEQ ID NO: 63184 - DNA, 22 bp, Homo sapiens
ccacaccatcgtttttacctta

SEQ ID NO: 63185 - DNA, 22 bp, Homo sapiens
tacaagatgacaggtgcatgat

SEQ ID NO: 63186 - DNA, 22 bp, Homo sapiens
cagggatggcgctggctgcccg

SEQ ID NO: 63187 - DNA, 22 bp, Homo sapiens
aacagctttgtatacagtaact

SEQ ID NO: 63188 - DNA, 23 bp, Homo sapiens
ccactagcacctgttcaacttct

SEQ ID NO: 63189 - DNA, 22 bp, Homo sapiens
gcaaacaaggacatacatcctg

SEQ ID NO: 63190 - DNA, 22 bp, Homo sapiens
aaggctcggcaatgtgcggctc

SEQ ID NO: 63191 - DNA, 22 bp, Homo sapiens
atacaaagtattgatcctgagt

SEQ ID NO: 63192 - DNA, 22 bp, Homo sapiens
tgagaccttggactccatcctt

SEQ ID NO: 63193 - DNA, 22 bp, Homo sapiens
aaaaaattatcatagttcctga

SEQ ID NO: 63194 - DNA, 22 bp, Homo sapiens
cactgcagcctcgctctcctga

SEQ ID NO: 63195 - DNA, 21 bp, Homo sapiens
tcctgtaagcttgggtggctc

SEQ ID NO: 63196 - DNA, 22 bp, Homo sapiens
caggagttttaaatctagcatg

SEQ ID NO: 63197 - DNA, 22 bp, Homo sapiens
attgataaattgcaatggggct

SEQ ID NO: 63198 - DNA, 22 bp, Homo sapiens
cccaccagtacagatggtagat

SEQ ID NO: 63199 - DNA, 22 bp, Homo sapiens
gagcccaggaagtggaggctga

SEQ ID NO: 63200 - DNA, 22 bp, Homo sapiens
aggacagagggaccagagccca

SEQ ID NO: 63201 - DNA, 22 bp, Homo sapiens
aacactgctgctgggttctgtg

SEQ ID NO: 63202 - DNA, 22 bp, Homo sapiens
ggcttggaccagtcacagtggt

SEQ ID NO: 63203 - DNA, 22 bp, Homo sapiens
gggcgccgtgggaaacagccgg

SEQ ID NO: 63204 - DNA, 22 bp, Homo sapiens
tatgttaacatgttaggaactg

SEQ ID NO: 63205 - DNA, 22 bp, Homo sapiens
actgcaaagggaagccctttct

SEQ ID NO: 63206 - DNA, 22 bp, Homo sapiens
agccagggtctctcgctctgtt

SEQ ID NO: 63207 - DNA, 17 bp, Homo sapiens
gggcagggactcctggg

SEQ ID NO: 63208 - DNA, 22 bp, Homo sapiens
gggacaatggaggcctctctcc

SEQ ID NO: 63209 - DNA, 22 bp, Homo sapiens
tttatagtagcatgatttatag

SEQ ID NO: 63210 - DNA, 22 bp, Homo sapiens
ttcagcttgctgactgcggcag

SEQ ID NO: 63211 - DNA, 22 bp, Homo sapiens
tttcaacagatctgtcttcagg

SEQ ID NO: 63212 - DNA, 22 bp, Homo sapiens
taaagggtaggttttactgtaa

SEQ ID NO: 63213 - DNA, 19 bp, Homo sapiens
agtgccgggtggcgctcag

SEQ ID NO: 63214 - DNA, 22 bp, Homo sapiens
cccaccagacctgcaccggcac

SEQ ID NO: 63215 - DNA, 22 bp, Homo sapiens
tattgacagtgactattggtag

SEQ ID NO: 63216 - DNA, 22 bp, Homo sapiens
aagtgctgggattacaggcatg

SEQ ID NO: 63217 - DNA, 22 bp, Homo sapiens
tacttttctataggtttgaaat

SEQ ID NO: 63218 - DNA, 15 bp, Homo sapiens
gcaggcaggtcacct

SEQ ID NO: 63219 - DNA, 21 bp, Homo sapiens
gggcagaggggcctcctgggt

SEQ ID NO: 63220 - DNA, 22 bp, Homo sapiens
ttgtcgggcttacgcagggcca

SEQ ID NO: 63221 - DNA, 22 bp, Homo sapiens
atatatttgagaatattcatga

SEQ ID NO: 63222 - DNA, 22 bp, Homo sapiens
ttggattcgtgcaaaagtaata

SEQ ID NO: 63223 - DNA, 22 bp, Homo sapiens
acatttatataactcactagga

SEQ ID NO: 63224 - DNA, 22 bp, Homo sapiens
aaacttttttaggttcataggc

SEQ ID NO: 63225 - DNA, 22 bp, Homo sapiens
tacatttataaggcttctctgt

SEQ ID NO: 63226 - DNA, 22 bp, Homo sapiens
tccagcccaggctggagtgtag

SEQ ID NO: 63227 - DNA, 22 bp, Homo sapiens
tttgaaatgtatcagtataggt

SEQ ID NO: 63228 - DNA, 22 bp, Homo sapiens
gcccagccacagtcactttcat

SEQ ID NO: 63229 - DNA, 22 bp, Homo sapiens
tccattatacttctgattcaaa

SEQ ID NO: 63230 - DNA, 23 bp, Homo sapiens
ctatttctcatagttcaggtctt

SEQ ID NO: 63231 - DNA, 22 bp, Homo sapiens
gggcttggcacatgggctcagc

SEQ ID NO: 63232 - DNA, 22 bp, Homo sapiens
tacaggcatgtagcatggtgat

SEQ ID NO: 63233 - DNA, 22 bp, Homo sapiens
cactgcactccagcttgggtga

SEQ ID NO: 63234 - DNA, 22 bp, Homo sapiens
aaaaagtattggccatggttga

SEQ ID NO: 63235 - DNA, 22 bp, Homo sapiens
atgcagaagactgaaaagctga

SEQ ID NO: 63236 - DNA, 22 bp, Homo sapiens
tttgcattgcattaagtattct

SEQ ID NO: 63237 - DNA, 22 bp, Homo sapiens
aaagtgctgggattacaagtgt

SEQ ID NO: 63238 - DNA, 22 bp, Homo sapiens
tgaatgtgatgctaaacatatg

SEQ ID NO: 63239 - DNA, 22 bp, Homo sapiens
gaattttattactagtcaactg

SEQ ID NO: 63240 - DNA, 22 bp, Homo sapiens
gtagagttgagtagtggtaaca

SEQ ID NO: 63241 - DNA, 22 bp, Homo sapiens
ttttctaacatctagtaatttg

SEQ ID NO: 63242 - DNA, 23 bp, Homo sapiens
ttgtcctctggatcggtttggtt

SEQ ID NO: 63243 - DNA, 22 bp, Homo sapiens
gagcactgatttatttttgtct

SEQ ID NO: 63244 - DNA, 22 bp, Homo sapiens
ctgagggtcaacttgattgtat

SEQ ID NO: 63245 - DNA, 22 bp, Homo sapiens
ccaattttattcttctgcaagt

SEQ ID NO: 63246 - DNA, 22 bp, Homo sapiens
aactaatacattaatacatgtg

SEQ ID NO: 63247 - DNA, 22 bp, Homo sapiens
gagacctcttggtatcgctagg

SEQ ID NO: 63248 - DNA, 22 bp, Homo sapiens
tgaccttatttggaaatagggt

SEQ ID NO: 63249 - DNA, 22 bp, Homo sapiens
ttacaaagtttaaggtggcact

SEQ ID NO: 63250 - DNA, 22 bp, Homo sapiens
atcctttcatctggtaatatat

SEQ ID NO: 63251 - DNA, 22 bp, Homo sapiens
tttctttatcatagcatctttg

SEQ ID NO: 63252 - DNA, 17 bp, Homo sapiens
tcggtttgccaggcttc

SEQ ID NO: 63253 - DNA, 22 bp, Homo sapiens
atcacaaaggtctcagagcaca

SEQ ID NO: 63254 - DNA, 22 bp, Homo sapiens
tccggcggccggcctgagcccg

SEQ ID NO: 63255 - DNA, 22 bp, Homo sapiens
gcccttacagggtggtcagcca

SEQ ID NO: 63256 - DNA, 22 bp, Homo sapiens
ctacaaaagtaattgtggtttt

SEQ ID NO: 63257 - DNA, 22 bp, Homo sapiens
ctaaagtgccaggaatacaggt

SEQ ID NO: 63258 - DNA, 22 bp, Homo sapiens
ctagttctagatccctgaggaa

SEQ ID NO: 63259 - DNA, 17 bp, Homo sapiens
cccgttctcttcgctgg

SEQ ID NO: 63260 - DNA, 22 bp, Homo sapiens
accagcacttccagaggtcagg

SEQ ID NO: 63261 - DNA, 22 bp, Homo sapiens
tttatagtagcatgatttataa

SEQ ID NO: 63262 - DNA, 22 bp, Homo sapiens
gcagctattgtctcctgggccc

SEQ ID NO: 63263 - DNA, 22 bp, Homo sapiens
cttgaagtggagcttttgaaat

SEQ ID NO: 63264 - DNA, 22 bp, Homo sapiens
gcaggcagaggtggaggagaca

SEQ ID NO: 63265 - DNA, 22 bp, Homo sapiens
ttagtttataattcatttctgt

SEQ ID NO: 63266 - DNA, 22 bp, Homo sapiens
ctccaggctcgtccaagatcga

SEQ ID NO: 63267 - DNA, 22 bp, Homo sapiens
atatattttttgagacagagtc

SEQ ID NO: 63268 - DNA, 22 bp, Homo sapiens
aagtgctgagactacaggcatg

SEQ ID NO: 63269 - DNA, 22 bp, Homo sapiens
gggcggggtggctcatgcctgt

SEQ ID NO: 63270 - DNA, 22 bp, Homo sapiens
tgtatattctgcctaaaagctt

SEQ ID NO: 63271 - DNA, 22 bp, Homo sapiens
aagtcacactagacaactgagg

SEQ ID NO: 63272 - DNA, 22 bp, Homo sapiens
ttatttaaaagtggtaagattc

SEQ ID NO: 63273 - DNA, 22 bp, Homo sapiens
acccacgaagatgagcggcatg

SEQ ID NO: 63274 - DNA, 22 bp, Homo sapiens
aggctatttccactcttctcat

SEQ ID NO: 63275 - DNA, 22 bp, Homo sapiens
tggcatttgagctggaaggatg

SEQ ID NO: 63276 - DNA, 22 bp, Homo sapiens
acagacaagtagttcagacaag

SEQ ID NO: 63277 - DNA, 22 bp, Homo sapiens
agttattactctttaacatatt

SEQ ID NO: 63278 - DNA, 22 bp, Homo sapiens
ccggctcggcgaccaggctgaa

SEQ ID NO: 63279 - DNA, 22 bp, Homo sapiens
aaaatcttgtgacttaggaagg

SEQ ID NO: 63280 - DNA, 22 bp, Homo sapiens
aactctatttaccctactaaac

SEQ ID NO: 63281 - DNA, 22 bp, Homo sapiens
ccaccagctgcatatgcacgta

SEQ ID NO: 63282 - DNA, 20 bp, Homo sapiens
tttctgtgagaaacactgtt

SEQ ID NO: 63283 - DNA, 22 bp, Homo sapiens
gcacatccaatgattgttttga

SEQ ID NO: 63284 - DNA, 22 bp, Homo sapiens
gcctgtgtggatgcgccggtgc

SEQ ID NO: 63285 - DNA, 22 bp, Homo sapiens
aagtgctgggattataggcatg

SEQ ID NO: 63286 - DNA, 22 bp, Homo sapiens
acaattctgatggtttcccagt

SEQ ID NO: 63287 - DNA, 22 bp, Homo sapiens
gcaggcaggcttccttgaactg

SEQ ID NO: 63288 - DNA, 22 bp, Homo sapiens
tctttcattctagtctgaggtt

SEQ ID NO: 63289 - DNA, 22 bp, Homo sapiens
atacaaagtattaatcctggat

SEQ ID NO: 63290 - DNA, 22 bp, Homo sapiens
actgccaatggtagtttgatgg

SEQ ID NO: 63291 - DNA, 22 bp, Homo sapiens
catataaatacaacatgtgtta

SEQ ID NO: 63292 - DNA, 22 bp, Homo sapiens
acttcttcttcagctgggggat

SEQ ID NO: 63293 - DNA, 22 bp, Homo sapiens
tacaaaaaattgatactgacga

SEQ ID NO: 63294 - DNA, 22 bp, Homo sapiens
gtgtttggtcagacgtccgggg

SEQ ID NO: 63295 - DNA, 19 bp, Homo sapiens
tttgatagggcataatata

SEQ ID NO: 63296 - DNA, 22 bp, Homo sapiens
tcgttagcctcgagatctttgt

SEQ ID NO: 63297 - DNA, 22 bp, Homo sapiens
ctggctgggagcgagctgctca

SEQ ID NO: 63298 - DNA, 22 bp, Homo sapiens
ggctcctggcaatgtaacttta

SEQ ID NO: 63299 - DNA, 22 bp, Homo sapiens
gcggggcccggacccagcctct

SEQ ID NO: 63300 - DNA, 22 bp, Homo sapiens
cactgcactccagcctgggtga

SEQ ID NO: 63301 - DNA, 22 bp, Homo sapiens
ctgggctagaaggaccaggatg

SEQ ID NO: 63302 - DNA, 22 bp, Homo sapiens
cccagcaaggccagctcagggc

SEQ ID NO: 63303 - DNA, 22 bp, Homo sapiens
tcttgaagtgggagacatcgtg

SEQ ID NO: 63304 - DNA, 22 bp, Homo sapiens
aggaaataggaccagacaaagc

SEQ ID NO: 63305 - DNA, 22 bp, Homo sapiens
tggggccatctcacccactgtt

SEQ ID NO: 63306 - DNA, 22 bp, Homo sapiens
gtcccataagtagtgcaacttg

SEQ ID NO: 63307 - DNA, 22 bp, Homo sapiens
gggatcgggcttgaggggccct

SEQ ID NO: 63308 - DNA, 18 bp, Homo sapiens
cttgttcttctcttggcg

SEQ ID NO: 63309 - DNA, 22 bp, Homo sapiens
ttataagactgtagtgagtatt

SEQ ID NO: 63310 - DNA, 22 bp, Homo sapiens
gggtggcaccacgtgtcttcaa

SEQ ID NO: 63311 - DNA, 22 bp, Homo sapiens
gttcaagaccagcctggccaac

SEQ ID NO: 63312 - DNA, 22 bp, Homo sapiens
gatgtggctgctctaaagccca

SEQ ID NO: 63313 - DNA, 22 bp, Homo sapiens
actgtgaacggactgaagccca

SEQ ID NO: 63314 - DNA, 22 bp, Homo sapiens
tatccaattcaccattgatggg

SEQ ID NO: 63315 - DNA, 22 bp, Homo sapiens
tttatagcagcatgatttatag

SEQ ID NO: 63316 - DNA, 22 bp, Homo sapiens
gccagggttgccaatgggggca

SEQ ID NO: 63317 - DNA, 22 bp, Homo sapiens
caaatgtataaatgtactttct

SEQ ID NO: 63318 - DNA, 22 bp, Homo sapiens
aaagaaatagatggcatttaaa

SEQ ID NO: 63319 - DNA, 22 bp, Homo sapiens
tttaaaaaactagtctgagtct

SEQ ID NO: 63320 - DNA, 22 bp, Homo sapiens
aggggctcctttgtgctgcgtc

SEQ ID NO: 63321 - DNA, 22 bp, Homo sapiens
ttcattcttttacatgtgaata

SEQ ID NO: 63322 - DNA, 22 bp, Homo sapiens
cgctgataaacgtcacgttccc

SEQ ID NO: 63323 - DNA, 22 bp, Homo sapiens
agaaatatgctgattagatgaa

SEQ ID NO: 63324 - DNA, 22 bp, Homo sapiens
ttttaatactgctattgtagga

SEQ ID NO: 63325 - DNA, 14 bp, Homo sapiens
gcaggcagatcacc

SEQ ID NO: 63326 - DNA, 22 bp, Homo sapiens
cccacacacatttatgatagga

SEQ ID NO: 63327 - DNA, 23 bp, Homo sapiens
acagtcgtaggtatccttttcct

SEQ ID NO: 63328 - DNA, 22 bp, Homo sapiens
cggagtcttgctatgttgccca

SEQ ID NO: 63329 - DNA, 22 bp, Homo sapiens
tatttcttttcgtgacttattg

SEQ ID NO: 63330 - DNA, 22 bp, Homo sapiens
tttatagcagcatgatttataa

SEQ ID NO: 63331 - DNA, 22 bp, Homo sapiens
atgggtgcagcatggtgggaac

SEQ ID NO: 63332 - DNA, 22 bp, Homo sapiens
caggcaggtcagtgaagaagga

SEQ ID NO: 63333 - DNA, 22 bp, Homo sapiens
agaaaacataggagacaggaaa

SEQ ID NO: 63334 - DNA, 22 bp, Homo sapiens
agaaaatttaaagagacacaca

SEQ ID NO: 63335 - DNA, 22 bp, Homo sapiens
acaagcatgggctttgacatca

SEQ ID NO: 63336 - DNA, 20 bp, Homo sapiens
ttgagcttttagtacagaca

SEQ ID NO: 63337 - DNA, 22 bp, Homo sapiens
agccagggacgctgcaggctac

SEQ ID NO: 63338 - DNA, 22 bp, Homo sapiens
tccgaggccaaagctgtgaata

SEQ ID NO: 63339 - DNA, 22 bp, Homo sapiens
gtgtttgttcgtgactccaaag

SEQ ID NO: 63340 - DNA, 22 bp, Homo sapiens
gggcggggggagctggaatgaa

SEQ ID NO: 63341 - DNA, 17 bp, Homo sapiens
cttcccaccatctcctg

SEQ ID NO: 63342 - DNA, 22 bp, Homo sapiens
tgaccaatactgtggatgccag

SEQ ID NO: 63343 - DNA, 22 bp, Homo sapiens
gggccatgagaggttcatcaac

SEQ ID NO: 63344 - DNA, 22 bp, Homo sapiens
tgagatgtaaggtatgcttact

SEQ ID NO: 63345 - DNA, 22 bp, Homo sapiens
acccgatgttggtgctctagta

SEQ ID NO: 63346 - DNA, 22 bp, Homo sapiens
aggaaagcttggcaaactaaat

SEQ ID NO: 63347 - DNA, 22 bp, Homo sapiens
gagccaagctcttctccatgag

SEQ ID NO: 63348 - DNA, 22 bp, Homo sapiens
tacttttagcctatttgattct

SEQ ID NO: 63349 - DNA, 16 bp, Homo sapiens
ccacctgcagctctca

SEQ ID NO: 63350 - DNA, 22 bp, Homo sapiens
ctccaggccatggctgcggagg

SEQ ID NO: 63351 - DNA, 22 bp, Homo sapiens
ccagcagccaccttctcgaaat

SEQ ID NO: 63352 - DNA, 22 bp, Homo sapiens
gaggagggagctggaagctctt

SEQ ID NO: 63353 - DNA, 22 bp, Homo sapiens
ataataacaatgccagatgcct

SEQ ID NO: 63354 - DNA, 22 bp, Homo sapiens
ttaaatattatgttgtctgcaa

SEQ ID NO: 63355 - DNA, 22 bp, Homo sapiens
ccctttagcccctgcagagact

SEQ ID NO: 63356 - DNA, 22 bp, Homo sapiens
agtcaataaaagctttagattc

SEQ ID NO: 63357 - DNA, 22 bp, Homo sapiens
tgggcagggagctggaaccaca

SEQ ID NO: 63358 - DNA, 22 bp, Homo sapiens
ccatcacagtccccatcgtgat

SEQ ID NO: 63359 - DNA, 22 bp, Homo sapiens
gactttctgatgtaaacattta

SEQ ID NO: 63360 - DNA, 22 bp, Homo sapiens
tgataaacttagaaagaatgtt

SEQ ID NO: 63361 - DNA, 22 bp, Homo sapiens
ttcttcagcctaccttgacctc

SEQ ID NO: 63362 - DNA, 22 bp, Homo sapiens
ataaaaactgacccatcctttg

SEQ ID NO: 63363 - DNA, 20 bp, Homo sapiens
ttggatgtgcatggccgtgc

SEQ ID NO: 63364 - DNA, 22 bp, Homo sapiens
cactgcactccagcctgggtca

SEQ ID NO: 63365 - DNA, 22 bp, Homo sapiens
acttttaaatgagtttcagttg

SEQ ID NO: 63366 - DNA, 22 bp, Homo sapiens
taattataacagttacatctta

SEQ ID NO: 63367 - DNA, 22 bp, Homo sapiens
gtggcattgccttctgcaggaa

SEQ ID NO: 63368 - DNA, 22 bp, Homo sapiens
cttgtcttgcacacggttgcca

SEQ ID NO: 63369 - DNA, 23 bp, Homo sapiens
caaaatgctatgtgcccaatgca

SEQ ID NO: 63370 - DNA, 22 bp, Homo sapiens
ccaggcagcctgctccattctg

SEQ ID NO: 63371 - DNA, 22 bp, Homo sapiens
ttatgatttgccacagattggt

SEQ ID NO: 63372 - DNA, 22 bp, Homo sapiens
atttactttgctgagatccatc

SEQ ID NO: 63373 - DNA, 22 bp, Homo sapiens
ttcatatttctttaaggacttt

SEQ ID NO: 63374 - DNA, 22 bp, Homo sapiens
aaggagtctgggccattcagag

SEQ ID NO: 63375 - DNA, 22 bp, Homo sapiens
tatagcagcatgatttatagtc

SEQ ID NO: 63376 - DNA, 22 bp, Homo sapiens
atgtttaaagggttgagaaata

SEQ ID NO: 63377 - DNA, 22 bp, Homo sapiens
tctgccttctatcttttgtctg

SEQ ID NO: 63378 - DNA, 22 bp, Homo sapiens
gtgccccagacacgcatgtggg

SEQ ID NO: 63379 - DNA, 22 bp, Homo sapiens
ccttgctcaagctagtgacggg

SEQ ID NO: 63380 - DNA, 22 bp, Homo sapiens
tgtgtggattcatctcaaagag

SEQ ID NO: 63381 - DNA, 22 bp, Homo sapiens
aaaagcaattgcagttcttgcc

SEQ ID NO: 63382 - DNA, 22 bp, Homo sapiens
ccagatatcactgccgtgttgt

SEQ ID NO: 63383 - DNA, 22 bp, Homo sapiens
atgcgagtgatgcagagtggct

SEQ ID NO: 63384 - DNA, 22 bp, Homo sapiens
gaagatgttatggagagctcag

SEQ ID NO: 63385 - DNA, 21 bp, Homo sapiens
ttgttcctatctgcctcctgc

SEQ ID NO: 63386 - DNA, 22 bp, Homo sapiens
cttcctcctccatctcgaaggc

SEQ ID NO: 63387 - DNA, 20 bp, Homo sapiens
ctgtggaattttaccatgcg

SEQ ID NO: 63388 - DNA, 22 bp, Homo sapiens
agttggagtgaacatgagattg

SEQ ID NO: 63389 - DNA, 22 bp, Homo sapiens
ttatagcagcatgatttacaat

SEQ ID NO: 63390 - DNA, 22 bp, Homo sapiens
tagattcagatatttaggacaa

SEQ ID NO: 63391 - DNA, 22 bp, Homo sapiens
ctcgggcaccctggttctggtg

SEQ ID NO: 63392 - DNA, 22 bp, Homo sapiens
tggacacaaagatcaaatattg

SEQ ID NO: 63393 - DNA, 22 bp, Homo sapiens
gacccggctccaggcccagcag

SEQ ID NO: 63394 - DNA, 22 bp, Homo sapiens
ccaggctggagtgcagtggcac

SEQ ID NO: 63395 - DNA, 22 bp, Homo sapiens
caaatactacgattcttgcagt

SEQ ID NO: 63396 - DNA, 22 bp, Homo sapiens
tcgagctctggagccaaggatg

SEQ ID NO: 63397 - DNA, 22 bp, Homo sapiens
cagtttcttcctcccccagaga

SEQ ID NO: 63398 - DNA, 22 bp, Homo sapiens
acatttttcacatttgtagggt

SEQ ID NO: 63399 - DNA, 22 bp, Homo sapiens
cgtgccactgcactctagcctg

SEQ ID NO: 63400 - DNA, 22 bp, Homo sapiens
acccaggctggcgtgcagtggc

SEQ ID NO: 63401 - DNA, 22 bp, Homo sapiens
agtatgtcagagtgaaaatggt

SEQ ID NO: 63402 - DNA, 20 bp, Homo sapiens
aagacaccagtggcagcccc

SEQ ID NO: 63403 - DNA, 22 bp, Homo sapiens
tttcataatactgtacatgaaa

SEQ ID NO: 63404 - DNA, 22 bp, Homo sapiens
tgcaataactactttaatgttg

SEQ ID NO: 63405 - DNA, 22 bp, Homo sapiens
gctgctaagcgtttctgttcca

SEQ ID NO: 63406 - DNA, 22 bp, Homo sapiens
cactgcacttcagcctgggtga

SEQ ID NO: 63407 - DNA, 22 bp, Homo sapiens
taagaaatttagttatagaatg

SEQ ID NO: 63408 - DNA, 18 bp, Homo sapiens
acacttcctggtggtgtg

SEQ ID NO: 63409 - DNA, 20 bp, Homo sapiens
ttcatgggagcaaagaggcc

SEQ ID NO: 63410 - DNA, 22 bp, Homo sapiens
ccggcgggcagcggcagtgagc

SEQ ID NO: 63411 - DNA, 22 bp, Homo sapiens
agttgcagacgcagagatgttg

SEQ ID NO: 63412 - DNA, 22 bp, Homo sapiens
gcatgcaatctatccttaggaa

SEQ ID NO: 63413 - DNA, 22 bp, Homo sapiens
gtctatatattgcttgaataat

SEQ ID NO: 63414 - DNA, 22 bp, Homo sapiens
ccttggcaggcacgtcctgcgg

SEQ ID NO: 63415 - DNA, 22 bp, Homo sapiens
aagcccttggcgcacaccgggc

SEQ ID NO: 63416 - DNA, 22 bp, Homo sapiens
gcaaatacatgttgagcaccta

SEQ ID NO: 63417 - DNA, 22 bp, Homo sapiens
gtgggggcaggcagtgctagga

SEQ ID NO: 63418 - DNA, 20 bp, Homo sapiens
ataaaataactgccacaaga

SEQ ID NO: 63419 - DNA, 22 bp, Homo sapiens
ttgtggttaaccgcacattttt

SEQ ID NO: 63420 - DNA, 22 bp, Homo sapiens
tttttgggtccaggctgtatct

SEQ ID NO: 63421 - DNA, 22 bp, Homo sapiens
ttatagcagcatgatttatagt

SEQ ID NO: 63422 - DNA, 18 bp, Homo sapiens
tgtagagccaggtttgcc

SEQ ID NO: 63423 - DNA, 22 bp, Homo sapiens
gggcaggggtcagtggccccaa

SEQ ID NO: 63424 - DNA, 22 bp, Homo sapiens
tcactgcaacctccacctcctg

SEQ ID NO: 63425 - DNA, 22 bp, Homo sapiens
gcacggctaatttttgtatttt

SEQ ID NO: 63426 - DNA, 22 bp, Homo sapiens
atggtactggggtcccggagtt

SEQ ID NO: 63427 - DNA, 22 bp, Homo sapiens
atcaagtgaagggctcttgaag

SEQ ID NO: 63428 - DNA, 22 bp, Homo sapiens
ccaggagtgcagggatggtatc

SEQ ID NO: 63429 - DNA, 22 bp, Homo sapiens
aaattctgatttaataagtgta

SEQ ID NO: 63430 - DNA, 22 bp, Homo sapiens
ttatttaatgtgatctgaagag

SEQ ID NO: 63431 - DNA, 22 bp, Homo sapiens
attgaaaataaggccagaaaca

SEQ ID NO: 63432 - DNA, 22 bp, Homo sapiens
ttcccacattctttacattcat

SEQ ID NO: 63433 - DNA, 22 bp, Homo sapiens
tcccacacagcccgctcaccgg

SEQ ID NO: 63434 - DNA, 22 bp, Homo sapiens
gcgagtgccgagagggcagggc

SEQ ID NO: 63435 - DNA, 22 bp, Homo sapiens
gtcactgtatccaggttccagc

SEQ ID NO: 63436 - DNA, 22 bp, Homo sapiens
gctccggcttggtgtgcagggt

SEQ ID NO: 63437 - DNA, 22 bp, Homo sapiens
atgcccaatgtcacaatttttg

SEQ ID NO: 63438 - DNA, 22 bp, Homo sapiens
caaggtgccatgctgggcgggg

SEQ ID NO: 63439 - DNA, 22 bp, Homo sapiens
tggtatgaccgtggtgcaagca

SEQ ID NO: 63440 - DNA, 22 bp, Homo sapiens
atttattcctttatggctggag

SEQ ID NO: 63441 - DNA, 22 bp, Homo sapiens
gtacaaatgcaggtttgttaca

SEQ ID NO: 63442 - DNA, 22 bp, Homo sapiens
cactgcaacctccacctcctgg

SEQ ID NO: 63443 - DNA, 22 bp, Homo sapiens
aataaacaaaggacaaggaggt

SEQ ID NO: 63444 - DNA, 22 bp, Homo sapiens
tttgctattgtgaatagtgcca

SEQ ID NO: 63445 - DNA, 22 bp, Homo sapiens
aaggctccagtgaatgctggca

SEQ ID NO: 63446 - DNA, 22 bp, Homo sapiens
acacagagccaaaccatatcac

SEQ ID NO: 63447 - DNA, 22 bp, Homo sapiens
tggtatttctgtgcccagctca

SEQ ID NO: 63448 - DNA, 22 bp, Homo sapiens
tttcttctatgtgtgatatttt

SEQ ID NO: 63449 - DNA, 18 bp, Homo sapiens
ccctgccagctcccagca

SEQ ID NO: 63450 - DNA, 22 bp, Homo sapiens
acaggtcctcaagtcagctggg

SEQ ID NO: 63451 - DNA, 22 bp, Homo sapiens
gcggggcctgactctgacccgc

SEQ ID NO: 63452 - DNA, 22 bp, Homo sapiens
ttgtcttttgtgggaaatatgg

SEQ ID NO: 63453 - DNA, 22 bp, Homo sapiens
ttgcacagaatgacaatatgta

SEQ ID NO: 63454 - DNA, 22 bp, Homo sapiens
aagacacaatgtagcccagcac

SEQ ID NO: 63455 - DNA, 22 bp, Homo sapiens
tctgttgcaatgtgcatggtga

SEQ ID NO: 63456 - DNA, 22 bp, Homo sapiens
ttatttttaaaagttcacacag

SEQ ID NO: 63457 - DNA, 22 bp, Homo sapiens
gatttttatataaagtgagaaa

SEQ ID NO: 63458 - DNA, 22 bp, Homo sapiens
acccaggctggagtgcagtggg

SEQ ID NO: 63459 - DNA, 22 bp, Homo sapiens
gcatctaaataaacgtgggagt

SEQ ID NO: 63460 - DNA, 22 bp, Homo sapiens
tgttttaagggtcaactgtcac

SEQ ID NO: 63461 - DNA, 22 bp, Homo sapiens
taatatctacttcatagagttt

SEQ ID NO: 63462 - DNA, 22 bp, Homo sapiens
tggtggcactgacatcagacac

SEQ ID NO: 63463 - DNA, 20 bp, Homo sapiens
agcaactctcacctggctgc

SEQ ID NO: 63464 - DNA, 22 bp, Homo sapiens
taaatgttgtaagtacatctaa

SEQ ID NO: 63465 - DNA, 22 bp, Homo sapiens
gcaggcagatcacctgtcagga

SEQ ID NO: 63466 - DNA, 22 bp, Homo sapiens
tgtctggtgggttgacaggcag

SEQ ID NO: 63467 - DNA, 22 bp, Homo sapiens
tccatgaggaccaaattcgtag

SEQ ID NO: 63468 - DNA, 22 bp, Homo sapiens
tgagtagagaattcagctaagg

SEQ ID NO: 63469 - DNA, 22 bp, Homo sapiens
ttatagcagcatgatttataat

SEQ ID NO: 63470 - DNA, 22 bp, Homo sapiens
tagtggatgttcagagatttga

SEQ ID NO: 63471 - DNA, 22 bp, Homo sapiens
cctttcctgtgtccttttaagg

SEQ ID NO: 63472 - DNA, 22 bp, Homo sapiens
tcactgcaacctccacctcccg

SEQ ID NO: 63473 - DNA, 22 bp, Homo sapiens
aagcatttcaggtagagatatt

SEQ ID NO: 63474 - DNA, 22 bp, Homo sapiens
cactgcactccatcctgggaaa

SEQ ID NO: 63475 - DNA, 22 bp, Homo sapiens
acaactttgacccttgttctta

SEQ ID NO: 63476 - DNA, 22 bp, Homo sapiens
ttctcttttcaccagttgctaa

SEQ ID NO: 63477 - DNA, 22 bp, Homo sapiens
aaaactacatttgacattttgt

SEQ ID NO: 63478 - DNA, 22 bp, Homo sapiens
atagaatatgacttttagatcc

SEQ ID NO: 63479 - DNA, 22 bp, Homo sapiens
atgaaatatcttgaagaaattc

SEQ ID NO: 63480 - DNA, 22 bp, Homo sapiens
gaggggctgccctggtgtcagg

SEQ ID NO: 63481 - DNA, 22 bp, Homo sapiens
cctgcacatgtgtgcgcctgta

SEQ ID NO: 63482 - DNA, 22 bp, Homo sapiens
cccaggggttcaaggctgcagt

SEQ ID NO: 63483 - DNA, 22 bp, Homo sapiens
ttcccttaaattatggcatcta

SEQ ID NO: 63484 - DNA, 22 bp, Homo sapiens
ttcccacagtgactccagagaa

SEQ ID NO: 63485 - DNA, 22 bp, Homo sapiens
tttgttttcaatgtgtcattca

SEQ ID NO: 63486 - DNA, 22 bp, Homo sapiens
aattttctggtgtgtaatgaag

SEQ ID NO: 63487 - DNA, 21 bp, Homo sapiens
tgactgaggcttcttcacaca

SEQ ID NO: 63488 - DNA, 22 bp, Homo sapiens
gtagcccacctggggagggcga

SEQ ID NO: 63489 - DNA, 22 bp, Homo sapiens
acccaggctggagtgcagtggc

SEQ ID NO: 63490 - DNA, 22 bp, Homo sapiens
aaacccagggttttgtcttccc

SEQ ID NO: 63491 - DNA, 22 bp, Homo sapiens
ttccacattccttacattcata

SEQ ID NO: 63492 - DNA, 22 bp, Homo sapiens
gttttgaatactactagaactt

SEQ ID NO: 63493 - DNA, 22 bp, Homo sapiens
ctttttcctcgtagagcctaat

SEQ ID NO: 63494 - DNA, 22 bp, Homo sapiens
tgactacaacctccacctcccg

SEQ ID NO: 63495 - DNA, 22 bp, Homo sapiens
atacaaaatatatactggagac

SEQ ID NO: 63496 - DNA, 22 bp, Homo sapiens
acttttgtggagtctgcggagc

SEQ ID NO: 63497 - DNA, 22 bp, Homo sapiens
ggatgttgattgaatggccatt

SEQ ID NO: 63498 - DNA, 22 bp, Homo sapiens
caggagttcaaggttgcagtga

SEQ ID NO: 63499 - DNA, 22 bp, Homo sapiens
atgttggagtcgtaaggcatgg

SEQ ID NO: 63500 - DNA, 22 bp, Homo sapiens
ttattccccatcttcctctggt

SEQ ID NO: 63501 - DNA, 22 bp, Homo sapiens
tggctccacaggccagggtgtg

SEQ ID NO: 63502 - DNA, 22 bp, Homo sapiens
taaaggtagtgtgacatattgt

SEQ ID NO: 63503 - DNA, 22 bp, Homo sapiens
gtatgtctatagtttttaaata

SEQ ID NO: 63504 - DNA, 22 bp, Homo sapiens
cctgagtagctggaattaaagg

SEQ ID NO: 63505 - DNA, 18 bp, Homo sapiens
tcttccaacactgacacc

SEQ ID NO: 63506 - DNA, 22 bp, Homo sapiens
gacctccgtgtacacctcccag

SEQ ID NO: 63507 - DNA, 22 bp, Homo sapiens
gtgctggggagataggaagaga

SEQ ID NO: 63508 - DNA, 22 bp, Homo sapiens
ctcttagtaatgccatgaagca

SEQ ID NO: 63509 - DNA, 22 bp, Homo sapiens
ttctgtgaatcttttttcccac

SEQ ID NO: 63510 - DNA, 18 bp, Homo sapiens
tccatgcacatagccccc

SEQ ID NO: 63511 - DNA, 22 bp, Homo sapiens
catgtaaagaatttcacacaag

SEQ ID NO: 63512 - DNA, 22 bp, Homo sapiens
cttctcaaagttgtgaatcagg

SEQ ID NO: 63513 - DNA, 22 bp, Homo sapiens
ggctcctgggggtgctcctgcc

SEQ ID NO: 63514 - DNA, 22 bp, Homo sapiens
taaaatttgtccctgagtgttg

SEQ ID NO: 63515 - DNA, 22 bp, Homo sapiens
ccaggctagagtgcaatggcat

SEQ ID NO: 63516 - DNA, 22 bp, Homo sapiens
atagggcctaaaaagtattgct

SEQ ID NO: 63517 - DNA, 22 bp, Homo sapiens
gtatcggtttatttttgggata

SEQ ID NO: 63518 - DNA, 22 bp, Homo sapiens
acagattcactgcactggccat

SEQ ID NO: 63519 - DNA, 22 bp, Homo sapiens
ctagcctgggatttgaacttat

SEQ ID NO: 63520 - DNA, 22 bp, Homo sapiens
acccaggctggagtgcagtgat

SEQ ID NO: 63521 - DNA, 16 bp, Homo sapiens
gcaggcagatcacatg

SEQ ID NO: 63522 - DNA, 22 bp, Homo sapiens
taatactgtatactgcaaattt

SEQ ID NO: 63523 - DNA, 22 bp, Homo sapiens
ccaggggttggaggttgcagtg

SEQ ID NO: 63524 - DNA, 22 bp, Homo sapiens
tgtcctgcccaaggtcacatac

SEQ ID NO: 63525 - DNA, 22 bp, Homo sapiens
agaggccggccgagcccatggg

SEQ ID NO: 63526 - DNA, 22 bp, Homo sapiens
actgcactccagcccgagcaac

SEQ ID NO: 63527 - DNA, 22 bp, Homo sapiens
ttttcatttttgtagatgcaag

SEQ ID NO: 63528 - DNA, 22 bp, Homo sapiens
cactgcactccagcctgggaga

SEQ ID NO: 63529 - DNA, 22 bp, Homo sapiens
gcccaggctggagtgcagtggt

SEQ ID NO: 63530 - DNA, 22 bp, Homo sapiens
gactttgtgccaaacgccagaa

SEQ ID NO: 63531 - DNA, 22 bp, Homo sapiens
attggccatttgcatgtattat

SEQ ID NO: 63532 - DNA, 22 bp, Homo sapiens
caggaaagggatgggctgccac

SEQ ID NO: 63533 - DNA, 22 bp, Homo sapiens
caggcagggagctggaaaggat

SEQ ID NO: 63534 - DNA, 22 bp, Homo sapiens
tgagggaatattgatagatccg

SEQ ID NO: 63535 - DNA, 22 bp, Homo sapiens
ttgctgacctttgctctccgtt

SEQ ID NO: 63536 - DNA, 22 bp, Homo sapiens
gagagtctaggaacctcatata

SEQ ID NO: 63537 - DNA, 22 bp, Homo sapiens
ctcactgcaacctccgtctccc

SEQ ID NO: 63538 - DNA, 22 bp, Homo sapiens
atgtatacgtgcaggtcacagg

SEQ ID NO: 63539 - DNA, 22 bp, Homo sapiens
cccaggaggcagaagttgcagt

SEQ ID NO: 63540 - DNA, 22 bp, Homo sapiens
agaggaggctctgggatcgtcc

SEQ ID NO: 63541 - DNA, 22 bp, Homo sapiens
tgagatgtcatagttcagttca

SEQ ID NO: 63542 - DNA, 22 bp, Homo sapiens
agtgagagtattaatgtgaact

SEQ ID NO: 63543 - DNA, 22 bp, Homo sapiens
tggcaatgttagcaaagcattt

SEQ ID NO: 63544 - DNA, 22 bp, Homo sapiens
aggctcagatccttgtgtcctg

SEQ ID NO: 63545 - DNA, 22 bp, Homo sapiens
gggagaggttacccgagcaact

SEQ ID NO: 63546 - DNA, 22 bp, Homo sapiens
tccaggctttggggcaggagcg

SEQ ID NO: 63547 - DNA, 22 bp, Homo sapiens
gacagacacaattgatccatga

SEQ ID NO: 63548 - DNA, 22 bp, Homo sapiens
cactgcactccagcctgcgcaa

SEQ ID NO: 63549 - DNA, 22 bp, Homo sapiens
gctgtgtatcagatgccacggg

SEQ ID NO: 63550 - DNA, 22 bp, Homo sapiens
tcccagtttttctccactaagg

SEQ ID NO: 63551 - DNA, 22 bp, Homo sapiens
agtcaaagatgaccgagttcct

SEQ ID NO: 63552 - DNA, 22 bp, Homo sapiens
tatcagcgtgcaaatctttgga

SEQ ID NO: 63553 - DNA, 22 bp, Homo sapiens
gaaaggagagggttaaggagct

SEQ ID NO: 63554 - DNA, 22 bp, Homo sapiens
cactgcactccagcctggcctg

SEQ ID NO: 63555 - DNA, 22 bp, Homo sapiens
cctcgacctccccaggctcagg

SEQ ID NO: 63556 - DNA, 22 bp, Homo sapiens
tcttttgtgattcttcagttac

SEQ ID NO: 63557 - DNA, 22 bp, Homo sapiens
ccaggctggagtgcagtggcac

SEQ ID NO: 63558 - DNA, 22 bp, Homo sapiens
ccaggctgctgttggtgtccgc

SEQ ID NO: 63559 - DNA, 22 bp, Homo sapiens
aaggaaagctgtggttctgaga

SEQ ID NO: 63560 - DNA, 22 bp, Homo sapiens
ccaggctggagtgcaatggcgt

SEQ ID NO: 63561 - DNA, 22 bp, Homo sapiens
tagtggatgttcagagatttga

SEQ ID NO: 63562 - DNA, 21 bp, Homo sapiens
tctgatggtagatgagatgtg

SEQ ID NO: 63563 - DNA, 21 bp, Homo sapiens
tggtacaccttgcctgtcaga

SEQ ID NO: 63564 - DNA, 22 bp, Homo sapiens
ctgctgagagccccagctgaga

SEQ ID NO: 63565 - DNA, 22 bp, Homo sapiens
tgaggcaggagaatcacatgaa

SEQ ID NO: 63566 - DNA, 22 bp, Homo sapiens
ggaggcggaggctgcagtgagc

SEQ ID NO: 63567 - DNA, 22 bp, Homo sapiens
caaccccactacacgttggaga

SEQ ID NO: 63568 - DNA, 22 bp, Homo sapiens
tggtggggccagacttcagctc

SEQ ID NO: 63569 - DNA, 22 bp, Homo sapiens
gacaagctcccggtggccctcc

SEQ ID NO: 63570 - DNA, 22 bp, Homo sapiens
gagacgtggcctttgcctgagc

SEQ ID NO: 63571 - DNA, 22 bp, Homo sapiens
ccacccttgggttcggaggccg

SEQ ID NO: 63572 - DNA, 22 bp, Homo sapiens
gagcaggaaggccagaagggtc

SEQ ID NO: 63573 - DNA, 22 bp, Homo sapiens
gcacctgcctgggactgaagat

SEQ ID NO: 63574 - DNA, 19 bp, Homo sapiens
agggaatccggctgaggga

SEQ ID NO: 63575 - DNA, 22 bp, Homo sapiens
gaggtggccaagcgaggaaggg

SEQ ID NO: 63576 - DNA, 22 bp, Homo sapiens
ggagtgactcacagctgggaca

SEQ ID NO: 63577 - DNA, 22 bp, Homo sapiens
gtgctccctccttcctcaagga

SEQ ID NO: 63578 - DNA, 22 bp, Homo sapiens
aggcaaggtgctacagacagtg

SEQ ID NO: 63579 - DNA, 22 bp, Homo sapiens
ctcaggagttggaggctacagt

SEQ ID NO: 63580 - DNA, 22 bp, Homo sapiens
ggaggcggaagttgcagtgagc

SEQ ID NO: 63581 - DNA, 22 bp, Homo sapiens
tttgttttcaatgtgtcattca

SEQ ID NO: 63582 - DNA, 22 bp, Homo sapiens
tgaatgtgatgctaaacatatg

SEQ ID NO: 63583 - DNA, 22 bp, Homo sapiens
tgagcaggcgcagcaggaggtc

SEQ ID NO: 63584 - DNA, 22 bp, Homo sapiens
ctgagggtcaacttgattgtat

SEQ ID NO: 63585 - DNA, 18 bp, Homo sapiens
gaggatggaaggagatgc

SEQ ID NO: 63586 - DNA, 22 bp, Homo sapiens
ccattgtaaattctgtggaagt

SEQ ID NO: 63587 - DNA, 22 bp, Homo sapiens
aatggaatacctaggtggccca

SEQ ID NO: 63588 - DNA, 22 bp, Homo sapiens
gtgaggtggtacaatattaact

SEQ ID NO: 63589 - DNA, 22 bp, Homo sapiens
ccaggaggttgaggctgcagtg

SEQ ID NO: 63590 - DNA, 22 bp, Homo sapiens
tgcaccctcatcagtcaaatgg

SEQ ID NO: 63591 - DNA, 22 bp, Homo sapiens
caggctgtccaggctcctttgg

SEQ ID NO: 63592 - DNA, 22 bp, Homo sapiens
cgtgccactgcactccagtctg

SEQ ID NO: 63593 - DNA, 22 bp, Homo sapiens
gctgcgccggatcccacgttcc

SEQ ID NO: 63594 - DNA, 21 bp, Homo sapiens
tgttttccaccttgaggcaag

SEQ ID NO: 63595 - DNA, 22 bp, Homo sapiens
agggaagaggaccagagtctct

SEQ ID NO: 63596 - DNA, 22 bp, Homo sapiens
ttttggctctgtctgtatcttt

SEQ ID NO: 63597 - DNA, 22 bp, Homo sapiens
ttttctgtttgcttcaagacat

SEQ ID NO: 63598 - DNA, 23 bp, Homo sapiens
atgtttgcagtaacccatcctgg

SEQ ID NO: 63599 - DNA, 22 bp, Homo sapiens
agcgccactgcactccagcctg

SEQ ID NO: 63600 - DNA, 22 bp, Homo sapiens
ttggcttttatgcagcttaggt

SEQ ID NO: 63601 - DNA, 22 bp, Homo sapiens
ccaggcaggcgatggtgcagtg

SEQ ID NO: 63602 - DNA, 22 bp, Homo sapiens
aggagggagcttaagccaggca

SEQ ID NO: 63603 - DNA, 22 bp, Homo sapiens
aactagaaaaagactttctgag

SEQ ID NO: 63604 - DNA, 22 bp, Homo sapiens
aaacttgagccaagggcttggg

SEQ ID NO: 63605 - DNA, 22 bp, Homo sapiens
tgctggtaccgcgcctccgcca

SEQ ID NO: 63606 - DNA, 22 bp, Homo sapiens
ggtgacctcacctggtcccacc

SEQ ID NO: 63607 - DNA, 22 bp, Homo sapiens
ggacaagcctgtgagtgggttt

SEQ ID NO: 63608 - DNA, 22 bp, Homo sapiens
ccaggctggagtgcaatggcat

SEQ ID NO: 63609 - DNA, 22 bp, Homo sapiens
gcagaggacacaggagggcaag

SEQ ID NO: 63610 - DNA, 22 bp, Homo sapiens
ctgagcctcctgcttctatttc

SEQ ID NO: 63611 - DNA, 22 bp, Homo sapiens
cccaggcttttctcttgcccca

SEQ ID NO: 63612 - DNA, 22 bp, Homo sapiens
tcactcaggctggagtgcagtg

SEQ ID NO: 63613 - DNA, 22 bp, Homo sapiens
ggagaagaggagctggaagcct

SEQ ID NO: 63614 - DNA, 22 bp, Homo sapiens
tacaaaaaattgatactgacga

SEQ ID NO: 63615 - DNA, 22 bp, Homo sapiens
caagctgaacactgtcttcaag

SEQ ID NO: 63616 - DNA, 22 bp, Homo sapiens
tgtgacctcatcttaactggaa

SEQ ID NO: 63617 - DNA, 22 bp, Homo sapiens
acatcctcccgatctactggct

SEQ ID NO: 63618 - DNA, 22 bp, Homo sapiens
agtgaggggcagctgagtgggc

SEQ ID NO: 63619 - DNA, 22 bp, Homo sapiens
gaggcaggcagattgcttgagg

SEQ ID NO: 63620 - DNA, 22 bp, Homo sapiens
aggtggggaggagtgtctcttt

SEQ ID NO: 63621 - DNA, 22 bp, Homo sapiens
ttgacctatgtttcttcatctg

SEQ ID NO: 63622 - DNA, 22 bp, Homo sapiens
tggcacgacaattggcaccaat

SEQ ID NO: 63623 - DNA, 22 bp, Homo sapiens
accctcaacaaattcactctat

SEQ ID NO: 63624 - DNA, 22 bp, Homo sapiens
aggaggaagggaagacaagtaa

SEQ ID NO: 63625 - DNA, 23 bp, Homo sapiens
tgctggagaagcaaagttctgag

SEQ ID NO: 63626 - DNA, 22 bp, Homo sapiens
agagggcattaactctgtcttg

SEQ ID NO: 63627 - DNA, 22 bp, Homo sapiens
atggggagctcaccacctgttt

SEQ ID NO: 63628 - DNA, 22 bp, Homo sapiens
ggaactgaggaacgaactggga

SEQ ID NO: 63629 - DNA, 22 bp, Homo sapiens
tttccatgtgtactggccagaa

SEQ ID NO: 63630 - DNA, 22 bp, Homo sapiens
tcgggctcgctctcctagcgga

SEQ ID NO: 63631 - DNA, 21 bp, Homo sapiens
taggtgggagccccagtatgc

SEQ ID NO: 63632 - DNA, 22 bp, Homo sapiens
agaggccggccgagcccatggg

SEQ ID NO: 63633 - DNA, 22 bp, Homo sapiens
agggaattcactggaacgccct

SEQ ID NO: 63634 - DNA, 22 bp, Homo sapiens
cccaggctggagtgtaatggtg

SEQ ID NO: 63635 - DNA, 22 bp, Homo sapiens
ccaggctggagtatagtggcgc

SEQ ID NO: 63636 - DNA, 22 bp, Homo sapiens
aggctggagtgcagttgcatga

SEQ ID NO: 63637 - DNA, 22 bp, Homo sapiens
ccaggaggtggagattgcagtg

SEQ ID NO: 63638 - DNA, 22 bp, Homo sapiens
aagtggactaatacaaggacta

SEQ ID NO: 63639 - DNA, 22 bp, Homo sapiens
gcccaggctggagtgcagtggc

SEQ ID NO: 63640 - DNA, 22 bp, Homo sapiens
actagaaagaagttttttgaga

SEQ ID NO: 63641 - DNA, 23 bp, Homo sapiens
ggttccaggaacacagcctgatg

SEQ ID NO: 63642 - DNA, 22 bp, Homo sapiens
cagtcactggaatagctgagga

SEQ ID NO: 63643 - DNA, 22 bp, Homo sapiens
gcaagacctatctagttgctgt

SEQ ID NO: 63644 - DNA, 19 bp, Homo sapiens
tccagatgatatggattac

SEQ ID NO: 63645 - DNA, 22 bp, Homo sapiens
ttgccgccgtctgctcgccccg

SEQ ID NO: 63646 - DNA, 22 bp, Homo sapiens
gccaggctgaggctctggaaga

SEQ ID NO: 63647 - DNA, 22 bp, Homo sapiens
ggaggcggaggttgcagtgagt

SEQ ID NO: 63648 - DNA, 22 bp, Homo sapiens
ccccatgaagtagggtctctga

SEQ ID NO: 63649 - DNA, 22 bp, Homo sapiens
tttgaaatgtatcagtataggt

SEQ ID NO: 63650 - DNA, 22 bp, Homo sapiens
cagctgctgttcagttttgttt

SEQ ID NO: 63651 - DNA, 22 bp, Homo sapiens
ggctcctgggggtgctcctgcc

SEQ ID NO: 63652 - DNA, 22 bp, Homo sapiens
aggggctcctttgtgctgcgtc

SEQ ID NO: 63653 - DNA, 22 bp, Homo sapiens
gctgcacagacttgctcattta

SEQ ID NO: 63654 - DNA, 22 bp, Homo sapiens
gtagcccacctggggagggcga

SEQ ID NO: 63655 - DNA, 22 bp, Homo sapiens
tgctccatgcgctcggccggcg

SEQ ID NO: 63656 - DNA, 22 bp, Homo sapiens
ccaggaggcggaggttgcagcg

SEQ ID NO: 63657 - DNA, 22 bp, Homo sapiens
ttggccatctaagcccagccac

SEQ ID NO: 63658 - DNA, 17 bp, Homo sapiens
cagtcgaggaggacctg

SEQ ID NO: 63659 - DNA, 22 bp, Homo sapiens
tcagtgatttctggggtgaggg

SEQ ID NO: 63660 - DNA, 22 bp, Homo sapiens
ctggcctaaaaatacagaacaa

SEQ ID NO: 63661 - DNA, 22 bp, Homo sapiens
cggctggtgtcgggcacagcaa

SEQ ID NO: 63662 - DNA, 22 bp, Homo sapiens
ctcactgcaatctccgtctccc

SEQ ID NO: 63663 - DNA, 21 bp, Homo sapiens
gctgctcgagatccagtgctt

SEQ ID NO: 63664 - DNA, 22 bp, Homo sapiens
tgctcattggcgatctgaggga

SEQ ID NO: 63665 - DNA, 22 bp, Homo sapiens
aagtccaggtcctcattccatc

SEQ ID NO: 63666 - DNA, 22 bp, Homo sapiens
gcaggcagaggtggaggagaca

SEQ ID NO: 63667 - DNA, 22 bp, Homo sapiens
tccaactttctcctccggcttg

SEQ ID NO: 63668 - DNA, 22 bp, Homo sapiens
tttccagagggtgctcagggcg

SEQ ID NO: 63669 - DNA, 22 bp, Homo sapiens
agcaggaaggggatgatgggca

SEQ ID NO: 63670 - DNA, 22 bp, Homo sapiens
caggctgctgcctagaatgaca

SEQ ID NO: 63671 - DNA, 22 bp, Homo sapiens
ggcttttgtttcagctctgcta

SEQ ID NO: 63672 - DNA, 19 bp, Homo sapiens
gcagacaggtccagagagg

SEQ ID NO: 63673 - DNA, 22 bp, Homo sapiens
tccagtgtttttcttcacaggt

SEQ ID NO: 63674 - DNA, 22 bp, Homo sapiens
aggacagagggaccagagccca

SEQ ID NO: 63675 - DNA, 22 bp, Homo sapiens
tgagatcattgacttgttcctg

SEQ ID NO: 63676 - DNA, 22 bp, Homo sapiens
ccaggaggcagaagttgcagtg

SEQ ID NO: 63677 - DNA, 22 bp, Homo sapiens
tgggtggcagcttcagcatgtt

SEQ ID NO: 63678 - DNA, 19 bp, Homo sapiens
gactcacaccttccgctgt

SEQ ID NO: 63679 - DNA, 22 bp, Homo sapiens
ctcgggcttgaggctgtttacc

SEQ ID NO: 63680 - DNA, 22 bp, Homo sapiens
aagaagagaactggcatcctaa

SEQ ID NO: 63681 - DNA, 22 bp, Homo sapiens
cagcatgaatgtgttcgtaggg

SEQ ID NO: 63682 - DNA, 22 bp, Homo sapiens
gagtcgagcagaaagccgtcgg

SEQ ID NO: 63683 - DNA, 22 bp, Homo sapiens
gtggtgtttgagctgccaggga

SEQ ID NO: 63684 - DNA, 22 bp, Homo sapiens
tgctgtgaggttgagaaggaag

SEQ ID NO: 63685 - DNA, 22 bp, Homo sapiens
accttcaggtgagcacacagat

SEQ ID NO: 63686 - DNA, 22 bp, Homo sapiens
atgtcactgttgttattgttat

SEQ ID NO: 63687 - DNA, 22 bp, Homo sapiens
atcttgttaaaaagcagattct

SEQ ID NO: 63688 - DNA, 22 bp, Homo sapiens
gagaagtcatttgaccacctag

SEQ ID NO: 63689 - DNA, 22 bp, Homo sapiens
tcacttcccagacggggtggca

SEQ ID NO: 63690 - DNA, 23 bp, Homo sapiens
ccagtgattgcctggaaggaggt

SEQ ID NO: 63691 - DNA, 22 bp, Homo sapiens
ggggcattgtgtctgggttcct

SEQ ID NO: 63692 - DNA, 22 bp, Homo sapiens
gagatggagtctttttctgtca

SEQ ID NO: 63693 - DNA, 22 bp, Homo sapiens
aatttgttataacttgggctga

SEQ ID NO: 63694 - DNA, 22 bp, Homo sapiens
ttgagggtctggatctgctgct

SEQ ID NO: 63695 - DNA, 22 bp, Homo sapiens
gaggcaggaggattgcttgagc

SEQ ID NO: 63696 - DNA, 22 bp, Homo sapiens
cattctgcgatcctcaagcaca

SEQ ID NO: 63697 - DNA, 23 bp, Homo sapiens
aatgggtgcaactatccatgaca

SEQ ID NO: 63698 - DNA, 22 bp, Homo sapiens
ccttctagcaaatcaacataaa

SEQ ID NO: 63699 - DNA, 19 bp, Homo sapiens
gggcaaagtgatcgtcctg

SEQ ID NO: 63700 - DNA, 22 bp, Homo sapiens
gagacacaggcacagaagaggc

SEQ ID NO: 63701 - DNA, 22 bp, Homo sapiens
catggcattgcataacggggct

SEQ ID NO: 63702 - DNA, 22 bp, Homo sapiens
agagggtgggcacgtgatggat

SEQ ID NO: 63703 - DNA, 22 bp, Homo sapiens
cacctagggtttcgcctttctt

SEQ ID NO: 63704 - DNA, 22 bp, Homo sapiens
tggtacacatgtccaaggtcag

SEQ ID NO: 63705 - DNA, 22 bp, Homo sapiens
ttgttgtcattgtagaggattt

SEQ ID NO: 63706 - DNA, 22 bp, Homo sapiens
ctcctgagctctgaggaagctt

SEQ ID NO: 63707 - DNA, 22 bp, Homo sapiens
tttgtcttatccaatctctcag

SEQ ID NO: 63708 - DNA, 19 bp, Homo sapiens
tctcacagctctactatgt

SEQ ID NO: 63709 - DNA, 22 bp, Homo sapiens
gaatttcctctaaacccctgag

SEQ ID NO: 63710 - DNA, 22 bp, Homo sapiens
cggtctcccgtgtgtgtgcgct

SEQ ID NO: 63711 - DNA, 22 bp, Homo sapiens
aggagaagccaagttgtgagca

SEQ ID NO: 63712 - DNA, 18 bp, Homo sapiens
tgagaggctattttttgc

SEQ ID NO: 63713 - DNA, 22 bp, Homo sapiens
cccaggctggagtgcagtggcg

SEQ ID NO: 63714 - DNA, 22 bp, Homo sapiens
ggtgtagctctgtgtcccactg

SEQ ID NO: 63715 - DNA, 22 bp, Homo sapiens
cacagctgaagtagccatgtgg

SEQ ID NO: 63716 - DNA, 22 bp, Homo sapiens
gaggagggagctggaagctctt

SEQ ID NO: 63717 - DNA, 22 bp, Homo sapiens
aatgtgagccaatgcccgtggg

SEQ ID NO: 63718 - DNA, 22 bp, Homo sapiens
ggctggtgttgagtgcctgtag

SEQ ID NO: 63719 - DNA, 22 bp, Homo sapiens
tgccaggcgtggtggtgcgcac

SEQ ID NO: 63720 - DNA, 22 bp, Homo sapiens
cgtggggcgggtggacacttgc

SEQ ID NO: 63721 - DNA, 22 bp, Homo sapiens
cagagctggtgtgtcctggcat

SEQ ID NO: 63722 - DNA, 22 bp, Homo sapiens
ctcgcatgccctgcctcatcca

SEQ ID NO: 63723 - DNA, 22 bp, Homo sapiens
cctgcacatgtgtgcgcctgta

SEQ ID NO: 63724 - DNA, 22 bp, Homo sapiens
agggaagaaaatccatcgctgc

SEQ ID NO: 63725 - DNA, 22 bp, Homo sapiens
gggttcagtccctcttgctact

SEQ ID NO: 63726 - DNA, 22 bp, Homo sapiens
cctgcacagccggacccctgct

SEQ ID NO: 63727 - DNA, 22 bp, Homo sapiens
tcttgcacttcatgaatatgtt

SEQ ID NO: 63728 - DNA, 22 bp, Homo sapiens
ctggcaagaaatatatatctta

SEQ ID NO: 63729 - DNA, 22 bp, Homo sapiens
gcaggctgtctaaagttagagt

SEQ ID NO: 63730 - DNA, 22 bp, Homo sapiens
gctggtagacctcactgcactc

SEQ ID NO: 63731 - DNA, 22 bp, Homo sapiens
tgacctattagatttccttgcc

SEQ ID NO: 63732 - DNA, 22 bp, Homo sapiens
ccaggaggcggaggttgcagtg

SEQ ID NO: 63733 - DNA, 23 bp, Homo sapiens
ttggcaaagcctatgaagtcctc

SEQ ID NO: 63734 - DNA, 22 bp, Homo sapiens
atatatttgagaatattcatga

SEQ ID NO: 63735 - DNA, 22 bp, Homo sapiens
gcagcctcaaactccccagctc

SEQ ID NO: 63736 - DNA, 22 bp, Homo sapiens
tgggcagggagctggaaccaca

SEQ ID NO: 63737 - DNA, 22 bp, Homo sapiens
ggaggcggaggttgcagtgagc

SEQ ID NO: 63738 - DNA, 22 bp, Homo sapiens
agtggcctggagccccgcctgg

SEQ ID NO: 63739 - DNA, 22 bp, Homo sapiens
tttctggcagcgggacaggggt

SEQ ID NO: 63740 - DNA, 22 bp, Homo sapiens
aacactgctgctgggttctgtg

SEQ ID NO: 63741 - DNA, 22 bp, Homo sapiens
tacaaaaaattgatactgacga

SEQ ID NO: 63742 - DNA, 22 bp, Homo sapiens
ctcctggaggatagtgactggg

SEQ ID NO: 63743 - DNA, 22 bp, Homo sapiens
ttattagagtgctttgagaaag

SEQ ID NO: 63744 - DNA, 22 bp, Homo sapiens
aaccaggtgactcatggtgagc

SEQ ID NO: 63745 - DNA, 21 bp, Homo sapiens
atgtagggtttgccttctcta

SEQ ID NO: 63746 - DNA, 22 bp, Homo sapiens
gtggccaacctggccctgaact

SEQ ID NO: 63747 - DNA, 22 bp, Homo sapiens
tggagccagagcgcagcctggg

SEQ ID NO: 63748 - DNA, 22 bp, Homo sapiens
gggaggaggaatgttttgtgta

SEQ ID NO: 63749 - DNA, 22 bp, Homo sapiens
tctcctggagcccagatgctgg

SEQ ID NO: 63750 - DNA, 22 bp, Homo sapiens
cttcatgctgatatcctcgatg

SEQ ID NO: 63751 - DNA, 22 bp, Homo sapiens
tgaatgtgatgctaaacatatg

SEQ ID NO: 63752 - DNA, 22 bp, Homo sapiens
ctgaaatgacggtttggggcaa

SEQ ID NO: 63753 - DNA, 22 bp, Homo sapiens
cagcctttgggtcagaagattc

SEQ ID NO: 63754 - DNA, 22 bp, Homo sapiens
tactaggaagcagctgcattgg

SEQ ID NO: 63755 - DNA, 22 bp, Homo sapiens
ttactggctgggcctgagggct

SEQ ID NO: 63756 - DNA, 22 bp, Homo sapiens
tctgagccagggtctcctccct

SEQ ID NO: 63757 - DNA, 22 bp, Homo sapiens
cattccttaacgtggggagtct

SEQ ID NO: 63758 - DNA, 22 bp, Homo sapiens
ctggccaagatggtgaaacccc

SEQ ID NO: 63759 - DNA, 22 bp, Homo sapiens
cttctcggggttcccgcgccct

SEQ ID NO: 63760 - DNA, 22 bp, Homo sapiens
agcttgtagaaggccacgagca

SEQ ID NO: 63761 - DNA, 22 bp, Homo sapiens
ttgaaaagttttgaaacactct

SEQ ID NO: 63762 - DNA, 22 bp, Homo sapiens
ttattaggaactcaggattttt

SEQ ID NO: 63763 - DNA, 22 bp, Homo sapiens
cactctgcagctgaagggctgg

SEQ ID NO: 63764 - DNA, 22 bp, Homo sapiens
aggtcacccgtttgactatcca

SEQ ID NO: 63765 - DNA, 22 bp, Homo sapiens
tttctggcagcgggacaggggt

SEQ ID NO: 63766 - DNA, 21 bp, Homo sapiens
gtggttctagagaaacagaat

SEQ ID NO: 63767 - DNA, 22 bp, Homo sapiens
aggatttctgtgcctggaaaat

SEQ ID NO: 63768 - DNA, 22 bp, Homo sapiens
ttgagggtctggatctgctgct

SEQ ID NO: 63769 - DNA, 22 bp, Homo sapiens
cgcatgagacctgccggccatc

SEQ ID NO: 63770 - DNA, 22 bp, Homo sapiens
aataaaatggtcagttttctca

SEQ ID NO: 63771 - DNA, 22 bp, Homo sapiens
cattaggacgccccgcccatac

SEQ ID NO: 63772 - DNA, 22 bp, Homo sapiens
actgcaaagggaagccctttct

SEQ ID NO: 63773 - DNA, 22 bp, Homo sapiens
atgttggccaggctggtcttga

SEQ ID NO: 63774 - DNA, 22 bp, Homo sapiens
gtcatcttgctgttttagatct

SEQ ID NO: 63775 - DNA, 22 bp, Homo sapiens
ttttaatactgctattgtagga

SEQ ID NO: 63776 - DNA, 22 bp, Homo sapiens
gatataggttcatagtgttaca

SEQ ID NO: 63777 - DNA, 22 bp, Homo sapiens
tatgcacaacatgcaggtttgt

SEQ ID NO: 63778 - DNA, 21 bp, Homo sapiens
gctcctggtgctgcgtggcgc

SEQ ID NO: 63779 - DNA, 22 bp, Homo sapiens
ggatgcacgaaggcgcctcgga

SEQ ID NO: 63780 - DNA, 22 bp, Homo sapiens
tttgaaatgtatcagtataggt

SEQ ID NO: 63781 - DNA, 22 bp, Homo sapiens
caccttgtgatcctcttgcctt

SEQ ID NO: 63782 - DNA, 22 bp, Homo sapiens
aagtttgtgtagtttagcatcc

SEQ ID NO: 63783 - DNA, 22 bp, Homo sapiens
gtctctatcatagctgaaccct

SEQ ID NO: 63784 - DNA, 18 bp, Homo sapiens
accttcattcctttgcct

SEQ ID NO: 63785 - DNA, 22 bp, Homo sapiens
agaggaagtaatcaggacctgc

SEQ ID NO: 63786 - DNA, 22 bp, Homo sapiens
cccatggcttaggagggagtgt

SEQ ID NO: 63787 - DNA, 22 bp, Homo sapiens
gctggccacagatccccaggga

SEQ ID NO: 63788 - DNA, 22 bp, Homo sapiens
tccttgactgtgaggaactagc

SEQ ID NO: 63789 - DNA, 22 bp, Homo sapiens
gttgaaatcctaaccccctagt

SEQ ID NO: 63790 - DNA, 22 bp, Homo sapiens
agctcctgaaaatccagactgg

SEQ ID NO: 63791 - DNA, 22 bp, Homo sapiens
tgcctgttgcccacctgataaa

SEQ ID NO: 63792 - DNA, 22 bp, Homo sapiens
tttatgtagttacggactatca

SEQ ID NO: 63793 - DNA, 22 bp, Homo sapiens
ttttatctgtgacatctggcag

SEQ ID NO: 63794 - DNA, 22 bp, Homo sapiens
aaagattaaatcaaattggtca

SEQ ID NO: 63795 - DNA, 19 bp, Homo sapiens
cattaggattagagacaag

SEQ ID NO: 63796 - DNA, 22 bp, Homo sapiens
tagaatgtaaattccaagggca

SEQ ID NO: 63797 - DNA, 20 bp, Homo sapiens
aaaatatgtataactcttct

SEQ ID NO: 63798 - DNA, 22 bp, Homo sapiens
agttgcagacgcagagatgttg

SEQ ID NO: 63799 - DNA, 22 bp, Homo sapiens
agtcatgtgttcatctttcatt

SEQ ID NO: 63800 - DNA, 22 bp, Homo sapiens
cttcttatcaagtggcaaatct

SEQ ID NO: 63801 - DNA, 22 bp, Homo sapiens
atattgaaccctacagactgta

SEQ ID NO: 63802 - DNA, 22 bp, Homo sapiens
actctggccatcttggaccttg

SEQ ID NO: 63803 - DNA, 22 bp, Homo sapiens
gtggccaaatcatgtcaaaggc

SEQ ID NO: 63804 - DNA, 22 bp, Homo sapiens
gttaggatatggtgaaatggag

SEQ ID NO: 63805 - DNA, 22 bp, Homo sapiens
tctcctggtacccttcctagca

SEQ ID NO: 63806 - DNA, 22 bp, Homo sapiens
ttaataaagtatgaattggaaa

SEQ ID NO: 63807 - DNA, 22 bp, Homo sapiens
gcaccgccttggaccgcccgct

SEQ ID NO: 63808 - DNA, 22 bp, Homo sapiens
aaattagtcatgttgtattact

SEQ ID NO: 63809 - DNA, 22 bp, Homo sapiens
atgattgaaaatgacattgcca

SEQ ID NO: 63810 - DNA, 22 bp, Homo sapiens
aatactgcctgtgaggtaactc

SEQ ID NO: 63811 - DNA, 22 bp, Homo sapiens
aactcactttgtggcttctgaa

SEQ ID NO: 63812 - DNA, 17 bp, Homo sapiens
ttaaggtggatcagcac

SEQ ID NO: 63813 - DNA, 20 bp, Homo sapiens
caaatccctgctctgtgctg

SEQ ID NO: 63814 - DNA, 18 bp, Homo sapiens
atggtctcatactgggag

SEQ ID NO: 63815 - DNA, 22 bp, Homo sapiens
caacccaaggttagttggtctt

SEQ ID NO: 63816 - DNA, 22 bp, Homo sapiens
ttcaccttgaatatgtcttaaa

SEQ ID NO: 63817 - DNA, 22 bp, Homo sapiens
ctgctaaacctctctgagagct

SEQ ID NO: 63818 - DNA, 22 bp, Homo sapiens
ttgcttcagagggagacacttt

SEQ ID NO: 63819 - DNA, 22 bp, Homo sapiens
ggtcagccttggatttggtagc

SEQ ID NO: 63820 - DNA, 22 bp, Homo sapiens
aaaaagtattggccatggttga

SEQ ID NO: 63821 - DNA, 22 bp, Homo sapiens
gttccagtatgattccacccat

SEQ ID NO: 63822 - DNA, 22 bp, Homo sapiens
gggaagatagtgttgagggccc

SEQ ID NO: 63823 - DNA, 22 bp, Homo sapiens
actggccagccaacaacaatag

SEQ ID NO: 63824 - DNA, 22 bp, Homo sapiens
cactctgcgctgggcgccagcg

SEQ ID NO: 63825 - DNA, 22 bp, Homo sapiens
caataagtgcttttgtttagca

SEQ ID NO: 63826 - DNA, 22 bp, Homo sapiens
aagtcattggtagcttgatagg

SEQ ID NO: 63827 - DNA, 22 bp, Homo sapiens
agcataagttggtacagccact

SEQ ID NO: 63828 - DNA, 22 bp, Homo sapiens
actctgctctgtatttcactgt

SEQ ID NO: 63829 - DNA, 22 bp, Homo sapiens
gctcaagccttctgcccacctc

SEQ ID NO: 63830 - DNA, 22 bp, Homo sapiens
cggccaagccggggccccgaag

SEQ ID NO: 63831 - DNA, 22 bp, Homo sapiens
acaactccttcttgggtcctgg

SEQ ID NO: 63832 - DNA, 22 bp, Homo sapiens
agcatgcgcttgatcagctcca

SEQ ID NO: 63833 - DNA, 22 bp, Homo sapiens
aatgccttggagagcctagagg

SEQ ID NO: 63834 - DNA, 22 bp, Homo sapiens
catataaatacaacatgtgtta

SEQ ID NO: 63835 - DNA, 20 bp, Homo sapiens
cattggacttggcttcatgg

SEQ ID NO: 63836 - DNA, 22 bp, Homo sapiens
tgaaatgtgtaatgtggatgcc

SEQ ID NO: 63837 - DNA, 22 bp, Homo sapiens
ctgagggtcaacttgattgtat

SEQ ID NO: 63838 - DNA, 22 bp, Homo sapiens
gcaaaaagtagtgctggttagg

SEQ ID NO: 63839 - DNA, 22 bp, Homo sapiens
cttgatctacatagtgaaaccc

SEQ ID NO: 63840 - DNA, 22 bp, Homo sapiens
attcatcaactgatagccatag

SEQ ID NO: 63841 - DNA, 22 bp, Homo sapiens
tatttaataaaactatggcatg

SEQ ID NO: 63842 - DNA, 22 bp, Homo sapiens
gagcactgatttatttttgtct

SEQ ID NO: 63843 - DNA, 22 bp, Homo sapiens
tcatctaagagtcttacattta

SEQ ID NO: 63844 - DNA, 22 bp, Homo sapiens
tcaaaaagttgaagagttgggg

SEQ ID NO: 63845 - DNA, 22 bp, Homo sapiens
tctgacattttgagaatgacat

SEQ ID NO: 63846 - DNA, 22 bp, Homo sapiens
gtacactccccctgtgaagttg

SEQ ID NO: 63847 - DNA, 22 bp, Homo sapiens
cgcaccactgaattccagcctg

SEQ ID NO: 63848 - DNA, 22 bp, Homo sapiens
gttatataagacaaatcagagt

SEQ ID NO: 63849 - DNA, 22 bp, Homo sapiens
atgaaatatcttgaagaaattc

SEQ ID NO: 63850 - DNA, 22 bp, Homo sapiens
aggtcaccatggcatgctccac

SEQ ID NO: 63851 - DNA, 22 bp, Homo sapiens
gaagccttgaactgcaaacccc

SEQ ID NO: 63852 - DNA, 22 bp, Homo sapiens
cgagcatgatgacggctgtggc

SEQ ID NO: 63853 - DNA, 22 bp, Homo sapiens
cttatagtatgatgttgagaat

SEQ ID NO: 63854 - DNA, 21 bp, Homo sapiens
tgtaagtttcatctgaattgg

SEQ ID NO: 63855 - DNA, 22 bp, Homo sapiens
gagccaggggtcagctccgagg

SEQ ID NO: 63856 - DNA, 22 bp, Homo sapiens
atgcccaatgtcacaatttttg

SEQ ID NO: 63857 - DNA, 22 bp, Homo sapiens
aggctgagataggtggatcatt

SEQ ID NO: 63858 - DNA, 22 bp, Homo sapiens
agctgattccactttttcccca

SEQ ID NO: 63859 - DNA, 22 bp, Homo sapiens
gggccatgagaggttcatcaac

SEQ ID NO: 63860 - DNA, 22 bp, Homo sapiens
ggagtagctgcattccgagcac

SEQ ID NO: 63861 - DNA, 22 bp, Homo sapiens
gctgtcttgctcactcttgcag

SEQ ID NO: 63862 - DNA, 22 bp, Homo sapiens
ggatgacagatgcaggctttga

SEQ ID NO: 63863 - DNA, 22 bp, Homo sapiens
caaagctggaaaaggaggctgg

SEQ ID NO: 63864 - DNA, 22 bp, Homo sapiens
tcctgggacaagccgtggaagt

SEQ ID NO: 63865 - DNA, 22 bp, Homo sapiens
gaggtgtcatcaggcagctctg

SEQ ID NO: 63866 - DNA, 22 bp, Homo sapiens
gggtgctttggctcacgcctgt

SEQ ID NO: 63867 - DNA, 22 bp, Homo sapiens
ttataagactgtagtgagtatt

SEQ ID NO: 63868 - DNA, 22 bp, Homo sapiens
gccaggctgaggctctggaaga

SEQ ID NO: 63869 - DNA, 22 bp, Homo sapiens
cttgcctttgtcttcaaaggct

SEQ ID NO: 63870 - DNA, 22 bp, Homo sapiens
aaagtgctcggattacaggtat

SEQ ID NO: 63871 - DNA, 23 bp, Homo sapiens
aaataggagtatctggatcatga

SEQ ID NO: 63872 - DNA, 22 bp, Homo sapiens
tccctagtcgcatctgtggaga

SEQ ID NO: 63873 - DNA, 22 bp, Homo sapiens
agggaaatctcagctctaaaat

SEQ ID NO: 63874 - DNA, 22 bp, Homo sapiens
ggtgaggggctcctctgcccgg

SEQ ID NO: 63875 - DNA, 22 bp, Homo sapiens
ggcagcactgcagcttgttggg

SEQ ID NO: 63876 - DNA, 22 bp, Homo sapiens
cccaggggttcaaggctgcagt

SEQ ID NO: 63877 - DNA, 22 bp, Homo sapiens
gcagggaggtttgctgacctgg

SEQ ID NO: 63878 - DNA, 22 bp, Homo sapiens
gagagagctctgtgcctgggat

SEQ ID NO: 63879 - DNA, 22 bp, Homo sapiens
tgtcacagtttgtactttatag

SEQ ID NO: 63880 - DNA, 22 bp, Homo sapiens
aagcatttcaggtagagatatt

SEQ ID NO: 63881 - DNA, 22 bp, Homo sapiens
agggtggcactggtggctctat

SEQ ID NO: 63882 - DNA, 22 bp, Homo sapiens
cactgcactccagcttgggtga

SEQ ID NO: 63883 - DNA, 23 bp, Homo sapiens
tgagctgggcctgcaggggtctc

SEQ ID NO: 63884 - DNA, 16 bp, Homo sapiens
aggctcagaggctgga

SEQ ID NO: 63885 - DNA, 22 bp, Homo sapiens
agctacctgatccttcttctga

SEQ ID NO: 63886 - DNA, 22 bp, Homo sapiens
acggcaggctcagagctggaat

SEQ ID NO: 63887 - DNA, 22 bp, Homo sapiens
taattataacagttacatctta

SEQ ID NO: 63888 - DNA, 22 bp, Homo sapiens
agaggaggctctgggatcgtcc

SEQ ID NO: 63889 - DNA, 22 bp, Homo sapiens
agtgactggtgtgaagttaaat

SEQ ID NO: 63890 - DNA, 22 bp, Homo sapiens
ggaactgaggaacgaactggga

SEQ ID NO: 63891 - DNA, 22 bp, Homo sapiens
acctagaatttaaaacattgct

SEQ ID NO: 63892 - DNA, 22 bp, Homo sapiens
ccagaggagttgaggctttggg

SEQ ID NO: 63893 - DNA, 19 bp, Homo sapiens
ccctcttgcacaaagcaaa

SEQ ID NO: 63894 - DNA, 22 bp, Homo sapiens
gacctcatgatccacctgcctt

SEQ ID NO: 63895 - DNA, 22 bp, Homo sapiens
gttattgaggtggagtctcact

SEQ ID NO: 63896 - DNA, 22 bp, Homo sapiens
tagccgggtgtggtggaactcc

SEQ ID NO: 63897 - DNA, 19 bp, Homo sapiens
ggagtttccaatgggtaaa

SEQ ID NO: 63898 - DNA, 22 bp, Homo sapiens
cttcctttgctgttcggaggtt

SEQ ID NO: 63899 - DNA, 22 bp, Homo sapiens
gcaggtggatcacctgaggtca

SEQ ID NO: 63900 - DNA, 22 bp, Homo sapiens
tgtgcctgttcccactttgcct

SEQ ID NO: 63901 - DNA, 18 bp, Homo sapiens
agtgtcagctgcagctca

SEQ ID NO: 63902 - DNA, 22 bp, Homo sapiens
gaatatcccgctatgcaaagta

SEQ ID NO: 63903 - DNA, 22 bp, Homo sapiens
gcaggcagatcacctgtcagga

SEQ ID NO: 63904 - DNA, 22 bp, Homo sapiens
gccgggaccaaggccacggagc

SEQ ID NO: 63905 - DNA, 22 bp, Homo sapiens
tgggcagggagctggaaccaca

SEQ ID NO: 63906 - DNA, 22 bp, Homo sapiens
ttacatgtggtgtgaagaagag

SEQ ID NO: 63907 - DNA, 22 bp, Homo sapiens
aaattagtgcaccaggttgaag

SEQ ID NO: 63908 - DNA, 22 bp, Homo sapiens
tttgattgcaatagttttatga

SEQ ID NO: 63909 - DNA, 22 bp, Homo sapiens
ccaggaggcggaaggtacagtg

SEQ ID NO: 63910 - DNA, 22 bp, Homo sapiens
atacttctttagcatattgaac

SEQ ID NO: 63911 - DNA, 22 bp, Homo sapiens
tgcaatctcggcactttgggag

SEQ ID NO: 63912 - DNA, 22 bp, Homo sapiens
acacagagccaaaccatatcac

SEQ ID NO: 63913 - DNA, 20 bp, Homo sapiens
tgatatggtttggctgtgtt

SEQ ID NO: 63914 - DNA, 22 bp, Homo sapiens
atgaaatgctattttggctaga

SEQ ID NO: 63915 - DNA, 23 bp, Homo sapiens
tatgaactgcattgctggtgtgt

SEQ ID NO: 63916 - DNA, 22 bp, Homo sapiens
actttaaaactgatcatcagag

SEQ ID NO: 63917 - DNA, 22 bp, Homo sapiens
cactgcactccagcctcggtga

SEQ ID NO: 63918 - DNA, 22 bp, Homo sapiens
gctccctggtagccatgctctc

SEQ ID NO: 63919 - DNA, 22 bp, Homo sapiens
gagggagggactagcattctct

SEQ ID NO: 63920 - DNA, 22 bp, Homo sapiens
aagatattcaaagatttattag

SEQ ID NO: 63921 - DNA, 22 bp, Homo sapiens
ggccgccctttccacggtttct

SEQ ID NO: 63922 - DNA, 22 bp, Homo sapiens
cagctggttgaagaggagctgg

SEQ ID NO: 63923 - DNA, 22 bp, Homo sapiens
gcagagctcatgcctgcacctc

SEQ ID NO: 63924 - DNA, 18 bp, Homo sapiens
tcttccaacactgacacc

SEQ ID NO: 63925 - DNA, 22 bp, Homo sapiens
agtgaggggcagctgagtgggc

SEQ ID NO: 63926 - DNA, 22 bp, Homo sapiens
tgtccagctcgagacactatct

SEQ ID NO: 63927 - DNA, 22 bp, Homo sapiens
gccgtccacctcgatggccact

SEQ ID NO: 63928 - DNA, 22 bp, Homo sapiens
cctggaggcggaggttgcagtg

SEQ ID NO: 63929 - DNA, 22 bp, Homo sapiens
ctgaaggatgtgtggtgggagt

SEQ ID NO: 63930 - DNA, 19 bp, Homo sapiens
ttccatctatcttcttact

SEQ ID NO: 63931 - DNA, 23 bp, Homo sapiens
cagagctggctcagagctgcctg

SEQ ID NO: 63932 - DNA, 22 bp, Homo sapiens
gaggtggctgcttgctgggaaa

SEQ ID NO: 63933 - DNA, 22 bp, Homo sapiens
ggctttgacatgctgaattaaa

SEQ ID NO: 63934 - DNA, 22 bp, Homo sapiens
gtgggttcgtggtctcgctggc

SEQ ID NO: 63935 - DNA, 22 bp, Homo sapiens
tgattcatcagaataggagttt

SEQ ID NO: 63936 - DNA, 22 bp, Homo sapiens
ccaggaggcggaggttgcagcg

SEQ ID NO: 63937 - DNA, 22 bp, Homo sapiens
gctggctgacagatttggggtg

SEQ ID NO: 63938 - DNA, 22 bp, Homo sapiens
ttctgggcacacaggccctggt

SEQ ID NO: 63939 - DNA, 22 bp, Homo sapiens
tacttttcctggaaccactgct

SEQ ID NO: 63940 - DNA, 22 bp, Homo sapiens
ctcccagccttcgccagtctga

SEQ ID NO: 63941 - DNA, 22 bp, Homo sapiens
caggctggagtgcagtggtgcc

SEQ ID NO: 63942 - DNA, 22 bp, Homo sapiens
gcacggctaatttttgtatttt

SEQ ID NO: 63943 - DNA, 22 bp, Homo sapiens
agcatttatcttttgtttgagt

SEQ ID NO: 63944 - DNA, 22 bp, Homo sapiens
gctgctttggaaagcatggaaa

SEQ ID NO: 63945 - DNA, 22 bp, Homo sapiens
tacaggcatgtagcatggtgat

SEQ ID NO: 63946 - DNA, 22 bp, Homo sapiens
ctggagagaatgtggaatgatt

SEQ ID NO: 63947 - DNA, 22 bp, Homo sapiens
ttgtgctcctgtgagaatctag

SEQ ID NO: 63948 - DNA, 22 bp, Homo sapiens
gaggggctgccctggtgtcagg

SEQ ID NO: 63949 - DNA, 22 bp, Homo sapiens
tggaatggaaacaaactgagga

SEQ ID NO: 63950 - DNA, 22 bp, Homo sapiens
tgagcttgcagtgccagccttg

SEQ ID NO: 63951 - DNA, 22 bp, Homo sapiens
gagcctcgtggcggccactgcg

SEQ ID NO: 63952 - DNA, 22 bp, Homo sapiens
ctggctgggagcgagctgctca

SEQ ID NO: 63953 - DNA, 22 bp, Homo sapiens
taggctaggctgaaggttttgg

SEQ ID NO: 63954 - DNA, 22 bp, Homo sapiens
tcctgagataaatctcatgtga

SEQ ID NO: 63955 - DNA, 22 bp, Homo sapiens
ctgtggctctttagttgagcac

SEQ ID NO: 63956 - DNA, 22 bp, Homo sapiens
catgagataatttttctccagt

SEQ ID NO: 63957 - DNA, 22 bp, Homo sapiens
tgaagactcagaagctaagata

SEQ ID NO: 63958 - DNA, 22 bp, Homo sapiens
ggccagaagttggaaaagagcc

SEQ ID NO: 63959 - DNA, 22 bp, Homo sapiens
gtgaaatatttaacgtccaggt

SEQ ID NO: 63960 - DNA, 22 bp, Homo sapiens
ggtcagaggtcccagaagaagc

SEQ ID NO: 63961 - DNA, 22 bp, Homo sapiens
acacccaggctggcgtgcagtg

SEQ ID NO: 63962 - DNA, 22 bp, Homo sapiens
gtagtcccagctaccccggagg

SEQ ID NO: 63963 - DNA, 22 bp, Homo sapiens
tgactacaacctccacctcccg

SEQ ID NO: 63964 - DNA, 22 bp, Homo sapiens
tcactgcacttcagcttgggca

SEQ ID NO: 63965 - DNA, 21 bp, Homo sapiens
tctctttctggaagcttccct

SEQ ID NO: 63966 - DNA, 19 bp, Homo sapiens
atgtacccagtgtcaatcc

SEQ ID NO: 63967 - DNA, 21 bp, Homo sapiens
aggtgctggcgccccaggaga

SEQ ID NO: 63968 - DNA, 22 bp, Homo sapiens
tgatctcctgaccttgtaatcc

SEQ ID NO: 63969 - DNA, 22 bp, Homo sapiens
ggcagagcttgcagtgagccga

SEQ ID NO: 63970 - DNA, 22 bp, Homo sapiens
cataaaaggtagcagtttgaaa

SEQ ID NO: 63971 - DNA, 22 bp, Homo sapiens
ctgcactgagcatctaacctta

SEQ ID NO: 63972 - DNA, 22 bp, Homo sapiens
cactccagcctcagtgacagag

SEQ ID NO: 63973 - DNA, 22 bp, Homo sapiens
ttcatagtgtttccttccagtg

SEQ ID NO: 63974 - DNA, 22 bp, Homo sapiens
caggtggtcaggcaaggacacg

SEQ ID NO: 63975 - DNA, 22 bp, Homo sapiens
gaagagtggttatccctgctgt

SEQ ID NO: 63976 - DNA, 21 bp, Homo sapiens
aggcttggatctagacaggcc

SEQ ID NO: 63977 - DNA, 22 bp, Homo sapiens
cagcacatgctcatcagggaag

SEQ ID NO: 63978 - DNA, 22 bp, Homo sapiens
aggtaaagacagtgaaagaggg

SEQ ID NO: 63979 - DNA, 22 bp, Homo sapiens
taggctgggaagaaagattctc

SEQ ID NO: 63980 - DNA, 22 bp, Homo sapiens
tataaactcctcttgcattcct

SEQ ID NO: 63981 - DNA, 22 bp, Homo sapiens
gagcactgagctggaattggag

SEQ ID NO: 63982 - DNA, 22 bp, Homo sapiens
cgtgccactgcactccagtctg

SEQ ID NO: 63983 - DNA, 22 bp, Homo sapiens
ccaggctggagtgcaatggcgt

SEQ ID NO: 63984 - DNA, 22 bp, Homo sapiens
ggagttcacgatgttggccagg

SEQ ID NO: 63985 - DNA, 22 bp, Homo sapiens
cctctgtgtgatgcgcaaagta

SEQ ID NO: 63986 - DNA, 20 bp, Homo sapiens
cttctggctggtcaaggact

SEQ ID NO: 63987 - DNA, 19 bp, Homo sapiens
gttctttcatagtaagagc

SEQ ID NO: 63988 - DNA, 22 bp, Homo sapiens
taacaatacccattctaattac

SEQ ID NO: 63989 - DNA, 22 bp, Homo sapiens
aaggctgagacagcacaggtcc

SEQ ID NO: 63990 - DNA, 22 bp, Homo sapiens
aggacagagggaccagagccca

SEQ ID NO: 63991 - DNA, 22 bp, Homo sapiens
tgaggaaacttacaaggcagaa

SEQ ID NO: 63992 - DNA, 22 bp, Homo sapiens
acccaggctggagtgcagtggc

SEQ ID NO: 63993 - DNA, 22 bp, Homo sapiens
agaggaagtaatcaggacctgc

SEQ ID NO: 63994 - DNA, 22 bp, Homo sapiens
ttctcatgaaactcgcttcctc

SEQ ID NO: 63995 - DNA, 22 bp, Homo sapiens
actacagtgtgataagaggggc

SEQ ID NO: 63996 - DNA, 22 bp, Homo sapiens
ggatgttgattgaatggccatt

SEQ ID NO: 63997 - DNA, 22 bp, Homo sapiens
ggcaatatggtgaaaccccatc

SEQ ID NO: 63998 - DNA, 18 bp, Homo sapiens
ggtgagggagctggaagc

SEQ ID NO: 63999 - DNA, 22 bp, Homo sapiens
tgagcccagagatctgagctat

SEQ ID NO: 64000 - DNA, 22 bp, Homo sapiens
tatgaagtgatgttgaattttg

SEQ ID NO: 64001 - DNA, 22 bp, Homo sapiens
atagcagggatgtcagcaagta

SEQ ID NO: 64002 - DNA, 17 bp, Homo sapiens
ctggagcagacaaaagg

SEQ ID NO: 64003 - DNA, 22 bp, Homo sapiens
ggcttcagtggccagagatgat

SEQ ID NO: 64004 - DNA, 22 bp, Homo sapiens
aggtggggaggagtgtctcttt

SEQ ID NO: 64005 - DNA, 21 bp, Homo sapiens
taaacataaccttgtatggct

SEQ ID NO: 64006 - DNA, 22 bp, Homo sapiens
atgtgtcaggtacactcattag

SEQ ID NO: 64007 - DNA, 20 bp, Homo sapiens
ccagagctgatggctgcccg

SEQ ID NO: 64008 - DNA, 22 bp, Homo sapiens
ggagtgaagtggcgcgatctcg

SEQ ID NO: 64009 - DNA, 21 bp, Homo sapiens
ggcaagaaacacaatcaagta

SEQ ID NO: 64010 - DNA, 22 bp, Homo sapiens
tgatgaccgccaacgtttaggt

SEQ ID NO: 64011 - DNA, 22 bp, Homo sapiens
agcaggaaggggatgatgggca

SEQ ID NO: 64012 - DNA, 22 bp, Homo sapiens
ggcctctcttgggacagctgtc

SEQ ID NO: 64013 - DNA, 22 bp, Homo sapiens
tgtagatattaattattccttt

SEQ ID NO: 64014 - DNA, 22 bp, Homo sapiens
cggaagagggacagcgccagcc

SEQ ID NO: 64015 - DNA, 22 bp, Homo sapiens
gggaggttgaggctgcagtgag

SEQ ID NO: 64016 - DNA, 22 bp, Homo sapiens
gcctggccgggtcttggatttt

SEQ ID NO: 64017 - DNA, 22 bp, Homo sapiens
ctacattaaattggcttactta

SEQ ID NO: 64018 - DNA, 22 bp, Homo sapiens
agcaggagtttgatgcttttat

SEQ ID NO: 64019 - DNA, 22 bp, Homo sapiens
agaggacagagtgctggattta

SEQ ID NO: 64020 - DNA, 22 bp, Homo sapiens
aaatcccatcggagaggaggat

SEQ ID NO: 64021 - DNA, 22 bp, Homo sapiens
ggtagtcggccttgccctgggc

SEQ ID NO: 64022 - DNA, 22 bp, Homo sapiens
agcataagttggtacagccact

SEQ ID NO: 64023 - DNA, 22 bp, Homo sapiens
tcctgggatcaagtgatcctcc

SEQ ID NO: 64024 - DNA, 22 bp, Homo sapiens
ctgggaggtggaggttgcattg

SEQ ID NO: 64025 - DNA, 22 bp, Homo sapiens
acaggatcgccctgttgcccag

SEQ ID NO: 64026 - DNA, 22 bp, Homo sapiens
ggcctcttatctggctcctgca

SEQ ID NO: 64027 - DNA, 22 bp, Homo sapiens
tttggaaattttcatccagaca

SEQ ID NO: 64028 - DNA, 22 bp, Homo sapiens
cagctggtgtcaggcactgcag

SEQ ID NO: 64029 - DNA, 22 bp, Homo sapiens
ctgaggaaggctgggggcatcc

SEQ ID NO: 64030 - DNA, 22 bp, Homo sapiens
taggctgggggtaggaattgag

SEQ ID NO: 64031 - DNA, 22 bp, Homo sapiens
agaggccgggtgcctgctcaga

SEQ ID NO: 64032 - DNA, 22 bp, Homo sapiens
gcctcctggggtgccatcatct

SEQ ID NO: 64033 - DNA, 20 bp, Homo sapiens
gctgaggtggaggaaggaga

SEQ ID NO: 64034 - DNA, 22 bp, Homo sapiens
gacaggaggcagagctcaggtg

SEQ ID NO: 64035 - DNA, 22 bp, Homo sapiens
gaggtgctgctgtacttcttgc

SEQ ID NO: 64036 - DNA, 22 bp, Homo sapiens
tacaaaggaggtgcatagaaca

SEQ ID NO: 64037 - DNA, 22 bp, Homo sapiens
aaaaaattatcatagttcctga

SEQ ID NO: 64038 - DNA, 22 bp, Homo sapiens
gatagtcacctcccttaacttt

SEQ ID NO: 64039 - DNA, 19 bp, Homo sapiens
acacagggatcagagggtt

SEQ ID NO: 64040 - DNA, 23 bp, Homo sapiens
tctacaaagctgtgtcaggaccc

SEQ ID NO: 64041 - DNA, 22 bp, Homo sapiens
ctcggcaggtggaggttgtagt

SEQ ID NO: 64042 - DNA, 22 bp, Homo sapiens
ctggtgtggactccgcgcggag

SEQ ID NO: 64043 - DNA, 22 bp, Homo sapiens
aggtcaccatggcatgctccac

SEQ ID NO: 64044 - DNA, 22 bp, Homo sapiens
gggcctgtgtgttcaggagcct

SEQ ID NO: 64045 - DNA, 22 bp, Homo sapiens
ctgctgggatagaagtatctca

SEQ ID NO: 64046 - DNA, 22 bp, Homo sapiens
ttctgcagtgttaacaatgtca

SEQ ID NO: 64047 - DNA, 22 bp, Homo sapiens
tgtgggtggcatcgtcctggcc

SEQ ID NO: 64048 - DNA, 21 bp, Homo sapiens
tcgtgcagcagctgaggcttg

SEQ ID NO: 64049 - DNA, 22 bp, Homo sapiens
aaagtgctggtattacaggtgt

SEQ ID NO: 64050 - DNA, 22 bp, Homo sapiens
gaagctgagctgaggcatgttg

SEQ ID NO: 64051 - DNA, 22 bp, Homo sapiens
tgtgacaagcattgtatattgg

SEQ ID NO: 64052 - DNA, 22 bp, Homo sapiens
ataaaatttgctactgttaaat

SEQ ID NO: 64053 - DNA, 22 bp, Homo sapiens
ataatacatggttgatcttttc

SEQ ID NO: 64054 - DNA, 22 bp, Homo sapiens
gaggcagaggttgcagtgagct

SEQ ID NO: 64055 - DNA, 22 bp, Homo sapiens
actgccaatggtagtttgatgg

SEQ ID NO: 64056 - DNA, 22 bp, Homo sapiens
agatggagtctcactcttgttg

SEQ ID NO: 64057 - DNA, 22 bp, Homo sapiens
atacagttatagtcagggctaa

SEQ ID NO: 64058 - DNA, 22 bp, Homo sapiens
catataaatacaacatgtgtta

SEQ ID NO: 64059 - DNA, 22 bp, Homo sapiens
atgggtgcagcatggtgggaac

SEQ ID NO: 64060 - DNA, 19 bp, Homo sapiens
ttcacattggaagaagtag

SEQ ID NO: 64061 - DNA, 22 bp, Homo sapiens
gcagggtctgaggccacagagg

SEQ ID NO: 64062 - DNA, 22 bp, Homo sapiens
gttgctcaggcaggagtacagt

SEQ ID NO: 64063 - DNA, 22 bp, Homo sapiens
cgttaataggtgcaaggtaagg

SEQ ID NO: 64064 - DNA, 22 bp, Homo sapiens
agttgcagacgcagagatgttg

SEQ ID NO: 64065 - DNA, 22 bp, Homo sapiens
accatgttggccaagctggtct

SEQ ID NO: 64066 - DNA, 22 bp, Homo sapiens
actggggtttaggcctgggcaa

SEQ ID NO: 64067 - DNA, 22 bp, Homo sapiens
tctgccttctatcttttgtctg

SEQ ID NO: 64068 - DNA, 22 bp, Homo sapiens
gtccacttctgcctttctggat

SEQ ID NO: 64069 - DNA, 22 bp, Homo sapiens
aatggaatacctaggtggccca

SEQ ID NO: 64070 - DNA, 22 bp, Homo sapiens
atattacacacggtatcacggg

SEQ ID NO: 64071 - DNA, 22 bp, Homo sapiens
cctaggagttcgaagctgcagt

SEQ ID NO: 64072 - DNA, 22 bp, Homo sapiens
tgggaggccgaggcaggtggat

SEQ ID NO: 64073 - DNA, 22 bp, Homo sapiens
acaactccttcttgggtcctgg

SEQ ID NO: 64074 - DNA, 22 bp, Homo sapiens
aactctatttaccctactaaac

SEQ ID NO: 64075 - DNA, 22 bp, Homo sapiens
acaccatactcatgttggttcc

SEQ ID NO: 64076 - DNA, 22 bp, Homo sapiens
cagtggcctctggctttgctgt

SEQ ID NO: 64077 - DNA, 22 bp, Homo sapiens
gaggctgaggcggatggatcac

SEQ ID NO: 64078 - DNA, 22 bp, Homo sapiens
gcccaggaggcagaggttgtgg

SEQ ID NO: 64079 - DNA, 22 bp, Homo sapiens
ccccatgaagtagggtctctga

SEQ ID NO: 64080 - DNA, 22 bp, Homo sapiens
gcaggagaacaaagcaagctgc

SEQ ID NO: 64081 - DNA, 22 bp, Homo sapiens
ctcactgcaagctctgcctcca

SEQ ID NO: 64082 - DNA, 22 bp, Homo sapiens
ccagaccctccattcaagctcc

SEQ ID NO: 64083 - DNA, 22 bp, Homo sapiens
gcccgcagagatctttaacaaa

SEQ ID NO: 64084 - DNA, 22 bp, Homo sapiens
actgcaacacctcctgggttca

SEQ ID NO: 64085 - DNA, 22 bp, Homo sapiens
ctgcagggagaggggacagcct

SEQ ID NO: 64086 - DNA, 17 bp, Homo sapiens
tctgagaatgctggagg

SEQ ID NO: 64087 - DNA, 22 bp, Homo sapiens
tttttccacataccctaggcca

SEQ ID NO: 64088 - DNA, 22 bp, Homo sapiens
gaccatcctggccaacgtggta

SEQ ID NO: 64089 - DNA, 22 bp, Homo sapiens
acgcccagactcccatactttg

SEQ ID NO: 64090 - DNA, 22 bp, Homo sapiens
acatgagatttgggtggtgata

SEQ ID NO: 64091 - DNA, 22 bp, Homo sapiens
ctgtggctcaggcctgtaagcc

SEQ ID NO: 64092 - DNA, 22 bp, Homo sapiens
atgaccagccgagataaacaga

SEQ ID NO: 64093 - DNA, 18 bp, Homo sapiens
ccctgccagctcccagca

SEQ ID NO: 64094 - DNA, 22 bp, Homo sapiens
agggatggagtgcggcccggac

SEQ ID NO: 64095 - DNA, 22 bp, Homo sapiens
gtatggcactatcctctctgat

SEQ ID NO: 64096 - DNA, 18 bp, Homo sapiens
gaaagatgaacttttttc

SEQ ID NO: 64097 - DNA, 21 bp, Homo sapiens
acataggcgaatgttcgggag

SEQ ID NO: 64098 - DNA, 22 bp, Homo sapiens
ttcattttctttcacgctgctg

SEQ ID NO: 64099 - DNA, 22 bp, Homo sapiens
ggctctgcgcctgcggggactt

SEQ ID NO: 64100 - DNA, 20 bp, Homo sapiens
caaatccctgctctgtgctg

SEQ ID NO: 64101 - DNA, 22 bp, Homo sapiens
agccggccatgtggtcttgtgc

SEQ ID NO: 64102 - DNA, 22 bp, Homo sapiens
ggtgcagaggagccagctgggg

SEQ ID NO: 64103 - DNA, 22 bp, Homo sapiens
cgagcatgatgacggctgtggc

SEQ ID NO: 64104 - DNA, 22 bp, Homo sapiens
tctggctctggagtccacctgc

SEQ ID NO: 64105 - DNA, 22 bp, Homo sapiens
atgccactgcgctctagcctgg

SEQ ID NO: 64106 - DNA, 22 bp, Homo sapiens
ctgagatctttatacgaggcac

SEQ ID NO: 64107 - DNA, 22 bp, Homo sapiens
gaactttgcgcagttcccgggg

SEQ ID NO: 64108 - DNA, 22 bp, Homo sapiens
gtttggggagttcctttaggcc

SEQ ID NO: 64109 - DNA, 23 bp, Homo sapiens
ggcctcagtgatgatgggttaaa

SEQ ID NO: 64110 - DNA, 22 bp, Homo sapiens
gtgagtaaaggttcattgaatt

SEQ ID NO: 64111 - DNA, 22 bp, Homo sapiens
aaagtgctgggattccaggcgt

SEQ ID NO: 64112 - DNA, 22 bp, Homo sapiens
gggactggagtagaggccggtg

SEQ ID NO: 64113 - DNA, 22 bp, Homo sapiens
tctgcaggtaagcgttcttgga

SEQ ID NO: 64114 - DNA, 22 bp, Homo sapiens
ataaaagatcccttctgagctc

SEQ ID NO: 64115 - DNA, 22 bp, Homo sapiens
gacttttgaataaggtaggata

SEQ ID NO: 64116 - DNA, 22 bp, Homo sapiens
gggagctgaaggagccggcggg

SEQ ID NO: 64117 - DNA, 22 bp, Homo sapiens
ttccgctgtttagttgaagttt

SEQ ID NO: 64118 - DNA, 22 bp, Homo sapiens
cccagctcttcaagtcaccccc

SEQ ID NO: 64119 - DNA, 22 bp, Homo sapiens
gggtacagttcttccagtgtca

SEQ ID NO: 64120 - DNA, 22 bp, Homo sapiens
taggcaagtggaccagaggttt

SEQ ID NO: 64121 - DNA, 22 bp, Homo sapiens
caggagtgtctccacacagcaa

SEQ ID NO: 64122 - DNA, 22 bp, Homo sapiens
tggcactgagcagccgcggcag

SEQ ID NO: 64123 - DNA, 22 bp, Homo sapiens
tattgagaccagtgcttgctta

SEQ ID NO: 64124 - DNA, 22 bp, Homo sapiens
aagaggtttaactgactcacag

SEQ ID NO: 64125 - DNA, 22 bp, Homo sapiens
cccgggttgtccgcgcgtccgg

SEQ ID NO: 64126 - DNA, 22 bp, Homo sapiens
tccagcccaggctggagtgtag

SEQ ID NO: 64127 - DNA, 22 bp, Homo sapiens
atatccagcagcaggtgagtat

SEQ ID NO: 64128 - DNA, 22 bp, Homo sapiens
gaaaattattgaaaatggctct

SEQ ID NO: 64129 - DNA, 22 bp, Homo sapiens
cgagagttagctaggagtcaca

SEQ ID NO: 64130 - DNA, 22 bp, Homo sapiens
ttgaggtccccagtacccactg

SEQ ID NO: 64131 - DNA, 22 bp, Homo sapiens
ggagaagaggagctggaagcct

SEQ ID NO: 64132 - DNA, 22 bp, Homo sapiens
cactgcaacctccacctcctgg

SEQ ID NO: 64133 - DNA, 22 bp, Homo sapiens
cttcagctgcagttatgtttag

SEQ ID NO: 64134 - DNA, 22 bp, Homo sapiens
agcagctttcacctccccgcct

SEQ ID NO: 64135 - DNA, 22 bp, Homo sapiens
ggaggactcaggtctggccatg

SEQ ID NO: 64136 - DNA, 22 bp, Homo sapiens
gagtgcagtggcgtgatctctg

SEQ ID NO: 64137 - DNA, 22 bp, Homo sapiens
gacctccgtgtacacctcccag

SEQ ID NO: 64138 - DNA, 22 bp, Homo sapiens
acagtctgtcccccaggtgcta

SEQ ID NO: 64139 - DNA, 22 bp, Homo sapiens
tttgaagactactgggagtgaa

SEQ ID NO: 64140 - DNA, 22 bp, Homo sapiens
aagatacagacagagccaaaat

SEQ ID NO: 64141 - DNA, 22 bp, Homo sapiens
atacataattacttccgatgtt

SEQ ID NO: 64142 - DNA, 22 bp, Homo sapiens
tctcgtgcaggccttgctcgga

SEQ ID NO: 64143 - DNA, 22 bp, Homo sapiens
ggtgccaggctgtagtcagggt

SEQ ID NO: 64144 - DNA, 22 bp, Homo sapiens
ttaccacagtgcctgtctaatg

SEQ ID NO: 64145 - DNA, 21 bp, Homo sapiens
gttcaaatcctgacactacac

SEQ ID NO: 64146 - DNA, 22 bp, Homo sapiens
aagctgcagcacagagaggtgg

SEQ ID NO: 64147 - DNA, 22 bp, Homo sapiens
tgttcttgagcctttagaccta

SEQ ID NO: 64148 - DNA, 22 bp, Homo sapiens
atcttgttaaaaagcagattct

SEQ ID NO: 64149 - DNA, 22 bp, Homo sapiens
gccatcatatcccctgtgacct

SEQ ID NO: 64150 - DNA, 22 bp, Homo sapiens
gattgagtctgaggatgctgca

SEQ ID NO: 64151 - DNA, 22 bp, Homo sapiens
ttttccttcatatcccttatgt

SEQ ID NO: 64152 - DNA, 22 bp, Homo sapiens
gcgagaaactaagtgccctttg

SEQ ID NO: 64153 - DNA, 22 bp, Homo sapiens
ttcattcttttacatgtgaata

SEQ ID NO: 64154 - DNA, 22 bp, Homo sapiens
ttccagctaactcacatccctt

SEQ ID NO: 64155 - DNA, 22 bp, Homo sapiens
atgtacataaaatgtataatga

SEQ ID NO: 64156 - DNA, 22 bp, Homo sapiens
cttgtgcatttcattcctcagg

SEQ ID NO: 64157 - DNA, 22 bp, Homo sapiens
tcactgcaacctctgcctcccg

SEQ ID NO: 64158 - DNA, 22 bp, Homo sapiens
ggagcagggaattacagcgcag

SEQ ID NO: 64159 - DNA, 22 bp, Homo sapiens
ttcaatatgatattagctgtgg

SEQ ID NO: 64160 - DNA, 22 bp, Homo sapiens
aggctctgtcaggcggagcagc

SEQ ID NO: 64161 - DNA, 22 bp, Homo sapiens
atgtttttggaaatgggaacat

SEQ ID NO: 64162 - DNA, 22 bp, Homo sapiens
agcccttagtacatttctcaag

SEQ ID NO: 64163 - DNA, 22 bp, Homo sapiens
tgtgtcagaaggcaatggggat

SEQ ID NO: 64164 - DNA, 22 bp, Homo sapiens
caggtggcagtgcctgcattct

SEQ ID NO: 64165 - DNA, 22 bp, Homo sapiens
ctgcgggctgtcaggcgtgcca

SEQ ID NO: 64166 - DNA, 22 bp, Homo sapiens
ggtcagccttggatttggtagc

SEQ ID NO: 64167 - DNA, 22 bp, Homo sapiens
cagggtttcaccatgttagcag

SEQ ID NO: 64168 - DNA, 22 bp, Homo sapiens
agtgctgggctatctactgcta

SEQ ID NO: 64169 - DNA, 22 bp, Homo sapiens
gtgggctgcccttgaggtcagc

SEQ ID NO: 64170 - DNA, 22 bp, Homo sapiens
aagtgctgggattacaggtgtc

SEQ ID NO: 64171 - DNA, 22 bp, Homo sapiens
agagggtgggcacgtgatggat

SEQ ID NO: 64172 - DNA, 22 bp, Homo sapiens
tgttcagaacaaaggtaaatga

SEQ ID NO: 64173 - DNA, 20 bp, Homo sapiens
ctgggtggcaagcaaggggg

SEQ ID NO: 64174 - DNA, 22 bp, Homo sapiens
ctgaccaacatggtgaaacctt

SEQ ID NO: 64175 - DNA, 22 bp, Homo sapiens
gctggtgagcaaaggagaagga

SEQ ID NO: 64176 - DNA, 22 bp, Homo sapiens
cagaagactgcagggaagggac

SEQ ID NO: 64177 - DNA, 22 bp, Homo sapiens
tggcaagaaccgcaattacttt

SEQ ID NO: 64178 - DNA, 22 bp, Homo sapiens
cactgcccaccaagtggctggt

SEQ ID NO: 64179 - DNA, 22 bp, Homo sapiens
tggctaacaaggtgaaaccccg

SEQ ID NO: 64180 - DNA, 22 bp, Homo sapiens
tcagtgcagggtgggagagaga

SEQ ID NO: 64181 - DNA, 22 bp, Homo sapiens
gtctttatttgagattgtcatt

SEQ ID NO: 64182 - DNA, 19 bp, Homo sapiens
caggcctcttaccctctct

SEQ ID NO: 64183 - DNA, 22 bp, Homo sapiens
cccgactagctgggattacagg

SEQ ID NO: 64184 - DNA, 22 bp, Homo sapiens
catggcactgagcaggtatgca

SEQ ID NO: 64185 - DNA, 22 bp, Homo sapiens
ctatggtctggaccgaggtcct

SEQ ID NO: 64186 - DNA, 22 bp, Homo sapiens
ggctgggctccgggagcatgcg

SEQ ID NO: 64187 - DNA, 22 bp, Homo sapiens
gctggagaggatcccaaagcca

SEQ ID NO: 64188 - DNA, 23 bp, Homo sapiens
attttttgtctttgtaactagat

SEQ ID NO: 64189 - DNA, 23 bp, Homo sapiens
atgacactcctgtgcgcaccctg

SEQ ID NO: 64190 - DNA, 22 bp, Homo sapiens
tccctgaggatggttgtattta

SEQ ID NO: 64191 - DNA, 22 bp, Homo sapiens
ttctaattaaatctacgctagg

SEQ ID NO: 64192 - DNA, 22 bp, Homo sapiens
tggcagtggcgggactcagggc

SEQ ID NO: 64193 - DNA, 22 bp, Homo sapiens
gggcagagagctggaactcctt

SEQ ID NO: 64194 - DNA, 22 bp, Homo sapiens
gcaggcaggcttccttgaactg

SEQ ID NO: 64195 - DNA, 22 bp, Homo sapiens
gtggagagagataagcctggtc

SEQ ID NO: 64196 - DNA, 22 bp, Homo sapiens
tgtgtggattcatctcaaagag

SEQ ID NO: 64197 - DNA, 22 bp, Homo sapiens
acccaggctggcgtgcagtggc

SEQ ID NO: 64198 - DNA, 20 bp, Homo sapiens
catgtgtcagttctcaccca

SEQ ID NO: 64199 - DNA, 22 bp, Homo sapiens
ttggaaacgtcaccttttcctt

SEQ ID NO: 64200 - DNA, 18 bp, Homo sapiens
gaggatggaaggagatgc

SEQ ID NO: 64201 - DNA, 22 bp, Homo sapiens
gcaaaagtacagccggatttct

SEQ ID NO: 64202 - DNA, 22 bp, Homo sapiens
tgagatgtaaggtatgcttact

SEQ ID NO: 64203 - DNA, 22 bp, Homo sapiens
cttctgagatgttgttttacag

SEQ ID NO: 64204 - DNA, 21 bp, Homo sapiens
acctgagctccacctcctgcc

SEQ ID NO: 64205 - DNA, 22 bp, Homo sapiens
ttccaactttgtcatatattat

SEQ ID NO: 64206 - DNA, 19 bp, Homo sapiens
gcagacaggtccagagagg

SEQ ID NO: 64207 - DNA, 22 bp, Homo sapiens
tggtgctgccaggctcctgcca

SEQ ID NO: 64208 - DNA, 22 bp, Homo sapiens
tgttgcccaggttctctcctgc

SEQ ID NO: 64209 - DNA, 22 bp, Homo sapiens
ctgagatggagtttcgctcttc

SEQ ID NO: 64210 - DNA, 22 bp, Homo sapiens
cgtcacttcttagtctattttc

SEQ ID NO: 64211 - DNA, 22 bp, Homo sapiens
tcgctgaggctgcacggctgcc

SEQ ID NO: 64212 - DNA, 22 bp, Homo sapiens
tgtagctctccagccagcaagg

SEQ ID NO: 64213 - DNA, 22 bp, Homo sapiens
cacatgaaggctggggtcgtga

SEQ ID NO: 64214 - DNA, 22 bp, Homo sapiens
tcacattttcaaaagctggtgc

SEQ ID NO: 64215 - DNA, 22 bp, Homo sapiens
cactgcaagctctgccacctgg

SEQ ID NO: 64216 - DNA, 22 bp, Homo sapiens
gctggaggatggactggaagaa

SEQ ID NO: 64217 - DNA, 22 bp, Homo sapiens
acccaggccattggcaagagtc

SEQ ID NO: 64218 - DNA, 22 bp, Homo sapiens
tttgcattgcattaagtattct

SEQ ID NO: 64219 - DNA, 18 bp, Homo sapiens
cccggctaatttttggta

SEQ ID NO: 64220 - DNA, 22 bp, Homo sapiens
atagagtgatgtaaggtatgtg

SEQ ID NO: 64221 - DNA, 22 bp, Homo sapiens
ttatatgtttctgtttggaggc

SEQ ID NO: 64222 - DNA, 22 bp, Homo sapiens
tggtaaggttccagatctagaa

SEQ ID NO: 64223 - DNA, 22 bp, Homo sapiens
gtacacaaagtgagacttgata

SEQ ID NO: 64224 - DNA, 22 bp, Homo sapiens
agctcctgaaaatccagactgg

SEQ ID NO: 64225 - DNA, 22 bp, Homo sapiens
acatttatataactcactagga

SEQ ID NO: 64226 - DNA, 23 bp, Homo sapiens
ccagtgattgcctggaaggaggt

SEQ ID NO: 64227 - DNA, 22 bp, Homo sapiens
ctgctccccagcctgcgccttt

SEQ ID NO: 64228 - DNA, 22 bp, Homo sapiens
agtggaccagaagactgaagct

SEQ ID NO: 64229 - DNA, 22 bp, Homo sapiens
tgagagcaacacgcagtagtat

SEQ ID NO: 64230 - DNA, 22 bp, Homo sapiens
aggatcagggtggtggaagtca

SEQ ID NO: 64231 - DNA, 23 bp, Homo sapiens
cctgcctccccatcagttataca

SEQ ID NO: 64232 - DNA, 22 bp, Homo sapiens
cctgggctctgtcagaattggg

SEQ ID NO: 64233 - DNA, 22 bp, Homo sapiens
ttaataaagtatgaattggaaa

SEQ ID NO: 64234 - DNA, 22 bp, Homo sapiens
aggccacggcgggtggattact

SEQ ID NO: 64235 - DNA, 20 bp, Homo sapiens
gaaatgtacacattaccaca

SEQ ID NO: 64236 - DNA, 22 bp, Homo sapiens
ctccaggccatggctgcggagg

SEQ ID NO: 64237 - DNA, 22 bp, Homo sapiens
ccaggcagcctgctccattctg

SEQ ID NO: 64238 - DNA, 22 bp, Homo sapiens
tggctcactgtagccttgacct

SEQ ID NO: 64239 - DNA, 22 bp, Homo sapiens
gggaagagggagctggaatgat

SEQ ID NO: 64240 - DNA, 18 bp, Homo sapiens
tgagaggctattttttgc

SEQ ID NO: 64241 - DNA, 22 bp, Homo sapiens
agccaggatggtctcgatcggc

SEQ ID NO: 64242 - DNA, 22 bp, Homo sapiens
ttccagagagttattcccctgg

SEQ ID NO: 64243 - DNA, 22 bp, Homo sapiens
gcaccgccttggaccgcccgct

SEQ ID NO: 64244 - DNA, 22 bp, Homo sapiens
gagctactgaaatattgatttt

SEQ ID NO: 64245 - DNA, 21 bp, Homo sapiens
gctgctcgagatccagtgctt

SEQ ID NO: 64246 - DNA, 22 bp, Homo sapiens
gtgctggggagataggaagaga

SEQ ID NO: 64247 - DNA, 22 bp, Homo sapiens
tcactgcaagctctgccttccg

SEQ ID NO: 64248 - DNA, 22 bp, Homo sapiens
ctgggaggcagaggttgcagtg

SEQ ID NO: 64249 - DNA, 22 bp, Homo sapiens
agtgaaaacctaatcatgcagt

SEQ ID NO: 64250 - DNA, 22 bp, Homo sapiens
gttgcagatgtggaactcgtgc

SEQ ID NO: 64251 - DNA, 22 bp, Homo sapiens
gagcaggaaggccagaagggtc

SEQ ID NO: 64252 - DNA, 22 bp, Homo sapiens
tgaaatgattatatggtgtttg

SEQ ID NO: 64253 - DNA, 22 bp, Homo sapiens
aaacaacctaaagttactgatc

SEQ ID NO: 64254 - DNA, 22 bp, Homo sapiens
atggccctaatgagttggtgtt

SEQ ID NO: 64255 - DNA, 22 bp, Homo sapiens
ttgcttcttagatattcctctc

SEQ ID NO: 64256 - DNA, 22 bp, Homo sapiens
tacataggtacagcctttttta

SEQ ID NO: 64257 - DNA, 22 bp, Homo sapiens
gcaggcagaggtggaggagaca

SEQ ID NO: 64258 - DNA, 22 bp, Homo sapiens
ggcgggaagttcttgcccactt

SEQ ID NO: 64259 - DNA, 22 bp, Homo sapiens
ggggcccctcggacacgtgcgg

SEQ ID NO: 64260 - DNA, 22 bp, Homo sapiens
tgagatgtcatagttcagttca

SEQ ID NO: 64261 - DNA, 22 bp, Homo sapiens
ggaaggcagaggtgtcgtgggg

SEQ ID NO: 64262 - DNA, 22 bp, Homo sapiens
tttccctttagcctgagaatcc

SEQ ID NO: 64263 - DNA, 22 bp, Homo sapiens
ccaaagtgctaggattacaggt

SEQ ID NO: 64264 - DNA, 22 bp, Homo sapiens
ccgggcctcgggacaccgggta

SEQ ID NO: 64265 - DNA, 22 bp, Homo sapiens
ctggggtcagggatcagagagc

SEQ ID NO: 64266 - DNA, 22 bp, Homo sapiens
ggcgagaagttgttagtggctt

SEQ ID NO: 64267 - DNA, 19 bp, Homo sapiens
gctggatggatcctggagt

SEQ ID NO: 64268 - DNA, 22 bp, Homo sapiens
tctgccttttactagctggatg

SEQ ID NO: 64269 - DNA, 19 bp, Homo sapiens
tcctgcctggggccgcctg

SEQ ID NO: 64270 - DNA, 22 bp, Homo sapiens
gttccaggtggtcacagagctc

SEQ ID NO: 64271 - DNA, 22 bp, Homo sapiens
aaagtgctgggattacaagcgt

SEQ ID NO: 64272 - DNA, 22 bp, Homo sapiens
tttaatcaggcaaagcataata

SEQ ID NO: 64273 - DNA, 22 bp, Homo sapiens
gagtggggggtccgtctcagtg

SEQ ID NO: 64274 - DNA, 22 bp, Homo sapiens
tgggaagaggagcactggaatg

SEQ ID NO: 64275 - DNA, 22 bp, Homo sapiens
ctgggaggcagaggttgtagtg

SEQ ID NO: 64276 - DNA, 22 bp, Homo sapiens
tgaacgcaggtccacatggctc

SEQ ID NO: 64277 - DNA, 22 bp, Homo sapiens
ttcctgggattattgtcaagca

SEQ ID NO: 64278 - DNA, 22 bp, Homo sapiens
ggcaagagggcagatggagtgc

SEQ ID NO: 64279 - DNA, 22 bp, Homo sapiens
acctggaggcagaggttgcagt

SEQ ID NO: 64280 - DNA, 21 bp, Homo sapiens
tcacgtggtcacatgagcttt

SEQ ID NO: 64281 - DNA, 22 bp, Homo sapiens
taagaaatttagttatagaatg

SEQ ID NO: 64282 - DNA, 22 bp, Homo sapiens
aaagtaattgcagtttctgcca

SEQ ID NO: 64283 - DNA, 22 bp, Homo sapiens
aatgttacgatcaacaacacat

SEQ ID NO: 64284 - DNA, 22 bp, Homo sapiens
aattatggtcactgttcctggg

SEQ ID NO: 64285 - DNA, 22 bp, Homo sapiens
tcactgcaacctctgcctgcca

SEQ ID NO: 64286 - DNA, 22 bp, Homo sapiens
cgtgtacagtctatcttttttc

SEQ ID NO: 64287 - DNA, 22 bp, Homo sapiens
tacaaaaaattgatactgacga

SEQ ID NO: 64288 - DNA, 22 bp, Homo sapiens
ttaaattttagaaacagactct

SEQ ID NO: 64289 - DNA, 22 bp, Homo sapiens
gctgcagctcgccttccggcct

SEQ ID NO: 64290 - DNA, 22 bp, Homo sapiens
catgtctgagtcatggtacttc

SEQ ID NO: 64291 - DNA, 20 bp, Homo sapiens
tgttgattggtgtcatctca

SEQ ID NO: 64292 - DNA, 22 bp, Homo sapiens
agcactgatttaaactggattt

SEQ ID NO: 64293 - DNA, 22 bp, Homo sapiens
agctggggctgtggttgtgatt

SEQ ID NO: 64294 - DNA, 22 bp, Homo sapiens
tggtggggccagacttcagctc

SEQ ID NO: 64295 - DNA, 22 bp, Homo sapiens
gtgcatgtgtctttatagtagc

SEQ ID NO: 64296 - DNA, 22 bp, Homo sapiens
aaaagtcttggggaaggccagg

SEQ ID NO: 64297 - DNA, 22 bp, Homo sapiens
agctcttacatttaggtctatg

SEQ ID NO: 64298 - DNA, 22 bp, Homo sapiens
ggccaggcgatgacccctccac

SEQ ID NO: 64299 - DNA, 22 bp, Homo sapiens
cgcgaggtggaggttgcagtga

SEQ ID NO: 64300 - DNA, 22 bp, Homo sapiens
acagcacttgggttttcctgtt

SEQ ID NO: 64301 - DNA, 22 bp, Homo sapiens
ttaccaaatgaaatagagattt

SEQ ID NO: 64302 - DNA, 22 bp, Homo sapiens
accatgtcatttattggccaaa

SEQ ID NO: 64303 - DNA, 22 bp, Homo sapiens
gaagaaggtggcccaggggtag

SEQ ID NO: 64304 - DNA, 22 bp, Homo sapiens
cactgcaagcaagctccgcctc

SEQ ID NO: 64305 - DNA, 22 bp, Homo sapiens
aataaacaaatccttccttccc

SEQ ID NO: 64306 - DNA, 22 bp, Homo sapiens
tttctttatcatagcatctttg

SEQ ID NO: 64307 - DNA, 22 bp, Homo sapiens
tgtcaccatgcgaggctaattt

SEQ ID NO: 64308 - DNA, 22 bp, Homo sapiens
gctggcagacttcctctggaac

SEQ ID NO: 64309 - DNA, 23 bp, Homo sapiens
ctcaccaagcgccgccgctgtgt

SEQ ID NO: 64310 - DNA, 22 bp, Homo sapiens
ctctggaggtggaggttgcagt

SEQ ID NO: 64311 - DNA, 22 bp, Homo sapiens
cagcctgtagtctggtccaggt

SEQ ID NO: 64312 - DNA, 22 bp, Homo sapiens
tcgttaccatagccttgtccct

SEQ ID NO: 64313 - DNA, 22 bp, Homo sapiens
gcccaggctggagttcagtggt

SEQ ID NO: 64314 - DNA, 22 bp, Homo sapiens
ataaaaactgacccatcctttg

SEQ ID NO: 64315 - DNA, 22 bp, Homo sapiens
aggtaggcctgacgctggggtg

SEQ ID NO: 64316 - DNA, 22 bp, Homo sapiens
ctgggaggcggagcttgcagtg

SEQ ID NO: 64317 - DNA, 22 bp, Homo sapiens
ggcaggaggtgagtggcgggtg

SEQ ID NO: 64318 - DNA, 22 bp, Homo sapiens
catgaaattgtattggcctcaa

SEQ ID NO: 64319 - DNA, 22 bp, Homo sapiens
caaatgaatatttccatgggtt

SEQ ID NO: 64320 - DNA, 22 bp, Homo sapiens
ctttaattgtagctcccataat

SEQ ID NO: 64321 - DNA, 22 bp, Homo sapiens
aagagggctcgatttggcaaaa

SEQ ID NO: 64322 - DNA, 22 bp, Homo sapiens
gtgcaggacagcacatctcctg

SEQ ID NO: 64323 - DNA, 22 bp, Homo sapiens
tctgtcacccagagtgcagtgg

SEQ ID NO: 64324 - DNA, 22 bp, Homo sapiens
accactgcccatggtgaaaact

SEQ ID NO: 64325 - DNA, 22 bp, Homo sapiens
cagcagcagtggctgcagaaca

SEQ ID NO: 64326 - DNA, 22 bp, Homo sapiens
ggcatagatttctttaggttta

SEQ ID NO: 64327 - DNA, 23 bp, Homo sapiens
tgctggagaagcaaagttctgag

SEQ ID NO: 64328 - DNA, 22 bp, Homo sapiens
tgtgtctcaagtcagagcatca

SEQ ID NO: 64329 - DNA, 22 bp, Homo sapiens
gaacactgctgttgggttctga

SEQ ID NO: 64330 - DNA, 22 bp, Homo sapiens
cgggaaggtggaggttgcagtg

SEQ ID NO: 64331 - DNA, 22 bp, Homo sapiens
cctgggtttggagcctgcagaa

SEQ ID NO: 64332 - DNA, 22 bp, Homo sapiens
gcagggcacaaggacgcacagg

SEQ ID NO: 64333 - DNA, 22 bp, Homo sapiens
ttttcagaattagcataccatt

SEQ ID NO: 64334 - DNA, 16 bp, Homo sapiens
gcagaggaaaggggag

SEQ ID NO: 64335 - DNA, 22 bp, Homo sapiens
acatcatttgtctgtagctgaa

SEQ ID NO: 64336 - DNA, 22 bp, Homo sapiens
tcatcagggatattggcctgaa

SEQ ID NO: 64337 - DNA, 22 bp, Homo sapiens
taggttttcctaaaattctggt

SEQ ID NO: 64338 - DNA, 22 bp, Homo sapiens
ccagtgtgcattatcatgtgtc

SEQ ID NO: 64339 - DNA, 22 bp, Homo sapiens
gaaacactcaatttagtaattc

SEQ ID NO: 64340 - DNA, 22 bp, Homo sapiens
tgcctccctggcaagtctctcc

SEQ ID NO: 64341 - DNA, 22 bp, Homo sapiens
ccctgcctacagggttttcttt

SEQ ID NO: 64342 - DNA, 22 bp, Homo sapiens
aagtggcagttcaggaagcaga

SEQ ID NO: 64343 - DNA, 22 bp, Homo sapiens
ctacaaaagtaattgtggtttt

SEQ ID NO: 64344 - DNA, 22 bp, Homo sapiens
ggtcccaggttgacagggagac

SEQ ID NO: 64345 - DNA, 22 bp, Homo sapiens
ggggtgggcgtgcagggacacc

SEQ ID NO: 64346 - DNA, 22 bp, Homo sapiens
tgtagtagcattcacgaagtgt

SEQ ID NO: 64347 - DNA, 22 bp, Homo sapiens
acaattctgatggtttcccagt

SEQ ID NO: 64348 - DNA, 22 bp, Homo sapiens
tacaacaatttccacattagaa

SEQ ID NO: 64349 - DNA, 18 bp, Homo sapiens
cccaggttggcctacaga

SEQ ID NO: 64350 - DNA, 22 bp, Homo sapiens
taccagggaacagggatattaa

SEQ ID NO: 64351 - DNA, 20 bp, Homo sapiens
atggggtgagtgacgccctc

SEQ ID NO: 64352 - DNA, 22 bp, Homo sapiens
cctacggaggacaggttagcca

SEQ ID NO: 64353 - DNA, 22 bp, Homo sapiens
ttgtaagtcacaccagggcagg

SEQ ID NO: 64354 - DNA, 22 bp, Homo sapiens
gaggaggcttccgggaggcacg

SEQ ID NO: 64355 - DNA, 22 bp, Homo sapiens
gctcactgcaacctctgcctcc

SEQ ID NO: 64356 - DNA, 20 bp, Homo sapiens
gggtgtgtgcagggcctggt

SEQ ID NO: 64357 - DNA, 23 bp, Homo sapiens
aggtaggttattgctgctacctg

SEQ ID NO: 64358 - DNA, 22 bp, Homo sapiens
caggcactgtgctgagctctgc

SEQ ID NO: 64359 - DNA, 22 bp, Homo sapiens
atcctccagctcctgcttctgc

SEQ ID NO: 64360 - DNA, 22 bp, Homo sapiens
tagaaaagccccagctggaggg

SEQ ID NO: 64361 - DNA, 22 bp, Homo sapiens
gttgaaatcctaaccccctagt

SEQ ID NO: 64362 - DNA, 20 bp, Homo sapiens
aaattactgccacacatttc

SEQ ID NO: 64363 - DNA, 22 bp, Homo sapiens
tgtttctgtatgatcaatattg

SEQ ID NO: 64364 - DNA, 22 bp, Homo sapiens
gcccaggctggagtgcagtggc

SEQ ID NO: 64365 - DNA, 22 bp, Homo sapiens
gagcccaggcagaggttgcagt

SEQ ID NO: 64366 - DNA, 22 bp, Homo sapiens
tgggaaatctttccgtatttat

SEQ ID NO: 64367 - DNA, 22 bp, Homo sapiens
gcaagacctatctagttgctgt

SEQ ID NO: 64368 - DNA, 22 bp, Homo sapiens
tcttgcacttcatgaatatgtt

SEQ ID NO: 64369 - DNA, 22 bp, Homo sapiens
ccgggcgggggctctcgtcacc

SEQ ID NO: 64370 - DNA, 22 bp, Homo sapiens
cacctgtacagggccgggctgg

SEQ ID NO: 64371 - DNA, 22 bp, Homo sapiens
cctagagctctgctttatctaa

SEQ ID NO: 64372 - DNA, 17 bp, Homo sapiens
aggtgggtggatcacct

SEQ ID NO: 64373 - DNA, 22 bp, Homo sapiens
cactctcacatgccctgtcagt

SEQ ID NO: 64374 - DNA, 22 bp, Homo sapiens
agaacagaggccttatgtttca

SEQ ID NO: 64375 - DNA, 22 bp, Homo sapiens
catgagatttgggaggggccag

SEQ ID NO: 64376 - DNA, 20 bp, Homo sapiens
aaacgagccatcattctggt

SEQ ID NO: 64377 - DNA, 22 bp, Homo sapiens
tgagtgaccagaagtccccctc

SEQ ID NO: 64378 - DNA, 22 bp, Homo sapiens
aggagggagcttaagccaggca

SEQ ID NO: 64379 - DNA, 21 bp, Homo sapiens
gaacccagcagcagtgctctg

SEQ ID NO: 64380 - DNA, 22 bp, Homo sapiens
ctggcagatagtaagtgatcaa

SEQ ID NO: 64381 - DNA, 22 bp, Homo sapiens
ccagctttatagcttcaaagga

SEQ ID NO: 64382 - DNA, 22 bp, Homo sapiens
gtggagggtgattgccggctgt

SEQ ID NO: 64383 - DNA, 22 bp, Homo sapiens
tatccaattcaccattgatggg

SEQ ID NO: 64384 - DNA, 22 bp, Homo sapiens
ggtctcttgtccaaggtcacac

SEQ ID NO: 64385 - DNA, 22 bp, Homo sapiens
ggggtggatttcaggcggtgtc

SEQ ID NO: 64386 - DNA, 22 bp, Homo sapiens
gccatgggcaaatgcagagctg

SEQ ID NO: 64387 - DNA, 22 bp, Homo sapiens
ctgaagagaaagggagctcttc

SEQ ID NO: 64388 - DNA, 22 bp, Homo sapiens
gactttctgatgtaaacattta

SEQ ID NO: 64389 - DNA, 22 bp, Homo sapiens
ggccactgctctccagcctggg

SEQ ID NO: 64390 - DNA, 22 bp, Homo sapiens
tgcactccaggctgggtgacag

SEQ ID NO: 64391 - DNA, 22 bp, Homo sapiens
gatgctgagaggtggagggaac

SEQ ID NO: 64392 - DNA, 22 bp, Homo sapiens
tcaccggcagacgtggcctgat

SEQ ID NO: 64393 - DNA, 22 bp, Homo sapiens
aatctgagggaacttgaactcc

SEQ ID NO: 64394 - DNA, 22 bp, Homo sapiens
aggtggaaatggctttcctagg

SEQ ID NO: 64395 - DNA, 22 bp, Homo sapiens
gcacatgcatgcatattcctgg

SEQ ID NO: 64396 - DNA, 22 bp, Homo sapiens
ttggtttccttaacagcctaaa

SEQ ID NO: 64397 - DNA, 22 bp, Homo sapiens
tgaggcaggagaatcacatgaa

SEQ ID NO: 64398 - DNA, 22 bp, Homo sapiens
ttccacattccttacattcata

SEQ ID NO: 64399 - DNA, 22 bp, Homo sapiens
gattcactcatattttacgttt

SEQ ID NO: 64400 - DNA, 22 bp, Homo sapiens
ctgagggtcaacttgattgtat

SEQ ID NO: 64401 - DNA, 22 bp, Homo sapiens
gctgaggctcctcgggaggaca

SEQ ID NO: 64402 - DNA, 22 bp, Homo sapiens
acaaacagagttgaaaaatagg

SEQ ID NO: 64403 - DNA, 22 bp, Homo sapiens
agaaacgcctgtgaaattatct

SEQ ID NO: 64404 - DNA, 22 bp, Homo sapiens
ctgcagtctacctggattttta

SEQ ID NO: 64405 - DNA, 22 bp, Homo sapiens
agaaaatgtgaacttgtgaatt

SEQ ID NO: 64406 - DNA, 21 bp, Homo sapiens
gggcactgaaagggaatagca

SEQ ID NO: 64407 - DNA, 22 bp, Homo sapiens
taattagtgtccagcttctgct

SEQ ID NO: 64408 - DNA, 22 bp, Homo sapiens
ccaggctgctgttggtgtccgc

SEQ ID NO: 64409 - DNA, 22 bp, Homo sapiens
tgtcagtgtctatgaagaattt

SEQ ID NO: 64410 - DNA, 22 bp, Homo sapiens
cagaggaacgtttggattgatt

SEQ ID NO: 64411 - DNA, 19 bp, Homo sapiens
gctgaggtggaggaaggag

SEQ ID NO: 64412 - DNA, 22 bp, Homo sapiens
ctgctaaacctctctgagagct

SEQ ID NO: 64413 - DNA, 22 bp, Homo sapiens
cttggattcctcatatgcacag

SEQ ID NO: 64414 - DNA, 17 bp, Homo sapiens
tggtccaggtggagcca

SEQ ID NO: 64415 - DNA, 22 bp, Homo sapiens
ggctgagtctgtgacccatgcg

SEQ ID NO: 64416 - DNA, 22 bp, Homo sapiens
tgatattttatgagctttcata

SEQ ID NO: 64417 - DNA, 22 bp, Homo sapiens
aacagtgtttttcttcagcact

SEQ ID NO: 64418 - DNA, 22 bp, Homo sapiens
ctcagactagcctgtaccgaca

SEQ ID NO: 64419 - DNA, 22 bp, Homo sapiens
tagatgtgttgcctggagttgt

SEQ ID NO: 64420 - DNA, 22 bp, Homo sapiens
acttttcttatcagaaaggcca

SEQ ID NO: 64421 - DNA, 22 bp, Homo sapiens
actgttgaagtgccagcttgat

SEQ ID NO: 64422 - DNA, 22 bp, Homo sapiens
catcatcaaaagtgacagagaa

SEQ ID NO: 64423 - DNA, 23 bp, Homo sapiens
aaaacagcttcctccagtggctc

SEQ ID NO: 64424 - DNA, 22 bp, Homo sapiens
ctgtaatcccagctactcggga

SEQ ID NO: 64425 - DNA, 22 bp, Homo sapiens
ctgtggctctcagaggctgctg

SEQ ID NO: 64426 - DNA, 22 bp, Homo sapiens
cctgggaggctgaggctgcagt

SEQ ID NO: 64427 - DNA, 22 bp, Homo sapiens
tttgaagccatgtcaatagttt

SEQ ID NO: 64428 - DNA, 22 bp, Homo sapiens
tgaggcaggtggattacaaggt

SEQ ID NO: 64429 - DNA, 22 bp, Homo sapiens
tggaggctggagtgcagtggcg

SEQ ID NO: 64430 - DNA, 22 bp, Homo sapiens
gggctagcctcttccctgctcc

SEQ ID NO: 64431 - DNA, 22 bp, Homo sapiens
cggccaagccggggccccgaag

SEQ ID NO: 64432 - DNA, 22 bp, Homo sapiens
tcccggcgctgggaggtgggtc

SEQ ID NO: 64433 - DNA, 22 bp, Homo sapiens
tctcctggagcccagatgctgg

SEQ ID NO: 64434 - DNA, 23 bp, Homo sapiens
caccactttctccttctccttgg

SEQ ID NO: 64435 - DNA, 22 bp, Homo sapiens
aaagagccgctgatgtcagccc

SEQ ID NO: 64436 - DNA, 22 bp, Homo sapiens
ctgaaatgacggtttggggcaa

SEQ ID NO: 64437 - DNA, 22 bp, Homo sapiens
cccaggccccagggcttgtcag

SEQ ID NO: 64438 - DNA, 22 bp, Homo sapiens
ctgggttggggttacatgactg

SEQ ID NO: 64439 - DNA, 22 bp, Homo sapiens
agatgctgctccacaggccagg

SEQ ID NO: 64440 - DNA, 22 bp, Homo sapiens
cttggggcagcccaggctgagc

SEQ ID NO: 64441 - DNA, 18 bp, Homo sapiens
cagctgccagctcatgga

SEQ ID NO: 64442 - DNA, 22 bp, Homo sapiens
cagcctggtccccggctcaccc

SEQ ID NO: 64443 - DNA, 22 bp, Homo sapiens
gctgatagactgaatgttggga

SEQ ID NO: 64444 - DNA, 22 bp, Homo sapiens
ttatttttaaaagttcacacag

SEQ ID NO: 64445 - DNA, 22 bp, Homo sapiens
caaggtgccatgctgggcgggg

SEQ ID NO: 64446 - DNA, 23 bp, Homo sapiens
tcctcgcaggagggagatgatgc

SEQ ID NO: 64447 - DNA, 22 bp, Homo sapiens
ttgtgaatagtgccgctataaa

SEQ ID NO: 64448 - DNA, 20 bp, Homo sapiens
gacatgtctttctcacacaa

SEQ ID NO: 64449 - DNA, 22 bp, Homo sapiens
acgtagcactgagagatgcagg

SEQ ID NO: 64450 - DNA, 22 bp, Homo sapiens
cgctgcagaagcgtgttcagga

SEQ ID NO: 64451 - DNA, 22 bp, Homo sapiens
ttgggctgaaccctgcagctga

SEQ ID NO: 64452 - DNA, 22 bp, Homo sapiens
atgtttttaaatagacttacag

SEQ ID NO: 64453 - DNA, 22 bp, Homo sapiens
tgctggaggccagaagtctgag

SEQ ID NO: 64454 - DNA, 22 bp, Homo sapiens
tcctgagccctactctagacga

SEQ ID NO: 64455 - DNA, 22 bp, Homo sapiens
aagacactcattatcactggtt

SEQ ID NO: 64456 - DNA, 22 bp, Homo sapiens
agcgccgcccctgctggtgttg

SEQ ID NO: 64457 - DNA, 19 bp, Homo sapiens
aggctaaagagtcttgcgt

SEQ ID NO: 64458 - DNA, 22 bp, Homo sapiens
cagcccaggactgcaggtgttt

SEQ ID NO: 64459 - DNA, 22 bp, Homo sapiens
tcaggctcaggttaggggccaa

SEQ ID NO: 64460 - DNA, 22 bp, Homo sapiens
gtggttttattcgttcctctgt

SEQ ID NO: 64461 - DNA, 22 bp, Homo sapiens
ttttcctttgattcccagatgt

SEQ ID NO: 64462 - DNA, 22 bp, Homo sapiens
agtccggggtctggacacctgg

SEQ ID NO: 64463 - DNA, 22 bp, Homo sapiens
cctactctgagcgcctccgcat

SEQ ID NO: 64464 - DNA, 22 bp, Homo sapiens
cctggctgacagcttaattcca

SEQ ID NO: 64465 - DNA, 22 bp, Homo sapiens
tcagccccacggggtcagccaa

SEQ ID NO: 64466 - DNA, 22 bp, Homo sapiens
tccaccatgtaacaagctctgt

SEQ ID NO: 64467 - DNA, 22 bp, Homo sapiens
tctttggatggaaattggagtc

SEQ ID NO: 64468 - DNA, 22 bp, Homo sapiens
tgaaatgtgttctagtgttttg

SEQ ID NO: 64469 - DNA, 22 bp, Homo sapiens
tccttagacaaagagtgggctt

SEQ ID NO: 64470 - DNA, 22 bp, Homo sapiens
accaggcccgctgctatggtgg

SEQ ID NO: 64471 - DNA, 22 bp, Homo sapiens
ccgccaggatattgtggctttt

SEQ ID NO: 64472 - DNA, 22 bp, Homo sapiens
gagatggagtctttttctgtca

SEQ ID NO: 64473 - DNA, 22 bp, Homo sapiens
agagtggctctgctgggcacag

SEQ ID NO: 64474 - DNA, 22 bp, Homo sapiens
tgagcctgggtggtcgaggctg

SEQ ID NO: 64475 - DNA, 22 bp, Homo sapiens
cagggcctcctaaggcatctaa

SEQ ID NO: 64476 - DNA, 22 bp, Homo sapiens
acggggctagagaaggtttctt

SEQ ID NO: 64477 - DNA, 22 bp, Homo sapiens
tagagatggggtcttgctatga

SEQ ID NO: 64478 - DNA, 22 bp, Homo sapiens
tgcctactagtactattttgtg

SEQ ID NO: 64479 - DNA, 23 bp, Homo sapiens
gtgcatgtgtctttacagtagca

SEQ ID NO: 64480 - DNA, 22 bp, Homo sapiens
ccaggaggcggaggttgcagtg

SEQ ID NO: 64481 - DNA, 22 bp, Homo sapiens
gatgtagacacttggaggctta

SEQ ID NO: 64482 - DNA, 22 bp, Homo sapiens
tctcctggtacccttcctagca

SEQ ID NO: 64483 - DNA, 22 bp, Homo sapiens
aagagggaaattgttggctgct

SEQ ID NO: 64484 - DNA, 20 bp, Homo sapiens
ttgttagaggaatgccatag

SEQ ID NO: 64485 - DNA, 22 bp, Homo sapiens
tgaccctgagagctgaatggct

SEQ ID NO: 64486 - DNA, 22 bp, Homo sapiens
tcagcctggcaggatggcctgg

SEQ ID NO: 64487 - DNA, 22 bp, Homo sapiens
atgcacacgtaccctacaaggc

SEQ ID NO: 64488 - DNA, 22 bp, Homo sapiens
cggagcctgcttgttgcagctg

SEQ ID NO: 64489 - DNA, 17 bp, Homo sapiens
aggaggccctggcgttt

SEQ ID NO: 64490 - DNA, 22 bp, Homo sapiens
tgctgggggtagctctgcgtag

SEQ ID NO: 64491 - DNA, 22 bp, Homo sapiens
tcagcctccgaaagtgctggga

SEQ ID NO: 64492 - DNA, 22 bp, Homo sapiens
cgtgccactgcactctagcctg

SEQ ID NO: 64493 - DNA, 22 bp, Homo sapiens
ttgtccgtggtgagttcgcatt

SEQ ID NO: 64494 - DNA, 22 bp, Homo sapiens
tgaacatgctgttgatggcctg

SEQ ID NO: 64495 - DNA, 22 bp, Homo sapiens
ggagtgcagtggcgtgatctca

SEQ ID NO: 64496 - DNA, 22 bp, Homo sapiens
gggtccctggaattacttgaca

SEQ ID NO: 64497 - DNA, 21 bp, Homo sapiens
ttaaagcctccctcataagga

SEQ ID NO: 64498 - DNA, 22 bp, Homo sapiens
agcccggcttccccggttgcta

SEQ ID NO: 64499 - DNA, 21 bp, Homo sapiens
gctcctggtgctgcgtggcgc

SEQ ID NO: 64500 - DNA, 22 bp, Homo sapiens
actcatgtcctaggagtaaagc

SEQ ID NO: 64501 - DNA, 22 bp, Homo sapiens
cactgcagcctcgctctcctga

SEQ ID NO: 64502 - DNA, 22 bp, Homo sapiens
cacagcctcctctggctcacgg

SEQ ID NO: 64503 - DNA, 22 bp, Homo sapiens
ggctgagttgagaggattactt

SEQ ID NO: 64504 - DNA, 22 bp, Homo sapiens
tgaggcaggaggattgcaggat

SEQ ID NO: 64505 - DNA, 22 bp, Homo sapiens
gcagcctgggcaacagagtgag

SEQ ID NO: 64506 - DNA, 22 bp, Homo sapiens
cattaaacaaccttgaatcaat

SEQ ID NO: 64507 - DNA, 22 bp, Homo sapiens
aggccaggaatccttgtcccag

SEQ ID NO: 64508 - DNA, 22 bp, Homo sapiens
ctcactgcaagttccacctacc

SEQ ID NO: 64509 - DNA, 22 bp, Homo sapiens
atatattttttgagacagagtc

SEQ ID NO: 64510 - DNA, 22 bp, Homo sapiens
aacactgctgctgggttctgtg

SEQ ID NO: 64511 - DNA, 22 bp, Homo sapiens
catctgtaaagtaggaatattg

SEQ ID NO: 64512 - DNA, 22 bp, Homo sapiens
gcctccagggatgattccttcc

SEQ ID NO: 64513 - DNA, 22 bp, Homo sapiens
agagtgtaccaaatatcctaca

SEQ ID NO: 64514 - DNA, 22 bp, Homo sapiens
gctcactgcaacctccgccttc

SEQ ID NO: 64515 - DNA, 19 bp, Homo sapiens
catctggatgattctcctg

SEQ ID NO: 64516 - DNA, 22 bp, Homo sapiens
aggactgggtgcagagggcatc

SEQ ID NO: 64517 - DNA, 21 bp, Homo sapiens
tggtaggtactggcttcaggc

SEQ ID NO: 64518 - DNA, 22 bp, Homo sapiens
taaatacttagttttgtgtcta

SEQ ID NO: 64519 - DNA, 22 bp, Homo sapiens
tttgttttcaatgtgtcattca

SEQ ID NO: 64520 - DNA, 22 bp, Homo sapiens
tcctccactttgtctagcaaca

SEQ ID NO: 64521 - DNA, 22 bp, Homo sapiens
gcctggagaaaggaaggtggga

SEQ ID NO: 64522 - DNA, 22 bp, Homo sapiens
ccctggaggcggagcttgcagt

SEQ ID NO: 64523 - DNA, 22 bp, Homo sapiens
gtggggtagatctttctcagga

SEQ ID NO: 64524 - DNA, 22 bp, Homo sapiens
gaatttaagaggatgaatctgt

SEQ ID NO: 64525 - DNA, 22 bp, Homo sapiens
ttggatccatctcaggcatagg

SEQ ID NO: 64526 - DNA, 22 bp, Homo sapiens
ggctcactgcaacctctgcctc

SEQ ID NO: 64527 - DNA, 22 bp, Homo sapiens
agatcggctttgcagacctcat

SEQ ID NO: 64528 - DNA, 22 bp, Homo sapiens
ggccaattccaggagccggcgg

SEQ ID NO: 64529 - DNA, 22 bp, Homo sapiens
taacatttaaatttttcacata

SEQ ID NO: 64530 - DNA, 22 bp, Homo sapiens
tgagtagagaattcagctaagg

SEQ ID NO: 64531 - DNA, 22 bp, Homo sapiens
ggtggcagtagcactgggcctg

SEQ ID NO: 64532 - DNA, 18 bp, Homo sapiens
tccatgcacatagccccc

SEQ ID NO: 64533 - DNA, 22 bp, Homo sapiens
ctgtcctgccagtcctggactc

SEQ ID NO: 64534 - DNA, 22 bp, Homo sapiens
atgaaatatcttgaagaaattc

SEQ ID NO: 64535 - DNA, 22 bp, Homo sapiens
tctgacattagattaattggaa

SEQ ID NO: 64536 - DNA, 22 bp, Homo sapiens
tggcacaggatctcagcggcca

SEQ ID NO: 64537 - DNA, 22 bp, Homo sapiens
actaggggctcaggcccaggga

SEQ ID NO: 64538 - DNA, 22 bp, Homo sapiens
tcctgggccctccggatcaggt

SEQ ID NO: 64539 - DNA, 22 bp, Homo sapiens
tctttcttgtgggtgccctttt

SEQ ID NO: 64540 - DNA, 22 bp, Homo sapiens
gggttcagtccctcttgctact

SEQ ID NO: 64541 - DNA, 22 bp, Homo sapiens
aaggtgggtggatcacgaggtc

SEQ ID NO: 64542 - DNA, 22 bp, Homo sapiens
aaattctgatttaataagtgta

SEQ ID NO: 64543 - DNA, 22 bp, Homo sapiens
caggctggagttcagtggtgtg

SEQ ID NO: 64544 - DNA, 22 bp, Homo sapiens
ggctagggatctagaccaggac

SEQ ID NO: 64545 - DNA, 22 bp, Homo sapiens
attaagtgactaaagtaatgct

SEQ ID NO: 64546 - DNA, 22 bp, Homo sapiens
ccccagtggaggtgagggtcct

SEQ ID NO: 64547 - DNA, 22 bp, Homo sapiens
gggcgccgtgggaaacagccgg

SEQ ID NO: 64548 - DNA, 22 bp, Homo sapiens
agaatgggggctacaggccaca

SEQ ID NO: 64549 - DNA, 22 bp, Homo sapiens
tctcgacagcctggcacagtgg

SEQ ID NO: 64550 - DNA, 22 bp, Homo sapiens
agggtcctgggtgcagttgctt

SEQ ID NO: 64551 - DNA, 20 bp, Homo sapiens
gctgaggggtctatggcata

SEQ ID NO: 64552 - DNA, 22 bp, Homo sapiens
agagagcccgggccagggcaca

SEQ ID NO: 64553 - DNA, 22 bp, Homo sapiens
atcaaatacaaagggcataagg

SEQ ID NO: 64554 - DNA, 22 bp, Homo sapiens
gagctctgactgctgggtgaca

SEQ ID NO: 64555 - DNA, 22 bp, Homo sapiens
ggaggcccagaaggaagcccag

SEQ ID NO: 64556 - DNA, 21 bp, Homo sapiens
tttcttaggctctaaaatgac

SEQ ID NO: 64557 - DNA, 22 bp, Homo sapiens
actcttgattgatttagtcttt

SEQ ID NO: 64558 - DNA, 22 bp, Homo sapiens
tgatatgggaaaagggctcgga

SEQ ID NO: 64559 - DNA, 22 bp, Homo sapiens
aaaagcaattgcgggttttgcc

SEQ ID NO: 64560 - DNA, 22 bp, Homo sapiens
tctgttgcaatgtgcatggtga

SEQ ID NO: 64561 - DNA, 22 bp, Homo sapiens
ggccctggtcctaggggtggaa

SEQ ID NO: 64562 - DNA, 22 bp, Homo sapiens
taaaggtagtgtgacatattgt

SEQ ID NO: 64563 - DNA, 22 bp, Homo sapiens
ggaggcggaggttgcagtgagc

SEQ ID NO: 64564 - DNA, 22 bp, Homo sapiens
tgatatgtccctcgacatcagg

SEQ ID NO: 64565 - DNA, 22 bp, Homo sapiens
ttgtcacagcagcaaaggctct

SEQ ID NO: 64566 - DNA, 22 bp, Homo sapiens
tcactgcactccagcactcagg

SEQ ID NO: 64567 - DNA, 22 bp, Homo sapiens
tggttttagggaatcaatctat

SEQ ID NO: 64568 - DNA, 23 bp, Homo sapiens
actctcaggttctttccagcagg

SEQ ID NO: 64569 - DNA, 22 bp, Homo sapiens
aggtcaagggagctgagggcca

SEQ ID NO: 64570 - DNA, 22 bp, Homo sapiens
tccagctgaggtggcctctgtg

SEQ ID NO: 64571 - DNA, 22 bp, Homo sapiens
gccaggaaagggaattccctga

SEQ ID NO: 64572 - DNA, 22 bp, Homo sapiens
gtgtatgttctacttaatatta

SEQ ID NO: 64573 - DNA, 22 bp, Homo sapiens
tatttccttgagacggagtctc

SEQ ID NO: 64574 - DNA, 22 bp, Homo sapiens
agtggcctggagccccgcctgg

SEQ ID NO: 64575 - DNA, 22 bp, Homo sapiens
gcccaggaggagaggctgcagt

SEQ ID NO: 64576 - DNA, 22 bp, Homo sapiens
tttgcttgttcaagatttctgt

SEQ ID NO: 64577 - DNA, 22 bp, Homo sapiens
gtcctggggattatagagtgtt

SEQ ID NO: 64578 - DNA, 22 bp, Homo sapiens
tgcccagggtggagtgcagtgg

SEQ ID NO: 64579 - DNA, 16 bp, Homo sapiens
tggggatggggaagag

SEQ ID NO: 64580 - DNA, 22 bp, Homo sapiens
tagagtgtcataacagtgccca

SEQ ID NO: 64581 - DNA, 22 bp, Homo sapiens
cttagatgaagtcacagaaccc

SEQ ID NO: 64582 - DNA, 22 bp, Homo sapiens
cacggtggcccacaggtgcaag

SEQ ID NO: 64583 - DNA, 22 bp, Homo sapiens
gtggcagagccaaggctggagc

SEQ ID NO: 64584 - DNA, 22 bp, Homo sapiens
attgtgtcctcattgaccttca

SEQ ID NO: 64585 - DNA, 22 bp, Homo sapiens
gggagaggttacccgagcaact

SEQ ID NO: 64586 - DNA, 22 bp, Homo sapiens
tggaagggagctggaatttgga

SEQ ID NO: 64587 - DNA, 22 bp, Homo sapiens
ctgtccccacccaaatctcatc

SEQ ID NO: 64588 - DNA, 22 bp, Homo sapiens
ttgaggtcatctgaagtactag

SEQ ID NO: 64589 - DNA, 22 bp, Homo sapiens
aagtgctgagactacaggcatg

SEQ ID NO: 64590 - DNA, 22 bp, Homo sapiens
gggacatctttctagtcagggt

SEQ ID NO: 64591 - DNA, 22 bp, Homo sapiens
ggttgtagttggaggttgtata

SEQ ID NO: 64592 - DNA, 22 bp, Homo sapiens
gtaggtcagacataagaggaca

SEQ ID NO: 64593 - DNA, 22 bp, Homo sapiens
tatacgtgcaggtcacagggga

SEQ ID NO: 64594 - DNA, 22 bp, Homo sapiens
ggagtgcaatggcgtgatctca

SEQ ID NO: 64595 - DNA, 22 bp, Homo sapiens
gtgtttggtcagacgtccgggg

SEQ ID NO: 64596 - DNA, 22 bp, Homo sapiens
tctcgctctgtcgcccaggctg

SEQ ID NO: 64597 - DNA, 22 bp, Homo sapiens
ggctggtgttgagtgcctgtag

SEQ ID NO: 64598 - DNA, 22 bp, Homo sapiens
aggaggaagggaagacaagtaa

SEQ ID NO: 64599 - DNA, 22 bp, Homo sapiens
tttgtgaataggttggcttcca

SEQ ID NO: 64600 - DNA, 22 bp, Homo sapiens
tggctgagttacgaacagagca

SEQ ID NO: 64601 - DNA, 22 bp, Homo sapiens
cagccctcctaccctgccaggc

SEQ ID NO: 64602 - DNA, 22 bp, Homo sapiens
aaagtgcttctctttggtgggt

SEQ ID NO: 64603 - DNA, 22 bp, Homo sapiens
gtgagcagagatcgcgtgattg

SEQ ID NO: 64604 - DNA, 22 bp, Homo sapiens
ggttcagggctaccagtgggtg

SEQ ID NO: 64605 - DNA, 22 bp, Homo sapiens
taagtcgtggatgattcttcgg

SEQ ID NO: 64606 - DNA, 17 bp, Homo sapiens
tgtatttatcatgtcag

SEQ ID NO: 64607 - DNA, 22 bp, Homo sapiens
ggggcaggagcccttcttcagc

SEQ ID NO: 64608 - DNA, 22 bp, Homo sapiens
ggcccaggctggagtgcagtgg

SEQ ID NO: 64609 - DNA, 22 bp, Homo sapiens
ggggaccctcaggactgcgtct

SEQ ID NO: 64610 - DNA, 22 bp, Homo sapiens
ggatgtcgaggatggggtagca

SEQ ID NO: 64611 - DNA, 22 bp, Homo sapiens
cagtggccaacttcctgcctct

SEQ ID NO: 64612 - DNA, 22 bp, Homo sapiens
gtgaggtggtacaatattaact

SEQ ID NO: 64613 - DNA, 22 bp, Homo sapiens
gcttagtcaattataaataggc

SEQ ID NO: 64614 - DNA, 22 bp, Homo sapiens
ttattgaaggaactgaaataaa

SEQ ID NO: 64615 - DNA, 22 bp, Homo sapiens
gtcacctcgctgtcttcctgag

SEQ ID NO: 64616 - DNA, 22 bp, Homo sapiens
tcctcagcttttatttcacttg

SEQ ID NO: 64617 - DNA, 22 bp, Homo sapiens
aggagctgtcagagtgccagag

SEQ ID NO: 64618 - DNA, 23 bp, Homo sapiens
aggatgtaggatgtatggcagag

SEQ ID NO: 64619 - DNA, 22 bp, Homo sapiens
aaggggaagagaccgcagagtc

SEQ ID NO: 64620 - DNA, 22 bp, Homo sapiens
ctggggaacgcagcgagcagcg

SEQ ID NO: 64621 - DNA, 22 bp, Homo sapiens
agtggctgagtgactgtgactc

SEQ ID NO: 64622 - DNA, 22 bp, Homo sapiens
actggacagaggaaatatggag

SEQ ID NO: 64623 - DNA, 19 bp, Homo sapiens
ggtatatgggcctcacttg

SEQ ID NO: 64624 - DNA, 22 bp, Homo sapiens
ctgtccctgagcaactcctgtt

SEQ ID NO: 64625 - DNA, 22 bp, Homo sapiens
tctggagataagcagcaatgaa

SEQ ID NO: 64626 - DNA, 22 bp, Homo sapiens
aggctgaggcaagaggatcact

SEQ ID NO: 64627 - DNA, 22 bp, Homo sapiens
aggtggagaagagatgggcagt

SEQ ID NO: 64628 - DNA, 20 bp, Homo sapiens
ttcatgggagcaaagaggcc

SEQ ID NO: 64629 - DNA, 22 bp, Homo sapiens
tatactctgagaaacgtgtcac

SEQ ID NO: 64630 - DNA, 22 bp, Homo sapiens
tttcaccatcttggccaggctg

SEQ ID NO: 64631 - DNA, 22 bp, Homo sapiens
tcaccgaggctggagtgcagtg

SEQ ID NO: 64632 - DNA, 22 bp, Homo sapiens
aaagcctcccaggttatgagta

SEQ ID NO: 64633 - DNA, 22 bp, Homo sapiens
actgcactcctgcctgggtaac

SEQ ID NO: 64634 - DNA, 22 bp, Homo sapiens
ggttttatcctacccacacagc

SEQ ID NO: 64635 - DNA, 22 bp, Homo sapiens
tgaaatctttagtttctgtccc

SEQ ID NO: 64636 - DNA, 22 bp, Homo sapiens
tttgctattgtgaatagtgcca

SEQ ID NO: 64637 - DNA, 22 bp, Homo sapiens
tcactgcagcctctgcctcccg

SEQ ID NO: 64638 - DNA, 22 bp, Homo sapiens
gggcggatcatttgaggtcagg

SEQ ID NO: 64639 - DNA, 22 bp, Homo sapiens
catctgctgttccttggactca

SEQ ID NO: 64640 - DNA, 22 bp, Homo sapiens
gggacgtgagtgaagaaggtct

SEQ ID NO: 64641 - DNA, 22 bp, Homo sapiens
tgagacgaagtcttgctctgtt

SEQ ID NO: 64642 - DNA, 17 bp, Homo sapiens
tactgaggggtctggag

SEQ ID NO: 64643 - DNA, 22 bp, Homo sapiens
gaggcctcatgaggtgagcatt

SEQ ID NO: 64644 - DNA, 18 bp, Homo sapiens
tgtccctgcaaataacat

SEQ ID NO: 64645 - DNA, 22 bp, Homo sapiens
tcccccaggctggagtgcagtg

SEQ ID NO: 64646 - DNA, 22 bp, Homo sapiens
gagagtctaggaacctcatata

SEQ ID NO: 64647 - DNA, 22 bp, Homo sapiens
tcactgcaagctccacctcccg

SEQ ID NO: 64648 - DNA, 22 bp, Homo sapiens
tggcacagactgggccaaggaa

SEQ ID NO: 64649 - DNA, 22 bp, Homo sapiens
tcaggcagtagaattgcttgaa

SEQ ID NO: 64650 - DNA, 22 bp, Homo sapiens
gctgcagctgtaggacacaatt

SEQ ID NO: 64651 - DNA, 22 bp, Homo sapiens
tctaatccttgctacctgggtg

SEQ ID NO: 64652 - DNA, 22 bp, Homo sapiens
aagaatgagctcaaagatctta

SEQ ID NO: 64653 - DNA, 22 bp, Homo sapiens
ttagtttataattcatttctgt

SEQ ID NO: 64654 - DNA, 22 bp, Homo sapiens
aggctcagatccttgtgtcctg

SEQ ID NO: 64655 - DNA, 22 bp, Homo sapiens
ggaggctgagaggtcgcagtgg

SEQ ID NO: 64656 - DNA, 22 bp, Homo sapiens
aggtcaagagtaaatttgggta

SEQ ID NO: 64657 - DNA, 22 bp, Homo sapiens
agtgcaggccccaggccaggcc

SEQ ID NO: 64658 - DNA, 22 bp, Homo sapiens
cagctgcccctccagggctggg

SEQ ID NO: 64659 - DNA, 20 bp, Homo sapiens
ttctccagtgcggtagccat

SEQ ID NO: 64660 - DNA, 22 bp, Homo sapiens
agatttatgtggtcacactcag

SEQ ID NO: 64661 - DNA, 22 bp, Homo sapiens
ctgccgtgtttttcatgttaaa

SEQ ID NO: 64662 - DNA, 22 bp, Homo sapiens
ctgagccaaggggacagtgaca

SEQ ID NO: 64663 - DNA, 22 bp, Homo sapiens
tgggaagaggggtataaagaag

SEQ ID NO: 64664 - DNA, 19 bp, Homo sapiens
catggtgaaaccccgtctc

SEQ ID NO: 64665 - DNA, 22 bp, Homo sapiens
tacgcctgtaatcccagcactt

SEQ ID NO: 64666 - DNA, 22 bp, Homo sapiens
tcattgagttgcacttttacta

SEQ ID NO: 64667 - DNA, 21 bp, Homo sapiens
ctctgaatcctgcttctcagt

SEQ ID NO: 64668 - DNA, 22 bp, Homo sapiens
attgttgggtctcactcctaga

SEQ ID NO: 64669 - DNA, 22 bp, Homo sapiens
aaccaccattctctcctcttcc

SEQ ID NO: 64670 - DNA, 22 bp, Homo sapiens
atgccactgcgctccagcctgg

SEQ ID NO: 64671 - DNA, 22 bp, Homo sapiens
ctcactgcaacctccgcctcct

SEQ ID NO: 64672 - DNA, 22 bp, Homo sapiens
tcacatctaattccatttctgc

SEQ ID NO: 64673 - DNA, 22 bp, Homo sapiens
atatgggggggcgtgcagagga

SEQ ID NO: 64674 - DNA, 20 bp, Homo sapiens
tgaggcccagcagagtcggg

SEQ ID NO: 64675 - DNA, 22 bp, Homo sapiens
tactgtgtgcccagccgagctg

SEQ ID NO: 64676 - DNA, 22 bp, Homo sapiens
caggctggagtgcagtggcgcc

SEQ ID NO: 64677 - DNA, 22 bp, Homo sapiens
ttaggctgttcttgtgttgtta

SEQ ID NO: 64678 - DNA, 22 bp, Homo sapiens
tgatctaggttggcttcaactg

SEQ ID NO: 64679 - DNA, 22 bp, Homo sapiens
tagtatagattgaagcagatca

SEQ ID NO: 64680 - DNA, 22 bp, Homo sapiens
cccagggagagcgcggaggcgg

SEQ ID NO: 64681 - DNA, 22 bp, Homo sapiens
ggctgggcaggtctgcacaggg

SEQ ID NO: 64682 - DNA, 22 bp, Homo sapiens
gttctgggagatcttgagcttc

SEQ ID NO: 64683 - DNA, 21 bp, Homo sapiens
gctgttcggcggccctcgcgc

SEQ ID NO: 64684 - DNA, 22 bp, Homo sapiens
acccacgaagatgagcggcatg

SEQ ID NO: 64685 - DNA, 22 bp, Homo sapiens
ttcaatttgtgctaaggcaccg

SEQ ID NO: 64686 - DNA, 22 bp, Homo sapiens
aggtgacaggacaggagctggt

SEQ ID NO: 64687 - DNA, 21 bp, Homo sapiens
gccatttcacacagacatttg

SEQ ID NO: 64688 - DNA, 22 bp, Homo sapiens
tgccgtggggctgaggctggag

SEQ ID NO: 64689 - DNA, 23 bp, Homo sapiens
actgagccagggcctgggtcagc

SEQ ID NO: 64690 - DNA, 22 bp, Homo sapiens
ggaggctgaggcaggcggatca

SEQ ID NO: 64691 - DNA, 22 bp, Homo sapiens
gctcactgcaacctccacctcc

SEQ ID NO: 64692 - DNA, 22 bp, Homo sapiens
tcaagcaaagtttagctggtta

SEQ ID NO: 64693 - DNA, 22 bp, Homo sapiens
gtcagtaggaacctagggtcaa

SEQ ID NO: 64694 - DNA, 22 bp, Homo sapiens
cacagggcttctcatggggtgc

SEQ ID NO: 64695 - DNA, 22 bp, Homo sapiens
gtggatggagctggaagccatt

SEQ ID NO: 64696 - DNA, 22 bp, Homo sapiens
ctgggtggcagagcctgcagtg

SEQ ID NO: 64697 - DNA, 22 bp, Homo sapiens
gaggcaggcagattgcttgagg

SEQ ID NO: 64698 - DNA, 22 bp, Homo sapiens
gagaaatatggctcagttccac

SEQ ID NO: 64699 - DNA, 22 bp, Homo sapiens
gcagtatctatgtgatgggttg

SEQ ID NO: 64700 - DNA, 21 bp, Homo sapiens
cccgcacagcggtaggccgcc

SEQ ID NO: 64701 - DNA, 22 bp, Homo sapiens
ccaaagtgctggggttacaggc

SEQ ID NO: 64702 - DNA, 22 bp, Homo sapiens
tgtgtcccttggaacctcagct

SEQ ID NO: 64703 - DNA, 22 bp, Homo sapiens
aataaaatggtcagttttctca

SEQ ID NO: 64704 - DNA, 22 bp, Homo sapiens
aggcaaggtgctacagacagtg

SEQ ID NO: 64705 - DNA, 22 bp, Homo sapiens
atgaagtggttctattggtttt

SEQ ID NO: 64706 - DNA, 22 bp, Homo sapiens
cccactgtttccctgaggctct

SEQ ID NO: 64707 - DNA, 22 bp, Homo sapiens
cctcggtttccacatctgtaca

SEQ ID NO: 64708 - DNA, 22 bp, Homo sapiens
agcctagggttctgatgtcact

SEQ ID NO: 64709 - DNA, 22 bp, Homo sapiens
agacagggtgatcgcttgagcc

SEQ ID NO: 64710 - DNA, 22 bp, Homo sapiens
ggcggaggttgcagtaagccga

SEQ ID NO: 64711 - DNA, 22 bp, Homo sapiens
ggcagacctctccagccccaca

SEQ ID NO: 64712 - DNA, 22 bp, Homo sapiens
aaggaggttatcccagtggact

SEQ ID NO: 64713 - DNA, 23 bp, Homo sapiens
tcaactgctctgggaaggtcccc

SEQ ID NO: 64714 - DNA, 22 bp, Homo sapiens
cactgggcgtgtcctgggtgag

SEQ ID NO: 64715 - DNA, 22 bp, Homo sapiens
tgacctattagatttccttgcc

SEQ ID NO: 64716 - DNA, 22 bp, Homo sapiens
tgagcctgggagatggaggctg

SEQ ID NO: 64717 - DNA, 22 bp, Homo sapiens
aaggagtctgggccattcagag

SEQ ID NO: 64718 - DNA, 22 bp, Homo sapiens
tgaggcaggaggttgagaactg

SEQ ID NO: 64719 - DNA, 22 bp, Homo sapiens
tgagccagaggaggctgtgtgg

SEQ ID NO: 64720 - DNA, 22 bp, Homo sapiens
cccaggaggcggaggttgcagt

SEQ ID NO: 64721 - DNA, 22 bp, Homo sapiens
ttgtgaatggtgccgcaataaa

SEQ ID NO: 64722 - DNA, 22 bp, Homo sapiens
tttctaatctgattctcctacc

SEQ ID NO: 64723 - DNA, 22 bp, Homo sapiens
tttcttctatgtgtgatatttt

SEQ ID NO: 64724 - DNA, 20 bp, Homo sapiens
aagcagtgaggtgaggagtg

SEQ ID NO: 64725 - DNA, 22 bp, Homo sapiens
cactctcagcataatgaatgtg

SEQ ID NO: 64726 - DNA, 22 bp, Homo sapiens
cctcagctcccatgagatctgc

SEQ ID NO: 64727 - DNA, 22 bp, Homo sapiens
cctgcagacacttgtccagcaa

SEQ ID NO: 64728 - DNA, 20 bp, Homo sapiens
tgagacccgctgacaagttc

SEQ ID NO: 64729 - DNA, 22 bp, Homo sapiens
ccatgaattcactccatgctag

SEQ ID NO: 64730 - DNA, 22 bp, Homo sapiens
tgccgcagtgcggggagggccc

SEQ ID NO: 64731 - DNA, 22 bp, Homo sapiens
tgtctcatctcttaaccccact

SEQ ID NO: 64732 - DNA, 22 bp, Homo sapiens
agctcagggccaggcgcgtttc

SEQ ID NO: 64733 - DNA, 22 bp, Homo sapiens
gaggagggagctggaagctctt

SEQ ID NO: 64734 - DNA, 22 bp, Homo sapiens
tatgaggtaggtattatactta

SEQ ID NO: 64735 - DNA, 22 bp, Homo sapiens
gagtagaactggttatctaata

SEQ ID NO: 64736 - DNA, 22 bp, Homo sapiens
ttctatttttgtggaactgtag

SEQ ID NO: 64737 - DNA, 22 bp, Homo sapiens
ccagatatcactgccgtgttgt

SEQ ID NO: 64738 - DNA, 22 bp, Homo sapiens
caggccggggcggcgccatctt

SEQ ID NO: 64739 - DNA, 22 bp, Homo sapiens
gcctcctgtcccaggctgagga

SEQ ID NO: 64740 - DNA, 22 bp, Homo sapiens
ccaggctggagtgcaatggcat

SEQ ID NO: 64741 - DNA, 22 bp, Homo sapiens
caggaagaccagggctgtggct

SEQ ID NO: 64742 - DNA, 22 bp, Homo sapiens
tgatttatgcattatactgttg

SEQ ID NO: 64743 - DNA, 22 bp, Homo sapiens
cttaatctcacctgcaaagtcc

SEQ ID NO: 64744 - DNA, 22 bp, Homo sapiens
tcactgcaagctcagcctcccg

SEQ ID NO: 64745 - DNA, 22 bp, Homo sapiens
gtctatgatattttgttatagc

SEQ ID NO: 64746 - DNA, 22 bp, Homo sapiens
aagacacaatgtagcccagcac

SEQ ID NO: 64747 - DNA, 22 bp, Homo sapiens
tctgttttgcataatgttcttt

SEQ ID NO: 64748 - DNA, 22 bp, Homo sapiens
ccagcagagcatggggaggaag

SEQ ID NO: 64749 - DNA, 22 bp, Homo sapiens
ggtagaaataatcttcaggctg

SEQ ID NO: 64750 - DNA, 22 bp, Homo sapiens
cagccacttgtgatgctgggga

SEQ ID NO: 64751 - DNA, 22 bp, Homo sapiens
tatctatgtgctctgacctctc

SEQ ID NO: 64752 - DNA, 22 bp, Homo sapiens
ccgagctgtggtctcttttacg

SEQ ID NO: 64753 - DNA, 22 bp, Homo sapiens
gaggtggccaagcgaggaaggg

SEQ ID NO: 64754 - DNA, 22 bp, Homo sapiens
tctcatctgccatttgcaggag

SEQ ID NO: 64755 - DNA, 22 bp, Homo sapiens
tcttctatcctcagcccctgcc

SEQ ID NO: 64756 - DNA, 19 bp, Homo sapiens
tccaggggctccacctcct

SEQ ID NO: 64757 - DNA, 18 bp, Homo sapiens
agagtatacagacaacaa

SEQ ID NO: 64758 - DNA, 22 bp, Homo sapiens
gtcctgacggctgattggcctg

SEQ ID NO: 64759 - DNA, 22 bp, Homo sapiens
caggcagggagctggaaaggat

SEQ ID NO: 64760 - DNA, 22 bp, Homo sapiens
caggagctcagatgacatctca

SEQ ID NO: 64761 - DNA, 22 bp, Homo sapiens
tgagtccgaagttgcagtgagc

SEQ ID NO: 64762 - DNA, 22 bp, Homo sapiens
ggtgacggggcccaggtttcct

SEQ ID NO: 64763 - DNA, 22 bp, Homo sapiens
atgccactgcacttcagcctgg

SEQ ID NO: 64764 - DNA, 19 bp, Homo sapiens
aggcttcaggccacatgct

SEQ ID NO: 64765 - DNA, 22 bp, Homo sapiens
aaattagtcatgttgtattact

SEQ ID NO: 64766 - DNA, 20 bp, Homo sapiens
agcagagtgcccatcccgga

SEQ ID NO: 64767 - DNA, 22 bp, Homo sapiens
catgtgtcttgctgccctccat

SEQ ID NO: 64768 - DNA, 22 bp, Homo sapiens
gacaattagatcattcctttga

SEQ ID NO: 64769 - DNA, 17 bp, Homo sapiens
catcaaagaaatttcca

SEQ ID NO: 64770 - DNA, 22 bp, Homo sapiens
gcctccagcccacgcaggcctg

SEQ ID NO: 64771 - DNA, 22 bp, Homo sapiens
actttatttcctattgcatcca

SEQ ID NO: 64772 - DNA, 22 bp, Homo sapiens
ggctgcaggttggttggcagct

SEQ ID NO: 64773 - DNA, 22 bp, Homo sapiens
tttggactgcatgatgatctgg

SEQ ID NO: 64774 - DNA, 22 bp, Homo sapiens
gctgggctgcgtcggggaagcc

SEQ ID NO: 64775 - DNA, 22 bp, Homo sapiens
aggctctcaccctctgaccaga

SEQ ID NO: 64776 - DNA, 18 bp, Homo sapiens
cttgttcttctcttggcg

SEQ ID NO: 64777 - DNA, 22 bp, Homo sapiens
tctgcaacattcctctccccac

SEQ ID NO: 64778 - DNA, 22 bp, Homo sapiens
tcgttaatcagcaccagaattc

SEQ ID NO: 64779 - DNA, 22 bp, Homo sapiens
ctcactgcaagctcagcctccc

SEQ ID NO: 64780 - DNA, 22 bp, Homo sapiens
ctgggggtcttgaaagggagag

SEQ ID NO: 64781 - DNA, 19 bp, Homo sapiens
tgaaggacagtgcacatca

SEQ ID NO: 64782 - DNA, 22 bp, Homo sapiens
acattaaacttgcttggctgta

SEQ ID NO: 64783 - DNA, 22 bp, Homo sapiens
accgcagtgacgtgggacttcc

SEQ ID NO: 64784 - DNA, 22 bp, Homo sapiens
agggagatcgaccgtgttatat

SEQ ID NO: 64785 - DNA, 22 bp, Homo sapiens
ctcattgcaacctccgcctccc

SEQ ID NO: 64786 - DNA, 22 bp, Homo sapiens
tgcctaggctggagtgcaatgg

SEQ ID NO: 64787 - DNA, 22 bp, Homo sapiens
ttttaagttggattgctaagta

SEQ ID NO: 64788 - DNA, 22 bp, Homo sapiens
gaggactgaaacttacaggaaa

SEQ ID NO: 64789 - DNA, 22 bp, Homo sapiens
cacccaggctggagtgcagtgg

SEQ ID NO: 64790 - DNA, 22 bp, Homo sapiens
ttctccgctaagttctctgcag

SEQ ID NO: 64791 - DNA, 22 bp, Homo sapiens
agccaagcactcaactcctgga

SEQ ID NO: 64792 - DNA, 22 bp, Homo sapiens
ccaaagtgctgggattcaggca

SEQ ID NO: 64793 - DNA, 22 bp, Homo sapiens
ttgagtgtactttagtcatctg

SEQ ID NO: 64794 - DNA, 22 bp, Homo sapiens
ccaggagttggaggttgcagtg

SEQ ID NO: 64795 - DNA, 22 bp, Homo sapiens
tcactgcaatctcagcctcctg

SEQ ID NO: 64796 - DNA, 23 bp, Homo sapiens
tgaatgtttattctcggtgcaga

SEQ ID NO: 64797 - DNA, 22 bp, Homo sapiens
cttatcagattatctgggctgt

SEQ ID NO: 64798 - DNA, 22 bp, Homo sapiens
cccaggcttttctcttgcccca

SEQ ID NO: 64799 - DNA, 22 bp, Homo sapiens
ctggcaggtggaggttgcagtg

SEQ ID NO: 64800 - DNA, 22 bp, Homo sapiens
gaagccttgaactgcaaacccc

SEQ ID NO: 64801 - DNA, 22 bp, Homo sapiens
agtcaaagatgaccgagttcct

SEQ ID NO: 64802 - DNA, 20 bp, Homo sapiens
tgtccccaccaaaatttcat

SEQ ID NO: 64803 - DNA, 22 bp, Homo sapiens
tcactgcaacctccgcctgctg

SEQ ID NO: 64804 - DNA, 22 bp, Homo sapiens
gctcccaccttaaccttcacat

SEQ ID NO: 64805 - DNA, 19 bp, Homo sapiens
gggcttggggctgaagcct

SEQ ID NO: 64806 - DNA, 22 bp, Homo sapiens
gaggcaaagcatgtggctcagg

SEQ ID NO: 64807 - DNA, 22 bp, Homo sapiens
gaggcagaggttgttgcagtga

SEQ ID NO: 64808 - DNA, 22 bp, Homo sapiens
gctgtgtatcagatgccacggg

SEQ ID NO: 64809 - DNA, 22 bp, Homo sapiens
acagagacacggaagctaaaga

SEQ ID NO: 64810 - DNA, 21 bp, Homo sapiens
ctacttaagtaggggattagg

SEQ ID NO: 64811 - DNA, 22 bp, Homo sapiens
gagctgagaagcagcgcttgat

SEQ ID NO: 64812 - DNA, 22 bp, Homo sapiens
ccgggttgaggttcccatagat

SEQ ID NO: 64813 - DNA, 22 bp, Homo sapiens
gtgggtggacggtgcttttgtt

SEQ ID NO: 64814 - DNA, 21 bp, Homo sapiens
gaccccagaccagcagacaca

SEQ ID NO: 64815 - DNA, 22 bp, Homo sapiens
agcccaggtccagttcactgca

SEQ ID NO: 64816 - DNA, 22 bp, Homo sapiens
ccccaggacgtggccctcatag

SEQ ID NO: 64817 - DNA, 22 bp, Homo sapiens
tgtgcctactgatagagccaag

SEQ ID NO: 64818 - DNA, 22 bp, Homo sapiens
cccagcaggtcggtgctgcctg

SEQ ID NO: 64819 - DNA, 22 bp, Homo sapiens
ggccctggcagccacgaaagcc

SEQ ID NO: 64820 - DNA, 22 bp, Homo sapiens
ccaggcaggcgatggtgcagtg

SEQ ID NO: 64821 - DNA, 22 bp, Homo sapiens
atgcacctgaactccatcagct

SEQ ID NO: 64822 - DNA, 21 bp, Homo sapiens
cactccacttagaacagggtt

SEQ ID NO: 64823 - DNA, 22 bp, Homo sapiens
tttgaagggcacgacaatagtt

SEQ ID NO: 64824 - DNA, 22 bp, Homo sapiens
aatttaagaacatttcaggact

SEQ ID NO: 64825 - DNA, 22 bp, Homo sapiens
cccaggaggtggagttcacagt

SEQ ID NO: 64826 - DNA, 22 bp, Homo sapiens
atgtgggccgtgcgggtgtcct

SEQ ID NO: 64827 - DNA, 22 bp, Homo sapiens
ggagagtggattccagctgtat

SEQ ID NO: 64828 - DNA, 22 bp, Homo sapiens
gataccagacagggagggagaa

SEQ ID NO: 64829 - DNA, 22 bp, Homo sapiens
cacccaggttggagtgcagtgg

SEQ ID NO: 64830 - DNA, 22 bp, Homo sapiens
ccctcccaggagtggccagaga

SEQ ID NO: 64831 - DNA, 22 bp, Homo sapiens
ccctgtgggaactcctgagttg

SEQ ID NO: 64832 - DNA, 22 bp, Homo sapiens
ctcagcagtatactctgaagat

SEQ ID NO: 64833 - DNA, 22 bp, Homo sapiens
cccacacacatttatgatagga

SEQ ID NO: 64834 - DNA, 22 bp, Homo sapiens
ggaatcctgccagctctgcccc

SEQ ID NO: 64835 - DNA, 22 bp, Homo sapiens
gaaagagaacctgggcctagat

SEQ ID NO: 64836 - DNA, 22 bp, Homo sapiens
caggtgcctcaggatgagacaa

SEQ ID NO: 64837 - DNA, 22 bp, Homo sapiens
ggctccaccctgcttccagaag

SEQ ID NO: 64838 - DNA, 22 bp, Homo sapiens
aggtacatggggtgtgtgcacg

SEQ ID NO: 64839 - DNA, 22 bp, Homo sapiens
cgtaggtggctcagcacctggg

SEQ ID NO: 64840 - DNA, 22 bp, Homo sapiens
tgaggcaggagttcaggctgcg

SEQ ID NO: 64841 - DNA, 22 bp, Homo sapiens
agcttgggcaacacagcaagac

SEQ ID NO: 64842 - DNA, 22 bp, Homo sapiens
gcaggaggttgagccaggactg

SEQ ID NO: 64843 - DNA, 19 bp, Homo sapiens
tctgaagaattagagagca

SEQ ID NO: 64844 - DNA, 22 bp, Homo sapiens
cagtcactggaatagctgagga

SEQ ID NO: 64845 - DNA, 22 bp, Homo sapiens
gaaggaagtcattagtgcagac

SEQ ID NO: 64846 - DNA, 22 bp, Homo sapiens
tgcatattatgtgtatctgtct

SEQ ID NO: 64847 - DNA, 22 bp, Homo sapiens
aggaaaatggaccagagttgtt

SEQ ID NO: 64848 - DNA, 23 bp, Homo sapiens
gtgccgacgctccagcaccatcc

SEQ ID NO: 64849 - DNA, 22 bp, Homo sapiens
cccaggaggtggagcttgcagt

SEQ ID NO: 64850 - DNA, 22 bp, Homo sapiens
aggggttggacataagacagaa

SEQ ID NO: 64851 - DNA, 22 bp, Homo sapiens
tctgctttcttactaaaaatga

SEQ ID NO: 64852 - DNA, 22 bp, Homo sapiens
tgtctgcctgcgggccggcaca

SEQ ID NO: 64853 - DNA, 22 bp, Homo sapiens
gtcccctgtccagggccagcca

SEQ ID NO: 64854 - DNA, 22 bp, Homo sapiens
tttctcttcactgtgtgcctca

SEQ ID NO: 64855 - DNA, 23 bp, Homo sapiens
aaacttgctatggctgaaatcat

SEQ ID NO: 64856 - DNA, 22 bp, Homo sapiens
tgactggattgtcattacgacg

SEQ ID NO: 64857 - DNA, 22 bp, Homo sapiens
gccagtggtcactgaggaagaa

SEQ ID NO: 64858 - DNA, 22 bp, Homo sapiens
aatgtgagccaatgcccgtggg

SEQ ID NO: 64859 - DNA, 22 bp, Homo sapiens
agtgagtttagggtgcaggtgt

SEQ ID NO: 64860 - DNA, 22 bp, Homo sapiens
aggctgtagtgcatgtgctatg

SEQ ID NO: 64861 - DNA, 22 bp, Homo sapiens
tggctgtgtccctgtccagagt

SEQ ID NO: 64862 - DNA, 22 bp, Homo sapiens
acaaagtgctgacattacaggc

SEQ ID NO: 64863 - DNA, 22 bp, Homo sapiens
tggggtacttgtatcaaagcac

SEQ ID NO: 64864 - DNA, 22 bp, Homo sapiens
cagaggctggcggccgccccga

SEQ ID NO: 64865 - DNA, 22 bp, Homo sapiens
aagtgctgggattataggcatg

SEQ ID NO: 64866 - DNA, 22 bp, Homo sapiens
ccagagctgattcctgggactt

SEQ ID NO: 64867 - DNA, 22 bp, Homo sapiens
aacaattactaccaaggcctgt

SEQ ID NO: 64868 - DNA, 22 bp, Homo sapiens
tcgcccaggctggaagtgcagt

SEQ ID NO: 64869 - DNA, 22 bp, Homo sapiens
gtacaaatgcaggtttgttaca

SEQ ID NO: 64870 - DNA, 22 bp, Homo sapiens
acctgcaggcacaggtgtgcgc

SEQ ID NO: 64871 - DNA, 22 bp, Homo sapiens
tctctcaggctggagtgcagtg

SEQ ID NO: 64872 - DNA, 22 bp, Homo sapiens
atgtcactgttgttattgttat

SEQ ID NO: 64873 - DNA, 22 bp, Homo sapiens
ggagtgcagtggcgtgagctcg

SEQ ID NO: 64874 - DNA, 22 bp, Homo sapiens
aggagcagaccgtagtcctgca

SEQ ID NO: 64875 - DNA, 22 bp, Homo sapiens
agcctggtttaagcattttata

SEQ ID NO: 64876 - DNA, 22 bp, Homo sapiens
ttgatgagaccattgccgcgtc

SEQ ID NO: 64877 - DNA, 22 bp, Homo sapiens
ctgaggaggctaatttgaggat

SEQ ID NO: 64878 - DNA, 22 bp, Homo sapiens
cctgggggccaggaaggtgtga

SEQ ID NO: 64879 - DNA, 22 bp, Homo sapiens
caggaaggcgcggctgtgcctg

SEQ ID NO: 64880 - DNA, 22 bp, Homo sapiens
tcctagttctctgccagtcgct

SEQ ID NO: 64881 - DNA, 22 bp, Homo sapiens
aaagtgctaggattacaagcgt

SEQ ID NO: 64882 - DNA, 22 bp, Homo sapiens
ggggtcggggcatagccactta

SEQ ID NO: 64883 - DNA, 22 bp, Homo sapiens
gggaggttctgttcgcacttga

SEQ ID NO: 64884 - DNA, 22 bp, Homo sapiens
tctagctctgcttatcatggct

SEQ ID NO: 64885 - DNA, 22 bp, Homo sapiens
accacctcatcaagctggattg

SEQ ID NO: 64886 - DNA, 22 bp, Homo sapiens
gctcactgcaagctccgcctcc

SEQ ID NO: 64887 - DNA, 21 bp, Homo sapiens
agatcctggggtctggggagg

SEQ ID NO: 64888 - DNA, 22 bp, Homo sapiens
cagagctggtgtgtcctggcat

SEQ ID NO: 64889 - DNA, 22 bp, Homo sapiens
cagggatggcgctggctgcccg

SEQ ID NO: 64890 - DNA, 22 bp, Homo sapiens
tctcagctcatggcagccttga

SEQ ID NO: 64891 - DNA, 22 bp, Homo sapiens
agctgccgatgcccagctgcat

SEQ ID NO: 64892 - DNA, 22 bp, Homo sapiens
agtcacagggggcccctgcaac

SEQ ID NO: 64893 - DNA, 22 bp, Homo sapiens
tccttaggaaaatgatgagggg

SEQ ID NO: 64894 - DNA, 22 bp, Homo sapiens
gttgcctaggctggtcttgaac

SEQ ID NO: 64895 - DNA, 22 bp, Homo sapiens
gggggctccaggcgagaatgtg

SEQ ID NO: 64896 - DNA, 22 bp, Homo sapiens
tccaggtgacagagacaggata

SEQ ID NO: 64897 - DNA, 20 bp, Homo sapiens
gggcagagccagccagtccc

SEQ ID NO: 64898 - DNA, 22 bp, Homo sapiens
aagtgctgggattacaggcatg

SEQ ID NO: 64899 - DNA, 22 bp, Homo sapiens
gttcaagaccagcctggccaac

SEQ ID NO: 64900 - DNA, 22 bp, Homo sapiens
ttggagagtgatattcagatgc

SEQ ID NO: 64901 - DNA, 22 bp, Homo sapiens
agcccaggagtttgaggctgtg

SEQ ID NO: 64902 - DNA, 22 bp, Homo sapiens
ctgctctgctgatcagtgtctc

SEQ ID NO: 64903 - DNA, 22 bp, Homo sapiens
agaagcagaaactgggcttgtg

SEQ ID NO: 64904 - DNA, 22 bp, Homo sapiens
gtgcccagcagcagcgtccccg

SEQ ID NO: 64905 - DNA, 18 bp, Homo sapiens
cagggctgtggggtcact

SEQ ID NO: 64906 - DNA, 22 bp, Homo sapiens
ttattttaccttcctctgagct

SEQ ID NO: 64907 - DNA, 22 bp, Homo sapiens
agcccagaggctgggcgtgcat

SEQ ID NO: 64908 - DNA, 22 bp, Homo sapiens
tggtcgaccagttggaaagtaa

SEQ ID NO: 64909 - DNA, 22 bp, Homo sapiens
ggccctgggccctctagcttgt

SEQ ID NO: 64910 - DNA, 22 bp, Homo sapiens
ctgggcagctgtatcagggagt

SEQ ID NO: 64911 - DNA, 16 bp, Homo sapiens
ccacctgcagctctca

SEQ ID NO: 64912 - DNA, 22 bp, Homo sapiens
cactgcactccagcctgggtga

SEQ ID NO: 64913 - DNA, 22 bp, Homo sapiens
aactcactttgtggcttctgaa

SEQ ID NO: 64914 - DNA, 22 bp, Homo sapiens
ctggctggagtgcaggtgagtg

SEQ ID NO: 64915 - DNA, 22 bp, Homo sapiens
gggtgtagaaagaaccctctgg

SEQ ID NO: 64916 - DNA, 22 bp, Homo sapiens
tgagagttctctcttcaggtgg

SEQ ID NO: 64917 - DNA, 22 bp, Homo sapiens
gacagacacaattgatccatga

SEQ ID NO: 64918 - DNA, 21 bp, Homo sapiens
ctggaggcaggtggtgccagg

SEQ ID NO: 64919 - DNA, 22 bp, Homo sapiens
tctgaaaactccatgagctcgt

SEQ ID NO: 64920 - DNA, 22 bp, Homo sapiens
acagtatagggcttatattgta

SEQ ID NO: 64921 - DNA, 22 bp, Homo sapiens
acacagggctgcgcctgacccc

SEQ ID NO: 64922 - DNA, 22 bp, Homo sapiens
caagctgaacactgtcttcaag

SEQ ID NO: 64923 - DNA, 22 bp, Homo sapiens
tgaggtgccacccaagagcctt

SEQ ID NO: 64924 - DNA, 22 bp, Homo sapiens
agagcagctcgctacctctcta

SEQ ID NO: 64925 - DNA, 22 bp, Homo sapiens
aaggaaagctgtggttctgaga

SEQ ID NO: 64926 - DNA, 22 bp, Homo sapiens
cgctgataaacgtcacgttccc

SEQ ID NO: 64927 - DNA, 22 bp, Homo sapiens
tgaagaaacgcagagaggtagg

SEQ ID NO: 64928 - DNA, 20 bp, Homo sapiens
tatttctgggcaaccattta

SEQ ID NO: 64929 - DNA, 22 bp, Homo sapiens
atcttcccaggctggggagagg

SEQ ID NO: 64930 - DNA, 22 bp, Homo sapiens
gcttcaggctgaattcctccta

SEQ ID NO: 64931 - DNA, 22 bp, Homo sapiens
tttattctgtgctacatgaaga

SEQ ID NO: 64932 - DNA, 22 bp, Homo sapiens
aggtgggcggattcatgaggtc

SEQ ID NO: 64933 - DNA, 22 bp, Homo sapiens
gctgccaatccagctgtgggag

SEQ ID NO: 64934 - DNA, 22 bp, Homo sapiens
cgcagggccgcgagcgggacca

SEQ ID NO: 64935 - DNA, 22 bp, Homo sapiens
aagaagcattctttcattggtt

SEQ ID NO: 64936 - DNA, 22 bp, Homo sapiens
ctcactgcaagctccgcctccc

SEQ ID NO: 64937 - DNA, 22 bp, Homo sapiens
gctgcagtgagccaagatcgtg

SEQ ID NO: 64938 - DNA, 22 bp, Homo sapiens
cccaggaggcagaagttgcagt

SEQ ID NO: 64939 - DNA, 22 bp, Homo sapiens
gagaggtggaggttgcagtgag

SEQ ID NO: 64940 - DNA, 23 bp, Homo sapiens
gcagaggagcaagctggacacca

SEQ ID NO: 64941 - DNA, 22 bp, Homo sapiens
tctcatttacttccacaggctg

SEQ ID NO: 64942 - DNA, 22 bp, Homo sapiens
cagtgcagccaaggacaggcac

SEQ ID NO: 64943 - DNA, 22 bp, Homo sapiens
cccaggaggtcgaagctgcagt

SEQ ID NO: 64944 - DNA, 22 bp, Homo sapiens
cccagaaggtcgaggctgcagt

SEQ ID NO: 64945 - DNA, 22 bp, Homo sapiens
ttatgatttgccacagattggt

SEQ ID NO: 64946 - DNA, 22 bp, Homo sapiens
tgctgtgaggttgagaaggaag

SEQ ID NO: 64947 - DNA, 22 bp, Homo sapiens
ctgccaggattctgtgaacccc

SEQ ID NO: 64948 - DNA, 22 bp, Homo sapiens
tcccaggccacacttggggaac

SEQ ID NO: 64949 - DNA, 22 bp, Homo sapiens
caggaaagggatgggctgccac

SEQ ID NO: 64950 - DNA, 22 bp, Homo sapiens
cctacagttatattcttgattg

SEQ ID NO: 64951 - DNA, 20 bp, Homo sapiens
gctctgtggtttgagtctcc

SEQ ID NO: 64952 - DNA, 22 bp, Homo sapiens
gctctctgcagcctccttggag

SEQ ID NO: 64953 - DNA, 22 bp, Homo sapiens
ttgaggcaggtccgggtccttc

SEQ ID NO: 64954 - DNA, 22 bp, Homo sapiens
ggcctttgcgtccacgccgctt

SEQ ID NO: 64955 - DNA, 22 bp, Homo sapiens
gcttggccagcagccgggatgc

SEQ ID NO: 64956 - DNA, 22 bp, Homo sapiens
acccaggctggagtgcagtggg

SEQ ID NO: 64957 - DNA, 22 bp, Homo sapiens
gcaggtctatcaggctgcaggt

SEQ ID NO: 64958 - DNA, 22 bp, Homo sapiens
tcacccaggctggactgcagtg

SEQ ID NO: 64959 - DNA, 18 bp, Homo sapiens
gaggtagataagattttc

SEQ ID NO: 64960 - DNA, 22 bp, Homo sapiens
gtggagaggaacccagctctgt

SEQ ID NO: 64961 - DNA, 22 bp, Homo sapiens
ggaggcagaatagagtgtgggt

SEQ ID NO: 64962 - DNA, 22 bp, Homo sapiens
ttctttcagaacacaagtgatt

SEQ ID NO: 64963 - DNA, 22 bp, Homo sapiens
tagaataatctgaggaaatgct

SEQ ID NO: 64964 - DNA, 22 bp, Homo sapiens
tctagttctagatccctgagga

SEQ ID NO: 64965 - DNA, 22 bp, Homo sapiens
gcccagagttcaaggctgcagt

SEQ ID NO: 64966 - DNA, 22 bp, Homo sapiens
taggcccctagtgccacgtggc

SEQ ID NO: 64967 - DNA, 22 bp, Homo sapiens
ttggggccgggataaggttgtt

SEQ ID NO: 64968 - DNA, 22 bp, Homo sapiens
tgcctcagctgaggccgctcca

SEQ ID NO: 64969 - DNA, 22 bp, Homo sapiens
gtgcttccatctagagggtcac

SEQ ID NO: 64970 - DNA, 22 bp, Homo sapiens
tacagtgcttggtatctagtaa

SEQ ID NO: 64971 - DNA, 21 bp, Homo sapiens
ctgtggtacagctgggacgga

SEQ ID NO: 64972 - DNA, 22 bp, Homo sapiens
atttacaggtagaattttaagt

SEQ ID NO: 64973 - DNA, 22 bp, Homo sapiens
ctgggctcaagtgatccaccca

SEQ ID NO: 64974 - DNA, 22 bp, Homo sapiens
gacggagctggttgctgcggct

SEQ ID NO: 64975 - DNA, 22 bp, Homo sapiens
tctgtgagaaccagtgccaggg

SEQ ID NO: 64976 - DNA, 22 bp, Homo sapiens
agggaattcactggaacgccct

SEQ ID NO: 64977 - DNA, 22 bp, Homo sapiens
ccagactgcttgcttcccagcc

SEQ ID NO: 64978 - DNA, 22 bp, Homo sapiens
gtgtgtccaaggcacggatgac

SEQ ID NO: 64979 - DNA, 22 bp, Homo sapiens
gccctgccctctcggcactcgc

SEQ ID NO: 64980 - DNA, 22 bp, Homo sapiens
ctgaacttattgagtgcttgct

SEQ ID NO: 64981 - DNA, 22 bp, Homo sapiens
aagtgctgggattacaggtgtg

SEQ ID NO: 64982 - DNA, 23 bp, Homo sapiens
ttgtcctctggatcggtttggtt

SEQ ID NO: 64983 - DNA, 22 bp, Homo sapiens
ctggagggctgcagcgaggctg

SEQ ID NO: 64984 - DNA, 22 bp, Homo sapiens
cccaggaggttgaggctgcagt

SEQ ID NO: 64985 - DNA, 22 bp, Homo sapiens
ttgtgggggctgccctgtacgg

SEQ ID NO: 64986 - DNA, 22 bp, Homo sapiens
aggtctcttgctgtctctgggc

SEQ ID NO: 64987 - DNA, 22 bp, Homo sapiens
tacttttctataggtttgaaat

SEQ ID NO: 64988 - DNA, 22 bp, Homo sapiens
aatttaagagcatagctccaac

SEQ ID NO: 64989 - DNA, 22 bp, Homo sapiens
tgagcctgagttcaaggctgca

SEQ ID NO: 64990 - DNA, 22 bp, Homo sapiens
agagtactgcctcagttatgaa

SEQ ID NO: 64991 - DNA, 22 bp, Homo sapiens
tggttcctcaagcgctggcggc

SEQ ID NO: 64992 - DNA, 22 bp, Homo sapiens
agccctcttccagccagcacag

SEQ ID NO: 64993 - DNA, 22 bp, Homo sapiens
ggagagcagggaggctgctctg

SEQ ID NO: 64994 - DNA, 22 bp, Homo sapiens
gggcggggggagctggaatgaa

SEQ ID NO: 64995 - DNA, 22 bp, Homo sapiens
caggagatgacagggaagaacc

SEQ ID NO: 64996 - DNA, 22 bp, Homo sapiens
ggggctgaacctggaggtggtc

SEQ ID NO: 64997 - DNA, 22 bp, Homo sapiens
ggactgggaatcagggagatgc

SEQ ID NO: 64998 - DNA, 22 bp, Homo sapiens
gtcactcaggctggagttcagt

SEQ ID NO: 64999 - DNA, 22 bp, Homo sapiens
gcccgcgccagcctctccatct

SEQ ID NO: 65000 - DNA, 22 bp, Homo sapiens
ccaggaggttgaggctgcagtg

SEQ ID NO: 65001 - DNA, 22 bp, Homo sapiens
agaggctgcacttgctcatgat

SEQ ID NO: 65002 - DNA, 22 bp, Homo sapiens
agctggagatgagtgacgtgcc

SEQ ID NO: 65003 - DNA, 22 bp, Homo sapiens
tcgtctgtgaaattgggataag

SEQ ID NO: 65004 - DNA, 22 bp, Homo sapiens
ttactttaagggtgtcttatta

SEQ ID NO: 65005 - DNA, 22 bp, Homo sapiens
atgatggctaggctggttttga

SEQ ID NO: 65006 - DNA, 22 bp, Homo sapiens
ctcttagtaatgccatgaagca

SEQ ID NO: 65007 - DNA, 22 bp, Homo sapiens
aagacttgaccaggttgaaggc

SEQ ID NO: 65008 - DNA, 22 bp, Homo sapiens
aggctatttccactcttctcat

SEQ ID NO: 65009 - DNA, 22 bp, Homo sapiens
tgggtgctctgcgaccgtaggg

SEQ ID NO: 65010 - DNA, 22 bp, Homo sapiens
caccaggctggagtgcagtggc

SEQ ID NO: 65011 - DNA, 22 bp, Homo sapiens
ccaaagtgctgagattacaggt

SEQ ID NO: 65012 - DNA, 22 bp, Homo sapiens
ctagcctgggatttgaacttat

SEQ ID NO: 65013 - DNA, 22 bp, Homo sapiens
tgacatgtatatcttacgctat

SEQ ID NO: 65014 - DNA, 20 bp, Homo sapiens
tgtttactctagagggtaga

SEQ ID NO: 65015 - DNA, 22 bp, Homo sapiens
ttttctcttccctctggacctg

SEQ ID NO: 65016 - DNA, 22 bp, Homo sapiens
ggacaagcctgtgagtgggttt

SEQ ID NO: 65017 - DNA, 22 bp, Homo sapiens
caggctggagtgcagtggcgct

SEQ ID NO: 65018 - DNA, 22 bp, Homo sapiens
ccaggaggcagaagttgcagtg

SEQ ID NO: 65019 - DNA, 22 bp, Homo sapiens
cacttgttggtggtgaaatcac

SEQ ID NO: 65020 - DNA, 22 bp, Homo sapiens
caggtgttggaagggcagtggg

SEQ ID NO: 65021 - DNA, 22 bp, Homo sapiens
tgatcaaaacattactccacca

SEQ ID NO: 65022 - DNA, 22 bp, Homo sapiens
actgcaacctccgcctgccagg

SEQ ID NO: 65023 - DNA, 22 bp, Homo sapiens
cggtcaggtgcagcgttggcac

SEQ ID NO: 65024 - DNA, 22 bp, Homo sapiens
ccaccgccatggcgttgtacag

SEQ ID NO: 65025 - DNA, 22 bp, Homo sapiens
ttccctccatttcattttataa

SEQ ID NO: 65026 - DNA, 22 bp, Homo sapiens
agcccaggttgaggctgcagtg

SEQ ID NO: 65027 - DNA, 22 bp, Homo sapiens
tccgggcaactgaagggaggtt

SEQ ID NO: 65028 - DNA, 22 bp, Homo sapiens
gagagtgagatcctcctgggga

SEQ ID NO: 65029 - DNA, 22 bp, Homo sapiens
tcactgcaagctcctcctcctg

SEQ ID NO: 65030 - DNA, 22 bp, Homo sapiens
cttccttctcactagcagcgcc

SEQ ID NO: 65031 - DNA, 23 bp, Homo sapiens
ggagtgcaatggcgccatctcgg

SEQ ID NO: 65032 - DNA, 18 bp, Homo sapiens
atggtctcatactgggag

SEQ ID NO: 65033 - DNA, 22 bp, Homo sapiens
tcactgcactccagcctgggca

SEQ ID NO: 65034 - DNA, 22 bp, Homo sapiens
ctcctgaattgtccctcacagc

SEQ ID NO: 65035 - DNA, 22 bp, Homo sapiens
ggcagggcaggaaagtcaggaa

SEQ ID NO: 65036 - DNA, 22 bp, Homo sapiens
gaggctgaggcaggaggatcac

SEQ ID NO: 65037 - DNA, 22 bp, Homo sapiens
tacatgctccttatgagaatct

SEQ ID NO: 65038 - DNA, 23 bp, Homo sapiens
gacagagtgagaccttgtcttac

SEQ ID NO: 65039 - DNA, 22 bp, Homo sapiens
ggttcccggatctccgagtccc

SEQ ID NO: 65040 - DNA, 22 bp, Homo sapiens
gtcactgtatccaggttccagc

SEQ ID NO: 65041 - DNA, 22 bp, Homo sapiens
agcccaggctggagtgcagtgg

SEQ ID NO: 65042 - DNA, 22 bp, Homo sapiens
cagtggcgtgatctctgctcac

SEQ ID NO: 65043 - DNA, 22 bp, Homo sapiens
gctcccagtctgatggaggaga

SEQ ID NO: 65044 - DNA, 19 bp, Homo sapiens
agggaatccggctgaggga

SEQ ID NO: 65045 - DNA, 22 bp, Homo sapiens
ccagatgtccctctcaggtttg

SEQ ID NO: 65046 - DNA, 22 bp, Homo sapiens
taagcctgcatgaaccatgaga

SEQ ID NO: 65047 - DNA, 22 bp, Homo sapiens
ttccacggggctccccgctctt

SEQ ID NO: 65048 - DNA, 22 bp, Homo sapiens
ccaaagtgctgggattacaggt

SEQ ID NO: 65049 - DNA, 21 bp, Homo sapiens
gttcttgcaggatttccttcc

SEQ ID NO: 65050 - DNA, 22 bp, Homo sapiens
cacccaggctggagtgcagtga

SEQ ID NO: 65051 - DNA, 22 bp, Homo sapiens
gagctgggcctgcgagtgctgc

SEQ ID NO: 65052 - DNA, 22 bp, Homo sapiens
ggcgtttcaccatgttgaccag

SEQ ID NO: 65053 - DNA, 22 bp, Homo sapiens
atggctgcctgggcgctggccg

SEQ ID NO: 65054 - DNA, 22 bp, Homo sapiens
ggggccttggatctgtgccccg

SEQ ID NO: 65055 - DNA, 22 bp, Homo sapiens
gagcacagtaaagcagtgtcac

SEQ ID NO: 65056 - DNA, 22 bp, Homo sapiens
aaagcagggaaatctatttgca

SEQ ID NO: 65057 - DNA, 22 bp, Homo sapiens
tccagggccatctccatgaggc

SEQ ID NO: 65058 - DNA, 22 bp, Homo sapiens
gaggctggacgtgcatttctac

SEQ ID NO: 65059 - DNA, 22 bp, Homo sapiens
tcctcagaatcacctggcagct

SEQ ID NO: 65060 - DNA, 22 bp, Homo sapiens
atcatcatgcccacttgagact

SEQ ID NO: 65061 - DNA, 22 bp, Homo sapiens
acacggcactttaggaaggggc

SEQ ID NO: 65062 - DNA, 21 bp, Homo sapiens
ccaccaggtcttctgctcggg

SEQ ID NO: 65063 - DNA, 22 bp, Homo sapiens
gcgaggaggggtgctgggcccc

SEQ ID NO: 65064 - DNA, 22 bp, Homo sapiens
ggctgccttccctgagccccgg

SEQ ID NO: 65065 - DNA, 18 bp, Homo sapiens
gctctgcaggtgctcggt

SEQ ID NO: 65066 - DNA, 22 bp, Homo sapiens
tgaggctccttgtagagagtgg

SEQ ID NO: 65067 - DNA, 19 bp, Homo sapiens
ctgctgccggagactcgtc

SEQ ID NO: 65068 - DNA, 22 bp, Homo sapiens
tctgcaacagtgccctgtaaat

SEQ ID NO: 65069 - DNA, 22 bp, Homo sapiens
ccaggagttggaagctgccatg

SEQ ID NO: 65070 - DNA, 22 bp, Homo sapiens
tcttgggcatgtgtttgatttc

SEQ ID NO: 65071 - DNA, 22 bp, Homo sapiens
ctccaggctcgtccaagatcga

SEQ ID NO: 65072 - DNA, 21 bp, Homo sapiens
cagaggcctatcacagactcc

SEQ ID NO: 65073 - DNA, 22 bp, Homo sapiens
cacccaggctggagagcagtgg

SEQ ID NO: 65074 - DNA, 22 bp, Homo sapiens
catagcggtattccacgtggtt

SEQ ID NO: 65075 - DNA, 22 bp, Homo sapiens
gaattcttttctttctgaaagt

SEQ ID NO: 65076 - DNA, 22 bp, Homo sapiens
attgttcaatgtaataattttg

SEQ ID NO: 65077 - DNA, 22 bp, Homo sapiens
tgttccagatttagccaaccga

SEQ ID NO: 65078 - DNA, 22 bp, Homo sapiens
ttgagcaggatggctatgcaca

SEQ ID NO: 65079 - DNA, 22 bp, Homo sapiens
gactggaaagcctgtcctcaga

SEQ ID NO: 65080 - DNA, 23 bp, Homo sapiens
actcgtggaattctctgcgatcg

SEQ ID NO: 65081 - DNA, 22 bp, Homo sapiens
agcatggccatctgggccgtcc

SEQ ID NO: 65082 - DNA, 22 bp, Homo sapiens
ggcctgcctcacagtcagcacc

SEQ ID NO: 65083 - DNA, 20 bp, Homo sapiens
tgtcattcttctttcacagg

SEQ ID NO: 65084 - DNA, 22 bp, Homo sapiens
actgtgtgccaggcgctggtct

SEQ ID NO: 65085 - DNA, 22 bp, Homo sapiens
cacagtcctgccagagggcctt

SEQ ID NO: 65086 - DNA, 22 bp, Homo sapiens
tctttctacatcatttgcttct

SEQ ID NO: 65087 - DNA, 22 bp, Homo sapiens
gagctcattcattcattgcctg

SEQ ID NO: 65088 - DNA, 22 bp, Homo sapiens
tttctcctcatgactggttgtg

SEQ ID NO: 65089 - DNA, 22 bp, Homo sapiens
cactgcacttcagcctgggtga

SEQ ID NO: 65090 - DNA, 22 bp, Homo sapiens
ggtttgttggggtccaggccca

SEQ ID NO: 65091 - DNA, 22 bp, Homo sapiens
tgtaggagtccaatcaggagac

SEQ ID NO: 65092 - DNA, 23 bp, Homo sapiens
aaactacaacgccaggcactgag

SEQ ID NO: 65093 - DNA, 22 bp, Homo sapiens
gtccctgataagagccatcgat

SEQ ID NO: 65094 - DNA, 22 bp, Homo sapiens
attaatgaaactttggttaagc

SEQ ID NO: 65095 - DNA, 22 bp, Homo sapiens
gcaggcattagcccccatggct

SEQ ID NO: 65096 - DNA, 22 bp, Homo sapiens
tggcactgaagctggaaagcct

SEQ ID NO: 65097 - DNA, 22 bp, Homo sapiens
cttgcctacttgtcaaccagca

SEQ ID NO: 65098 - DNA, 22 bp, Homo sapiens
ttggagatatcacaccttcaca

SEQ ID NO: 65099 - DNA, 22 bp, Homo sapiens
tcacttagatggggatcatcac

SEQ ID NO: 65100 - DNA, 22 bp, Homo sapiens
gttgaggagcaagcatgtgtct

SEQ ID NO: 65101 - DNA, 22 bp, Homo sapiens
agtggcacaattttgactcccc

SEQ ID NO: 65102 - DNA, 22 bp, Homo sapiens
tgtctttgttattgtggacagg

SEQ ID NO: 65103 - DNA, 22 bp, Homo sapiens
ctagggtgtgcagattttgcct

SEQ ID NO: 65104 - DNA, 22 bp, Homo sapiens
agcccttggtattttccgatcc

SEQ ID NO: 65105 - DNA, 22 bp, Homo sapiens
aggcaggaggatcatggatgca

SEQ ID NO: 65106 - DNA, 22 bp, Homo sapiens
ttctgattgctgatgaggccca

SEQ ID NO: 65107 - DNA, 23 bp, Homo sapiens
caggagatggctgctgtgtcagc

SEQ ID NO: 65108 - DNA, 22 bp, Homo sapiens
attgaaaataaggccagaaaca

SEQ ID NO: 65109 - DNA, 18 bp, Homo sapiens
gatcgggggcgccccaag

SEQ ID NO: 65110 - DNA, 22 bp, Homo sapiens
attacctatttcattttctgtc

SEQ ID NO: 65111 - DNA, 22 bp, Homo sapiens
tctgcaggaagctggcggctga

SEQ ID NO: 65112 - DNA, 22 bp, Homo sapiens
tgtttcttacgtttttagaggc

SEQ ID NO: 65113 - DNA, 22 bp, Homo sapiens
ttacaaagtttaaggtggcact

SEQ ID NO: 65114 - DNA, 22 bp, Homo sapiens
gagcctggagctggaacgaagc

SEQ ID NO: 65115 - DNA, 22 bp, Homo sapiens
tggcacgacaattggcaccaat

SEQ ID NO: 65116 - DNA, 22 bp, Homo sapiens
gcagctgacatctggctgggcc

SEQ ID NO: 65117 - DNA, 22 bp, Homo sapiens
ggctcaggcctgtaatcctagc

SEQ ID NO: 65118 - DNA, 22 bp, Homo sapiens
gaggggagcccccatcctccag

SEQ ID NO: 65119 - DNA, 22 bp, Homo sapiens
acagagcaatgcgtgttctcta

SEQ ID NO: 65120 - DNA, 22 bp, Homo sapiens
gggctgagacgatggggtcttc

SEQ ID NO: 65121 - DNA, 22 bp, Homo sapiens
tgctgctgaggctaaagtatag

SEQ ID NO: 65122 - DNA, 22 bp, Homo sapiens
ctggcaggttatagagctgccc

SEQ ID NO: 65123 - DNA, 22 bp, Homo sapiens
actgtgtgtttgtctagcacag

SEQ ID NO: 65124 - DNA, 22 bp, Homo sapiens
gcgagtgccgagagggcagggc

SEQ ID NO: 65125 - DNA, 22 bp, Homo sapiens
tcggagctgtagatgaaaccct

SEQ ID NO: 65126 - DNA, 22 bp, Homo sapiens
acagcagagcctggtacttact

SEQ ID NO: 65127 - DNA, 22 bp, Homo sapiens
cgtgccctgcgcaagtgctgct

SEQ ID NO: 65128 - DNA, 22 bp, Homo sapiens
ttcagcttgctgactgcggcag

SEQ ID NO: 65129 - DNA, 18 bp, Homo sapiens
ttcacaagggcttggttt

SEQ ID NO: 65130 - DNA, 22 bp, Homo sapiens
cccagggaggcccaggctctgc

SEQ ID NO: 65131 - DNA, 22 bp, Homo sapiens
aaagtgctgagattacaagcgt

SEQ ID NO: 65132 - DNA, 21 bp, Homo sapiens
acatggactgtgaatggggac

SEQ ID NO: 65133 - DNA, 22 bp, Homo sapiens
gatggcacacagacatccccgc

SEQ ID NO: 65134 - DNA, 22 bp, Homo sapiens
tttaaaaaactagtctgagtct

SEQ ID NO: 65135 - DNA, 22 bp, Homo sapiens
gcctcctgagtagctgggattg

SEQ ID NO: 65136 - DNA, 22 bp, Homo sapiens
ctgagctcaagcgatcctccca

SEQ ID NO: 65137 - DNA, 22 bp, Homo sapiens
ggccagcctggggctcccagac

SEQ ID NO: 65138 - DNA, 22 bp, Homo sapiens
gccagttttctgaggattaagt

SEQ ID NO: 65139 - DNA, 22 bp, Homo sapiens
tgcctaggctggagtgtagtgg

SEQ ID NO: 65140 - DNA, 22 bp, Homo sapiens
ttatttaatgtgatctgaagag

SEQ ID NO: 65141 - DNA, 22 bp, Homo sapiens
ctccagttggccccagttggtt

SEQ ID NO: 65142 - DNA, 22 bp, Homo sapiens
tataactacttgaagagttcag

SEQ ID NO: 65143 - DNA, 22 bp, Homo sapiens
agcaacctgccagtcactcagt

SEQ ID NO: 65144 - DNA, 22 bp, Homo sapiens
tctgagaatggtggatgtggtg

SEQ ID NO: 65145 - DNA, 22 bp, Homo sapiens
tagcccctgcctttgaacctgg

SEQ ID NO: 65146 - DNA, 22 bp, Homo sapiens
ctccttctgggcctggcagtgg

SEQ ID NO: 65147 - DNA, 22 bp, Homo sapiens
aatggccagacagatggctgct

SEQ ID NO: 65148 - DNA, 22 bp, Homo sapiens
aacccaggagacaggttgcagt

SEQ ID NO: 65149 - DNA, 22 bp, Homo sapiens
acccagggctcaagcgtaggca

SEQ ID NO: 65150 - DNA, 22 bp, Homo sapiens
gggcttggcacatgggctcagc

SEQ ID NO: 65151 - DNA, 22 bp, Homo sapiens
tatgtgtttgacaccctgcaag

SEQ ID NO: 65152 - DNA, 22 bp, Homo sapiens
gacaagctcccggtggccctcc

SEQ ID NO: 65153 - DNA, 22 bp, Homo sapiens
tagaagaaagtgaagctgggga

SEQ ID NO: 65154 - DNA, 22 bp, Homo sapiens
cccaggaggtggaggctgcagt

SEQ ID NO: 65155 - DNA, 21 bp, Homo sapiens
aaggacgaggttttgattaca

SEQ ID NO: 65156 - DNA, 22 bp, Homo sapiens
gcaggctgtctaaagttagagt

SEQ ID NO: 65157 - DNA, 22 bp, Homo sapiens
tcaccaggctagagtgcagtgg

SEQ ID NO: 65158 - DNA, 22 bp, Homo sapiens
tagatgaccttgtgttaggcaa

SEQ ID NO: 65159 - DNA, 22 bp, Homo sapiens
tagattcagatatttaggacaa

SEQ ID NO: 65160 - DNA, 22 bp, Homo sapiens
aggaggggttctcgggtgctga

SEQ ID NO: 65161 - DNA, 22 bp, Homo sapiens
acagcagcaatagcagtgacat

SEQ ID NO: 65162 - DNA, 22 bp, Homo sapiens
ccaggagtgcagggatggtatc

SEQ ID NO: 65163 - DNA, 22 bp, Homo sapiens
ccaggagctggagggtgcagtg

SEQ ID NO: 65164 - DNA, 22 bp, Homo sapiens
gtagggttggagagcacaacca

SEQ ID NO: 65165 - DNA, 18 bp, Homo sapiens
tcaaatactttgggcagt

SEQ ID NO: 65166 - DNA, 17 bp, Homo sapiens
tggctctgtcctcagct

SEQ ID NO: 65167 - DNA, 22 bp, Homo sapiens
acaagcgggccacagtgctggt

SEQ ID NO: 65168 - DNA, 22 bp, Homo sapiens
attggtagttttgtatttctct

SEQ ID NO: 65169 - DNA, 22 bp, Homo sapiens
gctgctttgtctgtaaaatgga

SEQ ID NO: 65170 - DNA, 22 bp, Homo sapiens
cactgcaatatctgcatcctgg

SEQ ID NO: 65171 - DNA, 22 bp, Homo sapiens
tccagcttataggtagatttaa

SEQ ID NO: 65172 - DNA, 22 bp, Homo sapiens
gccccagcctcccgagtagctg

SEQ ID NO: 65173 - DNA, 18 bp, Homo sapiens
tccctcagaattatagaa

SEQ ID NO: 65174 - DNA, 22 bp, Homo sapiens
tgagatcattgacttgttcctg

SEQ ID NO: 65175 - DNA, 22 bp, Homo sapiens
aaagtgctgggattacaggtgt

SEQ ID NO: 65176 - DNA, 22 bp, Homo sapiens
cagagcccctcgtctccaccac

SEQ ID NO: 65177 - DNA, 22 bp, Homo sapiens
tgacttcctgcactcaggtgat

SEQ ID NO: 65178 - DNA, 20 bp, Homo sapiens
aagacaccagtggcagcccc

SEQ ID NO: 65179 - DNA, 22 bp, Homo sapiens
ggcctcgcggcttctggtggct

SEQ ID NO: 65180 - DNA, 22 bp, Homo sapiens
gaggcagaagttgcagtgagca

SEQ ID NO: 65181 - DNA, 22 bp, Homo sapiens
gacaggtgctaagggacctggc

SEQ ID NO: 65182 - DNA, 22 bp, Homo sapiens
ttatttaaaagtggtaagattc

SEQ ID NO: 65183 - DNA, 22 bp, Homo sapiens
tcgcaccattgcactccagcca

SEQ ID NO: 65184 - DNA, 22 bp, Homo sapiens
ggggccgaccgcggttcaggcc

SEQ ID NO: 65185 - DNA, 22 bp, Homo sapiens
tcacgtgagggacctgtgtctg

SEQ ID NO: 65186 - DNA, 22 bp, Homo sapiens
ccgtggtcacctgagctccttg

SEQ ID NO: 65187 - DNA, 22 bp, Homo sapiens
cggagtcttgctatgttgccca

SEQ ID NO: 65188 - DNA, 22 bp, Homo sapiens
aaatgtaagtctttgtttctta

SEQ ID NO: 65189 - DNA, 22 bp, Homo sapiens
agaaaatttaaagagacacaca

SEQ ID NO: 65190 - DNA, 22 bp, Homo sapiens
cacagacagtgtccctttgttg

SEQ ID NO: 65191 - DNA, 22 bp, Homo sapiens
gctgcagggagctggaaggctc

SEQ ID NO: 65192 - DNA, 22 bp, Homo sapiens
tgcagaaacaagccatcattca

SEQ ID NO: 65193 - DNA, 22 bp, Homo sapiens
ttttctagggtgctaaatgaac

SEQ ID NO: 65194 - DNA, 22 bp, Homo sapiens
gcagagtgctgtcgtacgcccc

SEQ ID NO: 65195 - DNA, 22 bp, Homo sapiens
tccggtccgggtactcctctct

SEQ ID NO: 65196 - DNA, 22 bp, Homo sapiens
taatatctacttcatagagttt

SEQ ID NO: 65197 - DNA, 22 bp, Homo sapiens
gctgtggcctggcgcagagctg

SEQ ID NO: 65198 - DNA, 22 bp, Homo sapiens
ccatgtacatgaacacggcggc

SEQ ID NO: 65199 - DNA, 22 bp, Homo sapiens
tccctgatgccttgatccgtgg

SEQ ID NO: 65200 - DNA, 22 bp, Homo sapiens
ggagtgctttgaagccttcatt

SEQ ID NO: 65201 - DNA, 22 bp, Homo sapiens
gggacaatggaggcctctctcc

SEQ ID NO: 65202 - DNA, 19 bp, Homo sapiens
agtcctggcctgggggacc

SEQ ID NO: 65203 - DNA, 22 bp, Homo sapiens
cggctgggttcggctgcaggcc

SEQ ID NO: 65204 - DNA, 22 bp, Homo sapiens
actgcactccagcctgggtaac

SEQ ID NO: 65205 - DNA, 22 bp, Homo sapiens
cgagagatgggttggcaggggc

SEQ ID NO: 65206 - DNA, 22 bp, Homo sapiens
tataaagagtctcaaagaagtt

SEQ ID NO: 65207 - DNA, 22 bp, Homo sapiens
aaaatatgtataactcttctgc

SEQ ID NO: 65208 - DNA, 22 bp, Homo sapiens
taattataacatgctttctggc

SEQ ID NO: 65209 - DNA, 22 bp, Homo sapiens
atgaattgtccgatgttgtgca

SEQ ID NO: 65210 - DNA, 22 bp, Homo sapiens
tgctagtgtgtgagatgttcaa

SEQ ID NO: 65211 - DNA, 19 bp, Homo sapiens
ctgtccttggctgcactgt

SEQ ID NO: 65212 - DNA, 22 bp, Homo sapiens
tggggccatctcacccactgtt

SEQ ID NO: 65213 - DNA, 23 bp, Homo sapiens
cagagctggcttcatgggtgtgc

SEQ ID NO: 65214 - DNA, 22 bp, Homo sapiens
tcattccctcattgttcactgg

SEQ ID NO: 65215 - DNA, 18 bp, Homo sapiens
tttctcagactctctttc

SEQ ID NO: 65216 - DNA, 22 bp, Homo sapiens
ttgagaaccactgagttagata

SEQ ID NO: 65217 - DNA, 22 bp, Homo sapiens
ctgaggtgtgaaatggtggcaa

SEQ ID NO: 65218 - DNA, 22 bp, Homo sapiens
tcactgcaacctccacctcccg

SEQ ID NO: 65219 - DNA, 22 bp, Homo sapiens
tggttgcctctcagagattccg

SEQ ID NO: 65220 - DNA, 22 bp, Homo sapiens
ttcaccatgttggccaggctgg

SEQ ID NO: 65221 - DNA, 22 bp, Homo sapiens
tgctcccaaacctgacaggctc

SEQ ID NO: 65222 - DNA, 22 bp, Homo sapiens
gcgtctcaaggcccccaggcca

SEQ ID NO: 65223 - DNA, 22 bp, Homo sapiens
gtatgtgaggttggtttccagg

SEQ ID NO: 65224 - DNA, 19 bp, Homo sapiens
tgagggtgagctttggaga

SEQ ID NO: 65225 - DNA, 22 bp, Homo sapiens
gatggaggagatggcagggtgc

SEQ ID NO: 65226 - DNA, 22 bp, Homo sapiens
aggggaatgggtagactgttga

SEQ ID NO: 65227 - DNA, 22 bp, Homo sapiens
cactgcactccagcctgggtca

SEQ ID NO: 65228 - DNA, 22 bp, Homo sapiens
ccagcctggttcagaattggct

SEQ ID NO: 65229 - DNA, 22 bp, Homo sapiens
gtaatctcagctacttgggagg

SEQ ID NO: 65230 - DNA, 16 bp, Homo sapiens
atgctgctattagagg

SEQ ID NO: 65231 - DNA, 19 bp, Homo sapiens
atcccaaggagctgggact

SEQ ID NO: 65232 - DNA, 22 bp, Homo sapiens
gttgcctaggctggagtgcagt

SEQ ID NO: 65233 - DNA, 22 bp, Homo sapiens
tggggtgagattcagatattca

SEQ ID NO: 65234 - DNA, 22 bp, Homo sapiens
cctcttctaggacgtccttgtg

SEQ ID NO: 65235 - DNA, 22 bp, Homo sapiens
tccaggctttggggcaggagcg

SEQ ID NO: 65236 - DNA, 20 bp, Homo sapiens
aactcctagcctcaagtgat

SEQ ID NO: 65237 - DNA, 22 bp, Homo sapiens
gaccagtcattactcatgccct

SEQ ID NO: 65238 - DNA, 22 bp, Homo sapiens
agtgcattcctggggaagaagc

SEQ ID NO: 65239 - DNA, 22 bp, Homo sapiens
cacagagatggtctggcaggtg

SEQ ID NO: 65240 - DNA, 22 bp, Homo sapiens
ttctccacccactcttttgttg

SEQ ID NO: 65241 - DNA, 22 bp, Homo sapiens
agcatgcgcttgatcagctcca

SEQ ID NO: 65242 - DNA, 17 bp, Homo sapiens
tgtagcttctccttctc

SEQ ID NO: 65243 - DNA, 22 bp, Homo sapiens
atgtatacgtgcaggtcacagg

SEQ ID NO: 65244 - DNA, 22 bp, Homo sapiens
acagtgcttagcacagagtaga

SEQ ID NO: 65245 - DNA, 22 bp, Homo sapiens
ctgtgctccctctggcgccccg

SEQ ID NO: 65246 - DNA, 22 bp, Homo sapiens
caggccagggttgagaagagaa

SEQ ID NO: 65247 - DNA, 22 bp, Homo sapiens
ttacttaaacagaaatgcagaa

SEQ ID NO: 65248 - DNA, 22 bp, Homo sapiens
aagaaatgctgatgttggatgg

SEQ ID NO: 65249 - DNA, 22 bp, Homo sapiens
gaactttataactgtaaatgtc

SEQ ID NO: 65250 - DNA, 23 bp, Homo sapiens
aggttatgattatagagcgagga

SEQ ID NO: 65251 - DNA, 22 bp, Homo sapiens
gacgcatcaggaggcgaggagc

SEQ ID NO: 65252 - DNA, 22 bp, Homo sapiens
cccagttgttgccggctctgga

SEQ ID NO: 65253 - DNA, 22 bp, Homo sapiens
aattacagtcggagcagcactg

SEQ ID NO: 65254 - DNA, 22 bp, Homo sapiens
catgtgtgtctccaccagctgc

SEQ ID NO: 65255 - DNA, 22 bp, Homo sapiens
tgttttaagctctagaagggga

SEQ ID NO: 65256 - DNA, 22 bp, Homo sapiens
gtttacttgtgccttggcttaa

SEQ ID NO: 65257 - DNA, 22 bp, Homo sapiens
ttcctggtcactgctgttccct

SEQ ID NO: 65258 - DNA, 22 bp, Homo sapiens
ctccaccccgtgccggtgctgg

SEQ ID NO: 65259 - DNA, 22 bp, Homo sapiens
attggtggtgaggacatgccag

SEQ ID NO: 65260 - DNA, 18 bp, Homo sapiens
gatatggaaggccatgcc

SEQ ID NO: 65261 - DNA, 22 bp, Homo sapiens
tctgtggcccaagtgatggctg

SEQ ID NO: 65262 - DNA, 22 bp, Homo sapiens
catgcggctctttccaaaccgg

SEQ ID NO: 65263 - DNA, 22 bp, Homo sapiens
cattccttaacgtggggagtct

SEQ ID NO: 65264 - DNA, 23 bp, Homo sapiens
gtctctagagtgtggagcaaaga

SEQ ID NO: 65265 - DNA, 22 bp, Homo sapiens
aggggagagttaatgtgaatgt

SEQ ID NO: 65266 - DNA, 22 bp, Homo sapiens
gtctgctcatgctaccgcgggc

SEQ ID NO: 65267 - DNA, 22 bp, Homo sapiens
aaggcaggatgggaaaagattt

SEQ ID NO: 65268 - DNA, 21 bp, Homo sapiens
tggacttatggagtgtttctt

SEQ ID NO: 65269 - DNA, 22 bp, Homo sapiens
tgcgaccctagccccctcactt

SEQ ID NO: 65270 - DNA, 22 bp, Homo sapiens
tgcagtggcgccatctcagctc

SEQ ID NO: 65271 - DNA, 22 bp, Homo sapiens
ttgatcaaatcagctactgagg

SEQ ID NO: 65272 - DNA, 22 bp, Homo sapiens
ccaaagtgctgggattacaggc

SEQ ID NO: 65273 - DNA, 22 bp, Homo sapiens
gggaagtgatggagccaggatt

SEQ ID NO: 65274 - DNA, 22 bp, Homo sapiens
cccaggctggagtgcagtggcg

SEQ ID NO: 65275 - DNA, 22 bp, Homo sapiens
aatttgttataacttgggctga

SEQ ID NO: 65276 - DNA, 22 bp, Homo sapiens
gcagcaacgcggccctactgct

SEQ ID NO: 65277 - DNA, 22 bp, Homo sapiens
tcaaagatcagatggttgtagg

SEQ ID NO: 65278 - DNA, 22 bp, Homo sapiens
ttaaatattatgttgtctgcaa

SEQ ID NO: 65279 - DNA, 22 bp, Homo sapiens
gtcctgtgagattcatgctcaa

SEQ ID NO: 65280 - DNA, 22 bp, Homo sapiens
cattacagaatatgtaatgatc

SEQ ID NO: 65281 - DNA, 22 bp, Homo sapiens
cttttgattgagcagtttcaaa

SEQ ID NO: 65282 - DNA, 22 bp, Homo sapiens
tattttgtgccatgcactgcct

SEQ ID NO: 65283 - DNA, 23 bp, Homo sapiens
gctcatcaggcttagagtcaagg

SEQ ID NO: 65284 - DNA, 22 bp, Homo sapiens
ctggcctggcgcagtggctcac

SEQ ID NO: 65285 - DNA, 22 bp, Homo sapiens
cagcagcccacgcgtgctgtcc

SEQ ID NO: 65286 - DNA, 22 bp, Homo sapiens
tgagctgtagcagatgctgttg

SEQ ID NO: 65287 - DNA, 20 bp, Homo sapiens
tcacatcctctcccaacatg

SEQ ID NO: 65288 - DNA, 22 bp, Homo sapiens
ggagtgaatcactagatgcaga

SEQ ID NO: 65289 - DNA, 22 bp, Homo sapiens
gaagagctgacagtgtcatcct

SEQ ID NO: 65290 - DNA, 22 bp, Homo sapiens
gccttgccgctcagcagtgggg

SEQ ID NO: 65291 - DNA, 22 bp, Homo sapiens
tcacaaatgtttgcatgtgtct

SEQ ID NO: 65292 - DNA, 22 bp, Homo sapiens
ccctgccttgtctgggctaggt

SEQ ID NO: 65293 - DNA, 21 bp, Homo sapiens
tcttttctcagctttgtggtt

SEQ ID NO: 65294 - DNA, 22 bp, Homo sapiens
ggtaccaccaattcagctgcca

SEQ ID NO: 65295 - DNA, 22 bp, Homo sapiens
tggcgcgacgtgccccctgctt

SEQ ID NO: 65296 - DNA, 22 bp, Homo sapiens
attcacagggggagaagggtat

SEQ ID NO: 65297 - DNA, 23 bp, Homo sapiens
gtgcgccaggacaacctgacgga

SEQ ID NO: 65298 - DNA, 22 bp, Homo sapiens
ctacttgttcactgtaggtcgc

SEQ ID NO: 65299 - DNA, 22 bp, Homo sapiens
tgtccccacccaaatctcatct

SEQ ID NO: 65300 - DNA, 22 bp, Homo sapiens
tgggtagtttcccctgccctgc

SEQ ID NO: 65301 - DNA, 22 bp, Homo sapiens
tactaattgttcacacttgttt

SEQ ID NO: 65302 - DNA, 22 bp, Homo sapiens
gtgaccatcatctcagctagtt

SEQ ID NO: 65303 - DNA, 22 bp, Homo sapiens
gtgtcaataaatagcggtgtgg

SEQ ID NO: 65304 - DNA, 20 bp, Homo sapiens
tttcaccatcttggccaggc

SEQ ID NO: 65305 - DNA, 22 bp, Homo sapiens
taatttcagtgcaagctcacgg

SEQ ID NO: 65306 - DNA, 23 bp, Homo sapiens
gcctgggagttgcgatctgcccg

SEQ ID NO: 65307 - DNA, 22 bp, Homo sapiens
ttggccatctaagcccagccac

SEQ ID NO: 65308 - DNA, 22 bp, Homo sapiens
atgccacttcattccagcctcg

SEQ ID NO: 65309 - DNA, 22 bp, Homo sapiens
cactaggctggagtgcagtggc

SEQ ID NO: 65310 - DNA, 22 bp, Homo sapiens
acccaggagacggaggtgcagt

SEQ ID NO: 65311 - DNA, 22 bp, Homo sapiens
atagaatatgacttttagatcc

SEQ ID NO: 65312 - DNA, 22 bp, Homo sapiens
tgaactcctgacctcatgatcc

SEQ ID NO: 65313 - DNA, 22 bp, Homo sapiens
aggggtgaaagagggccctcaa

SEQ ID NO: 65314 - DNA, 17 bp, Homo sapiens
caggtgttctgtttttc

SEQ ID NO: 65315 - DNA, 20 bp, Homo sapiens
caggtccagcacgtgcacgg

SEQ ID NO: 65316 - DNA, 22 bp, Homo sapiens
tcttcacgccaagtgcccctca

SEQ ID NO: 65317 - DNA, 22 bp, Homo sapiens
ctcagcactgacccaggagatg

SEQ ID NO: 65318 - DNA, 22 bp, Homo sapiens
tagatagattctcctatagagt

SEQ ID NO: 65319 - DNA, 22 bp, Homo sapiens
cctcggctgggccttggccact

SEQ ID NO: 65320 - DNA, 22 bp, Homo sapiens
cactgctacctctgcctcccgg

SEQ ID NO: 65321 - DNA, 22 bp, Homo sapiens
caggaagctgtgaaggagacgg

SEQ ID NO: 65322 - DNA, 22 bp, Homo sapiens
accccagaggcggaggctgcag

SEQ ID NO: 65323 - DNA, 22 bp, Homo sapiens
ctcattgcccagatccccacag

SEQ ID NO: 65324 - DNA, 22 bp, Homo sapiens
agatttctgggcttcaccacct

SEQ ID NO: 65325 - DNA, 22 bp, Homo sapiens
cccagttttctgattgaagagc

SEQ ID NO: 65326 - DNA, 22 bp, Homo sapiens
gggcagagactcagaaacagaa

SEQ ID NO: 65327 - DNA, 22 bp, Homo sapiens
ccaggttggagttcagtggcgc

SEQ ID NO: 65328 - DNA, 22 bp, Homo sapiens
ccagggtggcgtagatgctggg

SEQ ID NO: 65329 - DNA, 22 bp, Homo sapiens
caggaggagggcagccgcctcc

SEQ ID NO: 65330 - DNA, 22 bp, Homo sapiens
tggtagtcggcctcggtggctc

SEQ ID NO: 65331 - DNA, 22 bp, Homo sapiens
aaggctgaggcagtgaggcaga

SEQ ID NO: 65332 - DNA, 22 bp, Homo sapiens
tgagacaggcttccttcttggg

SEQ ID NO: 65333 - DNA, 22 bp, Homo sapiens
ctttatgaaaacctgaattatg

SEQ ID NO: 65334 - DNA, 23 bp, Homo sapiens
ccaagactgttaggagtggggag

SEQ ID NO: 65335 - DNA, 22 bp, Homo sapiens
atgctaaggcccaggagaaaat

SEQ ID NO: 65336 - DNA, 22 bp, Homo sapiens
gatttttatataaagtgagaaa

SEQ ID NO: 65337 - DNA, 22 bp, Homo sapiens
tgccaggcgtggtggtgcgcac

SEQ ID NO: 65338 - DNA, 22 bp, Homo sapiens
gcgagggcacgcggttgaaggc

SEQ ID NO: 65339 - DNA, 22 bp, Homo sapiens
cttggaggtggaagttgcagtg

SEQ ID NO: 65340 - DNA, 22 bp, Homo sapiens
ctggcaggagcattcacagagg

SEQ ID NO: 65341 - DNA, 22 bp, Homo sapiens
tttctgagaaattaaacacttt

SEQ ID NO: 65342 - DNA, 21 bp, Homo sapiens
agcctcaggttgttggttctt

SEQ ID NO: 65343 - DNA, 22 bp, Homo sapiens
tggcaagaactgcaattgcttt

SEQ ID NO: 65344 - DNA, 22 bp, Homo sapiens
actgtctagttctcttttctaa

SEQ ID NO: 65345 - DNA, 22 bp, Homo sapiens
aaggctccagtgaatgctggca

SEQ ID NO: 65346 - DNA, 22 bp, Homo sapiens
ctgtaatcccagctacctggga

SEQ ID NO: 65347 - DNA, 22 bp, Homo sapiens
accctactaaatgtggtatgtc

SEQ ID NO: 65348 - DNA, 23 bp, Homo sapiens
ggaagctcacgtagtcctgcact

SEQ ID NO: 65349 - DNA, 22 bp, Homo sapiens
ggaggacaggggctgcagcaca

SEQ ID NO: 65350 - DNA, 22 bp, Homo sapiens
cgcaccactgaattccagcctg

SEQ ID NO: 65351 - DNA, 22 bp, Homo sapiens
aagccgggcctgagaaatgaca

SEQ ID NO: 65352 - DNA, 22 bp, Homo sapiens
caaagttgcagttatgtgatta

SEQ ID NO: 65353 - DNA, 22 bp, Homo sapiens
gtgcgcttcttcctgagccagg

SEQ ID NO: 65354 - DNA, 22 bp, Homo sapiens
ctgggatccacgggctcccaag

SEQ ID NO: 65355 - DNA, 22 bp, Homo sapiens
ggcagggagtggagactcccta

SEQ ID NO: 65356 - DNA, 22 bp, Homo sapiens
gcccaggctggagtgcagtggt

SEQ ID NO: 65357 - DNA, 22 bp, Homo sapiens
tgttattctagtggatcacgtc

SEQ ID NO: 65358 - DNA, 22 bp, Homo sapiens
gaggcaggaggattgcttgagc

SEQ ID NO: 65359 - DNA, 22 bp, Homo sapiens
gccgccgctgtgcaatttagca

SEQ ID NO: 65360 - DNA, 22 bp, Homo sapiens
tgtgactggttgtcccgctttc

SEQ ID NO: 65361 - DNA, 22 bp, Homo sapiens
ttcctagggcagagccgctggg

SEQ ID NO: 65362 - DNA, 22 bp, Homo sapiens
aacagcttgctgcaccttaata

SEQ ID NO: 65363 - DNA, 22 bp, Homo sapiens
tgtgctctgactttctcctggt

SEQ ID NO: 65364 - DNA, 22 bp, Homo sapiens
tgtctgttattggtgtataaga

SEQ ID NO: 65365 - DNA, 22 bp, Homo sapiens
aggggaggtgtccccaaatctc

SEQ ID NO: 65366 - DNA, 20 bp, Homo sapiens
tttgagaccagtctgcccaa

SEQ ID NO: 65367 - DNA, 22 bp, Homo sapiens
tctgccttgtttgagctttgac

SEQ ID NO: 65368 - DNA, 22 bp, Homo sapiens
tacttttagcctatttgattct

SEQ ID NO: 65369 - DNA, 22 bp, Homo sapiens
atatatttgagaatattcatga

SEQ ID NO: 65370 - DNA, 22 bp, Homo sapiens
agggtgaatctcacaactctta

SEQ ID NO: 65371 - DNA, 22 bp, Homo sapiens
gctgctgggatcctgggtctca

SEQ ID NO: 65372 - DNA, 22 bp, Homo sapiens
tgtctggtgggttgacaggcag

SEQ ID NO: 65373 - DNA, 22 bp, Homo sapiens
atacctgtgtatccacaagcgt

SEQ ID NO: 65374 - DNA, 22 bp, Homo sapiens
ccgcccacactaaatatgagcg

SEQ ID NO: 65375 - DNA, 22 bp, Homo sapiens
ctgaggcaggatggcctggctg

SEQ ID NO: 65376 - DNA, 22 bp, Homo sapiens
catgatctggtcctactgtggg

SEQ ID NO: 65377 - DNA, 22 bp, Homo sapiens
cacttcattgggaccagggctg

SEQ ID NO: 65378 - DNA, 22 bp, Homo sapiens
gcgggttgaagggcgcatcgaa

SEQ ID NO: 65379 - DNA, 22 bp, Homo sapiens
atgatactctaggtgatttaca

SEQ ID NO: 65380 - DNA, 22 bp, Homo sapiens
ctgggaggcggaggttgcagtg

SEQ ID NO: 65381 - DNA, 22 bp, Homo sapiens
tcaggggcttgaggtgcatgtc

SEQ ID NO: 65382 - DNA, 22 bp, Homo sapiens
gtcaccttgaacaggctactca

SEQ ID NO: 65383 - DNA, 22 bp, Homo sapiens
cccaggctggagtgtaatggtg

SEQ ID NO: 65384 - DNA, 19 bp, Homo sapiens
tcctggggaggggcatggc

SEQ ID NO: 65385 - DNA, 22 bp, Homo sapiens
tcacccaggctggagtgcagtg

SEQ ID NO: 65386 - DNA, 22 bp, Homo sapiens
gaggtaggtgtaggaggcctgc

SEQ ID NO: 65387 - DNA, 22 bp, Homo sapiens
aaagcactgcacatatatttgc

SEQ ID NO: 65388 - DNA, 17 bp, Homo sapiens
gggcagggactcctggg

SEQ ID NO: 65389 - DNA, 21 bp, Homo sapiens
aggcatgagccctgcatggac

SEQ ID NO: 65390 - DNA, 22 bp, Homo sapiens
gggagctggagctggaagactc

SEQ ID NO: 65391 - DNA, 22 bp, Homo sapiens
ccaggagttggaggctgcagtg

SEQ ID NO: 65392 - DNA, 22 bp, Homo sapiens
tcattacaagatttccaatttg

SEQ ID NO: 65393 - DNA, 22 bp, Homo sapiens
tggagaattctatgttgagggg

SEQ ID NO: 65394 - DNA, 22 bp, Homo sapiens
tttctggcagcgggacaggggt

SEQ ID NO: 65395 - DNA, 22 bp, Homo sapiens
ttgagggtctggatctgctgct

SEQ ID NO: 65396 - DNA, 23 bp, Homo sapiens
gggggccgtcctggggattatag

SEQ ID NO: 65397 - DNA, 22 bp, Homo sapiens
cttcaggggtgttagttttgtg

SEQ ID NO: 65398 - DNA, 22 bp, Homo sapiens
cgggttcacgccattctcctgc

SEQ ID NO: 65399 - DNA, 22 bp, Homo sapiens
ggaggaggggtgactgaatgct

SEQ ID NO: 65400 - DNA, 22 bp, Homo sapiens
tgttgactcaacactgtgggca

SEQ ID NO: 65401 - DNA, 22 bp, Homo sapiens
ttcatatttctttaaggacttt

SEQ ID NO: 65402 - DNA, 22 bp, Homo sapiens
gatgatcatctgtaaagttaga

SEQ ID NO: 65403 - DNA, 22 bp, Homo sapiens
tacatagctcctagtgatgcat

SEQ ID NO: 65404 - DNA, 22 bp, Homo sapiens
ttcccttaaattatggcatcta

SEQ ID NO: 65405 - DNA, 22 bp, Homo sapiens
cggaggttgaggctgcagtgag

SEQ ID NO: 65406 - DNA, 22 bp, Homo sapiens
gcaggtggatcaccacgtcagg

SEQ ID NO: 65407 - DNA, 22 bp, Homo sapiens
caggctggagtgcagtggggcg

SEQ ID NO: 65408 - DNA, 22 bp, Homo sapiens
ggtttattgttaataagtttga

SEQ ID NO: 65409 - DNA, 22 bp, Homo sapiens
gagccaggggtcagctccgagg

SEQ ID NO: 65410 - DNA, 19 bp, Homo sapiens
ggggcctgtgatggtcaca

SEQ ID NO: 65411 - DNA, 22 bp, Homo sapiens
tctgctctgtggcttcagctaa

SEQ ID NO: 65412 - DNA, 20 bp, Homo sapiens
aggggcacctgcgacggggc

SEQ ID NO: 65413 - DNA, 22 bp, Homo sapiens
ttggttttgaaatagcttattg

SEQ ID NO: 65414 - DNA, 22 bp, Homo sapiens
tgggtgagcggctgcacacccg

SEQ ID NO: 65415 - DNA, 21 bp, Homo sapiens
caatggcgagatcttggctca

SEQ ID NO: 65416 - DNA, 22 bp, Homo sapiens
ggagacagggttgaaccacgca

SEQ ID NO: 65417 - DNA, 22 bp, Homo sapiens
ggagatatttgtattctgtctc

SEQ ID NO: 65418 - DNA, 22 bp, Homo sapiens
tccataaattttatgaacatat

SEQ ID NO: 65419 - DNA, 22 bp, Homo sapiens
ctcctccacccgctggggccca

SEQ ID NO: 65420 - DNA, 22 bp, Homo sapiens
tgctcgaggtccccaccggctc

SEQ ID NO: 65421 - DNA, 22 bp, Homo sapiens
ttgcatgttccaaagaattttg

SEQ ID NO: 65422 - DNA, 22 bp, Homo sapiens
atttcatactaaggctcaaaaa

SEQ ID NO: 65423 - DNA, 22 bp, Homo sapiens
gtgttaaccagctaaactttgc

SEQ ID NO: 65424 - DNA, 22 bp, Homo sapiens
ctgctcctgtccagcagggcca

SEQ ID NO: 65425 - DNA, 22 bp, Homo sapiens
aggaagatgtgcaaagttggaa

SEQ ID NO: 65426 - DNA, 22 bp, Homo sapiens
gtgagaaatgacaaatgtgtcg

SEQ ID NO: 65427 - DNA, 22 bp, Homo sapiens
ggatgttctggggttctcttgt

SEQ ID NO: 65428 - DNA, 22 bp, Homo sapiens
tctccgatcacaggttttcaat

SEQ ID NO: 65429 - DNA, 22 bp, Homo sapiens
tgggggtgtcctggtgcacaca

SEQ ID NO: 65430 - DNA, 21 bp, Homo sapiens
tctgatggtagatgagatgtg

SEQ ID NO: 65431 - DNA, 23 bp, Homo sapiens
ggggcctgcaccggtctgcgcgg

SEQ ID NO: 65432 - DNA, 23 bp, Homo sapiens
tgaggcaggcggatcacgaggtc

SEQ ID NO: 65433 - DNA, 22 bp, Homo sapiens
ctgaggctggagtgcagtggtg

SEQ ID NO: 65434 - DNA, 22 bp, Homo sapiens
gtggtgtaggtcacagttagga

SEQ ID NO: 65435 - DNA, 22 bp, Homo sapiens
aaggctcggcaatgtgcggctc

SEQ ID NO: 65436 - DNA, 22 bp, Homo sapiens
agggaagaggaccagagtctct

SEQ ID NO: 65437 - DNA, 22 bp, Homo sapiens
tcactgcaacctctgcctcttg

SEQ ID NO: 65438 - DNA, 22 bp, Homo sapiens
catttacatttaaggttaatat

SEQ ID NO: 65439 - DNA, 22 bp, Homo sapiens
acactccagggagggagggaat

SEQ ID NO: 65440 - DNA, 22 bp, Homo sapiens
ctcctgggaaaggctggacaca

SEQ ID NO: 65441 - DNA, 22 bp, Homo sapiens
aggcactgtgcagtcccaagca

SEQ ID NO: 65442 - DNA, 22 bp, Homo sapiens
ttgtacatttgttcagttctga

SEQ ID NO: 65443 - DNA, 19 bp, Homo sapiens
ggcttcgaggctggggaag

SEQ ID NO: 65444 - DNA, 22 bp, Homo sapiens
aactgaggtatctgctgtgttt

SEQ ID NO: 65445 - DNA, 22 bp, Homo sapiens
ccctggcagtgctcctttagac

SEQ ID NO: 65446 - DNA, 22 bp, Homo sapiens
cccaggagttggaggctgcagt

SEQ ID NO: 65447 - DNA, 22 bp, Homo sapiens
tgttatctgagcaacgtcgacg

SEQ ID NO: 65448 - DNA, 22 bp, Homo sapiens
ggttccacctggcgaggggtat

SEQ ID NO: 65449 - DNA, 22 bp, Homo sapiens
gtggattacaagacagttgaga

SEQ ID NO: 65450 - DNA, 22 bp, Homo sapiens
ctcactgcaacctctgcctccc

SEQ ID NO: 65451 - DNA, 22 bp, Homo sapiens
ttggcgcccaggacgccgccgc

SEQ ID NO: 65452 - DNA, 22 bp, Homo sapiens
tacctcaagttccaggaaagcg

SEQ ID NO: 65453 - DNA, 22 bp, Homo sapiens
ttcctggaaattatgctcacct

SEQ ID NO: 65454 - DNA, 23 bp, Homo sapiens
tcagaacagttcttggtgcatag

SEQ ID NO: 65455 - DNA, 22 bp, Homo sapiens
aacagctttgtatacagtaact

SEQ ID NO: 65456 - DNA, 22 bp, Homo sapiens
gaggggcacagtaaagggtccc

SEQ ID NO: 65457 - DNA, 22 bp, Homo sapiens
tctaccctgcggtcttggggca

SEQ ID NO: 65458 - DNA, 22 bp, Homo sapiens
cccagagcatgtgctgcctttg

SEQ ID NO: 65459 - DNA, 22 bp, Homo sapiens
ttttctaacatctagtaatttg

SEQ ID NO: 65460 - DNA, 22 bp, Homo sapiens
cactgcactccagcctgcgcaa

SEQ ID NO: 65461 - DNA, 22 bp, Homo sapiens
caggaaggggctcactctggcc

SEQ ID NO: 65462 - DNA, 22 bp, Homo sapiens
acttttaaatgagtttcagttg

SEQ ID NO: 65463 - DNA, 22 bp, Homo sapiens
ccaggctggagtgcagtggcac

SEQ ID NO: 65464 - DNA, 22 bp, Homo sapiens
gcccaggagttcaagtctagtg

SEQ ID NO: 65465 - DNA, 19 bp, Homo sapiens
gatttaaacgtggctctat

SEQ ID NO: 65466 - DNA, 23 bp, Homo sapiens
gaggtggcaatgagggcagttgg

SEQ ID NO: 65467 - DNA, 22 bp, Homo sapiens
gtccaagagtcaagaagggggc

SEQ ID NO: 65468 - DNA, 21 bp, Homo sapiens
tgttttccaccttgaggcaag

SEQ ID NO: 65469 - DNA, 22 bp, Homo sapiens
tccagtgtttttcttcacaggt

SEQ ID NO: 65470 - DNA, 20 bp, Homo sapiens
acctcctggcgggcatcctc

SEQ ID NO: 65471 - DNA, 22 bp, Homo sapiens
ctcaggagttggaggctacagt

SEQ ID NO: 65472 - DNA, 22 bp, Homo sapiens
cggcatccccacttcctcctgc

SEQ ID NO: 65473 - DNA, 22 bp, Homo sapiens
cctgtcataatgtccgatgtca

SEQ ID NO: 65474 - DNA, 22 bp, Homo sapiens
ggcaaggggtcaggctgagaca

SEQ ID NO: 65475 - DNA, 22 bp, Homo sapiens
accctccccaagaggtcgtgcc

SEQ ID NO: 65476 - DNA, 22 bp, Homo sapiens
acgcagtttgtggacatttttt

SEQ ID NO: 65477 - DNA, 22 bp, Homo sapiens
gggcaggggtcagtggccccaa

SEQ ID NO: 65478 - DNA, 22 bp, Homo sapiens
tagtgtctcttcctgtttgaaa

SEQ ID NO: 65479 - DNA, 22 bp, Homo sapiens
tattccatttgggtcaggatga

SEQ ID NO: 65480 - DNA, 22 bp, Homo sapiens
tgggaaggggagctggaaagga

SEQ ID NO: 65481 - DNA, 22 bp, Homo sapiens
gtgcggatcggtgtcctccaaa

SEQ ID NO: 65482 - DNA, 22 bp, Homo sapiens
tggaggttgggatgcttgtgat

SEQ ID NO: 65483 - DNA, 22 bp, Homo sapiens
cagaggtagcatgctgtggctt

SEQ ID NO: 65484 - DNA, 22 bp, Homo sapiens
aaagaaatagatggcatttaaa

SEQ ID NO: 65485 - DNA, 22 bp, Homo sapiens
gcctcactgcagccccaggaag

SEQ ID NO: 65486 - DNA, 22 bp, Homo sapiens
tccacaggtccggcatgaacag

SEQ ID NO: 65487 - DNA, 22 bp, Homo sapiens
cttgtagacccctggactcacg

SEQ ID NO: 65488 - DNA, 22 bp, Homo sapiens
gctgccttgccctcttcccata

SEQ ID NO: 65489 - DNA, 22 bp, Homo sapiens
gggacgacaggctctgtggtag

SEQ ID NO: 65490 - DNA, 22 bp, Homo sapiens
ttcttttaattgtgggggagtg

SEQ ID NO: 65491 - DNA, 22 bp, Homo sapiens
aacctcaaactcttgggcttaa

SEQ ID NO: 65492 - DNA, 22 bp, Homo sapiens
caggagctcaagaccaccctgg

SEQ ID NO: 65493 - DNA, 20 bp, Homo sapiens
tcagccattccttacctttc

SEQ ID NO: 65494 - DNA, 22 bp, Homo sapiens
tgtgaagaattaatgtgaatca

SEQ ID NO: 65495 - DNA, 22 bp, Homo sapiens
ggctgatgggcatgagctgtca

SEQ ID NO: 65496 - DNA, 22 bp, Homo sapiens
gttaaggatcttgagatgagga

SEQ ID NO: 65497 - DNA, 22 bp, Homo sapiens
agggctggagccacagctggga

SEQ ID NO: 65498 - DNA, 22 bp, Homo sapiens
gctgctctccaagcctccttga

SEQ ID NO: 65499 - DNA, 22 bp, Homo sapiens
atgtatatgcatgcattcaaag

SEQ ID NO: 65500 - DNA, 22 bp, Homo sapiens
gctgctctcagagctcatgctg

SEQ ID NO: 65501 - DNA, 23 bp, Homo sapiens
tcaaatcccagctctaccacttc

SEQ ID NO: 65502 - DNA, 22 bp, Homo sapiens
atgggctgtccattgctggctg

SEQ ID NO: 65503 - DNA, 22 bp, Homo sapiens
atgccaggaacaaacagtggtg

SEQ ID NO: 65504 - DNA, 22 bp, Homo sapiens
tgttatatctaaatagccacat

SEQ ID NO: 65505 - DNA, 22 bp, Homo sapiens
gaggccacggaagggagctgtg

SEQ ID NO: 65506 - DNA, 22 bp, Homo sapiens
aaagtaattgtggttcttgcca

SEQ ID NO: 65507 - DNA, 22 bp, Homo sapiens
cccaggggttctgagcagcagc

SEQ ID NO: 65508 - DNA, 22 bp, Homo sapiens
caagcttgtttctcctgggggt

SEQ ID NO: 65509 - DNA, 22 bp, Homo sapiens
gcaggatgagtgagtacattta

SEQ ID NO: 65510 - DNA, 22 bp, Homo sapiens
ctgggcacagcgttgggctctt

SEQ ID NO: 65511 - DNA, 22 bp, Homo sapiens
cccaactactctcaggcagctt

SEQ ID NO: 65512 - DNA, 22 bp, Homo sapiens
ttgtatagcccagagagtgaga

SEQ ID NO: 65513 - DNA, 22 bp, Homo sapiens
agctggtgctcggggagctggc

SEQ ID NO: 65514 - DNA, 22 bp, Homo sapiens
gtgtgtcccttggaacctcagc

SEQ ID NO: 65515 - DNA, 22 bp, Homo sapiens
tagagctggccgggacagctgg

SEQ ID NO: 65516 - DNA, 22 bp, Homo sapiens
tcaccaggctggagtgcagtgg

SEQ ID NO: 65517 - DNA, 22 bp, Homo sapiens
ccactgtggaaagcagttcaga

SEQ ID NO: 65518 - DNA, 22 bp, Homo sapiens
cccaggaattggaggctgcagt

SEQ ID NO: 65519 - DNA, 22 bp, Homo sapiens
tggttcgtctcttttacagttc

SEQ ID NO: 65520 - DNA, 22 bp, Homo sapiens
gaggggtccaggaggcacttac

SEQ ID NO: 65521 - DNA, 22 bp, Homo sapiens
agggggctccttggtgtgcaga

SEQ ID NO: 65522 - DNA, 22 bp, Homo sapiens
ctgtatttcttggacagttgct

SEQ ID NO: 65523 - DNA, 22 bp, Homo sapiens
cctgagtagctggaattaaagg

SEQ ID NO: 65524 - DNA, 22 bp, Homo sapiens
cagagagaatcttggcagctga

SEQ ID NO: 65525 - DNA, 22 bp, Homo sapiens
cactgcactccagcctgggaga

SEQ ID NO: 65526 - DNA, 22 bp, Homo sapiens
ggaactcctgctccaagcagct

SEQ ID NO: 65527 - DNA, 22 bp, Homo sapiens
tctcttgagctcagttctgatg

SEQ ID NO: 65528 - DNA, 22 bp, Homo sapiens
gggcatggtggcaggcacctgt

SEQ ID NO: 65529 - DNA, 22 bp, Homo sapiens
gtccaggcctgcctctgaggag

SEQ ID NO: 65530 - DNA, 22 bp, Homo sapiens
ctggagggtggagagaagtctc

SEQ ID NO: 65531 - DNA, 22 bp, Homo sapiens
agggaaattaatgtgagcaatg

SEQ ID NO: 65532 - DNA, 22 bp, Homo sapiens
gcaactgaacatgtgtgtggcc

SEQ ID NO: 65533 - DNA, 22 bp, Homo sapiens
aaagaggcaatcaatgtagcaa

SEQ ID NO: 65534 - DNA, 22 bp, Homo sapiens
aagtgctgggattacaggggtg

SEQ ID NO: 65535 - DNA, 22 bp, Homo sapiens
tgcctgttgcccacctgataaa

SEQ ID NO: 65536 - DNA, 22 bp, Homo sapiens
ctgcattaagttgcctgtaaga

SEQ ID NO: 65537 - DNA, 22 bp, Homo sapiens
ttgcaattgctatggagagcgt

SEQ ID NO: 65538 - DNA, 22 bp, Homo sapiens
ctgctttggacaactattcttg

SEQ ID NO: 65539 - DNA, 22 bp, Homo sapiens
ccaggggggcgtagatgctggg

SEQ ID NO: 65540 - DNA, 22 bp, Homo sapiens
gcacagagagggaaggtaactt

SEQ ID NO: 65541 - DNA, 22 bp, Homo sapiens
ccaggtgtgctctgcagtggat

SEQ ID NO: 65542 - DNA, 22 bp, Homo sapiens
tggccttggccgtgctggggtc

SEQ ID NO: 65543 - DNA, 22 bp, Homo sapiens
ctttgcttgacactgtgattgt

SEQ ID NO: 65544 - DNA, 22 bp, Homo sapiens
tctgacattttgagaatgacat

SEQ ID NO: 65545 - DNA, 22 bp, Homo sapiens
caggcaggtcagtgaagaagga

SEQ ID NO: 65546 - DNA, 22 bp, Homo sapiens
cagcctttgggtcagaagattc

SEQ ID NO: 65547 - DNA, 22 bp, Homo sapiens
ggagaggcttccagagtcgtgc

SEQ ID NO: 65548 - DNA, 22 bp, Homo sapiens
tagcagtgtctaggtaggccat

SEQ ID NO: 65549 - DNA, 22 bp, Homo sapiens
ccagtgtgcaatctctggctta

SEQ ID NO: 65550 - DNA, 22 bp, Homo sapiens
agagctgggtggacttgtagtt

SEQ ID NO: 65551 - DNA, 22 bp, Homo sapiens
cattgcaacttcaaactcctgg

SEQ ID NO: 65552 - DNA, 22 bp, Homo sapiens
aaaggctttaaaatgtacatat

SEQ ID NO: 65553 - DNA, 22 bp, Homo sapiens
gcggcggagacagcaggaagcc

SEQ ID NO: 65554 - DNA, 23 bp, Homo sapiens
cttcacaggttcaggggattaag

SEQ ID NO: 65555 - DNA, 22 bp, Homo sapiens
catgtgtccacccttgaacaca

SEQ ID NO: 65556 - DNA, 22 bp, Homo sapiens
ctgagctcacgccattctcctt

SEQ ID NO: 65557 - DNA, 22 bp, Homo sapiens
tgcaatttttccatgacctaga

SEQ ID NO: 65558 - DNA, 22 bp, Homo sapiens
tcctgggtccatggcagccgaa

SEQ ID NO: 65559 - DNA, 22 bp, Homo sapiens
tgtatgtatgaataagcaagat

SEQ ID NO: 65560 - DNA, 20 bp, Homo sapiens
acgtggccaccagtggctta

SEQ ID NO: 65561 - DNA, 22 bp, Homo sapiens
gcacatccaatgattgttttga

SEQ ID NO: 65562 - DNA, 22 bp, Homo sapiens
tggggttttaacatgttgccag

SEQ ID NO: 65563 - DNA, 22 bp, Homo sapiens
ttctcccatctcagtcttacat

SEQ ID NO: 65564 - DNA, 22 bp, Homo sapiens
cccaggatggggctgcagttat

SEQ ID NO: 65565 - DNA, 22 bp, Homo sapiens
taatcctgtcttgaccatcagg

SEQ ID NO: 65566 - DNA, 22 bp, Homo sapiens
actagaaagaagttttttgaga

SEQ ID NO: 65567 - DNA, 22 bp, Homo sapiens
gcctgtgtctgggtggccagag

SEQ ID NO: 65568 - DNA, 22 bp, Homo sapiens
tgctcattggcgatctgaggga

SEQ ID NO: 65569 - DNA, 22 bp, Homo sapiens
tgggaagggtcaacagctggaa

SEQ ID NO: 65570 - DNA, 22 bp, Homo sapiens
aggaatgacagatgtccgcacc

SEQ ID NO: 65571 - DNA, 22 bp, Homo sapiens
tcttgggggactttggcatgga

SEQ ID NO: 65572 - DNA, 22 bp, Homo sapiens
tttctcggcagagatgatgggc

SEQ ID NO: 65573 - DNA, 22 bp, Homo sapiens
tgtgaatggacaattaaatcta

SEQ ID NO: 65574 - DNA, 19 bp, Homo sapiens
ttactatgtgacaagcact

SEQ ID NO: 65575 - DNA, 22 bp, Homo sapiens
caggaggacatactggctcaca

SEQ ID NO: 65576 - DNA, 22 bp, Homo sapiens
aagcctggcacattggagtctg

SEQ ID NO: 65577 - DNA, 22 bp, Homo sapiens
cagctgctgttcagttttgttt

SEQ ID NO: 65578 - DNA, 22 bp, Homo sapiens
ctgggaggcggaggttgtagtg

SEQ ID NO: 65579 - DNA, 22 bp, Homo sapiens
gtagggctcagtaaatactttg

SEQ ID NO: 65580 - DNA, 22 bp, Homo sapiens
gaagaaagatcaaatagtttcc

SEQ ID NO: 65581 - DNA, 22 bp, Homo sapiens
tcaacgcatgctccaagaaaga

SEQ ID NO: 65582 - DNA, 22 bp, Homo sapiens
aggccctattcaatggggccca

SEQ ID NO: 65583 - DNA, 22 bp, Homo sapiens
cgggcgcactccgggcagctgt

SEQ ID NO: 65584 - DNA, 21 bp, Homo sapiens
acagcctccatctcctgggct

SEQ ID NO: 65585 - DNA, 22 bp, Homo sapiens
cgccggcttgaggcaggcggca

SEQ ID NO: 65586 - DNA, 22 bp, Homo sapiens
ccttttatagatcagtgtgtta

SEQ ID NO: 65587 - DNA, 22 bp, Homo sapiens
tctggtgtcagtattctttgaa

SEQ ID NO: 65588 - DNA, 22 bp, Homo sapiens
ctctgtggtggagtgggtcacc

SEQ ID NO: 65589 - DNA, 22 bp, Homo sapiens
ttctagtgtccttggacttgct

SEQ ID NO: 65590 - DNA, 22 bp, Homo sapiens
tcagtgttaatcagtggtacct

SEQ ID NO: 65591 - DNA, 22 bp, Homo sapiens
tcccttatctggtattttttag

SEQ ID NO: 65592 - DNA, 22 bp, Homo sapiens
agtgttgtcaaacggctcagca

SEQ ID NO: 65593 - DNA, 22 bp, Homo sapiens
agatcacagtggcaactccctt

SEQ ID NO: 65594 - DNA, 22 bp, Homo sapiens
acgcctgtaatcccagcacttt

SEQ ID NO: 65595 - DNA, 22 bp, Homo sapiens
tgagcaggcgcagcaggaggtc

SEQ ID NO: 65596 - DNA, 22 bp, Homo sapiens
catccatagcttgatctgttcc

SEQ ID NO: 65597 - DNA, 22 bp, Homo sapiens
gagagtctagtgcacctagttt

SEQ ID NO: 65598 - DNA, 22 bp, Homo sapiens
agagcacagccaccatttacaa

SEQ ID NO: 65599 - DNA, 22 bp, Homo sapiens
gttgagtgggttaggatgctga

SEQ ID NO: 65600 - DNA, 22 bp, Homo sapiens
tggtacacatgtccaaggtcag

SEQ ID NO: 65601 - DNA, 22 bp, Homo sapiens
acctggacacctgctgtcatct

SEQ ID NO: 65602 - DNA, 22 bp, Homo sapiens
ctggtctggctacccagcgaat

SEQ ID NO: 65603 - DNA, 22 bp, Homo sapiens
actgggaagtcagagagaggct

SEQ ID NO: 65604 - DNA, 22 bp, Homo sapiens
tccccagcttgctacttctgct

SEQ ID NO: 65605 - DNA, 22 bp, Homo sapiens
aaacactcatgtgttactctcc

SEQ ID NO: 65606 - DNA, 22 bp, Homo sapiens
atacatgcgccatgttggtgtg

SEQ ID NO: 65607 - DNA, 22 bp, Homo sapiens
ttggagaggcagtcttgctctg

SEQ ID NO: 65608 - DNA, 22 bp, Homo sapiens
atttagaactttgtttgccaat

SEQ ID NO: 65609 - DNA, 23 bp, Homo sapiens
gtcacagtgggtggtgcctacat

SEQ ID NO: 65610 - DNA, 22 bp, Homo sapiens
aatactgcctgtgaggtaactc

SEQ ID NO: 65611 - DNA, 22 bp, Homo sapiens
aaaaatcacttttataggcagc

SEQ ID NO: 65612 - DNA, 22 bp, Homo sapiens
acattaaaattgggtggggtaa

SEQ ID NO: 65613 - DNA, 22 bp, Homo sapiens
atattgaaccctacagactgta

SEQ ID NO: 65614 - DNA, 20 bp, Homo sapiens
tttcttgtcggctgttgctg

SEQ ID NO: 65615 - DNA, 23 bp, Homo sapiens
ggctgggagctccgggtgcacgt

SEQ ID NO: 65616 - DNA, 22 bp, Homo sapiens
ccgaggtcctggacttggccct

SEQ ID NO: 65617 - DNA, 22 bp, Homo sapiens
tgagatgaataactcctgctaa

SEQ ID NO: 65618 - DNA, 22 bp, Homo sapiens
ctcagcactttggaaggctgat

SEQ ID NO: 65619 - DNA, 22 bp, Homo sapiens
taatggtgtttttctgtaattt

SEQ ID NO: 65620 - DNA, 22 bp, Homo sapiens
ctgagatggagttttgctcttg

SEQ ID NO: 65621 - DNA, 22 bp, Homo sapiens
tcctgggaggcggaggttgcag

SEQ ID NO: 65622 - DNA, 22 bp, Homo sapiens
ccctggaggttgaggctgcagt

SEQ ID NO: 65623 - DNA, 22 bp, Homo sapiens
tgctttgtgacagattagtttt

SEQ ID NO: 65624 - DNA, 22 bp, Homo sapiens
gctcagaggcacgacctcttgg

SEQ ID NO: 65625 - DNA, 22 bp, Homo sapiens
agcttagtggttgtatgagtta

SEQ ID NO: 65626 - DNA, 22 bp, Homo sapiens
caggcacggtggctcatgcctg

SEQ ID NO: 65627 - DNA, 22 bp, Homo sapiens
aggtcacccgtttgactatcca

SEQ ID NO: 65628 - DNA, 22 bp, Homo sapiens
ggggtctgggcttagctggaat

SEQ ID NO: 65629 - DNA, 22 bp, Homo sapiens
ctctctgggcccagttggcacc

SEQ ID NO: 65630 - DNA, 22 bp, Homo sapiens
cctcagacccctgctgagcttc

SEQ ID NO: 65631 - DNA, 22 bp, Homo sapiens
aagccaatgctagcccacatgc

SEQ ID NO: 65632 - DNA, 22 bp, Homo sapiens
cataatttctaccagggccata

SEQ ID NO: 65633 - DNA, 22 bp, Homo sapiens
cctgccagagcagcttgtcctc

SEQ ID NO: 65634 - DNA, 22 bp, Homo sapiens
ttccagttcactccatttctgg

SEQ ID NO: 65635 - DNA, 22 bp, Homo sapiens
tatttaataaaactatggcatg

SEQ ID NO: 65636 - DNA, 22 bp, Homo sapiens
gtcggccacgcaggtgcggtag

SEQ ID NO: 65637 - DNA, 22 bp, Homo sapiens
gggtaaatctcttttcatggct

SEQ ID NO: 65638 - DNA, 23 bp, Homo sapiens
aatgggtgcaactatccatgaca

SEQ ID NO: 65639 - DNA, 22 bp, Homo sapiens
ctggcaagaaatatatatctta

SEQ ID NO: 65640 - DNA, 22 bp, Homo sapiens
tggaaatgtttcttgagctcag

SEQ ID NO: 65641 - DNA, 22 bp, Homo sapiens
agcttgtgtttttctaagtatc

SEQ ID NO: 65642 - DNA, 22 bp, Homo sapiens
actgggcagcagctcgagccgc

SEQ ID NO: 65643 - DNA, 22 bp, Homo sapiens
gtcagtgtcttaacagagatta

SEQ ID NO: 65644 - DNA, 22 bp, Homo sapiens
ggaggcggaggctgcagtgagc

SEQ ID NO: 65645 - DNA, 22 bp, Homo sapiens
cctgtggcgggggccagtgcct

SEQ ID NO: 65646 - DNA, 22 bp, Homo sapiens
gtcatggtgctagcgggaatgt

SEQ ID NO: 65647 - DNA, 22 bp, Homo sapiens
gggggaagaaagaacatggcat

SEQ ID NO: 65648 - DNA, 22 bp, Homo sapiens
ggaagaaaggtggacaacaggt

SEQ ID NO: 65649 - DNA, 22 bp, Homo sapiens
gcggtagctcaagcttgtaatc

SEQ ID NO: 65650 - DNA, 22 bp, Homo sapiens
tgggtactcctattagttcagt

SEQ ID NO: 65651 - DNA, 22 bp, Homo sapiens
ctctgtagaaagagcccaggtg

SEQ ID NO: 65652 - DNA, 22 bp, Homo sapiens
tgggcgacagagcaagactccg

SEQ ID NO: 65653 - DNA, 22 bp, Homo sapiens
tagcagaagttgcaaactaggg

SEQ ID NO: 65654 - DNA, 22 bp, Homo sapiens
aagaaatgtgaatattgaatag

SEQ ID NO: 65655 - DNA, 22 bp, Homo sapiens
tcactggaaagacagcactctt

SEQ ID NO: 65656 - DNA, 15 bp, Homo sapiens
gcaggcaggtcacct

SEQ ID NO: 65657 - DNA, 22 bp, Homo sapiens
tatgccactgctctccatccta

SEQ ID NO: 65658 - DNA, 22 bp, Homo sapiens
aacactctctgttggtaaggct

SEQ ID NO: 65659 - DNA, 22 bp, Homo sapiens
tgcttttagctagtaactagta

SEQ ID NO: 65660 - DNA, 22 bp, Homo sapiens
tttgatccgttgctggtgagga

SEQ ID NO: 65661 - DNA, 22 bp, Homo sapiens
ctgaatccacacaaggtgatgg

SEQ ID NO: 65662 - DNA, 23 bp, Homo sapiens
acagtcgtaggtatccttttcct

SEQ ID NO: 65663 - DNA, 22 bp, Homo sapiens
aggaattcaagaccagctgggc

SEQ ID NO: 65664 - DNA, 22 bp, Homo sapiens
acccgggaggcaggagtcatag

SEQ ID NO: 65665 - DNA, 22 bp, Homo sapiens
cccaggaggtcaaggctgcagt

SEQ ID NO: 65666 - DNA, 22 bp, Homo sapiens
gccggggctggggagagacatg

SEQ ID NO: 65667 - DNA, 22 bp, Homo sapiens
atttttctctttccactgagat

SEQ ID NO: 65668 - DNA, 23 bp, Homo sapiens
ctggggctttcaaatctgggcag

SEQ ID NO: 65669 - DNA, 22 bp, Homo sapiens
tattagttgcaaaacattgact

SEQ ID NO: 65670 - DNA, 22 bp, Homo sapiens
tattcatagtaaacaaaagtgg

SEQ ID NO: 65671 - DNA, 22 bp, Homo sapiens
tagtcccggaactccttcaggt

SEQ ID NO: 65672 - DNA, 22 bp, Homo sapiens
ctgcatccatgttgctgcaaag

SEQ ID NO: 65673 - DNA, 22 bp, Homo sapiens
cacctcaggcagcaaagtctca

SEQ ID NO: 65674 - DNA, 22 bp, Homo sapiens
atgccactgcacttcagcttgg

SEQ ID NO: 65675 - DNA, 22 bp, Homo sapiens
aaagtgctgaaattacaggtgt

SEQ ID NO: 65676 - DNA, 22 bp, Homo sapiens
caggaacagggtgtcctggcag

SEQ ID NO: 65677 - DNA, 22 bp, Homo sapiens
aacccagggtggaggttgcagt

SEQ ID NO: 65678 - DNA, 22 bp, Homo sapiens
ccaggaggtggagattgcagtg

SEQ ID NO: 65679 - DNA, 22 bp, Homo sapiens
gctgggttttcttccgggccta

SEQ ID NO: 65680 - DNA, 22 bp, Homo sapiens
tgagaacggatactaagggctg

SEQ ID NO: 65681 - DNA, 21 bp, Homo sapiens
tccctgagcccaaggggctcc

SEQ ID NO: 65682 - DNA, 22 bp, Homo sapiens
ctggaaggcagaggttgcagtg

SEQ ID NO: 65683 - DNA, 22 bp, Homo sapiens
gacccaggggcagggagaaagt

SEQ ID NO: 65684 - DNA, 22 bp, Homo sapiens
atgagttgaagctacaagaggc

SEQ ID NO: 65685 - DNA, 22 bp, Homo sapiens
ttctgggtttacatctgacttc

SEQ ID NO: 65686 - DNA, 22 bp, Homo sapiens
ggaggtgggctaaggactctct

SEQ ID NO: 65687 - DNA, 22 bp, Homo sapiens
gggagctgagctggaagagaat

SEQ ID NO: 65688 - DNA, 22 bp, Homo sapiens
agacaaagaaaccgtagaagca

SEQ ID NO: 65689 - DNA, 20 bp, Homo sapiens
cagcctgcatcatctgcagc

SEQ ID NO: 65690 - DNA, 22 bp, Homo sapiens
tcagcctgctccaagtgctgcc

SEQ ID NO: 65691 - DNA, 22 bp, Homo sapiens
ggctcactgcaacttccgcctc

SEQ ID NO: 65692 - DNA, 22 bp, Homo sapiens
gatgaaggggctggtgccctct

SEQ ID NO: 65693 - DNA, 22 bp, Homo sapiens
aagagggctgcaatcttattgc

SEQ ID NO: 65694 - DNA, 22 bp, Homo sapiens
ctcctgcttcacgggcaccgcc

SEQ ID NO: 65695 - DNA, 22 bp, Homo sapiens
gggctgggattgcttgctgtga

SEQ ID NO: 65696 - DNA, 22 bp, Homo sapiens
gccaggttgctgacgacgatct

SEQ ID NO: 65697 - DNA, 22 bp, Homo sapiens
tccagggagagccgctgctcca

SEQ ID NO: 65698 - DNA, 22 bp, Homo sapiens
ctactttaacatggaggcactt

SEQ ID NO: 65699 - DNA, 22 bp, Homo sapiens
gttggctatgagagctttagtg

SEQ ID NO: 65700 - DNA, 22 bp, Homo sapiens
ttgtcgggcttacgcagggcca

SEQ ID NO: 65701 - DNA, 23 bp, Homo sapiens
tgttccagatacgccttttcctc

SEQ ID NO: 65702 - DNA, 22 bp, Homo sapiens
gagcccaggaagtggaggctga

SEQ ID NO: 65703 - DNA, 22 bp, Homo sapiens
cagccccacacggtctagctct

SEQ ID NO: 65704 - DNA, 22 bp, Homo sapiens
cagtgggtcctgcgtctgccag

SEQ ID NO: 65705 - DNA, 22 bp, Homo sapiens
tttttgggtccaggctgtatct

SEQ ID NO: 65706 - DNA, 22 bp, Homo sapiens
tgggattcaccatgggcttcag

SEQ ID NO: 65707 - DNA, 22 bp, Homo sapiens
tggacaggcaagcaagacatac

SEQ ID NO: 65708 - DNA, 18 bp, Homo sapiens
actctttctgcccacagg

SEQ ID NO: 65709 - DNA, 22 bp, Homo sapiens
ccaggctggagtatagtggcgc

SEQ ID NO: 65710 - DNA, 22 bp, Homo sapiens
ccaggctagagtgcaatggcat

SEQ ID NO: 65711 - DNA, 22 bp, Homo sapiens
actttcttggtcccatgtttga

SEQ ID NO: 65712 - DNA, 22 bp, Homo sapiens
aggctagaggcttctggcttca

SEQ ID NO: 65713 - DNA, 22 bp, Homo sapiens
actgaataaggtgaatgctctg

SEQ ID NO: 65714 - DNA, 22 bp, Homo sapiens
tcaaattgtcatcttgataatg

SEQ ID NO: 65715 - DNA, 19 bp, Homo sapiens
gccttcccaccacccgtcc

SEQ ID NO: 65716 - DNA, 22 bp, Homo sapiens
cacatttttactgccaacttaa

SEQ ID NO: 65717 - DNA, 22 bp, Homo sapiens
tcagtgatttctggggtgaggg

SEQ ID NO: 65718 - DNA, 22 bp, Homo sapiens
taaaatttgtccctgagtgttg

SEQ ID NO: 65719 - DNA, 22 bp, Homo sapiens
aagaggtagcagtcacaaaaga

SEQ ID NO: 65720 - DNA, 22 bp, Homo sapiens
cccagcgagtttgccggtgaac

SEQ ID NO: 65721 - DNA, 22 bp, Homo sapiens
tgagcttccctcctgcactaca

SEQ ID NO: 65722 - DNA, 22 bp, Homo sapiens
tcagggattaaggtcaaaggtg

SEQ ID NO: 65723 - DNA, 22 bp, Homo sapiens
gccctgggcaaggttctggcca

SEQ ID NO: 65724 - DNA, 22 bp, Homo sapiens
cagcagtgtacaaggtgtcaga

SEQ ID NO: 65725 - DNA, 22 bp, Homo sapiens
cctggagagctcgggccaggca

SEQ ID NO: 65726 - DNA, 22 bp, Homo sapiens
tgtggcacatacacaggagggc

SEQ ID NO: 65727 - DNA, 22 bp, Homo sapiens
tgcctgataccctctgtctctc

SEQ ID NO: 65728 - DNA, 22 bp, Homo sapiens
attgataaattgcaatggggct

SEQ ID NO: 65729 - DNA, 22 bp, Homo sapiens
tttgggcaggcttttccctaga

SEQ ID NO: 65730 - DNA, 22 bp, Homo sapiens
caggctgatcagggctgggatg

SEQ ID NO: 65731 - DNA, 22 bp, Homo sapiens
atgtgtattacctcgattgtga

SEQ ID NO: 65732 - DNA, 22 bp, Homo sapiens
ctctggagtgtctggccagggt

SEQ ID NO: 65733 - DNA, 22 bp, Homo sapiens
ttgtgctctgtgttatttaagg

SEQ ID NO: 65734 - DNA, 22 bp, Homo sapiens
aggtgcttggctcgtgcacaca

SEQ ID NO: 65735 - DNA, 22 bp, Homo sapiens
attctacatgatagaagggaga

SEQ ID NO: 65736 - DNA, 22 bp, Homo sapiens
aactagaaaaagactttctgag

SEQ ID NO: 65737 - DNA, 22 bp, Homo sapiens
gaccttgtgatctgcccacctt

SEQ ID NO: 65738 - DNA, 22 bp, Homo sapiens
caggtgtcggtcaggcggtttt

SEQ ID NO: 65739 - DNA, 22 bp, Homo sapiens
gggttggatcctggtggctgcc

SEQ ID NO: 65740 - DNA, 19 bp, Homo sapiens
gttttgcaggcagagggga

SEQ ID NO: 65741 - DNA, 22 bp, Homo sapiens
agatggtagactatggaacgta

SEQ ID NO: 65742 - DNA, 22 bp, Homo sapiens
gctgtagtgaatggccgcgttc

SEQ ID NO: 65743 - DNA, 22 bp, Homo sapiens
taaatgttgtaagtacatctaa

SEQ ID NO: 65744 - DNA, 22 bp, Homo sapiens
gtagttctgcagtgtcacctga

SEQ ID NO: 65745 - DNA, 22 bp, Homo sapiens
tccagctgttccatcagctctt

SEQ ID NO: 65746 - DNA, 22 bp, Homo sapiens
tcactgcaacctccacctcctg

SEQ ID NO: 65747 - DNA, 22 bp, Homo sapiens
cactgcaagctccgcctcccgg

SEQ ID NO: 65748 - DNA, 20 bp, Homo sapiens
aggccccaggtggacactag

SEQ ID NO: 65749 - DNA, 22 bp, Homo sapiens
tagccgggtgttgtgtcatgca

SEQ ID NO: 65750 - DNA, 19 bp, Homo sapiens
atctgccttagtgctgctg

SEQ ID NO: 65751 - DNA, 22 bp, Homo sapiens
tgctgagcgcatccggcggccg

SEQ ID NO: 65752 - DNA, 22 bp, Homo sapiens
gcgaatctcagctggtgctgcg

SEQ ID NO: 65753 - DNA, 22 bp, Homo sapiens
ctgaggcaggcagatcacttga

SEQ ID NO: 65754 - DNA, 22 bp, Homo sapiens
agaggccggccgagcccatggg

SEQ ID NO: 65755 - DNA, 22 bp, Homo sapiens
tctcagaacctcagtttgctct

SEQ ID NO: 65756 - DNA, 22 bp, Homo sapiens
ctctccattccctacagttttc

SEQ ID NO: 65757 - DNA, 22 bp, Homo sapiens
ccattgtaaattctgtggaagt

SEQ ID NO: 65758 - DNA, 22 bp, Homo sapiens
cagtcctgaatactggacggtg

SEQ ID NO: 65759 - DNA, 22 bp, Homo sapiens
tattgggtaaagatccagtttt

SEQ ID NO: 65760 - DNA, 22 bp, Homo sapiens
caggctggagtgcaatgacgcc

SEQ ID NO: 65761 - DNA, 22 bp, Homo sapiens
tagcataacaggtaagagtgag

SEQ ID NO: 65762 - DNA, 22 bp, Homo sapiens
gcgggccaccttggagagcgct

SEQ ID NO: 65763 - DNA, 22 bp, Homo sapiens
tgatatgtaactactccttata

SEQ ID NO: 65764 - DNA, 22 bp, Homo sapiens
agcctggcctgggcaggcacat

SEQ ID NO: 65765 - DNA, 22 bp, Homo sapiens
atgctttctcttagttcattga

SEQ ID NO: 65766 - DNA, 22 bp, Homo sapiens
tagattatccctgatttgtcca

SEQ ID NO: 65767 - DNA, 22 bp, Homo sapiens
gtgcatgtcggggtgcatgtca

SEQ ID NO: 65768 - DNA, 22 bp, Homo sapiens
aggcaagggggcgccaccttcc

SEQ ID NO: 65769 - DNA, 22 bp, Homo sapiens
gctccgtgggcattgctaggtg

SEQ ID NO: 65770 - DNA, 22 bp, Homo sapiens
cactgcactccatcctgggaaa

SEQ ID NO: 65771 - DNA, 22 bp, Homo sapiens
tccaggtgggctgcacccaggc

SEQ ID NO: 65772 - DNA, 22 bp, Homo sapiens
cattctctctacttgttttcaa

SEQ ID NO: 65773 - DNA, 22 bp, Homo sapiens
tgtaagtagtaatggaaggaca

SEQ ID NO: 65774 - DNA, 22 bp, Homo sapiens
ggtgggagagctctgtctccag

SEQ ID NO: 65775 - DNA, 22 bp, Homo sapiens
ggagtgactcacagctgggaca

SEQ ID NO: 65776 - DNA, 22 bp, Homo sapiens
aatgccttggagagcctagagg

SEQ ID NO: 65777 - DNA, 22 bp, Homo sapiens
tcctttgcttctgtcattctcc

SEQ ID NO: 65778 - DNA, 22 bp, Homo sapiens
caggctggagtacaattgtgtg

SEQ ID NO: 65779 - DNA, 21 bp, Homo sapiens
gggcctggctgcgcaggacgg

SEQ ID NO: 65780 - DNA, 22 bp, Homo sapiens
cggggccctggggctgaaggtc

SEQ ID NO: 65781 - DNA, 22 bp, Homo sapiens
tcctcctgtctaccagttcctg

SEQ ID NO: 65782 - DNA, 22 bp, Homo sapiens
ggtgtagctctgtgtcccactg

SEQ ID NO: 65783 - DNA, 22 bp, Homo sapiens
agctggtgtgccagttccagtt

SEQ ID NO: 65784 - DNA, 22 bp, Homo sapiens
ttgaggtcttcaggatcaggct

SEQ ID NO: 65785 - DNA, 22 bp, Homo sapiens
gagagcaggaggcagcgggacg

SEQ ID NO: 65786 - DNA, 22 bp, Homo sapiens
gcccagcacctctctcagggtt

SEQ ID NO: 65787 - DNA, 21 bp, Homo sapiens
ggtgacacgtggccccgctct

SEQ ID NO: 65788 - DNA, 22 bp, Homo sapiens
ggctcctgggggtgctcctgcc

SEQ ID NO: 65789 - DNA, 20 bp, Homo sapiens
aaactaaaggtgtttggttt

SEQ ID NO: 65790 - DNA, 22 bp, Homo sapiens
gatgcgggcccgctccactgcc

SEQ ID NO: 65791 - DNA, 22 bp, Homo sapiens
ggagagggtaggggtcctgccc

SEQ ID NO: 65792 - DNA, 17 bp, Homo sapiens
cgggcatggagggcagg

SEQ ID NO: 65793 - DNA, 22 bp, Homo sapiens
aagtgatgctacgactttgaca

SEQ ID NO: 65794 - DNA, 22 bp, Homo sapiens
caggctgaagtgcagtggtgtg

SEQ ID NO: 65795 - DNA, 22 bp, Homo sapiens
aactaatacattaatacatgtg

SEQ ID NO: 65796 - DNA, 22 bp, Homo sapiens
ttggcataccttagtggtggag

SEQ ID NO: 65797 - DNA, 19 bp, Homo sapiens
tggctctgtcgaaggcaca

SEQ ID NO: 65798 - DNA, 22 bp, Homo sapiens
tgcccaggctggagtgcagtgg

SEQ ID NO: 65799 - DNA, 22 bp, Homo sapiens
ttaggatttgaaaaggggcaga

SEQ ID NO: 65800 - DNA, 22 bp, Homo sapiens
aagtaaatatctgtagtcttta

SEQ ID NO: 65801 - DNA, 22 bp, Homo sapiens
aaaatcttgtgacttaggaagg

SEQ ID NO: 65802 - DNA, 22 bp, Homo sapiens
tgtttgagttctagcgcattta

SEQ ID NO: 65803 - DNA, 22 bp, Homo sapiens
taattctgacaacagtggcgtt

SEQ ID NO: 65804 - DNA, 22 bp, Homo sapiens
tgtcttcaggagtaaatatcat

SEQ ID NO: 65805 - DNA, 22 bp, Homo sapiens
atacaaaatatatactggagac

SEQ ID NO: 65806 - DNA, 22 bp, Homo sapiens
agctgaacgtgcttctgcagca

SEQ ID NO: 65807 - DNA, 22 bp, Homo sapiens
gcagaggacacaggagggcaag

SEQ ID NO: 65808 - DNA, 22 bp, Homo sapiens
tcttcctgtcaatgagaattaa

SEQ ID NO: 65809 - DNA, 21 bp, Homo sapiens
gggcagaggggcctcctgggt

SEQ ID NO: 65810 - DNA, 18 bp, Homo sapiens
tctgtgggatcagtgagg

SEQ ID NO: 65811 - DNA, 22 bp, Homo sapiens
gtagatgagctcacatgacctt

SEQ ID NO: 65812 - DNA, 22 bp, Homo sapiens
caggaggattgcttgaggccag

SEQ ID NO: 65813 - DNA, 19 bp, Homo sapiens
ccagagagctaggtacaga

SEQ ID NO: 65814 - DNA, 22 bp, Homo sapiens
ccaaagtgctaggattacaggc

SEQ ID NO: 65815 - DNA, 22 bp, Homo sapiens
gcagccagagggggtgtgatca

SEQ ID NO: 65816 - DNA, 22 bp, Homo sapiens
gctggccacagatccccaggga

SEQ ID NO: 65817 - DNA, 22 bp, Homo sapiens
catagagtgatgtaaggtatgt

SEQ ID NO: 65818 - DNA, 18 bp, Homo sapiens
acacttcctggtggtgtg

SEQ ID NO: 65819 - DNA, 22 bp, Homo sapiens
ccgaggctggagtgcagtggcg

SEQ ID NO: 65820 - DNA, 22 bp, Homo sapiens
ctcactgcaagctctgcctccc

SEQ ID NO: 65821 - DNA, 22 bp, Homo sapiens
aatgagatggaattcccgccta

SEQ ID NO: 65822 - DNA, 22 bp, Homo sapiens
tcacagagttaaaagtttcttt

SEQ ID NO: 65823 - DNA, 22 bp, Homo sapiens
gaggtgggtgtatcacaggtca

SEQ ID NO: 65824 - DNA, 22 bp, Homo sapiens
agcattccacactgaagtctgc

SEQ ID NO: 65825 - DNA, 22 bp, Homo sapiens
atacaaaaattagccgggagta

SEQ ID NO: 65826 - DNA, 22 bp, Homo sapiens
ccggtgttcaaagtctggtatg

SEQ ID NO: 65827 - DNA, 22 bp, Homo sapiens
tactggacacgtatatatagat

SEQ ID NO: 65828 - DNA, 23 bp, Homo sapiens
agctctgctcgggcatgccctgc

SEQ ID NO: 65829 - DNA, 22 bp, Homo sapiens
aagtgattgttccgttgagtgt

SEQ ID NO: 65830 - DNA, 22 bp, Homo sapiens
ccgttggaaagctccgagttga

SEQ ID NO: 65831 - DNA, 22 bp, Homo sapiens
ttgtgctcctatgagaatctaa

SEQ ID NO: 65832 - DNA, 20 bp, Homo sapiens
cagcagtggatgagagtttt

SEQ ID NO: 65833 - DNA, 22 bp, Homo sapiens
gcatatgatcacgtgtgtcggt

SEQ ID NO: 65834 - DNA, 22 bp, Homo sapiens
aagaggagaaaggctggctttg

SEQ ID NO: 65835 - DNA, 22 bp, Homo sapiens
actgcaacctccacctcctggg

SEQ ID NO: 65836 - DNA, 22 bp, Homo sapiens
gagaaagcttctttcccacagg

SEQ ID NO: 65837 - DNA, 22 bp, Homo sapiens
caggctgctgacaggcttggag

SEQ ID NO: 65838 - DNA, 22 bp, Homo sapiens
acagagcaataacagggagagg

SEQ ID NO: 65839 - DNA, 22 bp, Homo sapiens
tgagggaatattgatagatccg

SEQ ID NO: 65840 - DNA, 22 bp, Homo sapiens
gcccagctgcaccctggtgggt

SEQ ID NO: 65841 - DNA, 19 bp, Homo sapiens
gcctcatttccacctcccc

SEQ ID NO: 65842 - DNA, 22 bp, Homo sapiens
cacagctgaagtagccatgtgg

SEQ ID NO: 65843 - DNA, 22 bp, Homo sapiens
ggaggcggaagttgcagtgagc

SEQ ID NO: 65844 - DNA, 22 bp, Homo sapiens
tttgaggttagctagcagatca

SEQ ID NO: 65845 - DNA, 22 bp, Homo sapiens
gactacaggtgtgtgccaccat

SEQ ID NO: 65846 - DNA, 23 bp, Homo sapiens
aagtggttttgaacccggaccct

SEQ ID NO: 65847 - DNA, 22 bp, Homo sapiens
acaggggcaagggctcacggcc

SEQ ID NO: 65848 - DNA, 22 bp, Homo sapiens
attaaagctatccagtcatgaa

SEQ ID NO: 65849 - DNA, 20 bp, Homo sapiens
tgacatagctcttggggtgc

SEQ ID NO: 65850 - DNA, 22 bp, Homo sapiens
tcgaatggcaaggaaagaggct

SEQ ID NO: 65851 - DNA, 22 bp, Homo sapiens
ggctgtgtggccgtgggctcta

SEQ ID NO: 65852 - DNA, 22 bp, Homo sapiens
aagattttcagtgcctaaaaca

SEQ ID NO: 65853 - DNA, 23 bp, Homo sapiens
ttgcttagagacctcctcatcag

SEQ ID NO: 65854 - DNA, 22 bp, Homo sapiens
ggggtgtggacggctgtgccag

SEQ ID NO: 65855 - DNA, 22 bp, Homo sapiens
tatttcttttcgtgacttattg

SEQ ID NO: 65856 - DNA, 22 bp, Homo sapiens
gagccaggttggaggctgcagt

SEQ ID NO: 65857 - DNA, 22 bp, Homo sapiens
attttttgttaactcaggatag

SEQ ID NO: 65858 - DNA, 22 bp, Homo sapiens
ggctgtggcagctggaagtggt

SEQ ID NO: 65859 - DNA, 22 bp, Homo sapiens
cccacaggtgtgagcttgctgg

SEQ ID NO: 65860 - DNA, 22 bp, Homo sapiens
aggagatggagctcagtgggca

SEQ ID NO: 65861 - DNA, 22 bp, Homo sapiens
tgcaccctcatcagtcaaatgg

SEQ ID NO: 65862 - DNA, 19 bp, Homo sapiens
aggaatggaattaattctg

SEQ ID NO: 65863 - DNA, 22 bp, Homo sapiens
ctccccagccctggtattctga

SEQ ID NO: 65864 - DNA, 22 bp, Homo sapiens
tgctccagcaccaagagctcca

SEQ ID NO: 65865 - DNA, 22 bp, Homo sapiens
actccacaccacgggggccgcc

SEQ ID NO: 65866 - DNA, 22 bp, Homo sapiens
gaggctgaggttgcagtgagct

SEQ ID NO: 65867 - DNA, 22 bp, Homo sapiens
gaagcctcaacatctctgcgtc

SEQ ID NO: 65868 - DNA, 22 bp, Homo sapiens
gcccagtagttcaaggttgcag

SEQ ID NO: 65869 - DNA, 22 bp, Homo sapiens
taaattgagattattagggtaa

SEQ ID NO: 65870 - DNA, 22 bp, Homo sapiens
agccctggtttgcagcatttgc

SEQ ID NO: 65871 - DNA, 22 bp, Homo sapiens
agaaatatgctgattagatgaa

SEQ ID NO: 65872 - DNA, 22 bp, Homo sapiens
attgtgaatagtgccgcagtaa

SEQ ID NO: 65873 - DNA, 22 bp, Homo sapiens
ggagcatgcgctctgtgaccga

SEQ ID NO: 65874 - DNA, 22 bp, Homo sapiens
aagaggtaaccatagcaaccac

SEQ ID NO: 65875 - DNA, 22 bp, Homo sapiens
gtgctccctccttcctcaagga

SEQ ID NO: 65876 - DNA, 22 bp, Homo sapiens
ggaggtggaggttgcagtgagc

SEQ ID NO: 65877 - DNA, 22 bp, Homo sapiens
ggaggcggaggttgcagtgagt

SEQ ID NO: 65878 - DNA, 22 bp, Homo sapiens
acccaggctggagtgcagtgat

SEQ ID NO: 65879 - DNA, 22 bp, Homo sapiens
agggctctgagtgggaaagagg

SEQ ID NO: 65880 - DNA, 16 bp, Homo sapiens
gcaggcagatcacatg

SEQ ID NO: 65881 - DNA, 22 bp, Homo sapiens
caagcgtggctgctctgatgga

SEQ ID NO: 65882 - DNA, 22 bp, Homo sapiens
tagggcaatatttcccagaaaa

SEQ ID NO: 65883 - DNA, 22 bp, Homo sapiens
ttcttctttccaattacatggt

SEQ ID NO: 65884 - DNA, 22 bp, Homo sapiens
cggctcactgcagctccgcctc

SEQ ID NO: 65885 - DNA, 22 bp, Homo sapiens
aaggatgattggtaatgacact

SEQ ID NO: 65886 - DNA, 20 bp, Homo sapiens
ggcagagggcctgggagaag

SEQ ID NO: 65887 - DNA, 22 bp, Homo sapiens
tctctggttatgtcattaagca

SEQ ID NO: 65888 - DNA, 22 bp, Homo sapiens
ctcctggaggatagtgactggg

SEQ ID NO: 65889 - DNA, 22 bp, Homo sapiens
cccaggccctggcagagcttgt

SEQ ID NO: 65890 - DNA, 22 bp, Homo sapiens
cggtctcccgtgtgtgtgcgct

SEQ ID NO: 65891 - DNA, 22 bp, Homo sapiens
tgcttacgagctattttcactt

SEQ ID NO: 65892 - DNA, 22 bp, Homo sapiens
ccacaccatcgtttttacctta

SEQ ID NO: 65893 - DNA, 22 bp, Homo sapiens
aagtataatcaaagcagggcta

SEQ ID NO: 65894 - DNA, 22 bp, Homo sapiens
ttatttgtggcatatgagacga

SEQ ID NO: 65895 - DNA, 22 bp, Homo sapiens
ccagggatgcagaggttgcagt

SEQ ID NO: 65896 - DNA, 22 bp, Homo sapiens
gctcccaggatgaggagccagg

SEQ ID NO: 65897 - DNA, 22 bp, Homo sapiens
atccaccctgtggtggctttct

SEQ ID NO: 65898 - DNA, 22 bp, Homo sapiens
gaaatcatattctcagtccttc

SEQ ID NO: 65899 - DNA, 22 bp, Homo sapiens
ttgttgtcattgtagaggattt

SEQ ID NO: 65900 - DNA, 22 bp, Homo sapiens
tcccagaaccctgccaggtcct

SEQ ID NO: 65901 - DNA, 22 bp, Homo sapiens
caaccccactacacgttggaga

SEQ ID NO: 65902 - DNA, 22 bp, Homo sapiens
gggtaggcaaagcaatgacgtt

SEQ ID NO: 65903 - DNA, 22 bp, Homo sapiens
aggtttctttatgctgctagaa

SEQ ID NO: 65904 - DNA, 22 bp, Homo sapiens
tgagccgtggtctctgagggtg

SEQ ID NO: 65905 - DNA, 22 bp, Homo sapiens
aatgcaatgcagcacctccttg

SEQ ID NO: 65906 - DNA, 22 bp, Homo sapiens
cttagagatgggttttacttag

SEQ ID NO: 65907 - DNA, 22 bp, Homo sapiens
gagcccaggagtttgatgctgc

SEQ ID NO: 65908 - DNA, 22 bp, Homo sapiens
taggaatggtgctcagcagaaa

SEQ ID NO: 65909 - DNA, 22 bp, Homo sapiens
acacttggagcaacacttatgg

SEQ ID NO: 65910 - DNA, 22 bp, Homo sapiens
tgcgatgcaacagcttggcgga

SEQ ID NO: 65911 - DNA, 21 bp, Homo sapiens
ttgatggtgggtgatgctctg

SEQ ID NO: 65912 - DNA, 22 bp, Homo sapiens
ctgagcagatgaccagccccag

SEQ ID NO: 65913 - DNA, 22 bp, Homo sapiens
atgccactgcactccagcctag

SEQ ID NO: 65914 - DNA, 22 bp, Homo sapiens
tccaagatctacagcagtttag

SEQ ID NO: 65915 - DNA, 20 bp, Homo sapiens
gtctccactgggggttaacc

SEQ ID NO: 65916 - DNA, 22 bp, Homo sapiens
tacatttataaggcttctctgt

SEQ ID NO: 65917 - DNA, 14 bp, Homo sapiens
gcaggcagatcacc

SEQ ID NO: 65918 - DNA, 22 bp, Homo sapiens
tcctttaaacaaccagctctca

SEQ ID NO: 65919 - DNA, 18 bp, Homo sapiens
agctccatctgtcagcat

SEQ ID NO: 65920 - DNA, 22 bp, Homo sapiens
cactgcactccagcccgggcaa

SEQ ID NO: 65921 - DNA, 22 bp, Homo sapiens
ttgtgaatagtgccgcaataaa

SEQ ID NO: 65922 - DNA, 22 bp, Homo sapiens
tcgaaggaggcactcagacatg

SEQ ID NO: 65923 - DNA, 22 bp, Homo sapiens
aggtattattagcatctctatt

SEQ ID NO: 65924 - DNA, 22 bp, Homo sapiens
ctttttcctcgtagagcctaat

SEQ ID NO: 65925 - DNA, 22 bp, Homo sapiens
aggcgaagggaccagacggtag

SEQ ID NO: 65926 - DNA, 22 bp, Homo sapiens
tcccagagctctggaggttgga

SEQ ID NO: 65927 - DNA, 22 bp, Homo sapiens
cactcagctgagccctcagccc

SEQ ID NO: 65928 - DNA, 22 bp, Homo sapiens
attctggacaaggcaagctcct

SEQ ID NO: 65929 - DNA, 22 bp, Homo sapiens
tttgcttcacaagtatggttct

SEQ ID NO: 65930 - DNA, 22 bp, Homo sapiens
agtggccagcagcctagcctag

SEQ ID NO: 65931 - DNA, 22 bp, Homo sapiens
cgctgcgaggcgcccttgttgc

SEQ ID NO: 65932 - DNA, 22 bp, Homo sapiens
acctcctggcctcaagcaatcc

SEQ ID NO: 65933 - DNA, 22 bp, Homo sapiens
tgtctccaccatcatcttacca

SEQ ID NO: 65934 - DNA, 22 bp, Homo sapiens
tgtgactaggcctgagctcttg

SEQ ID NO: 65935 - DNA, 22 bp, Homo sapiens
tgctgctccccagcacacagca

SEQ ID NO: 65936 - DNA, 22 bp, Homo sapiens
cccacgtcgaacttgctccaga

SEQ ID NO: 65937 - DNA, 22 bp, Homo sapiens
gcttccacctactaaatgccac

SEQ ID NO: 65938 - DNA, 22 bp, Homo sapiens
aagaggttgtctgtgatgagtt

SEQ ID NO: 65939 - DNA, 22 bp, Homo sapiens
tgggaagctgcattttaacaag

SEQ ID NO: 65940 - DNA, 22 bp, Homo sapiens
gatcagagccagagatgataac

SEQ ID NO: 65941 - DNA, 22 bp, Homo sapiens
atgaaaacggaccagagctatt

SEQ ID NO: 65942 - DNA, 22 bp, Homo sapiens
gacccttagaatgtgatcttat

SEQ ID NO: 65943 - DNA, 17 bp, Homo sapiens
ggctgcagtccaggagg

SEQ ID NO: 65944 - DNA, 22 bp, Homo sapiens
atgttatgtctgggaaggggta

SEQ ID NO: 65945 - DNA, 22 bp, Homo sapiens
agaagccaccagctgaggaaga

SEQ ID NO: 65946 - DNA, 22 bp, Homo sapiens
gctttatccgcttgacccttac

SEQ ID NO: 65947 - DNA, 22 bp, Homo sapiens
ggctcacgcaattatcccggcc

SEQ ID NO: 65948 - DNA, 22 bp, Homo sapiens
ggcctgtaatcccagctactca

SEQ ID NO: 65949 - DNA, 22 bp, Homo sapiens
gaccttcttgctgtgtcctaac

SEQ ID NO: 65950 - DNA, 22 bp, Homo sapiens
cacactgtctttatgagctgta

SEQ ID NO: 65951 - DNA, 22 bp, Homo sapiens
tcaggaggcggaggttgcagtg

SEQ ID NO: 65952 - DNA, 22 bp, Homo sapiens
agaggcaggaggttgacttgag

SEQ ID NO: 65953 - DNA, 22 bp, Homo sapiens
ttttaatactgctattgtagga

SEQ ID NO: 65954 - DNA, 22 bp, Homo sapiens
gcactgcaggtgggtggagagg

SEQ ID NO: 65955 - DNA, 22 bp, Homo sapiens
gaagattgaaggctgggaatta

SEQ ID NO: 65956 - DNA, 22 bp, Homo sapiens
tggatgctgtaggacacgctct

SEQ ID NO: 65957 - DNA, 22 bp, Homo sapiens
cttatcttacttccccttcatg

SEQ ID NO: 65958 - DNA, 22 bp, Homo sapiens
gtgcaattcactgttatgtctg

SEQ ID NO: 65959 - DNA, 22 bp, Homo sapiens
aaaatcctgctgactcgagatg

SEQ ID NO: 65960 - DNA, 22 bp, Homo sapiens
ctcctgagctctgaggaagctt

SEQ ID NO: 65961 - DNA, 22 bp, Homo sapiens
aggacaaaggaccagatctgga

SEQ ID NO: 65962 - DNA, 22 bp, Homo sapiens
ctggccagatgttacgtccaat

SEQ ID NO: 65963 - DNA, 22 bp, Homo sapiens
atgaggcaggtggaggctgcca

SEQ ID NO: 65964 - DNA, 22 bp, Homo sapiens
tcactacaacctccgcctcctg

SEQ ID NO: 65965 - DNA, 22 bp, Homo sapiens
tcccagattcctgctcttatat

SEQ ID NO: 65966 - DNA, 22 bp, Homo sapiens
cttctcttcctttgtcaactga

SEQ ID NO: 65967 - DNA, 22 bp, Homo sapiens
ctgatagacaatcaccatggga

SEQ ID NO: 65968 - DNA, 22 bp, Homo sapiens
ggagtgactctcggggccacta

SEQ ID NO: 65969 - DNA, 22 bp, Homo sapiens
tgaccaatactgtggatgccag

SEQ ID NO: 65970 - DNA, 18 bp, Homo sapiens
cttttcccctttggactc

SEQ ID NO: 65971 - DNA, 22 bp, Homo sapiens
gtagcccacctggggagggcga

SEQ ID NO: 65972 - DNA, 22 bp, Homo sapiens
agggccagcactcctggcagga

SEQ ID NO: 65973 - DNA, 22 bp, Homo sapiens
gggtacttaatatttacggggt

SEQ ID NO: 65974 - DNA, 22 bp, Homo sapiens
ctgtcaggtttcccggctcacg

SEQ ID NO: 65975 - DNA, 23 bp, Homo sapiens
tactatggttattatccctctcc

SEQ ID NO: 65976 - DNA, 22 bp, Homo sapiens
aagttgttgttgaggtgggtaa

SEQ ID NO: 65977 - DNA, 22 bp, Homo sapiens
gaagatacaaatttcttagatg

SEQ ID NO: 65978 - DNA, 18 bp, Homo sapiens
ccctcttgcacaaagcaa

SEQ ID NO: 65979 - DNA, 22 bp, Homo sapiens
gctcttgtcaaaaattagttga

SEQ ID NO: 65980 - DNA, 22 bp, Homo sapiens
agaaaacataggagacaggaaa

SEQ ID NO: 65981 - DNA, 22 bp, Homo sapiens
cgtggggcgggtggacacttgc

SEQ ID NO: 65982 - DNA, 22 bp, Homo sapiens
tcgccatggaagtccttgcgga

SEQ ID NO: 65983 - DNA, 21 bp, Homo sapiens
tgctccaggagggggcagtcc

SEQ ID NO: 65984 - DNA, 22 bp, Homo sapiens
tcaatcacgtgttccatgttct

SEQ ID NO: 65985 - DNA, 22 bp, Homo sapiens
ttacctctagctctttgcttgt

SEQ ID NO: 65986 - DNA, 22 bp, Homo sapiens
gtaatagtctcaaactcctgga

SEQ ID NO: 65987 - DNA, 22 bp, Homo sapiens
aggtggcagatgggggtgctcg

SEQ ID NO: 65988 - DNA, 22 bp, Homo sapiens
agatgtgtttctagttcctgca

SEQ ID NO: 65989 - DNA, 22 bp, Homo sapiens
aaacttttttaggttcataggc

SEQ ID NO: 65990 - DNA, 22 bp, Homo sapiens
ctaggaccactgtaacaaagta

SEQ ID NO: 65991 - DNA, 22 bp, Homo sapiens
cagcagagaaattacatatttg

SEQ ID NO: 65992 - DNA, 22 bp, Homo sapiens
tctcagggctcagagctcaggc

SEQ ID NO: 65993 - DNA, 22 bp, Homo sapiens
ctaggtgatccactgctctctt

SEQ ID NO: 65994 - DNA, 22 bp, Homo sapiens
agcagcttgaggctggattcca

SEQ ID NO: 65995 - DNA, 22 bp, Homo sapiens
gctcatgactgtaatcccagca

SEQ ID NO: 65996 - DNA, 22 bp, Homo sapiens
tgtcctcatcctccagtctgtc

SEQ ID NO: 65997 - DNA, 22 bp, Homo sapiens
ggacctgaacataaaacgaggc

SEQ ID NO: 65998 - DNA, 22 bp, Homo sapiens
atgaggcaggagtgcagtggca

SEQ ID NO: 65999 - DNA, 22 bp, Homo sapiens
aaacccagggttttgtcttccc

SEQ ID NO: 66000 - DNA, 22 bp, Homo sapiens
cggctggtgtcgggcacagcaa

SEQ ID NO: 66001 - DNA, 22 bp, Homo sapiens
ggctcaatgcaacttctgcctc

SEQ ID NO: 66002 - DNA, 22 bp, Homo sapiens
atgtgagtgctatgatagacag

SEQ ID NO: 66003 - DNA, 22 bp, Homo sapiens
gccaggcgggtctcaaactcct

SEQ ID NO: 66004 - DNA, 22 bp, Homo sapiens
gcctgtgtggatgcgccggtgc

SEQ ID NO: 66005 - DNA, 22 bp, Homo sapiens
taggtttactgaattagtggaa

SEQ ID NO: 66006 - DNA, 22 bp, Homo sapiens
ggaggagcatgagagggtagtg

SEQ ID NO: 66007 - DNA, 22 bp, Homo sapiens
agggaacatttgcactgttggt

SEQ ID NO: 66008 - DNA, 22 bp, Homo sapiens
ttcaggcccagcacagcgcgtg

SEQ ID NO: 66009 - DNA, 22 bp, Homo sapiens
cgcaggtgaaagaggctgggca

SEQ ID NO: 66010 - DNA, 17 bp, Homo sapiens
tggtagaatgacaggcc

SEQ ID NO: 66011 - DNA, 22 bp, Homo sapiens
acaggcttacaggctgcaagta

SEQ ID NO: 66012 - DNA, 22 bp, Homo sapiens
tgcacgtgtgagcattcacatg

SEQ ID NO: 66013 - DNA, 22 bp, Homo sapiens
tggagagttctgtagatatcta

SEQ ID NO: 66014 - DNA, 22 bp, Homo sapiens
attaagactgcccatgttttta

SEQ ID NO: 66015 - DNA, 22 bp, Homo sapiens
tgctggtaccgcgcctccgcca

SEQ ID NO: 66016 - DNA, 22 bp, Homo sapiens
gctcccaccgccgctatgggta

SEQ ID NO: 66017 - DNA, 22 bp, Homo sapiens
agacactgttctcacatgcttg

SEQ ID NO: 66018 - DNA, 22 bp, Homo sapiens
attataggcttgagccaccgtg

SEQ ID NO: 66019 - DNA, 22 bp, Homo sapiens
gggaaggaaagttattagcaga

SEQ ID NO: 66020 - DNA, 22 bp, Homo sapiens
ggaggggatttagtagatgcta

SEQ ID NO: 66021 - DNA, 22 bp, Homo sapiens
actgatcaagggtttaatttta

SEQ ID NO: 66022 - DNA, 22 bp, Homo sapiens
tttaagaagttatgttataaat

SEQ ID NO: 66023 - DNA, 21 bp, Homo sapiens
aaactgaccttgcctgagaca

SEQ ID NO: 66024 - DNA, 22 bp, Homo sapiens
cacactgtctttcagaatggtt

SEQ ID NO: 66025 - DNA, 22 bp, Homo sapiens
tggctcctcacgtcctcagagc

SEQ ID NO: 66026 - DNA, 22 bp, Homo sapiens
atgaagctactgaatatttggt

SEQ ID NO: 66027 - DNA, 22 bp, Homo sapiens
atatacacatctttttaaatat

SEQ ID NO: 66028 - DNA, 22 bp, Homo sapiens
gaggctgaggttgcagtgagcc

SEQ ID NO: 66029 - DNA, 22 bp, Homo sapiens
cagagctgtccaaaccctgaca

SEQ ID NO: 66030 - DNA, 22 bp, Homo sapiens
cttatagtatgatgttgagaat

SEQ ID NO: 66031 - DNA, 22 bp, Homo sapiens
tagaggctttcagcggtaggtc

SEQ ID NO: 66032 - DNA, 22 bp, Homo sapiens
tgctgggattacagtcatgagc

SEQ ID NO: 66033 - DNA, 22 bp, Homo sapiens
caatttctaacattccatggat

SEQ ID NO: 66034 - DNA, 22 bp, Homo sapiens
ttcttctaaatgtgcttattaa

SEQ ID NO: 66035 - DNA, 22 bp, Homo sapiens
attttctatgttgtaattgtta

SEQ ID NO: 66036 - DNA, 22 bp, Homo sapiens
gtgtcaggccctgcattatgtg

SEQ ID NO: 66037 - DNA, 22 bp, Homo sapiens
tcctgccttgcctgggacatca

SEQ ID NO: 66038 - DNA, 22 bp, Homo sapiens
tcacagctcactgtagcctcga

SEQ ID NO: 66039 - DNA, 22 bp, Homo sapiens
tggggacttgccttgttgctca

SEQ ID NO: 66040 - DNA, 22 bp, Homo sapiens
ggagtgcagtggcgtgatctcg

SEQ ID NO: 66041 - DNA, 22 bp, Homo sapiens
atggggagctcaccacctgttt

SEQ ID NO: 66042 - DNA, 22 bp, Homo sapiens
tgttgattagtgtttagactta

SEQ ID NO: 66043 - DNA, 22 bp, Homo sapiens
cctctgtgtctccaagaggcct

SEQ ID NO: 66044 - DNA, 22 bp, Homo sapiens
tcgaaataatttagaatataga

SEQ ID NO: 66045 - DNA, 22 bp, Homo sapiens
ggcgctcagtgttgccccagag

SEQ ID NO: 66046 - DNA, 22 bp, Homo sapiens
aggccagcctcaggcagggacc

SEQ ID NO: 66047 - DNA, 22 bp, Homo sapiens
gccctgtgcaggtgtgcagcag

SEQ ID NO: 66048 - DNA, 22 bp, Homo sapiens
cttgtagaattgaaatggtctc

SEQ ID NO: 66049 - DNA, 22 bp, Homo sapiens
gctgtctcatacaaggccctgc

SEQ ID NO: 66050 - DNA, 22 bp, Homo sapiens
atcctagaatcagcccttgctg

SEQ ID NO: 66051 - DNA, 22 bp, Homo sapiens
tgggttcgatgtatatgtagcc

SEQ ID NO: 66052 - DNA, 22 bp, Homo sapiens
ccggctactcgggaggctgacg

SEQ ID NO: 66053 - DNA, 22 bp, Homo sapiens
gtccctgagcctggcatttccc

SEQ ID NO: 66054 - DNA, 22 bp, Homo sapiens
gggtggtggccagcagtgggca

SEQ ID NO: 66055 - DNA, 20 bp, Homo sapiens
ttcgctgggagtggccaggc

SEQ ID NO: 66056 - DNA, 22 bp, Homo sapiens
gcagtggcatgatgtgggctca

SEQ ID NO: 66057 - DNA, 22 bp, Homo sapiens
atcacaaaggtctcagagcaca

SEQ ID NO: 66058 - DNA, 22 bp, Homo sapiens
tgggggagctcagtccagccca

SEQ ID NO: 66059 - DNA, 22 bp, Homo sapiens
ctggaaggcggaggttgtagtg

SEQ ID NO: 66060 - DNA, 22 bp, Homo sapiens
acatacttctttacattccata

SEQ ID NO: 66061 - DNA, 21 bp, Homo sapiens
cagagctgtccaaaccctgac

SEQ ID NO: 66062 - DNA, 22 bp, Homo sapiens
atgccactgcactccagcctgg

SEQ ID NO: 66063 - DNA, 22 bp, Homo sapiens
ccacccttgggttcggaggccg

SEQ ID NO: 66064 - DNA, 22 bp, Homo sapiens
tacccaaggccctttcaatttc

SEQ ID NO: 66065 - DNA, 22 bp, Homo sapiens
tagcacagggctcctcaaccca

SEQ ID NO: 66066 - DNA, 22 bp, Homo sapiens
tctgctggaaaaccagggaatt

SEQ ID NO: 66067 - DNA, 19 bp, Homo sapiens
cccaggaagcggaggttgc

SEQ ID NO: 66068 - DNA, 22 bp, Homo sapiens
caatagtgtctgcttgtttcta

SEQ ID NO: 66069 - DNA, 22 bp, Homo sapiens
gatgccctggcctgtccccgca

SEQ ID NO: 66070 - DNA, 22 bp, Homo sapiens
gtggctgcagcggctgtggaga

SEQ ID NO: 66071 - DNA, 22 bp, Homo sapiens
cactgcactccagcactccagc

SEQ ID NO: 66072 - DNA, 22 bp, Homo sapiens
tacactgtttgaactgtggtcg

SEQ ID NO: 66073 - DNA, 22 bp, Homo sapiens
aggggatggagctggaaggcag

SEQ ID NO: 66074 - DNA, 22 bp, Homo sapiens
atttattcctttatggctggag

SEQ ID NO: 66075 - DNA, 22 bp, Homo sapiens
gcggggggaggaacatcttgca

SEQ ID NO: 66076 - DNA, 22 bp, Homo sapiens
tctctagtctcctttaacctga

SEQ ID NO: 66077 - DNA, 22 bp, Homo sapiens
ctcactgcaagctccacctctt

SEQ ID NO: 66078 - DNA, 22 bp, Homo sapiens
cctcgacctccccaggctcagg

SEQ ID NO: 66079 - DNA, 22 bp, Homo sapiens
gctggggaggcagcagagaaca

SEQ ID NO: 66080 - DNA, 22 bp, Homo sapiens
gaggcacagagtaggtgcacac

SEQ ID NO: 66081 - DNA, 22 bp, Homo sapiens
gatcctgggcccttctgggtca

SEQ ID NO: 66082 - DNA, 22 bp, Homo sapiens
cctgaggatgccagcatgggtg

SEQ ID NO: 66083 - DNA, 19 bp, Homo sapiens
tctcacagctctactatgt

SEQ ID NO: 66084 - DNA, 22 bp, Homo sapiens
agccagggacgctgcaggctac

SEQ ID NO: 66085 - DNA, 22 bp, Homo sapiens
gtagctctgtttaaagttcttt

SEQ ID NO: 66086 - DNA, 22 bp, Homo sapiens
tttgtagcagcatgatttataa

SEQ ID NO: 66087 - DNA, 22 bp, Homo sapiens
tggcctcggcatccagcaagag

SEQ ID NO: 66088 - DNA, 22 bp, Homo sapiens
tgttgagtatatacctacaagt

SEQ ID NO: 66089 - DNA, 22 bp, Homo sapiens
agggactatttacccatctcac

SEQ ID NO: 66090 - DNA, 22 bp, Homo sapiens
tgggaggccaaggcaggcggat

SEQ ID NO: 66091 - DNA, 22 bp, Homo sapiens
agcaacctcatgagagtgaaat

SEQ ID NO: 66092 - DNA, 20 bp, Homo sapiens
aaaatatgtataactcttct

SEQ ID NO: 66093 - DNA, 22 bp, Homo sapiens
tgttttaagggtcaactgtcac

SEQ ID NO: 66094 - DNA, 22 bp, Homo sapiens
cattcattacactcataaggtt

SEQ ID NO: 66095 - DNA, 22 bp, Homo sapiens
gactacaggccggcatcagaga

SEQ ID NO: 66096 - DNA, 22 bp, Homo sapiens
aggaatggtgctcagcagaaat

SEQ ID NO: 66097 - DNA, 21 bp, Homo sapiens
tgcaatccagcctgggcgaca

SEQ ID NO: 66098 - DNA, 22 bp, Homo sapiens
gctgaggtggaggaaggagacc

SEQ ID NO: 66099 - DNA, 22 bp, Homo sapiens
gggttgaggcggatgtcggcgg

SEQ ID NO: 66100 - DNA, 22 bp, Homo sapiens
ccaagctacttaggagtctgag

SEQ ID NO: 66101 - DNA, 22 bp, Homo sapiens
tgactcagtacatctggagttg

SEQ ID NO: 66102 - DNA, 22 bp, Homo sapiens
gctcactgcaagctctgcctcc

SEQ ID NO: 66103 - DNA, 21 bp, Homo sapiens
accaccctgtttatccagagg

SEQ ID NO: 66104 - DNA, 22 bp, Homo sapiens
tgagccaggagtttgaggctgt

SEQ ID NO: 66105 - DNA, 22 bp, Homo sapiens
tcaggagtgccagtaccttttg

SEQ ID NO: 66106 - DNA, 22 bp, Homo sapiens
ttccatttggcacttcactgag

SEQ ID NO: 66107 - DNA, 22 bp, Homo sapiens
tgcgccatgtgctctcggccct

SEQ ID NO: 66108 - DNA, 22 bp, Homo sapiens
tctgctcagccgatctgctccg

SEQ ID NO: 66109 - DNA, 22 bp, Homo sapiens
cttgatgagtcagaactgaagg

SEQ ID NO: 66110 - DNA, 22 bp, Homo sapiens
tctctcttttttgaacccgctc

SEQ ID NO: 66111 - DNA, 22 bp, Homo sapiens
ttttcctggagatggagttgtt

SEQ ID NO: 66112 - DNA, 22 bp, Homo sapiens
ccacgtccagctaattttcgta

SEQ ID NO: 66113 - DNA, 22 bp, Homo sapiens
tctacatgcagcgaggggactt

SEQ ID NO: 66114 - DNA, 22 bp, Homo sapiens
ttacactttaaatccagcttgt

SEQ ID NO: 66115 - DNA, 22 bp, Homo sapiens
agttattactctttaacatatt

SEQ ID NO: 66116 - DNA, 22 bp, Homo sapiens
tccttaggcaatttgggagagt

SEQ ID NO: 66117 - DNA, 22 bp, Homo sapiens
tgtacacatggtgtacactccc

SEQ ID NO: 66118 - DNA, 22 bp, Homo sapiens
gcagactgtatcaatgtcagta

SEQ ID NO: 66119 - DNA, 22 bp, Homo sapiens
gggaggcagtgctggaggctgg

SEQ ID NO: 66120 - DNA, 22 bp, Homo sapiens
ctgccctggggggcctccttgc

SEQ ID NO: 66121 - DNA, 22 bp, Homo sapiens
ttccatacgactgaggtctcgg

SEQ ID NO: 66122 - DNA, 22 bp, Homo sapiens
gccagggttcgaatccgtatgg

SEQ ID NO: 66123 - DNA, 22 bp, Homo sapiens
tcgaactcatagtcgtagctgt

SEQ ID NO: 66124 - DNA, 22 bp, Homo sapiens
tcactgcactccagcctgggtg

SEQ ID NO: 66125 - DNA, 22 bp, Homo sapiens
tagactggtgaattagggggaa

SEQ ID NO: 66126 - DNA, 22 bp, Homo sapiens
ggctccctgcaacctccgcctc

SEQ ID NO: 66127 - DNA, 23 bp, Homo sapiens
acagcaagaggaccagatgtgag

SEQ ID NO: 66128 - DNA, 22 bp, Homo sapiens
tcttcccccgtgctccagtgca

SEQ ID NO: 66129 - DNA, 22 bp, Homo sapiens
ttcatgggtccagagccctggg

SEQ ID NO: 66130 - DNA, 22 bp, Homo sapiens
taattcttcaggccttttgtct

SEQ ID NO: 66131 - DNA, 22 bp, Homo sapiens
gtctgaatacgtacttgtgaag

SEQ ID NO: 66132 - DNA, 22 bp, Homo sapiens
agctcaagctacacacagagtc

SEQ ID NO: 66133 - DNA, 20 bp, Homo sapiens
ggtcactgtggctgcaggat

SEQ ID NO: 66134 - DNA, 22 bp, Homo sapiens
gtatcacttttgagagtgagaa

SEQ ID NO: 66135 - DNA, 22 bp, Homo sapiens
tggtattctttctgtagatcat

SEQ ID NO: 66136 - DNA, 22 bp, Homo sapiens
cggggttcatccatgctgtggc

SEQ ID NO: 66137 - DNA, 22 bp, Homo sapiens
gccctcctggcaggcagtgatg

SEQ ID NO: 66138 - DNA, 21 bp, Homo sapiens
gtgcggatgccgtcattgtca

SEQ ID NO: 66139 - DNA, 22 bp, Homo sapiens
aagtggactaatacaaggacta

SEQ ID NO: 66140 - DNA, 22 bp, Homo sapiens
gggccctgggattcagagcaag

SEQ ID NO: 66141 - DNA, 22 bp, Homo sapiens
gtgtaagtatctttgtatcttt

SEQ ID NO: 66142 - DNA, 22 bp, Homo sapiens
gagcagtaggagaaccctgagc

SEQ ID NO: 66143 - DNA, 22 bp, Homo sapiens
ttttcatttttgtagatgcaag

SEQ ID NO: 66144 - DNA, 22 bp, Homo sapiens
taatgtaaacacagagacagaa

SEQ ID NO: 66145 - DNA, 22 bp, Homo sapiens
gagcactgatttatttttgtct

SEQ ID NO: 66146 - DNA, 22 bp, Homo sapiens
gctggtagacctcactgcactc

SEQ ID NO: 66147 - DNA, 22 bp, Homo sapiens
gtgcaaaagtaattgtggtttt

SEQ ID NO: 66148 - DNA, 22 bp, Homo sapiens
tgctcgccccacatgccctcat

SEQ ID NO: 66149 - DNA, 22 bp, Homo sapiens
ggcctgggctccgggagttact

SEQ ID NO: 66150 - DNA, 22 bp, Homo sapiens
aaaagagcttggttgattttgc

SEQ ID NO: 66151 - DNA, 22 bp, Homo sapiens
aagtgtgtgagcctgtcaggct

SEQ ID NO: 66152 - DNA, 22 bp, Homo sapiens
ggtggttcacgcctataatccc

SEQ ID NO: 66153 - DNA, 22 bp, Homo sapiens
cgggcaaggcgagactaggccc

SEQ ID NO: 66154 - DNA, 21 bp, Homo sapiens
tgtaagtttcatctgaattgg

SEQ ID NO: 66155 - DNA, 22 bp, Homo sapiens
cccattcatcctcgcttccttc

SEQ ID NO: 66156 - DNA, 22 bp, Homo sapiens
cccaggaggcagagcttgcagt

SEQ ID NO: 66157 - DNA, 22 bp, Homo sapiens
cgtgtggtcccggcaaggcaag

SEQ ID NO: 66158 - DNA, 22 bp, Homo sapiens
tgcctgatgcaggagtatcaga

SEQ ID NO: 66159 - DNA, 22 bp, Homo sapiens
gcagcctcaaactccccagctc

SEQ ID NO: 66160 - DNA, 22 bp, Homo sapiens
ctccagattccgtttattcagg

SEQ ID NO: 66161 - DNA, 22 bp, Homo sapiens
gagcagtgtttgtggacctgga

SEQ ID NO: 66162 - DNA, 22 bp, Homo sapiens
tccaactttctcctccggcttg

SEQ ID NO: 66163 - DNA, 22 bp, Homo sapiens
accattgccccctagtgtctgt

SEQ ID NO: 66164 - DNA, 22 bp, Homo sapiens
tttgaaatgtatcagtataggt

SEQ ID NO: 66165 - DNA, 22 bp, Homo sapiens
tggattcacaccattctcctgc

SEQ ID NO: 66166 - DNA, 22 bp, Homo sapiens
tgaatgtgatgctaaacatatg

SEQ ID NO: 66167 - DNA, 22 bp, Homo sapiens
ctgaggcaggagagttgcttga

SEQ ID NO: 66168 - DNA, 20 bp, Homo sapiens
ataaaataactgccacaaga

SEQ ID NO: 66169 - DNA, 22 bp, Homo sapiens
aaagttctctatggtgtaaaaa

SEQ ID NO: 66170 - DNA, 22 bp, Homo sapiens
ttaatgaaaggcagtttggaac

SEQ ID NO: 66171 - DNA, 21 bp, Homo sapiens
gttgtggttggggctgcagct

SEQ ID NO: 66172 - DNA, 22 bp, Homo sapiens
gattgtggaagtcagtggttct

SEQ ID NO: 66173 - DNA, 22 bp, Homo sapiens
actcccagaacatgctcttctt

SEQ ID NO: 66174 - DNA, 22 bp, Homo sapiens
gcctgcagggcctgggcctacc

SEQ ID NO: 66175 - DNA, 22 bp, Homo sapiens
tactttgtccatttgcaggcag

SEQ ID NO: 66176 - DNA, 22 bp, Homo sapiens
tgcacgtgggctctctgctctt

SEQ ID NO: 66177 - DNA, 19 bp, Homo sapiens
ccttgtctggtgaaggact

SEQ ID NO: 66178 - DNA, 22 bp, Homo sapiens
aattgcaaattcagacttaaga

SEQ ID NO: 66179 - DNA, 22 bp, Homo sapiens
gctcggtggccagcctgaggcc

SEQ ID NO: 66180 - DNA, 22 bp, Homo sapiens
tgacatttcctagtgctttgtg

SEQ ID NO: 66181 - DNA, 22 bp, Homo sapiens
gcatgtgtctttatagcagcat

SEQ ID NO: 66182 - DNA, 22 bp, Homo sapiens
gaccctgtttctacaaataatt

SEQ ID NO: 66183 - DNA, 22 bp, Homo sapiens
gggaaggccttgtcagcggatt

SEQ ID NO: 66184 - DNA, 22 bp, Homo sapiens
gccctcctgagctagcacgtgt

SEQ ID NO: 66185 - DNA, 22 bp, Homo sapiens
tgggcaggggccctgcttccgt

SEQ ID NO: 66186 - DNA, 22 bp, Homo sapiens
gggcggatcacctgaggtcagg

SEQ ID NO: 66187 - DNA, 22 bp, Homo sapiens
cttcagctgcagttatgtttag

SEQ ID NO: 66188 - DNA, 22 bp, Homo sapiens
agttgcagacgcagagatgttg

SEQ ID NO: 66189 - DNA, 22 bp, Homo sapiens
ttctgcaggctgtacaagaagc

SEQ ID NO: 66190 - DNA, 22 bp, Homo sapiens
gtcctggggattatagagtgtt

SEQ ID NO: 66191 - DNA, 22 bp, Homo sapiens
cagggcctcctaaggcatctaa

SEQ ID NO: 66192 - DNA, 22 bp, Homo sapiens
aggatgagccgcgcaagctgac

SEQ ID NO: 66193 - DNA, 22 bp, Homo sapiens
ccaggaggcggaggttgcagcg

SEQ ID NO: 66194 - DNA, 22 bp, Homo sapiens
atcttcccaggctggggagagg

SEQ ID NO: 66195 - DNA, 22 bp, Homo sapiens
gggacttaatgcagagagggac

SEQ ID NO: 66196 - DNA, 22 bp, Homo sapiens
gagcccaggagtttgatgctgc

SEQ ID NO: 66197 - DNA, 22 bp, Homo sapiens
aggaattcaagaccagctgggc

SEQ ID NO: 66198 - DNA, 22 bp, Homo sapiens
aggggaatgggtagactgttga

SEQ ID NO: 66199 - DNA, 22 bp, Homo sapiens
tcccacacagcccgctcaccgg

SEQ ID NO: 66200 - DNA, 22 bp, Homo sapiens
agaatccctgcttgtcttcaaa

SEQ ID NO: 66201 - DNA, 22 bp, Homo sapiens
tggaatgcagtgggagcttacc

SEQ ID NO: 66202 - DNA, 22 bp, Homo sapiens
tcagattgttggagccaaacag

SEQ ID NO: 66203 - DNA, 22 bp, Homo sapiens
tgggactcactcttttggccag

SEQ ID NO: 66204 - DNA, 22 bp, Homo sapiens
gtggagaggaacccagctctgt

SEQ ID NO: 66205 - DNA, 22 bp, Homo sapiens
tgatggctgtagggtccggggc

SEQ ID NO: 66206 - DNA, 22 bp, Homo sapiens
gatgtgtttccaggatttgttt

SEQ ID NO: 66207 - DNA, 22 bp, Homo sapiens
aagccctggcgggtggagggcc

SEQ ID NO: 66208 - DNA, 22 bp, Homo sapiens
tcacagctcactgtagcctcga

SEQ ID NO: 66209 - DNA, 22 bp, Homo sapiens
agggaagaggaccagagtctct

SEQ ID NO: 66210 - DNA, 22 bp, Homo sapiens
acttcttcttcagctgggggat

SEQ ID NO: 66211 - DNA, 22 bp, Homo sapiens
tcagcctgctccaagtgctgcc

SEQ ID NO: 66212 - DNA, 22 bp, Homo sapiens
ctcattgcaacctccgcctccc

SEQ ID NO: 66213 - DNA, 22 bp, Homo sapiens
agctggggctgtggttgtgatt

SEQ ID NO: 66214 - DNA, 22 bp, Homo sapiens
gacagacacaattgatccatga

SEQ ID NO: 66215 - DNA, 22 bp, Homo sapiens
aagctgttgttcatcctgaatt

SEQ ID NO: 66216 - DNA, 22 bp, Homo sapiens
agaaaacataggagacaggaaa

SEQ ID NO: 66217 - DNA, 23 bp, Homo sapiens
ggagcctccggtgtgtgagaggc

SEQ ID NO: 66218 - DNA, 22 bp, Homo sapiens
tccacgctgtgtgaccttgggc

SEQ ID NO: 66219 - DNA, 22 bp, Homo sapiens
ataaagtggaggtagtattcat

SEQ ID NO: 66220 - DNA, 22 bp, Homo sapiens
tagggtagtaccatgctgccag

SEQ ID NO: 66221 - DNA, 21 bp, Homo sapiens
gctcctggtgctgcgtggcgc

SEQ ID NO: 66222 - DNA, 22 bp, Homo sapiens
gattgagtctgaggatgctgca

SEQ ID NO: 66223 - DNA, 22 bp, Homo sapiens
tagttcaacgagttggggttgc

SEQ ID NO: 66224 - DNA, 22 bp, Homo sapiens
ttccaaaggctgcaccttgccc

SEQ ID NO: 66225 - DNA, 22 bp, Homo sapiens
tgttttaagggtcaactgtcac

SEQ ID NO: 66226 - DNA, 22 bp, Homo sapiens
tgataaacttagaaagaatgtt

SEQ ID NO: 66227 - DNA, 22 bp, Homo sapiens
tagatctgatacaattcatctg

SEQ ID NO: 66228 - DNA, 22 bp, Homo sapiens
tctggctccaggaccgggcaca

SEQ ID NO: 66229 - DNA, 22 bp, Homo sapiens
tgcttctgactaagctgcatga

SEQ ID NO: 66230 - DNA, 17 bp, Homo sapiens
tgcatgtcctttgttcc

SEQ ID NO: 66231 - DNA, 22 bp, Homo sapiens
tttgtagcagcatgatttataa

SEQ ID NO: 66232 - DNA, 22 bp, Homo sapiens
gaaaattattgaaaatggctct

SEQ ID NO: 66233 - DNA, 22 bp, Homo sapiens
gagagtctaggaacctcatata

SEQ ID NO: 66234 - DNA, 22 bp, Homo sapiens
tatttcttttcgtgacttattg

SEQ ID NO: 66235 - DNA, 22 bp, Homo sapiens
agaatccctggggagctgcagc

SEQ ID NO: 66236 - DNA, 22 bp, Homo sapiens
gatagtcacctcccttaacttt

SEQ ID NO: 66237 - DNA, 22 bp, Homo sapiens
gctcaagccttctgcccacctc

SEQ ID NO: 66238 - DNA, 22 bp, Homo sapiens
atctggttttggctgtgtccct

SEQ ID NO: 66239 - DNA, 17 bp, Homo sapiens
gtaaggcttgcagatgc

SEQ ID NO: 66240 - DNA, 22 bp, Homo sapiens
tcctccccaaagcccagcctgg

SEQ ID NO: 66241 - DNA, 22 bp, Homo sapiens
ctgggggtcttgaaagggagag

SEQ ID NO: 66242 - DNA, 23 bp, Homo sapiens
tctacaaagctgtgtcaggaccc

SEQ ID NO: 66243 - DNA, 23 bp, Homo sapiens
gcctgccgcctggctgagaactg

SEQ ID NO: 66244 - DNA, 22 bp, Homo sapiens
ggggtgggcgtgcagggacacc

SEQ ID NO: 66245 - DNA, 22 bp, Homo sapiens
atggtggacgggagacaggact

SEQ ID NO: 66246 - DNA, 22 bp, Homo sapiens
gaaggtggcgagcggattgctg

SEQ ID NO: 66247 - DNA, 22 bp, Homo sapiens
ggaggtggaggttgcagtgagc

SEQ ID NO: 66248 - DNA, 22 bp, Homo sapiens
aaagttctctatggtgtaaaaa

SEQ ID NO: 66249 - DNA, 22 bp, Homo sapiens
acagttaattgttgttgggtgt

SEQ ID NO: 66250 - DNA, 22 bp, Homo sapiens
aggagaagccaagttgtgagca

SEQ ID NO: 66251 - DNA, 21 bp, Homo sapiens
accaccctgtttatccagagg

SEQ ID NO: 66252 - DNA, 22 bp, Homo sapiens
gctcttgtcaaaaattagttga

SEQ ID NO: 66253 - DNA, 22 bp, Homo sapiens
caggaggacatactggctcaca

SEQ ID NO: 66254 - DNA, 22 bp, Homo sapiens
ctcttagtaatgccatgaagca

SEQ ID NO: 66255 - DNA, 22 bp, Homo sapiens
cccaggaggtggagcttgcagt

SEQ ID NO: 66256 - DNA, 22 bp, Homo sapiens
cttatagtatgatgttgagaat

SEQ ID NO: 66257 - DNA, 19 bp, Homo sapiens
ttttggaaatgtgaacagc

SEQ ID NO: 66258 - DNA, 22 bp, Homo sapiens
atgggttcaagtgattctcctg

SEQ ID NO: 66259 - DNA, 22 bp, Homo sapiens
tataaactcctcttgcattcct

SEQ ID NO: 66260 - DNA, 22 bp, Homo sapiens
ccagcttgctcctctgcaatgg

SEQ ID NO: 66261 - DNA, 22 bp, Homo sapiens
aacagctttgtatacagtaact

SEQ ID NO: 66262 - DNA, 22 bp, Homo sapiens
ccagctttatagcttcaaagga

SEQ ID NO: 66263 - DNA, 22 bp, Homo sapiens
aaggaaagctgtggttctgaga

SEQ ID NO: 66264 - DNA, 22 bp, Homo sapiens
ccaggaggcggaaggtacagtg

SEQ ID NO: 66265 - DNA, 22 bp, Homo sapiens
tttgcattgcattaagtattct

SEQ ID NO: 66266 - DNA, 22 bp, Homo sapiens
agactgttgtgtgaagtagggt

SEQ ID NO: 66267 - DNA, 22 bp, Homo sapiens
ccctcccaggagtggccagaga

SEQ ID NO: 66268 - DNA, 22 bp, Homo sapiens
aagaggtagcagtcacaaaaga

SEQ ID NO: 66269 - DNA, 22 bp, Homo sapiens
gttttgaatactactagaactt

SEQ ID NO: 66270 - DNA, 22 bp, Homo sapiens
tcctcagcttttatttcacttg

SEQ ID NO: 66271 - DNA, 22 bp, Homo sapiens
gcgagcctctggagtcctctgg

SEQ ID NO: 66272 - DNA, 22 bp, Homo sapiens
tcatggcttttattatgttgag

SEQ ID NO: 66273 - DNA, 22 bp, Homo sapiens
acatcatttgtctgtagctgaa

SEQ ID NO: 66274 - DNA, 22 bp, Homo sapiens
tctgccgtgcgaggtcccacca

SEQ ID NO: 66275 - DNA, 22 bp, Homo sapiens
gaatccctaagatttttataaa

SEQ ID NO: 66276 - DNA, 17 bp, Homo sapiens
cgggcatggagggcagg

SEQ ID NO: 66277 - DNA, 22 bp, Homo sapiens
gccaccccataggtgttaggtg

SEQ ID NO: 66278 - DNA, 22 bp, Homo sapiens
ggtgggagagctctgtctccag

SEQ ID NO: 66279 - DNA, 23 bp, Homo sapiens
agctctgctcgggcatgccctgc

SEQ ID NO: 66280 - DNA, 22 bp, Homo sapiens
ttctcccatctcagtcttacat

SEQ ID NO: 66281 - DNA, 22 bp, Homo sapiens
gcggcggagacagcaggaagcc

SEQ ID NO: 66282 - DNA, 22 bp, Homo sapiens
atctggttcttcttaggcatca

SEQ ID NO: 66283 - DNA, 22 bp, Homo sapiens
gcagtatctatgtgatgggttg

SEQ ID NO: 66284 - DNA, 22 bp, Homo sapiens
tagcccaggctggagtgcaggg

SEQ ID NO: 66285 - DNA, 22 bp, Homo sapiens
aagaaatgctgatgttggatgg

SEQ ID NO: 66286 - DNA, 20 bp, Homo sapiens
aaaatatgtataactcttct

SEQ ID NO: 66287 - DNA, 22 bp, Homo sapiens
ctgtaatcccagctacctggga

SEQ ID NO: 66288 - DNA, 22 bp, Homo sapiens
tgcctccctggcaagtctctcc

SEQ ID NO: 66289 - DNA, 22 bp, Homo sapiens
tttgaggttagctagcagatca

SEQ ID NO: 66290 - DNA, 22 bp, Homo sapiens
ttccctccatttcattttataa

SEQ ID NO: 66291 - DNA, 22 bp, Homo sapiens
ctggtgggagataattgaatca

SEQ ID NO: 66292 - DNA, 22 bp, Homo sapiens
atgtttaaagggttgagaaata

SEQ ID NO: 66293 - DNA, 22 bp, Homo sapiens
ggagagggtaggggtcctgccc

SEQ ID NO: 66294 - DNA, 22 bp, Homo sapiens
actgcaacacctcctgggttca

SEQ ID NO: 66295 - DNA, 22 bp, Homo sapiens
ctggagtagccggacgggtctg

SEQ ID NO: 66296 - DNA, 22 bp, Homo sapiens
tccttaggcaatttgggagagt

SEQ ID NO: 66297 - DNA, 20 bp, Homo sapiens
ttcgctgggagtggccaggc

SEQ ID NO: 66298 - DNA, 22 bp, Homo sapiens
gaggcaggcagattgcttgagg

SEQ ID NO: 66299 - DNA, 22 bp, Homo sapiens
gatgaatgatggcttgtttctg

SEQ ID NO: 66300 - DNA, 18 bp, Homo sapiens
ttcacaagggcttggttt

SEQ ID NO: 66301 - DNA, 22 bp, Homo sapiens
gcctccggagtcacagtgtctt

SEQ ID NO: 66302 - DNA, 22 bp, Homo sapiens
atgctattgaaaagaaataaga

SEQ ID NO: 66303 - DNA, 22 bp, Homo sapiens
caggaaggggctcactctggcc

SEQ ID NO: 66304 - DNA, 22 bp, Homo sapiens
ctgagatctttatacgaggcac

SEQ ID NO: 66305 - DNA, 22 bp, Homo sapiens
gagagtctagtgcacctagttt

SEQ ID NO: 66306 - DNA, 22 bp, Homo sapiens
atggctctgttttttatgctct

SEQ ID NO: 66307 - DNA, 22 bp, Homo sapiens
gagagttagttgagcagtctga

SEQ ID NO: 66308 - DNA, 21 bp, Homo sapiens
tcacgtggtcacatgagcttt

SEQ ID NO: 66309 - DNA, 22 bp, Homo sapiens
caggaaagggatgggctgccac

SEQ ID NO: 66310 - DNA, 22 bp, Homo sapiens
tcatctccatacggtctcgcag

SEQ ID NO: 66311 - DNA, 22 bp, Homo sapiens
aaggtgggcagatcacaaggtc

SEQ ID NO: 66312 - DNA, 22 bp, Homo sapiens
agagtgcaaccgaaacaagcag

SEQ ID NO: 66313 - DNA, 23 bp, Homo sapiens
aatgggtgcaactatccatgaca

SEQ ID NO: 66314 - DNA, 22 bp, Homo sapiens
gctggcagacttcctctggaac

SEQ ID NO: 66315 - DNA, 22 bp, Homo sapiens
ttttcatttttgtagatgcaag

SEQ ID NO: 66316 - DNA, 23 bp, Homo sapiens
tgcatggggctatactgctgttc

SEQ ID NO: 66317 - DNA, 22 bp, Homo sapiens
tggggagtgatgcctcggataa

SEQ ID NO: 66318 - DNA, 22 bp, Homo sapiens
tagaggccgaatgctgagctgg

SEQ ID NO: 66319 - DNA, 22 bp, Homo sapiens
taactgattcctttttgaaaat

SEQ ID NO: 66320 - DNA, 22 bp, Homo sapiens
gcaagacatgtctaaggtttaa

SEQ ID NO: 66321 - DNA, 22 bp, Homo sapiens
gggaggttgaggctgcagtgag

SEQ ID NO: 66322 - DNA, 19 bp, Homo sapiens
agaatcccaggccccactg

SEQ ID NO: 66323 - DNA, 23 bp, Homo sapiens
ggaagctcacgtagtcctgcact

SEQ ID NO: 66324 - DNA, 22 bp, Homo sapiens
tctccccagtatggattctctg

SEQ ID NO: 66325 - DNA, 22 bp, Homo sapiens
actttcttggtcccatgtttga

SEQ ID NO: 66326 - DNA, 22 bp, Homo sapiens
gcaggcagaggtggaggagaca

SEQ ID NO: 66327 - DNA, 22 bp, Homo sapiens
ggcaagagggcagatggagtgc

SEQ ID NO: 66328 - DNA, 22 bp, Homo sapiens
cccaggaggtcgaagctgcagt

SEQ ID NO: 66329 - DNA, 22 bp, Homo sapiens
acagttaataagtagtaagtca

SEQ ID NO: 66330 - DNA, 22 bp, Homo sapiens
ttatcacttatgagctttttgc

SEQ ID NO: 66331 - DNA, 22 bp, Homo sapiens
cagctacaaatacttttgtatg

SEQ ID NO: 66332 - DNA, 22 bp, Homo sapiens
cttgcctttgtcttcaaaggct

SEQ ID NO: 66333 - DNA, 22 bp, Homo sapiens
ctctcgccagcggggctgcgct

SEQ ID NO: 66334 - DNA, 18 bp, Homo sapiens
gctttctatgcgacagta

SEQ ID NO: 66335 - DNA, 22 bp, Homo sapiens
caagatcttcctcaatagacct

SEQ ID NO: 66336 - DNA, 22 bp, Homo sapiens
ggcgtttcaccatgttgaccag

SEQ ID NO: 66337 - DNA, 22 bp, Homo sapiens
ttaattctgcctttcatgtaac

SEQ ID NO: 66338 - DNA, 22 bp, Homo sapiens
catcccctgatgctcttgagta

SEQ ID NO: 66339 - DNA, 18 bp, Homo sapiens
cccggctaatttttggta

SEQ ID NO: 66340 - DNA, 22 bp, Homo sapiens
cagatagctgtaaataaatgga

SEQ ID NO: 66341 - DNA, 21 bp, Homo sapiens
atctcgggcttctcgcccagc

SEQ ID NO: 66342 - DNA, 22 bp, Homo sapiens
catataaatacaacatgtgtta

SEQ ID NO: 66343 - DNA, 23 bp, Homo sapiens
actcgtggaattctctgcgatcg

SEQ ID NO: 66344 - DNA, 22 bp, Homo sapiens
ttctacagtgactgcagccata

SEQ ID NO: 66345 - DNA, 22 bp, Homo sapiens
taggcatgcaaataaatgtgca

SEQ ID NO: 66346 - DNA, 22 bp, Homo sapiens
cttctcttcctttgtcaactga

SEQ ID NO: 66347 - DNA, 22 bp, Homo sapiens
gggagaggttacccgagcaact

SEQ ID NO: 66348 - DNA, 22 bp, Homo sapiens
tggaggctggagtgcagtggcg

SEQ ID NO: 66349 - DNA, 22 bp, Homo sapiens
cctgggaggctgaggctgcagt

SEQ ID NO: 66350 - DNA, 22 bp, Homo sapiens
actgcaacctccacctcctggg

SEQ ID NO: 66351 - DNA, 22 bp, Homo sapiens
cactgttttacatgttatttaa

SEQ ID NO: 66352 - DNA, 22 bp, Homo sapiens
aacagcttgctgcaccttaata

SEQ ID NO: 66353 - DNA, 22 bp, Homo sapiens
ctggcaggtggaggttgcagtg

SEQ ID NO: 66354 - DNA, 20 bp, Homo sapiens
gctgaggggtctatggcata

SEQ ID NO: 66355 - DNA, 22 bp, Homo sapiens
ccagagctgattcctgggactt

SEQ ID NO: 66356 - DNA, 22 bp, Homo sapiens
agcaagatttttcaggttagta

SEQ ID NO: 66357 - DNA, 22 bp, Homo sapiens
acaaagtgctgacattacaggc

SEQ ID NO: 66358 - DNA, 22 bp, Homo sapiens
ggaggctctgaccatttaccca

SEQ ID NO: 66359 - DNA, 22 bp, Homo sapiens
aggcaaggtgctacagacagtg

SEQ ID NO: 66360 - DNA, 22 bp, Homo sapiens
tcccagaaacgcatatgttcat

SEQ ID NO: 66361 - DNA, 22 bp, Homo sapiens
ttatttttaaaagttcacacag

SEQ ID NO: 66362 - DNA, 20 bp, Homo sapiens
aactcctagcctcaagtgat

SEQ ID NO: 66363 - DNA, 22 bp, Homo sapiens
agtgcaggccccaggccaggcc

SEQ ID NO: 66364 - DNA, 22 bp, Homo sapiens
aggaagatgtgcaaagttggaa

SEQ ID NO: 66365 - DNA, 22 bp, Homo sapiens
gcccagagtttgaagatacagt

SEQ ID NO: 66366 - DNA, 21 bp, Homo sapiens
gttcttgcaggatttccttcc

SEQ ID NO: 66367 - DNA, 22 bp, Homo sapiens
ctggcagagttgggtctcaaat

SEQ ID NO: 66368 - DNA, 22 bp, Homo sapiens
aggtaaagacagtgaaagaggg

SEQ ID NO: 66369 - DNA, 22 bp, Homo sapiens
ggagacagggttgaaccacgca

SEQ ID NO: 66370 - DNA, 22 bp, Homo sapiens
ggcatagatttctttaggttta

SEQ ID NO: 66371 - DNA, 22 bp, Homo sapiens
attgagaagaaaatctaatata

SEQ ID NO: 66372 - DNA, 22 bp, Homo sapiens
caggtgtgccgggagcagtttg

SEQ ID NO: 66373 - DNA, 22 bp, Homo sapiens
gtcacaaagcgcggtggtcggt

SEQ ID NO: 66374 - DNA, 22 bp, Homo sapiens
tcctcctgtctaccagttcctg

SEQ ID NO: 66375 - DNA, 22 bp, Homo sapiens
atattgttagtaatatttcgaa

SEQ ID NO: 66376 - DNA, 22 bp, Homo sapiens
gggaagagggagctggaatgat

SEQ ID NO: 66377 - DNA, 22 bp, Homo sapiens
aggtggagaagagatgggcagt

SEQ ID NO: 66378 - DNA, 22 bp, Homo sapiens
agggcactgcaagggttgaagg

SEQ ID NO: 66379 - DNA, 22 bp, Homo sapiens
gtccaagagtcaagaagggggc

SEQ ID NO: 66380 - DNA, 22 bp, Homo sapiens
gtggctcacacctgtaatccca

SEQ ID NO: 66381 - DNA, 22 bp, Homo sapiens
aaagtaattgcagtttctgcca

SEQ ID NO: 66382 - DNA, 22 bp, Homo sapiens
agagggatcaccctgtttctgg

SEQ ID NO: 66383 - DNA, 22 bp, Homo sapiens
tttggaaattttcatccagaca

SEQ ID NO: 66384 - DNA, 22 bp, Homo sapiens
accccactcacacatggacctg

SEQ ID NO: 66385 - DNA, 22 bp, Homo sapiens
cagaggtagcatgctgtggctt

SEQ ID NO: 66386 - DNA, 22 bp, Homo sapiens
ttgctttgcagtgcctatagga

SEQ ID NO: 66387 - DNA, 22 bp, Homo sapiens
ataaaatttgctactgttaaat

SEQ ID NO: 66388 - DNA, 19 bp, Homo sapiens
ttctggtctggaatcaagg

SEQ ID NO: 66389 - DNA, 22 bp, Homo sapiens
cagccccacacggtctagctct

SEQ ID NO: 66390 - DNA, 22 bp, Homo sapiens
cctcgggctgaggctcccaggc

SEQ ID NO: 66391 - DNA, 22 bp, Homo sapiens
gcagttaaaaataaaccttcat

SEQ ID NO: 66392 - DNA, 22 bp, Homo sapiens
aaattgcaaaagtacttttagg

SEQ ID NO: 66393 - DNA, 22 bp, Homo sapiens
cctccccacagcccaggagact

SEQ ID NO: 66394 - DNA, 22 bp, Homo sapiens
tgtccccacctaaatcttatct

SEQ ID NO: 66395 - DNA, 22 bp, Homo sapiens
tccaagatctacagcagtttag

SEQ ID NO: 66396 - DNA, 22 bp, Homo sapiens
ccaggaggcggaggttgcagtg

SEQ ID NO: 66397 - DNA, 22 bp, Homo sapiens
tgtccaggctaaagtgcagtgg

SEQ ID NO: 66398 - DNA, 22 bp, Homo sapiens
tcttggattttaatggatcaaa

SEQ ID NO: 66399 - DNA, 22 bp, Homo sapiens
gaatcccttgcattatcccttt

SEQ ID NO: 66400 - DNA, 22 bp, Homo sapiens
ccagcagccaccttctcgaaat

SEQ ID NO: 66401 - DNA, 22 bp, Homo sapiens
tttgggcaggcttttccctaga

SEQ ID NO: 66402 - DNA, 22 bp, Homo sapiens
ctgctccccagcctgcgccttt

SEQ ID NO: 66403 - DNA, 22 bp, Homo sapiens
gaggcagaagttgcagtgagca

SEQ ID NO: 66404 - DNA, 21 bp, Homo sapiens
gggcactgaaagggaatagca

SEQ ID NO: 66405 - DNA, 22 bp, Homo sapiens
agatgcagtggttaacaataca

SEQ ID NO: 66406 - DNA, 22 bp, Homo sapiens
agtcttagaactacagtgccta

SEQ ID NO: 66407 - DNA, 22 bp, Homo sapiens
aggtctcttgctgtctctgggc

SEQ ID NO: 66408 - DNA, 22 bp, Homo sapiens
ctcccagccttcgccagtctga

SEQ ID NO: 66409 - DNA, 22 bp, Homo sapiens
gtcccataagtagtgcaacttg

SEQ ID NO: 66410 - DNA, 22 bp, Homo sapiens
acagcagcaatagcagtgacat

SEQ ID NO: 66411 - DNA, 22 bp, Homo sapiens
tccctagtcgcatctgtggaga

SEQ ID NO: 66412 - DNA, 22 bp, Homo sapiens
tcactgcaacctccacctcccg

SEQ ID NO: 66413 - DNA, 22 bp, Homo sapiens
ttgggcctctcaaagtgctggg

SEQ ID NO: 66414 - DNA, 22 bp, Homo sapiens
gaggtgggtgtatcacaggtca

SEQ ID NO: 66415 - DNA, 22 bp, Homo sapiens
ctgcagggagaggggacagcct

SEQ ID NO: 66416 - DNA, 22 bp, Homo sapiens
gtggagagagataagcctggtc

SEQ ID NO: 66417 - DNA, 22 bp, Homo sapiens
ccactgtgcccagcctcatggg

SEQ ID NO: 66418 - DNA, 22 bp, Homo sapiens
agacactgttctcacatgcttg

SEQ ID NO: 66419 - DNA, 22 bp, Homo sapiens
aaagaaatagatggcatttaaa

SEQ ID NO: 66420 - DNA, 22 bp, Homo sapiens
gagcccaggaagtggaggctga

SEQ ID NO: 66421 - DNA, 22 bp, Homo sapiens
gcctccggagttgcagtgtctt

SEQ ID NO: 66422 - DNA, 21 bp, Homo sapiens
tggtttatgtgcttagggtct

SEQ ID NO: 66423 - DNA, 22 bp, Homo sapiens
tggattcacaccattctcctgc

SEQ ID NO: 66424 - DNA, 22 bp, Homo sapiens
ccaggaggcagaagttgcagtg

SEQ ID NO: 66425 - DNA, 22 bp, Homo sapiens
tcccagaaccctgccaggtcct

SEQ ID NO: 66426 - DNA, 22 bp, Homo sapiens
aggcaggaggatcatggatgca

SEQ ID NO: 66427 - DNA, 22 bp, Homo sapiens
gtccaggcctgcctctgaggag

SEQ ID NO: 66428 - DNA, 22 bp, Homo sapiens
ttgcaaatcagaagtatagatt

SEQ ID NO: 66429 - DNA, 19 bp, Homo sapiens
atcccaaggagctgggact

SEQ ID NO: 66430 - DNA, 22 bp, Homo sapiens
atcacaaaggtctcagagcaca

SEQ ID NO: 66431 - DNA, 21 bp, Homo sapiens
cgtgactgggtccgtctggct

SEQ ID NO: 66432 - DNA, 22 bp, Homo sapiens
gggaggctctgctcagcccccg

SEQ ID NO: 66433 - DNA, 22 bp, Homo sapiens
ggctgagtctgtgacccatgcg

SEQ ID NO: 66434 - DNA, 22 bp, Homo sapiens
cccaggaggcagaagttgcagt

SEQ ID NO: 66435 - DNA, 22 bp, Homo sapiens
ggagactgatctgagtgataac

SEQ ID NO: 66436 - DNA, 22 bp, Homo sapiens
agtgaaaacctaatcatgcagt

SEQ ID NO: 66437 - DNA, 22 bp, Homo sapiens
gtttctctgtctgttacattgg

SEQ ID NO: 66438 - DNA, 22 bp, Homo sapiens
aaggggaagagaccgcagagtc

SEQ ID NO: 66439 - DNA, 22 bp, Homo sapiens
gctgggttttcttccgggccta

SEQ ID NO: 66440 - DNA, 22 bp, Homo sapiens
cggagtcttgctatgttgccca

SEQ ID NO: 66441 - DNA, 22 bp, Homo sapiens
ttgtgaatagtgccgctataaa

SEQ ID NO: 66442 - DNA, 22 bp, Homo sapiens
tattttgtgccatgcactgcct

SEQ ID NO: 66443 - DNA, 23 bp, Homo sapiens
agcagccagagatcctcggccct

SEQ ID NO: 66444 - DNA, 22 bp, Homo sapiens
gaggtgggcggatcacaaggtc

SEQ ID NO: 66445 - DNA, 22 bp, Homo sapiens
aagaggttgtctgtgatgagtt

SEQ ID NO: 66446 - DNA, 22 bp, Homo sapiens
tggctccgttgtacaggctgga

SEQ ID NO: 66447 - DNA, 22 bp, Homo sapiens
acaggggcaagggctcacggcc

SEQ ID NO: 66448 - DNA, 20 bp, Homo sapiens
ccagagctgatggctgcccg

SEQ ID NO: 66449 - DNA, 22 bp, Homo sapiens
ggtgtagctctgtgtcccactg

SEQ ID NO: 66450 - DNA, 22 bp, Homo sapiens
cctcagctcccatgagatctgc

SEQ ID NO: 66451 - DNA, 22 bp, Homo sapiens
agcttgtagaaggccacgagca

SEQ ID NO: 66452 - DNA, 22 bp, Homo sapiens
tgtgggagaaggaagcaagctg

SEQ ID NO: 66453 - DNA, 22 bp, Homo sapiens
gcagaggacacaggagggcaag

SEQ ID NO: 66454 - DNA, 22 bp, Homo sapiens
tagcttatcccacagtgcccag

SEQ ID NO: 66455 - DNA, 22 bp, Homo sapiens
gatggtgcaggtgaagtgctgg

SEQ ID NO: 66456 - DNA, 22 bp, Homo sapiens
ctctggaggtggaggttgcagt

SEQ ID NO: 66457 - DNA, 22 bp, Homo sapiens
agagggtgggcacgtgatggat

SEQ ID NO: 66458 - DNA, 22 bp, Homo sapiens
gagaggtggaggttgcagtgag

SEQ ID NO: 66459 - DNA, 19 bp, Homo sapiens
gactcacaccttccgctgt

SEQ ID NO: 66460 - DNA, 22 bp, Homo sapiens
agtccaggcattccagccattc

SEQ ID NO: 66461 - DNA, 22 bp, Homo sapiens
agatgaatccacacatggcaaa

SEQ ID NO: 66462 - DNA, 22 bp, Homo sapiens
ttaataaagtatgaattggaaa

SEQ ID NO: 66463 - DNA, 22 bp, Homo sapiens
tgggaaggggagctggaaagga

SEQ ID NO: 66464 - DNA, 22 bp, Homo sapiens
gccagagttgaggcagtttatt

SEQ ID NO: 66465 - DNA, 22 bp, Homo sapiens
ttgagcccaggaggcctgggtg

SEQ ID NO: 66466 - DNA, 22 bp, Homo sapiens
gagcctggagctggaacgaagc

SEQ ID NO: 66467 - DNA, 22 bp, Homo sapiens
ttgtatagcccagagagtgaga

SEQ ID NO: 66468 - DNA, 22 bp, Homo sapiens
tcactgcaacctccacctcctg

SEQ ID NO: 66469 - DNA, 22 bp, Homo sapiens
attgttcaatgtaataattttg

SEQ ID NO: 66470 - DNA, 22 bp, Homo sapiens
gatctggaatctgaaggctgag

SEQ ID NO: 66471 - DNA, 22 bp, Homo sapiens
agtgagagtattaatgtgaact

SEQ ID NO: 66472 - DNA, 22 bp, Homo sapiens
atccatttgacataatttcagc

SEQ ID NO: 66473 - DNA, 19 bp, Homo sapiens
aggaatggaattaattctg

SEQ ID NO: 66474 - DNA, 22 bp, Homo sapiens
ggtgtctatgattcagtttatg

SEQ ID NO: 66475 - DNA, 22 bp, Homo sapiens
gtggcaggagggcatcacttgg

SEQ ID NO: 66476 - DNA, 22 bp, Homo sapiens
ctgaagagaaagggagctcttc

SEQ ID NO: 66477 - DNA, 22 bp, Homo sapiens
agtccaggactgtttcagctga

SEQ ID NO: 66478 - DNA, 22 bp, Homo sapiens
cactgcaacctccacctcctgg

SEQ ID NO: 66479 - DNA, 22 bp, Homo sapiens
tgatttatgcattatactgttg

SEQ ID NO: 66480 - DNA, 23 bp, Homo sapiens
aaaacagcttcctccagtggctc

SEQ ID NO: 66481 - DNA, 22 bp, Homo sapiens
ggaggaggggtgactgaatgct

SEQ ID NO: 66482 - DNA, 22 bp, Homo sapiens
gcaaaagtacagccggatttct

SEQ ID NO: 66483 - DNA, 22 bp, Homo sapiens
ctggcctcggcagcaggaacag

SEQ ID NO: 66484 - DNA, 23 bp, Homo sapiens
caccactttctccttctccttgg

SEQ ID NO: 66485 - DNA, 22 bp, Homo sapiens
cggtcaggtgcagcgttggcac

SEQ ID NO: 66486 - DNA, 22 bp, Homo sapiens
agaggaggctctgggatcgtcc

SEQ ID NO: 66487 - DNA, 22 bp, Homo sapiens
tgagaaacttgccaagcatctc

SEQ ID NO: 66488 - DNA, 22 bp, Homo sapiens
tctcgctctgtcgcccaggctg

SEQ ID NO: 66489 - DNA, 22 bp, Homo sapiens
tcccagagctctggaggttgga

SEQ ID NO: 66490 - DNA, 22 bp, Homo sapiens
aaaatatgtataactcttctgc

SEQ ID NO: 66491 - DNA, 22 bp, Homo sapiens
tctcctggtacccttcctagca

SEQ ID NO: 66492 - DNA, 22 bp, Homo sapiens
tgtcttcgctacaatgaaaagg

SEQ ID NO: 66493 - DNA, 20 bp, Homo sapiens
caggtccagcacgtgcacgg

SEQ ID NO: 66494 - DNA, 22 bp, Homo sapiens
ttgtgaatagtgccgcaataaa

SEQ ID NO: 66495 - DNA, 22 bp, Homo sapiens
ttcctttctctggactgcagcc

SEQ ID NO: 66496 - DNA, 22 bp, Homo sapiens
gtgctgacaggagcctggcggt

SEQ ID NO: 66497 - DNA, 22 bp, Homo sapiens
gcacggctaatttttgtatttt

SEQ ID NO: 66498 - DNA, 22 bp, Homo sapiens
tgttcttgagcctttagaccta

SEQ ID NO: 66499 - DNA, 22 bp, Homo sapiens
gtggctcacgcctgtaatccca

SEQ ID NO: 66500 - DNA, 22 bp, Homo sapiens
gaccctctagatggaagcactg

SEQ ID NO: 66501 - DNA, 22 bp, Homo sapiens
ttccaaagaagttcacatttac

SEQ ID NO: 66502 - DNA, 22 bp, Homo sapiens
tgagcaggcgcagcaggaggtc

SEQ ID NO: 66503 - DNA, 22 bp, Homo sapiens
actctggccatcttggaccttg

SEQ ID NO: 66504 - DNA, 18 bp, Homo sapiens
gaggatggaaggagatgc

SEQ ID NO: 66505 - DNA, 22 bp, Homo sapiens
gctgctctccaagcctccttga

SEQ ID NO: 66506 - DNA, 22 bp, Homo sapiens
tttcttcctgctttgtcccatg

SEQ ID NO: 66507 - DNA, 22 bp, Homo sapiens
aggtttctttatgctgctagaa

SEQ ID NO: 66508 - DNA, 22 bp, Homo sapiens
tggtagtcggcctcggtggctc

SEQ ID NO: 66509 - DNA, 22 bp, Homo sapiens
ggctttctgtctgcgtctgtgt

SEQ ID NO: 66510 - DNA, 22 bp, Homo sapiens
tttggaaatgaccccgtctaag

SEQ ID NO: 66511 - DNA, 21 bp, Homo sapiens
ggtgctcgctgatgaggagtg

SEQ ID NO: 66512 - DNA, 22 bp, Homo sapiens
cccaggaggcagagcttgcagt

SEQ ID NO: 66513 - DNA, 22 bp, Homo sapiens
tcttgaattgtactcccataag

SEQ ID NO: 66514 - DNA, 19 bp, Homo sapiens
ttcacattggaagaagtag

SEQ ID NO: 66515 - DNA, 22 bp, Homo sapiens
tgtgctctgactttctcctggt

SEQ ID NO: 66516 - DNA, 22 bp, Homo sapiens
agtggcctggagccccgcctgg

SEQ ID NO: 66517 - DNA, 22 bp, Homo sapiens
agtaatcaatttttcggtggat

SEQ ID NO: 66518 - DNA, 22 bp, Homo sapiens
gtcagatgtttgcgtagggtat

SEQ ID NO: 66519 - DNA, 23 bp, Homo sapiens
ggagtgcaatggcgccatctcgg

SEQ ID NO: 66520 - DNA, 22 bp, Homo sapiens
ccttctagcaaatcaacataaa

SEQ ID NO: 66521 - DNA, 22 bp, Homo sapiens
cccaggaggtggagttcacagt

SEQ ID NO: 66522 - DNA, 22 bp, Homo sapiens
atgattgaccatctgctgggct

SEQ ID NO: 66523 - DNA, 22 bp, Homo sapiens
aagaggtaaccatagcaaccac

SEQ ID NO: 66524 - DNA, 22 bp, Homo sapiens
ctgtggtcatgagtccttccat

SEQ ID NO: 66525 - DNA, 20 bp, Homo sapiens
tcagccattccttacctttc

SEQ ID NO: 66526 - DNA, 22 bp, Homo sapiens
tgagacaggcttccttcttggg

SEQ ID NO: 66527 - DNA, 22 bp, Homo sapiens
gatgctgagagattggagacta

SEQ ID NO: 66528 - DNA, 22 bp, Homo sapiens
atcttgccagtctccaaatcaa

SEQ ID NO: 66529 - DNA, 22 bp, Homo sapiens
taggtttactgaattagtggaa

SEQ ID NO: 66530 - DNA, 22 bp, Homo sapiens
agctcttacatttaggtctatg

SEQ ID NO: 66531 - DNA, 17 bp, Homo sapiens
tggctctgtcctcagct

SEQ ID NO: 66532 - DNA, 22 bp, Homo sapiens
cggggttcatccatgctgtggc

SEQ ID NO: 66533 - DNA, 22 bp, Homo sapiens
tgtccaggctggagtgcagtgg

SEQ ID NO: 66534 - DNA, 22 bp, Homo sapiens
gctgggctgcgtcggggaagcc

SEQ ID NO: 66535 - DNA, 22 bp, Homo sapiens
atgaggcaggtggaggctgcca

SEQ ID NO: 66536 - DNA, 22 bp, Homo sapiens
ttgctgacctttgctctccgtt

SEQ ID NO: 66537 - DNA, 22 bp, Homo sapiens
ccaggaggttgaggctgcagtg

SEQ ID NO: 66538 - DNA, 20 bp, Homo sapiens
tcccccactgtttctgctac

SEQ ID NO: 66539 - DNA, 22 bp, Homo sapiens
aaagggaagttgcacatgttcc

SEQ ID NO: 66540 - DNA, 22 bp, Homo sapiens
gggaagatagtgttgagggccc

SEQ ID NO: 66541 - DNA, 22 bp, Homo sapiens
aaagaaggtagggctggtgact

SEQ ID NO: 66542 - DNA, 19 bp, Homo sapiens
gcccacggccctgctctgc

SEQ ID NO: 66543 - DNA, 22 bp, Homo sapiens
cacagtcctgccagagggcctt

SEQ ID NO: 66544 - DNA, 22 bp, Homo sapiens
cttcccaccaaagcccttgttg

SEQ ID NO: 66545 - DNA, 20 bp, Homo sapiens
ggcagagggcctgggagaag

SEQ ID NO: 66546 - DNA, 22 bp, Homo sapiens
aaacttttttaggttcataggc

SEQ ID NO: 66547 - DNA, 22 bp, Homo sapiens
aatattatcaaaagctttttca

SEQ ID NO: 66548 - DNA, 22 bp, Homo sapiens
cccaggaggcagatgttgcagt

SEQ ID NO: 66549 - DNA, 22 bp, Homo sapiens
gctcccaggatgaggagccagg

SEQ ID NO: 66550 - DNA, 21 bp, Homo sapiens
cctcaaagatgatggggtttc

SEQ ID NO: 66551 - DNA, 22 bp, Homo sapiens
tcctcggctgggccccaggctt

SEQ ID NO: 66552 - DNA, 19 bp, Homo sapiens
ccttgtctggtgaaggact

SEQ ID NO: 66553 - DNA, 22 bp, Homo sapiens
gactggaaagcctgtcctcaga

SEQ ID NO: 66554 - DNA, 22 bp, Homo sapiens
agatgctgctccacaggccagg

SEQ ID NO: 66555 - DNA, 22 bp, Homo sapiens
accatgttggccaagctggtct

SEQ ID NO: 66556 - DNA, 22 bp, Homo sapiens
tcgggctcgctctcctagcgga

SEQ ID NO: 66557 - DNA, 22 bp, Homo sapiens
aggcactgtgcagtcccaagca

SEQ ID NO: 66558 - DNA, 22 bp, Homo sapiens
ggtttattgttaataagtttga

SEQ ID NO: 66559 - DNA, 22 bp, Homo sapiens
cccacgttgaaccgcttacaga

SEQ ID NO: 66560 - DNA, 22 bp, Homo sapiens
cacccaggctggagagcagtgg

SEQ ID NO: 66561 - DNA, 22 bp, Homo sapiens
ttaaatattatgttgtctgcaa

SEQ ID NO: 66562 - DNA, 22 bp, Homo sapiens
ctggcaggttatagagctgccc

SEQ ID NO: 66563 - DNA, 22 bp, Homo sapiens
gcccaggaggagaggctgcagt

SEQ ID NO: 66564 - DNA, 22 bp, Homo sapiens
gggttgaggcggatgtcggcgg

SEQ ID NO: 66565 - DNA, 22 bp, Homo sapiens
gcctggattccttgtttctcag

SEQ ID NO: 66566 - DNA, 22 bp, Homo sapiens
aggctcagatccttgtgtcctg

SEQ ID NO: 66567 - DNA, 18 bp, Homo sapiens
gaggtagataagattttc

SEQ ID NO: 66568 - DNA, 22 bp, Homo sapiens
gggaggcagtgctggaggctgg

SEQ ID NO: 66569 - DNA, 22 bp, Homo sapiens
ttgtagtctaggatagattttt

SEQ ID NO: 66570 - DNA, 22 bp, Homo sapiens
agatgctgggatgcttggatgg

SEQ ID NO: 66571 - DNA, 22 bp, Homo sapiens
tctgcgttgctcacgctgggag

SEQ ID NO: 66572 - DNA, 22 bp, Homo sapiens
tgccatagcaatggtaagctga

SEQ ID NO: 66573 - DNA, 22 bp, Homo sapiens
tgaggaaacttacaaggcagaa

SEQ ID NO: 66574 - DNA, 22 bp, Homo sapiens
catgagatctgcagggatgggc

SEQ ID NO: 66575 - DNA, 22 bp, Homo sapiens
aggaggggttctcgggtgctga

SEQ ID NO: 66576 - DNA, 22 bp, Homo sapiens
aagtggactaatacaaggacta

SEQ ID NO: 66577 - DNA, 22 bp, Homo sapiens
tagatgcttgttcagaaatagg

SEQ ID NO: 66578 - DNA, 21 bp, Homo sapiens
tggtaggtactggcttcaggc

SEQ ID NO: 66579 - DNA, 22 bp, Homo sapiens
tcaatcacgtgttccatgttct

SEQ ID NO: 66580 - DNA, 22 bp, Homo sapiens
tgagacgaagtcttgctctgtt

SEQ ID NO: 66581 - DNA, 22 bp, Homo sapiens
cagaggaacgtttggattgatt

SEQ ID NO: 66582 - DNA, 22 bp, Homo sapiens
tggaagggagctggaatttgga

SEQ ID NO: 66583 - DNA, 22 bp, Homo sapiens
gctgctctcagagctcatgctg

SEQ ID NO: 66584 - DNA, 22 bp, Homo sapiens
ccggagtgtctggcctgctggg

SEQ ID NO: 66585 - DNA, 22 bp, Homo sapiens
ttaaattttagaaacagactct

SEQ ID NO: 66586 - DNA, 22 bp, Homo sapiens
aatgttacgatcaacaacacat

SEQ ID NO: 66587 - DNA, 22 bp, Homo sapiens
gatcgggtgggttctgccatca

SEQ ID NO: 66588 - DNA, 21 bp, Homo sapiens
taaacataaccttgtatggct

SEQ ID NO: 66589 - DNA, 22 bp, Homo sapiens
agcccggcttccccggttgcta

SEQ ID NO: 66590 - DNA, 22 bp, Homo sapiens
tgtgcacaatgtgcaggtttgt

SEQ ID NO: 66591 - DNA, 22 bp, Homo sapiens
cagcctggtccccggctcaccc

SEQ ID NO: 66592 - DNA, 22 bp, Homo sapiens
aagcccttggcgcacaccgggc

SEQ ID NO: 66593 - DNA, 22 bp, Homo sapiens
gaggtggatgttgcagtgagct

SEQ ID NO: 66594 - DNA, 22 bp, Homo sapiens
ttgtgaatggtgccgcaataaa

SEQ ID NO: 66595 - DNA, 22 bp, Homo sapiens
ttcagatgattagaatagtatt

SEQ ID NO: 66596 - DNA, 20 bp, Homo sapiens
caaatccctgctctgtgctg

SEQ ID NO: 66597 - DNA, 22 bp, Homo sapiens
cttcatcagctggcttactgtt

SEQ ID NO: 66598 - DNA, 22 bp, Homo sapiens
gacaggaggcagagctcaggtg

SEQ ID NO: 66599 - DNA, 22 bp, Homo sapiens
gagatggagtctttttctgtca

SEQ ID NO: 66600 - DNA, 22 bp, Homo sapiens
tcacaaatgtttgcatgtgtct

SEQ ID NO: 66601 - DNA, 22 bp, Homo sapiens
tatcacagccttttggtgaggg

SEQ ID NO: 66602 - DNA, 22 bp, Homo sapiens
tttctttatcatagcatctttg

SEQ ID NO: 66603 - DNA, 22 bp, Homo sapiens
ggaggtcccaggcctggcagca

SEQ ID NO: 66604 - DNA, 22 bp, Homo sapiens
tgggaagggtcaacagctggaa

SEQ ID NO: 66605 - DNA, 21 bp, Homo sapiens
tttcttaggctctaaaatgac

SEQ ID NO: 66606 - DNA, 22 bp, Homo sapiens
aagaataagaggatttagaaca

SEQ ID NO: 66607 - DNA, 22 bp, Homo sapiens
tggacaacatagtgagacctca

SEQ ID NO: 66608 - DNA, 22 bp, Homo sapiens
tagcacagggctcctcaaccca

SEQ ID NO: 66609 - DNA, 22 bp, Homo sapiens
ttgctgccttggagaagctcct

SEQ ID NO: 66610 - DNA, 22 bp, Homo sapiens
attgcagatgatccccaagtta

SEQ ID NO: 66611 - DNA, 22 bp, Homo sapiens
tgggaagaggagcactggaatg

SEQ ID NO: 66612 - DNA, 22 bp, Homo sapiens
tttgttttcaatgtgtcattca

SEQ ID NO: 66613 - DNA, 22 bp, Homo sapiens
agagtggagagaaacaactctg

SEQ ID NO: 66614 - DNA, 22 bp, Homo sapiens
caggaagaccagggctgtggct

SEQ ID NO: 66615 - DNA, 22 bp, Homo sapiens
tggctcactgtagccttgacct

SEQ ID NO: 66616 - DNA, 22 bp, Homo sapiens
attataggcttgagccaccgtg

SEQ ID NO: 66617 - DNA, 22 bp, Homo sapiens
agctggagatgagtgacgtgcc

SEQ ID NO: 66618 - DNA, 22 bp, Homo sapiens
aatggaatacctaggtggccca

SEQ ID NO: 66619 - DNA, 22 bp, Homo sapiens
agatgtgtttctagttcctgca

SEQ ID NO: 66620 - DNA, 22 bp, Homo sapiens
gatgctgagaggtggagggaac

SEQ ID NO: 66621 - DNA, 19 bp, Homo sapiens
ccctcttgcacaaagcaaa

SEQ ID NO: 66622 - DNA, 22 bp, Homo sapiens
gaggcagaggttgcagtgagct

SEQ ID NO: 66623 - DNA, 22 bp, Homo sapiens
aagtccaggtcctcattccatc

SEQ ID NO: 66624 - DNA, 22 bp, Homo sapiens
catgggtaagactcttttgccc

SEQ ID NO: 66625 - DNA, 22 bp, Homo sapiens
gcccagagttcaaggctgcagt

SEQ ID NO: 66626 - DNA, 22 bp, Homo sapiens
ccagaggagttgaggctttggg

SEQ ID NO: 66627 - DNA, 22 bp, Homo sapiens
atgattgaaaatgacattgcca

SEQ ID NO: 66628 - DNA, 22 bp, Homo sapiens
gtctctcaaaactagaagagaa

SEQ ID NO: 66629 - DNA, 22 bp, Homo sapiens
cattgcaacttcaaactcctgg

SEQ ID NO: 66630 - DNA, 22 bp, Homo sapiens
ttgtaagtcacaccagggcagg

SEQ ID NO: 66631 - DNA, 22 bp, Homo sapiens
gcctcctgagtagctgggattg

SEQ ID NO: 66632 - DNA, 22 bp, Homo sapiens
tccagcttataggtagatttaa

SEQ ID NO: 66633 - DNA, 22 bp, Homo sapiens
tccagctgttccatcagctctt

SEQ ID NO: 66634 - DNA, 22 bp, Homo sapiens
gtctcttgttatcatttctgag

SEQ ID NO: 66635 - DNA, 22 bp, Homo sapiens
aggaaggcttctttggtcttct

SEQ ID NO: 66636 - DNA, 22 bp, Homo sapiens
tcgtgaggctctgcatcgcaca

SEQ ID NO: 66637 - DNA, 22 bp, Homo sapiens
cctggctcctacgggtattttg

SEQ ID NO: 66638 - DNA, 22 bp, Homo sapiens
ggaggacaggggctgcagcaca

SEQ ID NO: 66639 - DNA, 21 bp, Homo sapiens
aggcatgagccctgcatggac

SEQ ID NO: 66640 - DNA, 22 bp, Homo sapiens
gaggcaggaggattgcttgagc

SEQ ID NO: 66641 - DNA, 22 bp, Homo sapiens
tgcatctgcctggagtagcgcc

SEQ ID NO: 66642 - DNA, 22 bp, Homo sapiens
gaaggaagtcattagtgcagac

SEQ ID NO: 66643 - DNA, 22 bp, Homo sapiens
gaccttcttgctgtgtcctaac

SEQ ID NO: 66644 - DNA, 18 bp, Homo sapiens
cttttcccctttggactc

SEQ ID NO: 66645 - DNA, 18 bp, Homo sapiens
atggtctcatactgggag

SEQ ID NO: 66646 - DNA, 22 bp, Homo sapiens
cactgggcgtgtcctgggtgag

SEQ ID NO: 66647 - DNA, 22 bp, Homo sapiens
gaaatggtcaagctgcaggata

SEQ ID NO: 66648 - DNA, 22 bp, Homo sapiens
ttacatgtttatgtggtacatg

SEQ ID NO: 66649 - DNA, 18 bp, Homo sapiens
cagctgccagctcatgga

SEQ ID NO: 66650 - DNA, 22 bp, Homo sapiens
agtgagagtattaatgtgaact

SEQ ID NO: 66651 - DNA, 22 bp, Homo sapiens
tagagtgtcataacagtgccca

SEQ ID NO: 66652 - DNA, 22 bp, Homo sapiens
ttaggatttgaaaaggggcaga

SEQ ID NO: 66653 - DNA, 22 bp, Homo sapiens
catgagatttgggaggggccag

SEQ ID NO: 66654 - DNA, 22 bp, Homo sapiens
cagtgacgtaaactgcatgtgc

SEQ ID NO: 66655 - DNA, 22 bp, Homo sapiens
agggctggagccacagctggga

SEQ ID NO: 66656 - DNA, 22 bp, Homo sapiens
aaagtgctgagattacaagcgt

SEQ ID NO: 66657 - DNA, 22 bp, Homo sapiens
cagggagtgtacaccatgtgta

SEQ ID NO: 66658 - DNA, 22 bp, Homo sapiens
agtccaggcattccagccattc

SEQ ID NO: 66659 - DNA, 22 bp, Homo sapiens
tcagtttttctatactttgtag

SEQ ID NO: 66660 - DNA, 22 bp, Homo sapiens
ctgaccaacatggtgaaacctt

SEQ ID NO: 66661 - DNA, 22 bp, Homo sapiens
tcgtggaatatggatgcttgtc

SEQ ID NO: 66662 - DNA, 22 bp, Homo sapiens
tcttgggcaatttctctagagg

SEQ ID NO: 66663 - DNA, 22 bp, Homo sapiens
aggaggggttctcgggtgctga

SEQ ID NO: 66664 - DNA, 22 bp, Homo sapiens
ttgtcttttgtgggaaatatgg

SEQ ID NO: 66665 - DNA, 19 bp, Homo sapiens
gcagacaggtccagagagg

SEQ ID NO: 66666 - DNA, 22 bp, Homo sapiens
tggctaacaaggtgaaaccccg

SEQ ID NO: 66667 - DNA, 22 bp, Homo sapiens
atttagtagagaaattaagaaa

SEQ ID NO: 66668 - DNA, 22 bp, Homo sapiens
aggacaaaggaccagatctgga

SEQ ID NO: 66669 - DNA, 22 bp, Homo sapiens
ggggtggatttcaggcggtgtc

SEQ ID NO: 66670 - DNA, 22 bp, Homo sapiens
ggtgacggggcccaggtttcct

SEQ ID NO: 66671 - DNA, 20 bp, Homo sapiens
ataaaataactgccacaaga

SEQ ID NO: 66672 - DNA, 22 bp, Homo sapiens
ggaggctgagaggtcgcagtgg

SEQ ID NO: 66673 - DNA, 22 bp, Homo sapiens
acatgagatttgggtggtgata

SEQ ID NO: 66674 - DNA, 18 bp, Homo sapiens
gctatctctaagatcttt

SEQ ID NO: 66675 - DNA, 22 bp, Homo sapiens
acatttttcacatttgtagggt

SEQ ID NO: 66676 - DNA, 22 bp, Homo sapiens
tctgactcccatattccacttc

SEQ ID NO: 66677 - DNA, 19 bp, Homo sapiens
ccctcttgcacaaagcaaa

SEQ ID NO: 66678 - DNA, 22 bp, Homo sapiens
gaacactgctgttgggttctga

SEQ ID NO: 66679 - DNA, 22 bp, Homo sapiens
ttcatagtgtttccttccagtg

SEQ ID NO: 66680 - DNA, 22 bp, Homo sapiens
ccaggctggagtgcaatggcgt

SEQ ID NO: 66681 - DNA, 22 bp, Homo sapiens
ggagaggcttccagagtcgtgc

SEQ ID NO: 66682 - DNA, 22 bp, Homo sapiens
ggctttgacatgctgaattaaa

SEQ ID NO: 66683 - DNA, 22 bp, Homo sapiens
acggggctagagaaggtttctt

SEQ ID NO: 66684 - DNA, 22 bp, Homo sapiens
tttaggttttttcacgtggcta

SEQ ID NO: 66685 - DNA, 22 bp, Homo sapiens
ggaggctgaggcaggcggatca

SEQ ID NO: 66686 - DNA, 22 bp, Homo sapiens
cgtcagtttactgttgccatgg

SEQ ID NO: 66687 - DNA, 22 bp, Homo sapiens
aagcatttcaggtagagatatt

SEQ ID NO: 66688 - DNA, 22 bp, Homo sapiens
ggcatcgtcctgggcataggga

SEQ ID NO: 66689 - DNA, 22 bp, Homo sapiens
ggggccttggatctgtgccccg

SEQ ID NO: 66690 - DNA, 22 bp, Homo sapiens
tggggtgagattcagatattca

SEQ ID NO: 66691 - DNA, 22 bp, Homo sapiens
attataggcttgagccaccgtg

SEQ ID NO: 66692 - DNA, 22 bp, Homo sapiens
ctggctggagtgcaggtgagtg

SEQ ID NO: 66693 - DNA, 16 bp, Homo sapiens
tggggatggggaagag

SEQ ID NO: 66694 - DNA, 23 bp, Homo sapiens
aaactacaacgccaggcactgag

SEQ ID NO: 66695 - DNA, 22 bp, Homo sapiens
ttatatgtttctgtttggaggc

SEQ ID NO: 66696 - DNA, 22 bp, Homo sapiens
aaagtgctgggattacaagcgt

SEQ ID NO: 66697 - DNA, 22 bp, Homo sapiens
gggaggcagtgctggaggctgg

SEQ ID NO: 66698 - DNA, 22 bp, Homo sapiens
cgtgccactgcactctagcctg

SEQ ID NO: 66699 - DNA, 22 bp, Homo sapiens
attaagactgcccatgttttta

SEQ ID NO: 66700 - DNA, 22 bp, Homo sapiens
ctcctctttagccccagctgga

SEQ ID NO: 66701 - DNA, 22 bp, Homo sapiens
aggctggagtgcagttgcatga

SEQ ID NO: 66702 - DNA, 22 bp, Homo sapiens
ggagagtggattccagctgtat

SEQ ID NO: 66703 - DNA, 22 bp, Homo sapiens
atttttctctttccactgagat

SEQ ID NO: 66704 - DNA, 22 bp, Homo sapiens
atgaaaacggaccagagctatt

SEQ ID NO: 66705 - DNA, 22 bp, Homo sapiens
aggctctcaccctctgaccaga

SEQ ID NO: 66706 - DNA, 19 bp, Homo sapiens
ggcttgtctcggcagccgc

SEQ ID NO: 66707 - DNA, 22 bp, Homo sapiens
ctcccagccttcgccagtctga

SEQ ID NO: 66708 - DNA, 22 bp, Homo sapiens
tttaagaagttatgttataaat

SEQ ID NO: 66709 - DNA, 22 bp, Homo sapiens
cctcttcaggcactcgaaggcc

SEQ ID NO: 66710 - DNA, 22 bp, Homo sapiens
aacggctagcaggggtgtcatg

SEQ ID NO: 66711 - DNA, 18 bp, Homo sapiens
gctgtggaagtctttata

SEQ ID NO: 66712 - DNA, 22 bp, Homo sapiens
caggctgctgcctagaatgaca

SEQ ID NO: 66713 - DNA, 22 bp, Homo sapiens
cccaggctggagtgtaatggtg

SEQ ID NO: 66714 - DNA, 22 bp, Homo sapiens
atcaaatacaaagggcataagg

SEQ ID NO: 66715 - DNA, 22 bp, Homo sapiens
actttaaaactgatcatcagag

SEQ ID NO: 66716 - DNA, 22 bp, Homo sapiens
gggacttcatagctaggcactt

SEQ ID NO: 66717 - DNA, 22 bp, Homo sapiens
atctgggagcggaggttgcagt

SEQ ID NO: 66718 - DNA, 22 bp, Homo sapiens
tgagatgaataactcctgctaa

SEQ ID NO: 66719 - DNA, 22 bp, Homo sapiens
cagggccctgctcaatttctcc

SEQ ID NO: 66720 - DNA, 22 bp, Homo sapiens
ccaggctggagtgcaatggcat

SEQ ID NO: 66721 - DNA, 22 bp, Homo sapiens
ctggtgtggactccgcgcggag

SEQ ID NO: 66722 - DNA, 22 bp, Homo sapiens
tgggaggccgaggcaggtggat

SEQ ID NO: 66723 - DNA, 22 bp, Homo sapiens
aaaaaattatcatagttcctga

SEQ ID NO: 66724 - DNA, 22 bp, Homo sapiens
gattgagtctgaggatgctgca

SEQ ID NO: 66725 - DNA, 22 bp, Homo sapiens
catggcattgcataacggggct

SEQ ID NO: 66726 - DNA, 17 bp, Homo sapiens
tgtagcttctccttctc

SEQ ID NO: 66727 - DNA, 22 bp, Homo sapiens
ggaactgaggaacgaactggga

SEQ ID NO: 66728 - DNA, 22 bp, Homo sapiens
gaccatcctggccaacgtggta

SEQ ID NO: 66729 - DNA, 22 bp, Homo sapiens
atgccactgcacttcagcttgg

SEQ ID NO: 66730 - DNA, 22 bp, Homo sapiens
ttcttctcagggtcccacatgg

SEQ ID NO: 66731 - DNA, 19 bp, Homo sapiens
tcctggggaggggcatggc

SEQ ID NO: 66732 - DNA, 22 bp, Homo sapiens
cctgggctctgtcagaattggg

SEQ ID NO: 66733 - DNA, 22 bp, Homo sapiens
ctcctgagctctgaggaagctt

SEQ ID NO: 66734 - DNA, 22 bp, Homo sapiens
gagacacaggcacagaagaggc

SEQ ID NO: 66735 - DNA, 22 bp, Homo sapiens
actgcactccagcctgggtaac

SEQ ID NO: 66736 - DNA, 22 bp, Homo sapiens
agacactgttctcacatgcttg

SEQ ID NO: 66737 - DNA, 22 bp, Homo sapiens
ttcttctccgaggagggctggt

SEQ ID NO: 66738 - DNA, 22 bp, Homo sapiens
tgacttcctgcactcaggtgat

SEQ ID NO: 66739 - DNA, 22 bp, Homo sapiens
caggaaagggatgggctgccac

SEQ ID NO: 66740 - DNA, 17 bp, Homo sapiens
ggctgcagtccaggagg

SEQ ID NO: 66741 - DNA, 22 bp, Homo sapiens
tcgaaataatttagaatataga

SEQ ID NO: 66742 - DNA, 22 bp, Homo sapiens
tgctatgtgtgccagggactgt

SEQ ID NO: 66743 - DNA, 22 bp, Homo sapiens
cctcgacctccccaggctcagg

SEQ ID NO: 66744 - DNA, 22 bp, Homo sapiens
aaggagtctgggccattcagag

SEQ ID NO: 66745 - DNA, 20 bp, Homo sapiens
tttcttgtcggctgttgctg

SEQ ID NO: 66746 - DNA, 22 bp, Homo sapiens
gcgggccaccttggagagcgct

SEQ ID NO: 66747 - DNA, 22 bp, Homo sapiens
atgccactgcacttcagcctgg

SEQ ID NO: 66748 - DNA, 22 bp, Homo sapiens
tggtagtcggcctcggtggctc

SEQ ID NO: 66749 - DNA, 22 bp, Homo sapiens
ctggagggctgcagcgaggctg

SEQ ID NO: 66750 - DNA, 22 bp, Homo sapiens
tgccaggcgtggtggtgcgcac

SEQ ID NO: 66751 - DNA, 22 bp, Homo sapiens
agaaatatgctgattagatgaa

SEQ ID NO: 66752 - DNA, 22 bp, Homo sapiens
caggagatgacagggaagaacc

SEQ ID NO: 66753 - DNA, 22 bp, Homo sapiens
gtgagactcgcctttgtgtagc

SEQ ID NO: 66754 - DNA, 22 bp, Homo sapiens
ggaggcagaatagagtgtgggt

SEQ ID NO: 66755 - DNA, 22 bp, Homo sapiens
aaacttgagccaagggcttggg

SEQ ID NO: 66756 - DNA, 22 bp, Homo sapiens
ggatgtcgaggatggggtagca

SEQ ID NO: 66757 - DNA, 22 bp, Homo sapiens
ttcttctaaatgtgcttattaa

SEQ ID NO: 66758 - DNA, 22 bp, Homo sapiens
tatgacagtttcgtaggggttg

SEQ ID NO: 66759 - DNA, 22 bp, Homo sapiens
tttgcattgcattaagtattct

SEQ ID NO: 66760 - DNA, 22 bp, Homo sapiens
tgggaggccaaggcaggcggat

SEQ ID NO: 66761 - DNA, 22 bp, Homo sapiens
aggaaataggaccagacaaagc

SEQ ID NO: 66762 - DNA, 22 bp, Homo sapiens
tttgtcttatccaatctctcag

SEQ ID NO: 66763 - DNA, 22 bp, Homo sapiens
gtggagggtgattgccggctgt

SEQ ID NO: 66764 - DNA, 22 bp, Homo sapiens
ccaggctggagtgcagtggcac

SEQ ID NO: 66765 - DNA, 22 bp, Homo sapiens
caggcagaagaagtggaaggac

SEQ ID NO: 66766 - DNA, 15 bp, Homo sapiens
tggcccacccgttga

SEQ ID NO: 66767 - DNA, 22 bp, Homo sapiens
ttgtggaatgtggctgtcaatt

SEQ ID NO: 66768 - DNA, 22 bp, Homo sapiens
ggaggcggaggctgcagtgagc

SEQ ID NO: 66769 - DNA, 22 bp, Homo sapiens
acattaaaattgggtggggtaa

SEQ ID NO: 66770 - DNA, 22 bp, Homo sapiens
gggcggatcatttgaggtcagg

SEQ ID NO: 66771 - DNA, 23 bp, Homo sapiens
ctcaaccctagtaagggagtagg

SEQ ID NO: 66772 - DNA, 20 bp, Homo sapiens
gggcagagccagccagtccc

SEQ ID NO: 66773 - DNA, 22 bp, Homo sapiens
agcaggaaggggatgatgggca

SEQ ID NO: 66774 - DNA, 22 bp, Homo sapiens
gaattcttttctttctgaaagt

SEQ ID NO: 66775 - DNA, 22 bp, Homo sapiens
gtagctctgtttaaagttcttt

SEQ ID NO: 66776 - DNA, 22 bp, Homo sapiens
aaggaaagctgtggttctgaga

SEQ ID NO: 66777 - DNA, 22 bp, Homo sapiens
ggggtcggggcatagccactta

SEQ ID NO: 66778 - DNA, 22 bp, Homo sapiens
ctgagggtcaacttgattgtat

SEQ ID NO: 66779 - DNA, 22 bp, Homo sapiens
aggtggagaagagatgggcagt

SEQ ID NO: 66780 - DNA, 22 bp, Homo sapiens
gccaggcgggtctcaaactcct

SEQ ID NO: 66781 - DNA, 22 bp, Homo sapiens
agggccagcactcctggcagga

SEQ ID NO: 66782 - DNA, 22 bp, Homo sapiens
atgtaaactactgactacacta

SEQ ID NO: 66783 - DNA, 22 bp, Homo sapiens
agggatggagtgcggcccggac

SEQ ID NO: 66784 - DNA, 18 bp, Homo sapiens
ggctcaagtgatcctcct

SEQ ID NO: 66785 - DNA, 22 bp, Homo sapiens
aggaggaagggaagacaagtaa

SEQ ID NO: 66786 - DNA, 22 bp, Homo sapiens
ttctatttttgtggaactgtag

SEQ ID NO: 66787 - DNA, 17 bp, Homo sapiens
cttcccaccatctcctg

SEQ ID NO: 66788 - DNA, 22 bp, Homo sapiens
tccaggctttggggcaggagcg

SEQ ID NO: 66789 - DNA, 22 bp, Homo sapiens
agctggggctgtggttgtgatt

SEQ ID NO: 66790 - DNA, 22 bp, Homo sapiens
tatgccactgctctccatccta

SEQ ID NO: 66791 - DNA, 22 bp, Homo sapiens
taagaaatttagttatagaatg

SEQ ID NO: 66792 - DNA, 22 bp, Homo sapiens
ctgtggctctcagaggctgctg

SEQ ID NO: 66793 - DNA, 22 bp, Homo sapiens
tcatgctatgagcgagggcctg

SEQ ID NO: 66794 - DNA, 22 bp, Homo sapiens
gcccaggctggagtgcagtggt

SEQ ID NO: 66795 - DNA, 22 bp, Homo sapiens
aagtggactaatacaaggacta

SEQ ID NO: 66796 - DNA, 22 bp, Homo sapiens
gcaggcagaggtggaggagaca

SEQ ID NO: 66797 - DNA, 22 bp, Homo sapiens
cagctgctgttcagttttgttt

SEQ ID NO: 66798 - DNA, 23 bp, Homo sapiens
cagggccctgctcaatttctcca

SEQ ID NO: 66799 - DNA, 22 bp, Homo sapiens
agaagccaccagctgaggaaga

SEQ ID NO: 66800 - DNA, 22 bp, Homo sapiens
ttcttctttccaattacatggt

SEQ ID NO: 66801 - DNA, 21 bp, Homo sapiens
gggcagaggggcctcctgggt

SEQ ID NO: 66802 - DNA, 22 bp, Homo sapiens
tgtcaagccccagctgtcacgc

SEQ ID NO: 66803 - DNA, 22 bp, Homo sapiens
aggctagaggcttctggcttca

SEQ ID NO: 66804 - DNA, 22 bp, Homo sapiens
aataaaatggtcagttttctca

SEQ ID NO: 66805 - DNA, 22 bp, Homo sapiens
actgcactcctgcctgggtaac

SEQ ID NO: 66806 - DNA, 22 bp, Homo sapiens
acattaaacttgcttggctgta

SEQ ID NO: 66807 - DNA, 22 bp, Homo sapiens
cataaaaggtagcagtttgaaa

SEQ ID NO: 66808 - DNA, 22 bp, Homo sapiens
acgcctgtaatcccagcacttt

SEQ ID NO: 66809 - DNA, 18 bp, Homo sapiens
ggtgagggagctggaagc

SEQ ID NO: 66810 - DNA, 22 bp, Homo sapiens
aatgttacgatcaacaacacat

SEQ ID NO: 66811 - DNA, 22 bp, Homo sapiens
attttctatgttgtaattgtta

SEQ ID NO: 66812 - DNA, 22 bp, Homo sapiens
taattcttcaggccttttgtct

SEQ ID NO: 66813 - DNA, 22 bp, Homo sapiens
taaatacttagttttgtgtcta

SEQ ID NO: 66814 - DNA, 22 bp, Homo sapiens
gctcagacctgtaatcttagca

SEQ ID NO: 66815 - DNA, 22 bp, Homo sapiens
tgggggtgtcctggtgcacaca

SEQ ID NO: 66816 - DNA, 22 bp, Homo sapiens
ggaggcggaggttgcagtgagt

SEQ ID NO: 66817 - DNA, 22 bp, Homo sapiens
ttcccttaaattatggcatcta

SEQ ID NO: 66818 - DNA, 22 bp, Homo sapiens
tttattggatatttacaagata

SEQ ID NO: 66819 - DNA, 22 bp, Homo sapiens
gggttgaggcggatgtcggcgg

SEQ ID NO: 66820 - DNA, 22 bp, Homo sapiens
aggcaaggtgctacagacagtg

SEQ ID NO: 66821 - DNA, 22 bp, Homo sapiens
attaagtgactaaagtaatgct

SEQ ID NO: 66822 - DNA, 22 bp, Homo sapiens
aggctctgtcaggcggagcagc

SEQ ID NO: 66823 - DNA, 22 bp, Homo sapiens
taaggctatcttttgagtgtgt

SEQ ID NO: 66824 - DNA, 22 bp, Homo sapiens
tgaaggggttcagcatgggggt

SEQ ID NO: 66825 - DNA, 22 bp, Homo sapiens
ttccccttgataagcagggttg

SEQ ID NO: 66826 - DNA, 22 bp, Homo sapiens
cagtggcgtgatctctgctcac

SEQ ID NO: 66827 - DNA, 22 bp, Homo sapiens
atgccactgcgctccagcctgg

SEQ ID NO: 66828 - DNA, 22 bp, Homo sapiens
ctagcctgggatttgaacttat

SEQ ID NO: 66829 - DNA, 20 bp, Homo sapiens
aaaatatgtataactcttct

SEQ ID NO: 66830 - DNA, 22 bp, Homo sapiens
caggtgcctcaggatgagacaa

SEQ ID NO: 66831 - DNA, 22 bp, Homo sapiens
agcactgatttaaactggattt

SEQ ID NO: 66832 - DNA, 22 bp, Homo sapiens
tatttcttttcgtgacttattg

SEQ ID NO: 66833 - DNA, 22 bp, Homo sapiens
ctttttcctcgtagagcctaat

SEQ ID NO: 66834 - DNA, 22 bp, Homo sapiens
aaaaatcacttttataggcagc

SEQ ID NO: 66835 - DNA, 22 bp, Homo sapiens
cactgaacaacaaatagtgaat

SEQ ID NO: 66836 - DNA, 22 bp, Homo sapiens
gctgggctgcgtcggggaagcc

SEQ ID NO: 66837 - DNA, 22 bp, Homo sapiens
tccgggaggcagaggttgcagt

SEQ ID NO: 66838 - DNA, 22 bp, Homo sapiens
tgaacatgctgttgatggcctg

SEQ ID NO: 66839 - DNA, 19 bp, Homo sapiens
agtcctggcctgggggacc

SEQ ID NO: 66840 - DNA, 22 bp, Homo sapiens
gccaggctgaggctctggaaga

SEQ ID NO: 66841 - DNA, 22 bp, Homo sapiens
aaagttctctatggtgtaaaaa

SEQ ID NO: 66842 - DNA, 22 bp, Homo sapiens
gtggcattgccttctgcaggaa

SEQ ID NO: 66843 - DNA, 22 bp, Homo sapiens
tgctatgtcgaaagggccatta

SEQ ID NO: 66844 - DNA, 22 bp, Homo sapiens
ttggccatctaagcccagccac

SEQ ID NO: 66845 - DNA, 21 bp, Homo sapiens
gctgctcgagatccagtgctt

SEQ ID NO: 66846 - DNA, 22 bp, Homo sapiens
gggagaagaatgtgtcaattgt

SEQ ID NO: 66847 - DNA, 22 bp, Homo sapiens
cctggctgacagcttaattcca

SEQ ID NO: 66848 - DNA, 22 bp, Homo sapiens
atgccactgcactccagcctag

SEQ ID NO: 66849 - DNA, 22 bp, Homo sapiens
cttatttgcccatgtttcttta

SEQ ID NO: 66850 - DNA, 22 bp, Homo sapiens
ggaggcggaagttgcagtgagc

SEQ ID NO: 66851 - DNA, 22 bp, Homo sapiens
cccacaggtgtgagcttgctgg

SEQ ID NO: 66852 - DNA, 22 bp, Homo sapiens
tatgttgcaccaacctaataat

SEQ ID NO: 66853 - DNA, 22 bp, Homo sapiens
ggctcctgggggtgctcctgcc

SEQ ID NO: 66854 - DNA, 22 bp, Homo sapiens
ttctgattgctgatgaggccca

SEQ ID NO: 66855 - DNA, 22 bp, Homo sapiens
gagatcggtaaagagcatgcac

SEQ ID NO: 66856 - DNA, 22 bp, Homo sapiens
ccattgtaaattctgtggaagt

SEQ ID NO: 66857 - DNA, 22 bp, Homo sapiens
ggagaagaggagctggaagcct

SEQ ID NO: 66858 - DNA, 22 bp, Homo sapiens
ttttggctctgtctgtatcttt

SEQ ID NO: 66859 - DNA, 22 bp, Homo sapiens
agttattactctttaacatatt

SEQ ID NO: 66860 - DNA, 22 bp, Homo sapiens
aactcagatgtttggctacctt

SEQ ID NO: 66861 - DNA, 22 bp, Homo sapiens
tctacatgcagcgaggggactt

SEQ ID NO: 66862 - DNA, 22 bp, Homo sapiens
caggcagggagctggaaaggat

SEQ ID NO: 66863 - DNA, 22 bp, Homo sapiens
ttaaatattatgttgtctgcaa

SEQ ID NO: 66864 - DNA, 22 bp, Homo sapiens
ctgaaatgacggtttggggcaa

SEQ ID NO: 66865 - DNA, 23 bp, Homo sapiens
ggagtgcaatggcgccatctcgg

SEQ ID NO: 66866 - DNA, 22 bp, Homo sapiens
cttgggaggcagaggttgcagt

SEQ ID NO: 66867 - DNA, 22 bp, Homo sapiens
tttaaaaaactagtctgagtct

SEQ ID NO: 66868 - DNA, 22 bp, Homo sapiens
ctggcctaaaaatacagaacaa

SEQ ID NO: 66869 - DNA, 22 bp, Homo sapiens
acagattcactgcactggccat

SEQ ID NO: 66870 - DNA, 22 bp, Homo sapiens
cttctgagatgttgttttacag

SEQ ID NO: 66871 - DNA, 22 bp, Homo sapiens
aaggctgaggcagtgaggcaga

SEQ ID NO: 66872 - DNA, 22 bp, Homo sapiens
cagggatggcgctggctgcccg

SEQ ID NO: 66873 - DNA, 22 bp, Homo sapiens
cccaggctggagtgcagtggcg

SEQ ID NO: 66874 - DNA, 22 bp, Homo sapiens
tttccctttagcctgagaatcc

SEQ ID NO: 66875 - DNA, 22 bp, Homo sapiens
tagtggatgttcagagatttga

SEQ ID NO: 66876 - DNA, 22 bp, Homo sapiens
gaggcagaggttgcagtgagct

SEQ ID NO: 66877 - DNA, 22 bp, Homo sapiens
gaggagggagctggaagctctt

SEQ ID NO: 66878 - DNA, 22 bp, Homo sapiens
aggggtgaaagagggccctcaa

SEQ ID NO: 66879 - DNA, 22 bp, Homo sapiens
tgagacaggcttccttcttggg

SEQ ID NO: 66880 - DNA, 22 bp, Homo sapiens
aggtacatggggtgtgtgcacg

SEQ ID NO: 66881 - DNA, 23 bp, Homo sapiens
attttttgtctttgtaactagat

SEQ ID NO: 66882 - DNA, 22 bp, Homo sapiens
gtgggcatctccttggaagcca

SEQ ID NO: 66883 - DNA, 22 bp, Homo sapiens
gctgctgggatcctgggtctca

SEQ ID NO: 66884 - DNA, 22 bp, Homo sapiens
tgaatgtgatgctaaacatatg

SEQ ID NO: 66885 - DNA, 22 bp, Homo sapiens
aatttaagagcatagctccaac

SEQ ID NO: 66886 - DNA, 22 bp, Homo sapiens
cgtgggtcgggactccgcctcg

SEQ ID NO: 66887 - DNA, 22 bp, Homo sapiens
ggagtgactcacagctgggaca

SEQ ID NO: 66888 - DNA, 22 bp, Homo sapiens
aatgagatggaattcccgccta

SEQ ID NO: 66889 - DNA, 22 bp, Homo sapiens
cggccaggcacagtggcccacg

SEQ ID NO: 66890 - DNA, 22 bp, Homo sapiens
aggggagagttaatgtgaatgt

SEQ ID NO: 66891 - DNA, 22 bp, Homo sapiens
cgccggcttgaggcaggcggca

SEQ ID NO: 66892 - DNA, 22 bp, Homo sapiens
ggcctgggctccgggagttact

SEQ ID NO: 66893 - DNA, 22 bp, Homo sapiens
gagcaggaaggccagaagggtc

SEQ ID NO: 66894 - DNA, 22 bp, Homo sapiens
tatgttaacatgttaggaactg

SEQ ID NO: 66895 - DNA, 22 bp, Homo sapiens
tcagtgatttctggggtgaggg

SEQ ID NO: 66896 - DNA, 22 bp, Homo sapiens
gcccaggctggagtgcagtggc

SEQ ID NO: 66897 - DNA, 22 bp, Homo sapiens
atgagttgaagctacaagaggc

SEQ ID NO: 66898 - DNA, 22 bp, Homo sapiens
ttatttttaaaagttcacacag

SEQ ID NO: 66899 - DNA, 22 bp, Homo sapiens
acagatgttgcttgtcattctc

SEQ ID NO: 66900 - DNA, 22 bp, Homo sapiens
tgctatgttgcccagggtggcc

SEQ ID NO: 66901 - DNA, 22 bp, Homo sapiens
catgaaattgtattggcctcaa

SEQ ID NO: 66902 - DNA, 22 bp, Homo sapiens
tggaaatgtttcttgagctcag

SEQ ID NO: 66903 - DNA, 22 bp, Homo sapiens
ctcaggagttggaggctacagt

SEQ ID NO: 66904 - DNA, 22 bp, Homo sapiens
tggtccttctgtcttccgcacc

SEQ ID NO: 66905 - DNA, 22 bp, Homo sapiens
tgattcatcagaataggagttt

SEQ ID NO: 66906 - DNA, 22 bp, Homo sapiens
ttcttcagcctaccttgacctc

SEQ ID NO: 66907 - DNA, 18 bp, Homo sapiens
ccctcttgcacaaagcaa

SEQ ID NO: 66908 - DNA, 22 bp, Homo sapiens
tcagggattgcaaaattcatcc

SEQ ID NO: 66909 - DNA, 22 bp, Homo sapiens
gaaaggagagggttaaggagct

SEQ ID NO: 66910 - DNA, 22 bp, Homo sapiens
actgcaacctccgcctgccagg

SEQ ID NO: 66911 - DNA, 22 bp, Homo sapiens
ccaggaggcggaggttgcagcg

SEQ ID NO: 66912 - DNA, 22 bp, Homo sapiens
gagaggaagccttctgtacttg

SEQ ID NO: 66913 - DNA, 22 bp, Homo sapiens
ggtgggagagctctgtctccag

SEQ ID NO: 66914 - DNA, 22 bp, Homo sapiens
ttcacagtggtagtgcatttag

SEQ ID NO: 66915 - DNA, 22 bp, Homo sapiens
ccaggaggttgaggctgcagtg

SEQ ID NO: 66916 - DNA, 22 bp, Homo sapiens
gggaggttgaggctgcagtgag

SEQ ID NO: 66917 - DNA, 22 bp, Homo sapiens
tcatcagggatattggcctgaa

SEQ ID NO: 66918 - DNA, 22 bp, Homo sapiens
tgagggaatattgatagatccg

SEQ ID NO: 66919 - DNA, 22 bp, Homo sapiens
ccaggctgctgttggtgtccgc

SEQ ID NO: 66920 - DNA, 22 bp, Homo sapiens
cagctgcccctccagggctggg

SEQ ID NO: 66921 - DNA, 22 bp, Homo sapiens
aatgtgagccaatgcccgtggg

SEQ ID NO: 66922 - DNA, 22 bp, Homo sapiens
aaagaaatagatggcatttaaa

SEQ ID NO: 66923 - DNA, 22 bp, Homo sapiens
ctgggggtcttgaaagggagag

SEQ ID NO: 66924 - DNA, 22 bp, Homo sapiens
ctgggaggcggaggttgtagtg

SEQ ID NO: 66925 - DNA, 21 bp, Homo sapiens
caatggcgagatcttggctca

SEQ ID NO: 66926 - DNA, 23 bp, Homo sapiens
aggatatgacttgtctgccaacc

SEQ ID NO: 66927 - DNA, 23 bp, Homo sapiens
aaataggagtatctggatcatga

SEQ ID NO: 66928 - DNA, 22 bp, Homo sapiens
gaaaattattgaaaatggctct

SEQ ID NO: 66929 - DNA, 22 bp, Homo sapiens
ccggctactcgggaggctgacg

SEQ ID NO: 66930 - DNA, 22 bp, Homo sapiens
tcactgcaacctccacctcccg

SEQ ID NO: 66931 - DNA, 22 bp, Homo sapiens
ttattttaccttcctctgagct

SEQ ID NO: 66932 - DNA, 22 bp, Homo sapiens
ggtaacttagctcatggctgtg

SEQ ID NO: 66933 - DNA, 22 bp, Homo sapiens
tgaaatgattatatggtgtttg

SEQ ID NO: 66934 - DNA, 22 bp, Homo sapiens
gtcgtggagctcacagtgtgcc

SEQ ID NO: 66935 - DNA, 22 bp, Homo sapiens
actgggctcaagtgattgtcct

SEQ ID NO: 66936 - DNA, 22 bp, Homo sapiens
ccaggcaggcgatggtgcagtg

SEQ ID NO: 66937 - DNA, 16 bp, Homo sapiens
aggctcagaggctgga

SEQ ID NO: 66938 - DNA, 22 bp, Homo sapiens
ccaggaggcggaggttgcagtg

SEQ ID NO: 66939 - DNA, 22 bp, Homo sapiens
aggctgtgtggataatattggg

SEQ ID NO: 66940 - DNA, 22 bp, Homo sapiens
cacctagggtttcgcctttctt

SEQ ID NO: 66941 - DNA, 22 bp, Homo sapiens
ggcagagcttgcagtgagccga

SEQ ID NO: 66942 - DNA, 22 bp, Homo sapiens
acactgaaagaagccagcttgt

SEQ ID NO: 66943 - DNA, 22 bp, Homo sapiens
tagctcaaaggttaagtgtgga

SEQ ID NO: 66944 - DNA, 22 bp, Homo sapiens
ccaggaggtggagattgcagtg

SEQ ID NO: 66945 - DNA, 22 bp, Homo sapiens
tggctgtgtccctgtccagagt

SEQ ID NO: 66946 - DNA, 22 bp, Homo sapiens
aagggggcggcagccagtggaa

SEQ ID NO: 66947 - DNA, 22 bp, Homo sapiens
aaaggctttaaaatgtacatat

SEQ ID NO: 66948 - DNA, 22 bp, Homo sapiens
ttgtggaactcatctgcctggt

SEQ ID NO: 66949 - DNA, 17 bp, Homo sapiens
catcaaagaaatttcca

SEQ ID NO: 66950 - DNA, 22 bp, Homo sapiens
ttttctaacatctagtaatttg

SEQ ID NO: 66951 - DNA, 22 bp, Homo sapiens
ttttctgtttgcttcaagacat

SEQ ID NO: 66952 - DNA, 22 bp, Homo sapiens
agatggggtttcatcatgttgg

SEQ ID NO: 66953 - DNA, 22 bp, Homo sapiens
aatgttgcagagtgattgtcca

SEQ ID NO: 66954 - DNA, 22 bp, Homo sapiens
gtcagatctttggggatgctgt

SEQ ID NO: 66955 - DNA, 22 bp, Homo sapiens
actctgctctgtatttcactgt

SEQ ID NO: 66956 - DNA, 22 bp, Homo sapiens
agcgccactgcactccagcctg

SEQ ID NO: 66957 - DNA, 22 bp, Homo sapiens
cccaggaggcagaagttgcagt

SEQ ID NO: 66958 - DNA, 22 bp, Homo sapiens
atttacaggtagaattttaagt

SEQ ID NO: 66959 - DNA, 19 bp, Homo sapiens
agggaatccggctgaggga

SEQ ID NO: 66960 - DNA, 22 bp, Homo sapiens
gtgggcatcaccagggcctcca

SEQ ID NO: 66961 - DNA, 22 bp, Homo sapiens
tgtcagtgtctatgaagaattt

SEQ ID NO: 66962 - DNA, 22 bp, Homo sapiens
ctcagcttttcccggataggtg

SEQ ID NO: 66963 - DNA, 22 bp, Homo sapiens
gtgctggggagataggaagaga

SEQ ID NO: 66964 - DNA, 22 bp, Homo sapiens
gggttcagtccctcttgctact

SEQ ID NO: 66965 - DNA, 22 bp, Homo sapiens
tgccgtggggctgaggctggag

SEQ ID NO: 66966 - DNA, 22 bp, Homo sapiens
cctcagacccctgctgagcttc

SEQ ID NO: 66967 - DNA, 22 bp, Homo sapiens
tcactgcaacctccacctcctg

SEQ ID NO: 66968 - DNA, 22 bp, Homo sapiens
gatggaggagatggcagggtgc

SEQ ID NO: 66969 - DNA, 22 bp, Homo sapiens
taagtcaaggtggcatttgaga

SEQ ID NO: 66970 - DNA, 22 bp, Homo sapiens
tgcatattatgtgtatctgtct

SEQ ID NO: 66971 - DNA, 22 bp, Homo sapiens
gccatcatatcccctgtgacct

SEQ ID NO: 66972 - DNA, 22 bp, Homo sapiens
actggggtttaggcctgggcaa

SEQ ID NO: 66973 - DNA, 22 bp, Homo sapiens
ccaggaggcagaagttgcagtg

SEQ ID NO: 66974 - DNA, 20 bp, Homo sapiens
atggggtgagtgacgccctc

SEQ ID NO: 66975 - DNA, 22 bp, Homo sapiens
agtgaggggcagctgagtgggc

SEQ ID NO: 66976 - DNA, 22 bp, Homo sapiens
ggctgtggcagctggaagtggt

SEQ ID NO: 66977 - DNA, 19 bp, Homo sapiens
catggtgaaaccccgtctc

SEQ ID NO: 66978 - DNA, 21 bp, Homo sapiens
tgaaggggtggcagtgtgctt

SEQ ID NO: 66979 - DNA, 22 bp, Homo sapiens
caccaaagtcgcttctgtcgtc

SEQ ID NO: 66980 - DNA, 22 bp, Homo sapiens
aaagtgctaggattacaagcgt

SEQ ID NO: 66981 - DNA, 22 bp, Homo sapiens
tgggtgagcggctgcacacccg

SEQ ID NO: 66982 - DNA, 22 bp, Homo sapiens
aggccaggaatccttgtcccag

SEQ ID NO: 66983 - DNA, 22 bp, Homo sapiens
tcccgtaggttgctgtagtcgg

SEQ ID NO: 66984 - DNA, 22 bp, Homo sapiens
actttcttggtcccatgtttga

SEQ ID NO: 66985 - DNA, 22 bp, Homo sapiens
acaattctgatggtttcccagt

SEQ ID NO: 66986 - DNA, 22 bp, Homo sapiens
aggattgtgcctccagtcagaa

SEQ ID NO: 66987 - DNA, 22 bp, Homo sapiens
caggagctcagatgacatctca

SEQ ID NO: 66988 - DNA, 22 bp, Homo sapiens
tacgcctgtaatcccagcactt

SEQ ID NO: 66989 - DNA, 22 bp, Homo sapiens
tccttaggcaatttgggagagt

SEQ ID NO: 66990 - DNA, 22 bp, Homo sapiens
gatttttatataaagtgagaaa

SEQ ID NO: 66991 - DNA, 22 bp, Homo sapiens
tgtgggtggcatcgtcctggcc

SEQ ID NO: 66992 - DNA, 22 bp, Homo sapiens
cgtaggtggctcagcacctggg

SEQ ID NO: 66993 - DNA, 22 bp, Homo sapiens
ctgggaggcagaggttgtagtg

SEQ ID NO: 66994 - DNA, 22 bp, Homo sapiens
tgcctgtgtcagcaggtggaag

SEQ ID NO: 66995 - DNA, 22 bp, Homo sapiens
ttgtggttaaccgcacattttt

SEQ ID NO: 66996 - DNA, 22 bp, Homo sapiens
acctcctggcctcaagcaatcc

SEQ ID NO: 66997 - DNA, 22 bp, Homo sapiens
ttgccttgttattctctcagaa

SEQ ID NO: 66998 - DNA, 22 bp, Homo sapiens
tctatgtctcgacccaagacaa

SEQ ID NO: 66999 - DNA, 22 bp, Homo sapiens
ttatttaatgtgatctgaagag

SEQ ID NO: 67000 - DNA, 22 bp, Homo sapiens
gggcggatcacctgaggtcagg

SEQ ID NO: 67001 - DNA, 22 bp, Homo sapiens
tgctgggggtagctctgcgtag

SEQ ID NO: 67002 - DNA, 22 bp, Homo sapiens
aaattgtaatgacttcacttga

SEQ ID NO: 67003 - DNA, 22 bp, Homo sapiens
gctggctgacagatttggggtg

SEQ ID NO: 67004 - DNA, 22 bp, Homo sapiens
atacttctttagcatattgaac

SEQ ID NO: 67005 - DNA, 22 bp, Homo sapiens
ggctctgtgtctccacccaaat

SEQ ID NO: 67006 - DNA, 22 bp, Homo sapiens
ggaggcggaggttgcagtgagc

SEQ ID NO: 67007 - DNA, 22 bp, Homo sapiens
gcacggctaatttttgtatttt

SEQ ID NO: 67008 - DNA, 22 bp, Homo sapiens
gggttggatcctggtggctgcc

SEQ ID NO: 67009 - DNA, 23 bp, Homo sapiens
ccagtgattgcctggaaggaggt

SEQ ID NO: 67010 - DNA, 22 bp, Homo sapiens
ctggagagaatgtggaatgatt

SEQ ID NO: 67011 - DNA, 22 bp, Homo sapiens
tgtttgagttctagcgcattta

SEQ ID NO: 67012 - DNA, 23 bp, Homo sapiens
tgctggagaagcaaagttctgag

SEQ ID NO: 67013 - DNA, 22 bp, Homo sapiens
gcagaggacacaggagggcaag

SEQ ID NO: 67014 - DNA, 22 bp, Homo sapiens
aggagggagcttaagccaggca

SEQ ID NO: 67015 - DNA, 22 bp, Homo sapiens
tctgagctgggtcttgacagct

SEQ ID NO: 67016 - DNA, 22 bp, Homo sapiens
atgccacttcattccagcctcg

SEQ ID NO: 67017 - DNA, 22 bp, Homo sapiens
aagaagagaactggcatcctaa

SEQ ID NO: 67018 - DNA, 22 bp, Homo sapiens
cagggaaagtcccaccccacac

SEQ ID NO: 67019 - DNA, 22 bp, Homo sapiens
ggcttctctccagtatgcattc

SEQ ID NO: 67020 - DNA, 22 bp, Homo sapiens
cactgcaacctccacctcctgg

SEQ ID NO: 67021 - DNA, 22 bp, Homo sapiens
atgccactgcactccagcctgg

SEQ ID NO: 67022 - DNA, 22 bp, Homo sapiens
cccagagcatgtgctgcctttg

SEQ ID NO: 67023 - DNA, 22 bp, Homo sapiens
aggagaagccaagttgtgagca

SEQ ID NO: 67024 - DNA, 22 bp, Homo sapiens
ttgagacacagtttcactctgt

SEQ ID NO: 67025 - DNA, 22 bp, Homo sapiens
ggggtgtggacggctgtgccag

SEQ ID NO: 67026 - DNA, 22 bp, Homo sapiens
ggtagtcggccttgccctgggc

SEQ ID NO: 67027 - DNA, 22 bp, Homo sapiens
gagggagggactagcattctct

SEQ ID NO: 67028 - DNA, 20 bp, Homo sapiens
aaattactgccacacatttc

SEQ ID NO: 67029 - DNA, 22 bp, Homo sapiens
aggggatggagctggaaggcag

SEQ ID NO: 67030 - DNA, 22 bp, Homo sapiens
cccaggcttttctcttgcccca

SEQ ID NO: 67031 - DNA, 22 bp, Homo sapiens
gacaggaggcagagctcaggtg

SEQ ID NO: 67032 - DNA, 22 bp, Homo sapiens
attggccatttgcatgtattat

SEQ ID NO: 67033 - DNA, 22 bp, Homo sapiens
aggctcagatccttgtgtcctg

SEQ ID NO: 67034 - DNA, 23 bp, Homo sapiens
aatgggtgcaactatccatgaca

SEQ ID NO: 67035 - DNA, 21 bp, Homo sapiens
cgcagagcgaacttgcggcgc

SEQ ID NO: 67036 - DNA, 22 bp, Homo sapiens
ccaagcagagcagcctctctgg

SEQ ID NO: 67037 - DNA, 22 bp, Homo sapiens
gcaggctgtctaaagttagagt

SEQ ID NO: 67038 - DNA, 20 bp, Homo sapiens
ctgtggaattttaccatgcg

SEQ ID NO: 67039 - DNA, 22 bp, Homo sapiens
atgaaatgctattttggctaga

SEQ ID NO: 67040 - DNA, 22 bp, Homo sapiens
gggcttggcacatgggctcagc

SEQ ID NO: 67041 - DNA, 22 bp, Homo sapiens
gaggcagaagttgcagtgagca

SEQ ID NO: 67042 - DNA, 22 bp, Homo sapiens
gttacagtcaggagatattttg

SEQ ID NO: 67043 - DNA, 22 bp, Homo sapiens
catgagataatttttctccagt

SEQ ID NO: 67044 - DNA, 22 bp, Homo sapiens
tcatctaagagtcttacattta

SEQ ID NO: 67045 - DNA, 22 bp, Homo sapiens
gcccggcagtcacacacccagg

SEQ ID NO: 67046 - DNA, 22 bp, Homo sapiens
aagcagagaatctgggagcgag

SEQ ID NO: 67047 - DNA, 22 bp, Homo sapiens
caggctgtccaggctcctttgg

SEQ ID NO: 67048 - DNA, 22 bp, Homo sapiens
aatgtcaaaggctatacattca

SEQ ID NO: 67049 - DNA, 22 bp, Homo sapiens
ctctccattccctacagttttc

SEQ ID NO: 67050 - DNA, 22 bp, Homo sapiens
ccaggctggagtatagtggcgc

SEQ ID NO: 67051 - DNA, 22 bp, Homo sapiens
gggcggggggagctggaatgaa

SEQ ID NO: 67052 - DNA, 22 bp, Homo sapiens
ttatttaaaagtggtaagattc

SEQ ID NO: 67053 - DNA, 22 bp, Homo sapiens
atgccactgcgctctagcctgg

SEQ ID NO: 67054 - DNA, 22 bp, Homo sapiens
tcactgaaacctccacctctcg

SEQ ID NO: 67055 - DNA, 22 bp, Homo sapiens
gggagaggttacccgagcaact

SEQ ID NO: 67056 - DNA, 22 bp, Homo sapiens
tcttgggcatgtgtttgatttc

SEQ ID NO: 67057 - DNA, 22 bp, Homo sapiens
tgtagctctccagccagcaagg

SEQ ID NO: 67058 - DNA, 22 bp, Homo sapiens
ttccccttgggctgtggaggag

SEQ ID NO: 67059 - DNA, 22 bp, Homo sapiens
taggtgcctgcacgacccaaac

SEQ ID NO: 67060 - DNA, 22 bp, Homo sapiens
tttctttatcatagcatctttg

SEQ ID NO: 67061 - DNA, 22 bp, Homo sapiens
gcaaacaaggacatacatcctg

SEQ ID NO: 67062 - DNA, 22 bp, Homo sapiens
tgtaatattgtagtgacagtac

SEQ ID NO: 67063 - DNA, 22 bp, Homo sapiens
agtaatcaatttttcggtggat

SEQ ID NO: 67064 - DNA, 22 bp, Homo sapiens
aagttactggcaagggctgcag

SEQ ID NO: 67065 - DNA, 22 bp, Homo sapiens
aactatgttaataagtttcatt

SEQ ID NO: 67066 - DNA, 22 bp, Homo sapiens
tccttaggcaatttgggagagt

SEQ ID NO: 67067 - DNA, 22 bp, Homo sapiens
cttgacactgtcactcaggcca

SEQ ID NO: 67068 - DNA, 22 bp, Homo sapiens
caaaatgcatctgagaccaggc

SEQ ID NO: 67069 - DNA, 22 bp, Homo sapiens
ctcactgcaagctctgcctccc

SEQ ID NO: 67070 - DNA, 22 bp, Homo sapiens
tgcactccaggctgggtgacag

SEQ ID NO: 67071 - DNA, 22 bp, Homo sapiens
gtgcacttgatctagacagatt

SEQ ID NO: 67072 - DNA, 22 bp, Homo sapiens
aacagtgtttttcttcagcact

SEQ ID NO: 67073 - DNA, 22 bp, Homo sapiens
atgattgaaaatgacattgcca

SEQ ID NO: 67074 - DNA, 22 bp, Homo sapiens
atacaaaaattagccgggagta

SEQ ID NO: 67075 - DNA, 22 bp, Homo sapiens
gcctccggagtcacagtgtctt

SEQ ID NO: 67076 - DNA, 22 bp, Homo sapiens
acagtcttcagaagggattggg

SEQ ID NO: 67077 - DNA, 22 bp, Homo sapiens
ttgcaattgctatggagagcgt

SEQ ID NO: 67078 - DNA, 22 bp, Homo sapiens
tccttgtaaaggagctctaaca

SEQ ID NO: 67079 - DNA, 22 bp, Homo sapiens
ggtccccgtggaggctggagcg

SEQ ID NO: 67080 - DNA, 22 bp, Homo sapiens
atgcattgtcaggcaatttcat

SEQ ID NO: 67081 - DNA, 22 bp, Homo sapiens
ctcactgcaagctctgcctcca

SEQ ID NO: 67082 - DNA, 22 bp, Homo sapiens
ttaagctagtgaagtccctcaa

SEQ ID NO: 67083 - DNA, 22 bp, Homo sapiens
ctgggagtggtgacagctctcg

SEQ ID NO: 67084 - DNA, 22 bp, Homo sapiens
ttatgatttgccacagattggt

SEQ ID NO: 67085 - DNA, 22 bp, Homo sapiens
actgccaatggtagtttgatgg

SEQ ID NO: 67086 - DNA, 22 bp, Homo sapiens
ctcactgcaacctctgcctccc

SEQ ID NO: 67087 - DNA, 22 bp, Homo sapiens
gacaatatagttgaatgagcaa

SEQ ID NO: 67088 - DNA, 22 bp, Homo sapiens
acaaagtgctgacattacaggc

SEQ ID NO: 67089 - DNA, 22 bp, Homo sapiens
gcatatgatcacgtgtgtcggt

SEQ ID NO: 67090 - DNA, 20 bp, Homo sapiens
ataaaataactgccacaaga

SEQ ID NO: 67091 - DNA, 22 bp, Homo sapiens
gcttccgcgatgtcctaggtgg

SEQ ID NO: 67092 - DNA, 22 bp, Homo sapiens
gcaaaagtacagccggatttct

SEQ ID NO: 67093 - DNA, 22 bp, Homo sapiens
agatttatgtggtcacactcag

SEQ ID NO: 67094 - DNA, 22 bp, Homo sapiens
atacaaaatatatactggagac

SEQ ID NO: 67095 - DNA, 22 bp, Homo sapiens
actaaagctcacagagttgaac

SEQ ID NO: 67096 - DNA, 22 bp, Homo sapiens
ccgcccacactaaatatgagcg

SEQ ID NO: 67097 - DNA, 22 bp, Homo sapiens
tgtacttgaacttgactgtaga

SEQ ID NO: 67098 - DNA, 22 bp, Homo sapiens
ctacaaaagtaattgtggtttt

SEQ ID NO: 67099 - DNA, 22 bp, Homo sapiens
gctcagacctgtaatcttagca

SEQ ID NO: 67100 - DNA, 22 bp, Homo sapiens
gcctccggagttgcagtgtctt

SEQ ID NO: 67101 - DNA, 22 bp, Homo sapiens
ttcaatatgatattagctgtgg

SEQ ID NO: 67102 - DNA, 22 bp, Homo sapiens
tcagtgttaatcagtggtacct

SEQ ID NO: 67103 - DNA, 22 bp, Homo sapiens
taaagattgctcaaaactgtga

SEQ ID NO: 67104 - DNA, 22 bp, Homo sapiens
tgtgggagaaggaagcaagctg

SEQ ID NO: 67105 - DNA, 22 bp, Homo sapiens
tacaaaaaattgatactgacga

SEQ ID NO: 67106 - DNA, 22 bp, Homo sapiens
tacaacaatttccacattagaa

SEQ ID NO: 67107 - DNA, 22 bp, Homo sapiens
ttggaagttgatttaaaaagga

SEQ ID NO: 67108 - DNA, 22 bp, Homo sapiens
caggtgagaggcggtcctgcat

SEQ ID NO: 67109 - DNA, 21 bp, Homo sapiens
cagaggcctatcacagactcc

SEQ ID NO: 67110 - DNA, 22 bp, Homo sapiens
ctgggaggcagaggttgtagtg

SEQ ID NO: 67111 - DNA, 22 bp, Homo sapiens
aaggctcggcaatgtgcggctc

SEQ ID NO: 67112 - DNA, 20 bp, Homo sapiens
acgcacacgcgggggcgtgc

SEQ ID NO: 67113 - DNA, 21 bp, Homo sapiens
tgctgggtttgcccatcaggc

SEQ ID NO: 67114 - DNA, 22 bp, Homo sapiens
ctggcctaggaatggttttccg

SEQ ID NO: 67115 - DNA, 22 bp, Homo sapiens
gcacatgagaagctggcgatgc

SEQ ID NO: 67116 - DNA, 22 bp, Homo sapiens
tattgggtaaagatccagtttt

SEQ ID NO: 67117 - DNA, 20 bp, Homo sapiens
tgctggaaattgttctagga

SEQ ID NO: 67118 - DNA, 22 bp, Homo sapiens
tgttattctagtggatcacgtc

SEQ ID NO: 67119 - DNA, 22 bp, Homo sapiens
atgccactgcactccagcctgg

SEQ ID NO: 67120 - DNA, 22 bp, Homo sapiens
ccgcgaggtggaggttgcagtg

SEQ ID NO: 67121 - DNA, 22 bp, Homo sapiens
tgtccaggctaaagtgcagtgg

SEQ ID NO: 67122 - DNA, 22 bp, Homo sapiens
tgtgtggattcatctcaaagag

SEQ ID NO: 67123 - DNA, 22 bp, Homo sapiens
cccaggccctggcagagcttgt

SEQ ID NO: 67124 - DNA, 22 bp, Homo sapiens
gggccctgggattcagagcaag

SEQ ID NO: 67125 - DNA, 22 bp, Homo sapiens
cagtgatatttatcctactcac

SEQ ID NO: 67126 - DNA, 21 bp, Homo sapiens
aagaggaagcattatggcata

SEQ ID NO: 67127 - DNA, 22 bp, Homo sapiens
cgcccccagggcctcgagcatg

SEQ ID NO: 67128 - DNA, 22 bp, Homo sapiens
gaactttataactgtaaatgtc

SEQ ID NO: 67129 - DNA, 22 bp, Homo sapiens
ggaaggggtgggtgagcctcag

SEQ ID NO: 67130 - DNA, 22 bp, Homo sapiens
cacccaggctggagagcagtgg

SEQ ID NO: 67131 - DNA, 22 bp, Homo sapiens
ccgccgtgcaggccgcgacgtg

SEQ ID NO: 67132 - DNA, 20 bp, Homo sapiens
caggtccagcacgtgcacgg

SEQ ID NO: 67133 - DNA, 22 bp, Homo sapiens
atgtgccaacgtgcaggtttgt

SEQ ID NO: 67134 - DNA, 22 bp, Homo sapiens
gccgtggggagagagggtgcgt

SEQ ID NO: 67135 - DNA, 22 bp, Homo sapiens
tggaatggaaacaaactgagga

SEQ ID NO: 67136 - DNA, 22 bp, Homo sapiens
tgagaattacaaatgagtcaca

SEQ ID NO: 67137 - DNA, 22 bp, Homo sapiens
gaagatgttatggagagctcag

SEQ ID NO: 67138 - DNA, 22 bp, Homo sapiens
ggagtttgcctattgcttttgg

SEQ ID NO: 67139 - DNA, 22 bp, Homo sapiens
gaggcctgggcaagggggtctg

SEQ ID NO: 67140 - DNA, 21 bp, Homo sapiens
ggtgctcgctgatgaggagtg

SEQ ID NO: 67141 - DNA, 22 bp, Homo sapiens
agctgctgagccaggctgatgt

SEQ ID NO: 67142 - DNA, 22 bp, Homo sapiens
tgtggcacatacacaggagggc

SEQ ID NO: 67143 - DNA, 21 bp, Homo sapiens
gttcatgtcagcattaaggga

SEQ ID NO: 67144 - DNA, 22 bp, Homo sapiens
gcaagacatgtctaaggtttaa

SEQ ID NO: 67145 - DNA, 22 bp, Homo sapiens
tggaagactcaaggtggtgaat

SEQ ID NO: 67146 - DNA, 22 bp, Homo sapiens
gctgcagctcgccttccggcct

SEQ ID NO: 67147 - DNA, 22 bp, Homo sapiens
tccggccgaaagatctgaccga

SEQ ID NO: 67148 - DNA, 22 bp, Homo sapiens
caagacttcaccgctctgtgct

SEQ ID NO: 67149 - DNA, 22 bp, Homo sapiens
atctagattaggtataagagct

SEQ ID NO: 67150 - DNA, 22 bp, Homo sapiens
tgagctgtctgaatggtgagga

SEQ ID NO: 67151 - DNA, 22 bp, Homo sapiens
ctgctccccagcctgcgccttt

SEQ ID NO: 67152 - DNA, 22 bp, Homo sapiens
ttatttgtggcatatgagacga

SEQ ID NO: 67153 - DNA, 19 bp, Homo sapiens
acacagggatcagagggtt

SEQ ID NO: 67154 - DNA, 22 bp, Homo sapiens
aggagcagaccgtagtcctgca

SEQ ID NO: 67155 - DNA, 22 bp, Homo sapiens
tggccttggccgtgctggggtc

SEQ ID NO: 67156 - DNA, 22 bp, Homo sapiens
agagctccagggttttgtagtg

SEQ ID NO: 67157 - DNA, 22 bp, Homo sapiens
gtggagggtgattgccggctgt

SEQ ID NO: 67158 - DNA, 22 bp, Homo sapiens
tcaccaggctagagtgcagtgg

SEQ ID NO: 67159 - DNA, 22 bp, Homo sapiens
tcctgagccctactctagacga

SEQ ID NO: 67160 - DNA, 22 bp, Homo sapiens
cccttagaattttgtagttatt

SEQ ID NO: 67161 - DNA, 22 bp, Homo sapiens
gtatcacttttgagagtgagaa

SEQ ID NO: 67162 - DNA, 22 bp, Homo sapiens
tctcatttacttccacaggctg

SEQ ID NO: 67163 - DNA, 22 bp, Homo sapiens
gagggccctggctggctccagc

SEQ ID NO: 67164 - DNA, 22 bp, Homo sapiens
cgtgaggggggtaaggcgtccg

SEQ ID NO: 67165 - DNA, 22 bp, Homo sapiens
tatgccactgctctccatccta

SEQ ID NO: 67166 - DNA, 22 bp, Homo sapiens
tgtgcctactgatagagccaag

SEQ ID NO: 67167 - DNA, 22 bp, Homo sapiens
cagcggagggcagccttgcagc

SEQ ID NO: 67168 - DNA, 20 bp, Homo sapiens
gggtgtgtgcagggcctggt

SEQ ID NO: 67169 - DNA, 22 bp, Homo sapiens
tcctgggacaagccgtggaagt

SEQ ID NO: 67170 - DNA, 22 bp, Homo sapiens
caaggtgccatgctgggcgggg

SEQ ID NO: 67171 - DNA, 22 bp, Homo sapiens
cagcagagaaattacatatttg

SEQ ID NO: 67172 - DNA, 22 bp, Homo sapiens
tcagtgcagggtgggagagaga

SEQ ID NO: 67173 - DNA, 22 bp, Homo sapiens
gatatcatgggaaggtgtactt

SEQ ID NO: 67174 - DNA, 22 bp, Homo sapiens
agctacagtcggaaggacagac

SEQ ID NO: 67175 - DNA, 22 bp, Homo sapiens
ttctttgaatagatgttcccag

SEQ ID NO: 67176 - DNA, 23 bp, Homo sapiens
cagggccctgctcaatttctcca

SEQ ID NO: 67177 - DNA, 22 bp, Homo sapiens
tgagcacatttcacatgacagg

SEQ ID NO: 67178 - DNA, 22 bp, Homo sapiens
gggctgactcctattggatgaa

SEQ ID NO: 67179 - DNA, 22 bp, Homo sapiens
tttggtattgcacactgtcttc

SEQ ID NO: 67180 - DNA, 22 bp, Homo sapiens
tggtgccatcatagctcactgc

SEQ ID NO: 67181 - DNA, 22 bp, Homo sapiens
gagtgttccagaaactggccct

SEQ ID NO: 67182 - DNA, 20 bp, Homo sapiens
gggcagagccagccagtccc

SEQ ID NO: 67183 - DNA, 22 bp, Homo sapiens
acacatggtctacttcttctca

SEQ ID NO: 67184 - DNA, 20 bp, Homo sapiens
agcagagtgcccatcccgga

SEQ ID NO: 67185 - DNA, 22 bp, Homo sapiens
ccagtgtgcattatcatgtgtc

SEQ ID NO: 67186 - DNA, 22 bp, Homo sapiens
ggactgggaatcagggagatgc

SEQ ID NO: 67187 - DNA, 22 bp, Homo sapiens
tggagggcatgctgtccatggg

SEQ ID NO: 67188 - DNA, 22 bp, Homo sapiens
gcagagtgctgtcgtacgcccc

SEQ ID NO: 67189 - DNA, 22 bp, Homo sapiens
tgaaggggttcagcatgggggt

SEQ ID NO: 67190 - DNA, 22 bp, Homo sapiens
atttaagggatttggagaccaa

SEQ ID NO: 67191 - DNA, 22 bp, Homo sapiens
gcggccttgtggcggagcaggc

SEQ ID NO: 67192 - DNA, 22 bp, Homo sapiens
gatattcctgaaggacagggtt

SEQ ID NO: 67193 - DNA, 22 bp, Homo sapiens
ggtgccctggaagctgctgcat

SEQ ID NO: 67194 - DNA, 22 bp, Homo sapiens
aagtccattaggcccctgcctg

SEQ ID NO: 67195 - DNA, 22 bp, Homo sapiens
tgtgtttctgagaatcccacct

SEQ ID NO: 67196 - DNA, 22 bp, Homo sapiens
tatctgatacaacagaataaca

SEQ ID NO: 67197 - DNA, 20 bp, Homo sapiens
gctctgtggtttgagtctcc

SEQ ID NO: 67198 - DNA, 22 bp, Homo sapiens
ggcctcgcggcttctggtggct

SEQ ID NO: 67199 - DNA, 22 bp, Homo sapiens
caaagttgcagttatgtgatta

SEQ ID NO: 67200 - DNA, 22 bp, Homo sapiens
tttacacagaggacactgggct

SEQ ID NO: 67201 - DNA, 22 bp, Homo sapiens
ctgcactgagcatctaacctta

SEQ ID NO: 67202 - DNA, 22 bp, Homo sapiens
tacctcaagttccaggaaagcg

SEQ ID NO: 67203 - DNA, 22 bp, Homo sapiens
tagactggtgaattagggggaa

SEQ ID NO: 67204 - DNA, 22 bp, Homo sapiens
agcctggcggtcgtcggtcagg

SEQ ID NO: 67205 - DNA, 22 bp, Homo sapiens
tcaagcaaagtttagctggtta

SEQ ID NO: 67206 - DNA, 22 bp, Homo sapiens
gtggtggatgtctgtaatctca

SEQ ID NO: 67207 - DNA, 22 bp, Homo sapiens
tgaatgtgatgctaaacatatg

SEQ ID NO: 67208 - DNA, 22 bp, Homo sapiens
agaaagtgcttccctttggact

SEQ ID NO: 67209 - DNA, 22 bp, Homo sapiens
tggctgtacattggaattatct

SEQ ID NO: 67210 - DNA, 22 bp, Homo sapiens
aagaatgagctcaaagatctta

SEQ ID NO: 67211 - DNA, 22 bp, Homo sapiens
caggaggttgagggtgcagtga

SEQ ID NO: 67212 - DNA, 22 bp, Homo sapiens
agcttgtagaaggccacgagca

SEQ ID NO: 67213 - DNA, 22 bp, Homo sapiens
gcgttggggaccccgaagctgg

SEQ ID NO: 67214 - DNA, 22 bp, Homo sapiens
attgtgaatagtgccgcagtaa

SEQ ID NO: 67215 - DNA, 22 bp, Homo sapiens
gcggcccgagcaggacgggtgg

SEQ ID NO: 67216 - DNA, 22 bp, Homo sapiens
gaaagtgctctctctatacaca

SEQ ID NO: 67217 - DNA, 22 bp, Homo sapiens
cctggctctgccacttactgcc

SEQ ID NO: 67218 - DNA, 18 bp, Homo sapiens
ttgcttcttttctctagg

SEQ ID NO: 67219 - DNA, 22 bp, Homo sapiens
gagcaccgcctccacgatgccc

SEQ ID NO: 67220 - DNA, 22 bp, Homo sapiens
aagacttgaccaggttgaaggc

SEQ ID NO: 67221 - DNA, 22 bp, Homo sapiens
ggtgtagctctgtgtcccactg

SEQ ID NO: 67222 - DNA, 22 bp, Homo sapiens
ggttttcacctccagaatgtgc

SEQ ID NO: 67223 - DNA, 22 bp, Homo sapiens
atgtgctgagtgtgtatataca

SEQ ID NO: 67224 - DNA, 22 bp, Homo sapiens
ggagaagaggagctggaagcct

SEQ ID NO: 67225 - DNA, 21 bp, Homo sapiens
gctcctggtgctgcgtggcgc

SEQ ID NO: 67226 - DNA, 22 bp, Homo sapiens
cctggggccccgagccagaagc

SEQ ID NO: 67227 - DNA, 22 bp, Homo sapiens
gtccaggcctgcctctgaggag

SEQ ID NO: 67228 - DNA, 22 bp, Homo sapiens
ctcattgcccagatccccacag

SEQ ID NO: 67229 - DNA, 22 bp, Homo sapiens
tggcactgagcagccgcggcag

SEQ ID NO: 67230 - DNA, 22 bp, Homo sapiens
tcaggctcaggttaggggccaa

SEQ ID NO: 67231 - DNA, 22 bp, Homo sapiens
aagcctggcacattggagtctg

SEQ ID NO: 67232 - DNA, 22 bp, Homo sapiens
atgttctacagatggaaagggg

SEQ ID NO: 67233 - DNA, 22 bp, Homo sapiens
ctgtctgaatcctaagcttcct

SEQ ID NO: 67234 - DNA, 22 bp, Homo sapiens
tcacagagaaatgtggcacaaa

SEQ ID NO: 67235 - DNA, 22 bp, Homo sapiens
tcgcccaggctggaagtgcagt

SEQ ID NO: 67236 - DNA, 19 bp, Homo sapiens
caggcctcttaccctctct

SEQ ID NO: 67237 - DNA, 22 bp, Homo sapiens
aggcgcctgcgggatccttgcc

SEQ ID NO: 67238 - DNA, 22 bp, Homo sapiens
gaggcagaggttgcagtgagct

SEQ ID NO: 67239 - DNA, 21 bp, Homo sapiens
tgttttccaccttgaggcaag

SEQ ID NO: 67240 - DNA, 22 bp, Homo sapiens
ttgtgaatagtgctgcaataaa

SEQ ID NO: 67241 - DNA, 22 bp, Homo sapiens
ccaggaggtggagattgcagtg

SEQ ID NO: 67242 - DNA, 22 bp, Homo sapiens
aataaacaaaggacaaggaggt

SEQ ID NO: 67243 - DNA, 22 bp, Homo sapiens
caggcgggcaggtgcggcccct

SEQ ID NO: 67244 - DNA, 22 bp, Homo sapiens
atattacacacggtatcacggg

SEQ ID NO: 67245 - DNA, 22 bp, Homo sapiens
agagctgggtggacttgtagtt

SEQ ID NO: 67246 - DNA, 22 bp, Homo sapiens
tttacaacccaagtccagagag

SEQ ID NO: 67247 - DNA, 22 bp, Homo sapiens
aaggatgattggtaatgacact

SEQ ID NO: 67248 - DNA, 22 bp, Homo sapiens
aaaaatcacttttataggcagc

SEQ ID NO: 67249 - DNA, 22 bp, Homo sapiens
ttgctctgactggagtgcagtg

SEQ ID NO: 67250 - DNA, 22 bp, Homo sapiens
gctgggctgcgtcggggaagcc

SEQ ID NO: 67251 - DNA, 22 bp, Homo sapiens
tggcaggcgggagccatagagg

SEQ ID NO: 67252 - DNA, 22 bp, Homo sapiens
ttggatttgtctaccagggaat

SEQ ID NO: 67253 - DNA, 22 bp, Homo sapiens
actgagggtcaaccatttgctc

SEQ ID NO: 67254 - DNA, 22 bp, Homo sapiens
tagcagcatttttgtagagtat

SEQ ID NO: 67255 - DNA, 19 bp, Homo sapiens
gcctcatttccacctcccc

SEQ ID NO: 67256 - DNA, 22 bp, Homo sapiens
gatatgttgagtagagtttttg

SEQ ID NO: 67257 - DNA, 22 bp, Homo sapiens
cccgggttgtccgcgcgtccgg

SEQ ID NO: 67258 - DNA, 22 bp, Homo sapiens
gaggtgggtgtatcacaggtca

SEQ ID NO: 67259 - DNA, 22 bp, Homo sapiens
ttaggctgttcttgtgttgtta

SEQ ID NO: 67260 - DNA, 22 bp, Homo sapiens
ttgctgacctttgctctccgtt

SEQ ID NO: 67261 - DNA, 22 bp, Homo sapiens
aagcctaggcctactctggttt

SEQ ID NO: 67262 - DNA, 22 bp, Homo sapiens
ctgggcgtggcagcggagctgg

SEQ ID NO: 67263 - DNA, 22 bp, Homo sapiens
aagcttcctgcatgggactgct

SEQ ID NO: 67264 - DNA, 23 bp, Homo sapiens
cgcccagcctcagtgacctgggc

SEQ ID NO: 67265 - DNA, 16 bp, Homo sapiens
gcaggcagatcacatg

SEQ ID NO: 67266 - DNA, 22 bp, Homo sapiens
ttatacagggagtttccctgca

SEQ ID NO: 67267 - DNA, 22 bp, Homo sapiens
tcccggcgctgggaggtgggtc

SEQ ID NO: 67268 - DNA, 22 bp, Homo sapiens
aagatgcggttgaccatggtgt

SEQ ID NO: 67269 - DNA, 22 bp, Homo sapiens
tcagccagccagctacaggctt

SEQ ID NO: 67270 - DNA, 22 bp, Homo sapiens
tcacttcccagacggggtggca

SEQ ID NO: 67271 - DNA, 22 bp, Homo sapiens
gccagcagcttcttctcatcct

SEQ ID NO: 67272 - DNA, 22 bp, Homo sapiens
agatgaatccacacatggcaaa

SEQ ID NO: 67273 - DNA, 22 bp, Homo sapiens
tcaaagatcagatggttgtagg

SEQ ID NO: 67274 - DNA, 23 bp, Homo sapiens
gcaagagacagagcatcctgttc

SEQ ID NO: 67275 - DNA, 22 bp, Homo sapiens
tgatctggtcctactgtgggca

SEQ ID NO: 67276 - DNA, 18 bp, Homo sapiens
aggcttacagcagcaggc

SEQ ID NO: 67277 - DNA, 22 bp, Homo sapiens
tataaactcctcttgcattcct

SEQ ID NO: 67278 - DNA, 22 bp, Homo sapiens
aggattgtgcctccagtcagaa

SEQ ID NO: 67279 - DNA, 22 bp, Homo sapiens
ctcgggcaccctggttctggtg

SEQ ID NO: 67280 - DNA, 22 bp, Homo sapiens
aacatacgagcagtttatagag

SEQ ID NO: 67281 - DNA, 22 bp, Homo sapiens
acccaggccattggcaagagtc

SEQ ID NO: 67282 - DNA, 22 bp, Homo sapiens
tgaggcaggaggattgcaggat

SEQ ID NO: 67283 - DNA, 22 bp, Homo sapiens
aatactgcctgtgaggtaactc

SEQ ID NO: 67284 - DNA, 23 bp, Homo sapiens
gcctgggagttgcgatctgcccg

SEQ ID NO: 67285 - DNA, 22 bp, Homo sapiens
gagcccaggagtttgatgctgc

SEQ ID NO: 67286 - DNA, 22 bp, Homo sapiens
agctcttacatttaggtctatg

SEQ ID NO: 67287 - DNA, 22 bp, Homo sapiens
tgcaatttttccatgacctaga

SEQ ID NO: 67288 - DNA, 22 bp, Homo sapiens
ttactttaagggtgtcttatta

SEQ ID NO: 67289 - DNA, 21 bp, Homo sapiens
tgactgaggcttcttcacaca

SEQ ID NO: 67290 - DNA, 22 bp, Homo sapiens
ctaggctggagtgcagtggcac

SEQ ID NO: 67291 - DNA, 22 bp, Homo sapiens
ttccagctaactcacatccctt

SEQ ID NO: 67292 - DNA, 22 bp, Homo sapiens
gtgagccgagtatagttcatag

SEQ ID NO: 67293 - DNA, 22 bp, Homo sapiens
tctcctggagcccagatgctgg

SEQ ID NO: 67294 - DNA, 19 bp, Homo sapiens
agagtattgaatttgccct

SEQ ID NO: 67295 - DNA, 21 bp, Homo sapiens
gcagcagtgttctagaatact

SEQ ID NO: 67296 - DNA, 22 bp, Homo sapiens
tgttttaagctctagaagggga

SEQ ID NO: 67297 - DNA, 22 bp, Homo sapiens
agggatgtaaattcttcttctt

SEQ ID NO: 67298 - DNA, 23 bp, Homo sapiens
agagcaaggaaatgaggtgtgat

SEQ ID NO: 67299 - DNA, 22 bp, Homo sapiens
acagcagcaatagcagtgacat

SEQ ID NO: 67300 - DNA, 22 bp, Homo sapiens
cacctagggtttcgcctttctt

SEQ ID NO: 67301 - DNA, 22 bp, Homo sapiens
aacactctctgttggtaaggct

SEQ ID NO: 67302 - DNA, 22 bp, Homo sapiens
gattgtggaagtcagtggttct

SEQ ID NO: 67303 - DNA, 22 bp, Homo sapiens
gcggggcccggacccagcctct

SEQ ID NO: 67304 - DNA, 18 bp, Homo sapiens
agaggatgcatctaagag

SEQ ID NO: 67305 - DNA, 22 bp, Homo sapiens
acaaagtgctgacattacaggc

SEQ ID NO: 67306 - DNA, 22 bp, Homo sapiens
ccagagctgcaggtaaaatgct

SEQ ID NO: 67307 - DNA, 22 bp, Homo sapiens
ctctgcctcccaggttcaagcg

SEQ ID NO: 67308 - DNA, 22 bp, Homo sapiens
ccagactcatctgccattgctg

SEQ ID NO: 67309 - DNA, 22 bp, Homo sapiens
aaggtcagagtgagctgtggcc

SEQ ID NO: 67310 - DNA, 22 bp, Homo sapiens
catgtgaattccaaagctaggt

SEQ ID NO: 67311 - DNA, 22 bp, Homo sapiens
tggctacctgatttcttttcag

SEQ ID NO: 67312 - DNA, 23 bp, Homo sapiens
aggtaggttattgctgctacctg

SEQ ID NO: 67313 - DNA, 22 bp, Homo sapiens
ggggccgccagagagagccttg

SEQ ID NO: 67314 - DNA, 22 bp, Homo sapiens
tcaggaggcggaggttgcagtg

SEQ ID NO: 67315 - DNA, 22 bp, Homo sapiens
gctcggtggccagcctgaggcc

SEQ ID NO: 67316 - DNA, 22 bp, Homo sapiens
tcctgggaggcggaggttgcag

SEQ ID NO: 67317 - DNA, 22 bp, Homo sapiens
aaatgtaagtctttgtttctta

SEQ ID NO: 67318 - DNA, 22 bp, Homo sapiens
agtgctatcgagttctaatgct

SEQ ID NO: 67319 - DNA, 22 bp, Homo sapiens
tattgacagtgactattggtag

SEQ ID NO: 67320 - DNA, 22 bp, Homo sapiens
tacgcctgtaatcccagcactt

SEQ ID NO: 67321 - DNA, 22 bp, Homo sapiens
gaggcggaggttgcagtgagct

SEQ ID NO: 67322 - DNA, 22 bp, Homo sapiens
acctggccaatttttgtatttt

SEQ ID NO: 67323 - DNA, 22 bp, Homo sapiens
tttgcattgcattaagtattct

SEQ ID NO: 67324 - DNA, 22 bp, Homo sapiens
ttgagaaccactgagttagata

SEQ ID NO: 67325 - DNA, 22 bp, Homo sapiens
gatctggaatctgaaggctgag

SEQ ID NO: 67326 - DNA, 22 bp, Homo sapiens
tcctttgcttctgtcattctcc

SEQ ID NO: 67327 - DNA, 22 bp, Homo sapiens
ggatgttctggggttctcttgt

SEQ ID NO: 67328 - DNA, 21 bp, Homo sapiens
tgctccaggagggggcagtcc

SEQ ID NO: 67329 - DNA, 22 bp, Homo sapiens
actttaattaatgaactgtggc

SEQ ID NO: 67330 - DNA, 22 bp, Homo sapiens
ctgctgtttctcaaaattaagt

SEQ ID NO: 67331 - DNA, 22 bp, Homo sapiens
actggccagccaacaacaatag

SEQ ID NO: 67332 - DNA, 22 bp, Homo sapiens
acggtgcagcctgtcccttctc

SEQ ID NO: 67333 - DNA, 22 bp, Homo sapiens
agtgcaggccccaggccaggcc

SEQ ID NO: 67334 - DNA, 22 bp, Homo sapiens
ttacactttaaatccagcttgt

SEQ ID NO: 67335 - DNA, 22 bp, Homo sapiens
gcctccggagttgcagtgtctt

SEQ ID NO: 67336 - DNA, 22 bp, Homo sapiens
tgactacaacctccacctcccg

SEQ ID NO: 67337 - DNA, 20 bp, Homo sapiens
agcggctggcggaggacacg

SEQ ID NO: 67338 - DNA, 22 bp, Homo sapiens
gggcagatcacctgaggtcagg

SEQ ID NO: 67339 - DNA, 19 bp, Homo sapiens
gctgaaggaggtgcctgca

SEQ ID NO: 67340 - DNA, 22 bp, Homo sapiens
ttctttcagaacacaagtgatt

SEQ ID NO: 67341 - DNA, 22 bp, Homo sapiens
tgagtcagccttggcagcccct

SEQ ID NO: 67342 - DNA, 19 bp, Homo sapiens
ctgtccttggctgcactgt

SEQ ID NO: 67343 - DNA, 22 bp, Homo sapiens
ctgctgaggtggagattgcagt

SEQ ID NO: 67344 - DNA, 22 bp, Homo sapiens
gactgtggggaagcagatgcca

SEQ ID NO: 67345 - DNA, 22 bp, Homo sapiens
caattgacaatgacagtgtcaa

SEQ ID NO: 67346 - DNA, 22 bp, Homo sapiens
gcgggcgggggttcccaggtct

SEQ ID NO: 67347 - DNA, 22 bp, Homo sapiens
caggctggagtgcagtggtgcc

SEQ ID NO: 67348 - DNA, 22 bp, Homo sapiens
ttcccagtcaaacgaaggactt

SEQ ID NO: 67349 - DNA, 22 bp, Homo sapiens
ggagacagggttgaaccacgca

SEQ ID NO: 67350 - DNA, 22 bp, Homo sapiens
tgtctcttttcaagctaccctt

SEQ ID NO: 67351 - DNA, 22 bp, Homo sapiens
ggcaagagggcagatggagtgc

SEQ ID NO: 67352 - DNA, 22 bp, Homo sapiens
ctaaaatgtttggggcagaacc

SEQ ID NO: 67353 - DNA, 22 bp, Homo sapiens
acagaactgggaaatgcacata

SEQ ID NO: 67354 - DNA, 23 bp, Homo sapiens
gcgtccggcctctctcgctcccg

SEQ ID NO: 67355 - DNA, 22 bp, Homo sapiens
ggtccccgtggaggctggagcg

SEQ ID NO: 67356 - DNA, 22 bp, Homo sapiens
gggcagccccagcgcgttggct

SEQ ID NO: 67357 - DNA, 22 bp, Homo sapiens
tggttgtggtcctccacatcgc

SEQ ID NO: 67358 - DNA, 22 bp, Homo sapiens
aggaattgtgttgtagtggaga

SEQ ID NO: 67359 - DNA, 22 bp, Homo sapiens
ttccctccatttcattttataa

SEQ ID NO: 67360 - DNA, 22 bp, Homo sapiens
atagggctgccatcacagaaga

SEQ ID NO: 67361 - DNA, 22 bp, Homo sapiens
atgcacacgtaccctacaaggc

SEQ ID NO: 67362 - DNA, 22 bp, Homo sapiens
attggccatttgcatgtattat

SEQ ID NO: 67363 - DNA, 22 bp, Homo sapiens
aaattgtaatgacttcacttga

SEQ ID NO: 67364 - DNA, 22 bp, Homo sapiens
gctaagggataggctgcctcct

SEQ ID NO: 67365 - DNA, 22 bp, Homo sapiens
gagctactgaaatattgatttt

SEQ ID NO: 67366 - DNA, 22 bp, Homo sapiens
ctccaggccatggctgcggagg

SEQ ID NO: 67367 - DNA, 22 bp, Homo sapiens
ttgcacatctaataatgctaga

SEQ ID NO: 67368 - DNA, 22 bp, Homo sapiens
ctcctccacccgctggggccca

SEQ ID NO: 67369 - DNA, 22 bp, Homo sapiens
gggctgtgaggtgagaacttac

SEQ ID NO: 67370 - DNA, 19 bp, Homo sapiens
taggaccctggtggccccc

SEQ ID NO: 67371 - DNA, 22 bp, Homo sapiens
ctacaaaagtaattgtggtttt

SEQ ID NO: 67372 - DNA, 22 bp, Homo sapiens
ttgtgagtagtgccgcaataaa

SEQ ID NO: 67373 - DNA, 22 bp, Homo sapiens
aggtggaagatgaacccaaatt

SEQ ID NO: 67374 - DNA, 22 bp, Homo sapiens
gtttctctgtctgttacattgg

SEQ ID NO: 67375 - DNA, 20 bp, Homo sapiens
ttgagcagcagtgctgtgtc

SEQ ID NO: 67376 - DNA, 22 bp, Homo sapiens
ctcctgcttcacgggcaccgcc

SEQ ID NO: 67377 - DNA, 22 bp, Homo sapiens
ctagggtcaggggcctgcgtcg

SEQ ID NO: 67378 - DNA, 22 bp, Homo sapiens
gggcaggggtcagtggccccaa

SEQ ID NO: 67379 - DNA, 22 bp, Homo sapiens
tccacaaggcagctcctccagg

SEQ ID NO: 67380 - DNA, 22 bp, Homo sapiens
gcctggccaacgtggtgaaacc

SEQ ID NO: 67381 - DNA, 22 bp, Homo sapiens
tttatagcagcatgatttataa

SEQ ID NO: 67382 - DNA, 22 bp, Homo sapiens
gtgtgacctcatcttaactgga

SEQ ID NO: 67383 - DNA, 22 bp, Homo sapiens
taatggattaacgtccctgtcg

SEQ ID NO: 67384 - DNA, 22 bp, Homo sapiens
tcagggctgcagaagaggcagg

SEQ ID NO: 67385 - DNA, 22 bp, Homo sapiens
tttgaaatgtatcagtataggt

SEQ ID NO: 67386 - DNA, 22 bp, Homo sapiens
ctgaagcagggagtgatgaagt

SEQ ID NO: 67387 - DNA, 22 bp, Homo sapiens
gagacacaggcacagaagaggc

SEQ ID NO: 67388 - DNA, 22 bp, Homo sapiens
tgctcttcacagtttcagcatc

SEQ ID NO: 67389 - DNA, 22 bp, Homo sapiens
tttccctttagcctgagaatcc

SEQ ID NO: 67390 - DNA, 22 bp, Homo sapiens
tggctcctcacgtcctcagagc

SEQ ID NO: 67391 - DNA, 22 bp, Homo sapiens
gaaaattattgaaaatggctct

SEQ ID NO: 67392 - DNA, 22 bp, Homo sapiens
aggcttttctccagaatgtact

SEQ ID NO: 67393 - DNA, 22 bp, Homo sapiens
cagcagcagtgttctagaatct

SEQ ID NO: 67394 - DNA, 22 bp, Homo sapiens
ggctgcaggttggttggcagct

SEQ ID NO: 67395 - DNA, 22 bp, Homo sapiens
agctctgaaagttatgtcgccg

SEQ ID NO: 67396 - DNA, 22 bp, Homo sapiens
ctgccctggggggcctccttgc

SEQ ID NO: 67397 - DNA, 19 bp, Homo sapiens
gagtattttccaacttggt

SEQ ID NO: 67398 - DNA, 22 bp, Homo sapiens
tggtatgaccgtggtgcaagca

SEQ ID NO: 67399 - DNA, 22 bp, Homo sapiens
ctggtaggggtgactgttatcg

SEQ ID NO: 67400 - DNA, 22 bp, Homo sapiens
atttcctgcaaggagtgggttt

SEQ ID NO: 67401 - DNA, 22 bp, Homo sapiens
gaggcccggcgcaggcggactt

SEQ ID NO: 67402 - DNA, 22 bp, Homo sapiens
atggcaccttccccagagctca

SEQ ID NO: 67403 - DNA, 22 bp, Homo sapiens
ataaaatttgctactgttaaat

SEQ ID NO: 67404 - DNA, 22 bp, Homo sapiens
gctgggacaacaggtgagcacc

SEQ ID NO: 67405 - DNA, 19 bp, Homo sapiens
gggtcccaaaagatgtgct

SEQ ID NO: 67406 - DNA, 22 bp, Homo sapiens
tgtagatatagaaaaagactga

SEQ ID NO: 67407 - DNA, 20 bp, Homo sapiens
agagatggggtatcaccgta

SEQ ID NO: 67408 - DNA, 22 bp, Homo sapiens
aggtaggcctgacgctggggtg

SEQ ID NO: 67409 - DNA, 22 bp, Homo sapiens
tagaaaagccccagctggaggg

SEQ ID NO: 67410 - DNA, 22 bp, Homo sapiens
tgattcatcagaataggagttt

SEQ ID NO: 67411 - DNA, 19 bp, Homo sapiens
actgtagcactgcagtata

SEQ ID NO: 67412 - DNA, 22 bp, Homo sapiens
cagggggctcaaaggagagtgc

SEQ ID NO: 67413 - DNA, 22 bp, Homo sapiens
tgaaatgttaaacaagtggctc

SEQ ID NO: 67414 - DNA, 22 bp, Homo sapiens
tgtctggtgggttgacaggcag

SEQ ID NO: 67415 - DNA, 22 bp, Homo sapiens
atgaattgtccgatgttgtgca

SEQ ID NO: 67416 - DNA, 22 bp, Homo sapiens
gggttcttatagtatcagagct

SEQ ID NO: 67417 - DNA, 22 bp, Homo sapiens
gcccagcacctctctcagggtt

SEQ ID NO: 67418 - DNA, 22 bp, Homo sapiens
gaggactgaaacttacaggaaa

SEQ ID NO: 67419 - DNA, 22 bp, Homo sapiens
tttgcatattaatatctgcgct

SEQ ID NO: 67420 - DNA, 23 bp, Homo sapiens
tcctcgcaggagggagatgatgc

SEQ ID NO: 67421 - DNA, 22 bp, Homo sapiens
tctgagaaatttctttgtgatg

SEQ ID NO: 67422 - DNA, 22 bp, Homo sapiens
gccctcctggcaggcagtgatg

SEQ ID NO: 67423 - DNA, 18 bp, Homo sapiens
gatatggaaggccatgcc

SEQ ID NO: 67424 - DNA, 22 bp, Homo sapiens
ttctaattaaatctacgctagg

SEQ ID NO: 67425 - DNA, 22 bp, Homo sapiens
acttattagacatcttcattgt

SEQ ID NO: 67426 - DNA, 22 bp, Homo sapiens
ggtcccaggttgacagggagac

SEQ ID NO: 67427 - DNA, 22 bp, Homo sapiens
ctgaattatttaaggtgaaggg

SEQ ID NO: 67428 - DNA, 22 bp, Homo sapiens
tagatacctgctggacctcatt

SEQ ID NO: 67429 - DNA, 22 bp, Homo sapiens
ggaactcctgctccaagcagct

SEQ ID NO: 67430 - DNA, 22 bp, Homo sapiens
gctcatgactgtaatcccagca

SEQ ID NO: 67431 - DNA, 22 bp, Homo sapiens
ttctacagtgactgcagccata

SEQ ID NO: 67432 - DNA, 22 bp, Homo sapiens
attctcaaaacataacttcact

SEQ ID NO: 67433 - DNA, 22 bp, Homo sapiens
ccaaagaaacccaagctcaggg

SEQ ID NO: 67434 - DNA, 22 bp, Homo sapiens
ctgaagaggctccgcccacaag

SEQ ID NO: 67435 - DNA, 22 bp, Homo sapiens
tacccaaggccctttcaatttc

SEQ ID NO: 67436 - DNA, 22 bp, Homo sapiens
tggtacctgaatgaagggagga

SEQ ID NO: 67437 - DNA, 22 bp, Homo sapiens
ttgtgttggcgaaagcatgtca

SEQ ID NO: 67438 - DNA, 22 bp, Homo sapiens
tccacgtgagcttcgtgtgcag

SEQ ID NO: 67439 - DNA, 22 bp, Homo sapiens
ctctgtggtggagtgggtcacc

SEQ ID NO: 67440 - DNA, 22 bp, Homo sapiens
gcggcctgcgctgctcccgacg

SEQ ID NO: 67441 - DNA, 22 bp, Homo sapiens
agctcctgaaaatccagactgg

SEQ ID NO: 67442 - DNA, 22 bp, Homo sapiens
accactgcactccagtctgggc

SEQ ID NO: 67443 - DNA, 22 bp, Homo sapiens
tttacgaatggggtgacaactt

SEQ ID NO: 67444 - DNA, 22 bp, Homo sapiens
gtgggctgcccttgaggtcagc

SEQ ID NO: 67445 - DNA, 22 bp, Homo sapiens
cctccctgccggctggactagt

SEQ ID NO: 67446 - DNA, 18 bp, Homo sapiens
tggtcactgtggatagtg

SEQ ID NO: 67447 - DNA, 22 bp, Homo sapiens
ttaaacatttatggaggcagca

SEQ ID NO: 67448 - DNA, 22 bp, Homo sapiens
aggtgacaggacaggagctggt

SEQ ID NO: 67449 - DNA, 22 bp, Homo sapiens
agctagtatttcattgaggatt

SEQ ID NO: 67450 - DNA, 22 bp, Homo sapiens
gtagatgagctcacatgacctt

SEQ ID NO: 67451 - DNA, 22 bp, Homo sapiens
tgttcttgagcctttagaccta

SEQ ID NO: 67452 - DNA, 22 bp, Homo sapiens
ttaatgacaggataggctctga

SEQ ID NO: 67453 - DNA, 22 bp, Homo sapiens
ctactggccatctgatctacaa

SEQ ID NO: 67454 - DNA, 22 bp, Homo sapiens
ggccaggcgatgacccctccac

SEQ ID NO: 67455 - DNA, 22 bp, Homo sapiens
atgtcactgttgttattgttat

SEQ ID NO: 67456 - DNA, 23 bp, Homo sapiens
tcggtgggcgtggaggccgaggc

SEQ ID NO: 67457 - DNA, 22 bp, Homo sapiens
ctgtggttggagtgcagtgaga

SEQ ID NO: 67458 - DNA, 22 bp, Homo sapiens
atcctagaatcagcccttgctg

SEQ ID NO: 67459 - DNA, 22 bp, Homo sapiens
tcttgggcagcttgctcgcccc

SEQ ID NO: 67460 - DNA, 22 bp, Homo sapiens
cctgcctactgagttttatatt

SEQ ID NO: 67461 - DNA, 23 bp, Homo sapiens
ggggcctgcaccggtctgcgcgg

SEQ ID NO: 67462 - DNA, 22 bp, Homo sapiens
ttttgacaatgctaatctcaat

SEQ ID NO: 67463 - DNA, 22 bp, Homo sapiens
cactgcacttcagcctgggtga

SEQ ID NO: 67464 - DNA, 22 bp, Homo sapiens
ggagcagggaattacagcgcag

SEQ ID NO: 67465 - DNA, 22 bp, Homo sapiens
gagaggtggaggttgcagtgag

SEQ ID NO: 67466 - DNA, 22 bp, Homo sapiens
ccaagctacttaggagtctgag

SEQ ID NO: 67467 - DNA, 22 bp, Homo sapiens
gatcgggtgggttctgccatca

SEQ ID NO: 67468 - DNA, 22 bp, Homo sapiens
ggtcaggagcccttggccccct

SEQ ID NO: 67469 - DNA, 22 bp, Homo sapiens
gagggagggactagcattctct

SEQ ID NO: 67470 - DNA, 22 bp, Homo sapiens
atcagagtagttgttgcccaga

SEQ ID NO: 67471 - DNA, 22 bp, Homo sapiens
gggcggatcacctgaggtcagg

SEQ ID NO: 67472 - DNA, 22 bp, Homo sapiens
cactgcatggctgtgaggcagc

SEQ ID NO: 67473 - DNA, 22 bp, Homo sapiens
acacagggctgcgcctgacccc

SEQ ID NO: 67474 - DNA, 22 bp, Homo sapiens
gcaggcagatcacctgtcagga

SEQ ID NO: 67475 - DNA, 22 bp, Homo sapiens
gcctggccgggtcttggatttt

SEQ ID NO: 67476 - DNA, 22 bp, Homo sapiens
tccctagtcgcatctgtggaga

SEQ ID NO: 67477 - DNA, 22 bp, Homo sapiens
ctgggggtcttgaaagggagag

SEQ ID NO: 67478 - DNA, 22 bp, Homo sapiens
ttccaaagaagttcacatttac

SEQ ID NO: 67479 - DNA, 22 bp, Homo sapiens
ttccggaaggttctctagaatt

SEQ ID NO: 67480 - DNA, 22 bp, Homo sapiens
tgtggctcaggcggcttctcct

SEQ ID NO: 67481 - DNA, 22 bp, Homo sapiens
tgcagtggcgccatctcagctc

SEQ ID NO: 67482 - DNA, 22 bp, Homo sapiens
gtcccctgtccagggccagcca

SEQ ID NO: 67483 - DNA, 19 bp, Homo sapiens
ccttgtctggtgaaggact

SEQ ID NO: 67484 - DNA, 22 bp, Homo sapiens
accactgcccatggtgaaaact

SEQ ID NO: 67485 - DNA, 22 bp, Homo sapiens
tggttaagtccagaaaggaagc

SEQ ID NO: 67486 - DNA, 22 bp, Homo sapiens
ggcccaggctggagtgcagtgg

SEQ ID NO: 67487 - DNA, 22 bp, Homo sapiens
ccactgtgcccagcctcatggg

SEQ ID NO: 67488 - DNA, 22 bp, Homo sapiens
cagtcactggaatagctgagga

SEQ ID NO: 67489 - DNA, 22 bp, Homo sapiens
aggagaagccaagttgtgagca

SEQ ID NO: 67490 - DNA, 22 bp, Homo sapiens
ttagcttttgagaatgatttct

SEQ ID NO: 67491 - DNA, 20 bp, Homo sapiens
ggcagagggcctgggagaag

SEQ ID NO: 67492 - DNA, 21 bp, Homo sapiens
cttccccaggctggtctgtat

SEQ ID NO: 67493 - DNA, 22 bp, Homo sapiens
aacgcccagccttgatcaaatg

SEQ ID NO: 67494 - DNA, 19 bp, Homo sapiens
gcagacaggtccagagagg

SEQ ID NO: 67495 - DNA, 22 bp, Homo sapiens
ttttaatactgctattgtagga

SEQ ID NO: 67496 - DNA, 22 bp, Homo sapiens
gaggcagaggttgttgcagtga

SEQ ID NO: 67497 - DNA, 22 bp, Homo sapiens
tccattatacttctgattcaaa

SEQ ID NO: 67498 - DNA, 22 bp, Homo sapiens
ctgctcctgtccagcagggcca

SEQ ID NO: 67499 - DNA, 21 bp, Homo sapiens
gcaattcgctatgatggtggc

SEQ ID NO: 67500 - DNA, 23 bp, Homo sapiens
tcaaatcccagctctaccacttc

SEQ ID NO: 67501 - DNA, 22 bp, Homo sapiens
cccagcagtagagctcatatgg

SEQ ID NO: 67502 - DNA, 22 bp, Homo sapiens
tgctgctgaggctaaagtatag

SEQ ID NO: 67503 - DNA, 22 bp, Homo sapiens
tctttgttattgtgaatagggt

SEQ ID NO: 67504 - DNA, 22 bp, Homo sapiens
tgtgggtttgtagttaagttct

SEQ ID NO: 67505 - DNA, 22 bp, Homo sapiens
ctccatgtctgtaacacatgac

SEQ ID NO: 67506 - DNA, 22 bp, Homo sapiens
attcgcgggcctggagggtggg

SEQ ID NO: 67507 - DNA, 22 bp, Homo sapiens
accttgatggggctgttggagt

SEQ ID NO: 67508 - DNA, 22 bp, Homo sapiens
ggaagaaaggtggacaacaggt

SEQ ID NO: 67509 - DNA, 22 bp, Homo sapiens
ggagagggtaggggtcctgccc

SEQ ID NO: 67510 - DNA, 22 bp, Homo sapiens
gaagaaagatcaaatagtttcc

SEQ ID NO: 67511 - DNA, 22 bp, Homo sapiens
tacaggcatgtagcatggtgat

SEQ ID NO: 67512 - DNA, 22 bp, Homo sapiens
ctcagctgcagcctggctggca

SEQ ID NO: 67513 - DNA, 22 bp, Homo sapiens
agacaaagaaaccgtagaagca

SEQ ID NO: 67514 - DNA, 23 bp, Homo sapiens
tctacaaagctgtgtcaggaccc

SEQ ID NO: 67515 - DNA, 22 bp, Homo sapiens
ttgggctcaggagtttgagacc

SEQ ID NO: 67516 - DNA, 23 bp, Homo sapiens
aaaacagcttcctccagtggctc

SEQ ID NO: 67517 - DNA, 22 bp, Homo sapiens
cagggatggcgctggctgcccg

SEQ ID NO: 67518 - DNA, 22 bp, Homo sapiens
ccagcctggttcagaattggct

SEQ ID NO: 67519 - DNA, 22 bp, Homo sapiens
gttttgaatactactagaactt

SEQ ID NO: 67520 - DNA, 22 bp, Homo sapiens
ttatagcagcatgatttatagt

SEQ ID NO: 67521 - DNA, 22 bp, Homo sapiens
gggagctggagctggaagactc

SEQ ID NO: 67522 - DNA, 22 bp, Homo sapiens
atggcagaatatctgcatcgca

SEQ ID NO: 67523 - DNA, 22 bp, Homo sapiens
ggcagggcaggaaagtcaggaa

SEQ ID NO: 67524 - DNA, 22 bp, Homo sapiens
cgtcccgggttcacgccattct

SEQ ID NO: 67525 - DNA, 22 bp, Homo sapiens
gtcagaggggcagctgccaggc

SEQ ID NO: 67526 - DNA, 22 bp, Homo sapiens
cactgcactccagcctgggaga

SEQ ID NO: 67527 - DNA, 22 bp, Homo sapiens
ttgtatagcccagagagtgaga

SEQ ID NO: 67528 - DNA, 22 bp, Homo sapiens
gaagccttgaactgcaaacccc

SEQ ID NO: 67529 - DNA, 22 bp, Homo sapiens
tcggagcgtcactggctggagg

SEQ ID NO: 67530 - DNA, 22 bp, Homo sapiens
atacagggacatccagtttttc

SEQ ID NO: 67531 - DNA, 22 bp, Homo sapiens
ggcatagcggctcagcgtccag

SEQ ID NO: 67532 - DNA, 22 bp, Homo sapiens
cagctgttcattgttgccaccc

SEQ ID NO: 67533 - DNA, 22 bp, Homo sapiens
ctctgcctgtctcatcctgcaa

SEQ ID NO: 67534 - DNA, 21 bp, Homo sapiens
aggattccagcacactgcttc

SEQ ID NO: 67535 - DNA, 22 bp, Homo sapiens
gttgaggtgatgccagccctgc

SEQ ID NO: 67536 - DNA, 22 bp, Homo sapiens
tcgcagaccgcggtgcacgtgg

SEQ ID NO: 67537 - DNA, 22 bp, Homo sapiens
aggctgagataggtggatcatt

SEQ ID NO: 67538 - DNA, 22 bp, Homo sapiens
gaccttgtgatccacctgcctt

SEQ ID NO: 67539 - DNA, 22 bp, Homo sapiens
gcttaattctggctcagtttcc

SEQ ID NO: 67540 - DNA, 22 bp, Homo sapiens
tgggcaaggctggagcctgcag

SEQ ID NO: 67541 - DNA, 22 bp, Homo sapiens
ggagggcagagtcccctgctga

SEQ ID NO: 67542 - DNA, 22 bp, Homo sapiens
tacaacaatttccacattagaa

SEQ ID NO: 67543 - DNA, 22 bp, Homo sapiens
cgtcttggagatattctgggct

SEQ ID NO: 67544 - DNA, 22 bp, Homo sapiens
tcttgcacttcatgaatatgtt

SEQ ID NO: 67545 - DNA, 22 bp, Homo sapiens
ggctgtggcagctggaagtggt

SEQ ID NO: 67546 - DNA, 22 bp, Homo sapiens
aagccctggcgggtggagggcc

SEQ ID NO: 67547 - DNA, 22 bp, Homo sapiens
attttttgttaactcaggatag

SEQ ID NO: 67548 - DNA, 22 bp, Homo sapiens
ataataacaatgccagatgcct

SEQ ID NO: 67549 - DNA, 22 bp, Homo sapiens
ggaggactcaggtctggccatg

SEQ ID NO: 67550 - DNA, 22 bp, Homo sapiens
gtgggggctggaaatcttgcca

SEQ ID NO: 67551 - DNA, 22 bp, Homo sapiens
actgaataaggtgaatgctctg

SEQ ID NO: 67552 - DNA, 22 bp, Homo sapiens
gcagctattgtctcctgggccc

SEQ ID NO: 67553 - DNA, 22 bp, Homo sapiens
gagatgcagaaccctcaggagc

SEQ ID NO: 67554 - DNA, 23 bp, Homo sapiens
gggggccgtcctggggattatag

SEQ ID NO: 67555 - DNA, 22 bp, Homo sapiens
tgcctaggctggagtgtagtgg

SEQ ID NO: 67556 - DNA, 22 bp, Homo sapiens
tcataaattctggtgctgtgag

SEQ ID NO: 67557 - DNA, 23 bp, Homo sapiens
aagttagtttcaataaagcaatt

SEQ ID NO: 67558 - DNA, 19 bp, Homo sapiens
gggaatgatggaagacttc

SEQ ID NO: 67559 - DNA, 22 bp, Homo sapiens
actgtaacctcaaactcctggg

SEQ ID NO: 67560 - DNA, 22 bp, Homo sapiens
gaccttgtgatctgcctgcctt

SEQ ID NO: 67561 - DNA, 22 bp, Homo sapiens
gcctcctggggtgccatcatct

SEQ ID NO: 67562 - DNA, 22 bp, Homo sapiens
gacttctgaattcctatcaggt

SEQ ID NO: 67563 - DNA, 22 bp, Homo sapiens
tggcaagaactgcaattgcttt

SEQ ID NO: 67564 - DNA, 19 bp, Homo sapiens
catggtgaaaccccgtctc

SEQ ID NO: 67565 - DNA, 22 bp, Homo sapiens
accctggaggtggaggtgcagt

SEQ ID NO: 67566 - DNA, 22 bp, Homo sapiens
tttaatcataagaaggaaaata

SEQ ID NO: 67567 - DNA, 22 bp, Homo sapiens
cacatttttactgccaacttaa

SEQ ID NO: 67568 - DNA, 22 bp, Homo sapiens
ttgatcaaatcagctactgagg

SEQ ID NO: 67569 - DNA, 22 bp, Homo sapiens
cagcccaggactgcaggtgttt

SEQ ID NO: 67570 - DNA, 22 bp, Homo sapiens
tgttcagaacaaaggtaaatga

SEQ ID NO: 67571 - DNA, 22 bp, Homo sapiens
ttattgcttatgattaggtgtt

SEQ ID NO: 67572 - DNA, 22 bp, Homo sapiens
cctagagctctgctttatctaa

SEQ ID NO: 67573 - DNA, 22 bp, Homo sapiens
taacctgttaagggctgaccca

SEQ ID NO: 67574 - DNA, 22 bp, Homo sapiens
ggggaccctcaggactgcgtct

SEQ ID NO: 67575 - DNA, 22 bp, Homo sapiens
ggccgcggattttcccgctggc

SEQ ID NO: 67576 - DNA, 22 bp, Homo sapiens
taactctgaatcctcacagcag

SEQ ID NO: 67577 - DNA, 22 bp, Homo sapiens
tcacagagatgaacttttgata

SEQ ID NO: 67578 - DNA, 22 bp, Homo sapiens
agcgggtctgcaagccttccct

SEQ ID NO: 67579 - DNA, 22 bp, Homo sapiens
tgcactactgtgatacacagcc

SEQ ID NO: 67580 - DNA, 22 bp, Homo sapiens
agatggggtttcatcatgttgg

SEQ ID NO: 67581 - DNA, 22 bp, Homo sapiens
taacaaagtattgtttgtgtat

SEQ ID NO: 67582 - DNA, 22 bp, Homo sapiens
gaggttcattcagctctgtcac

SEQ ID NO: 67583 - DNA, 22 bp, Homo sapiens
aagcagatctgatagggccctg

SEQ ID NO: 67584 - DNA, 22 bp, Homo sapiens
gggcggatcatttgaggtcagg

SEQ ID NO: 67585 - DNA, 22 bp, Homo sapiens
tagtttcatctccaccctgccc

SEQ ID NO: 67586 - DNA, 22 bp, Homo sapiens
gcagggaggtttgctgacctgg

SEQ ID NO: 67587 - DNA, 22 bp, Homo sapiens
caggcagggagctggaaaggat

SEQ ID NO: 67588 - DNA, 22 bp, Homo sapiens
tcgttaccatagccttgtccct

SEQ ID NO: 67589 - DNA, 22 bp, Homo sapiens
tatcacatttggagatttatga

SEQ ID NO: 67590 - DNA, 22 bp, Homo sapiens
aggccgaggcgggcggatcacc

SEQ ID NO: 67591 - DNA, 22 bp, Homo sapiens
gcagagatctgagaaggctgcc

SEQ ID NO: 67592 - DNA, 22 bp, Homo sapiens
tcgcgggttgcacatggccatc

SEQ ID NO: 67593 - DNA, 22 bp, Homo sapiens
actttcttggtcccatgtttga

SEQ ID NO: 67594 - DNA, 17 bp, Homo sapiens
ggctgcagtccaggagg

SEQ ID NO: 67595 - DNA, 22 bp, Homo sapiens
taatgtataacaaatactcatc

SEQ ID NO: 67596 - DNA, 22 bp, Homo sapiens
cattctctctacttgttttcaa

SEQ ID NO: 67597 - DNA, 22 bp, Homo sapiens
atacctgtgtatccacaagcgt

SEQ ID NO: 67598 - DNA, 22 bp, Homo sapiens
cctccccacagcccaggagact

SEQ ID NO: 67599 - DNA, 22 bp, Homo sapiens
gttgcctaggctggtcttgaac

SEQ ID NO: 67600 - DNA, 22 bp, Homo sapiens
tgtcatagtgtggtagcagtgg

SEQ ID NO: 67601 - DNA, 22 bp, Homo sapiens
caattgtcagtgctgtttaaat

SEQ ID NO: 67602 - DNA, 21 bp, Homo sapiens
tgtaagtttcatctgaattgg

SEQ ID NO: 67603 - DNA, 19 bp, Homo sapiens
ccacagcctgctgtcttcc

SEQ ID NO: 67604 - DNA, 22 bp, Homo sapiens
tccctcaatgtgggtcaagacc

SEQ ID NO: 67605 - DNA, 22 bp, Homo sapiens
agaggggcccggttctccgtct

SEQ ID NO: 67606 - DNA, 22 bp, Homo sapiens
aaaagcaattgcagttcttgcc

SEQ ID NO: 67607 - DNA, 22 bp, Homo sapiens
ttaataaagtatgaattggaaa

SEQ ID NO: 67608 - DNA, 23 bp, Homo sapiens
attttttgtctttgtaactagat

SEQ ID NO: 67609 - DNA, 22 bp, Homo sapiens
atggctgcctgggcgctggccg

SEQ ID NO: 67610 - DNA, 22 bp, Homo sapiens
taattataacatgctttctggc

SEQ ID NO: 67611 - DNA, 22 bp, Homo sapiens
atatatttgagaatattcatga

SEQ ID NO: 67612 - DNA, 22 bp, Homo sapiens
ctgctgggatagaagtatctca

SEQ ID NO: 67613 - DNA, 22 bp, Homo sapiens
tgctgggattacagtcatgagc

SEQ ID NO: 67614 - DNA, 22 bp, Homo sapiens
ctgtccgccgacttggccaggc

SEQ ID NO: 67615 - DNA, 22 bp, Homo sapiens
ttctcctacttaaggccttcca

SEQ ID NO: 67616 - DNA, 22 bp, Homo sapiens
aagcccttggcgcacaccgggc

SEQ ID NO: 67617 - DNA, 22 bp, Homo sapiens
ctccagttggccccagttggtt

SEQ ID NO: 67618 - DNA, 22 bp, Homo sapiens
tgacagaggagctggaatgatt

SEQ ID NO: 67619 - DNA, 22 bp, Homo sapiens
tatctgttaaaacaagctttaa

SEQ ID NO: 67620 - DNA, 22 bp, Homo sapiens
acagagcaataacagggagagg

SEQ ID NO: 67621 - DNA, 22 bp, Homo sapiens
gggaggcacgaggcgcgcagtg

SEQ ID NO: 67622 - DNA, 22 bp, Homo sapiens
tttctcatggaacatcgtttag

SEQ ID NO: 67623 - DNA, 22 bp, Homo sapiens
gcccccgtagtagatgaggcgc

SEQ ID NO: 67624 - DNA, 22 bp, Homo sapiens
ttctctgcctcacaggtctaag

SEQ ID NO: 67625 - DNA, 22 bp, Homo sapiens
ggggaaagccagccctgcttcc

SEQ ID NO: 67626 - DNA, 22 bp, Homo sapiens
cctgggacttggtctggggttt

SEQ ID NO: 67627 - DNA, 22 bp, Homo sapiens
aggtttctttatgctgctagaa

SEQ ID NO: 67628 - DNA, 22 bp, Homo sapiens
atctattttaaatggcagtaaa

SEQ ID NO: 67629 - DNA, 22 bp, Homo sapiens
tgcaataactactttaatgttg

SEQ ID NO: 67630 - DNA, 22 bp, Homo sapiens
tgacttcctgcactcaggtgat

SEQ ID NO: 67631 - DNA, 22 bp, Homo sapiens
tgtgtgagtaaggctgagagag

SEQ ID NO: 67632 - DNA, 22 bp, Homo sapiens
tctatgcttgagacagatgggg

SEQ ID NO: 67633 - DNA, 22 bp, Homo sapiens
gagccaggtcgggccgcggcga

SEQ ID NO: 67634 - DNA, 22 bp, Homo sapiens
agggtcctgggtgcagttgctt

SEQ ID NO: 67635 - DNA, 22 bp, Homo sapiens
acagagacacggaagctaaaga

SEQ ID NO: 67636 - DNA, 22 bp, Homo sapiens
atttcatactaaggctcaaaaa

SEQ ID NO: 67637 - DNA, 22 bp, Homo sapiens
ttagatttacaagcactgttta

SEQ ID NO: 67638 - DNA, 22 bp, Homo sapiens
cccaggaggtggaggctgcagt

SEQ ID NO: 67639 - DNA, 22 bp, Homo sapiens
attgtggtgtcagttataggca

SEQ ID NO: 67640 - DNA, 22 bp, Homo sapiens
ccagctttatagcttcaaagga

SEQ ID NO: 67641 - DNA, 22 bp, Homo sapiens
aagtagcagggattacaggtgt

SEQ ID NO: 67642 - DNA, 22 bp, Homo sapiens
tcctgggatcaagtgatcctcc

SEQ ID NO: 67643 - DNA, 22 bp, Homo sapiens
cagagctggtgtgtcctggcat

SEQ ID NO: 67644 - DNA, 22 bp, Homo sapiens
tgcgcctctaatctcgggcgtc

SEQ ID NO: 67645 - DNA, 22 bp, Homo sapiens
aatatttccaaggcctgtcagg

SEQ ID NO: 67646 - DNA, 22 bp, Homo sapiens
ctcccgaggagcctcagcgctc

SEQ ID NO: 67647 - DNA, 18 bp, Homo sapiens
atcccaaaagacaaggaa

SEQ ID NO: 67648 - DNA, 22 bp, Homo sapiens
aacactgctgctgggttctgtg

SEQ ID NO: 67649 - DNA, 17 bp, Homo sapiens
gggcagggactcctggg

SEQ ID NO: 67650 - DNA, 22 bp, Homo sapiens
ccggctactcgggaggctgacg

SEQ ID NO: 67651 - DNA, 22 bp, Homo sapiens
tcactgcaacctccacctcccg

SEQ ID NO: 67652 - DNA, 22 bp, Homo sapiens
tccgggagctgaacgtcttgcg

SEQ ID NO: 67653 - DNA, 22 bp, Homo sapiens
aaagaaatagatggcatttaaa

SEQ ID NO: 67654 - DNA, 22 bp, Homo sapiens
accaggcccgctgctatggtgg

SEQ ID NO: 67655 - DNA, 22 bp, Homo sapiens
tctgtgctaggcagcctggccc

SEQ ID NO: 67656 - DNA, 22 bp, Homo sapiens
gaaactctcgcatcctgggaac

SEQ ID NO: 67657 - DNA, 22 bp, Homo sapiens
gtcctgtgagattcatgctcaa

SEQ ID NO: 67658 - DNA, 22 bp, Homo sapiens
gggaaatctcgtcctctattta

SEQ ID NO: 67659 - DNA, 22 bp, Homo sapiens
ctgtcaggtttcccggctcacg

SEQ ID NO: 67660 - DNA, 22 bp, Homo sapiens
atagttttaaaacctcaggaag

SEQ ID NO: 67661 - DNA, 22 bp, Homo sapiens
aggcgaagggaccagacggtag

SEQ ID NO: 67662 - DNA, 22 bp, Homo sapiens
ggcgggaagttcttgcccactt

SEQ ID NO: 67663 - DNA, 22 bp, Homo sapiens
cacagagctggaaaggctgggc

SEQ ID NO: 67664 - DNA, 22 bp, Homo sapiens
ctcactgcaagctccgcctccc

SEQ ID NO: 67665 - DNA, 22 bp, Homo sapiens
ctctgcaacttctagcagtgtc

SEQ ID NO: 67666 - DNA, 22 bp, Homo sapiens
cactgcactccagcactccagc

SEQ ID NO: 67667 - DNA, 22 bp, Homo sapiens
tctcatctgccatttgcaggag

SEQ ID NO: 67668 - DNA, 22 bp, Homo sapiens
attcacatttagcctctgacat

SEQ ID NO: 67669 - DNA, 22 bp, Homo sapiens
ctagttctagatccctgaggaa

SEQ ID NO: 67670 - DNA, 22 bp, Homo sapiens
aaacatggccattcagactgtg

SEQ ID NO: 67671 - DNA, 22 bp, Homo sapiens
agaaatatgctgattagatgaa

SEQ ID NO: 67672 - DNA, 22 bp, Homo sapiens
gcagctgacatctggctgggcc

SEQ ID NO: 67673 - DNA, 22 bp, Homo sapiens
aggggaatgggtagactgttga

SEQ ID NO: 67674 - DNA, 22 bp, Homo sapiens
ggctgagtctgtgacccatgcg

SEQ ID NO: 67675 - DNA, 22 bp, Homo sapiens
acatttatataactcactagga

SEQ ID NO: 67676 - DNA, 22 bp, Homo sapiens
tctcgatctcctgaccttgtga

SEQ ID NO: 67677 - DNA, 22 bp, Homo sapiens
tttgtgaataggttggcttcca

SEQ ID NO: 67678 - DNA, 22 bp, Homo sapiens
tgagccagaggaggctgtgtgg

SEQ ID NO: 67679 - DNA, 20 bp, Homo sapiens
gtgtgacctcctgtggatgc

SEQ ID NO: 67680 - DNA, 22 bp, Homo sapiens
tcctcattcttggtgcatcaaa

SEQ ID NO: 67681 - DNA, 22 bp, Homo sapiens
acaaggcactttatgaagagga

SEQ ID NO: 67682 - DNA, 22 bp, Homo sapiens
tcttttgtgattctttagttac

SEQ ID NO: 67683 - DNA, 22 bp, Homo sapiens
tgtcttggttcttctgaaacac

SEQ ID NO: 67684 - DNA, 22 bp, Homo sapiens
aagtccaggtcctcattccatc

SEQ ID NO: 67685 - DNA, 22 bp, Homo sapiens
aagcccggttgggaacgtggtg

SEQ ID NO: 67686 - DNA, 22 bp, Homo sapiens
gttactcttccccggggtctgg

SEQ ID NO: 67687 - DNA, 22 bp, Homo sapiens
tacagctgctggtgctccatgc

SEQ ID NO: 67688 - DNA, 22 bp, Homo sapiens
gcaccacatcaatgaggggagc

SEQ ID NO: 67689 - DNA, 22 bp, Homo sapiens
cattaaacaaccttgaatcaat

SEQ ID NO: 67690 - DNA, 22 bp, Homo sapiens
tgcatctgcctggagtagcgcc

SEQ ID NO: 67691 - DNA, 22 bp, Homo sapiens
ctcagggccaaggatgctgttg

SEQ ID NO: 67692 - DNA, 22 bp, Homo sapiens
caccaggctggagtgcagtggc

SEQ ID NO: 67693 - DNA, 22 bp, Homo sapiens
acccggcggagcctgcagtgag

SEQ ID NO: 67694 - DNA, 22 bp, Homo sapiens
aggactcatccctgcttgtcag

SEQ ID NO: 67695 - DNA, 22 bp, Homo sapiens
acgcctctgcagctgccgggcc

SEQ ID NO: 67696 - DNA, 22 bp, Homo sapiens
aatcggttgaacccaggaagtg

SEQ ID NO: 67697 - DNA, 22 bp, Homo sapiens
taggtttaggagtgaaggtgaa

SEQ ID NO: 67698 - DNA, 21 bp, Homo sapiens
gagcgccgctcacctcccctg

SEQ ID NO: 67699 - DNA, 22 bp, Homo sapiens
ctcaggacccggtccaggtggg

SEQ ID NO: 67700 - DNA, 22 bp, Homo sapiens
gtatagaaacccagaaagatag

SEQ ID NO: 67701 - DNA, 22 bp, Homo sapiens
ggccggggcctgctcgcctgtg

SEQ ID NO: 67702 - DNA, 20 bp, Homo sapiens
gtgtggccaggagctgcgct

SEQ ID NO: 67703 - DNA, 21 bp, Homo sapiens
atctcgggcttctcgcccagc

SEQ ID NO: 67704 - DNA, 22 bp, Homo sapiens
ggagagcagggaggctgctctg

SEQ ID NO: 67705 - DNA, 19 bp, Homo sapiens
cgcctggcaggccctgcgc

SEQ ID NO: 67706 - DNA, 22 bp, Homo sapiens
agggaaattaatgtgagcaatg

SEQ ID NO: 67707 - DNA, 22 bp, Homo sapiens
gcccaggagttcaagtctagtg

SEQ ID NO: 67708 - DNA, 22 bp, Homo sapiens
ctccagattccgtttattcagg

SEQ ID NO: 67709 - DNA, 22 bp, Homo sapiens
caggagctcaagaccaccctgg

SEQ ID NO: 67710 - DNA, 22 bp, Homo sapiens
cgcccaggctggagtgcagtga

SEQ ID NO: 67711 - DNA, 22 bp, Homo sapiens
atggggggatgaaggagtccaa

SEQ ID NO: 67712 - DNA, 22 bp, Homo sapiens
ggagtagctgcattccgagcac

SEQ ID NO: 67713 - DNA, 22 bp, Homo sapiens
atggcagcggagctggaaatga

SEQ ID NO: 67714 - DNA, 22 bp, Homo sapiens
tgacccctatatcctgtttctt

SEQ ID NO: 67715 - DNA, 22 bp, Homo sapiens
ggcatcttgttgctcaaatcta

SEQ ID NO: 67716 - DNA, 22 bp, Homo sapiens
tcttcacgccaagtgcccctca

SEQ ID NO: 67717 - DNA, 22 bp, Homo sapiens
ggtgagaaagggattcctgttc

SEQ ID NO: 67718 - DNA, 22 bp, Homo sapiens
tttcacagaggaggaagctgag

SEQ ID NO: 67719 - DNA, 22 bp, Homo sapiens
tcaacagtggcaaagaggcacg

SEQ ID NO: 67720 - DNA, 22 bp, Homo sapiens
cttgaatgtcctgtggcaaagt

SEQ ID NO: 67721 - DNA, 22 bp, Homo sapiens
tccatcaagatgacttttgcta

SEQ ID NO: 67722 - DNA, 22 bp, Homo sapiens
aggaggaagggaagacaagtaa

SEQ ID NO: 67723 - DNA, 22 bp, Homo sapiens
cactgcccaccaagtggctggt

SEQ ID NO: 67724 - DNA, 22 bp, Homo sapiens
agcctattccaggatgagctca

SEQ ID NO: 67725 - DNA, 22 bp, Homo sapiens
ttacttaaacagaaatgcagaa

SEQ ID NO: 67726 - DNA, 22 bp, Homo sapiens
cagtgcttttaaaacaacatca

SEQ ID NO: 67727 - DNA, 19 bp, Homo sapiens
gcctatgtcttcaaatcat

SEQ ID NO: 67728 - DNA, 22 bp, Homo sapiens
tagaacctccacaggacctcca

SEQ ID NO: 67729 - DNA, 22 bp, Homo sapiens
agtccggggtctggacacctgg

SEQ ID NO: 67730 - DNA, 22 bp, Homo sapiens
tgggggagctcagtccagccca

SEQ ID NO: 67731 - DNA, 22 bp, Homo sapiens
aatggcactttataaatgttaa

SEQ ID NO: 67732 - DNA, 22 bp, Homo sapiens
tctttgctattgtgagtagtgc

SEQ ID NO: 67733 - DNA, 16 bp, Homo sapiens
ccacctgcagctctca

SEQ ID NO: 67734 - DNA, 22 bp, Homo sapiens
ccagtggctacaggggggttga

SEQ ID NO: 67735 - DNA, 22 bp, Homo sapiens
attgcacttcagcctgggtgac

SEQ ID NO: 67736 - DNA, 22 bp, Homo sapiens
tatccaattcaccattgatggg

SEQ ID NO: 67737 - DNA, 22 bp, Homo sapiens
agacattttcgttggagaggtt

SEQ ID NO: 67738 - DNA, 20 bp, Homo sapiens
ttgttagaggaatgccatag

SEQ ID NO: 67739 - DNA, 22 bp, Homo sapiens
gacaattagatcattcctttga

SEQ ID NO: 67740 - DNA, 22 bp, Homo sapiens
catggcggtcaggatgtaggtg

SEQ ID NO: 67741 - DNA, 22 bp, Homo sapiens
gagtccaagctagagccactca

SEQ ID NO: 67742 - DNA, 22 bp, Homo sapiens
caaagcccagaggcctcacttt

SEQ ID NO: 67743 - DNA, 22 bp, Homo sapiens
ccacgacgagtcatcagggcga

SEQ ID NO: 67744 - DNA, 22 bp, Homo sapiens
aagtgattgttccgttgagtgt

SEQ ID NO: 67745 - DNA, 22 bp, Homo sapiens
gcagtatctatgtgatgggttg

SEQ ID NO: 67746 - DNA, 22 bp, Homo sapiens
atgcaggcagacactgtgggca

SEQ ID NO: 67747 - DNA, 22 bp, Homo sapiens
accacctcatcaagctggattg

SEQ ID NO: 67748 - DNA, 22 bp, Homo sapiens
ggacctgaacataaaacgaggc

SEQ ID NO: 67749 - DNA, 22 bp, Homo sapiens
gtgcaaacatcatagagtgtac

SEQ ID NO: 67750 - DNA, 22 bp, Homo sapiens
ccctcccagatgggcttgaggt

SEQ ID NO: 67751 - DNA, 21 bp, Homo sapiens
ggccgccgccttgtgctctgc

SEQ ID NO: 67752 - DNA, 22 bp, Homo sapiens
gatggcacacagacatccccgc

SEQ ID NO: 67753 - DNA, 22 bp, Homo sapiens
ccctgttgggaagagagatggc

SEQ ID NO: 67754 - DNA, 22 bp, Homo sapiens
agatgtgtttctagttcctgca

SEQ ID NO: 67755 - DNA, 18 bp, Homo sapiens
tgagaggctattttttgc

SEQ ID NO: 67756 - DNA, 22 bp, Homo sapiens
agatttatgtggtcacactcag

SEQ ID NO: 67757 - DNA, 22 bp, Homo sapiens
tttgctcagtttgataatttga

SEQ ID NO: 67758 - DNA, 22 bp, Homo sapiens
tgtgaatggacaattaaatcta

SEQ ID NO: 67759 - DNA, 22 bp, Homo sapiens
aacccagggtggaggttgcagt

SEQ ID NO: 67760 - DNA, 22 bp, Homo sapiens
tgtatattctgcctaaaagctt

SEQ ID NO: 67761 - DNA, 22 bp, Homo sapiens
cttcctctgtggccagagtgta

SEQ ID NO: 67762 - DNA, 21 bp, Homo sapiens
tcttttctcagctttgtggtt

SEQ ID NO: 67763 - DNA, 22 bp, Homo sapiens
gcagtgccgaaggtagtggttg

SEQ ID NO: 67764 - DNA, 22 bp, Homo sapiens
ttgtctctggaaggaaaaagca

SEQ ID NO: 67765 - DNA, 22 bp, Homo sapiens
ctctggagtgtctggccagggt

SEQ ID NO: 67766 - DNA, 22 bp, Homo sapiens
gttgtgattgtagctaaactag

SEQ ID NO: 67767 - DNA, 22 bp, Homo sapiens
ccacagaattctgtctccagga

SEQ ID NO: 67768 - DNA, 22 bp, Homo sapiens
agagcggggatagttaatattc

SEQ ID NO: 67769 - DNA, 22 bp, Homo sapiens
ggggttaacagtattgctcatg

SEQ ID NO: 67770 - DNA, 22 bp, Homo sapiens
acacagagccaaaccatatcac

SEQ ID NO: 67771 - DNA, 22 bp, Homo sapiens
tccgggaggcagaggttgcagt

SEQ ID NO: 67772 - DNA, 22 bp, Homo sapiens
gtcagatgtttgcgtagggtat

SEQ ID NO: 67773 - DNA, 21 bp, Homo sapiens
gctgctcgagatccagtgctt

SEQ ID NO: 67774 - DNA, 22 bp, Homo sapiens
cggccaggcacagtggcccacg

SEQ ID NO: 67775 - DNA, 22 bp, Homo sapiens
gatcatgcttaaagttggagtc

SEQ ID NO: 67776 - DNA, 22 bp, Homo sapiens
aggccagcagcatgacggcatc

SEQ ID NO: 67777 - DNA, 20 bp, Homo sapiens
ggggcccaagccctcttgcc

SEQ ID NO: 67778 - DNA, 22 bp, Homo sapiens
agaacagaggccttatgtttca

SEQ ID NO: 67779 - DNA, 22 bp, Homo sapiens
ctcagccccagcccagatagca

SEQ ID NO: 67780 - DNA, 22 bp, Homo sapiens
tgccctctttctgtacagctcc

SEQ ID NO: 67781 - DNA, 22 bp, Homo sapiens
aaagcactgcacatatatttgc

SEQ ID NO: 67782 - DNA, 22 bp, Homo sapiens
atccccctgtatctggaagaat

SEQ ID NO: 67783 - DNA, 22 bp, Homo sapiens
gcaaagaatgcagatttgcctc

SEQ ID NO: 67784 - DNA, 22 bp, Homo sapiens
ccgggcgggggctctcgtcacc

SEQ ID NO: 67785 - DNA, 22 bp, Homo sapiens
acccagccatgttcagttctct

SEQ ID NO: 67786 - DNA, 22 bp, Homo sapiens
actgcacttcagcctgggtgac

SEQ ID NO: 67787 - DNA, 22 bp, Homo sapiens
gagtgcagtggcgtgatctctg

SEQ ID NO: 67788 - DNA, 22 bp, Homo sapiens
aggcaggaaaatcgcttgaacc

SEQ ID NO: 67789 - DNA, 22 bp, Homo sapiens
ttttctgtttgcttcaagacat

SEQ ID NO: 67790 - DNA, 22 bp, Homo sapiens
tgcctgatgcaggagtatcaga

SEQ ID NO: 67791 - DNA, 22 bp, Homo sapiens
tgaggaaacttacaaggcagaa

SEQ ID NO: 67792 - DNA, 22 bp, Homo sapiens
gacaggaggcagagctcaggtg

SEQ ID NO: 67793 - DNA, 22 bp, Homo sapiens
tggtgctgccaggctcctgcca

SEQ ID NO: 67794 - DNA, 23 bp, Homo sapiens
tcatcttcctcatttctccaggg

SEQ ID NO: 67795 - DNA, 22 bp, Homo sapiens
aaagtgcttcctttttgagggt

SEQ ID NO: 67796 - DNA, 22 bp, Homo sapiens
ggttccccaggcggcccttgga

SEQ ID NO: 67797 - DNA, 19 bp, Homo sapiens
gcccacggccctgctctgc

SEQ ID NO: 67798 - DNA, 22 bp, Homo sapiens
cctggagagctcgggccaggca

SEQ ID NO: 67799 - DNA, 22 bp, Homo sapiens
gaggggcacagtaaagggtccc

SEQ ID NO: 67800 - DNA, 22 bp, Homo sapiens
tgttctctaagccacccatttt

SEQ ID NO: 67801 - DNA, 22 bp, Homo sapiens
ggcggaggttgcagtaagccga

SEQ ID NO: 67802 - DNA, 22 bp, Homo sapiens
gtggtgtaggtcacagttagga

SEQ ID NO: 67803 - DNA, 22 bp, Homo sapiens
ccctgtgggaactcctgagttg

SEQ ID NO: 67804 - DNA, 22 bp, Homo sapiens
aagcatgaatcgactcggcaac

SEQ ID NO: 67805 - DNA, 22 bp, Homo sapiens
tggcaatgttagcaaagcattt

SEQ ID NO: 67806 - DNA, 22 bp, Homo sapiens
gaagttctttatagcagtgtga

SEQ ID NO: 67807 - DNA, 22 bp, Homo sapiens
tagcacagcttcttgatgtcac

SEQ ID NO: 67808 - DNA, 22 bp, Homo sapiens
actgcactccagcctgggtaac

SEQ ID NO: 67809 - DNA, 22 bp, Homo sapiens
actgcactccaacctgggtgac

SEQ ID NO: 67810 - DNA, 22 bp, Homo sapiens
tgacaatgaggccctccacaaa

SEQ ID NO: 67811 - DNA, 22 bp, Homo sapiens
gtgcaaccatcaccactgactc

SEQ ID NO: 67812 - DNA, 22 bp, Homo sapiens
tgctaataaactccaggctgag

SEQ ID NO: 67813 - DNA, 22 bp, Homo sapiens
ccaatgatggtgcccacgatga

SEQ ID NO: 67814 - DNA, 22 bp, Homo sapiens
gtcctggggattatagagtgtt

SEQ ID NO: 67815 - DNA, 22 bp, Homo sapiens
agaaactctggaagaactttta

SEQ ID NO: 67816 - DNA, 22 bp, Homo sapiens
gaacccaggaggcagaggttgc

SEQ ID NO: 67817 - DNA, 22 bp, Homo sapiens
gataccagacagggagggagaa

SEQ ID NO: 67818 - DNA, 22 bp, Homo sapiens
catgagataatttttctccagt

SEQ ID NO: 67819 - DNA, 22 bp, Homo sapiens
atagaatatgacttttagatcc

SEQ ID NO: 67820 - DNA, 22 bp, Homo sapiens
attcccagatttatattgatag

SEQ ID NO: 67821 - DNA, 22 bp, Homo sapiens
tttccagaaataccatttggtg

SEQ ID NO: 67822 - DNA, 22 bp, Homo sapiens
tgcaaatgtgttttaaaccaaa

SEQ ID NO: 67823 - DNA, 22 bp, Homo sapiens
tgggaagaggggtataaagaag

SEQ ID NO: 67824 - DNA, 22 bp, Homo sapiens
aaagtgcaaggattacaggcat

SEQ ID NO: 67825 - DNA, 22 bp, Homo sapiens
cgaggcggcggaagtgcccgta

SEQ ID NO: 67826 - DNA, 22 bp, Homo sapiens
aaggtccttttgcagtgtgatc

SEQ ID NO: 67827 - DNA, 22 bp, Homo sapiens
caagggaattgtgtgtgagagg

SEQ ID NO: 67828 - DNA, 22 bp, Homo sapiens
ctttttcactgtgtcctcacac

SEQ ID NO: 67829 - DNA, 22 bp, Homo sapiens
ctggcctggcgcagtggctcac

SEQ ID NO: 67830 - DNA, 22 bp, Homo sapiens
aagtggactaatacaaggacta

SEQ ID NO: 67831 - DNA, 22 bp, Homo sapiens
actctttgtctgttgccgctta

SEQ ID NO: 67832 - DNA, 22 bp, Homo sapiens
gggatctgggacaacaggtggt

SEQ ID NO: 67833 - DNA, 22 bp, Homo sapiens
cagctcacccatcacgtctgct

SEQ ID NO: 67834 - DNA, 22 bp, Homo sapiens
tgtttacagctgatcaggcatc

SEQ ID NO: 67835 - DNA, 20 bp, Homo sapiens
tcaggtgacacacgtggcac

SEQ ID NO: 67836 - DNA, 22 bp, Homo sapiens
aagattttcagtgcctaaaaca

SEQ ID NO: 67837 - DNA, 22 bp, Homo sapiens
agcccaggttgaggctgcagtg

SEQ ID NO: 67838 - DNA, 22 bp, Homo sapiens
aaccaggtgactcatggtgagc

SEQ ID NO: 67839 - DNA, 22 bp, Homo sapiens
tcacccttgacttggaaaaacc

SEQ ID NO: 67840 - DNA, 22 bp, Homo sapiens
aattacagtcggagcagcactg

SEQ ID NO: 67841 - DNA, 22 bp, Homo sapiens
cactgcactccatcctgggaaa

SEQ ID NO: 67842 - DNA, 22 bp, Homo sapiens
cactgcacttcagcctgggcga

SEQ ID NO: 67843 - DNA, 22 bp, Homo sapiens
gctggggaggcagcagagaaca

SEQ ID NO: 67844 - DNA, 23 bp, Homo sapiens
aacgacagctacaggcatcccac

SEQ ID NO: 67845 - DNA, 22 bp, Homo sapiens
tagcataacaggtaagagtgag

SEQ ID NO: 67846 - DNA, 22 bp, Homo sapiens
acaattctgatggtttcccagt

SEQ ID NO: 67847 - DNA, 22 bp, Homo sapiens
cagagcttcctgctgggcttct

SEQ ID NO: 67848 - DNA, 22 bp, Homo sapiens
gtaatctcagctacttgggagg

SEQ ID NO: 67849 - DNA, 20 bp, Homo sapiens
atgctttcttgtgtgctgct

SEQ ID NO: 67850 - DNA, 22 bp, Homo sapiens
cagggcgaacttggcggtgggc

SEQ ID NO: 67851 - DNA, 22 bp, Homo sapiens
aggctcgcatgccctgcaccac

SEQ ID NO: 67852 - DNA, 22 bp, Homo sapiens
tttctataaaaagtgctaggat

SEQ ID NO: 67853 - DNA, 22 bp, Homo sapiens
ttgcttgggctggagtgcaatg

SEQ ID NO: 67854 - DNA, 22 bp, Homo sapiens
tctagctctgcttatcatggct

SEQ ID NO: 67855 - DNA, 22 bp, Homo sapiens
ccactgtggaaagcagttcaga

SEQ ID NO: 67856 - DNA, 19 bp, Homo sapiens
tggctctgtcgaaggcaca

SEQ ID NO: 67857 - DNA, 22 bp, Homo sapiens
ctgaggaaggctgggggcatcc

SEQ ID NO: 67858 - DNA, 22 bp, Homo sapiens
agcgtgaattagttggtacaca

SEQ ID NO: 67859 - DNA, 22 bp, Homo sapiens
ctgggcagctgtatcagggagt

SEQ ID NO: 67860 - DNA, 22 bp, Homo sapiens
tgagccatgggactccaaggga

SEQ ID NO: 67861 - DNA, 22 bp, Homo sapiens
tggaacgtcgtaatgttggtta

SEQ ID NO: 67862 - DNA, 22 bp, Homo sapiens
aggacaaaggaccagatctgga

SEQ ID NO: 67863 - DNA, 19 bp, Homo sapiens
ccctcttgcacaaagcaaa

SEQ ID NO: 67864 - DNA, 22 bp, Homo sapiens
tttcttcctgctttgtcccatg

SEQ ID NO: 67865 - DNA, 22 bp, Homo sapiens
atagcaacaccccaattttcta

SEQ ID NO: 67866 - DNA, 22 bp, Homo sapiens
cattccttaacgtggggagtct

SEQ ID NO: 67867 - DNA, 22 bp, Homo sapiens
tttaatgtagcgtgaaatgatt

SEQ ID NO: 67868 - DNA, 22 bp, Homo sapiens
actgcactccagcccgagcaac

SEQ ID NO: 67869 - DNA, 22 bp, Homo sapiens
aagttactggcaagggctgcag

SEQ ID NO: 67870 - DNA, 22 bp, Homo sapiens
gctgcagctgtaggacacaatt

SEQ ID NO: 67871 - DNA, 22 bp, Homo sapiens
ctggctcctgtttaaccagctg

SEQ ID NO: 67872 - DNA, 22 bp, Homo sapiens
ttaaattttagaaacagactct

SEQ ID NO: 67873 - DNA, 22 bp, Homo sapiens
ttcttcatgggttcttttagga

SEQ ID NO: 67874 - DNA, 22 bp, Homo sapiens
ctgaggaggctaatttgaggat

SEQ ID NO: 67875 - DNA, 22 bp, Homo sapiens
agttgggtttgtgtcagttgca

SEQ ID NO: 67876 - DNA, 23 bp, Homo sapiens
gacagagtgagaccttgtcttac

SEQ ID NO: 67877 - DNA, 22 bp, Homo sapiens
agctcaatgcaacctccgcctc

SEQ ID NO: 67878 - DNA, 22 bp, Homo sapiens
cccaggaggcgcaggttgcggt

SEQ ID NO: 67879 - DNA, 22 bp, Homo sapiens
tggtggggccagacttcagctc

SEQ ID NO: 67880 - DNA, 22 bp, Homo sapiens
gcgctctcttctcctggcccgc

SEQ ID NO: 67881 - DNA, 22 bp, Homo sapiens
aagaagagaactggcatcctaa

SEQ ID NO: 67882 - DNA, 22 bp, Homo sapiens
atgagctcatccgagtcacact

SEQ ID NO: 67883 - DNA, 23 bp, Homo sapiens
agagtgcagagatatgcttgtgt

SEQ ID NO: 67884 - DNA, 22 bp, Homo sapiens
attcacagggggagaagggtat

SEQ ID NO: 67885 - DNA, 22 bp, Homo sapiens
ttcccttaaattatggcatcta

SEQ ID NO: 67886 - DNA, 22 bp, Homo sapiens
ctgaggagaggtggcctgtgtt

SEQ ID NO: 67887 - DNA, 22 bp, Homo sapiens
cctggcaggtggcgccctcggc

SEQ ID NO: 67888 - DNA, 22 bp, Homo sapiens
tgcactccaggctgggtgacag

SEQ ID NO: 67889 - DNA, 23 bp, Homo sapiens
ggctgggagctccgggtgcacgt

SEQ ID NO: 67890 - DNA, 18 bp, Homo sapiens
tctggaacaacttcatgt

SEQ ID NO: 67891 - DNA, 22 bp, Homo sapiens
catctgtctgcatgctctgggt

SEQ ID NO: 67892 - DNA, 22 bp, Homo sapiens
gagcacgttgaagcgcactgtc

SEQ ID NO: 67893 - DNA, 22 bp, Homo sapiens
tccttaggcaatttgggagagt

SEQ ID NO: 67894 - DNA, 22 bp, Homo sapiens
tgcaatctcggcactttgggag

SEQ ID NO: 67895 - DNA, 22 bp, Homo sapiens
caggctggagtgcaatgacgcc

SEQ ID NO: 67896 - DNA, 22 bp, Homo sapiens
accatgttggccaagctggtct

SEQ ID NO: 67897 - DNA, 22 bp, Homo sapiens
ccatgaattcactccatgctag

SEQ ID NO: 67898 - DNA, 22 bp, Homo sapiens
tttgcttcacaagtatggttct

SEQ ID NO: 67899 - DNA, 22 bp, Homo sapiens
aaatggaagctatttatgattc

SEQ ID NO: 67900 - DNA, 22 bp, Homo sapiens
tctaccctgcggtcttggggca

SEQ ID NO: 67901 - DNA, 22 bp, Homo sapiens
taaatacttagttttgtgtcta

SEQ ID NO: 67902 - DNA, 22 bp, Homo sapiens
ctcccagccttcgccagtctga

SEQ ID NO: 67903 - DNA, 22 bp, Homo sapiens
tcctcagcttttatttcacttg

SEQ ID NO: 67904 - DNA, 22 bp, Homo sapiens
gcggtatttgtgtgggtgtcga

SEQ ID NO: 67905 - DNA, 21 bp, Homo sapiens
cgcagagcgaacttgcggcgc

SEQ ID NO: 67906 - DNA, 22 bp, Homo sapiens
attttctctttgtatatgctag

SEQ ID NO: 67907 - DNA, 22 bp, Homo sapiens
ttatgggagcaattggggaggt

SEQ ID NO: 67908 - DNA, 22 bp, Homo sapiens
aaaaaattatcatagttcctga

SEQ ID NO: 67909 - DNA, 22 bp, Homo sapiens
caagaatcaacattatttagtg

SEQ ID NO: 67910 - DNA, 22 bp, Homo sapiens
attgtctctgaatttccagctg

SEQ ID NO: 67911 - DNA, 21 bp, Homo sapiens
cagagctgtccaaaccctgac

SEQ ID NO: 67912 - DNA, 22 bp, Homo sapiens
aaagtgcttccttttagaggct

SEQ ID NO: 67913 - DNA, 22 bp, Homo sapiens
atgcacctgaactccatcagct

SEQ ID NO: 67914 - DNA, 22 bp, Homo sapiens
actgcactccagcctcggggtc

SEQ ID NO: 67915 - DNA, 22 bp, Homo sapiens
gatgctgagaggtggagggaac

SEQ ID NO: 67916 - DNA, 22 bp, Homo sapiens
gggtggtggccagcagtgggca

SEQ ID NO: 67917 - DNA, 22 bp, Homo sapiens
ggggtccctgcaccagcatgtc

SEQ ID NO: 67918 - DNA, 22 bp, Homo sapiens
gcaaatgctaaagtgtagagac

SEQ ID NO: 67919 - DNA, 18 bp, Homo sapiens
gaggatggaaggagatgc

SEQ ID NO: 67920 - DNA, 22 bp, Homo sapiens
aggaaaatggaccagagttgtt

SEQ ID NO: 67921 - DNA, 22 bp, Homo sapiens
tccttgactgtgaggaactagc

SEQ ID NO: 67922 - DNA, 22 bp, Homo sapiens
ggcgtggggccttctgcccgct

SEQ ID NO: 67923 - DNA, 22 bp, Homo sapiens
tggacaacatagtgagacctca

SEQ ID NO: 67924 - DNA, 22 bp, Homo sapiens
tcccgcttcttccgaatcgcga

SEQ ID NO: 67925 - DNA, 22 bp, Homo sapiens
actgcactcctgcctgggtaac

SEQ ID NO: 67926 - DNA, 22 bp, Homo sapiens
cggctggtgtcgggcacagcaa

SEQ ID NO: 67927 - DNA, 20 bp, Homo sapiens
agatacagtggtttctttag

SEQ ID NO: 67928 - DNA, 22 bp, Homo sapiens
gtagctctgtttaaagttcttt

SEQ ID NO: 67929 - DNA, 22 bp, Homo sapiens
agctggtgtgccagttccagtt

SEQ ID NO: 67930 - DNA, 22 bp, Homo sapiens
aaagtaattgtggttcttgcca

SEQ ID NO: 67931 - DNA, 22 bp, Homo sapiens
gctgtatgtttatttgggaatt

SEQ ID NO: 67932 - DNA, 22 bp, Homo sapiens
atcaagagcacagtgctggcat

SEQ ID NO: 67933 - DNA, 22 bp, Homo sapiens
atgaaaacggaccagagctatt

SEQ ID NO: 67934 - DNA, 22 bp, Homo sapiens
cccagttgttgccggctctgga

SEQ ID NO: 67935 - DNA, 22 bp, Homo sapiens
cgtgccactgcactccagtctg

SEQ ID NO: 67936 - DNA, 22 bp, Homo sapiens
actaggggctcaggcccaggga

SEQ ID NO: 67937 - DNA, 22 bp, Homo sapiens
cttaatctcacctgcaaagtcc

SEQ ID NO: 67938 - DNA, 22 bp, Homo sapiens
cctgggctctgtcagaattggg

SEQ ID NO: 67939 - DNA, 22 bp, Homo sapiens
ctcctggaggatagtgactggg

SEQ ID NO: 67940 - DNA, 18 bp, Homo sapiens
agagtatacagacaacaa

SEQ ID NO: 67941 - DNA, 22 bp, Homo sapiens
taggtttactgaattagtggaa

SEQ ID NO: 67942 - DNA, 22 bp, Homo sapiens
ttctaggcctggcttgggccca

SEQ ID NO: 67943 - DNA, 22 bp, Homo sapiens
atcccaggcggcacaggttgca

SEQ ID NO: 67944 - DNA, 22 bp, Homo sapiens
aagtgctgagactacaggcatg

SEQ ID NO: 67945 - DNA, 22 bp, Homo sapiens
tagttagagaagccacagtgga

SEQ ID NO: 67946 - DNA, 22 bp, Homo sapiens
ggtaccaccaattcagctgcca

SEQ ID NO: 67947 - DNA, 22 bp, Homo sapiens
ttgcttcattttgggtgtgcag

SEQ ID NO: 67948 - DNA, 22 bp, Homo sapiens
ctcactgcaagctcagcctccc

SEQ ID NO: 67949 - DNA, 22 bp, Homo sapiens
agcagcttgaggctggattcca

SEQ ID NO: 67950 - DNA, 22 bp, Homo sapiens
tccttcactccctctgcatcca

SEQ ID NO: 67951 - DNA, 22 bp, Homo sapiens
ttcccacattctttacattcat

SEQ ID NO: 67952 - DNA, 22 bp, Homo sapiens
aagactgagtggcttaagaaaa

SEQ ID NO: 67953 - DNA, 22 bp, Homo sapiens
ggagtgactctcggggccacta

SEQ ID NO: 67954 - DNA, 22 bp, Homo sapiens
gagatcggtaaagagcatgcac

SEQ ID NO: 67955 - DNA, 22 bp, Homo sapiens
ttccccttgataagcagggttg

SEQ ID NO: 67956 - DNA, 22 bp, Homo sapiens
gaaaaggcctggggcaaagtgt

SEQ ID NO: 67957 - DNA, 22 bp, Homo sapiens
gacaattgcttttgccgaataa

SEQ ID NO: 67958 - DNA, 22 bp, Homo sapiens
ggctttgacatgctgaattaaa

SEQ ID NO: 67959 - DNA, 22 bp, Homo sapiens
ccagcttgaagatgtgctggtt

SEQ ID NO: 67960 - DNA, 22 bp, Homo sapiens
ataaaagatcccttctgagctc

SEQ ID NO: 67961 - DNA, 22 bp, Homo sapiens
tagactagaggatcagcaaggg

SEQ ID NO: 67962 - DNA, 21 bp, Homo sapiens
agcgtcaatatcgtcaacagg

SEQ ID NO: 67963 - DNA, 22 bp, Homo sapiens
ctacaccggagcctggaaggta

SEQ ID NO: 67964 - DNA, 22 bp, Homo sapiens
taaggctatcttttgagtgtgt

SEQ ID NO: 67965 - DNA, 22 bp, Homo sapiens
ttccacggggctccccgctctt

SEQ ID NO: 67966 - DNA, 22 bp, Homo sapiens
tcggtgcgcgaggcgcggtccc

SEQ ID NO: 67967 - DNA, 22 bp, Homo sapiens
ctacattaaattggcttactta

SEQ ID NO: 67968 - DNA, 22 bp, Homo sapiens
aacagtgtttttcttcagcact

SEQ ID NO: 67969 - DNA, 22 bp, Homo sapiens
catgcctgtaatcccagcactt

SEQ ID NO: 67970 - DNA, 22 bp, Homo sapiens
actgggcctacccagattggca

SEQ ID NO: 67971 - DNA, 22 bp, Homo sapiens
tgcgatggcgtagacaaatccc

SEQ ID NO: 67972 - DNA, 21 bp, Homo sapiens
cccgcacagcggtaggccgcc

SEQ ID NO: 67973 - DNA, 22 bp, Homo sapiens
tgggatgctcagggcctggagc

SEQ ID NO: 67974 - DNA, 22 bp, Homo sapiens
atggggagctcaccacctgttt

SEQ ID NO: 67975 - DNA, 22 bp, Homo sapiens
tgggcaggggccctgcttccgt

SEQ ID NO: 67976 - DNA, 22 bp, Homo sapiens
gggctgagacgatggggtcttc

SEQ ID NO: 67977 - DNA, 22 bp, Homo sapiens
tgcctaggctggaatgcagtgg

SEQ ID NO: 67978 - DNA, 22 bp, Homo sapiens
tccgggggtggtagatttcctt

SEQ ID NO: 67979 - DNA, 22 bp, Homo sapiens
gagagtctagtgcacctagttt

SEQ ID NO: 67980 - DNA, 22 bp, Homo sapiens
acacggcactttaggaaggggc

SEQ ID NO: 67981 - DNA, 22 bp, Homo sapiens
acaaacagagttgaaaaatagg

SEQ ID NO: 67982 - DNA, 22 bp, Homo sapiens
gttactcttgagaggctgaggt

SEQ ID NO: 67983 - DNA, 22 bp, Homo sapiens
gccaatgacagtctcagttctg

SEQ ID NO: 67984 - DNA, 22 bp, Homo sapiens
actttaaaactgatcatcagag

SEQ ID NO: 67985 - DNA, 22 bp, Homo sapiens
cgttgtttgagattttcagaat

SEQ ID NO: 67986 - DNA, 22 bp, Homo sapiens
tccagtatcaaagtcctagtcc

SEQ ID NO: 67987 - DNA, 22 bp, Homo sapiens
tgcagcaccgtcccactggcta

SEQ ID NO: 67988 - DNA, 22 bp, Homo sapiens
cctgggcctctcaaagtgctgg

SEQ ID NO: 67989 - DNA, 22 bp, Homo sapiens
gacagctgcatcctcagacaca

SEQ ID NO: 67990 - DNA, 22 bp, Homo sapiens
cgtgagcaaaatggacactccc

SEQ ID NO: 67991 - DNA, 22 bp, Homo sapiens
attaagtgactaaagtaatgct

SEQ ID NO: 67992 - DNA, 22 bp, Homo sapiens
cctgagtagctggaattaaagg

SEQ ID NO: 67993 - DNA, 22 bp, Homo sapiens
gccttgtttcattacacgtggt

SEQ ID NO: 67994 - DNA, 22 bp, Homo sapiens
agtgaagctggagaaaggcagt

SEQ ID NO: 67995 - DNA, 22 bp, Homo sapiens
actgggcagcagctcgagccgc

SEQ ID NO: 67996 - DNA, 22 bp, Homo sapiens
tcttaagcagagaagaagttga

SEQ ID NO: 67997 - DNA, 22 bp, Homo sapiens
agatggagtctcactcttgttg

SEQ ID NO: 67998 - DNA, 19 bp, Homo sapiens
acccagcccaggagtggca

SEQ ID NO: 67999 - DNA, 22 bp, Homo sapiens
cctgctcaacgaatatggcgat

SEQ ID NO: 68000 - DNA, 22 bp, Homo sapiens
ttcaccttgaatatgtcttaaa

SEQ ID NO: 68001 - DNA, 22 bp, Homo sapiens
aaattacagccttgggtagctt

SEQ ID NO: 68002 - DNA, 23 bp, Homo sapiens
ctcaccaagcgccgccgctgtgt

SEQ ID NO: 68003 - DNA, 22 bp, Homo sapiens
atggaaggctttatgactcaaa

SEQ ID NO: 68004 - DNA, 22 bp, Homo sapiens
ccgggagcaggcgccaccgcca

SEQ ID NO: 68005 - DNA, 21 bp, Homo sapiens
ttagaagctaatgcagctggt

SEQ ID NO: 68006 - DNA, 22 bp, Homo sapiens
acgtagattcctccatgcgcag

SEQ ID NO: 68007 - DNA, 17 bp, Homo sapiens
acctattgatctgtcac

SEQ ID NO: 68008 - DNA, 22 bp, Homo sapiens
gcataaactccaaaaggcaggg

SEQ ID NO: 68009 - DNA, 23 bp, Homo sapiens
tgaggcaggcggatcacgaggtc

SEQ ID NO: 68010 - DNA, 22 bp, Homo sapiens
gcagaggacacaggagggcaag

SEQ ID NO: 68011 - DNA, 22 bp, Homo sapiens
tcctggcttgtcacatctacgt

SEQ ID NO: 68012 - DNA, 22 bp, Homo sapiens
ctgagtgaaagaagccagacat

SEQ ID NO: 68013 - DNA, 22 bp, Homo sapiens
ggaggcccagaaggaagcccag

SEQ ID NO: 68014 - DNA, 22 bp, Homo sapiens
caggccagggttgagaagagaa

SEQ ID NO: 68015 - DNA, 22 bp, Homo sapiens
ctctgctgtgccgccagggcct

SEQ ID NO: 68016 - DNA, 22 bp, Homo sapiens
tgtggacgtcattaaagcagtg

SEQ ID NO: 68017 - DNA, 23 bp, Homo sapiens
atgggccaagcaagacccatgac

SEQ ID NO: 68018 - DNA, 22 bp, Homo sapiens
tgagccaagttcacaccattgc

SEQ ID NO: 68019 - DNA, 22 bp, Homo sapiens
ttgttgagatgtgtctctcaat

SEQ ID NO: 68020 - DNA, 22 bp, Homo sapiens
taggcaagtggaccagaggttt

SEQ ID NO: 68021 - DNA, 22 bp, Homo sapiens
tcccagtttttctccactaagg

SEQ ID NO: 68022 - DNA, 22 bp, Homo sapiens
aatgtcaaaggctatacattca

SEQ ID NO: 68023 - DNA, 22 bp, Homo sapiens
ccctaaaagtctcattttccag

SEQ ID NO: 68024 - DNA, 22 bp, Homo sapiens
gtcttagatttcaccgataatg

SEQ ID NO: 68025 - DNA, 22 bp, Homo sapiens
ctgaagagaaagggagctcttc

SEQ ID NO: 68026 - DNA, 22 bp, Homo sapiens
tggctccacaggccagggtgtg

SEQ ID NO: 68027 - DNA, 23 bp, Homo sapiens
ggggtcttggaacaggtggccct

SEQ ID NO: 68028 - DNA, 22 bp, Homo sapiens
ggcatggacgtctctgaggcca

SEQ ID NO: 68029 - DNA, 22 bp, Homo sapiens
ttgaaaagttttgaaacactct

SEQ ID NO: 68030 - DNA, 22 bp, Homo sapiens
ctgtcaggttggtctcagagct

SEQ ID NO: 68031 - DNA, 22 bp, Homo sapiens
gcaggctgtctaaagttagagt

SEQ ID NO: 68032 - DNA, 22 bp, Homo sapiens
gtgctccctccttcctcaagga

SEQ ID NO: 68033 - DNA, 22 bp, Homo sapiens
cccccagctctgctgggtcccg

SEQ ID NO: 68034 - DNA, 22 bp, Homo sapiens
gacctccgtgtacacctcccag

SEQ ID NO: 68035 - DNA, 22 bp, Homo sapiens
aaggagtctgggccattcagag

SEQ ID NO: 68036 - DNA, 22 bp, Homo sapiens
agcccggcttccccggttgcta

SEQ ID NO: 68037 - DNA, 22 bp, Homo sapiens
gagcccaggcagaggttgcagt

SEQ ID NO: 68038 - DNA, 22 bp, Homo sapiens
cttagatgaagtcacagaaccc

SEQ ID NO: 68039 - DNA, 22 bp, Homo sapiens
gcatctaaataaacgtgggagt

SEQ ID NO: 68040 - DNA, 22 bp, Homo sapiens
gagtcacatactatgtaataga

SEQ ID NO: 68041 - DNA, 22 bp, Homo sapiens
ccacccttgggttcggaggccg

SEQ ID NO: 68042 - DNA, 19 bp, Homo sapiens
tttgatagggcataatata

SEQ ID NO: 68043 - DNA, 22 bp, Homo sapiens
ggttcccggatctccgagtccc

SEQ ID NO: 68044 - DNA, 22 bp, Homo sapiens
tccctgatgccttgatccgtgg

SEQ ID NO: 68045 - DNA, 22 bp, Homo sapiens
ggtccccccatggtgagcactg

SEQ ID NO: 68046 - DNA, 22 bp, Homo sapiens
atgccaggaacaaacagtggtg

SEQ ID NO: 68047 - DNA, 22 bp, Homo sapiens
aatggctctgatgttgttgtga

SEQ ID NO: 68048 - DNA, 22 bp, Homo sapiens
gagatgggcgagaaggtggact

SEQ ID NO: 68049 - DNA, 22 bp, Homo sapiens
taacatttaaatttttcacata

SEQ ID NO: 68050 - DNA, 22 bp, Homo sapiens
ccctggaggcggagcttgcagt

SEQ ID NO: 68051 - DNA, 22 bp, Homo sapiens
cggtctcccgtgtgtgtgcgct

SEQ ID NO: 68052 - DNA, 22 bp, Homo sapiens
gaaccacaatgtgaagaaggag

SEQ ID NO: 68053 - DNA, 22 bp, Homo sapiens
tctttggtttctgtctctgtaa

SEQ ID NO: 68054 - DNA, 22 bp, Homo sapiens
taaatcttctacatcatcataa

SEQ ID NO: 68055 - DNA, 22 bp, Homo sapiens
tgtccaggctggagtgcagtgg

SEQ ID NO: 68056 - DNA, 22 bp, Homo sapiens
cagggtgctgcaccatccctca

SEQ ID NO: 68057 - DNA, 22 bp, Homo sapiens
acatctagactcttgccctctt

SEQ ID NO: 68058 - DNA, 22 bp, Homo sapiens
tcagcctccgaaagtgctggga

SEQ ID NO: 68059 - DNA, 21 bp, Homo sapiens
aaactgaccttgcctgagaca

SEQ ID NO: 68060 - DNA, 22 bp, Homo sapiens
ctgtatctgtgttggatgagtt

SEQ ID NO: 68061 - DNA, 22 bp, Homo sapiens
tgctggtaccgcgcctccgcca

SEQ ID NO: 68062 - DNA, 22 bp, Homo sapiens
ctatacagcagcttactagtta

SEQ ID NO: 68063 - DNA, 22 bp, Homo sapiens
caatagtgtctgcttgtttcta

SEQ ID NO: 68064 - DNA, 22 bp, Homo sapiens
gtccccgacgtttggcttgatg

SEQ ID NO: 68065 - DNA, 22 bp, Homo sapiens
taaagattgctcaaaactgtga

SEQ ID NO: 68066 - DNA, 22 bp, Homo sapiens
ttctccgctaagttctctgcag

SEQ ID NO: 68067 - DNA, 22 bp, Homo sapiens
tgtctgggagactgatcacccg

SEQ ID NO: 68068 - DNA, 22 bp, Homo sapiens
tcctgccttgcctgggacatca

SEQ ID NO: 68069 - DNA, 22 bp, Homo sapiens
cgcgctgcagacagcggaggcc

SEQ ID NO: 68070 - DNA, 22 bp, Homo sapiens
gcaggcaggcttccttgaactg

SEQ ID NO: 68071 - DNA, 22 bp, Homo sapiens
cctgaggatgccagcatgggtg

SEQ ID NO: 68072 - DNA, 22 bp, Homo sapiens
ttcctcaggctgctttcacata

SEQ ID NO: 68073 - DNA, 22 bp, Homo sapiens
ctgggggcagcaagaagccatg

SEQ ID NO: 68074 - DNA, 22 bp, Homo sapiens
acgatgatgaaagagaacattc

SEQ ID NO: 68075 - DNA, 22 bp, Homo sapiens
tcttcctggatgggggttgatg

SEQ ID NO: 68076 - DNA, 22 bp, Homo sapiens
tttgtagcagcatgatttataa

SEQ ID NO: 68077 - DNA, 22 bp, Homo sapiens
ttggcttttatgcagcttaggt

SEQ ID NO: 68078 - DNA, 22 bp, Homo sapiens
ctgctcttcacactacacccgt

SEQ ID NO: 68079 - DNA, 22 bp, Homo sapiens
ggccactggccaggatctaaga

SEQ ID NO: 68080 - DNA, 22 bp, Homo sapiens
aatgtgttgaataaattgtgcc

SEQ ID NO: 68081 - DNA, 22 bp, Homo sapiens
tcacaaatgtttgcatgtgtct

SEQ ID NO: 68082 - DNA, 22 bp, Homo sapiens
cagccagtgtgaccgaggagga

SEQ ID NO: 68083 - DNA, 22 bp, Homo sapiens
aggaaggcttctttggtcttct

SEQ ID NO: 68084 - DNA, 23 bp, Homo sapiens
aatgggtgcaactatccatgaca

SEQ ID NO: 68085 - DNA, 22 bp, Homo sapiens
agtactgtcagcagggtgttga

SEQ ID NO: 68086 - DNA, 22 bp, Homo sapiens
ctgccttttaaagccagtgtta

SEQ ID NO: 68087 - DNA, 22 bp, Homo sapiens
tgaggatgtctgtattttgcct

SEQ ID NO: 68088 - DNA, 22 bp, Homo sapiens
agggaagaaaatccatcgctgc

SEQ ID NO: 68089 - DNA, 22 bp, Homo sapiens
ctccccccacagtgttcttgcc

SEQ ID NO: 68090 - DNA, 22 bp, Homo sapiens
cgactgtcatacacaagacatg

SEQ ID NO: 68091 - DNA, 22 bp, Homo sapiens
aggaggcagtctgtcccttagc

SEQ ID NO: 68092 - DNA, 22 bp, Homo sapiens
agccctcgtttctgcatcctgt

SEQ ID NO: 68093 - DNA, 22 bp, Homo sapiens
actgtgtgccaggcgctggtct

SEQ ID NO: 68094 - DNA, 22 bp, Homo sapiens
ggtagtcggccttgccctgggc

SEQ ID NO: 68095 - DNA, 22 bp, Homo sapiens
tgttttaagggtcaactgtcac

SEQ ID NO: 68096 - DNA, 22 bp, Homo sapiens
ttttgcaatgagatgcttgtca

SEQ ID NO: 68097 - DNA, 22 bp, Homo sapiens
agaggcaggaggttgacttgag

SEQ ID NO: 68098 - DNA, 22 bp, Homo sapiens
ccagtgtgcaatctctggctta

SEQ ID NO: 68099 - DNA, 22 bp, Homo sapiens
caaatgaatatttccatgggtt

SEQ ID NO: 68100 - DNA, 22 bp, Homo sapiens
gggaaggaaagttattagcaga

SEQ ID NO: 68101 - DNA, 22 bp, Homo sapiens
tttgcttgattaggatatggaa

SEQ ID NO: 68102 - DNA, 22 bp, Homo sapiens
cttcatagtgagtttaatgatg

SEQ ID NO: 68103 - DNA, 22 bp, Homo sapiens
tgagatgtaaggtatgcttact

SEQ ID NO: 68104 - DNA, 22 bp, Homo sapiens
aggtgggcgctgctcccgctgg

SEQ ID NO: 68105 - DNA, 22 bp, Homo sapiens
gcgagggcacgcggttgaaggc

SEQ ID NO: 68106 - DNA, 22 bp, Homo sapiens
caaccccactacacgttggaga

SEQ ID NO: 68107 - DNA, 17 bp, Homo sapiens
gtaaggcttgcagatgc

SEQ ID NO: 68108 - DNA, 22 bp, Homo sapiens
ctggctggagtgcaggtgagtg

SEQ ID NO: 68109 - DNA, 21 bp, Homo sapiens
cactccacttagaacagggtt

SEQ ID NO: 68110 - DNA, 22 bp, Homo sapiens
agcccaggagtttgaggctgtg

SEQ ID NO: 68111 - DNA, 22 bp, Homo sapiens
catgagatttgggaggggccag

SEQ ID NO: 68112 - DNA, 22 bp, Homo sapiens
atctgagtcaaatatttcattt

SEQ ID NO: 68113 - DNA, 22 bp, Homo sapiens
gaggtgctgctgtacttcttgc

SEQ ID NO: 68114 - DNA, 22 bp, Homo sapiens
accctcaacaaattcactctat

SEQ ID NO: 68115 - DNA, 22 bp, Homo sapiens
tgataggtcctcgggcactgga

SEQ ID NO: 68116 - DNA, 22 bp, Homo sapiens
gactggaaagcctgtcctcaga

SEQ ID NO: 68117 - DNA, 22 bp, Homo sapiens
tgggtactcctattagttcagt

SEQ ID NO: 68118 - DNA, 22 bp, Homo sapiens
ttgttcttgtctttgccttcac

SEQ ID NO: 68119 - DNA, 22 bp, Homo sapiens
atgccactgcacttcagcttgg

SEQ ID NO: 68120 - DNA, 22 bp, Homo sapiens
cgtgtagcatgcgccaccacca

SEQ ID NO: 68121 - DNA, 22 bp, Homo sapiens
gggtacagttcttccagtgtca

SEQ ID NO: 68122 - DNA, 22 bp, Homo sapiens
gtgcccagcagcagcgtccccg

SEQ ID NO: 68123 - DNA, 22 bp, Homo sapiens
cacagacagtgtccctttgttg

SEQ ID NO: 68124 - DNA, 22 bp, Homo sapiens
gccagggttcgaatccgtatgg

SEQ ID NO: 68125 - DNA, 22 bp, Homo sapiens
ttcatagtgtttccttccagtg

SEQ ID NO: 68126 - DNA, 22 bp, Homo sapiens
atgaaatatcttgaagaaattc

SEQ ID NO: 68127 - DNA, 22 bp, Homo sapiens
tccaccatgtaacaagctctgt

SEQ ID NO: 68128 - DNA, 22 bp, Homo sapiens
tgtcatggggttgttttgtaca

SEQ ID NO: 68129 - DNA, 22 bp, Homo sapiens
ggtgaggggctcctctgcccgg

SEQ ID NO: 68130 - DNA, 22 bp, Homo sapiens
ctggggaacgcagcgagcagcg

SEQ ID NO: 68131 - DNA, 22 bp, Homo sapiens
gtggatggagctggaagccatt

SEQ ID NO: 68132 - DNA, 22 bp, Homo sapiens
cgtggcctctatggctcccgcc

SEQ ID NO: 68133 - DNA, 22 bp, Homo sapiens
caattctgaggcctgctttgtt

SEQ ID NO: 68134 - DNA, 22 bp, Homo sapiens
acccaggagacggaggtgcagt

SEQ ID NO: 68135 - DNA, 22 bp, Homo sapiens
ggtgacggggcccaggtttcct

SEQ ID NO: 68136 - DNA, 22 bp, Homo sapiens
gctggctgacagatttggggtg

SEQ ID NO: 68137 - DNA, 22 bp, Homo sapiens
caaatgtataaatgtactttct

SEQ ID NO: 68138 - DNA, 22 bp, Homo sapiens
taaaatttgtccctgagtgttg

SEQ ID NO: 68139 - DNA, 22 bp, Homo sapiens
aagaggtttaactgactcacag

SEQ ID NO: 68140 - DNA, 22 bp, Homo sapiens
ccttttgctctcccatccagaa

SEQ ID NO: 68141 - DNA, 22 bp, Homo sapiens
tgggttcacgccattctcctgc

SEQ ID NO: 68142 - DNA, 22 bp, Homo sapiens
tctcaacagtgcaagctgctcc

SEQ ID NO: 68143 - DNA, 22 bp, Homo sapiens
atgaccagccgagataaacaga

SEQ ID NO: 68144 - DNA, 22 bp, Homo sapiens
cccagggagagcgcggaggcgg

SEQ ID NO: 68145 - DNA, 22 bp, Homo sapiens
aaaggctcagatgaggccctgg

SEQ ID NO: 68146 - DNA, 22 bp, Homo sapiens
cggggccctggggctgaaggtc

SEQ ID NO: 68147 - DNA, 22 bp, Homo sapiens
tcttcattttacaggcagacct

SEQ ID NO: 68148 - DNA, 22 bp, Homo sapiens
cacctgtaatcccagcacttca

SEQ ID NO: 68149 - DNA, 22 bp, Homo sapiens
ccaggttggagttcagtggcgc

SEQ ID NO: 68150 - DNA, 22 bp, Homo sapiens
accagcctggccaacatggtga

SEQ ID NO: 68151 - DNA, 20 bp, Homo sapiens
tttcaccatcttggccaggc

SEQ ID NO: 68152 - DNA, 22 bp, Homo sapiens
ccccacaactcatgttgaaact

SEQ ID NO: 68153 - DNA, 22 bp, Homo sapiens
catctgtaaagtaggaatattg

SEQ ID NO: 68154 - DNA, 22 bp, Homo sapiens
agtccaggcattccagccattc

SEQ ID NO: 68155 - DNA, 22 bp, Homo sapiens
agtcaggggatctagacttgaa

SEQ ID NO: 68156 - DNA, 22 bp, Homo sapiens
aggtgggcggattcatgaggtc

SEQ ID NO: 68157 - DNA, 22 bp, Homo sapiens
ttgcagatatttccgatgctat

SEQ ID NO: 68158 - DNA, 22 bp, Homo sapiens
tcctcggctgggccccaggctt

SEQ ID NO: 68159 - DNA, 23 bp, Homo sapiens
ttctgggctgtggaagcctcggg

SEQ ID NO: 68160 - DNA, 22 bp, Homo sapiens
aacagctttgtatacagtaact

SEQ ID NO: 68161 - DNA, 22 bp, Homo sapiens
gcctgatgagcttccagctgag

SEQ ID NO: 68162 - DNA, 22 bp, Homo sapiens
taggctgggggtaggaattgag

SEQ ID NO: 68163 - DNA, 22 bp, Homo sapiens
gagagtctaggaacctcatata

SEQ ID NO: 68164 - DNA, 22 bp, Homo sapiens
atcacaaaggtctcagagcaca

SEQ ID NO: 68165 - DNA, 22 bp, Homo sapiens
cgtgtggtcccggcaaggcaag

SEQ ID NO: 68166 - DNA, 22 bp, Homo sapiens
ggttgcaaactcctgggatcaa

SEQ ID NO: 68167 - DNA, 22 bp, Homo sapiens
tgctccatgcgctcggccggcg

SEQ ID NO: 68168 - DNA, 22 bp, Homo sapiens
cagctgctgttcagttttgttt

SEQ ID NO: 68169 - DNA, 22 bp, Homo sapiens
tggtaatggttctcttgctata

SEQ ID NO: 68170 - DNA, 22 bp, Homo sapiens
gcaccctgtcaaaatggaccaa

SEQ ID NO: 68171 - DNA, 21 bp, Homo sapiens
ggccagtggaattttatgtca

SEQ ID NO: 68172 - DNA, 22 bp, Homo sapiens
tagatttgtttccttctctcca

SEQ ID NO: 68173 - DNA, 22 bp, Homo sapiens
ctgggtggcagagcctgcagtg

SEQ ID NO: 68174 - DNA, 22 bp, Homo sapiens
cacgaatggaagggtcttggct

SEQ ID NO: 68175 - DNA, 22 bp, Homo sapiens
gagaaagctaaataagttgatt

SEQ ID NO: 68176 - DNA, 22 bp, Homo sapiens
ggcgcacaatgtgcaggtttgt

SEQ ID NO: 68177 - DNA, 22 bp, Homo sapiens
ttttcctttgattcccagatgt

SEQ ID NO: 68178 - DNA, 22 bp, Homo sapiens
gtggcagagccaaggctggagc

SEQ ID NO: 68179 - DNA, 22 bp, Homo sapiens
tgatgggaggtgctgcaggacc

SEQ ID NO: 68180 - DNA, 22 bp, Homo sapiens
gaaatctttgccttagctgtgt

SEQ ID NO: 68181 - DNA, 22 bp, Homo sapiens
aataatctcactttatgtggaa

SEQ ID NO: 68182 - DNA, 22 bp, Homo sapiens
aaagattaaatcaaattggtca

SEQ ID NO: 68183 - DNA, 22 bp, Homo sapiens
atgtaaactactgactacacta

SEQ ID NO: 68184 - DNA, 22 bp, Homo sapiens
cagctacaaatacttttgtatg

SEQ ID NO: 68185 - DNA, 22 bp, Homo sapiens
aaaagttattgatgcaggacaa

SEQ ID NO: 68186 - DNA, 22 bp, Homo sapiens
gtgagtaaaggttcattgaatt

SEQ ID NO: 68187 - DNA, 22 bp, Homo sapiens
cttcatgtcggcggctctcggg

SEQ ID NO: 68188 - DNA, 22 bp, Homo sapiens
gtataggtgagggacttgatca

SEQ ID NO: 68189 - DNA, 22 bp, Homo sapiens
gatgaggcataaacacagtcac

SEQ ID NO: 68190 - DNA, 22 bp, Homo sapiens
gaggttggggctgcagtgagct

SEQ ID NO: 68191 - DNA, 22 bp, Homo sapiens
gctggaggatggactggaagaa

SEQ ID NO: 68192 - DNA, 22 bp, Homo sapiens
gtttacttgtgccttggcttaa

SEQ ID NO: 68193 - DNA, 22 bp, Homo sapiens
tttcaggacacctttaaaaacg

SEQ ID NO: 68194 - DNA, 22 bp, Homo sapiens
aaacttgagccaagggcttggg

SEQ ID NO: 68195 - DNA, 22 bp, Homo sapiens
gcagacgtcaccgagtcgatgg

SEQ ID NO: 68196 - DNA, 22 bp, Homo sapiens
tccgaggccaaagctgtgaata

SEQ ID NO: 68197 - DNA, 22 bp, Homo sapiens
gccagccagaaacgtcacactg

SEQ ID NO: 68198 - DNA, 22 bp, Homo sapiens
ggtatactgcatgacattgggg

SEQ ID NO: 68199 - DNA, 22 bp, Homo sapiens
agcattccacactgaagtctgc

SEQ ID NO: 68200 - DNA, 22 bp, Homo sapiens
gtgcaaaagtaattgtggtttt

SEQ ID NO: 68201 - DNA, 22 bp, Homo sapiens
tcattgccatggcatttgcaga

SEQ ID NO: 68202 - DNA, 22 bp, Homo sapiens
tccctgcaggtgtgcaagctga

SEQ ID NO: 68203 - DNA, 22 bp, Homo sapiens
agtccgcctgctgccgtggcag

SEQ ID NO: 68204 - DNA, 22 bp, Homo sapiens
tctcgctctgtcgcccaggctg

SEQ ID NO: 68205 - DNA, 22 bp, Homo sapiens
gtggctcacgtctgtcatctca

SEQ ID NO: 68206 - DNA, 22 bp, Homo sapiens
gggcggggggagctggaatgaa

SEQ ID NO: 68207 - DNA, 22 bp, Homo sapiens
cgcagacactgagggtccgggg

SEQ ID NO: 68208 - DNA, 22 bp, Homo sapiens
gggacacgggctgagcagagcc

SEQ ID NO: 68209 - DNA, 22 bp, Homo sapiens
cgagcatgatgacggctgtggc

SEQ ID NO: 68210 - DNA, 18 bp, Homo sapiens
gaccccgggatctgtcga

SEQ ID NO: 68211 - DNA, 22 bp, Homo sapiens
aggtggaaatggctttcctagg

SEQ ID NO: 68212 - DNA, 23 bp, Homo sapiens
cagagctggcttcatgggtgtgc

SEQ ID NO: 68213 - DNA, 22 bp, Homo sapiens
agcccaggctggagtgcagtgg

SEQ ID NO: 68214 - DNA, 22 bp, Homo sapiens
ccaggagctggagggtgcagtg

SEQ ID NO: 68215 - DNA, 22 bp, Homo sapiens
aaggtcatggcaaattactttt

SEQ ID NO: 68216 - DNA, 22 bp, Homo sapiens
cccaggaggttgaggctgcagt

SEQ ID NO: 68217 - DNA, 22 bp, Homo sapiens
agcaacacgcagtagtatacga

SEQ ID NO: 68218 - DNA, 22 bp, Homo sapiens
taaggcaggaactggctgtttt

SEQ ID NO: 68219 - DNA, 22 bp, Homo sapiens
agcaagattgaggcttcctcag

SEQ ID NO: 68220 - DNA, 22 bp, Homo sapiens
catagcggtattccacgtggtt

SEQ ID NO: 68221 - DNA, 22 bp, Homo sapiens
tctgcatattgttaatggaatg

SEQ ID NO: 68222 - DNA, 22 bp, Homo sapiens
aaagtgctgggattataggcat

SEQ ID NO: 68223 - DNA, 22 bp, Homo sapiens
gtgcgggcctgggggtttctct

SEQ ID NO: 68224 - DNA, 22 bp, Homo sapiens
tctgtgttgagaaggatcatga

SEQ ID NO: 68225 - DNA, 22 bp, Homo sapiens
cttatttgcccatgtttcttta

SEQ ID NO: 68226 - DNA, 22 bp, Homo sapiens
ttgcttcagagggagacacttt

SEQ ID NO: 68227 - DNA, 22 bp, Homo sapiens
ccgcggggcgtgggctcttacc

SEQ ID NO: 68228 - DNA, 22 bp, Homo sapiens
gagctgggcctgcgagtgctgc

SEQ ID NO: 68229 - DNA, 22 bp, Homo sapiens
tactaggaagcagctgcattgg

SEQ ID NO: 68230 - DNA, 22 bp, Homo sapiens
gcacagccacgtaatgtggtca

SEQ ID NO: 68231 - DNA, 22 bp, Homo sapiens
tgcctactagtactattttgtg

SEQ ID NO: 68232 - DNA, 22 bp, Homo sapiens
ggtgggagagcttgctttgatg

SEQ ID NO: 68233 - DNA, 22 bp, Homo sapiens
agcctgggccctgcctcttctc

SEQ ID NO: 68234 - DNA, 22 bp, Homo sapiens
ggctccaccctgcttccagaag

SEQ ID NO: 68235 - DNA, 22 bp, Homo sapiens
tcctcctgtctaccagttcctg

SEQ ID NO: 68236 - DNA, 18 bp, Homo sapiens
gagtcgtcggagagtctg

SEQ ID NO: 68237 - DNA, 22 bp, Homo sapiens
ttgacacagtcaacttgatttt

SEQ ID NO: 68238 - DNA, 22 bp, Homo sapiens
aaccaccattctctcctcttcc

SEQ ID NO: 68239 - DNA, 22 bp, Homo sapiens
gagaacagaagcattcctaatt

SEQ ID NO: 68240 - DNA, 22 bp, Homo sapiens
ccagtgacttgccaggtggatc

SEQ ID NO: 68241 - DNA, 22 bp, Homo sapiens
cagtgcatgcacacacatggta

SEQ ID NO: 68242 - DNA, 22 bp, Homo sapiens
ccagatgtccctctcaggtttg

SEQ ID NO: 68243 - DNA, 22 bp, Homo sapiens
ctcgggtaccatgctaggcact

SEQ ID NO: 68244 - DNA, 22 bp, Homo sapiens
ctctctgggcccagttggcacc

SEQ ID NO: 68245 - DNA, 22 bp, Homo sapiens
cagtctctaaatcaatctgaat

SEQ ID NO: 68246 - DNA, 22 bp, Homo sapiens
catttacatttaaggttaatat

SEQ ID NO: 68247 - DNA, 21 bp, Homo sapiens
agtagtttagcacagggtttg

SEQ ID NO: 68248 - DNA, 22 bp, Homo sapiens
cgggcagtgtggctccagagtc

SEQ ID NO: 68249 - DNA, 22 bp, Homo sapiens
cactgcactccagcctgggcaa

SEQ ID NO: 68250 - DNA, 22 bp, Homo sapiens
agagctaagaaacagaattgct

SEQ ID NO: 68251 - DNA, 22 bp, Homo sapiens
atgccactgcactccagcctag

SEQ ID NO: 68252 - DNA, 22 bp, Homo sapiens
agggggctccttggtgtgcaga

SEQ ID NO: 68253 - DNA, 22 bp, Homo sapiens
gtatgtgaggttggtttccagg

SEQ ID NO: 68254 - DNA, 22 bp, Homo sapiens
gaggcacagagtaggtgcacac

SEQ ID NO: 68255 - DNA, 22 bp, Homo sapiens
gccaggttgctgacgacgatct

SEQ ID NO: 68256 - DNA, 22 bp, Homo sapiens
tcaatcacgtgttccatgttct

SEQ ID NO: 68257 - DNA, 21 bp, Homo sapiens
ccgccgctgatagctctgggc

SEQ ID NO: 68258 - DNA, 22 bp, Homo sapiens
gcggcggagacagcaggaagcc

SEQ ID NO: 68259 - DNA, 22 bp, Homo sapiens
gaccttcttgctgtgtcctaac

SEQ ID NO: 68260 - DNA, 22 bp, Homo sapiens
gccagatttacagatttgccct

SEQ ID NO: 68261 - DNA, 22 bp, Homo sapiens
cagggtttcaccatgttagcag

SEQ ID NO: 68262 - DNA, 22 bp, Homo sapiens
gagcactgagctggaattggag

SEQ ID NO: 68263 - DNA, 22 bp, Homo sapiens
caggctggagttcagtggtgtg

SEQ ID NO: 68264 - DNA, 22 bp, Homo sapiens
gggctgggattgcttgctgtga

SEQ ID NO: 68265 - DNA, 22 bp, Homo sapiens
atcatgttttaattagcaaact

SEQ ID NO: 68266 - DNA, 22 bp, Homo sapiens
aatgttacgatcaacaacacat

SEQ ID NO: 68267 - DNA, 22 bp, Homo sapiens
ggaattgtctagtactcacggc

SEQ ID NO: 68268 - DNA, 22 bp, Homo sapiens
acatttttcacatttgtagggt

SEQ ID NO: 68269 - DNA, 22 bp, Homo sapiens
tttcaccatcttggccaggctg

SEQ ID NO: 68270 - DNA, 22 bp, Homo sapiens
taccagggaacagggatattaa

SEQ ID NO: 68271 - DNA, 22 bp, Homo sapiens
ccaggaggcggaaggtacagtg

SEQ ID NO: 68272 - DNA, 22 bp, Homo sapiens
aaggagaaatggtagatgtgca

SEQ ID NO: 68273 - DNA, 22 bp, Homo sapiens
ggccctggcagccacgaaagcc

SEQ ID NO: 68274 - DNA, 22 bp, Homo sapiens
gcttggaagtaggattgggaga

SEQ ID NO: 68275 - DNA, 22 bp, Homo sapiens
ttggctgtgcagatcttgccta

SEQ ID NO: 68276 - DNA, 22 bp, Homo sapiens
gttcaagaccagcctggccaac

SEQ ID NO: 68277 - DNA, 22 bp, Homo sapiens
agtgaccgaggcacttggcaac

SEQ ID NO: 68278 - DNA, 22 bp, Homo sapiens
gccagggttcaagctattctcc

SEQ ID NO: 68279 - DNA, 22 bp, Homo sapiens
gcagcagtgctttggaatcctg

SEQ ID NO: 68280 - DNA, 17 bp, Homo sapiens
agtttttggacctgtgt

SEQ ID NO: 68281 - DNA, 22 bp, Homo sapiens
gtggaggagaggcgccttgcgg

SEQ ID NO: 68282 - DNA, 22 bp, Homo sapiens
atgctatgtaactggcagatag

SEQ ID NO: 68283 - DNA, 22 bp, Homo sapiens
cggggaagcggttctggcggta

SEQ ID NO: 68284 - DNA, 22 bp, Homo sapiens
gaccagtcattactcatgccct

SEQ ID NO: 68285 - DNA, 19 bp, Homo sapiens
cggcccctcctctcgcgcc

SEQ ID NO: 68286 - DNA, 22 bp, Homo sapiens
atctggttttggctgtgtccct

SEQ ID NO: 68287 - DNA, 22 bp, Homo sapiens
cccgcagtcggaatttctcagt

SEQ ID NO: 68288 - DNA, 22 bp, Homo sapiens
tgcgcggctcagtcatctccag

SEQ ID NO: 68289 - DNA, 22 bp, Homo sapiens
agacgcggtggtgcatgcctgt

SEQ ID NO: 68290 - DNA, 21 bp, Homo sapiens
ctggaggcaggtggtgccagg

SEQ ID NO: 68291 - DNA, 22 bp, Homo sapiens
gtagaggggtgattctgtgaga

SEQ ID NO: 68292 - DNA, 22 bp, Homo sapiens
ttggccttagcttcttcttaaa

SEQ ID NO: 68293 - DNA, 21 bp, Homo sapiens
atgtagggtttgccttctcta

SEQ ID NO: 68294 - DNA, 22 bp, Homo sapiens
gtgggtggacggtgcttttgtt

SEQ ID NO: 68295 - DNA, 22 bp, Homo sapiens
attctaatggcagagactcctg

SEQ ID NO: 68296 - DNA, 22 bp, Homo sapiens
ttttaagttggattgctaagta

SEQ ID NO: 68297 - DNA, 22 bp, Homo sapiens
agctggaattacaggcacgcac

SEQ ID NO: 68298 - DNA, 22 bp, Homo sapiens
tccaggctttggggcaggagcg

SEQ ID NO: 68299 - DNA, 22 bp, Homo sapiens
atgttatgtctgggaaggggta

SEQ ID NO: 68300 - DNA, 22 bp, Homo sapiens
acccatccagtgtccctgctag

SEQ ID NO: 68301 - DNA, 22 bp, Homo sapiens
cccaggaggtcgaagctgcagt

SEQ ID NO: 68302 - DNA, 22 bp, Homo sapiens
cccagaaggtcgaggctgcagt

SEQ ID NO: 68303 - DNA, 22 bp, Homo sapiens
agctggtgctcggggagctggc

SEQ ID NO: 68304 - DNA, 22 bp, Homo sapiens
accttcaggtgagcacacagat

SEQ ID NO: 68305 - DNA, 22 bp, Homo sapiens
taaatgttgtaagtacatctaa

SEQ ID NO: 68306 - DNA, 22 bp, Homo sapiens
gggggagagacgagcggctctg

SEQ ID NO: 68307 - DNA, 22 bp, Homo sapiens
aagtggcagttcaggaagcaga

SEQ ID NO: 68308 - DNA, 22 bp, Homo sapiens
tagtgccctcccctttgggata

SEQ ID NO: 68309 - DNA, 22 bp, Homo sapiens
caccagagtgggtgagggtgat

SEQ ID NO: 68310 - DNA, 20 bp, Homo sapiens
cgcccagtgcggttctgacc

SEQ ID NO: 68311 - DNA, 22 bp, Homo sapiens
ggcagagcttgcagtgagccga

SEQ ID NO: 68312 - DNA, 22 bp, Homo sapiens
cccagggaggcccaggctctgc

SEQ ID NO: 68313 - DNA, 22 bp, Homo sapiens
ggaggcggaggttgcagtgagc

SEQ ID NO: 68314 - DNA, 22 bp, Homo sapiens
tcagtgatttctggggtgaggg

SEQ ID NO: 68315 - DNA, 22 bp, Homo sapiens
tgaggcaggacttgcataaagt

SEQ ID NO: 68316 - DNA, 22 bp, Homo sapiens
ctgaacttattgagtgcttgct

SEQ ID NO: 68317 - DNA, 22 bp, Homo sapiens
attgagaagaaaatctaatata

SEQ ID NO: 68318 - DNA, 22 bp, Homo sapiens
tgccatctcctggtcaactggt

SEQ ID NO: 68319 - DNA, 22 bp, Homo sapiens
tggacaggcaagcaagacatac

SEQ ID NO: 68320 - DNA, 22 bp, Homo sapiens
acggcttcttgactgtgggttg

SEQ ID NO: 68321 - DNA, 22 bp, Homo sapiens
ccaggctgctgttggtgtccgc

SEQ ID NO: 68322 - DNA, 22 bp, Homo sapiens
atgtgggccgtgcgggtgtcct

SEQ ID NO: 68323 - DNA, 22 bp, Homo sapiens
gcggggggaggaacatcttgca

SEQ ID NO: 68324 - DNA, 22 bp, Homo sapiens
ccaggctggagtgcagtggcac

SEQ ID NO: 68325 - DNA, 22 bp, Homo sapiens
aagtgctgggattacaggcatg

SEQ ID NO: 68326 - DNA, 22 bp, Homo sapiens
ctaaatctcatcatgtacctcc

SEQ ID NO: 68327 - DNA, 22 bp, Homo sapiens
aggggctcctttgtgctgcgtc

SEQ ID NO: 68328 - DNA, 22 bp, Homo sapiens
ttgcaaatcagaagtatagatt

SEQ ID NO: 68329 - DNA, 22 bp, Homo sapiens
gaccctctagatggaagcactg

SEQ ID NO: 68330 - DNA, 22 bp, Homo sapiens
cagaccagaaggaagccgacaa

SEQ ID NO: 68331 - DNA, 22 bp, Homo sapiens
ttgtttccataattaagtgtga

SEQ ID NO: 68332 - DNA, 22 bp, Homo sapiens
gagccaggggtcagctccgagg

SEQ ID NO: 68333 - DNA, 22 bp, Homo sapiens
ggccttggagtcagccttgagc

SEQ ID NO: 68334 - DNA, 20 bp, Homo sapiens
atggatgaccttggccaggg

SEQ ID NO: 68335 - DNA, 22 bp, Homo sapiens
tcacttagatggggatcatcac

SEQ ID NO: 68336 - DNA, 22 bp, Homo sapiens
agcccttggtattttccgatcc

SEQ ID NO: 68337 - DNA, 22 bp, Homo sapiens
agccagggacgctgcaggctac

SEQ ID NO: 68338 - DNA, 22 bp, Homo sapiens
catggcactgagcaggtatgca

SEQ ID NO: 68339 - DNA, 22 bp, Homo sapiens
tctaggcctggcttgggcccag

SEQ ID NO: 68340 - DNA, 22 bp, Homo sapiens
ccggcgggcagcggcagtgagc

SEQ ID NO: 68341 - DNA, 22 bp, Homo sapiens
gctgcagggagctggaaggctc

SEQ ID NO: 68342 - DNA, 22 bp, Homo sapiens
gagatatgttggcagctggtat

SEQ ID NO: 68343 - DNA, 22 bp, Homo sapiens
ccctaagaagcaaagtgatacc

SEQ ID NO: 68344 - DNA, 22 bp, Homo sapiens
ttgctttgcagtgcctatagga

SEQ ID NO: 68345 - DNA, 22 bp, Homo sapiens
atggctagcaccgcgttgctgg

SEQ ID NO: 68346 - DNA, 22 bp, Homo sapiens
taacaatacccattctaattac

SEQ ID NO: 68347 - DNA, 22 bp, Homo sapiens
tggctaacaaggtgaaaccccg

SEQ ID NO: 68348 - DNA, 20 bp, Homo sapiens
tgatatggtttggctgtgtt

SEQ ID NO: 68349 - DNA, 22 bp, Homo sapiens
gattcactcatattttacgttt

SEQ ID NO: 68350 - DNA, 22 bp, Homo sapiens
agggcgctgaaatactaacatg

SEQ ID NO: 68351 - DNA, 22 bp, Homo sapiens
agaaaacataggagacaggaaa

SEQ ID NO: 68352 - DNA, 22 bp, Homo sapiens
ccaggctagagtgcaatggcat

SEQ ID NO: 68353 - DNA, 22 bp, Homo sapiens
ccaggctggagtatagtggcgc

SEQ ID NO: 68354 - DNA, 22 bp, Homo sapiens
actgccaatggtagtttgatgg

SEQ ID NO: 68355 - DNA, 22 bp, Homo sapiens
tcgaaataatttagaatataga

SEQ ID NO: 68356 - DNA, 22 bp, Homo sapiens
caggaagctgtgaaggagacgg

SEQ ID NO: 68357 - DNA, 22 bp, Homo sapiens
tccttagacaaagagtgggctt

SEQ ID NO: 68358 - DNA, 22 bp, Homo sapiens
actgcgtggggagctgtgacta

SEQ ID NO: 68359 - DNA, 22 bp, Homo sapiens
gctgccttgccctcttcccata

SEQ ID NO: 68360 - DNA, 22 bp, Homo sapiens
atacaaagtattaatcctggat

SEQ ID NO: 68361 - DNA, 22 bp, Homo sapiens
tgtctgcctgcgggccggcaca

SEQ ID NO: 68362 - DNA, 22 bp, Homo sapiens
tggggatcataaattgatggag

SEQ ID NO: 68363 - DNA, 22 bp, Homo sapiens
aactaatacattaatacatgtg

SEQ ID NO: 68364 - DNA, 22 bp, Homo sapiens
tgtaccactctactaagggttc

SEQ ID NO: 68365 - DNA, 22 bp, Homo sapiens
tacagctgcaagggtttctggg

SEQ ID NO: 68366 - DNA, 22 bp, Homo sapiens
tggcagttcaggttggactctt

SEQ ID NO: 68367 - DNA, 19 bp, Homo sapiens
ggggcctgtgatggtcaca

SEQ ID NO: 68368 - DNA, 22 bp, Homo sapiens
tgtttcctttctggtgagcata

SEQ ID NO: 68369 - DNA, 22 bp, Homo sapiens
aggaaataagggacaagacaaa

SEQ ID NO: 68370 - DNA, 22 bp, Homo sapiens
gtggagaggaacccagctctgt

SEQ ID NO: 68371 - DNA, 22 bp, Homo sapiens
ccactgcacttcagcctgggtg

SEQ ID NO: 68372 - DNA, 22 bp, Homo sapiens
gaccttgtgatccacccgcctt

SEQ ID NO: 68373 - DNA, 18 bp, Homo sapiens
cagctgccagctcatgga

SEQ ID NO: 68374 - DNA, 22 bp, Homo sapiens
tttgtttgccacacaaaacagt

SEQ ID NO: 68375 - DNA, 19 bp, Homo sapiens
gggcttggggctgaagcct

SEQ ID NO: 68376 - DNA, 22 bp, Homo sapiens
ttgttgtcattgtagaggattt

SEQ ID NO: 68377 - DNA, 22 bp, Homo sapiens
agcccaggtccagttcactgca

SEQ ID NO: 68378 - DNA, 22 bp, Homo sapiens
taggctaggctgaaggttttgg

SEQ ID NO: 68379 - DNA, 22 bp, Homo sapiens
aaacccagggttttgtcttccc

SEQ ID NO: 68380 - DNA, 22 bp, Homo sapiens
agagtggctctgctgggcacag

SEQ ID NO: 68381 - DNA, 22 bp, Homo sapiens
gctcaagccttctgcccacctc

SEQ ID NO: 68382 - DNA, 22 bp, Homo sapiens
tccagatgctgcacattcctga

SEQ ID NO: 68383 - DNA, 22 bp, Homo sapiens
ttgcttcctctagtttcttgaa

SEQ ID NO: 68384 - DNA, 22 bp, Homo sapiens
ctggcaagaaatatatatctta

SEQ ID NO: 68385 - DNA, 22 bp, Homo sapiens
agccaggatggtctcgatcggc

SEQ ID NO: 68386 - DNA, 22 bp, Homo sapiens
tggtacacatgtccaaggtcag

SEQ ID NO: 68387 - DNA, 22 bp, Homo sapiens
aggtggcagatgggggtgctcg

SEQ ID NO: 68388 - DNA, 22 bp, Homo sapiens
aggatttctgtgcctggaaaat

SEQ ID NO: 68389 - DNA, 22 bp, Homo sapiens
gtgctttgttaagtctgaaatt

SEQ ID NO: 68390 - DNA, 22 bp, Homo sapiens
tcttcaggtagtgagtggggtg

SEQ ID NO: 68391 - DNA, 22 bp, Homo sapiens
tactttaatatatgtgaagttc

SEQ ID NO: 68392 - DNA, 22 bp, Homo sapiens
aaggagcacacaatctagaacc

SEQ ID NO: 68393 - DNA, 22 bp, Homo sapiens
tgatatgcatgtaagggagaca

SEQ ID NO: 68394 - DNA, 22 bp, Homo sapiens
aaagcctcccaggttatgagta

SEQ ID NO: 68395 - DNA, 20 bp, Homo sapiens
tcacatcctctcccaacatg

SEQ ID NO: 68396 - DNA, 22 bp, Homo sapiens
tgagatgtcatagttcagttca

SEQ ID NO: 68397 - DNA, 22 bp, Homo sapiens
gggcaaaacctgggcatcatga

SEQ ID NO: 68398 - DNA, 22 bp, Homo sapiens
agggaattcactggaacgccct

SEQ ID NO: 68399 - DNA, 22 bp, Homo sapiens
actacagtgtgataagaggggc

SEQ ID NO: 68400 - DNA, 22 bp, Homo sapiens
tgcgttgcgctcctgcagcagg

SEQ ID NO: 68401 - DNA, 22 bp, Homo sapiens
ctaggaccactgtaacaaagta

SEQ ID NO: 68402 - DNA, 20 bp, Homo sapiens
ctgggtggcaagcaaggggg

SEQ ID NO: 68403 - DNA, 22 bp, Homo sapiens
gctgtgtccaggtgggggtgac

SEQ ID NO: 68404 - DNA, 22 bp, Homo sapiens
gaggcaggaggattgcttgagc

SEQ ID NO: 68405 - DNA, 22 bp, Homo sapiens
tattattgacatttacttggtg

SEQ ID NO: 68406 - DNA, 22 bp, Homo sapiens
tggttgcctctcagagattccg

SEQ ID NO: 68407 - DNA, 22 bp, Homo sapiens
cagcagcccacgcgtgctgtcc

SEQ ID NO: 68408 - DNA, 22 bp, Homo sapiens
tggcacgacaattggcaccaat

SEQ ID NO: 68409 - DNA, 22 bp, Homo sapiens
ttgaggcaggtccgggtccttc

SEQ ID NO: 68410 - DNA, 22 bp, Homo sapiens
tagatgaccttgtgttaggcaa

SEQ ID NO: 68411 - DNA, 17 bp, Homo sapiens
tggctctgtcctcagct

SEQ ID NO: 68412 - DNA, 18 bp, Homo sapiens
ccatcaccctaactagtg

SEQ ID NO: 68413 - DNA, 22 bp, Homo sapiens
cttgacactgtcactcaggcca

SEQ ID NO: 68414 - DNA, 22 bp, Homo sapiens
gtgagaaatgacaaatgtgtcg

SEQ ID NO: 68415 - DNA, 22 bp, Homo sapiens
agccagatgaagaggtccttaa

SEQ ID NO: 68416 - DNA, 22 bp, Homo sapiens
cccaggagttagaggttgtggt

SEQ ID NO: 68417 - DNA, 20 bp, Homo sapiens
tttgagaccagtctgcccaa

SEQ ID NO: 68418 - DNA, 22 bp, Homo sapiens
cctcgcggcactcgggccggat

SEQ ID NO: 68419 - DNA, 22 bp, Homo sapiens
atgaggcaggtggaggctgcca

SEQ ID NO: 68420 - DNA, 22 bp, Homo sapiens
aggacttccatggatggattgg

SEQ ID NO: 68421 - DNA, 22 bp, Homo sapiens
aggctcccaagcactgacccca

SEQ ID NO: 68422 - DNA, 22 bp, Homo sapiens
cgaggcctcctcgccgccaccg

SEQ ID NO: 68423 - DNA, 22 bp, Homo sapiens
cagaggaacgtttggattgatt

SEQ ID NO: 68424 - DNA, 22 bp, Homo sapiens
gagcaacacgcagtagtatacg

SEQ ID NO: 68425 - DNA, 22 bp, Homo sapiens
tgggcgacagagcaagactccg

SEQ ID NO: 68426 - DNA, 22 bp, Homo sapiens
tgggtgacagagcaagactctg

SEQ ID NO: 68427 - DNA, 22 bp, Homo sapiens
aggaaataggaccagacaaagc

SEQ ID NO: 68428 - DNA, 22 bp, Homo sapiens
attgtggactgatcagggctag

SEQ ID NO: 68429 - DNA, 22 bp, Homo sapiens
gagtgtgtcggtcagcgtggcg

SEQ ID NO: 68430 - DNA, 22 bp, Homo sapiens
ttccaatagtgtgaccttatag

SEQ ID NO: 68431 - DNA, 22 bp, Homo sapiens
ctgggaggtggaggttgcattg

SEQ ID NO: 68432 - DNA, 22 bp, Homo sapiens
aattttctggtgtgtaatgaag

SEQ ID NO: 68433 - DNA, 19 bp, Homo sapiens
aatgctgcttctttttgca

SEQ ID NO: 68434 - DNA, 22 bp, Homo sapiens
agagggtgggcacgtgatggat

SEQ ID NO: 68435 - DNA, 22 bp, Homo sapiens
atgatgaagcatggttacactg

SEQ ID NO: 68436 - DNA, 22 bp, Homo sapiens
gcccttacagggtggtcagcca

SEQ ID NO: 68437 - DNA, 22 bp, Homo sapiens
gaggaggcagcctatcccttag

SEQ ID NO: 68438 - DNA, 22 bp, Homo sapiens
agtgggccggacagcccaggcc

SEQ ID NO: 68439 - DNA, 22 bp, Homo sapiens
tcaagcggactgagatactctg

SEQ ID NO: 68440 - DNA, 22 bp, Homo sapiens
tagggtagtaccatgctgccag

SEQ ID NO: 68441 - DNA, 22 bp, Homo sapiens
tatggctaattctttactgacc

SEQ ID NO: 68442 - DNA, 22 bp, Homo sapiens
tcaccgccttgcccggccgggc

SEQ ID NO: 68443 - DNA, 22 bp, Homo sapiens
accccagaggcggaggctgcag

SEQ ID NO: 68444 - DNA, 22 bp, Homo sapiens
gctgatgtatatagtgattgag

SEQ ID NO: 68445 - DNA, 22 bp, Homo sapiens
gcagcctgggcaacagagtgag

SEQ ID NO: 68446 - DNA, 22 bp, Homo sapiens
ccccaggacgtggccctcatag

SEQ ID NO: 68447 - DNA, 22 bp, Homo sapiens
tgcccagggtggagtgcagtgg

SEQ ID NO: 68448 - DNA, 22 bp, Homo sapiens
aattgaaaatattgtagaccat

SEQ ID NO: 68449 - DNA, 22 bp, Homo sapiens
ctgtacttttgcaggtcacagc

SEQ ID NO: 68450 - DNA, 22 bp, Homo sapiens
atctgggagcggaggttgcagt

SEQ ID NO: 68451 - DNA, 22 bp, Homo sapiens
gcgcactgggcgcacgcgtagg

SEQ ID NO: 68452 - DNA, 22 bp, Homo sapiens
ttggaaacgtcaccttttcctt

SEQ ID NO: 68453 - DNA, 22 bp, Homo sapiens
gtggtgagattgctggatcaaa

SEQ ID NO: 68454 - DNA, 22 bp, Homo sapiens
tgccgctccaggtctcgcggtg

SEQ ID NO: 68455 - DNA, 22 bp, Homo sapiens
aaattgcaaaagtacttttagg

SEQ ID NO: 68456 - DNA, 17 bp, Homo sapiens
gaggccaaggcaggcgg

SEQ ID NO: 68457 - DNA, 22 bp, Homo sapiens
actgcattccagcctgggcaac

SEQ ID NO: 68458 - DNA, 22 bp, Homo sapiens
gttgaaatcctaaccccctagt

SEQ ID NO: 68459 - DNA, 22 bp, Homo sapiens
ttatagcagcatgatttacaat

SEQ ID NO: 68460 - DNA, 22 bp, Homo sapiens
tagattcagatatttaggacaa

SEQ ID NO: 68461 - DNA, 22 bp, Homo sapiens
attacctatttcattttctgtc

SEQ ID NO: 68462 - DNA, 22 bp, Homo sapiens
agcttagtggttgtatgagtta

SEQ ID NO: 68463 - DNA, 22 bp, Homo sapiens
actgttgaagtgccagcttgat

SEQ ID NO: 68464 - DNA, 22 bp, Homo sapiens
ctgggcaaattgtgccagctat

SEQ ID NO: 68465 - DNA, 22 bp, Homo sapiens
tcacagcctggacagttgcctg

SEQ ID NO: 68466 - DNA, 21 bp, Homo sapiens
tctgagactgggttagaatgt

SEQ ID NO: 68467 - DNA, 22 bp, Homo sapiens
atgtcttctctgtaggtaaatt

SEQ ID NO: 68468 - DNA, 22 bp, Homo sapiens
gagctctgactgctgggtgaca

SEQ ID NO: 68469 - DNA, 22 bp, Homo sapiens
tgtgccataggcagcgtggcca

SEQ ID NO: 68470 - DNA, 22 bp, Homo sapiens
gtctgctttgtctttcatgata

SEQ ID NO: 68471 - DNA, 22 bp, Homo sapiens
cttgctttcagtctcggcctca

SEQ ID NO: 68472 - DNA, 22 bp, Homo sapiens
atcatcatgcccacttgagact

SEQ ID NO: 68473 - DNA, 22 bp, Homo sapiens
ggaggtggagctggaagttcca

SEQ ID NO: 68474 - DNA, 18 bp, Homo sapiens
tggaggaaaaatctcatg

SEQ ID NO: 68475 - DNA, 22 bp, Homo sapiens
ctgagatctttatacgaggcac

SEQ ID NO: 68476 - DNA, 22 bp, Homo sapiens
ggtgtccgcgctgtagaaggtc

SEQ ID NO: 68477 - DNA, 22 bp, Homo sapiens
tgtctcatctcttaaccccact

SEQ ID NO: 68478 - DNA, 22 bp, Homo sapiens
tatagcagcatgatttatagtc

SEQ ID NO: 68479 - DNA, 19 bp, Homo sapiens
gatttaaacgtggctctat

SEQ ID NO: 68480 - DNA, 22 bp, Homo sapiens
agttggcttcaaaggcagagag

SEQ ID NO: 68481 - DNA, 22 bp, Homo sapiens
gggcgcatcacctgaggtcagg

SEQ ID NO: 68482 - DNA, 22 bp, Homo sapiens
ttgggctgaaccctgcagctga

SEQ ID NO: 68483 - DNA, 22 bp, Homo sapiens
gcaggaggttgagccaggactg

SEQ ID NO: 68484 - DNA, 22 bp, Homo sapiens
tctgttgcaatgtgcatggtga

SEQ ID NO: 68485 - DNA, 22 bp, Homo sapiens
agggactatttacccatctcac

SEQ ID NO: 68486 - DNA, 22 bp, Homo sapiens
ggagttgattttggatatatta

SEQ ID NO: 68487 - DNA, 22 bp, Homo sapiens
ccttacctgattgctggcatcc

SEQ ID NO: 68488 - DNA, 22 bp, Homo sapiens
agaagtatcaggaagattctca

SEQ ID NO: 68489 - DNA, 22 bp, Homo sapiens
aaaggctttaaaatgtacatat

SEQ ID NO: 68490 - DNA, 22 bp, Homo sapiens
atagagtgatgtaaggtatgtg

SEQ ID NO: 68491 - DNA, 22 bp, Homo sapiens
cactgcactccagcctgggtga

SEQ ID NO: 68492 - DNA, 22 bp, Homo sapiens
tggcactgaagctggaaagcct

SEQ ID NO: 68493 - DNA, 22 bp, Homo sapiens
actgcattctttatcccacaac

SEQ ID NO: 68494 - DNA, 22 bp, Homo sapiens
tcttgaattgtactcccataag

SEQ ID NO: 68495 - DNA, 22 bp, Homo sapiens
cggccgcagcagtgtcggccca

SEQ ID NO: 68496 - DNA, 22 bp, Homo sapiens
cccaggaggcagagcttgcagt

SEQ ID NO: 68497 - DNA, 22 bp, Homo sapiens
agagagcagtggatcacctagc

SEQ ID NO: 68498 - DNA, 22 bp, Homo sapiens
ggagtgaatcactagatgcaga

SEQ ID NO: 68499 - DNA, 22 bp, Homo sapiens
ctgtaatcccagctacctggga

SEQ ID NO: 68500 - DNA, 22 bp, Homo sapiens
ttcaggcccagcacagcgcgtg

SEQ ID NO: 68501 - DNA, 22 bp, Homo sapiens
agtgactggtgtgaagttaaat

SEQ ID NO: 68502 - DNA, 22 bp, Homo sapiens
ttccaaaggctgcaccttgccc

SEQ ID NO: 68503 - DNA, 22 bp, Homo sapiens
ggggctgaacctggaggtggtc

SEQ ID NO: 68504 - DNA, 22 bp, Homo sapiens
agggtgaatctcacaactctta

SEQ ID NO: 68505 - DNA, 22 bp, Homo sapiens
acattaaacttgcttggctgta

SEQ ID NO: 68506 - DNA, 22 bp, Homo sapiens
taagatgtttacagtatggaga

SEQ ID NO: 68507 - DNA, 22 bp, Homo sapiens
tgggcagggagctggaaccaca

SEQ ID NO: 68508 - DNA, 22 bp, Homo sapiens
ttcaatttgtgctaaggcaccg

SEQ ID NO: 68509 - DNA, 22 bp, Homo sapiens
ccaggaggcggaggttgcagtg

SEQ ID NO: 68510 - DNA, 22 bp, Homo sapiens
ctggagagaatgtggaatgatt

SEQ ID NO: 68511 - DNA, 22 bp, Homo sapiens
ttcataaacaaattaaggcctg

SEQ ID NO: 68512 - DNA, 22 bp, Homo sapiens
tgccatagcaatggtaagctga

SEQ ID NO: 68513 - DNA, 22 bp, Homo sapiens
cagtgacgtaaactgcatgtgc

SEQ ID NO: 68514 - DNA, 22 bp, Homo sapiens
tcatgcctggaatctcaccact

SEQ ID NO: 68515 - DNA, 22 bp, Homo sapiens
aaagggaagttgcacatgttcc

SEQ ID NO: 68516 - DNA, 20 bp, Homo sapiens
aaactaaaggtgtttggttt

SEQ ID NO: 68517 - DNA, 22 bp, Homo sapiens
gccctgggcaaggttctggcca

SEQ ID NO: 68518 - DNA, 22 bp, Homo sapiens
caaagtgggtgccctgatgctc

SEQ ID NO: 68519 - DNA, 22 bp, Homo sapiens
atggagttctgccagcgctgct

SEQ ID NO: 68520 - DNA, 22 bp, Homo sapiens
gaccatcctggccaacgtggta

SEQ ID NO: 68521 - DNA, 22 bp, Homo sapiens
gccctgtgcaggtgtgcagcag

SEQ ID NO: 68522 - DNA, 22 bp, Homo sapiens
taccaccatttgcctgctgtat

SEQ ID NO: 68523 - DNA, 20 bp, Homo sapiens
gggcagtggcgctatctcag

SEQ ID NO: 68524 - DNA, 22 bp, Homo sapiens
catgtctgagtcatggtacttc

SEQ ID NO: 68525 - DNA, 22 bp, Homo sapiens
agcgccactgcactccagcctg

SEQ ID NO: 68526 - DNA, 22 bp, Homo sapiens
tccccagcttgctacttctgct

SEQ ID NO: 68527 - DNA, 22 bp, Homo sapiens
gtgggacaaggatgaagatatt

SEQ ID NO: 68528 - DNA, 22 bp, Homo sapiens
aatttcggttcaaggcccagtt

SEQ ID NO: 68529 - DNA, 22 bp, Homo sapiens
cctgacaggcggaggctgcagt

SEQ ID NO: 68530 - DNA, 22 bp, Homo sapiens
ttcctggtctatttagaattgc

SEQ ID NO: 68531 - DNA, 22 bp, Homo sapiens
acccaggctggagtgcagtgat

SEQ ID NO: 68532 - DNA, 22 bp, Homo sapiens
taattataacagttacatctta

SEQ ID NO: 68533 - DNA, 22 bp, Homo sapiens
tgtaggagtccaatcaggagac

SEQ ID NO: 68534 - DNA, 22 bp, Homo sapiens
tcacttcgtaaacccctcccat

SEQ ID NO: 68535 - DNA, 22 bp, Homo sapiens
gctttatccgcttgacccttac

SEQ ID NO: 68536 - DNA, 22 bp, Homo sapiens
cttgcagtttaggtcctctgtg

SEQ ID NO: 68537 - DNA, 22 bp, Homo sapiens
gggagagtagctggaaggttct

SEQ ID NO: 68538 - DNA, 22 bp, Homo sapiens
gcaactgaacatgtgtgtggcc

SEQ ID NO: 68539 - DNA, 22 bp, Homo sapiens
aaggagaggttgtccgtgttgt

SEQ ID NO: 68540 - DNA, 22 bp, Homo sapiens
tgtgctctgactttctcctggt

SEQ ID NO: 68541 - DNA, 22 bp, Homo sapiens
ggtgtgattatgacatgtgact

SEQ ID NO: 68542 - DNA, 22 bp, Homo sapiens
gcctgctcccagttggcgcctc

SEQ ID NO: 68543 - DNA, 22 bp, Homo sapiens
gcaggatgagtgagtacattta

SEQ ID NO: 68544 - DNA, 22 bp, Homo sapiens
ggtgctggacacgtggcactcc

SEQ ID NO: 68545 - DNA, 22 bp, Homo sapiens
tggaggagaccgcattttattt

SEQ ID NO: 68546 - DNA, 22 bp, Homo sapiens
cagggtgacaagtggcaaggag

SEQ ID NO: 68547 - DNA, 22 bp, Homo sapiens
cggggttcatccatgctgtggc

SEQ ID NO: 68548 - DNA, 22 bp, Homo sapiens
agtccctctgggagcaggactg

SEQ ID NO: 68549 - DNA, 22 bp, Homo sapiens
tggtatgtaaattgtaactcaa

SEQ ID NO: 68550 - DNA, 22 bp, Homo sapiens
cccaggatggggctgcagttat

SEQ ID NO: 68551 - DNA, 22 bp, Homo sapiens
agatgcagtggttaacaataca

SEQ ID NO: 68552 - DNA, 22 bp, Homo sapiens
ttcaacagacccttctttcttt

SEQ ID NO: 68553 - DNA, 22 bp, Homo sapiens
ttgattatagactcactaatct

SEQ ID NO: 68554 - DNA, 18 bp, Homo sapiens
taggagagaatttattta

SEQ ID NO: 68555 - DNA, 22 bp, Homo sapiens
agtggcctggagccccgcctgg

SEQ ID NO: 68556 - DNA, 22 bp, Homo sapiens
tggtgggctgagtctcatcgga

SEQ ID NO: 68557 - DNA, 22 bp, Homo sapiens
ctgcaccgtgtctcgggctgcc

SEQ ID NO: 68558 - DNA, 22 bp, Homo sapiens
ttcaccatgttggccaggctgg

SEQ ID NO: 68559 - DNA, 22 bp, Homo sapiens
ccaaggccttgaaggcgcgggg

SEQ ID NO: 68560 - DNA, 22 bp, Homo sapiens
ctccccagccctggtattctga

SEQ ID NO: 68561 - DNA, 22 bp, Homo sapiens
agcctgattttgataattatat

SEQ ID NO: 68562 - DNA, 22 bp, Homo sapiens
aggtctcttgctgtctctgggc

SEQ ID NO: 68563 - DNA, 22 bp, Homo sapiens
gcaggtctgttgattacagtca

SEQ ID NO: 68564 - DNA, 21 bp, Homo sapiens
ggtgacacgtggccccgctct

SEQ ID NO: 68565 - DNA, 22 bp, Homo sapiens
aagtctctcacatatctggtcc

SEQ ID NO: 68566 - DNA, 22 bp, Homo sapiens
tgagaaacacaggcatgaatag

SEQ ID NO: 68567 - DNA, 22 bp, Homo sapiens
gccatgactctccataccaaag

SEQ ID NO: 68568 - DNA, 22 bp, Homo sapiens
catccctgtcgtcaagtctctg

SEQ ID NO: 68569 - DNA, 22 bp, Homo sapiens
cttcatcagctggcttactgtt

SEQ ID NO: 68570 - DNA, 22 bp, Homo sapiens
gcgctgaggctggaggcgcacg

SEQ ID NO: 68571 - DNA, 22 bp, Homo sapiens
ccacctgagataagagagctca

SEQ ID NO: 68572 - DNA, 22 bp, Homo sapiens
ttctgggcacacaggccctggt

SEQ ID NO: 68573 - DNA, 22 bp, Homo sapiens
caggctgaagtgcagtggtgtg

SEQ ID NO: 68574 - DNA, 22 bp, Homo sapiens
tctttgaccaaattatcctgtt

SEQ ID NO: 68575 - DNA, 18 bp, Homo sapiens
gcactgaggaaaacctct

SEQ ID NO: 68576 - DNA, 22 bp, Homo sapiens
aggtattattagcatctctatt

SEQ ID NO: 68577 - DNA, 22 bp, Homo sapiens
tgataaacttagaaagaatgtt

SEQ ID NO: 68578 - DNA, 22 bp, Homo sapiens
ggccttggttccaaagcaggca

SEQ ID NO: 68579 - DNA, 22 bp, Homo sapiens
cctcctgcacctccaggaactc

SEQ ID NO: 68580 - DNA, 21 bp, Homo sapiens
caaaagagactgattcttgga

SEQ ID NO: 68581 - DNA, 22 bp, Homo sapiens
ttgaagaaccatctgtgccact

SEQ ID NO: 68582 - DNA, 22 bp, Homo sapiens
acaggcacctgccaccacatct

SEQ ID NO: 68583 - DNA, 22 bp, Homo sapiens
cgggcgcactccgggcagctgt

SEQ ID NO: 68584 - DNA, 22 bp, Homo sapiens
aaatcggttggttcaaggtaat

SEQ ID NO: 68585 - DNA, 22 bp, Homo sapiens
tcttcctgtcaatgagaattaa

SEQ ID NO: 68586 - DNA, 22 bp, Homo sapiens
tcccacaggtggagcttgcagt

SEQ ID NO: 68587 - DNA, 22 bp, Homo sapiens
ccctggctgcgtgatggatgaa

SEQ ID NO: 68588 - DNA, 22 bp, Homo sapiens
caggagtgtctccacacagcaa

SEQ ID NO: 68589 - DNA, 22 bp, Homo sapiens
tgagcaggcgcagcaggaggtc

SEQ ID NO: 68590 - DNA, 22 bp, Homo sapiens
ggttggtaactccctgtgcagt

SEQ ID NO: 68591 - DNA, 17 bp, Homo sapiens
ggcctgcacctcctgct

SEQ ID NO: 68592 - DNA, 19 bp, Homo sapiens
aggctaaagagtcttgcgt

SEQ ID NO: 68593 - DNA, 22 bp, Homo sapiens
catgtctgtgtacacatgcaca

SEQ ID NO: 68594 - DNA, 22 bp, Homo sapiens
caccatgcccggctaattttgg

SEQ ID NO: 68595 - DNA, 21 bp, Homo sapiens
aggcttggatctagacaggcc

SEQ ID NO: 68596 - DNA, 22 bp, Homo sapiens
gctcgttgaacctgtccccgag

SEQ ID NO: 68597 - DNA, 22 bp, Homo sapiens
acatgggcatctatgaggctct

SEQ ID NO: 68598 - DNA, 21 bp, Homo sapiens
aggcatgagccctgcatggac

SEQ ID NO: 68599 - DNA, 22 bp, Homo sapiens
ttattgaaggaactgaaataaa

SEQ ID NO: 68600 - DNA, 22 bp, Homo sapiens
ggctagggatctagaccaggac

SEQ ID NO: 68601 - DNA, 22 bp, Homo sapiens
ctggaatctttggagaatgtgg

SEQ ID NO: 68602 - DNA, 18 bp, Homo sapiens
gcctggcttcggagccgc

SEQ ID NO: 68603 - DNA, 22 bp, Homo sapiens
gcaccaggtgcagccgggcccc

SEQ ID NO: 68604 - DNA, 16 bp, Homo sapiens
gcagaggaaaggggag

SEQ ID NO: 68605 - DNA, 22 bp, Homo sapiens
agcatttatcttttgtttgagt

SEQ ID NO: 68606 - DNA, 22 bp, Homo sapiens
gagcccgagcgcgtacccggcg

SEQ ID NO: 68607 - DNA, 22 bp, Homo sapiens
ggcgctcagtgttgccccagag

SEQ ID NO: 68608 - DNA, 22 bp, Homo sapiens
ggcaaaaaccataattactttt

SEQ ID NO: 68609 - DNA, 22 bp, Homo sapiens
ggccgctctccggtgtggatct

SEQ ID NO: 68610 - DNA, 21 bp, Homo sapiens
tctgcaccccagcctgagtga

SEQ ID NO: 68611 - DNA, 22 bp, Homo sapiens
atttttctctttccactgagat

SEQ ID NO: 68612 - DNA, 22 bp, Homo sapiens
gctggcagacttcctctggaac

SEQ ID NO: 68613 - DNA, 22 bp, Homo sapiens
gccccagcctcccgagtagctg

SEQ ID NO: 68614 - DNA, 22 bp, Homo sapiens
aggagatggagctcagtgggca

SEQ ID NO: 68615 - DNA, 22 bp, Homo sapiens
tctcaagcttgttggtatgttt

SEQ ID NO: 68616 - DNA, 22 bp, Homo sapiens
tcatggggccacagctgccagc

SEQ ID NO: 68617 - DNA, 22 bp, Homo sapiens
cctcagctcccatgagatctgc

SEQ ID NO: 68618 - DNA, 22 bp, Homo sapiens
gttaggtagaagtttactttga

SEQ ID NO: 68619 - DNA, 22 bp, Homo sapiens
cactgcaacaacctctacctcc

SEQ ID NO: 68620 - DNA, 22 bp, Homo sapiens
agattctaccagagctagtttg

SEQ ID NO: 68621 - DNA, 22 bp, Homo sapiens
ggctcaggcctgtaatcctagc

SEQ ID NO: 68622 - DNA, 22 bp, Homo sapiens
actgttttctgtaaagggccag

SEQ ID NO: 68623 - DNA, 22 bp, Homo sapiens
gtgtttggtcagacgtccgggg

SEQ ID NO: 68624 - DNA, 22 bp, Homo sapiens
acaatgaagctccactgagctt

SEQ ID NO: 68625 - DNA, 22 bp, Homo sapiens
aagggcctgccagctcttcatg

SEQ ID NO: 68626 - DNA, 22 bp, Homo sapiens
gaccaagatacagcatcataga

SEQ ID NO: 68627 - DNA, 22 bp, Homo sapiens
ataaatgcatacatggttttga

SEQ ID NO: 68628 - DNA, 22 bp, Homo sapiens
tgctgagcccagaacggcctgg

SEQ ID NO: 68629 - DNA, 22 bp, Homo sapiens
agttaagaatacacatcataat

SEQ ID NO: 68630 - DNA, 22 bp, Homo sapiens
cacccaggctggaatgcagtgg

SEQ ID NO: 68631 - DNA, 22 bp, Homo sapiens
cacccaggctggagtgcagtga

SEQ ID NO: 68632 - DNA, 22 bp, Homo sapiens
taagtcaaggtggcatttgaga

SEQ ID NO: 68633 - DNA, 22 bp, Homo sapiens
gccagaagcacatgagaggtga

SEQ ID NO: 68634 - DNA, 22 bp, Homo sapiens
tgtgtcccttggaacctcagct

SEQ ID NO: 68635 - DNA, 18 bp, Homo sapiens
tctgtgggatcagtgagg

SEQ ID NO: 68636 - DNA, 22 bp, Homo sapiens
atcttggggaatcctctgtgta

SEQ ID NO: 68637 - DNA, 22 bp, Homo sapiens
agaggccggccgagcccatggg

SEQ ID NO: 68638 - DNA, 22 bp, Homo sapiens
tcgtctgtgaaattgggataag

SEQ ID NO: 68639 - DNA, 22 bp, Homo sapiens
gagccagactgcctgaagctca

SEQ ID NO: 68640 - DNA, 22 bp, Homo sapiens
agatgctgggatgcttggatgg

SEQ ID NO: 68641 - DNA, 22 bp, Homo sapiens
aaattagtcatgttgtattact

SEQ ID NO: 68642 - DNA, 22 bp, Homo sapiens
aataaacaaatccttccttccc

SEQ ID NO: 68643 - DNA, 22 bp, Homo sapiens
ggcaggaggtgagtggcgggtg

SEQ ID NO: 68644 - DNA, 21 bp, Homo sapiens
tctctttctggaagcttccct

SEQ ID NO: 68645 - DNA, 22 bp, Homo sapiens
taggcatgcaaataaatgtgca

SEQ ID NO: 68646 - DNA, 22 bp, Homo sapiens
atccccctcttggatggcggca

SEQ ID NO: 68647 - DNA, 22 bp, Homo sapiens
agctgccgatgcccagctgcat

SEQ ID NO: 68648 - DNA, 22 bp, Homo sapiens
agcccttagtacatttctcaag

SEQ ID NO: 68649 - DNA, 22 bp, Homo sapiens
tgacagtgcgggtacatcatag

SEQ ID NO: 68650 - DNA, 21 bp, Homo sapiens
ccgtgctcggctatggaccac

SEQ ID NO: 68651 - DNA, 22 bp, Homo sapiens
tcaaatgaagacagttgacttg

SEQ ID NO: 68652 - DNA, 22 bp, Homo sapiens
agtcaaggtggaccagaaaaat

SEQ ID NO: 68653 - DNA, 22 bp, Homo sapiens
gcgagtgccgagagggcagggc

SEQ ID NO: 68654 - DNA, 21 bp, Homo sapiens
gccaattccagctgagttagc

SEQ ID NO: 68655 - DNA, 22 bp, Homo sapiens
gaagccagtgtttgaagaattt

SEQ ID NO: 68656 - DNA, 22 bp, Homo sapiens
cccagcaggtcggtgctgcctg

SEQ ID NO: 68657 - DNA, 22 bp, Homo sapiens
ggggatggaggcgtgtggtcct

SEQ ID NO: 68658 - DNA, 22 bp, Homo sapiens
tgatcaaaacattactccacca

SEQ ID NO: 68659 - DNA, 22 bp, Homo sapiens
aacagcttgctgcaccttaata

SEQ ID NO: 68660 - DNA, 22 bp, Homo sapiens
gatggtgcaggtgaagtgctgg

SEQ ID NO: 68661 - DNA, 22 bp, Homo sapiens
tcagtgcacccaattctctcca

SEQ ID NO: 68662 - DNA, 22 bp, Homo sapiens
aaaactacatttgacattttgt

SEQ ID NO: 68663 - DNA, 22 bp, Homo sapiens
tgaggctccttgtagagagtgg

SEQ ID NO: 68664 - DNA, 22 bp, Homo sapiens
agaatttcctatgagagattcc

SEQ ID NO: 68665 - DNA, 22 bp, Homo sapiens
tggaatgcagtgggagcttacc

SEQ ID NO: 68666 - DNA, 22 bp, Homo sapiens
tagctttgtttatcaaggggca

SEQ ID NO: 68667 - DNA, 22 bp, Homo sapiens
attgttgggtctcactcctaga

SEQ ID NO: 68668 - DNA, 22 bp, Homo sapiens
tcttttgtgattcttcagttac

SEQ ID NO: 68669 - DNA, 22 bp, Homo sapiens
tcatctaagagtcttacattta

SEQ ID NO: 68670 - DNA, 22 bp, Homo sapiens
gcagactgtatcaatgtcagta

SEQ ID NO: 68671 - DNA, 22 bp, Homo sapiens
attggtggtgaggacatgccag

SEQ ID NO: 68672 - DNA, 22 bp, Homo sapiens
gagcagtaggagaaccctgagc

SEQ ID NO: 68673 - DNA, 22 bp, Homo sapiens
tggggaaaatgcttgtagtcag

SEQ ID NO: 68674 - DNA, 22 bp, Homo sapiens
atgagctagaaaaccatgtgga

SEQ ID NO: 68675 - DNA, 22 bp, Homo sapiens
ctttgcttgacactgtgattgt

SEQ ID NO: 68676 - DNA, 22 bp, Homo sapiens
agctacctgatccttcttctga

SEQ ID NO: 68677 - DNA, 22 bp, Homo sapiens
caagctgaacactgtcttcaag

SEQ ID NO: 68678 - DNA, 22 bp, Homo sapiens
tttcccagcctcagctcagcag

SEQ ID NO: 68679 - DNA, 22 bp, Homo sapiens
gtccaaaagagccagccgggcg

SEQ ID NO: 68680 - DNA, 22 bp, Homo sapiens
tgcagcggtagttctcgtggaa

SEQ ID NO: 68681 - DNA, 22 bp, Homo sapiens
aaaatatgtataactcttctgc

SEQ ID NO: 68682 - DNA, 22 bp, Homo sapiens
ccagagctgattcctgggactt

SEQ ID NO: 68683 - DNA, 23 bp, Homo sapiens
tgaatgtttattctcggtgcaga

SEQ ID NO: 68684 - DNA, 22 bp, Homo sapiens
ggctcacgcaattatcccggcc

SEQ ID NO: 68685 - DNA, 22 bp, Homo sapiens
cctggaggcggaggttgcagtg

SEQ ID NO: 68686 - DNA, 22 bp, Homo sapiens
cagctttgccaagtaaggtctt

SEQ ID NO: 68687 - DNA, 22 bp, Homo sapiens
gtagtcccagctaccccggagg

SEQ ID NO: 68688 - DNA, 22 bp, Homo sapiens
ggggcaggagcccttcttcagc

SEQ ID NO: 68689 - DNA, 22 bp, Homo sapiens
tcctgaagaaggcagatatttg

SEQ ID NO: 68690 - DNA, 17 bp, Homo sapiens
tactgaggggtctggag

SEQ ID NO: 68691 - DNA, 22 bp, Homo sapiens
cagccacttgtgatgctgggga

SEQ ID NO: 68692 - DNA, 22 bp, Homo sapiens
gagcaggaaggccagaagggtc

SEQ ID NO: 68693 - DNA, 22 bp, Homo sapiens
agaggaagtaatcaggacctgc

SEQ ID NO: 68694 - DNA, 22 bp, Homo sapiens
cactgcaagctccacctcccgg

SEQ ID NO: 68695 - DNA, 23 bp, Homo sapiens
tgttccagatacgccttttcctc

SEQ ID NO: 68696 - DNA, 22 bp, Homo sapiens
caggtggcagtgcctgcattct

SEQ ID NO: 68697 - DNA, 22 bp, Homo sapiens
atgtatacgtgcaagtcacagg

SEQ ID NO: 68698 - DNA, 22 bp, Homo sapiens
ctgtggctcaggcctgtaagcc

SEQ ID NO: 68699 - DNA, 22 bp, Homo sapiens
gtcactgtatccaggttccagc

SEQ ID NO: 68700 - DNA, 22 bp, Homo sapiens
tctcctggtacccttcctagca

SEQ ID NO: 68701 - DNA, 22 bp, Homo sapiens
agttctgcctatatagaaactc

SEQ ID NO: 68702 - DNA, 22 bp, Homo sapiens
gaaggaccctctggggtctcag

SEQ ID NO: 68703 - DNA, 22 bp, Homo sapiens
cgggaaggtggaggttgcagtg

SEQ ID NO: 68704 - DNA, 22 bp, Homo sapiens
ctcctgggaaaggctggacaca

SEQ ID NO: 68705 - DNA, 22 bp, Homo sapiens
gctgtggcctggcgcagagctg

SEQ ID NO: 68706 - DNA, 22 bp, Homo sapiens
gtgccgcgacgcagtcggtgcc

SEQ ID NO: 68707 - DNA, 22 bp, Homo sapiens
ccctgccttgtctgggctaggt

SEQ ID NO: 68708 - DNA, 22 bp, Homo sapiens
tcattgagttgcacttttacta

SEQ ID NO: 68709 - DNA, 22 bp, Homo sapiens
gtggttttattcgttcctctgt

SEQ ID NO: 68710 - DNA, 22 bp, Homo sapiens
gggaggcagtgctggaggctgg

SEQ ID NO: 68711 - DNA, 22 bp, Homo sapiens
tgccgcagtgcggggagggccc

SEQ ID NO: 68712 - DNA, 22 bp, Homo sapiens
gctgtctcatacaaggccctgc

SEQ ID NO: 68713 - DNA, 22 bp, Homo sapiens
gtctctatcatagctgaaccct

SEQ ID NO: 68714 - DNA, 22 bp, Homo sapiens
gactttggttcagggctcagag

SEQ ID NO: 68715 - DNA, 22 bp, Homo sapiens
ttaggatttgaaaaggggcaga

SEQ ID NO: 68716 - DNA, 22 bp, Homo sapiens
gagccaggaggcagagactgca

SEQ ID NO: 68717 - DNA, 22 bp, Homo sapiens
actgattgcattcatagggttt

SEQ ID NO: 68718 - DNA, 22 bp, Homo sapiens
cgtcacttcttagtctattttc

SEQ ID NO: 68719 - DNA, 22 bp, Homo sapiens
gtctcctccctttcattcacct

SEQ ID NO: 68720 - DNA, 22 bp, Homo sapiens
cctgtcataatgtccgatgtca

SEQ ID NO: 68721 - DNA, 22 bp, Homo sapiens
ctttttcctcgtagagcctaat

SEQ ID NO: 68722 - DNA, 22 bp, Homo sapiens
ttggagtgacagatgaggaaac

SEQ ID NO: 68723 - DNA, 22 bp, Homo sapiens
cttgatctacatagtgaaaccc

SEQ ID NO: 68724 - DNA, 22 bp, Homo sapiens
tagtatagattgaagcagatca

SEQ ID NO: 68725 - DNA, 22 bp, Homo sapiens
gagtagaactggttatctaata

SEQ ID NO: 68726 - DNA, 14 bp, Homo sapiens
gcaggcagatcacc

SEQ ID NO: 68727 - DNA, 22 bp, Homo sapiens
cgaggaggaaacgcggagaact

SEQ ID NO: 68728 - DNA, 22 bp, Homo sapiens
ttcctgcgcccttctcgcccgc

SEQ ID NO: 68729 - DNA, 22 bp, Homo sapiens
gccaccctggacgcactgttcg

SEQ ID NO: 68730 - DNA, 22 bp, Homo sapiens
gaggagggagctggaagctctt

SEQ ID NO: 68731 - DNA, 22 bp, Homo sapiens
ccctctctgctgcatagaggaa

SEQ ID NO: 68732 - DNA, 19 bp, Homo sapiens
gttggcactgaaaatggct

SEQ ID NO: 68733 - DNA, 22 bp, Homo sapiens
tgcttgtgacagaactgtgtcc

SEQ ID NO: 68734 - DNA, 22 bp, Homo sapiens
gcgtctcaaggcccccaggcca

SEQ ID NO: 68735 - DNA, 22 bp, Homo sapiens
gcacctgcctgggactgaagat

SEQ ID NO: 68736 - DNA, 22 bp, Homo sapiens
cccaggaggcagaagttgcagt

SEQ ID NO: 68737 - DNA, 22 bp, Homo sapiens
gaggtggctgcttgctgggaaa

SEQ ID NO: 68738 - DNA, 17 bp, Homo sapiens
ttcttttctgagccttg

SEQ ID NO: 68739 - DNA, 22 bp, Homo sapiens
tagagcaatgctctactccttg

SEQ ID NO: 68740 - DNA, 22 bp, Homo sapiens
cccaggaggcctgcctggccgg

SEQ ID NO: 68741 - DNA, 22 bp, Homo sapiens
aggaaagcttggcaaactaaat

SEQ ID NO: 68742 - DNA, 22 bp, Homo sapiens
atgccacttcattccagcctcg

SEQ ID NO: 68743 - DNA, 22 bp, Homo sapiens
tagatgcttgttcagaaatagg

SEQ ID NO: 68744 - DNA, 22 bp, Homo sapiens
tctgtcttagccatctcaggct

SEQ ID NO: 68745 - DNA, 22 bp, Homo sapiens
ccaggaggttgaggctgcagtg

SEQ ID NO: 68746 - DNA, 22 bp, Homo sapiens
cctcagacccctgctgagcttc

SEQ ID NO: 68747 - DNA, 22 bp, Homo sapiens
ttctatttttgtggaactgtag

SEQ ID NO: 68748 - DNA, 22 bp, Homo sapiens
ggtgcccaaggaaggttgccgt

SEQ ID NO: 68749 - DNA, 22 bp, Homo sapiens
ggaggtagcctcaaaagcagct

SEQ ID NO: 68750 - DNA, 22 bp, Homo sapiens
ttctcatgaaactcgcttcctc

SEQ ID NO: 68751 - DNA, 22 bp, Homo sapiens
aaggctccagtgaatgctggca

SEQ ID NO: 68752 - DNA, 22 bp, Homo sapiens
ttatttaaaagtggtaagattc

SEQ ID NO: 68753 - DNA, 20 bp, Homo sapiens
ctgtggaattttaccatgcg

SEQ ID NO: 68754 - DNA, 22 bp, Homo sapiens
tttgaaatatgtgtcttttgaa

SEQ ID NO: 68755 - DNA, 22 bp, Homo sapiens
gggctgcactagggcaaggtga

SEQ ID NO: 68756 - DNA, 22 bp, Homo sapiens
gatttagtggcccttggtacac

SEQ ID NO: 68757 - DNA, 22 bp, Homo sapiens
tggcatgcatctgttgtcctag

SEQ ID NO: 68758 - DNA, 22 bp, Homo sapiens
tgccatggcctagacctgtgat

SEQ ID NO: 68759 - DNA, 22 bp, Homo sapiens
tgaaggacagcagtggctccaa

SEQ ID NO: 68760 - DNA, 20 bp, Homo sapiens
gttaggaggttggacatgga

SEQ ID NO: 68761 - DNA, 21 bp, Homo sapiens
ctagcccctactccaagttga

SEQ ID NO: 68762 - DNA, 22 bp, Homo sapiens
ggctgcttgatggaaggggacg

SEQ ID NO: 68763 - DNA, 22 bp, Homo sapiens
taggaatggtgctcagcagaaa

SEQ ID NO: 68764 - DNA, 17 bp, Homo sapiens
cagtcgaggaggacctg

SEQ ID NO: 68765 - DNA, 22 bp, Homo sapiens
agaaacgcctgtgaaattatct

SEQ ID NO: 68766 - DNA, 22 bp, Homo sapiens
ggcatcgtcctgggcataggga

SEQ ID NO: 68767 - DNA, 22 bp, Homo sapiens
agagcacggccaccatttacaa

SEQ ID NO: 68768 - DNA, 22 bp, Homo sapiens
gacgagacacgaagggttgaca

SEQ ID NO: 68769 - DNA, 22 bp, Homo sapiens
gttcagaaattaggagaataaa

SEQ ID NO: 68770 - DNA, 22 bp, Homo sapiens
agacagggtgatcgcttgagcc

SEQ ID NO: 68771 - DNA, 22 bp, Homo sapiens
agtcacagggggcccctgcaac

SEQ ID NO: 68772 - DNA, 22 bp, Homo sapiens
ctcactgaaacctccgcctccc

SEQ ID NO: 68773 - DNA, 22 bp, Homo sapiens
atctcttgccagtcagaatggt

SEQ ID NO: 68774 - DNA, 22 bp, Homo sapiens
tttcttctatgtgtgatatttt

SEQ ID NO: 68775 - DNA, 22 bp, Homo sapiens
gctcactgcaacctccgccttc

SEQ ID NO: 68776 - DNA, 22 bp, Homo sapiens
gtggattacaagacagttgaga

SEQ ID NO: 68777 - DNA, 22 bp, Homo sapiens
ggtttgttggggtccaggccca

SEQ ID NO: 68778 - DNA, 22 bp, Homo sapiens
tttggactgcatgatgatctgg

SEQ ID NO: 68779 - DNA, 22 bp, Homo sapiens
aggggcgtgctcttccccgacg

SEQ ID NO: 68780 - DNA, 22 bp, Homo sapiens
gttcagatttgactggtttctc

SEQ ID NO: 68781 - DNA, 22 bp, Homo sapiens
taaagttggacctgattttatt

SEQ ID NO: 68782 - DNA, 22 bp, Homo sapiens
cccaggaggcagatgttgcagt

SEQ ID NO: 68783 - DNA, 22 bp, Homo sapiens
ggggccttttctgaatgtggaa

SEQ ID NO: 68784 - DNA, 22 bp, Homo sapiens
ggtcagccttggatttggtagc

SEQ ID NO: 68785 - DNA, 17 bp, Homo sapiens
aagtgattcagccctca

SEQ ID NO: 68786 - DNA, 22 bp, Homo sapiens
cactgcactccagcctgggcga

SEQ ID NO: 68787 - DNA, 22 bp, Homo sapiens
gtatccatgggggattggttcc

SEQ ID NO: 68788 - DNA, 22 bp, Homo sapiens
ctattattagataatctacttg

SEQ ID NO: 68789 - DNA, 22 bp, Homo sapiens
gcacatccaatgattgttttga

SEQ ID NO: 68790 - DNA, 22 bp, Homo sapiens
ctgaggggatgtttttgacgga

SEQ ID NO: 68791 - DNA, 22 bp, Homo sapiens
cacagctgaagtagccatgtgg

SEQ ID NO: 68792 - DNA, 22 bp, Homo sapiens
ctgagggtcaacttgattgtat

SEQ ID NO: 68793 - DNA, 22 bp, Homo sapiens
gttacagtcaggagatattttg

SEQ ID NO: 68794 - DNA, 22 bp, Homo sapiens
tgacatttcctagtgctttgtg

SEQ ID NO: 68795 - DNA, 22 bp, Homo sapiens
gacgagagactccatccaccac

SEQ ID NO: 68796 - DNA, 22 bp, Homo sapiens
ccatcacagtccccatcgtgat

SEQ ID NO: 68797 - DNA, 22 bp, Homo sapiens
cccggacagaggggcagagtgt

SEQ ID NO: 68798 - DNA, 17 bp, Homo sapiens
aggaggccctggcgttt

SEQ ID NO: 68799 - DNA, 22 bp, Homo sapiens
gccgggaccaaggccacggagc

SEQ ID NO: 68800 - DNA, 22 bp, Homo sapiens
gggcatggtggcaggcacctgt

SEQ ID NO: 68801 - DNA, 22 bp, Homo sapiens
atgacaagagtgttcagggaga

SEQ ID NO: 68802 - DNA, 22 bp, Homo sapiens
tgagccaggagtttgaggctgt

SEQ ID NO: 68803 - DNA, 22 bp, Homo sapiens
aagtgcttccatgtttgagtgt

SEQ ID NO: 68804 - DNA, 22 bp, Homo sapiens
ggaaactagaagaatactagtc

SEQ ID NO: 68805 - DNA, 22 bp, Homo sapiens
aggctgtgtgctccttatgaga

SEQ ID NO: 68806 - DNA, 22 bp, Homo sapiens
tcatgctatgagcgagggcctg

SEQ ID NO: 68807 - DNA, 21 bp, Homo sapiens
cgggaaggaggttctgaccct

SEQ ID NO: 68808 - DNA, 22 bp, Homo sapiens
tgggcttaggtcggaggcggcc

SEQ ID NO: 68809 - DNA, 17 bp, Homo sapiens
tgcatgtcctttgttcc

SEQ ID NO: 68810 - DNA, 22 bp, Homo sapiens
ccctcccggcgtgctgggctcg

SEQ ID NO: 68811 - DNA, 22 bp, Homo sapiens
gccttgccgctcagcagtgggg

SEQ ID NO: 68812 - DNA, 19 bp, Homo sapiens
tctagttttgagagacttc

SEQ ID NO: 68813 - DNA, 22 bp, Homo sapiens
aggcggaagatggccccataga

SEQ ID NO: 68814 - DNA, 22 bp, Homo sapiens
aatcacacaaaggcaacttttg

SEQ ID NO: 68815 - DNA, 22 bp, Homo sapiens
agagggcgcccaggcccacgcc

SEQ ID NO: 68816 - DNA, 22 bp, Homo sapiens
atgattgaaaatgacattgcca

SEQ ID NO: 68817 - DNA, 22 bp, Homo sapiens
tcaaaattaaaccaacgtccag

SEQ ID NO: 68818 - DNA, 22 bp, Homo sapiens
ctggaaggcggaggttgtagtg

SEQ ID NO: 68819 - DNA, 22 bp, Homo sapiens
cacagcctcctctggctcacgg

SEQ ID NO: 68820 - DNA, 22 bp, Homo sapiens
ctcccggctgctccggctcccg

SEQ ID NO: 68821 - DNA, 22 bp, Homo sapiens
tcgctgaggctgcacggctgcc

SEQ ID NO: 68822 - DNA, 22 bp, Homo sapiens
aaagatcacgtcccaggactcg

SEQ ID NO: 68823 - DNA, 22 bp, Homo sapiens
cactgcactccagcctgggtca

SEQ ID NO: 68824 - DNA, 22 bp, Homo sapiens
tactgtgtgcccagccgagctg

SEQ ID NO: 68825 - DNA, 21 bp, Homo sapiens
ttgctgttttcccaatgcagt

SEQ ID NO: 68826 - DNA, 22 bp, Homo sapiens
acggtgctgggtattggggttc

SEQ ID NO: 68827 - DNA, 22 bp, Homo sapiens
gtgtcaataaatagcggtgtgg

SEQ ID NO: 68828 - DNA, 19 bp, Homo sapiens
cgcgccgtcgggtccagcc

SEQ ID NO: 68829 - DNA, 22 bp, Homo sapiens
aggacagagggaccagagccca

SEQ ID NO: 68830 - DNA, 22 bp, Homo sapiens
gacatagctcagagctcagcac

SEQ ID NO: 68831 - DNA, 22 bp, Homo sapiens
agggaagaggaccagagtctct

SEQ ID NO: 68832 - DNA, 22 bp, Homo sapiens
attctaaatcagagagctctgt

SEQ ID NO: 68833 - DNA, 22 bp, Homo sapiens
gagcctggagctggaacgaagc

SEQ ID NO: 68834 - DNA, 22 bp, Homo sapiens
tgctgagcttccactgcttctg

SEQ ID NO: 68835 - DNA, 22 bp, Homo sapiens
aagaggtaaccatagcaaccac

SEQ ID NO: 68836 - DNA, 22 bp, Homo sapiens
tgttatcctcagctcacctcta

SEQ ID NO: 68837 - DNA, 22 bp, Homo sapiens
ccagccgcggtgagggtggctg

SEQ ID NO: 68838 - DNA, 22 bp, Homo sapiens
tagttcaacgagttggggttgc

SEQ ID NO: 68839 - DNA, 22 bp, Homo sapiens
cacagagatggtctggcaggtg

SEQ ID NO: 68840 - DNA, 22 bp, Homo sapiens
aggggatggagctggaaggcag

SEQ ID NO: 68841 - DNA, 22 bp, Homo sapiens
gggggctaccgtctctggagct

SEQ ID NO: 68842 - DNA, 22 bp, Homo sapiens
tttctcctcatgactggttgtg

SEQ ID NO: 68843 - DNA, 22 bp, Homo sapiens
taggtagctttggcgtttcttg

SEQ ID NO: 68844 - DNA, 22 bp, Homo sapiens
gagatttccatattttgtaaca

SEQ ID NO: 68845 - DNA, 22 bp, Homo sapiens
ggcctggcagagcgcgcggctg

SEQ ID NO: 68846 - DNA, 22 bp, Homo sapiens
gttgcagatgtggaactcgtgc

SEQ ID NO: 68847 - DNA, 22 bp, Homo sapiens
tatccgtgatgtttataaacca

SEQ ID NO: 68848 - DNA, 22 bp, Homo sapiens
ccggctcggcgaccaggctgaa

SEQ ID NO: 68849 - DNA, 22 bp, Homo sapiens
tccgtgcccctggcactaggtc

SEQ ID NO: 68850 - DNA, 22 bp, Homo sapiens
tatcataggttctgaatgtttc

SEQ ID NO: 68851 - DNA, 22 bp, Homo sapiens
agaggaggctctgggatcgtcc

SEQ ID NO: 68852 - DNA, 22 bp, Homo sapiens
gtgctggggagataggaagaga

SEQ ID NO: 68853 - DNA, 22 bp, Homo sapiens
tagcccctgcctttgaacctgg

SEQ ID NO: 68854 - DNA, 22 bp, Homo sapiens
ccttagggactaatagactgtc

SEQ ID NO: 68855 - DNA, 22 bp, Homo sapiens
gtgtaagtatctttgtatcttt

SEQ ID NO: 68856 - DNA, 22 bp, Homo sapiens
cctgtcatatacatacctcctc

SEQ ID NO: 68857 - DNA, 22 bp, Homo sapiens
acactccagggagggagggaat

SEQ ID NO: 68858 - DNA, 22 bp, Homo sapiens
actcccttggtggagaatgcaa

SEQ ID NO: 68859 - DNA, 22 bp, Homo sapiens
ttcaaagggaaaagcaggctgg

SEQ ID NO: 68860 - DNA, 22 bp, Homo sapiens
ggctgatgggcatgagctgtca

SEQ ID NO: 68861 - DNA, 22 bp, Homo sapiens
gttgctcaggcaggagtacagt

SEQ ID NO: 68862 - DNA, 22 bp, Homo sapiens
agctttggttgccatgatctga

SEQ ID NO: 68863 - DNA, 20 bp, Homo sapiens
tcagccttgaatgcttgaaa

SEQ ID NO: 68864 - DNA, 23 bp, Homo sapiens
tgcatggggctatactgctgttc

SEQ ID NO: 68865 - DNA, 22 bp, Homo sapiens
ggtggctgcaatggctaacttc

SEQ ID NO: 68866 - DNA, 23 bp, Homo sapiens
ccagtgattgcctggaaggaggt

SEQ ID NO: 68867 - DNA, 22 bp, Homo sapiens
caaatcctcacctcatcatgaa

SEQ ID NO: 68868 - DNA, 22 bp, Homo sapiens
tgatatgtccctcgacatcagg

SEQ ID NO: 68869 - DNA, 23 bp, Homo sapiens
acagcaagaggaccagatgtgag

SEQ ID NO: 68870 - DNA, 22 bp, Homo sapiens
gaaaggagagggttaaggagct

SEQ ID NO: 68871 - DNA, 22 bp, Homo sapiens
ttgctcttgaaaattgatgctg

SEQ ID NO: 68872 - DNA, 22 bp, Homo sapiens
ctgccgttgtgaagctcttaga

SEQ ID NO: 68873 - DNA, 20 bp, Homo sapiens
caaatccctgctctgtgctg

SEQ ID NO: 68874 - DNA, 22 bp, Homo sapiens
tggaggttgggatgcttgtgat

SEQ ID NO: 68875 - DNA, 22 bp, Homo sapiens
cccagctcttcaagtcaccccc

SEQ ID NO: 68876 - DNA, 22 bp, Homo sapiens
cctttgatttcccccgtctcag

SEQ ID NO: 68877 - DNA, 22 bp, Homo sapiens
tctcagggctcagagctcaggc

SEQ ID NO: 68878 - DNA, 22 bp, Homo sapiens
tgtacaatgctgaggtttgggg

SEQ ID NO: 68879 - DNA, 22 bp, Homo sapiens
catttctgggagacatgctaga

SEQ ID NO: 68880 - DNA, 22 bp, Homo sapiens
tggaagctcaaggcagggtgag

SEQ ID NO: 68881 - DNA, 22 bp, Homo sapiens
ctggctcgcattatattttggg

SEQ ID NO: 68882 - DNA, 22 bp, Homo sapiens
atcaaatacaaagggcataagg

SEQ ID NO: 68883 - DNA, 22 bp, Homo sapiens
ttctgattgctgatgaggccca

SEQ ID NO: 68884 - DNA, 22 bp, Homo sapiens
aaggcaggatgggaaaagattt

SEQ ID NO: 68885 - DNA, 22 bp, Homo sapiens
atgtatatgcatgcattcaaag

SEQ ID NO: 68886 - DNA, 22 bp, Homo sapiens
tgcaggctgtgtcatttagtga

SEQ ID NO: 68887 - DNA, 22 bp, Homo sapiens
cactgcactccagcttgggtga

SEQ ID NO: 68888 - DNA, 22 bp, Homo sapiens
gctctgccagcccaaggcgcag

SEQ ID NO: 68889 - DNA, 18 bp, Homo sapiens
agctccatctgtcagcat

SEQ ID NO: 68890 - DNA, 22 bp, Homo sapiens
aatgtgagccaatgcccgtggg

SEQ ID NO: 68891 - DNA, 22 bp, Homo sapiens
ggagagcttggagtgcgatttt

SEQ ID NO: 68892 - DNA, 21 bp, Homo sapiens
tccctgagcccaaggggctcc

SEQ ID NO: 68893 - DNA, 22 bp, Homo sapiens
tgacagtgaacaggttaccact

SEQ ID NO: 68894 - DNA, 22 bp, Homo sapiens
agccacacttgccaggggaagg

SEQ ID NO: 68895 - DNA, 22 bp, Homo sapiens
gtgacatggtttgccgtccctg

SEQ ID NO: 68896 - DNA, 22 bp, Homo sapiens
cccaggaggcggaggttgcagt

SEQ ID NO: 68897 - DNA, 22 bp, Homo sapiens
aatcagaccgttctggctgtcc

SEQ ID NO: 68898 - DNA, 22 bp, Homo sapiens
atatgggggggcgtgcagagga

SEQ ID NO: 68899 - DNA, 22 bp, Homo sapiens
atcagagtgtaagttctttcct

SEQ ID NO: 68900 - DNA, 21 bp, Homo sapiens
caatggcgagatcttggctca

SEQ ID NO: 68901 - DNA, 23 bp, Homo sapiens
tcgttgaatagcaatagcacaac

SEQ ID NO: 68902 - DNA, 22 bp, Homo sapiens
gttctgagtcctcctttgaagg

SEQ ID NO: 68903 - DNA, 22 bp, Homo sapiens
tggttcctcaagcgctggcggc

SEQ ID NO: 68904 - DNA, 22 bp, Homo sapiens
tggagtgcaatagtaataaggt

SEQ ID NO: 68905 - DNA, 22 bp, Homo sapiens
agtctacaaagggaagcccttt

SEQ ID NO: 68906 - DNA, 22 bp, Homo sapiens
acagatgttgcttgtcattctc

SEQ ID NO: 68907 - DNA, 22 bp, Homo sapiens
gacttttgaataaggtaggata

SEQ ID NO: 68908 - DNA, 22 bp, Homo sapiens
ttggagaggcagtcttgctctg

SEQ ID NO: 68909 - DNA, 22 bp, Homo sapiens
ttttttgttgggtagaacggaa

SEQ ID NO: 68910 - DNA, 22 bp, Homo sapiens
cgacgggctcggtccgcttcct

SEQ ID NO: 68911 - DNA, 19 bp, Homo sapiens
ttcacattggaagaagtag

SEQ ID NO: 68912 - DNA, 22 bp, Homo sapiens
ttgttggaaatgagaggctagg

SEQ ID NO: 68913 - DNA, 22 bp, Homo sapiens
caggatatttacgttctgctac

SEQ ID NO: 68914 - DNA, 22 bp, Homo sapiens
tgcttttagctagtaactagta

SEQ ID NO: 68915 - DNA, 22 bp, Homo sapiens
ttgtgcttgccctggaggtgcg

SEQ ID NO: 68916 - DNA, 22 bp, Homo sapiens
aaagcagaggttgcagtgagct

SEQ ID NO: 68917 - DNA, 22 bp, Homo sapiens
actagaccaaggaatcctggaa

SEQ ID NO: 68918 - DNA, 22 bp, Homo sapiens
caagatcttcctcaatagacct

SEQ ID NO: 68919 - DNA, 22 bp, Homo sapiens
ttgctttcccaaggcagaacat

SEQ ID NO: 68920 - DNA, 22 bp, Homo sapiens
gacctcatgatccacctgcctt

SEQ ID NO: 68921 - DNA, 22 bp, Homo sapiens
gtggagagagataagcctggtc

SEQ ID NO: 68922 - DNA, 22 bp, Homo sapiens
atgcagtggcttcagtgtcagt

SEQ ID NO: 68923 - DNA, 22 bp, Homo sapiens
taactaggattacaagcgtgcg

SEQ ID NO: 68924 - DNA, 22 bp, Homo sapiens
tcctccccaaagcccagcctgg

SEQ ID NO: 68925 - DNA, 22 bp, Homo sapiens
acaggggcaagggctcacggcc

SEQ ID NO: 68926 - DNA, 22 bp, Homo sapiens
aggtgcccatgagctccatggc

SEQ ID NO: 68927 - DNA, 22 bp, Homo sapiens
ccaggcaggcgatggtgcagtg

SEQ ID NO: 68928 - DNA, 22 bp, Homo sapiens
tggcaccatcaaggctgagaac

SEQ ID NO: 68929 - DNA, 22 bp, Homo sapiens
ttccatttggcacttcactgag

SEQ ID NO: 68930 - DNA, 20 bp, Homo sapiens
gccgactgccttgtgagcct

SEQ ID NO: 68931 - DNA, 22 bp, Homo sapiens
tatttaataaaactatggcatg

SEQ ID NO: 68932 - DNA, 22 bp, Homo sapiens
aaagagactggtggcattttgc

SEQ ID NO: 68933 - DNA, 22 bp, Homo sapiens
gaggcagtccagtgggtaagaa

SEQ ID NO: 68934 - DNA, 22 bp, Homo sapiens
ttgtgaatggtgccgcaataaa

SEQ ID NO: 68935 - DNA, 22 bp, Homo sapiens
cagctgcccctccagggctggg

SEQ ID NO: 68936 - DNA, 22 bp, Homo sapiens
ttagggttacaccagcctcctg

SEQ ID NO: 68937 - DNA, 22 bp, Homo sapiens
attgtgtcctcattgaccttca

SEQ ID NO: 68938 - DNA, 22 bp, Homo sapiens
acagtatagggcttatattgta

SEQ ID NO: 68939 - DNA, 22 bp, Homo sapiens
aggggttggacataagacagaa

SEQ ID NO: 68940 - DNA, 22 bp, Homo sapiens
agactggaggcattttgctcct

SEQ ID NO: 68941 - DNA, 22 bp, Homo sapiens
cacattccttacattcatagag

SEQ ID NO: 68942 - DNA, 22 bp, Homo sapiens
ctgaggcaggagagttgcttga

SEQ ID NO: 68943 - DNA, 22 bp, Homo sapiens
ggcttctctccagtatgcattc

SEQ ID NO: 68944 - DNA, 22 bp, Homo sapiens
cctactctgagcgcctccgcat

SEQ ID NO: 68945 - DNA, 22 bp, Homo sapiens
acatagtgttttgagagacagc

SEQ ID NO: 68946 - DNA, 22 bp, Homo sapiens
gcaggtctatcaggctgcaggt

SEQ ID NO: 68947 - DNA, 22 bp, Homo sapiens
cccagcaggaggaggttgcagt

SEQ ID NO: 68948 - DNA, 22 bp, Homo sapiens
cagccccacacggtctagctct

SEQ ID NO: 68949 - DNA, 22 bp, Homo sapiens
cggagcctgcttgttgcagctg

SEQ ID NO: 68950 - DNA, 22 bp, Homo sapiens
gaatgtcttcaaaactagactg

SEQ ID NO: 68951 - DNA, 22 bp, Homo sapiens
cgcccaggctggagagcagtgg

SEQ ID NO: 68952 - DNA, 22 bp, Homo sapiens
gcggggggcaggcagtacgttg

SEQ ID NO: 68953 - DNA, 22 bp, Homo sapiens
tccacatggctgggaggcctca

SEQ ID NO: 68954 - DNA, 22 bp, Homo sapiens
agctgcaccggctggaccactg

SEQ ID NO: 68955 - DNA, 22 bp, Homo sapiens
gaattttattactagtcaactg

SEQ ID NO: 68956 - DNA, 22 bp, Homo sapiens
aaagcagaactgagagagctgg

SEQ ID NO: 68957 - DNA, 22 bp, Homo sapiens
ttttggctctgtctgtatcttt

SEQ ID NO: 68958 - DNA, 22 bp, Homo sapiens
cagtttcttcctcccccagaga

SEQ ID NO: 68959 - DNA, 22 bp, Homo sapiens
tgacagagtgacactcttgtct

SEQ ID NO: 68960 - DNA, 22 bp, Homo sapiens
tgctcatcaacatgatgatcat

SEQ ID NO: 68961 - DNA, 22 bp, Homo sapiens
cctttaggagtgaggaccgagc

SEQ ID NO: 68962 - DNA, 22 bp, Homo sapiens
gtaggccatggtggttgtctct

SEQ ID NO: 68963 - DNA, 22 bp, Homo sapiens
tggatatccttgttaactttct

SEQ ID NO: 68964 - DNA, 22 bp, Homo sapiens
cacatacccggctattgctgct

SEQ ID NO: 68965 - DNA, 22 bp, Homo sapiens
ttttcagaattagcataccatt

SEQ ID NO: 68966 - DNA, 22 bp, Homo sapiens
ccgggcctcgggacaccgggta

SEQ ID NO: 68967 - DNA, 22 bp, Homo sapiens
tgcacgtgggctctctgctctt

SEQ ID NO: 68968 - DNA, 22 bp, Homo sapiens
tgggactcactcttttggccag

SEQ ID NO: 68969 - DNA, 22 bp, Homo sapiens
gaggtgatggttgcacaatgct

SEQ ID NO: 68970 - DNA, 22 bp, Homo sapiens
cgtgtacagtctatcttttttc

SEQ ID NO: 68971 - DNA, 21 bp, Homo sapiens
cagggccaatcctgacctcta

SEQ ID NO: 68972 - DNA, 22 bp, Homo sapiens
tggatctcggcaatgcgggact

SEQ ID NO: 68973 - DNA, 20 bp, Homo sapiens
ttcaggaataagatagcagc

SEQ ID NO: 68974 - DNA, 22 bp, Homo sapiens
taagagaatgttgtggctaggt

SEQ ID NO: 68975 - DNA, 22 bp, Homo sapiens
cgcaggtgaaagaggctgggca

SEQ ID NO: 68976 - DNA, 22 bp, Homo sapiens
tccaggtgggctgcacccaggc

SEQ ID NO: 68977 - DNA, 22 bp, Homo sapiens
aacttagtgagccactcttgca

SEQ ID NO: 68978 - DNA, 22 bp, Homo sapiens
ttagtactgatagggtcaatca

SEQ ID NO: 68979 - DNA, 22 bp, Homo sapiens
tctcccaagcctggcaggggca

SEQ ID NO: 68980 - DNA, 22 bp, Homo sapiens
aggtgcttggctcgtgcacaca

SEQ ID NO: 68981 - DNA, 19 bp, Homo sapiens
aatgtcagcatgttaattt

SEQ ID NO: 68982 - DNA, 22 bp, Homo sapiens
gcagtggcatgatgtgggctca

SEQ ID NO: 68983 - DNA, 22 bp, Homo sapiens
ttggagatatcacaccttcaca

SEQ ID NO: 68984 - DNA, 21 bp, Homo sapiens
gcccacagtgaggaggatccc

SEQ ID NO: 68985 - DNA, 22 bp, Homo sapiens
atgatggctaggctggttttga

SEQ ID NO: 68986 - DNA, 22 bp, Homo sapiens
atggccaggcacctctggctga

SEQ ID NO: 68987 - DNA, 22 bp, Homo sapiens
tcccagattcctgctcttatat

SEQ ID NO: 68988 - DNA, 22 bp, Homo sapiens
cgcaccactgaattccagcctg

SEQ ID NO: 68989 - DNA, 22 bp, Homo sapiens
tgggattcaccatgggcttcag

SEQ ID NO: 68990 - DNA, 22 bp, Homo sapiens
cacccaggcaaggattctgcaa

SEQ ID NO: 68991 - DNA, 22 bp, Homo sapiens
agaagcattggaccaggggccc

SEQ ID NO: 68992 - DNA, 22 bp, Homo sapiens
agaaaatgtgaacttgtgaatt

SEQ ID NO: 68993 - DNA, 22 bp, Homo sapiens
ttgctgttgatgatgtgataca

SEQ ID NO: 68994 - DNA, 22 bp, Homo sapiens
aaagaggcaatcaatgtagcaa

SEQ ID NO: 68995 - DNA, 22 bp, Homo sapiens
aggttatatgactgtcatgcct

SEQ ID NO: 68996 - DNA, 22 bp, Homo sapiens
ggaggctgagaggtcgcagtgg

SEQ ID NO: 68997 - DNA, 22 bp, Homo sapiens
tcggggtctttgacacgctctg

SEQ ID NO: 68998 - DNA, 22 bp, Homo sapiens
catgcaggcgcaacttctacaa

SEQ ID NO: 68999 - DNA, 20 bp, Homo sapiens
aagacaccagtggcagcccc

SEQ ID NO: 69000 - DNA, 22 bp, Homo sapiens
ctgtctgcaggatagtaccctc

SEQ ID NO: 69001 - DNA, 22 bp, Homo sapiens
ggaggacaggggctgcagcaca

SEQ ID NO: 69002 - DNA, 22 bp, Homo sapiens
ggctgtgtggccgtgggctcta

SEQ ID NO: 69003 - DNA, 22 bp, Homo sapiens
taggtagatttaaagattttct

SEQ ID NO: 69004 - DNA, 22 bp, Homo sapiens
gccacgtagaagtgccgcgaga

SEQ ID NO: 69005 - DNA, 16 bp, Homo sapiens
gaggagcccctctgcc

SEQ ID NO: 69006 - DNA, 22 bp, Homo sapiens
tgaggcaggagaatcaccggaa

SEQ ID NO: 69007 - DNA, 22 bp, Homo sapiens
atgaaatgctattttggctaga

SEQ ID NO: 69008 - DNA, 22 bp, Homo sapiens
acccaggctggcgtgcagtggc

SEQ ID NO: 69009 - DNA, 22 bp, Homo sapiens
tgactggattgtcattacgacg

SEQ ID NO: 69010 - DNA, 22 bp, Homo sapiens
cgcatgagacctgccggccatc

SEQ ID NO: 69011 - DNA, 22 bp, Homo sapiens
ttggaacatgccggggtccagg

SEQ ID NO: 69012 - DNA, 20 bp, Homo sapiens
ggccggggagctctccaggg

SEQ ID NO: 69013 - DNA, 22 bp, Homo sapiens
gggagtgggtttggcctaggcc

SEQ ID NO: 69014 - DNA, 22 bp, Homo sapiens
tgagcctgggagatggaggctg

SEQ ID NO: 69015 - DNA, 22 bp, Homo sapiens
tccagcccaggctggagtgtag

SEQ ID NO: 69016 - DNA, 22 bp, Homo sapiens
ggtgttgcagttgaagactggt

SEQ ID NO: 69017 - DNA, 22 bp, Homo sapiens
caggctggagtgcagtggcgct

SEQ ID NO: 69018 - DNA, 22 bp, Homo sapiens
gagggaaaggttaatacatgat

SEQ ID NO: 69019 - DNA, 22 bp, Homo sapiens
tgaggcaggagttcaggctgcg

SEQ ID NO: 69020 - DNA, 22 bp, Homo sapiens
attttctatgttgtaattgtta

SEQ ID NO: 69021 - DNA, 22 bp, Homo sapiens
actgtgaacggactgaagccca

SEQ ID NO: 69022 - DNA, 22 bp, Homo sapiens
atacatgcgccatgttggtgtg

SEQ ID NO: 69023 - DNA, 22 bp, Homo sapiens
cgtctggcttctccacggtaaa

SEQ ID NO: 69024 - DNA, 22 bp, Homo sapiens
cctttcctgtgtccttttaagg

SEQ ID NO: 69025 - DNA, 20 bp, Homo sapiens
tgttgattggtgtcatctca

SEQ ID NO: 69026 - DNA, 22 bp, Homo sapiens
tagctaccattattgagcacct

SEQ ID NO: 69027 - DNA, 22 bp, Homo sapiens
agacggaatttcatcatgttag

SEQ ID NO: 69028 - DNA, 22 bp, Homo sapiens
aactatgttaataagtttcatt

SEQ ID NO: 69029 - DNA, 22 bp, Homo sapiens
ttgtggttaaccgcacattttt

SEQ ID NO: 69030 - DNA, 23 bp, Homo sapiens
gatgaggacctacaggtggccag

SEQ ID NO: 69031 - DNA, 22 bp, Homo sapiens
gggttgaggcggatgtcggcgg

SEQ ID NO: 69032 - DNA, 22 bp, Homo sapiens
tgaggcaggaggttgagaactg

SEQ ID NO: 69033 - DNA, 22 bp, Homo sapiens
tctgaaaactccatgagctcgt

SEQ ID NO: 69034 - DNA, 22 bp, Homo sapiens
tctggcaatctgattctgcatc

SEQ ID NO: 69035 - DNA, 22 bp, Homo sapiens
tggccagctttgactgtaaacc

SEQ ID NO: 69036 - DNA, 22 bp, Homo sapiens
aggtgactggtttatctggcag

SEQ ID NO: 69037 - DNA, 22 bp, Homo sapiens
gacccttagaatgtgatcttat

SEQ ID NO: 69038 - DNA, 22 bp, Homo sapiens
gagaggaagccttctgtacttg

SEQ ID NO: 69039 - DNA, 20 bp, Homo sapiens
ctgccgaccacagccatgga

SEQ ID NO: 69040 - DNA, 22 bp, Homo sapiens
gagggggctagcgcagtgccca

SEQ ID NO: 69041 - DNA, 22 bp, Homo sapiens
atgggctgtccattgctggctg

SEQ ID NO: 69042 - DNA, 22 bp, Homo sapiens
aaagtgcttctctttggtgggt

SEQ ID NO: 69043 - DNA, 22 bp, Homo sapiens
gtgtatgttctacttaatatta

SEQ ID NO: 69044 - DNA, 22 bp, Homo sapiens
gctcccaggatgaggagccagg

SEQ ID NO: 69045 - DNA, 22 bp, Homo sapiens
caggaaggcgcggctgtgcctg

SEQ ID NO: 69046 - DNA, 22 bp, Homo sapiens
aggcaaggtgctacagacagtg

SEQ ID NO: 69047 - DNA, 23 bp, Homo sapiens
aggatgtaggatgtatggcagag

SEQ ID NO: 69048 - DNA, 22 bp, Homo sapiens
ggcgtgggcgaggtgctctatc

SEQ ID NO: 69049 - DNA, 22 bp, Homo sapiens
tgcctcagctgaggccgctcca

SEQ ID NO: 69050 - DNA, 22 bp, Homo sapiens
ccctgctgtgtagcggaggaac

SEQ ID NO: 69051 - DNA, 22 bp, Homo sapiens
cgccaggcttggtagctcatgc

SEQ ID NO: 69052 - DNA, 17 bp, Homo sapiens
tcggtttgccaggcttc

SEQ ID NO: 69053 - DNA, 22 bp, Homo sapiens
gggaggttgaggctgcagtgag

SEQ ID NO: 69054 - DNA, 22 bp, Homo sapiens
gctggccacagatccccaggga

SEQ ID NO: 69055 - DNA, 18 bp, Homo sapiens
gacatagctcagagctca

SEQ ID NO: 69056 - DNA, 22 bp, Homo sapiens
aagtgatgctacgactttgaca

SEQ ID NO: 69057 - DNA, 22 bp, Homo sapiens
aaatgtggggctggaggcagga

SEQ ID NO: 69058 - DNA, 22 bp, Homo sapiens
cctcccctcagacagagactgg

SEQ ID NO: 69059 - DNA, 22 bp, Homo sapiens
tgcagagtgaagacatcacccc

SEQ ID NO: 69060 - DNA, 22 bp, Homo sapiens
tccttcagcctcccagctcaaa

SEQ ID NO: 69061 - DNA, 22 bp, Homo sapiens
gaggcggaggttgcagtgagcc

SEQ ID NO: 69062 - DNA, 22 bp, Homo sapiens
ccagcagccaccttctcgaaat

SEQ ID NO: 69063 - DNA, 22 bp, Homo sapiens
gcaggcagaggtggaggagaca

SEQ ID NO: 69064 - DNA, 22 bp, Homo sapiens
tcctgccaggagatggtagcca

SEQ ID NO: 69065 - DNA, 22 bp, Homo sapiens
gaggccaaggtgggcagatcac

SEQ ID NO: 69066 - DNA, 23 bp, Homo sapiens
aggttatgattatagagcgagga

SEQ ID NO: 69067 - DNA, 20 bp, Homo sapiens
ataaaataactgccacaaga

SEQ ID NO: 69068 - DNA, 22 bp, Homo sapiens
tatcactacacctggctaatta

SEQ ID NO: 69069 - DNA, 22 bp, Homo sapiens
aatatttcttctaaagcccttt

SEQ ID NO: 69070 - DNA, 22 bp, Homo sapiens
actgcactccagcctgggtgat

SEQ ID NO: 69071 - DNA, 22 bp, Homo sapiens
atcatccaagcgtagttcttct

SEQ ID NO: 69072 - DNA, 22 bp, Homo sapiens
atccaccctgtggtggctttct

SEQ ID NO: 69073 - DNA, 22 bp, Homo sapiens
tttatagtagcatgatttataa

SEQ ID NO: 69074 - DNA, 18 bp, Homo sapiens
tccaccgcgtgcacctct

SEQ ID NO: 69075 - DNA, 22 bp, Homo sapiens
aaatgcacaaagattttgcact

SEQ ID NO: 69076 - DNA, 22 bp, Homo sapiens
gaccttgtgatccccctgcctt

SEQ ID NO: 69077 - DNA, 22 bp, Homo sapiens
aggatgagccgcgcaagctgac

SEQ ID NO: 69078 - DNA, 22 bp, Homo sapiens
atttctctgcagtgttcggaat

SEQ ID NO: 69079 - DNA, 22 bp, Homo sapiens
tgtctcctcggctgtccagcca

SEQ ID NO: 69080 - DNA, 22 bp, Homo sapiens
ttatttaatgtgatctgaagag

SEQ ID NO: 69081 - DNA, 22 bp, Homo sapiens
ccaggggttggaggttgcagtg

SEQ ID NO: 69082 - DNA, 22 bp, Homo sapiens
tgccgtggggctgaggctggag

SEQ ID NO: 69083 - DNA, 22 bp, Homo sapiens
taggcgacagcttgatggtgcg

SEQ ID NO: 69084 - DNA, 22 bp, Homo sapiens
catctttgcccatccacttcca

SEQ ID NO: 69085 - DNA, 22 bp, Homo sapiens
gcctcctgagtagctgggattg

SEQ ID NO: 69086 - DNA, 22 bp, Homo sapiens
gcccaggctggagtgcagtggc

SEQ ID NO: 69087 - DNA, 22 bp, Homo sapiens
gggccaccccactgcccacgct

SEQ ID NO: 69088 - DNA, 22 bp, Homo sapiens
ctacccttaagtttctgtgggg

SEQ ID NO: 69089 - DNA, 22 bp, Homo sapiens
ggcttagcaactcctgaggctc

SEQ ID NO: 69090 - DNA, 16 bp, Homo sapiens
tgggtgggaggagcgg

SEQ ID NO: 69091 - DNA, 22 bp, Homo sapiens
ctcctctttagccccagctgga

SEQ ID NO: 69092 - DNA, 22 bp, Homo sapiens
tttggaaatgaccccgtctaag

SEQ ID NO: 69093 - DNA, 20 bp, Homo sapiens
tgcagcacgggccctttcca

SEQ ID NO: 69094 - DNA, 22 bp, Homo sapiens
tactcttttagccccacagaga

SEQ ID NO: 69095 - DNA, 22 bp, Homo sapiens
tgagaactgcctgtatttatct

SEQ ID NO: 69096 - DNA, 22 bp, Homo sapiens
tttaatcaggcaaagcataata

SEQ ID NO: 69097 - DNA, 22 bp, Homo sapiens
agtcaaagatgaccgagttcct

SEQ ID NO: 69098 - DNA, 20 bp, Homo sapiens
ctgtaactgtcccttttgcc

SEQ ID NO: 69099 - DNA, 20 bp, Homo sapiens
agacagtgtggagattcctt

SEQ ID NO: 69100 - DNA, 22 bp, Homo sapiens
ttgcttgagacttaagaggtca

SEQ ID NO: 69101 - DNA, 22 bp, Homo sapiens
gcctggagaaaggaaggtggga

SEQ ID NO: 69102 - DNA, 22 bp, Homo sapiens
ttcttctaaatgtgcttattaa

SEQ ID NO: 69103 - DNA, 22 bp, Homo sapiens
gggcttggcacatgggctcagc

SEQ ID NO: 69104 - DNA, 22 bp, Homo sapiens
ggtcgggcactctccagggctg

SEQ ID NO: 69105 - DNA, 22 bp, Homo sapiens
agaagccaccagctgaggaaga

SEQ ID NO: 69106 - DNA, 22 bp, Homo sapiens
tctgtagcttcttgagaggcca

SEQ ID NO: 69107 - DNA, 22 bp, Homo sapiens
gcagttaaaaataaaccttcat

SEQ ID NO: 69108 - DNA, 22 bp, Homo sapiens
gcagctcaaaggccacggacgg

SEQ ID NO: 69109 - DNA, 22 bp, Homo sapiens
cactaggcgccgggtggctgtg

SEQ ID NO: 69110 - DNA, 22 bp, Homo sapiens
ctgcatccatgttgctgcaaag

SEQ ID NO: 69111 - DNA, 22 bp, Homo sapiens
cagaagactgcagggaagggac

SEQ ID NO: 69112 - DNA, 22 bp, Homo sapiens
tgggcccgcgcaaaggactcca

SEQ ID NO: 69113 - DNA, 22 bp, Homo sapiens
tgcatggacgtgacttggccaa

SEQ ID NO: 69114 - DNA, 22 bp, Homo sapiens
aaggccttgccgaaggatgcca

SEQ ID NO: 69115 - DNA, 22 bp, Homo sapiens
tctggctccaggaccgggcaca

SEQ ID NO: 69116 - DNA, 22 bp, Homo sapiens
cagggcctcctaaggcatctaa

SEQ ID NO: 69117 - DNA, 22 bp, Homo sapiens
acccagggctcaagcgtaggca

SEQ ID NO: 69118 - DNA, 22 bp, Homo sapiens
ttctagtgtccttggacttgct

SEQ ID NO: 69119 - DNA, 22 bp, Homo sapiens
ttccacaatggttaagctcgtt

SEQ ID NO: 69120 - DNA, 22 bp, Homo sapiens
aacctgggcttgaacagtgcct

SEQ ID NO: 69121 - DNA, 22 bp, Homo sapiens
gctgtgtatcagatgccacggg

SEQ ID NO: 69122 - DNA, 22 bp, Homo sapiens
tgggggtgtcctggtgcacaca

SEQ ID NO: 69123 - DNA, 22 bp, Homo sapiens
tttgctgctgtatatggagccc

SEQ ID NO: 69124 - DNA, 22 bp, Homo sapiens
tgatgtggccccacttagctgt

SEQ ID NO: 69125 - DNA, 22 bp, Homo sapiens
caggctggagtacaattgtgtg

SEQ ID NO: 69126 - DNA, 22 bp, Homo sapiens
tgccaccccggaccccgaagtg

SEQ ID NO: 69127 - DNA, 22 bp, Homo sapiens
tgagctgacacccaatcatact

SEQ ID NO: 69128 - DNA, 22 bp, Homo sapiens
tctgtgcctgcttccccaccca

SEQ ID NO: 69129 - DNA, 22 bp, Homo sapiens
tggcaaaatgagcaattacttt

SEQ ID NO: 69130 - DNA, 22 bp, Homo sapiens
actgcacttcaccctgggtgac

SEQ ID NO: 69131 - DNA, 19 bp, Homo sapiens
tcctgcccaccagccaggg

SEQ ID NO: 69132 - DNA, 22 bp, Homo sapiens
acgtgcaggatctggttggcga

SEQ ID NO: 69133 - DNA, 22 bp, Homo sapiens
aggagggagcttaagccaggca

SEQ ID NO: 69134 - DNA, 17 bp, Homo sapiens
tggtccaggtggagcca

SEQ ID NO: 69135 - DNA, 22 bp, Homo sapiens
ggagtgcggtggcaccatctca

SEQ ID NO: 69136 - DNA, 22 bp, Homo sapiens
cttctcggggttcccgcgccct

SEQ ID NO: 69137 - DNA, 22 bp, Homo sapiens
acagttaattgttgttgggtgt

SEQ ID NO: 69138 - DNA, 22 bp, Homo sapiens
tcagaattgtggagaaagggga

SEQ ID NO: 69139 - DNA, 22 bp, Homo sapiens
tgaagaaacgcagagaggtagg

SEQ ID NO: 69140 - DNA, 20 bp, Homo sapiens
tttctgtgagaaacactgtt

SEQ ID NO: 69141 - DNA, 22 bp, Homo sapiens
tgggagaaagaaccctgagtga

SEQ ID NO: 69142 - DNA, 22 bp, Homo sapiens
gtctccccagggccctcttcat

SEQ ID NO: 69143 - DNA, 22 bp, Homo sapiens
gaatatcccgctatgcaaagta

SEQ ID NO: 69144 - DNA, 22 bp, Homo sapiens
ggaggagcatgagagggtagtg

SEQ ID NO: 69145 - DNA, 22 bp, Homo sapiens
tgggtgagcggctgcacacccg

SEQ ID NO: 69146 - DNA, 22 bp, Homo sapiens
cttctcttcctttgtcaactga

SEQ ID NO: 69147 - DNA, 20 bp, Homo sapiens
tggcctctgagatgccacgg

SEQ ID NO: 69148 - DNA, 23 bp, Homo sapiens
caccactttctccttctccttgg

SEQ ID NO: 69149 - DNA, 22 bp, Homo sapiens
gagtgccttccccatgctttgg

SEQ ID NO: 69150 - DNA, 22 bp, Homo sapiens
tctgcaacattcctctccccac

SEQ ID NO: 69151 - DNA, 22 bp, Homo sapiens
tttcataatactgtacatgaaa

SEQ ID NO: 69152 - DNA, 22 bp, Homo sapiens
ggctgagttgagaggattactt

SEQ ID NO: 69153 - DNA, 22 bp, Homo sapiens
cccaggggttctgagcagcagc

SEQ ID NO: 69154 - DNA, 22 bp, Homo sapiens
aggccagcctcaggcagggacc

SEQ ID NO: 69155 - DNA, 22 bp, Homo sapiens
gtctcttagaaccttgttttgg

SEQ ID NO: 69156 - DNA, 22 bp, Homo sapiens
taggatttaataaaagaataga

SEQ ID NO: 69157 - DNA, 22 bp, Homo sapiens
ggtgcagaggagccagctgggg

SEQ ID NO: 69158 - DNA, 22 bp, Homo sapiens
tatgatagttttttaaatgtcc

SEQ ID NO: 69159 - DNA, 22 bp, Homo sapiens
agcataagttggtacagccact

SEQ ID NO: 69160 - DNA, 22 bp, Homo sapiens
ctccaggctcgtccaagatcga

SEQ ID NO: 69161 - DNA, 22 bp, Homo sapiens
cccagcgagtttgccggtgaac

SEQ ID NO: 69162 - DNA, 22 bp, Homo sapiens
ttttctcttccctctggacctg

SEQ ID NO: 69163 - DNA, 22 bp, Homo sapiens
agacccaggattggggctgccg

SEQ ID NO: 69164 - DNA, 22 bp, Homo sapiens
aggtcacccgtttgactatcca

SEQ ID NO: 69165 - DNA, 22 bp, Homo sapiens
gggctgtaggagctggaatggg

SEQ ID NO: 69166 - DNA, 22 bp, Homo sapiens
ggacattgaagctggaaaggga

SEQ ID NO: 69167 - DNA, 22 bp, Homo sapiens
tgggaggccaaggcaggcggat

SEQ ID NO: 69168 - DNA, 21 bp, Homo sapiens
tcgtgcagcagctgaggcttg

SEQ ID NO: 69169 - DNA, 22 bp, Homo sapiens
actagaaagaagttttttgaga

SEQ ID NO: 69170 - DNA, 22 bp, Homo sapiens
ctcaggagttggaggctacagt

SEQ ID NO: 69171 - DNA, 22 bp, Homo sapiens
atggtggacgggagacaggact

SEQ ID NO: 69172 - DNA, 22 bp, Homo sapiens
cagcagcattgctctggattcc

SEQ ID NO: 69173 - DNA, 22 bp, Homo sapiens
agtggctttgttccgtatggca

SEQ ID NO: 69174 - DNA, 22 bp, Homo sapiens
gcctcctgtcccaggctgagga

SEQ ID NO: 69175 - DNA, 22 bp, Homo sapiens
cgcggtggcggcctccagcgcc

SEQ ID NO: 69176 - DNA, 22 bp, Homo sapiens
tgctgggctggggcctcagacc

SEQ ID NO: 69177 - DNA, 22 bp, Homo sapiens
tttatagcagcatgatttatag

SEQ ID NO: 69178 - DNA, 22 bp, Homo sapiens
agcttgggcaacacagcaagac

SEQ ID NO: 69179 - DNA, 22 bp, Homo sapiens
agtgcattcctggggaagaagc

SEQ ID NO: 69180 - DNA, 22 bp, Homo sapiens
ggctccctgcaacctccgcctc

SEQ ID NO: 69181 - DNA, 22 bp, Homo sapiens
cgccggcttgaggcaggcggca

SEQ ID NO: 69182 - DNA, 22 bp, Homo sapiens
ccgggctggagtgcaatggctc

SEQ ID NO: 69183 - DNA, 22 bp, Homo sapiens
tttgctggagatgagcgtgggt

SEQ ID NO: 69184 - DNA, 22 bp, Homo sapiens
gcgccccatctacagtactttt

SEQ ID NO: 69185 - DNA, 22 bp, Homo sapiens
cggggacacactggcagctcct

SEQ ID NO: 69186 - DNA, 22 bp, Homo sapiens
atttcccagggcctgggatttg

SEQ ID NO: 69187 - DNA, 22 bp, Homo sapiens
cgccgcctgctgcagcagctgt

SEQ ID NO: 69188 - DNA, 22 bp, Homo sapiens
tgatttacagtagtgtctaaac

SEQ ID NO: 69189 - DNA, 22 bp, Homo sapiens
cagccccatggtgtgctccagc

SEQ ID NO: 69190 - DNA, 22 bp, Homo sapiens
ggcctgcctcacagtcagcacc

SEQ ID NO: 69191 - DNA, 22 bp, Homo sapiens
aacagaatgcaggggatgctgc

SEQ ID NO: 69192 - DNA, 22 bp, Homo sapiens
ctgctgagagccccagctgaga

SEQ ID NO: 69193 - DNA, 22 bp, Homo sapiens
tccagaatcaatagcagttatc

SEQ ID NO: 69194 - DNA, 22 bp, Homo sapiens
acaactttgacccttgttctta

SEQ ID NO: 69195 - DNA, 22 bp, Homo sapiens
catataaatacaacatgtgtta

SEQ ID NO: 69196 - DNA, 19 bp, Homo sapiens
agggaatccggctgaggga

SEQ ID NO: 69197 - DNA, 22 bp, Homo sapiens
cagagatgtgatccagctgtct

SEQ ID NO: 69198 - DNA, 22 bp, Homo sapiens
cccaggggttcaaggctgcagt

SEQ ID NO: 69199 - DNA, 22 bp, Homo sapiens
atgcccaatgtcacaatttttg

SEQ ID NO: 69200 - DNA, 22 bp, Homo sapiens
ctggagggtggagagaagtctc

SEQ ID NO: 69201 - DNA, 22 bp, Homo sapiens
gagtctctgaccagggtgccaa

SEQ ID NO: 69202 - DNA, 22 bp, Homo sapiens
tacaccattcccaggtggattt

SEQ ID NO: 69203 - DNA, 22 bp, Homo sapiens
aaaggtcaaaatcgtgacattg

SEQ ID NO: 69204 - DNA, 22 bp, Homo sapiens
aaatcgcttgaacccaggaagt

SEQ ID NO: 69205 - DNA, 22 bp, Homo sapiens
ctccaacgaggctggggtacaa

SEQ ID NO: 69206 - DNA, 22 bp, Homo sapiens
gggtaaatctcttttcatggct

SEQ ID NO: 69207 - DNA, 18 bp, Homo sapiens
cccggctaatttttggta

SEQ ID NO: 69208 - DNA, 22 bp, Homo sapiens
gcccaggctggagttcagtggt

SEQ ID NO: 69209 - DNA, 22 bp, Homo sapiens
aagctgcagcacagagaggtgg

SEQ ID NO: 69210 - DNA, 22 bp, Homo sapiens
aggcaagggggcgccaccttcc

SEQ ID NO: 69211 - DNA, 22 bp, Homo sapiens
tggctgagttacgaacagagca

SEQ ID NO: 69212 - DNA, 22 bp, Homo sapiens
ggcaaggggtcaggctgagaca

SEQ ID NO: 69213 - DNA, 22 bp, Homo sapiens
attgcactccagcctgggggac

SEQ ID NO: 69214 - DNA, 22 bp, Homo sapiens
tggcacagactgggccaaggaa

SEQ ID NO: 69215 - DNA, 22 bp, Homo sapiens
tgagcttccctcctgcactaca

SEQ ID NO: 69216 - DNA, 22 bp, Homo sapiens
cgtctaggccgtgccctgaggt

SEQ ID NO: 69217 - DNA, 22 bp, Homo sapiens
aggagctgtcagagtgccagag

SEQ ID NO: 69218 - DNA, 22 bp, Homo sapiens
gggctgcatcagcaggacccgg

SEQ ID NO: 69219 - DNA, 22 bp, Homo sapiens
aactcactttgtggcttctgaa

SEQ ID NO: 69220 - DNA, 22 bp, Homo sapiens
catgggtaagactcttttgccc

SEQ ID NO: 69221 - DNA, 22 bp, Homo sapiens
tccttgccctaaatgtctgtgt

SEQ ID NO: 69222 - DNA, 22 bp, Homo sapiens
ttcagagaattggataattcgt

SEQ ID NO: 69223 - DNA, 22 bp, Homo sapiens
ccaggaggcggaggttgcagcg

SEQ ID NO: 69224 - DNA, 22 bp, Homo sapiens
gcccgcgccagcctctccatct

SEQ ID NO: 69225 - DNA, 22 bp, Homo sapiens
ctagggtgtgcagattttgcct

SEQ ID NO: 69226 - DNA, 22 bp, Homo sapiens
gctctagtaggaatgtccctct

SEQ ID NO: 69227 - DNA, 22 bp, Homo sapiens
cctgtatggctattccttggac

SEQ ID NO: 69228 - DNA, 22 bp, Homo sapiens
agtggcaggatctcggttcact

SEQ ID NO: 69229 - DNA, 21 bp, Homo sapiens
tctgccagctgaagaggtgga

SEQ ID NO: 69230 - DNA, 22 bp, Homo sapiens
ttcttctcagggtcccacatgg

SEQ ID NO: 69231 - DNA, 22 bp, Homo sapiens
ggatgttgattgaatggccatt

SEQ ID NO: 69232 - DNA, 22 bp, Homo sapiens
ggagaggcttccagagtcgtgc

SEQ ID NO: 69233 - DNA, 22 bp, Homo sapiens
tcctgggccctccggatcaggt

SEQ ID NO: 69234 - DNA, 22 bp, Homo sapiens
tctcatggagtcaggagcagaa

SEQ ID NO: 69235 - DNA, 22 bp, Homo sapiens
agcaggaaggggatgatgggca

SEQ ID NO: 69236 - DNA, 19 bp, Homo sapiens
ccagagagctaggtacaga

SEQ ID NO: 69237 - DNA, 22 bp, Homo sapiens
cctgtggcgggggccagtgcct

SEQ ID NO: 69238 - DNA, 22 bp, Homo sapiens
attgaaaataaggccagaaaca

SEQ ID NO: 69239 - DNA, 22 bp, Homo sapiens
cactcagctgagccctcagccc

SEQ ID NO: 69240 - DNA, 22 bp, Homo sapiens
atacataattacttccgatgtt

SEQ ID NO: 69241 - DNA, 21 bp, Homo sapiens
gggcctggctgcgcaggacgg

SEQ ID NO: 69242 - DNA, 22 bp, Homo sapiens
ttaccacagtgcctgtctaatg

SEQ ID NO: 69243 - DNA, 22 bp, Homo sapiens
tcacatctaattccatttctgc

SEQ ID NO: 69244 - DNA, 22 bp, Homo sapiens
tagatctgatacaattcatctg

SEQ ID NO: 69245 - DNA, 22 bp, Homo sapiens
ttctcaaagtgtgctccctgga

SEQ ID NO: 69246 - DNA, 22 bp, Homo sapiens
agccggccatgtggtcttgtgc

SEQ ID NO: 69247 - DNA, 22 bp, Homo sapiens
gttgtgaatagtgccgcaataa

SEQ ID NO: 69248 - DNA, 22 bp, Homo sapiens
atgctaaggcccaggagaaaat

SEQ ID NO: 69249 - DNA, 22 bp, Homo sapiens
aataaaatggtcagttttctca

SEQ ID NO: 69250 - DNA, 22 bp, Homo sapiens
acagcgccgattctccggggct

SEQ ID NO: 69251 - DNA, 22 bp, Homo sapiens
tttggcggggcaattctgaagc

SEQ ID NO: 69252 - DNA, 19 bp, Homo sapiens
gcataaatacactattgtc

SEQ ID NO: 69253 - DNA, 22 bp, Homo sapiens
ctgctctgctgatcagtgtctc

SEQ ID NO: 69254 - DNA, 22 bp, Homo sapiens
aggctgtgtggataatattggg

SEQ ID NO: 69255 - DNA, 22 bp, Homo sapiens
ctcttagtaatgccatgaagca

SEQ ID NO: 69256 - DNA, 22 bp, Homo sapiens
acgggccttctcttcaggcgag

SEQ ID NO: 69257 - DNA, 22 bp, Homo sapiens
gcccagctgcaccctggtgggt

SEQ ID NO: 69258 - DNA, 22 bp, Homo sapiens
gccctcctgagctagcacgtgt

SEQ ID NO: 69259 - DNA, 22 bp, Homo sapiens
ggtggcagtagcactgggcctg

SEQ ID NO: 69260 - DNA, 22 bp, Homo sapiens
ttgttccaacctaatagatgat

SEQ ID NO: 69261 - DNA, 22 bp, Homo sapiens
tctttcattctagtctgaggtt

SEQ ID NO: 69262 - DNA, 22 bp, Homo sapiens
ggcggtctcagcaccctcttgg

SEQ ID NO: 69263 - DNA, 22 bp, Homo sapiens
gggcagagagctggaactcctt

SEQ ID NO: 69264 - DNA, 22 bp, Homo sapiens
gtccaagagtcaagaagggggc

SEQ ID NO: 69265 - DNA, 22 bp, Homo sapiens
agtgaaaacctaatcatgcagt

SEQ ID NO: 69266 - DNA, 22 bp, Homo sapiens
gccaggctgaggctctggaaga

SEQ ID NO: 69267 - DNA, 22 bp, Homo sapiens
tcatggcttttattatgttgag

SEQ ID NO: 69268 - DNA, 22 bp, Homo sapiens
ccagcttgctcctctgcaatgg

SEQ ID NO: 69269 - DNA, 22 bp, Homo sapiens
gctggagaggatcccaaagcca

SEQ ID NO: 69270 - DNA, 22 bp, Homo sapiens
ttatagcagcatgatttataat

SEQ ID NO: 69271 - DNA, 22 bp, Homo sapiens
tgctccagcaccaagagctcca

SEQ ID NO: 69272 - DNA, 22 bp, Homo sapiens
actgcgctccagcctgggtgac

SEQ ID NO: 69273 - DNA, 22 bp, Homo sapiens
cttttcattgtttgtacatgca

SEQ ID NO: 69274 - DNA, 22 bp, Homo sapiens
ccgcccacactaaatatgagcg

SEQ ID NO: 69275 - DNA, 22 bp, Homo sapiens
tataaagagtctcaaagaagtt

SEQ ID NO: 69276 - DNA, 22 bp, Homo sapiens
ctgcactgacttccccggctgc

SEQ ID NO: 69277 - DNA, 22 bp, Homo sapiens
gctgagtacatatgatgcatca

SEQ ID NO: 69278 - DNA, 22 bp, Homo sapiens
agaagcagaaactgggcttgtg

SEQ ID NO: 69279 - DNA, 22 bp, Homo sapiens
tttctggcagcgggacaggggt

SEQ ID NO: 69280 - DNA, 22 bp, Homo sapiens
atgttggccaggctggtcttga

SEQ ID NO: 69281 - DNA, 22 bp, Homo sapiens
gctaggagtggtgggtcaagga

SEQ ID NO: 69282 - DNA, 22 bp, Homo sapiens
ggggtggatttcaggcggtgtc

SEQ ID NO: 69283 - DNA, 22 bp, Homo sapiens
tgtgggtggcatcgtcctggcc

SEQ ID NO: 69284 - DNA, 22 bp, Homo sapiens
gcagcctcaaactccccagctc

SEQ ID NO: 69285 - DNA, 22 bp, Homo sapiens
tgctgggggtagctctgcgtag

SEQ ID NO: 69286 - DNA, 22 bp, Homo sapiens
aagaaatgtgaatattgaatag

SEQ ID NO: 69287 - DNA, 22 bp, Homo sapiens
aggggtgaaagagggccctcaa

SEQ ID NO: 69288 - DNA, 22 bp, Homo sapiens
aaggtgggtggatcacgaggtc

SEQ ID NO: 69289 - DNA, 22 bp, Homo sapiens
agtattctggaattctatgtga

SEQ ID NO: 69290 - DNA, 22 bp, Homo sapiens
ttcctttctctggactgcagcc

SEQ ID NO: 69291 - DNA, 17 bp, Homo sapiens
acttcccacccctccag

SEQ ID NO: 69292 - DNA, 22 bp, Homo sapiens
gtgcaattcactgttatgtctg

SEQ ID NO: 69293 - DNA, 22 bp, Homo sapiens
gtcgtggagctcacagtgtgcc

SEQ ID NO: 69294 - DNA, 22 bp, Homo sapiens
atgttgtgtttgactgttaccc

SEQ ID NO: 69295 - DNA, 22 bp, Homo sapiens
gcctccggagtcacagtgtctt

SEQ ID NO: 69296 - DNA, 22 bp, Homo sapiens
cgccccggacgtctgaccaaac

SEQ ID NO: 69297 - DNA, 22 bp, Homo sapiens
tagagctggccgggacagctgg

SEQ ID NO: 69298 - DNA, 22 bp, Homo sapiens
gccgtgcgtgcgcaggtgctgt

SEQ ID NO: 69299 - DNA, 22 bp, Homo sapiens
ggctcactgcaacttccgcctc

SEQ ID NO: 69300 - DNA, 22 bp, Homo sapiens
ttttctaacatctagtaatttg

SEQ ID NO: 69301 - DNA, 22 bp, Homo sapiens
tcaccaggctggagtgcagtgg

SEQ ID NO: 69302 - DNA, 22 bp, Homo sapiens
ggccctgggccctctagcttgt

SEQ ID NO: 69303 - DNA, 22 bp, Homo sapiens
gaggggtccaggaggcacttac

SEQ ID NO: 69304 - DNA, 23 bp, Homo sapiens
aaacttgctatggctgaaatcat

SEQ ID NO: 69305 - DNA, 22 bp, Homo sapiens
aactagaaaaagactttctgag

SEQ ID NO: 69306 - DNA, 22 bp, Homo sapiens
ctgcttctagcaccaagtccct

SEQ ID NO: 69307 - DNA, 22 bp, Homo sapiens
tcctagttctctgccagtcgct

SEQ ID NO: 69308 - DNA, 22 bp, Homo sapiens
gtcaggactctgacccgtcccg

SEQ ID NO: 69309 - DNA, 22 bp, Homo sapiens
ggtcccatgactgacacagcag

SEQ ID NO: 69310 - DNA, 22 bp, Homo sapiens
tcacgtgagggacctgtgtctg

SEQ ID NO: 69311 - DNA, 22 bp, Homo sapiens
ccttggttgtgcttcaacttct

SEQ ID NO: 69312 - DNA, 22 bp, Homo sapiens
tcaaatgttccctgtactggcc

SEQ ID NO: 69313 - DNA, 22 bp, Homo sapiens
cttatcagattatctgggctgt

SEQ ID NO: 69314 - DNA, 18 bp, Homo sapiens
tcaagtgattctcctgcc

SEQ ID NO: 69315 - DNA, 22 bp, Homo sapiens
taatggttttttggagactgct

SEQ ID NO: 69316 - DNA, 22 bp, Homo sapiens
gctgatggaaggacaggcgccg

SEQ ID NO: 69317 - DNA, 22 bp, Homo sapiens
ctgggatccacgggctcccaag

SEQ ID NO: 69318 - DNA, 22 bp, Homo sapiens
tcttagaaattccccagtggct

SEQ ID NO: 69319 - DNA, 22 bp, Homo sapiens
gcacttgtggatttgatataca

SEQ ID NO: 69320 - DNA, 22 bp, Homo sapiens
gtggcatgaaagcatctgtgat

SEQ ID NO: 69321 - DNA, 22 bp, Homo sapiens
tgagcctgagttcaaggctgca

SEQ ID NO: 69322 - DNA, 22 bp, Homo sapiens
aggacttagaacattatgtact

SEQ ID NO: 69323 - DNA, 22 bp, Homo sapiens
cgggcaaggcgagactaggccc

SEQ ID NO: 69324 - DNA, 22 bp, Homo sapiens
ggaaggcagaggtgtcgtgggg

SEQ ID NO: 69325 - DNA, 21 bp, Homo sapiens
tgcaatccagcctgggcgaca

SEQ ID NO: 69326 - DNA, 22 bp, Homo sapiens
gccgcggcactggcctggctcc

SEQ ID NO: 69327 - DNA, 21 bp, Homo sapiens
tggtaggtactggcttcaggc

SEQ ID NO: 69328 - DNA, 22 bp, Homo sapiens
gtggcctggctggcaccacctc

SEQ ID NO: 69329 - DNA, 22 bp, Homo sapiens
agctgtcaccaggagccggacc

SEQ ID NO: 69330 - DNA, 22 bp, Homo sapiens
ttgtaacaggtactaaataact

SEQ ID NO: 69331 - DNA, 22 bp, Homo sapiens
agaggctgcacttgctcatgat

SEQ ID NO: 69332 - DNA, 22 bp, Homo sapiens
tgatctcctgaccttgtaatcc

SEQ ID NO: 69333 - DNA, 18 bp, Homo sapiens
ctgccagtgtgctctccg

SEQ ID NO: 69334 - DNA, 22 bp, Homo sapiens
attgcactccggcctgggtgac

SEQ ID NO: 69335 - DNA, 19 bp, Homo sapiens
ctgctgccggagactcgtc

SEQ ID NO: 69336 - DNA, 22 bp, Homo sapiens
aaaatcttgtgacttaggaagg

SEQ ID NO: 69337 - DNA, 22 bp, Homo sapiens
cgttttcatgggtagaggttct

SEQ ID NO: 69338 - DNA, 22 bp, Homo sapiens
gtgtggctgaaatcaaggcagg

SEQ ID NO: 69339 - DNA, 22 bp, Homo sapiens
acatgtttaagtttgttatatg

SEQ ID NO: 69340 - DNA, 22 bp, Homo sapiens
aggtggggaggagtgtctcttt

SEQ ID NO: 69341 - DNA, 22 bp, Homo sapiens
cccgagtgtctactcactccca

SEQ ID NO: 69342 - DNA, 22 bp, Homo sapiens
ctgtccctgagcaactcctgtt

SEQ ID NO: 69343 - DNA, 22 bp, Homo sapiens
tgaagctacagaccttcgcggt

SEQ ID NO: 69344 - DNA, 22 bp, Homo sapiens
agcagctcctgtttttgggata

SEQ ID NO: 69345 - DNA, 22 bp, Homo sapiens
gccagtggtcactgaggaagaa

SEQ ID NO: 69346 - DNA, 17 bp, Homo sapiens
aggcgagaggaacatag

SEQ ID NO: 69347 - DNA, 22 bp, Homo sapiens
tcctgggtccatggcagccgaa

SEQ ID NO: 69348 - DNA, 22 bp, Homo sapiens
tctgctctgtggcttcagctaa

SEQ ID NO: 69349 - DNA, 22 bp, Homo sapiens
ctcgcggcgcccgaagcccttg

SEQ ID NO: 69350 - DNA, 22 bp, Homo sapiens
aggccttaccatagctgtagca

SEQ ID NO: 69351 - DNA, 22 bp, Homo sapiens
acactgcagatgaaagcataag

SEQ ID NO: 69352 - DNA, 22 bp, Homo sapiens
cagatgtacatgaagggcaatg

SEQ ID NO: 69353 - DNA, 22 bp, Homo sapiens
gcccagagttcaaggctgcagt

SEQ ID NO: 69354 - DNA, 22 bp, Homo sapiens
tgtccccacctaaatcttatct

SEQ ID NO: 69355 - DNA, 22 bp, Homo sapiens
aggccagcctgcccaaagctgc

SEQ ID NO: 69356 - DNA, 22 bp, Homo sapiens
ggcaggactgatcagtgggatg

SEQ ID NO: 69357 - DNA, 22 bp, Homo sapiens
cggatcctcagtcgtgcgggag

SEQ ID NO: 69358 - DNA, 22 bp, Homo sapiens
cccaggcttttctcttgcccca

SEQ ID NO: 69359 - DNA, 22 bp, Homo sapiens
agttggagtgaacatgagattg

SEQ ID NO: 69360 - DNA, 22 bp, Homo sapiens
tttggaaattttcatccagaca

SEQ ID NO: 69361 - DNA, 22 bp, Homo sapiens
tcacagctctgtcaattttata

SEQ ID NO: 69362 - DNA, 22 bp, Homo sapiens
ctatggtctggaccgaggtcct

SEQ ID NO: 69363 - DNA, 22 bp, Homo sapiens
acttttaaatgagtttcagttg

SEQ ID NO: 69364 - DNA, 22 bp, Homo sapiens
gccgggttcaagccattctcct

SEQ ID NO: 69365 - DNA, 18 bp, Homo sapiens
acacttcctggtggtgtg

SEQ ID NO: 69366 - DNA, 22 bp, Homo sapiens
tggcccagtatgtataatctta

SEQ ID NO: 69367 - DNA, 22 bp, Homo sapiens
aaggaaagctgtggttctgaga

SEQ ID NO: 69368 - DNA, 22 bp, Homo sapiens
tgtcctcatcctccagtctgtc

SEQ ID NO: 69369 - DNA, 22 bp, Homo sapiens
gccaggacctcagatgcagggc

SEQ ID NO: 69370 - DNA, 22 bp, Homo sapiens
gtggccccagggccctgtctgg

SEQ ID NO: 69371 - DNA, 22 bp, Homo sapiens
ggaggcagaatagagtgtgggt

SEQ ID NO: 69372 - DNA, 21 bp, Homo sapiens
gccatttcacacagacatttg

SEQ ID NO: 69373 - DNA, 22 bp, Homo sapiens
ttgcttgaacccaggaagtgga

SEQ ID NO: 69374 - DNA, 22 bp, Homo sapiens
agtccgtcctgtcaagcagctg

SEQ ID NO: 69375 - DNA, 22 bp, Homo sapiens
accctcaagatggaagcagttt

SEQ ID NO: 69376 - DNA, 22 bp, Homo sapiens
gaggctgcagctatcagacatt

SEQ ID NO: 69377 - DNA, 22 bp, Homo sapiens
agtatgtcagagtgaaaatggt

SEQ ID NO: 69378 - DNA, 22 bp, Homo sapiens
agcaagatttttcaggttagta

SEQ ID NO: 69379 - DNA, 22 bp, Homo sapiens
ctgcagtctacctggattttta

SEQ ID NO: 69380 - DNA, 22 bp, Homo sapiens
aagccaggttccatggaggagc

SEQ ID NO: 69381 - DNA, 22 bp, Homo sapiens
tggggagaaatgtctttgttcc

SEQ ID NO: 69382 - DNA, 22 bp, Homo sapiens
agtgagagtattaatgtgaact

SEQ ID NO: 69383 - DNA, 22 bp, Homo sapiens
tgaagttgttaaggttgccatt

SEQ ID NO: 69384 - DNA, 22 bp, Homo sapiens
acatggcaaaaccccgtttcta

SEQ ID NO: 69385 - DNA, 22 bp, Homo sapiens
ccaccagctgcatatgcacgta

SEQ ID NO: 69386 - DNA, 22 bp, Homo sapiens
tttattggatatttacaagata

SEQ ID NO: 69387 - DNA, 22 bp, Homo sapiens
tttgaagactactgggagtgaa

SEQ ID NO: 69388 - DNA, 22 bp, Homo sapiens
aggctctgtcaggcggagcagc

SEQ ID NO: 69389 - DNA, 22 bp, Homo sapiens
aatctgagggaacttgaactcc

SEQ ID NO: 69390 - DNA, 18 bp, Homo sapiens
tgctgatggtccattagt

SEQ ID NO: 69391 - DNA, 22 bp, Homo sapiens
ccggaaggcggaacgtgcagtg

SEQ ID NO: 69392 - DNA, 22 bp, Homo sapiens
cctggctcctacgggtattttg

SEQ ID NO: 69393 - DNA, 22 bp, Homo sapiens
gaccctgtttctacaaataatt

SEQ ID NO: 69394 - DNA, 22 bp, Homo sapiens
agttgctgggaaagatttcagt

SEQ ID NO: 69395 - DNA, 22 bp, Homo sapiens
ccctcccaggagtggccagaga

SEQ ID NO: 69396 - DNA, 22 bp, Homo sapiens
aggctatttccactcttctcat

SEQ ID NO: 69397 - DNA, 22 bp, Homo sapiens
tcagggattgcaaaattcatcc

SEQ ID NO: 69398 - DNA, 22 bp, Homo sapiens
tccaggattgcaggtgcacaac

SEQ ID NO: 69399 - DNA, 22 bp, Homo sapiens
gccacctggtggcatcttctgg

SEQ ID NO: 69400 - DNA, 22 bp, Homo sapiens
tctgggtccgggactgtggatg

SEQ ID NO: 69401 - DNA, 22 bp, Homo sapiens
gtgtggaatggagtttttgccc

SEQ ID NO: 69402 - DNA, 22 bp, Homo sapiens
ggctcctgggggtgctcctgcc

SEQ ID NO: 69403 - DNA, 22 bp, Homo sapiens
ctgaggcaggcagatcacttga

SEQ ID NO: 69404 - DNA, 22 bp, Homo sapiens
tcttgggcatgtgtttgatttc

SEQ ID NO: 69405 - DNA, 22 bp, Homo sapiens
atgtttttaaatagacttacag

SEQ ID NO: 69406 - DNA, 23 bp, Homo sapiens
cccagaccttgtgctgcccttgg

SEQ ID NO: 69407 - DNA, 22 bp, Homo sapiens
cttgtcagccaattgtggattt

SEQ ID NO: 69408 - DNA, 22 bp, Homo sapiens
acgaatcattcacggacaacac

SEQ ID NO: 69409 - DNA, 22 bp, Homo sapiens
tttattctgtgctacatgaaga

SEQ ID NO: 69410 - DNA, 22 bp, Homo sapiens
tcgcaccattgcactccagcca

SEQ ID NO: 69411 - DNA, 23 bp, Homo sapiens
ctgtggtgaggccctagaatctg

SEQ ID NO: 69412 - DNA, 22 bp, Homo sapiens
cctgcctatgagacgttttgcc

SEQ ID NO: 69413 - DNA, 22 bp, Homo sapiens
tgaggcaggtggattacaaggt

SEQ ID NO: 69414 - DNA, 22 bp, Homo sapiens
ttaaatattatgttgtctgcaa

SEQ ID NO: 69415 - DNA, 22 bp, Homo sapiens
ttcacagtggtagtgcatttag

SEQ ID NO: 69416 - DNA, 22 bp, Homo sapiens
tagggcaatatttcccagaaaa

SEQ ID NO: 69417 - DNA, 22 bp, Homo sapiens
tgagaaacttgccaagcatctc

SEQ ID NO: 69418 - DNA, 22 bp, Homo sapiens
ctgagataggactctgctggct

SEQ ID NO: 69419 - DNA, 22 bp, Homo sapiens
tctgccgtgcgaggtcccacca

SEQ ID NO: 69420 - DNA, 22 bp, Homo sapiens
caaagtggaggctctggggcca

SEQ ID NO: 69421 - DNA, 22 bp, Homo sapiens
ggacccaggggtctctctgtcc

SEQ ID NO: 69422 - DNA, 22 bp, Homo sapiens
tactgcattatcaaggggaagg

SEQ ID NO: 69423 - DNA, 22 bp, Homo sapiens
tttgcttgttcaagatttctgt

SEQ ID NO: 69424 - DNA, 22 bp, Homo sapiens
agccctcttccagccagcacag

SEQ ID NO: 69425 - DNA, 22 bp, Homo sapiens
actggacagaggaaatatggag

SEQ ID NO: 69426 - DNA, 22 bp, Homo sapiens
gcccagcccagaaaggttcgga

SEQ ID NO: 69427 - DNA, 22 bp, Homo sapiens
tgcccaggctggagtgcagtgg

SEQ ID NO: 69428 - DNA, 21 bp, Homo sapiens
gaccccagaccagcagacaca

SEQ ID NO: 69429 - DNA, 22 bp, Homo sapiens
gtagcccacctggggagggcga

SEQ ID NO: 69430 - DNA, 22 bp, Homo sapiens
ctggcctcggcagcaggaacag

SEQ ID NO: 69431 - DNA, 22 bp, Homo sapiens
aagcgccatggttcctgcgcag

SEQ ID NO: 69432 - DNA, 22 bp, Homo sapiens
ggtgtctatgattcagtttatg

SEQ ID NO: 69433 - DNA, 22 bp, Homo sapiens
ccaggctggagtgcaatggcgt

SEQ ID NO: 69434 - DNA, 22 bp, Homo sapiens
aggtcaagagtaaatttgggta

SEQ ID NO: 69435 - DNA, 22 bp, Homo sapiens
tgagctgtagcagatgctgttg

SEQ ID NO: 69436 - DNA, 22 bp, Homo sapiens
tgggaagctgcattttaacaag

SEQ ID NO: 69437 - DNA, 22 bp, Homo sapiens
gtgggccactgggaggcaaggg

SEQ ID NO: 69438 - DNA, 22 bp, Homo sapiens
caggaggattgcttgaggccag

SEQ ID NO: 69439 - DNA, 18 bp, Homo sapiens
actctgcggaggccccag

SEQ ID NO: 69440 - DNA, 22 bp, Homo sapiens
ggggtgggcgtgcagggacacc

SEQ ID NO: 69441 - DNA, 22 bp, Homo sapiens
ggcgccagcactgcagcgcctc

SEQ ID NO: 69442 - DNA, 22 bp, Homo sapiens
ggtttattgttaataagtttga

SEQ ID NO: 69443 - DNA, 22 bp, Homo sapiens
cttgaagtggagcttttgaaat

SEQ ID NO: 69444 - DNA, 22 bp, Homo sapiens
cgggagcctctgggtcacactg

SEQ ID NO: 69445 - DNA, 22 bp, Homo sapiens
ggccactgacctacatctgggg

SEQ ID NO: 69446 - DNA, 22 bp, Homo sapiens
ccactattactgtgtggcagtc

SEQ ID NO: 69447 - DNA, 22 bp, Homo sapiens
gattgggggtcaggctcaggtc

SEQ ID NO: 69448 - DNA, 22 bp, Homo sapiens
cagcagcagtggctgcagaaca

SEQ ID NO: 69449 - DNA, 22 bp, Homo sapiens
caggaaggggctcactctggcc

SEQ ID NO: 69450 - DNA, 22 bp, Homo sapiens
tgaggtgccacccaagagcctt

SEQ ID NO: 69451 - DNA, 22 bp, Homo sapiens
gcccagtggtaaaagcaggcct

SEQ ID NO: 69452 - DNA, 22 bp, Homo sapiens
aagccctggacggcccttcccc

SEQ ID NO: 69453 - DNA, 22 bp, Homo sapiens
aatatcatctctcttttctgca

SEQ ID NO: 69454 - DNA, 22 bp, Homo sapiens
tccagcagtccatgtgagacac

SEQ ID NO: 69455 - DNA, 22 bp, Homo sapiens
gaatttcacaaggtgaggataa

SEQ ID NO: 69456 - DNA, 22 bp, Homo sapiens
gccatcatatcccctgtgacct

SEQ ID NO: 69457 - DNA, 22 bp, Homo sapiens
aattcacatccgaccaggtcaa

SEQ ID NO: 69458 - DNA, 22 bp, Homo sapiens
actttatttcctattgcatcca

SEQ ID NO: 69459 - DNA, 22 bp, Homo sapiens
ccagcagagcatggggaggaag

SEQ ID NO: 69460 - DNA, 22 bp, Homo sapiens
aagatgattatgtagattggga

SEQ ID NO: 69461 - DNA, 22 bp, Homo sapiens
tggcacaggatctcagcggcca

SEQ ID NO: 69462 - DNA, 22 bp, Homo sapiens
aaggcaaaagaggtgtcatcac

SEQ ID NO: 69463 - DNA, 22 bp, Homo sapiens
gtgctgacaggagcctggcggt

SEQ ID NO: 69464 - DNA, 22 bp, Homo sapiens
cgcagggccgcgagcgggacca

SEQ ID NO: 69465 - DNA, 22 bp, Homo sapiens
cttatagtatgatgttgagaat

SEQ ID NO: 69466 - DNA, 22 bp, Homo sapiens
gagtccctgctgtcaggtgctg

SEQ ID NO: 69467 - DNA, 22 bp, Homo sapiens
cacccaggctggagtgcagtgg

SEQ ID NO: 69468 - DNA, 22 bp, Homo sapiens
accgggctaatttttgtatctt

SEQ ID NO: 69469 - DNA, 22 bp, Homo sapiens
tgcagattcaaatgaaatgcaa

SEQ ID NO: 69470 - DNA, 22 bp, Homo sapiens
cttgcctacttgtcaaccagca

SEQ ID NO: 69471 - DNA, 22 bp, Homo sapiens
cagatagctgtaaataaatgga

SEQ ID NO: 69472 - DNA, 22 bp, Homo sapiens
agcaactgggctcattttttaa

SEQ ID NO: 69473 - DNA, 20 bp, Homo sapiens
ttggatgtgcatggccgtgc

SEQ ID NO: 69474 - DNA, 22 bp, Homo sapiens
gaaaaggcagagttccggggaa

SEQ ID NO: 69475 - DNA, 22 bp, Homo sapiens
ggccactgctctccagcctggg

SEQ ID NO: 69476 - DNA, 22 bp, Homo sapiens
agggagcaaaggtttcagggtt

SEQ ID NO: 69477 - DNA, 22 bp, Homo sapiens
gtcgatcacctcgtcctccgtg

SEQ ID NO: 69478 - DNA, 22 bp, Homo sapiens
gcctccccaagcagcagggatt

SEQ ID NO: 69479 - DNA, 22 bp, Homo sapiens
ggtgggagccaacacccttctg

SEQ ID NO: 69480 - DNA, 19 bp, Homo sapiens
gactccaactttaagcatg

SEQ ID NO: 69481 - DNA, 22 bp, Homo sapiens
aaggaggttatcccagtggact

SEQ ID NO: 69482 - DNA, 22 bp, Homo sapiens
ttgcctgtgtcagcaggtggaa

SEQ ID NO: 69483 - DNA, 22 bp, Homo sapiens
ctggtctggctacccagcgaat

SEQ ID NO: 69484 - DNA, 22 bp, Homo sapiens
cggcttctgcccattcagtcct

SEQ ID NO: 69485 - DNA, 22 bp, Homo sapiens
gtatttggaaaccaccagtgcc

SEQ ID NO: 69486 - DNA, 22 bp, Homo sapiens
cttcccaccaaagcccttgttg

SEQ ID NO: 69487 - DNA, 22 bp, Homo sapiens
aaacttttttaggttcataggc

SEQ ID NO: 69488 - DNA, 22 bp, Homo sapiens
caggctgctgacaggcttggag

SEQ ID NO: 69489 - DNA, 22 bp, Homo sapiens
tcaccgaggctggagtgcagtg

SEQ ID NO: 69490 - DNA, 22 bp, Homo sapiens
tttgatccgttgctggtgagga

SEQ ID NO: 69491 - DNA, 22 bp, Homo sapiens
agggctggagccacagctggga

SEQ ID NO: 69492 - DNA, 22 bp, Homo sapiens
tttacagcagcatgatttataa

SEQ ID NO: 69493 - DNA, 22 bp, Homo sapiens
ggctgggctccgggagcatgcg

SEQ ID NO: 69494 - DNA, 22 bp, Homo sapiens
ttgtgctcctgtgagaatctag

SEQ ID NO: 69495 - DNA, 22 bp, Homo sapiens
gtcccaaactcctgacctcagg

SEQ ID NO: 69496 - DNA, 19 bp, Homo sapiens
agggttacccgctgccacc

SEQ ID NO: 69497 - DNA, 20 bp, Homo sapiens
aaacgagccatcattctggt

SEQ ID NO: 69498 - DNA, 22 bp, Homo sapiens
attctggacaaggcaagctcct

SEQ ID NO: 69499 - DNA, 23 bp, Homo sapiens
tcaagtaatactcccatcttggc

SEQ ID NO: 69500 - DNA, 22 bp, Homo sapiens
tggaaacacccacgcatgcata

SEQ ID NO: 69501 - DNA, 23 bp, Homo sapiens
gaggtggcaatgagggcagttgg

SEQ ID NO: 69502 - DNA, 22 bp, Homo sapiens
gcccagtagttcaaggttgcag

SEQ ID NO: 69503 - DNA, 22 bp, Homo sapiens
tcactgcaacctccacctcctg

SEQ ID NO: 69504 - DNA, 22 bp, Homo sapiens
gtcagtaggaacctagggtcaa

SEQ ID NO: 69505 - DNA, 22 bp, Homo sapiens
agtgcactggcaccatctcagc

SEQ ID NO: 69506 - DNA, 22 bp, Homo sapiens
ggcagggagtggagactcccta

SEQ ID NO: 69507 - DNA, 23 bp, Homo sapiens
aggcgagctcttctccagcacgt

SEQ ID NO: 69508 - DNA, 23 bp, Homo sapiens
tctctgcatgtcctgagcacatc

SEQ ID NO: 69509 - DNA, 22 bp, Homo sapiens
tgggagtgtaaattagttcaac

SEQ ID NO: 69510 - DNA, 22 bp, Homo sapiens
ttgaaattttaggccttgcaat

SEQ ID NO: 69511 - DNA, 22 bp, Homo sapiens
ctcactgcaatctccgtctccc

SEQ ID NO: 69512 - DNA, 22 bp, Homo sapiens
tgccaggcgtggtggtgcgcac

SEQ ID NO: 69513 - DNA, 21 bp, Homo sapiens
ggagtttttctggaagggact

SEQ ID NO: 69514 - DNA, 22 bp, Homo sapiens
ggctcaatgcaacttctgcctc

SEQ ID NO: 69515 - DNA, 22 bp, Homo sapiens
tcaggaggtccgcccgggaggg

SEQ ID NO: 69516 - DNA, 22 bp, Homo sapiens
actgggctcaagtgattgtcct

SEQ ID NO: 69517 - DNA, 22 bp, Homo sapiens
tatactctgagaaacgtgtcac

SEQ ID NO: 69518 - DNA, 22 bp, Homo sapiens
ccagggtggcgtagatgctggg

SEQ ID NO: 69519 - DNA, 22 bp, Homo sapiens
tatttggtgaatctatggtcag

SEQ ID NO: 69520 - DNA, 22 bp, Homo sapiens
attgataaattgcaatggggct

SEQ ID NO: 69521 - DNA, 22 bp, Homo sapiens
tcgaactcatagtcgtagctgt

SEQ ID NO: 69522 - DNA, 22 bp, Homo sapiens
aatgttgcagagtgattgtcca

SEQ ID NO: 69523 - DNA, 22 bp, Homo sapiens
caggggcggtggctcacgcctg

SEQ ID NO: 69524 - DNA, 22 bp, Homo sapiens
agcaggcctgccacctcggggt

SEQ ID NO: 69525 - DNA, 22 bp, Homo sapiens
gctgaaggcccggaggacaggg

SEQ ID NO: 69526 - DNA, 20 bp, Homo sapiens
gccctcatgtacaggctgga

SEQ ID NO: 69527 - DNA, 22 bp, Homo sapiens
tctgtggcccaagtgatggctg

SEQ ID NO: 69528 - DNA, 22 bp, Homo sapiens
ggtcgctgtgtaggttcagcta

SEQ ID NO: 69529 - DNA, 22 bp, Homo sapiens
gtaggtcagacataagaggaca

SEQ ID NO: 69530 - DNA, 22 bp, Homo sapiens
catgttggtgtgctgcacccgt

SEQ ID NO: 69531 - DNA, 22 bp, Homo sapiens
ctggcaggtggaggttgcagtg

SEQ ID NO: 69532 - DNA, 22 bp, Homo sapiens
ctaaactgctctggggttctaa

SEQ ID NO: 69533 - DNA, 22 bp, Homo sapiens
tggccttgagagatcaaaaggt

SEQ ID NO: 69534 - DNA, 22 bp, Homo sapiens
agcctgcgatcccacctggcct

SEQ ID NO: 69535 - DNA, 23 bp, Homo sapiens
aaataggagtatctggatcatga

SEQ ID NO: 69536 - DNA, 22 bp, Homo sapiens
cagtggctggttagggacagga

SEQ ID NO: 69537 - DNA, 19 bp, Homo sapiens
actggcacacaggggctgc

SEQ ID NO: 69538 - DNA, 22 bp, Homo sapiens
ctggcctaaaaatacagaacaa

SEQ ID NO: 69539 - DNA, 22 bp, Homo sapiens
tggcagtggcgggactcagggc

SEQ ID NO: 69540 - DNA, 22 bp, Homo sapiens
gctcactgcaagctccgcctcc

SEQ ID NO: 69541 - DNA, 22 bp, Homo sapiens
ctgagccaaggggacagtgaca

SEQ ID NO: 69542 - DNA, 22 bp, Homo sapiens
tctgcaccatcgtatgcttaat

SEQ ID NO: 69543 - DNA, 22 bp, Homo sapiens
aaggaggcctggcagatgaaga

SEQ ID NO: 69544 - DNA, 22 bp, Homo sapiens
ggggccttggatctgtgccccg

SEQ ID NO: 69545 - DNA, 22 bp, Homo sapiens
tgtttcttacgtttttagaggc

SEQ ID NO: 69546 - DNA, 22 bp, Homo sapiens
cggccaagccggggccccgaag

SEQ ID NO: 69547 - DNA, 22 bp, Homo sapiens
tacttttcctggaaccactgct

SEQ ID NO: 69548 - DNA, 22 bp, Homo sapiens
tgatttatgcattatactgttg

SEQ ID NO: 69549 - DNA, 22 bp, Homo sapiens
atcggcaagccccacaccgtcc

SEQ ID NO: 69550 - DNA, 22 bp, Homo sapiens
ggagactgatctgagtgataac

SEQ ID NO: 69551 - DNA, 22 bp, Homo sapiens
gcctggcgccgggctgcctgtc

SEQ ID NO: 69552 - DNA, 22 bp, Homo sapiens
tagatgtgttgcctggagttgt

SEQ ID NO: 69553 - DNA, 22 bp, Homo sapiens
acagttaataagtagtaagtca

SEQ ID NO: 69554 - DNA, 22 bp, Homo sapiens
tcttcccagaggaggtgccagc

SEQ ID NO: 69555 - DNA, 22 bp, Homo sapiens
tgaggcactccaggatgctgtt

SEQ ID NO: 69556 - DNA, 22 bp, Homo sapiens
gggcctgctgcaggttcaggat

SEQ ID NO: 69557 - DNA, 22 bp, Homo sapiens
gcgtctgagttgcgggggctca

SEQ ID NO: 69558 - DNA, 15 bp, Homo sapiens
tggcccacccgttga

SEQ ID NO: 69559 - DNA, 22 bp, Homo sapiens
tttaagaagttatgttataaat

SEQ ID NO: 69560 - DNA, 22 bp, Homo sapiens
atgattagttaccttgatttaa

SEQ ID NO: 69561 - DNA, 22 bp, Homo sapiens
gacctggtccttgtactttgaa

SEQ ID NO: 69562 - DNA, 22 bp, Homo sapiens
tatactacgcaccaaacaaagg

SEQ ID NO: 69563 - DNA, 22 bp, Homo sapiens
cactgcaacctccacctcctgg

SEQ ID NO: 69564 - DNA, 22 bp, Homo sapiens
tcttccagatggttctttagct

SEQ ID NO: 69565 - DNA, 22 bp, Homo sapiens
tctctttgcctgctgccatcca

SEQ ID NO: 69566 - DNA, 22 bp, Homo sapiens
gctgggttttcttccgggccta

SEQ ID NO: 69567 - DNA, 22 bp, Homo sapiens
aggaggggttctcgggtgctga

SEQ ID NO: 69568 - DNA, 20 bp, Homo sapiens
ctttaactggaaggctgctt

SEQ ID NO: 69569 - DNA, 22 bp, Homo sapiens
gtccttccacatggccaacttc

SEQ ID NO: 69570 - DNA, 22 bp, Homo sapiens
gcggtcggcagaggggctctgc

SEQ ID NO: 69571 - DNA, 22 bp, Homo sapiens
atttacaggtagaattttaagt

SEQ ID NO: 69572 - DNA, 22 bp, Homo sapiens
attataggcttgagccaccgtg

SEQ ID NO: 69573 - DNA, 22 bp, Homo sapiens
ccagttccagtgctcacatcca

SEQ ID NO: 69574 - DNA, 22 bp, Homo sapiens
ctgtaatcccagctactcggga

SEQ ID NO: 69575 - DNA, 22 bp, Homo sapiens
aaatatcttaggagtatatgag

SEQ ID NO: 69576 - DNA, 22 bp, Homo sapiens
ataatacatggttgatcttttc

SEQ ID NO: 69577 - DNA, 22 bp, Homo sapiens
aggtacatggggtgtgtgcacg

SEQ ID NO: 69578 - DNA, 22 bp, Homo sapiens
tagcagtgtctaggtaggccat

SEQ ID NO: 69579 - DNA, 22 bp, Homo sapiens
ttcaatatgatattagctgtgg

SEQ ID NO: 69580 - DNA, 22 bp, Homo sapiens
tgtccttatctccaaacaatca

SEQ ID NO: 69581 - DNA, 22 bp, Homo sapiens
atgttcatatccccattctgat

SEQ ID NO: 69582 - DNA, 22 bp, Homo sapiens
tggggccatctcacccactgtt

SEQ ID NO: 69583 - DNA, 22 bp, Homo sapiens
gttccaggtggtcacagagctc

SEQ ID NO: 69584 - DNA, 22 bp, Homo sapiens
gagtggggggtccgtctcagtg

SEQ ID NO: 69585 - DNA, 23 bp, Homo sapiens
ggatggacgtgatgccttagcca

SEQ ID NO: 69586 - DNA, 22 bp, Homo sapiens
tgggagcagcctcagcttcggg

SEQ ID NO: 69587 - DNA, 22 bp, Homo sapiens
cccaggccccagggcttgtcag

SEQ ID NO: 69588 - DNA, 21 bp, Homo sapiens
gggcactgaaagggaatagca

SEQ ID NO: 69589 - DNA, 22 bp, Homo sapiens
aacagaatattttgcctttctc

SEQ ID NO: 69590 - DNA, 22 bp, Homo sapiens
cagcgtctcgttgtgggcctcg

SEQ ID NO: 69591 - DNA, 22 bp, Homo sapiens
tctgcgttgctcacgctgggag

SEQ ID NO: 69592 - DNA, 22 bp, Homo sapiens
tgtggggatcttctagcttttc

SEQ ID NO: 69593 - DNA, 22 bp, Homo sapiens
caatttgccctgttaaattttc

SEQ ID NO: 69594 - DNA, 22 bp, Homo sapiens
caggaagaccagggctgtggct

SEQ ID NO: 69595 - DNA, 22 bp, Homo sapiens
tgtcttcgctacaatgaaaagg

SEQ ID NO: 69596 - DNA, 22 bp, Homo sapiens
agcgctgtgggcgtgcgaggag

SEQ ID NO: 69597 - DNA, 22 bp, Homo sapiens
agggatggagtgcggcccggac

SEQ ID NO: 69598 - DNA, 22 bp, Homo sapiens
aacccgggaggcggaggttgtg

SEQ ID NO: 69599 - DNA, 22 bp, Homo sapiens
gccctgagaagaagtcggaggg

SEQ ID NO: 69600 - DNA, 22 bp, Homo sapiens
gagctgagaagcagcgcttgat

SEQ ID NO: 69601 - DNA, 22 bp, Homo sapiens
ctggagtagccggacgggtctg

SEQ ID NO: 69602 - DNA, 22 bp, Homo sapiens
agtccgtggccagactcaagag

SEQ ID NO: 69603 - DNA, 22 bp, Homo sapiens
acagtctgtcccccaggtgcta

SEQ ID NO: 69604 - DNA, 22 bp, Homo sapiens
agggtggcactggtggctctat

SEQ ID NO: 69605 - DNA, 22 bp, Homo sapiens
cttgtagaattgaaatggtctc

SEQ ID NO: 69606 - DNA, 22 bp, Homo sapiens
tgctggaagggtcggcgtgggc

SEQ ID NO: 69607 - DNA, 22 bp, Homo sapiens
gggtccagtagttggtggccgt

SEQ ID NO: 69608 - DNA, 22 bp, Homo sapiens
gctgcagtgagccaagatcgtg

SEQ ID NO: 69609 - DNA, 22 bp, Homo sapiens
tgggaagaggagcactggaatg

SEQ ID NO: 69610 - DNA, 22 bp, Homo sapiens
aggcttcaggtttgctttgcag

SEQ ID NO: 69611 - DNA, 22 bp, Homo sapiens
agacacttcatgtaagtggaat

SEQ ID NO: 69612 - DNA, 22 bp, Homo sapiens
cctcgacctccccaggctcagg

SEQ ID NO: 69613 - DNA, 22 bp, Homo sapiens
aagaggttgtacctaaagtgtt

SEQ ID NO: 69614 - DNA, 22 bp, Homo sapiens
tgcacgtgtgagcattcacatg

SEQ ID NO: 69615 - DNA, 22 bp, Homo sapiens
atgtttaaagggttgagaaata

SEQ ID NO: 69616 - DNA, 21 bp, Homo sapiens
acacaagcactcgtacatacg

SEQ ID NO: 69617 - DNA, 22 bp, Homo sapiens
cgcgctctccttctggcaccca

SEQ ID NO: 69618 - DNA, 22 bp, Homo sapiens
tgtatatacacactcccatgtt

SEQ ID NO: 69619 - DNA, 22 bp, Homo sapiens
catctgctgttccttggactca

SEQ ID NO: 69620 - DNA, 22 bp, Homo sapiens
tgagaaattacttcagtgatgg

SEQ ID NO: 69621 - DNA, 18 bp, Homo sapiens
ccctcttgcacaaagcaa

SEQ ID NO: 69622 - DNA, 22 bp, Homo sapiens
cagtgcagccaaggacaggcac

SEQ ID NO: 69623 - DNA, 21 bp, Homo sapiens
tggtttatgtgcttagggtct

SEQ ID NO: 69624 - DNA, 22 bp, Homo sapiens
accctccccaagaggtcgtgcc

SEQ ID NO: 69625 - DNA, 22 bp, Homo sapiens
agccccttgtgggcgcacagca

SEQ ID NO: 69626 - DNA, 22 bp, Homo sapiens
attcttggatttggctctagtg

SEQ ID NO: 69627 - DNA, 22 bp, Homo sapiens
tggccaccaccaatacttgcct

SEQ ID NO: 69628 - DNA, 22 bp, Homo sapiens
tgctcattggcgatctgaggga

SEQ ID NO: 69629 - DNA, 22 bp, Homo sapiens
aagaaggcggaccagaagggag

SEQ ID NO: 69630 - DNA, 19 bp, Homo sapiens
actgcactttagcctgggc

SEQ ID NO: 69631 - DNA, 22 bp, Homo sapiens
tctgctcagccgatctgctccg

SEQ ID NO: 69632 - DNA, 22 bp, Homo sapiens
agaggcagtatacaatccgagc

SEQ ID NO: 69633 - DNA, 22 bp, Homo sapiens
aacccaggagacaggttgcagt

SEQ ID NO: 69634 - DNA, 22 bp, Homo sapiens
tgctgtgaggttgagaaggaag

SEQ ID NO: 69635 - DNA, 22 bp, Homo sapiens
ttctttgcccatgtttcctaag

SEQ ID NO: 69636 - DNA, 20 bp, Homo sapiens
gtgcaatggcaccatctcag

SEQ ID NO: 69637 - DNA, 22 bp, Homo sapiens
gtgacaatattagctcaggggc

SEQ ID NO: 69638 - DNA, 22 bp, Homo sapiens
gggagaggttacccgagcaact

SEQ ID NO: 69639 - DNA, 22 bp, Homo sapiens
catccaccgcgtgcacctctac

SEQ ID NO: 69640 - DNA, 22 bp, Homo sapiens
accagcacttccagaggtcagg

SEQ ID NO: 69641 - DNA, 22 bp, Homo sapiens
tgagcctgggtggtcgaggctg

SEQ ID NO: 69642 - DNA, 22 bp, Homo sapiens
tgcgaccctagccccctcactt

SEQ ID NO: 69643 - DNA, 22 bp, Homo sapiens
gggagctgagctggaagagaat

SEQ ID NO: 69644 - DNA, 22 bp, Homo sapiens
gctgctttgtctgtaaaatgga

SEQ ID NO: 69645 - DNA, 22 bp, Homo sapiens
atcaagggcgcgtggttcggcg

SEQ ID NO: 69646 - DNA, 22 bp, Homo sapiens
tgtaagtagtaatggaaggaca

SEQ ID NO: 69647 - DNA, 22 bp, Homo sapiens
aagaataagaggatttagaaca

SEQ ID NO: 69648 - DNA, 22 bp, Homo sapiens
atataatttttggttagctcaa

SEQ ID NO: 69649 - DNA, 22 bp, Homo sapiens
tataccatgtgtgcacactccc

SEQ ID NO: 69650 - DNA, 22 bp, Homo sapiens
gcaggtggatcacctgaggtca

SEQ ID NO: 69651 - DNA, 22 bp, Homo sapiens
tctgttgactcctagcagccat

SEQ ID NO: 69652 - DNA, 22 bp, Homo sapiens
caggaacagggtgtcctggcag

SEQ ID NO: 69653 - DNA, 22 bp, Homo sapiens
tgagatgaataactcctgctaa

SEQ ID NO: 69654 - DNA, 22 bp, Homo sapiens
aaggcaaggcttccagctcccc

SEQ ID NO: 69655 - DNA, 22 bp, Homo sapiens
aggaatgacagatgtccgcacc

SEQ ID NO: 69656 - DNA, 21 bp, Homo sapiens
gggcagaggggcctcctgggt

SEQ ID NO: 69657 - DNA, 22 bp, Homo sapiens
ttggatccatctcaggcatagg

SEQ ID NO: 69658 - DNA, 23 bp, Homo sapiens
ttaaacactagttcgagtagcat

SEQ ID NO: 69659 - DNA, 22 bp, Homo sapiens
attggtagttttgtatttctct

SEQ ID NO: 69660 - DNA, 22 bp, Homo sapiens
ctttggaacacccagctctgtg

SEQ ID NO: 69661 - DNA, 21 bp, Homo sapiens
agctgcctccacttctgaggc

SEQ ID NO: 69662 - DNA, 22 bp, Homo sapiens
aaacatctactgtaggctggag

SEQ ID NO: 69663 - DNA, 18 bp, Homo sapiens
tccagttttcccagcatc

SEQ ID NO: 69664 - DNA, 22 bp, Homo sapiens
gccaggcgggtctcaaactcct

SEQ ID NO: 69665 - DNA, 22 bp, Homo sapiens
tgtcttcagcagtcatctgggg

SEQ ID NO: 69666 - DNA, 22 bp, Homo sapiens
gagatggagtctttttctgtca

SEQ ID NO: 69667 - DNA, 22 bp, Homo sapiens
tccaccctgcttttgtctttga

SEQ ID NO: 69668 - DNA, 22 bp, Homo sapiens
agaaagagatgaatgctttaag

SEQ ID NO: 69669 - DNA, 22 bp, Homo sapiens
catcccctgatgctcttgagta

SEQ ID NO: 69670 - DNA, 16 bp, Homo sapiens
aggctcagaggctgga

SEQ ID NO: 69671 - DNA, 23 bp, Homo sapiens
caccccaccctgaggaggaggga

SEQ ID NO: 69672 - DNA, 19 bp, Homo sapiens
gctgttaaggaccctcgga

SEQ ID NO: 69673 - DNA, 22 bp, Homo sapiens
gcagatggatgtggacggcgcc

SEQ ID NO: 69674 - DNA, 22 bp, Homo sapiens
ttcaggaagtgctgcctggtgt

SEQ ID NO: 69675 - DNA, 22 bp, Homo sapiens
cagctggtgtcaggcactgcag

SEQ ID NO: 69676 - DNA, 19 bp, Homo sapiens
tcctgcctggggccgcctg

SEQ ID NO: 69677 - DNA, 22 bp, Homo sapiens
ccaagcagagcagcctctctgg

SEQ ID NO: 69678 - DNA, 22 bp, Homo sapiens
ctgaggggtcgtgggagcccag

SEQ ID NO: 69679 - DNA, 22 bp, Homo sapiens
ggtggttcacgcctataatccc

SEQ ID NO: 69680 - DNA, 22 bp, Homo sapiens
tccctctacagggaagcgcttt

SEQ ID NO: 69681 - DNA, 22 bp, Homo sapiens
gctgtctgtcttcacatctcgc

SEQ ID NO: 69682 - DNA, 22 bp, Homo sapiens
ctgggaggcagaggttgcagtg

SEQ ID NO: 69683 - DNA, 22 bp, Homo sapiens
agctgaaacttcccattaattg

SEQ ID NO: 69684 - DNA, 22 bp, Homo sapiens
caggctggagtgcagtggggcg

SEQ ID NO: 69685 - DNA, 15 bp, Homo sapiens
gcaggcaggtcacct

SEQ ID NO: 69686 - DNA, 22 bp, Homo sapiens
gggaagtgagctggaatcaagg

SEQ ID NO: 69687 - DNA, 22 bp, Homo sapiens
gtcctgacggctgattggcctg

SEQ ID NO: 69688 - DNA, 22 bp, Homo sapiens
agtggaccagaagactgaagct

SEQ ID NO: 69689 - DNA, 22 bp, Homo sapiens
ccctcgtgcatccatcatttag

SEQ ID NO: 69690 - DNA, 22 bp, Homo sapiens
tgtcatctgcgggtggcactgc

SEQ ID NO: 69691 - DNA, 22 bp, Homo sapiens
cagcaggaggtgagtagcaggt

SEQ ID NO: 69692 - DNA, 21 bp, Homo sapiens
ccaccaggtcttctgctcggg

SEQ ID NO: 69693 - DNA, 22 bp, Homo sapiens
taacagtatatttaccaaacct

SEQ ID NO: 69694 - DNA, 22 bp, Homo sapiens
cctgttgtttactgcagtgagt

SEQ ID NO: 69695 - DNA, 22 bp, Homo sapiens
gcccaggaggagaggctgcagt

SEQ ID NO: 69696 - DNA, 20 bp, Homo sapiens
aggaaaaatggaaactggag

SEQ ID NO: 69697 - DNA, 22 bp, Homo sapiens
ggccgccctttccacggtttct

SEQ ID NO: 69698 - DNA, 22 bp, Homo sapiens
ttttcagctaagtcacacgctg

SEQ ID NO: 69699 - DNA, 23 bp, Homo sapiens
atgtttgcagtaacccatcctgg

SEQ ID NO: 69700 - DNA, 22 bp, Homo sapiens
ctgctcttgagggactgcggtc

SEQ ID NO: 69701 - DNA, 22 bp, Homo sapiens
ctgggaagaagggacaacagcg

SEQ ID NO: 69702 - DNA, 22 bp, Homo sapiens
atacaccaccttggatctttca

SEQ ID NO: 69703 - DNA, 22 bp, Homo sapiens
ccaggaggcagaagttgcagtg

SEQ ID NO: 69704 - DNA, 18 bp, Homo sapiens
gaaagatgaacttttttc

SEQ ID NO: 69705 - DNA, 22 bp, Homo sapiens
agcttgtgtttttctaagtatc

SEQ ID NO: 69706 - DNA, 19 bp, Homo sapiens
ctctgggcaagtcacttaa

SEQ ID NO: 69707 - DNA, 22 bp, Homo sapiens
agccttacataaacagccttat

SEQ ID NO: 69708 - DNA, 22 bp, Homo sapiens
cacagtcctgccagagggcctt

SEQ ID NO: 69709 - DNA, 22 bp, Homo sapiens
tctgacattagattaattggaa

SEQ ID NO: 69710 - DNA, 22 bp, Homo sapiens
ttgctggaaggtggctggaatc

SEQ ID NO: 69711 - DNA, 22 bp, Homo sapiens
ggccgtgctccaaagtcatcgt

SEQ ID NO: 69712 - DNA, 22 bp, Homo sapiens
ctgggctagaaggaccaggatg

SEQ ID NO: 69713 - DNA, 22 bp, Homo sapiens
tgcctgcctaggaagctgtgaa

SEQ ID NO: 69714 - DNA, 21 bp, Homo sapiens
ggcaagaaacacaatcaagta

SEQ ID NO: 69715 - DNA, 22 bp, Homo sapiens
tcgcttgaacccaggaagtgga

SEQ ID NO: 69716 - DNA, 22 bp, Homo sapiens
tgggctttgagctcggtcacct

SEQ ID NO: 69717 - DNA, 22 bp, Homo sapiens
cgctccttgagcgtgtcggcct

SEQ ID NO: 69718 - DNA, 22 bp, Homo sapiens
tgactcctggtatggatgacag

SEQ ID NO: 69719 - DNA, 22 bp, Homo sapiens
gcccagcgagcagaggtggacg

SEQ ID NO: 69720 - DNA, 22 bp, Homo sapiens
gtcttttgctagccagagagct

SEQ ID NO: 69721 - DNA, 22 bp, Homo sapiens
tgcgggtcccagggtcacaggc

SEQ ID NO: 69722 - DNA, 22 bp, Homo sapiens
tttctaatctgattctcctacc

SEQ ID NO: 69723 - DNA, 22 bp, Homo sapiens
ataagattgtcatagtatggac

SEQ ID NO: 69724 - DNA, 20 bp, Homo sapiens
tgtttgtgtggggccttggc

SEQ ID NO: 69725 - DNA, 22 bp, Homo sapiens
gagtaggttgtcagactccaaa

SEQ ID NO: 69726 - DNA, 22 bp, Homo sapiens
ggttggacactaggtaggagcg

SEQ ID NO: 69727 - DNA, 22 bp, Homo sapiens
gagcactgatttatttttgtct

SEQ ID NO: 69728 - DNA, 22 bp, Homo sapiens
ggaggaggggtgactgaatgct

SEQ ID NO: 69729 - DNA, 22 bp, Homo sapiens
tggttacccagtcgctggagtt

SEQ ID NO: 69730 - DNA, 22 bp, Homo sapiens
tgtccaggttagcttcaaacac

SEQ ID NO: 69731 - DNA, 19 bp, Homo sapiens
gagaaagcaggcacagcac

SEQ ID NO: 69732 - DNA, 22 bp, Homo sapiens
ggcctcttatctggctcctgca

SEQ ID NO: 69733 - DNA, 22 bp, Homo sapiens
ttaagtctctttgaagtgctct

SEQ ID NO: 69734 - DNA, 22 bp, Homo sapiens
tgggccactgctgcggaaggcg

SEQ ID NO: 69735 - DNA, 22 bp, Homo sapiens
gtcatcttgctgttttagatct

SEQ ID NO: 69736 - DNA, 22 bp, Homo sapiens
gtcacaaagcgcggtggtcggt

SEQ ID NO: 69737 - DNA, 22 bp, Homo sapiens
ggctgggcaggtctgcacaggg

SEQ ID NO: 69738 - DNA, 22 bp, Homo sapiens
tgagtgtggggaatgtcatgag

SEQ ID NO: 69739 - DNA, 22 bp, Homo sapiens
aaggtgggcagatcacaaggtc

SEQ ID NO: 69740 - DNA, 22 bp, Homo sapiens
tctggtgtcagtattctttgaa

SEQ ID NO: 69741 - DNA, 22 bp, Homo sapiens
ctggaaggcagaggttgcagtg

SEQ ID NO: 69742 - DNA, 23 bp, Homo sapiens
ggagtgcaatggcgccatctcgg

SEQ ID NO: 69743 - DNA, 22 bp, Homo sapiens
aggccaggaatccttgtcccag

SEQ ID NO: 69744 - DNA, 22 bp, Homo sapiens
ccctggaggttgaggctgcagt

SEQ ID NO: 69745 - DNA, 22 bp, Homo sapiens
tcccagctactctagaggctga

SEQ ID NO: 69746 - DNA, 22 bp, Homo sapiens
tggttgatgtgtctgttttagg

SEQ ID NO: 69747 - DNA, 22 bp, Homo sapiens
ccttctagcaaatcaacataaa

SEQ ID NO: 69748 - DNA, 20 bp, Homo sapiens
gctgaggggtctatggcata

SEQ ID NO: 69749 - DNA, 22 bp, Homo sapiens
ctgggaggcggaggttgcagtg

SEQ ID NO: 69750 - DNA, 22 bp, Homo sapiens
ttgtgaatagtgccgctataaa

SEQ ID NO: 69751 - DNA, 22 bp, Homo sapiens
taaatgttttgtgggttgagtt

SEQ ID NO: 69752 - DNA, 22 bp, Homo sapiens
gcttcggggtccaagcgcgtgt

SEQ ID NO: 69753 - DNA, 22 bp, Homo sapiens
aactctatttaccctactaaac

SEQ ID NO: 69754 - DNA, 22 bp, Homo sapiens
tacagaagcttttgaaaagatg

SEQ ID NO: 69755 - DNA, 22 bp, Homo sapiens
cacagtggtccccgaagcccct

SEQ ID NO: 69756 - DNA, 22 bp, Homo sapiens
gggatcgtcatggaaagtgcta

SEQ ID NO: 69757 - DNA, 22 bp, Homo sapiens
ttccccttgggctgtggaggag

SEQ ID NO: 69758 - DNA, 18 bp, Homo sapiens
cttttcccctttggactc

SEQ ID NO: 69759 - DNA, 22 bp, Homo sapiens
gaaagagaacctgggcctagat

SEQ ID NO: 69760 - DNA, 22 bp, Homo sapiens
ctcactgcaacctccgcctcct

SEQ ID NO: 69761 - DNA, 22 bp, Homo sapiens
agtcccaacagcttacaaggaa

SEQ ID NO: 69762 - DNA, 22 bp, Homo sapiens
tgtgcctgttcccactttgcct

SEQ ID NO: 69763 - DNA, 22 bp, Homo sapiens
ggaggtgggctaaggactctct

SEQ ID NO: 69764 - DNA, 22 bp, Homo sapiens
agagagcccgggccagggcaca

SEQ ID NO: 69765 - DNA, 22 bp, Homo sapiens
cgtgccactgcactctagcctg

SEQ ID NO: 69766 - DNA, 22 bp, Homo sapiens
gctctgagtcacactgccctgt

SEQ ID NO: 69767 - DNA, 22 bp, Homo sapiens
tgcctgtggaaaggctggtgct

SEQ ID NO: 69768 - DNA, 22 bp, Homo sapiens
tgtcttcaggagtaaatatcat

SEQ ID NO: 69769 - DNA, 22 bp, Homo sapiens
aaaactgaaatacgatccaatg

SEQ ID NO: 69770 - DNA, 22 bp, Homo sapiens
ccggagtgtctggcctgctggg

SEQ ID NO: 69771 - DNA, 22 bp, Homo sapiens
gagtcgagcagaaagccgtcgg

SEQ ID NO: 69772 - DNA, 22 bp, Homo sapiens
atttcctgtaggggcttgcgaa

SEQ ID NO: 69773 - DNA, 22 bp, Homo sapiens
acaaagtgaattgcatcgagtt

SEQ ID NO: 69774 - DNA, 22 bp, Homo sapiens
ctgcccccagcctgggcttcga

SEQ ID NO: 69775 - DNA, 22 bp, Homo sapiens
cccatgcaccctctaagaagga

SEQ ID NO: 69776 - DNA, 22 bp, Homo sapiens
taagaaatttagttatagaatg

SEQ ID NO: 69777 - DNA, 18 bp, Homo sapiens
aggtttggtggaaacata

SEQ ID NO: 69778 - DNA, 22 bp, Homo sapiens
ttgaatctgggtacttgtaata

SEQ ID NO: 69779 - DNA, 22 bp, Homo sapiens
aacactgcctacactttatgaa

SEQ ID NO: 69780 - DNA, 22 bp, Homo sapiens
gggtccctggaattacttgaca

SEQ ID NO: 69781 - DNA, 22 bp, Homo sapiens
tttctcttcactgtgtgcctca

SEQ ID NO: 69782 - DNA, 22 bp, Homo sapiens
gctgctgggatcctgggtctca

SEQ ID NO: 69783 - DNA, 22 bp, Homo sapiens
tcttatacccctaaactgcagc

SEQ ID NO: 69784 - DNA, 22 bp, Homo sapiens
ggcctacgccagtatccccagg

SEQ ID NO: 69785 - DNA, 22 bp, Homo sapiens
gctcttgtcaaaaattagttga

SEQ ID NO: 69786 - DNA, 19 bp, Homo sapiens
tctgaagaattagagagca

SEQ ID NO: 69787 - DNA, 19 bp, Homo sapiens
gactcacaccttccgctgt

SEQ ID NO: 69788 - DNA, 22 bp, Homo sapiens
caggaggagggcagccgcctcc

SEQ ID NO: 69789 - DNA, 22 bp, Homo sapiens
cgcccaggctggagtgcagtgg

SEQ ID NO: 69790 - DNA, 22 bp, Homo sapiens
cacagctgtgagaagggagcct

SEQ ID NO: 69791 - DNA, 22 bp, Homo sapiens
agggcaaagccagtgactccca

SEQ ID NO: 69792 - DNA, 22 bp, Homo sapiens
agctgattccactttttcccca

SEQ ID NO: 69793 - DNA, 22 bp, Homo sapiens
ctgtggctctcagaggctgctg

SEQ ID NO: 69794 - DNA, 22 bp, Homo sapiens
tggaaaactttggtggtgaggg

SEQ ID NO: 69795 - DNA, 22 bp, Homo sapiens
ataaaaactgacccatcctttg

SEQ ID NO: 69796 - DNA, 21 bp, Homo sapiens
tggtacaccttgcctgtcaga

SEQ ID NO: 69797 - DNA, 22 bp, Homo sapiens
tccaggatggtgacggtggcca

SEQ ID NO: 69798 - DNA, 22 bp, Homo sapiens
gaggctgaggttgcagtgagct

SEQ ID NO: 69799 - DNA, 22 bp, Homo sapiens
ctgctgagccgcacccaggagc

SEQ ID NO: 69800 - DNA, 22 bp, Homo sapiens
ggtcacgtgaccgcacctgcct

SEQ ID NO: 69801 - DNA, 22 bp, Homo sapiens
cctggtgctgctatcaggggta

SEQ ID NO: 69802 - DNA, 22 bp, Homo sapiens
cgagagttagctaggagtcaca

SEQ ID NO: 69803 - DNA, 22 bp, Homo sapiens
gtgcgcttcttcctgagccagg

SEQ ID NO: 69804 - DNA, 22 bp, Homo sapiens
gaagaaggtggcccaggggtag

SEQ ID NO: 69805 - DNA, 22 bp, Homo sapiens
tgatctaggttggcttcaactg

SEQ ID NO: 69806 - DNA, 22 bp, Homo sapiens
ttgcttcttagatattcctctc

SEQ ID NO: 69807 - DNA, 22 bp, Homo sapiens
gccggggctggggagagacatg

SEQ ID NO: 69808 - DNA, 22 bp, Homo sapiens
ccggtcccaggtgccccggtga

SEQ ID NO: 69809 - DNA, 22 bp, Homo sapiens
tttcaacagatctgtcttcagg

SEQ ID NO: 69810 - DNA, 22 bp, Homo sapiens
accctcttgagggaagcacttt

SEQ ID NO: 69811 - DNA, 22 bp, Homo sapiens
tagaactaagagttatcattta

SEQ ID NO: 69812 - DNA, 22 bp, Homo sapiens
ggaatgaatttccagctgggtc

SEQ ID NO: 69813 - DNA, 23 bp, Homo sapiens
agctctgctcgggcatgccctgc

SEQ ID NO: 69814 - DNA, 21 bp, Homo sapiens
ttgaccaagggtgcgtgctcc

SEQ ID NO: 69815 - DNA, 22 bp, Homo sapiens
atttactcgtgcttcattgaat

SEQ ID NO: 69816 - DNA, 22 bp, Homo sapiens
agccagggtctctcgctctgtt

SEQ ID NO: 69817 - DNA, 22 bp, Homo sapiens
agtgaatgtccccgcgggtcag

SEQ ID NO: 69818 - DNA, 22 bp, Homo sapiens
ccagaagtcaagtaagatgaag

SEQ ID NO: 69819 - DNA, 22 bp, Homo sapiens
acattacctggcatttgatctt

SEQ ID NO: 69820 - DNA, 22 bp, Homo sapiens
agaccaaagaaaacacatctgg

SEQ ID NO: 69821 - DNA, 22 bp, Homo sapiens
actcaaatagcaacggtgagaa

SEQ ID NO: 69822 - DNA, 22 bp, Homo sapiens
gactttgctgtgtcagcttcag

SEQ ID NO: 69823 - DNA, 22 bp, Homo sapiens
gcttccacctactaaatgccac

SEQ ID NO: 69824 - DNA, 22 bp, Homo sapiens
ggccttggcctagccctccagg

SEQ ID NO: 69825 - DNA, 22 bp, Homo sapiens
ttcaccctggaccagaaattgg

SEQ ID NO: 69826 - DNA, 22 bp, Homo sapiens
atctggttcttcttaggcatca

SEQ ID NO: 69827 - DNA, 19 bp, Homo sapiens
ggagccgccgcccttcatt

SEQ ID NO: 69828 - DNA, 22 bp, Homo sapiens
gtccctgagcctggcatttccc

SEQ ID NO: 69829 - DNA, 22 bp, Homo sapiens
acatcctcccgatctactggct

SEQ ID NO: 69830 - DNA, 22 bp, Homo sapiens
tccagggagagccgctgctcca

SEQ ID NO: 69831 - DNA, 22 bp, Homo sapiens
cccctcttggcattgagtgcca

SEQ ID NO: 69832 - DNA, 22 bp, Homo sapiens
gtggagacctcctaggatgtgt

SEQ ID NO: 69833 - DNA, 22 bp, Homo sapiens
ggacaccggtcctattggatga

SEQ ID NO: 69834 - DNA, 22 bp, Homo sapiens
tggagccagcggcctgctgagg

SEQ ID NO: 69835 - DNA, 22 bp, Homo sapiens
cagcttggaggaggatctaaga

SEQ ID NO: 69836 - DNA, 22 bp, Homo sapiens
gggaaagaccttcctggggtgt

SEQ ID NO: 69837 - DNA, 23 bp, Homo sapiens
gtgcgccaggacaacctgacgga

SEQ ID NO: 69838 - DNA, 21 bp, Homo sapiens
tttcttaggctctaaaatgac

SEQ ID NO: 69839 - DNA, 17 bp, Homo sapiens
tgtatttatcatgtcag

SEQ ID NO: 69840 - DNA, 22 bp, Homo sapiens
tttgattgtcacctaccttgca

SEQ ID NO: 69841 - DNA, 22 bp, Homo sapiens
cactgcactccagcttgggcaa

SEQ ID NO: 69842 - DNA, 22 bp, Homo sapiens
gaggtaggtgtaggaggcctgc

SEQ ID NO: 69843 - DNA, 22 bp, Homo sapiens
tttcccaggctggaatgcagtg

SEQ ID NO: 69844 - DNA, 22 bp, Homo sapiens
tctccccagtatggattctctg

SEQ ID NO: 69845 - DNA, 22 bp, Homo sapiens
tacagaggaggggattttaata

SEQ ID NO: 69846 - DNA, 22 bp, Homo sapiens
gaggctgaggcaggaggatcac

SEQ ID NO: 69847 - DNA, 22 bp, Homo sapiens
aggccgtctgcaggcctgcagg

SEQ ID NO: 69848 - DNA, 22 bp, Homo sapiens
tcagtttttctatactttgtag

SEQ ID NO: 69849 - DNA, 22 bp, Homo sapiens
cggtcaggtgcagcgttggcac

SEQ ID NO: 69850 - DNA, 22 bp, Homo sapiens
gggcccctgggaattctgtgat

SEQ ID NO: 69851 - DNA, 22 bp, Homo sapiens
ccaggaggtggaggttgcggtg

SEQ ID NO: 69852 - DNA, 22 bp, Homo sapiens
tattgtccaataggatgttcct

SEQ ID NO: 69853 - DNA, 22 bp, Homo sapiens
gaccttgtgatccgcccgcctt

SEQ ID NO: 69854 - DNA, 22 bp, Homo sapiens
tttcctcttctggcaggcaggg

SEQ ID NO: 69855 - DNA, 22 bp, Homo sapiens
ggcctctcttgggacagctgtc

SEQ ID NO: 69856 - DNA, 22 bp, Homo sapiens
tggtacaatcacagctcactgt

SEQ ID NO: 69857 - DNA, 18 bp, Homo sapiens
ccgggctttggtgacaca

SEQ ID NO: 69858 - DNA, 22 bp, Homo sapiens
tcactacaacctccgcctcctg

SEQ ID NO: 69859 - DNA, 22 bp, Homo sapiens
cctgggaggctgaggctgcagt

SEQ ID NO: 69860 - DNA, 22 bp, Homo sapiens
aggtcaccatggcatgctccac

SEQ ID NO: 69861 - DNA, 22 bp, Homo sapiens
ttcatcttgatggcttcctaat

SEQ ID NO: 69862 - DNA, 22 bp, Homo sapiens
aggagagctggtgtctggaatc

SEQ ID NO: 69863 - DNA, 21 bp, Homo sapiens
attctttgatgtgcaataagt

SEQ ID NO: 69864 - DNA, 22 bp, Homo sapiens
cccaggaggtcaaggctgcagt

SEQ ID NO: 69865 - DNA, 22 bp, Homo sapiens
ttggcataccttagtggtggag

SEQ ID NO: 69866 - DNA, 22 bp, Homo sapiens
gagccaagctcttctccatgag

SEQ ID NO: 69867 - DNA, 18 bp, Homo sapiens
ctgcactcccgcctgggc

SEQ ID NO: 69868 - DNA, 22 bp, Homo sapiens
aggactgggtgcagagggcatc

SEQ ID NO: 69869 - DNA, 22 bp, Homo sapiens
atttattcctttatggctggag

SEQ ID NO: 69870 - DNA, 22 bp, Homo sapiens
catgtaaagaatttcacacaag

SEQ ID NO: 69871 - DNA, 22 bp, Homo sapiens
gaggcaggcagattgcttgagg

SEQ ID NO: 69872 - DNA, 23 bp, Homo sapiens
ttttgcaataagtcactggaata

SEQ ID NO: 69873 - DNA, 22 bp, Homo sapiens
cttccctctgctccttggtcca

SEQ ID NO: 69874 - DNA, 22 bp, Homo sapiens
ggctcactgcaacctccacctc

SEQ ID NO: 69875 - DNA, 22 bp, Homo sapiens
ggacagaaaccatatgagtgta

SEQ ID NO: 69876 - DNA, 20 bp, Homo sapiens
atcggcttgcctggaaacaa

SEQ ID NO: 69877 - DNA, 22 bp, Homo sapiens
tgagataatcatgtgatttcat

SEQ ID NO: 69878 - DNA, 22 bp, Homo sapiens
tctgagctccatgcaggaggct

SEQ ID NO: 69879 - DNA, 22 bp, Homo sapiens
ggctctgcagcttggggtcctg

SEQ ID NO: 69880 - DNA, 22 bp, Homo sapiens
caatagtaaattacggaggaga

SEQ ID NO: 69881 - DNA, 22 bp, Homo sapiens
cacatgaaggctggggtcgtga

SEQ ID NO: 69882 - DNA, 22 bp, Homo sapiens
actggggactctggccttttga

SEQ ID NO: 69883 - DNA, 21 bp, Homo sapiens
taaacataaccttgtatggct

SEQ ID NO: 69884 - DNA, 22 bp, Homo sapiens
cactgcacttcagcctgggcaa

SEQ ID NO: 69885 - DNA, 22 bp, Homo sapiens
caggcagaagaagtggaaggac

SEQ ID NO: 69886 - DNA, 22 bp, Homo sapiens
ttgaccactgaatggttctgaa

SEQ ID NO: 69887 - DNA, 22 bp, Homo sapiens
agcctctcagagtgctgggatt

SEQ ID NO: 69888 - DNA, 22 bp, Homo sapiens
tgggccacacacagaagaatca

SEQ ID NO: 69889 - DNA, 22 bp, Homo sapiens
ttgtaagtcacaccagggcagg

SEQ ID NO: 69890 - DNA, 22 bp, Homo sapiens
cctgcgcgtctgggtctgtctc

SEQ ID NO: 69891 - DNA, 18 bp, Homo sapiens
ggagactaaactgttgac

SEQ ID NO: 69892 - DNA, 22 bp, Homo sapiens
tcttgccgcgcaggcgcagttc

SEQ ID NO: 69893 - DNA, 22 bp, Homo sapiens
cagtaatagaggctttgagtct

SEQ ID NO: 69894 - DNA, 22 bp, Homo sapiens
ggctcactgcaaactgtgcctc

SEQ ID NO: 69895 - DNA, 22 bp, Homo sapiens
tcccaagtagatgggaatacag

SEQ ID NO: 69896 - DNA, 22 bp, Homo sapiens
tcaaattgtcatcttgataatg

SEQ ID NO: 69897 - DNA, 22 bp, Homo sapiens
ggagctcctggcagtgacagag

SEQ ID NO: 69898 - DNA, 22 bp, Homo sapiens
cggagtcttgctatgttgccca

SEQ ID NO: 69899 - DNA, 22 bp, Homo sapiens
gtcagtgtcttaacagagatta

SEQ ID NO: 69900 - DNA, 22 bp, Homo sapiens
atacaaaaattagccgggagta

SEQ ID NO: 69901 - DNA, 22 bp, Homo sapiens
tggattcacaccattctcctgc

SEQ ID NO: 69902 - DNA, 22 bp, Homo sapiens
ggttctctaactttgactggag

SEQ ID NO: 69903 - DNA, 22 bp, Homo sapiens
ttctcacagaagcacgaagcct

SEQ ID NO: 69904 - DNA, 22 bp, Homo sapiens
tgtgtgattgcaggagatgtgg

SEQ ID NO: 69905 - DNA, 22 bp, Homo sapiens
gagctgaaggagaaagcagggg

SEQ ID NO: 69906 - DNA, 22 bp, Homo sapiens
ctgatagacaatcaccatggga

SEQ ID NO: 69907 - DNA, 22 bp, Homo sapiens
tccggtccgggtactcctctct

SEQ ID NO: 69908 - DNA, 22 bp, Homo sapiens
gagcgattgcgggggtcagagg

SEQ ID NO: 69909 - DNA, 22 bp, Homo sapiens
cggaggttgaggctgcagtgag

SEQ ID NO: 69910 - DNA, 22 bp, Homo sapiens
gtgcacatcgtgcaggtttgtt

SEQ ID NO: 69911 - DNA, 22 bp, Homo sapiens
tcgttaatcagcaccagaattc

SEQ ID NO: 69912 - DNA, 22 bp, Homo sapiens
aaagcagggaaatctatttgca

SEQ ID NO: 69913 - DNA, 22 bp, Homo sapiens
tgcgggttggtggcatatgcag

SEQ ID NO: 69914 - DNA, 22 bp, Homo sapiens
atgggttcaagtgattctcctg

SEQ ID NO: 69915 - DNA, 22 bp, Homo sapiens
aggggaggtgtccccaaatctc

SEQ ID NO: 69916 - DNA, 22 bp, Homo sapiens
cctagagccgcacctcctccac

SEQ ID NO: 69917 - DNA, 22 bp, Homo sapiens
agtgaaccaggctgcgtccctg

SEQ ID NO: 69918 - DNA, 22 bp, Homo sapiens
ggtgccaggctgtagtcagggt

SEQ ID NO: 69919 - DNA, 22 bp, Homo sapiens
agacggattacctgaggtcagg

SEQ ID NO: 69920 - DNA, 21 bp, Homo sapiens
tggacttatggagtgtttctt

SEQ ID NO: 69921 - DNA, 22 bp, Homo sapiens
aagtcgtggcaggcttgcacga

SEQ ID NO: 69922 - DNA, 22 bp, Homo sapiens
acattcagaatcttgtagcagt

SEQ ID NO: 69923 - DNA, 22 bp, Homo sapiens
tgtgggagaaggaagcaagctg

SEQ ID NO: 69924 - DNA, 22 bp, Homo sapiens
aggttatcatcagttgagcact

SEQ ID NO: 69925 - DNA, 21 bp, Homo sapiens
cccagaagttccatggggggc

SEQ ID NO: 69926 - DNA, 22 bp, Homo sapiens
tggcccttgttcaaatatgtca

SEQ ID NO: 69927 - DNA, 22 bp, Homo sapiens
cttctcggccgtgtggatgcgc

SEQ ID NO: 69928 - DNA, 22 bp, Homo sapiens
ttgcaattgctatggagagcgt

SEQ ID NO: 69929 - DNA, 20 bp, Homo sapiens
ttgagcttttagtacagaca

SEQ ID NO: 69930 - DNA, 22 bp, Homo sapiens
atggcctgcagtgctgccacag

SEQ ID NO: 69931 - DNA, 22 bp, Homo sapiens
tcatcataatatggaatcttgt

SEQ ID NO: 69932 - DNA, 22 bp, Homo sapiens
gcccaggctggagtgcagtggt

SEQ ID NO: 69933 - DNA, 22 bp, Homo sapiens
gcagggcacaaggacgcacagg

SEQ ID NO: 69934 - DNA, 22 bp, Homo sapiens
aatgtgaggccttggtagttat

SEQ ID NO: 69935 - DNA, 22 bp, Homo sapiens
cttgcctttgtcttcaaaggct

SEQ ID NO: 69936 - DNA, 22 bp, Homo sapiens
cttctcaaagttgtgaatcagg

SEQ ID NO: 69937 - DNA, 22 bp, Homo sapiens
aaggtcgtgtgggggttgctgc

SEQ ID NO: 69938 - DNA, 22 bp, Homo sapiens
tcttggattttaatggatcaaa

SEQ ID NO: 69939 - DNA, 22 bp, Homo sapiens
ttatcacttatgagctttttgc

SEQ ID NO: 69940 - DNA, 22 bp, Homo sapiens
tcccgcccttgtacttgccgag

SEQ ID NO: 69941 - DNA, 18 bp, Homo sapiens
cagggctgtggggtcact

SEQ ID NO: 69942 - DNA, 22 bp, Homo sapiens
ttacaattacttgatctcagct

SEQ ID NO: 69943 - DNA, 22 bp, Homo sapiens
aagaagcaggtcacagacaggg

SEQ ID NO: 69944 - DNA, 22 bp, Homo sapiens
tgaactcctgacctcatgatcc

SEQ ID NO: 69945 - DNA, 22 bp, Homo sapiens
actgcaacacctcctgggttca

SEQ ID NO: 69946 - DNA, 22 bp, Homo sapiens
ccccatgaagtagggtctctga

SEQ ID NO: 69947 - DNA, 22 bp, Homo sapiens
tccagtttccaatcactgcacg

SEQ ID NO: 69948 - DNA, 22 bp, Homo sapiens
acggcctggtgcagcaggtcgc

SEQ ID NO: 69949 - DNA, 22 bp, Homo sapiens
gatgctgagagattggagacta

SEQ ID NO: 69950 - DNA, 22 bp, Homo sapiens
ggaggtggaggttgcagtgagc

SEQ ID NO: 69951 - DNA, 22 bp, Homo sapiens
ggaggcggaggttgcagtgagt

SEQ ID NO: 69952 - DNA, 22 bp, Homo sapiens
ctgggcctggggctgttgagag

SEQ ID NO: 69953 - DNA, 22 bp, Homo sapiens
tgctgagcgcatccggcggccg

SEQ ID NO: 69954 - DNA, 22 bp, Homo sapiens
agaaagtgcttccctttggtga

SEQ ID NO: 69955 - DNA, 22 bp, Homo sapiens
tacttttagcctatttgattct

SEQ ID NO: 69956 - DNA, 22 bp, Homo sapiens
agttcgagatctgctgatgaga

SEQ ID NO: 69957 - DNA, 22 bp, Homo sapiens
ctgcattaagttgcctgtaaga

SEQ ID NO: 69958 - DNA, 22 bp, Homo sapiens
tttgctttgtttaaaagtggta

SEQ ID NO: 69959 - DNA, 22 bp, Homo sapiens
tggtttgtctaaatgagtaata

SEQ ID NO: 69960 - DNA, 17 bp, Homo sapiens
aatctgtttacagtcag

SEQ ID NO: 69961 - DNA, 22 bp, Homo sapiens
ggacaagcctgtgagtgggttt

SEQ ID NO: 69962 - DNA, 22 bp, Homo sapiens
catagagtgatgtaaggtatgt

SEQ ID NO: 69963 - DNA, 22 bp, Homo sapiens
aacccgggaggcagaggttgtg

SEQ ID NO: 69964 - DNA, 22 bp, Homo sapiens
tgcctgttgcccacctgataaa

SEQ ID NO: 69965 - DNA, 22 bp, Homo sapiens
aacatatcatttaaccctcacc

SEQ ID NO: 69966 - DNA, 22 bp, Homo sapiens
ttcagatgattagaatagtatt

SEQ ID NO: 69967 - DNA, 22 bp, Homo sapiens
gcacatgaggctgtctttgtct

SEQ ID NO: 69968 - DNA, 22 bp, Homo sapiens
gcgggccaccttggagagcgct

SEQ ID NO: 69969 - DNA, 22 bp, Homo sapiens
attcactgtgggtcctttggat

SEQ ID NO: 69970 - DNA, 22 bp, Homo sapiens
gaatgctaagcatgtgggagtt

SEQ ID NO: 69971 - DNA, 22 bp, Homo sapiens
tacgtgtgttcgtgtaagcact

SEQ ID NO: 69972 - DNA, 22 bp, Homo sapiens
atctttgattgaagggaccctg

SEQ ID NO: 69973 - DNA, 22 bp, Homo sapiens
aagatattcaaagatttattag

SEQ ID NO: 69974 - DNA, 22 bp, Homo sapiens
actgggcctgattgggtcggag

SEQ ID NO: 69975 - DNA, 22 bp, Homo sapiens
atcactgtgtatgtatatgcag

SEQ ID NO: 69976 - DNA, 22 bp, Homo sapiens
ctatggtgatagaaatcagaat

SEQ ID NO: 69977 - DNA, 22 bp, Homo sapiens
caggaggacatactggctcaca

SEQ ID NO: 69978 - DNA, 22 bp, Homo sapiens
aagatacagacagagccaaaat

SEQ ID NO: 69979 - DNA, 22 bp, Homo sapiens
cactgcactccagcctggcctg

SEQ ID NO: 69980 - DNA, 22 bp, Homo sapiens
tgaggcaggagaatcacatgaa

SEQ ID NO: 69981 - DNA, 23 bp, Homo sapiens
ctcctcgtaactctgtggtgggt

SEQ ID NO: 69982 - DNA, 22 bp, Homo sapiens
aggggcacgagtagagctctag

SEQ ID NO: 69983 - DNA, 22 bp, Homo sapiens
tgggtggcagcttcagcatgtt

SEQ ID NO: 69984 - DNA, 22 bp, Homo sapiens
atgatccaaagccacaggggca

SEQ ID NO: 69985 - DNA, 19 bp, Homo sapiens
actgcactccagcctgggt

SEQ ID NO: 69986 - DNA, 22 bp, Homo sapiens
ctcattgcaacctccgcctccc

SEQ ID NO: 69987 - DNA, 22 bp, Homo sapiens
cactgcactccagcccgggcaa

SEQ ID NO: 69988 - DNA, 22 bp, Homo sapiens
catgagatctgcagggatgggc

SEQ ID NO: 69989 - DNA, 23 bp, Homo sapiens
ttgcttagagacctcctcatcag

SEQ ID NO: 69990 - DNA, 22 bp, Homo sapiens
tttgtcttatccaatctctcag

SEQ ID NO: 69991 - DNA, 20 bp, Homo sapiens
tcagccattccttacctttc

SEQ ID NO: 69992 - DNA, 22 bp, Homo sapiens
gaattcttttctttctgaaagt

SEQ ID NO: 69993 - DNA, 22 bp, Homo sapiens
tgtacttgaacttgactgtaga

SEQ ID NO: 69994 - DNA, 22 bp, Homo sapiens
caggtcttcttcagcacttgga

SEQ ID NO: 69995 - DNA, 22 bp, Homo sapiens
ggagagtggattccagctgtat

SEQ ID NO: 69996 - DNA, 22 bp, Homo sapiens
tacatttataaggcttctctgt

SEQ ID NO: 69997 - DNA, 22 bp, Homo sapiens
ggctagcaaggtagcagaatgc

SEQ ID NO: 69998 - DNA, 22 bp, Homo sapiens
caggctgtccaggctcctttgg

SEQ ID NO: 69999 - DNA, 22 bp, Homo sapiens
acccggagtcggaggttgcagt

SEQ ID NO: 70000 - DNA, 19 bp, Homo sapiens
tgtgactggttgtctcgct

SEQ ID NO: 70001 - DNA, 22 bp, Homo sapiens
ctggcaggttatagagctgccc

SEQ ID NO: 70002 - DNA, 19 bp, Homo sapiens
agccccttggtactgtcct

SEQ ID NO: 70003 - DNA, 22 bp, Homo sapiens
atgccactgcgctccagcctgg

SEQ ID NO: 70004 - DNA, 22 bp, Homo sapiens
gtcagactgcactcaaggacag

SEQ ID NO: 70005 - DNA, 22 bp, Homo sapiens
gagccaggttggaggctgcagt

SEQ ID NO: 70006 - DNA, 17 bp, Homo sapiens
cgggcatggagggcagg

SEQ ID NO: 70007 - DNA, 22 bp, Homo sapiens
ctcactgcaacctccgtctccc

SEQ ID NO: 70008 - DNA, 22 bp, Homo sapiens
gtgtttgttcgtgactccaaag

SEQ ID NO: 70009 - DNA, 22 bp, Homo sapiens
actgggccaggtgtgggtgagt

SEQ ID NO: 70010 - DNA, 22 bp, Homo sapiens
atgcgagtgatgcagagtggct

SEQ ID NO: 70011 - DNA, 22 bp, Homo sapiens
aggcgactgttgatttgaaatt

SEQ ID NO: 70012 - DNA, 22 bp, Homo sapiens
gagcacagtaaagcagtgtcac

SEQ ID NO: 70013 - DNA, 22 bp, Homo sapiens
gggacatctttctagtcagggt

SEQ ID NO: 70014 - DNA, 18 bp, Homo sapiens
tcttcatctcctgagctg

SEQ ID NO: 70015 - DNA, 22 bp, Homo sapiens
acccaggctggagtgcagtggc

SEQ ID NO: 70016 - DNA, 22 bp, Homo sapiens
aggctagaggcttctggcttca

SEQ ID NO: 70017 - DNA, 22 bp, Homo sapiens
ttgcccactggctgttggtcag

SEQ ID NO: 70018 - DNA, 22 bp, Homo sapiens
cctgccagagcagcttgtcctc

SEQ ID NO: 70019 - DNA, 22 bp, Homo sapiens
ccctggctggctctgcccggac

SEQ ID NO: 70020 - DNA, 20 bp, Homo sapiens
cattggacttggcttcatgg

SEQ ID NO: 70021 - DNA, 22 bp, Homo sapiens
acggcaggctcagagctggaat

SEQ ID NO: 70022 - DNA, 22 bp, Homo sapiens
atacaaaatatatactggagac

SEQ ID NO: 70023 - DNA, 19 bp, Homo sapiens
ctctggagtcattgctccc

SEQ ID NO: 70024 - DNA, 22 bp, Homo sapiens
aggcactgtgcagtcccaagca

SEQ ID NO: 70025 - DNA, 22 bp, Homo sapiens
cttccttctcactagcagcgcc

SEQ ID NO: 70026 - DNA, 22 bp, Homo sapiens
aaggaattcaaattttctctgg

SEQ ID NO: 70027 - DNA, 22 bp, Homo sapiens
cctgtctctgcagggccctgcc

SEQ ID NO: 70028 - DNA, 22 bp, Homo sapiens
agacatccttcaagtgatatgt

SEQ ID NO: 70029 - DNA, 22 bp, Homo sapiens
acaggggattgattggaagtct

SEQ ID NO: 70030 - DNA, 22 bp, Homo sapiens
ggcctcacccatcggtgccttt

SEQ ID NO: 70031 - DNA, 22 bp, Homo sapiens
gggccatgagaggttcatcaac

SEQ ID NO: 70032 - DNA, 22 bp, Homo sapiens
aagaggagaaaggctggctttg

SEQ ID NO: 70033 - DNA, 22 bp, Homo sapiens
tagtcccggaactccttcaggt

SEQ ID NO: 70034 - DNA, 22 bp, Homo sapiens
aggctccctgaatcgcccgttc

SEQ ID NO: 70035 - DNA, 22 bp, Homo sapiens
acagagcaatgcgtgttctcta

SEQ ID NO: 70036 - DNA, 22 bp, Homo sapiens
gcagctggaagtgacactctgt

SEQ ID NO: 70037 - DNA, 22 bp, Homo sapiens
ctgagcctcctgcttctatttc

SEQ ID NO: 70038 - DNA, 22 bp, Homo sapiens
cagctggttgaagaggagctgg

SEQ ID NO: 70039 - DNA, 22 bp, Homo sapiens
ctcctgagctctgaggaagctt

SEQ ID NO: 70040 - DNA, 22 bp, Homo sapiens
agcctgggcaacagagcaaaac

SEQ ID NO: 70041 - DNA, 22 bp, Homo sapiens
tgcctctgaggaagattgtgtt

SEQ ID NO: 70042 - DNA, 22 bp, Homo sapiens
aaaagcaattgcgggttttgcc

SEQ ID NO: 70043 - DNA, 22 bp, Homo sapiens
gtggggtctgtcctcttctggg

SEQ ID NO: 70044 - DNA, 22 bp, Homo sapiens
tcacccaggctggagtgcagtg

SEQ ID NO: 70045 - DNA, 22 bp, Homo sapiens
tctcccaggcaggagtgcagtg

SEQ ID NO: 70046 - DNA, 21 bp, Homo sapiens
ctcccagggtgactgttcaac

SEQ ID NO: 70047 - DNA, 22 bp, Homo sapiens
tggtctgctgaacagccgtatc

SEQ ID NO: 70048 - DNA, 22 bp, Homo sapiens
ccagagtcccttgcagctcagt

SEQ ID NO: 70049 - DNA, 22 bp, Homo sapiens
gtcccataagtagtgcaacttg

SEQ ID NO: 70050 - DNA, 22 bp, Homo sapiens
tgaagctttaggatgggttcat

SEQ ID NO: 70051 - DNA, 22 bp, Homo sapiens
caccgaggctggagtgcagtgg

SEQ ID NO: 70052 - DNA, 17 bp, Homo sapiens
aatgtccttggaccaca

SEQ ID NO: 70053 - DNA, 20 bp, Homo sapiens
ccagagctgatggctgcccg

SEQ ID NO: 70054 - DNA, 22 bp, Homo sapiens
tacaggacattgtgcatttgtc

SEQ ID NO: 70055 - DNA, 22 bp, Homo sapiens
tcactgcgcttcagcctgggtg

SEQ ID NO: 70056 - DNA, 22 bp, Homo sapiens
ttcgggcccaggccgaggacct

SEQ ID NO: 70057 - DNA, 18 bp, Homo sapiens
agtgtcagctgcagctca

SEQ ID NO: 70058 - DNA, 22 bp, Homo sapiens
cccacgtcgaacttgctccaga

SEQ ID NO: 70059 - DNA, 22 bp, Homo sapiens
tgatcagcatcttcccagctcg

SEQ ID NO: 70060 - DNA, 22 bp, Homo sapiens
ctggaggccactgtacagattg

SEQ ID NO: 70061 - DNA, 22 bp, Homo sapiens
tgtgcacaatgtgcaggtttgt

SEQ ID NO: 70062 - DNA, 22 bp, Homo sapiens
acagattcactgcactggccat

SEQ ID NO: 70063 - DNA, 22 bp, Homo sapiens
gaagtgtagtcttgagccccca

SEQ ID NO: 70064 - DNA, 22 bp, Homo sapiens
tttcttaggctctaaaatgact

SEQ ID NO: 70065 - DNA, 22 bp, Homo sapiens
gtcctcgcggcgcgaagccagt

SEQ ID NO: 70066 - DNA, 22 bp, Homo sapiens
cttcctttgctgttcggaggtt

SEQ ID NO: 70067 - DNA, 22 bp, Homo sapiens
tcacaatatttatcttccaatt

SEQ ID NO: 70068 - DNA, 22 bp, Homo sapiens
gggaaacaacaaagtatctatg

SEQ ID NO: 70069 - DNA, 22 bp, Homo sapiens
gagcctcgtggcggccactgcg

SEQ ID NO: 70070 - DNA, 22 bp, Homo sapiens
tcggagctgtagatgaaaccct

SEQ ID NO: 70071 - DNA, 22 bp, Homo sapiens
cccaagaggtggaggttgcagt

SEQ ID NO: 70072 - DNA, 21 bp, Homo sapiens
tcacgtggtcacatgagcttt

SEQ ID NO: 70073 - DNA, 22 bp, Homo sapiens
agttgcagacgcagagatgttg

SEQ ID NO: 70074 - DNA, 22 bp, Homo sapiens
ccagatatcactgccgtgttgt

SEQ ID NO: 70075 - DNA, 22 bp, Homo sapiens
tgtgacactggccatctgggtt

SEQ ID NO: 70076 - DNA, 22 bp, Homo sapiens
atgattgaccatctgctgggct

SEQ ID NO: 70077 - DNA, 22 bp, Homo sapiens
gagaaatgcatgcatgtcatca

SEQ ID NO: 70078 - DNA, 22 bp, Homo sapiens
ctgaggctggagtgcagtggtg

SEQ ID NO: 70079 - DNA, 22 bp, Homo sapiens
agccctggtttgcagcatttgc

SEQ ID NO: 70080 - DNA, 21 bp, Homo sapiens
cctcaaagatgatggggtttc

SEQ ID NO: 70081 - DNA, 22 bp, Homo sapiens
tttttgggtccaggctgtatct

SEQ ID NO: 70082 - DNA, 22 bp, Homo sapiens
cccacagtgatcgcattcgtac

SEQ ID NO: 70083 - DNA, 22 bp, Homo sapiens
ttgctgctctgccggtacagct

SEQ ID NO: 70084 - DNA, 19 bp, Homo sapiens
tccaaagaagttcacattt

SEQ ID NO: 70085 - DNA, 22 bp, Homo sapiens
gacaagctcccggtggccctcc

SEQ ID NO: 70086 - DNA, 22 bp, Homo sapiens
cgttctctcatgatcttcccga

SEQ ID NO: 70087 - DNA, 22 bp, Homo sapiens
cgctgcagaagcgtgttcagga

SEQ ID NO: 70088 - DNA, 22 bp, Homo sapiens
cacactgtctttatgagctgta

SEQ ID NO: 70089 - DNA, 22 bp, Homo sapiens
tctgagctgggtcttgacagct

SEQ ID NO: 70090 - DNA, 22 bp, Homo sapiens
tgcccaggctggagtacagtgg

SEQ ID NO: 70091 - DNA, 20 bp, Homo sapiens
tcccccactgtttctgctac

SEQ ID NO: 70092 - DNA, 22 bp, Homo sapiens
ttggagagtgatattcagatgc

SEQ ID NO: 70093 - DNA, 22 bp, Homo sapiens
ggcaatatggtgaaaccccatc

SEQ ID NO: 70094 - DNA, 22 bp, Homo sapiens
ctggcaggagcattcacagagg

SEQ ID NO: 70095 - DNA, 22 bp, Homo sapiens
taagcccaggaatgcacttcag

SEQ ID NO: 70096 - DNA, 22 bp, Homo sapiens
gctcactgcaacctctgcctcc

SEQ ID NO: 70097 - DNA, 22 bp, Homo sapiens
gtcagatctttggggatgctgt

SEQ ID NO: 70098 - DNA, 22 bp, Homo sapiens
aaggggtgagcagaggcttcgc

SEQ ID NO: 70099 - DNA, 22 bp, Homo sapiens
caggaaagggatgggctgccac

SEQ ID NO: 70100 - DNA, 22 bp, Homo sapiens
tccaagatctacagcagtttag

SEQ ID NO: 70101 - DNA, 22 bp, Homo sapiens
gcaaacaaggacatacatcctg

SEQ ID NO: 70102 - DNA, 18 bp, Homo sapiens
ggtgagggagctggaagc

SEQ ID NO: 70103 - DNA, 22 bp, Homo sapiens
cttcctcctccatctcgaaggc

SEQ ID NO: 70104 - DNA, 22 bp, Homo sapiens
cgagagagacatggtgacctgc

SEQ ID NO: 70105 - DNA, 22 bp, Homo sapiens
ttcactcttcggcatctctgta

SEQ ID NO: 70106 - DNA, 22 bp, Homo sapiens
acttcttcttcagctgggggat

SEQ ID NO: 70107 - DNA, 22 bp, Homo sapiens
tagcaaaggatgactatgtacc

SEQ ID NO: 70108 - DNA, 22 bp, Homo sapiens
tttatagtagcatgatttatag

SEQ ID NO: 70109 - DNA, 22 bp, Homo sapiens
gagagcaggaggcagcgggacg

SEQ ID NO: 70110 - DNA, 22 bp, Homo sapiens
cagagctgtccaaaccctgaca

SEQ ID NO: 70111 - DNA, 22 bp, Homo sapiens
gggttcagtccctcttgctact

SEQ ID NO: 70112 - DNA, 22 bp, Homo sapiens
tggaggcagccgtgaaccacct

SEQ ID NO: 70113 - DNA, 22 bp, Homo sapiens
gctcactgcaagctctgcctcc

SEQ ID NO: 70114 - DNA, 22 bp, Homo sapiens
tgtaggacatgtacttgtaaca

SEQ ID NO: 70115 - DNA, 22 bp, Homo sapiens
tctcagctcatggcagccttga

SEQ ID NO: 70116 - DNA, 22 bp, Homo sapiens
gatgtgtttccaggatttgttt

SEQ ID NO: 70117 - DNA, 22 bp, Homo sapiens
gctccctggtagccatgctctc

SEQ ID NO: 70118 - DNA, 23 bp, Homo sapiens
cttcacaggttcaggggattaag

SEQ ID NO: 70119 - DNA, 23 bp, Homo sapiens
cctgcctccccatcagttataca

SEQ ID NO: 70120 - DNA, 23 bp, Homo sapiens
tgtgggcgcattgtaagggtagc

SEQ ID NO: 70121 - DNA, 19 bp, Homo sapiens
gccttcccaccacccgtcc

SEQ ID NO: 70122 - DNA, 22 bp, Homo sapiens
gcaggtggatcaccacgtcagg

SEQ ID NO: 70123 - DNA, 22 bp, Homo sapiens
ttgatacccaagtgttatgggt

SEQ ID NO: 70124 - DNA, 22 bp, Homo sapiens
tttgctattgtgaatagtgcca

SEQ ID NO: 70125 - DNA, 22 bp, Homo sapiens
attgggatgccggctgataaga

SEQ ID NO: 70126 - DNA, 22 bp, Homo sapiens
tcttcccccgtgctccagtgca

SEQ ID NO: 70127 - DNA, 22 bp, Homo sapiens
gaggcagaagttgcagtgagca

SEQ ID NO: 70128 - DNA, 21 bp, Homo sapiens
tctgatggtagatgagatgtg

SEQ ID NO: 70129 - DNA, 22 bp, Homo sapiens
gcactgcaggtgggtggagagg

SEQ ID NO: 70130 - DNA, 20 bp, Homo sapiens
tgacatagctcttggggtgc

SEQ ID NO: 70131 - DNA, 22 bp, Homo sapiens
aggtggagaagagatgggcagt

SEQ ID NO: 70132 - DNA, 22 bp, Homo sapiens
aagaggttgtctgtgatgagtt

SEQ ID NO: 70133 - DNA, 22 bp, Homo sapiens
cccaggagttggaggctgcagt

SEQ ID NO: 70134 - DNA, 22 bp, Homo sapiens
ttagtattaggatcatatttga

SEQ ID NO: 70135 - DNA, 22 bp, Homo sapiens
accgggaagtcctgcactgggc

SEQ ID NO: 70136 - DNA, 22 bp, Homo sapiens
gcctgcaactggcacagcttgt

SEQ ID NO: 70137 - DNA, 22 bp, Homo sapiens
atcattatcctcctatttgcct

SEQ ID NO: 70138 - DNA, 22 bp, Homo sapiens
actctggccatcttggaccttg

SEQ ID NO: 70139 - DNA, 23 bp, Homo sapiens
ggagcctccggtgtgtgagaggc

SEQ ID NO: 70140 - DNA, 22 bp, Homo sapiens
agaagcctgttgagagggccgt

SEQ ID NO: 70141 - DNA, 22 bp, Homo sapiens
catgcctgcctggtgggcgtgg

SEQ ID NO: 70142 - DNA, 22 bp, Homo sapiens
ggaggagacagtaaaaagcacg

SEQ ID NO: 70143 - DNA, 22 bp, Homo sapiens
ggcctttgcgtccacgccgctt

SEQ ID NO: 70144 - DNA, 22 bp, Homo sapiens
agcctgagaaaggagtttggag

SEQ ID NO: 70145 - DNA, 22 bp, Homo sapiens
caggctgatcagggctgggatg

SEQ ID NO: 70146 - DNA, 22 bp, Homo sapiens
gttcagtcacgtgcccaagttc

SEQ ID NO: 70147 - DNA, 22 bp, Homo sapiens
gatgatcatctgtaaagttaga

SEQ ID NO: 70148 - DNA, 22 bp, Homo sapiens
cttggattcctcatatgcacag

SEQ ID NO: 70149 - DNA, 22 bp, Homo sapiens
atttagaactttgtttgccaat

SEQ ID NO: 70150 - DNA, 20 bp, Homo sapiens
ttcatgggagcaaagaggcc

SEQ ID NO: 70151 - DNA, 22 bp, Homo sapiens
ctggtgtggactccgcgcggag

SEQ ID NO: 70152 - DNA, 19 bp, Homo sapiens
atgtacccagtgtcaatcc

SEQ ID NO: 70153 - DNA, 22 bp, Homo sapiens
aagagaattctggttttcctat

SEQ ID NO: 70154 - DNA, 22 bp, Homo sapiens
aaggctgaggcagtgaggcaga

SEQ ID NO: 70155 - DNA, 22 bp, Homo sapiens
ccatgtggtgggaaggagaatg

SEQ ID NO: 70156 - DNA, 18 bp, Homo sapiens
gatcgggggcgccccaag

SEQ ID NO: 70157 - DNA, 22 bp, Homo sapiens
gatatcattgagcccaggagtt

SEQ ID NO: 70158 - DNA, 17 bp, Homo sapiens
tgtagcttctccttctc

SEQ ID NO: 70159 - DNA, 22 bp, Homo sapiens
gatggaggagatggcagggtgc

SEQ ID NO: 70160 - DNA, 22 bp, Homo sapiens
gcatatgatcacgtgtgtcggt

SEQ ID NO: 70161 - DNA, 22 bp, Homo sapiens
ccagaggagttgaggctttggg

SEQ ID NO: 70162 - DNA, 20 bp, Homo sapiens
gccactgggcaccagcaggg

SEQ ID NO: 70163 - DNA, 22 bp, Homo sapiens
acagacaagtagttcagacaag

SEQ ID NO: 70164 - DNA, 22 bp, Homo sapiens
cccaggaggtggagcttgcagt

SEQ ID NO: 70165 - DNA, 22 bp, Homo sapiens
tcccctggtgccacgatctgct

SEQ ID NO: 70166 - DNA, 22 bp, Homo sapiens
atacaaagtattgatcctgagt

SEQ ID NO: 70167 - DNA, 22 bp, Homo sapiens
caggctgctgcctagaatgaca

SEQ ID NO: 70168 - DNA, 22 bp, Homo sapiens
cctacagttatattcttgattg

SEQ ID NO: 70169 - DNA, 22 bp, Homo sapiens
cccgggaggaggaagttgcagt

SEQ ID NO: 70170 - DNA, 22 bp, Homo sapiens
gaagagctgacagtgtcatcct

SEQ ID NO: 70171 - DNA, 22 bp, Homo sapiens
cccagagcatgtgctgcctttg

SEQ ID NO: 70172 - DNA, 22 bp, Homo sapiens
tgttatcagagagaggtgctgt

SEQ ID NO: 70173 - DNA, 22 bp, Homo sapiens
gctggtgagcaaaggagaagga

SEQ ID NO: 70174 - DNA, 19 bp, Homo sapiens
taccatccaagctggtttg

SEQ ID NO: 70175 - DNA, 22 bp, Homo sapiens
agggctgcccagtgtgagagct

SEQ ID NO: 70176 - DNA, 22 bp, Homo sapiens
gggccctgcgactcgcggcgga

SEQ ID NO: 70177 - DNA, 22 bp, Homo sapiens
tctctcttttttgaacccgctc

SEQ ID NO: 70178 - DNA, 22 bp, Homo sapiens
ttacatgtggtgtgaagaagag

SEQ ID NO: 70179 - DNA, 22 bp, Homo sapiens
ggggccgaccgcggttcaggcc

SEQ ID NO: 70180 - DNA, 22 bp, Homo sapiens
tttaaaaaactagtctgagtct

SEQ ID NO: 70181 - DNA, 22 bp, Homo sapiens
ttgagcccaggaggcctgggtg

SEQ ID NO: 70182 - DNA, 22 bp, Homo sapiens
caaatactacgattcttgcagt

SEQ ID NO: 70183 - DNA, 22 bp, Homo sapiens
tgatggggaattaattaatggg

SEQ ID NO: 70184 - DNA, 22 bp, Homo sapiens
tccttgcagggtttgataaaga

SEQ ID NO: 70185 - DNA, 22 bp, Homo sapiens
taagtgagggagctgggacttg

SEQ ID NO: 70186 - DNA, 22 bp, Homo sapiens
agctcactgcaacctccgcctc

SEQ ID NO: 70187 - DNA, 22 bp, Homo sapiens
tgagatggagtctcgctctgtt

SEQ ID NO: 70188 - DNA, 18 bp, Homo sapiens
gtcaggcatgaatctggg

SEQ ID NO: 70189 - DNA, 22 bp, Homo sapiens
ttataagactgtagtgagtatt

SEQ ID NO: 70190 - DNA, 22 bp, Homo sapiens
ctaggtgatccactgctctctt

SEQ ID NO: 70191 - DNA, 22 bp, Homo sapiens
ttctggaaggatgtttctatct

SEQ ID NO: 70192 - DNA, 22 bp, Homo sapiens
aggcaggaggatcatggatgca

SEQ ID NO: 70193 - DNA, 22 bp, Homo sapiens
actgcaacctccgcctgccagg

SEQ ID NO: 70194 - DNA, 22 bp, Homo sapiens
tctttgctattgtgaatagtgc

SEQ ID NO: 70195 - DNA, 22 bp, Homo sapiens
gaggtggccaagcgaggaaggg

SEQ ID NO: 70196 - DNA, 22 bp, Homo sapiens
aagtcagacagctgagctgcct

SEQ ID NO: 70197 - DNA, 22 bp, Homo sapiens
aagaaatgctgatgttggatgg

SEQ ID NO: 70198 - DNA, 22 bp, Homo sapiens
ccagcatccatgctccctcggg

SEQ ID NO: 70199 - DNA, 22 bp, Homo sapiens
ggggcccctcggacacgtgcgg

SEQ ID NO: 70200 - DNA, 22 bp, Homo sapiens
gggccggagctgggtcccgcgc

SEQ ID NO: 70201 - DNA, 22 bp, Homo sapiens
gtctatatattgcttgaataat

SEQ ID NO: 70202 - DNA, 22 bp, Homo sapiens
tcagccccacggggtcagccaa

SEQ ID NO: 70203 - DNA, 22 bp, Homo sapiens
ttgcatagtgctgaggttcggg

SEQ ID NO: 70204 - DNA, 22 bp, Homo sapiens
acgcctgtaatcccagcacttt

SEQ ID NO: 70205 - DNA, 22 bp, Homo sapiens
gcctgtgtctgggtggccagag

SEQ ID NO: 70206 - DNA, 22 bp, Homo sapiens
ttcattcttttacatgtgaata

SEQ ID NO: 70207 - DNA, 22 bp, Homo sapiens
aatgccttggagagcctagagg

SEQ ID NO: 70208 - DNA, 22 bp, Homo sapiens
aggaaggactccatggtccgtc

SEQ ID NO: 70209 - DNA, 22 bp, Homo sapiens
ggtcactttaccccttggagcc

SEQ ID NO: 70210 - DNA, 22 bp, Homo sapiens
atgaggcaggagtgcagtggca

SEQ ID NO: 70211 - DNA, 22 bp, Homo sapiens
gaagctgagctgaggcatgttg

SEQ ID NO: 70212 - DNA, 22 bp, Homo sapiens
aagcatttcaggtagagatatt

SEQ ID NO: 70213 - DNA, 22 bp, Homo sapiens
ctgggaggcggagcttgcagtg

SEQ ID NO: 70214 - DNA, 22 bp, Homo sapiens
ttgggcctctcaaagtgctggg

SEQ ID NO: 70215 - DNA, 22 bp, Homo sapiens
gcggtagctcaagcttgtaatc

SEQ ID NO: 70216 - DNA, 22 bp, Homo sapiens
acctggccagtggggccgcgct

SEQ ID NO: 70217 - DNA, 22 bp, Homo sapiens
gaggtgggcggatcacaaggtc

SEQ ID NO: 70218 - DNA, 22 bp, Homo sapiens
catgcggctctttccaaaccgg

SEQ ID NO: 70219 - DNA, 23 bp, Homo sapiens
gacattggctgtctgatgcaggg

SEQ ID NO: 70220 - DNA, 22 bp, Homo sapiens
tgttgattagtgtttagactta

SEQ ID NO: 70221 - DNA, 22 bp, Homo sapiens
cttgtcttgcacacggttgcca

SEQ ID NO: 70222 - DNA, 22 bp, Homo sapiens
actgcacttcagcctgggtgtc

SEQ ID NO: 70223 - DNA, 22 bp, Homo sapiens
ttaccaaatgaaatagagattt

SEQ ID NO: 70224 - DNA, 22 bp, Homo sapiens
gccaccccataggtgttaggtg

SEQ ID NO: 70225 - DNA, 22 bp, Homo sapiens
gagagagctctgtgcctgggat

SEQ ID NO: 70226 - DNA, 22 bp, Homo sapiens
ttccagagagttattcccctgg

SEQ ID NO: 70227 - DNA, 22 bp, Homo sapiens
ttttcatttttgtagatgcaag

SEQ ID NO: 70228 - DNA, 22 bp, Homo sapiens
tttgagtgcccatgtttcccag

SEQ ID NO: 70229 - DNA, 22 bp, Homo sapiens
gtgggggcaggcagtgctagga

SEQ ID NO: 70230 - DNA, 22 bp, Homo sapiens
tcagtatcaatagcgtcacaat

SEQ ID NO: 70231 - DNA, 22 bp, Homo sapiens
agctggagatgagtgacgtgcc

SEQ ID NO: 70232 - DNA, 22 bp, Homo sapiens
gcaagacctatctagttgctgt

SEQ ID NO: 70233 - DNA, 22 bp, Homo sapiens
tcaggagtgccagtaccttttg

SEQ ID NO: 70234 - DNA, 22 bp, Homo sapiens
agacactgttctcacatgcttg

SEQ ID NO: 70235 - DNA, 22 bp, Homo sapiens
ttcaaagcagagggtcaataca

SEQ ID NO: 70236 - DNA, 22 bp, Homo sapiens
tgtagatattaattattccttt

SEQ ID NO: 70237 - DNA, 22 bp, Homo sapiens
gacaggcttccactatgttgcc

SEQ ID NO: 70238 - DNA, 19 bp, Homo sapiens
aggaatggaattaattctg

SEQ ID NO: 70239 - DNA, 22 bp, Homo sapiens
cctgcagacacttgtccagcaa

SEQ ID NO: 70240 - DNA, 22 bp, Homo sapiens
tctttgctccacactctagaga

SEQ ID NO: 70241 - DNA, 22 bp, Homo sapiens
atatacacatctttttaaatat

SEQ ID NO: 70242 - DNA, 22 bp, Homo sapiens
tgggaagggtcaacagctggaa

SEQ ID NO: 70243 - DNA, 22 bp, Homo sapiens
gggaagagggagctggaatgat

SEQ ID NO: 70244 - DNA, 22 bp, Homo sapiens
gcaggcggaggttgcagtgagc

SEQ ID NO: 70245 - DNA, 22 bp, Homo sapiens
aagtcacactagacaactgagg

SEQ ID NO: 70246 - DNA, 22 bp, Homo sapiens
agtgcaatggtgccatcatagc

SEQ ID NO: 70247 - DNA, 22 bp, Homo sapiens
tctttctacatcatttgcttct

SEQ ID NO: 70248 - DNA, 22 bp, Homo sapiens
aaatgcaacgggctttccttat

SEQ ID NO: 70249 - DNA, 22 bp, Homo sapiens
atcttgttaaaaagcagattct

SEQ ID NO: 70250 - DNA, 22 bp, Homo sapiens
aacccaggaggcagatgttgtg

SEQ ID NO: 70251 - DNA, 22 bp, Homo sapiens
tgggatgccggcaggaggcaat

SEQ ID NO: 70252 - DNA, 22 bp, Homo sapiens
ctgtggccagagcgccgttgac

SEQ ID NO: 70253 - DNA, 22 bp, Homo sapiens
ccaggctggagtgcaatggcat

SEQ ID NO: 70254 - DNA, 22 bp, Homo sapiens
acatcatttgtctgtagctgaa

SEQ ID NO: 70255 - DNA, 22 bp, Homo sapiens
tccgcccgcacgtatggagtgg

SEQ ID NO: 70256 - DNA, 22 bp, Homo sapiens
ccgcaaggcagaggttgcagtg

SEQ ID NO: 70257 - DNA, 22 bp, Homo sapiens
tttgttttcaatgtgtcattca

SEQ ID NO: 70258 - DNA, 22 bp, Homo sapiens
gggtggagagaaagaaacgtga

SEQ ID NO: 70259 - DNA, 22 bp, Homo sapiens
ttttccttcatatcccttatgt

SEQ ID NO: 70260 - DNA, 22 bp, Homo sapiens
tgagtggacacctgcttcttta

SEQ ID NO: 70261 - DNA, 21 bp, Homo sapiens
ctggccactgcacctcttcct

SEQ ID NO: 70262 - DNA, 22 bp, Homo sapiens
gaagtattactctgaatgtatt

SEQ ID NO: 70263 - DNA, 22 bp, Homo sapiens
cagtggcctctggctttgctgt

SEQ ID NO: 70264 - DNA, 22 bp, Homo sapiens
tcactgccattagttggttaat

SEQ ID NO: 70265 - DNA, 22 bp, Homo sapiens
tagcccaggctggagtgcaggg

SEQ ID NO: 70266 - DNA, 22 bp, Homo sapiens
tttacctttgtgggtctccctc

SEQ ID NO: 70267 - DNA, 22 bp, Homo sapiens
gctcccaccttaaccttcacat

SEQ ID NO: 70268 - DNA, 22 bp, Homo sapiens
gcttttgaggtcctgctcagcc

SEQ ID NO: 70269 - DNA, 22 bp, Homo sapiens
tgggaggccgaggcaggtggat

SEQ ID NO: 70270 - DNA, 22 bp, Homo sapiens
tgttataacatcggttgactaa

SEQ ID NO: 70271 - DNA, 22 bp, Homo sapiens
tatctattatgttctatgtgtc

SEQ ID NO: 70272 - DNA, 22 bp, Homo sapiens
cagcctgccgtcagccaggtag

SEQ ID NO: 70273 - DNA, 22 bp, Homo sapiens
atgtcatgaggctagcccccaa

SEQ ID NO: 70274 - DNA, 22 bp, Homo sapiens
tcagaacatgtttgagtaagac

SEQ ID NO: 70275 - DNA, 22 bp, Homo sapiens
catcatactgtttacactcaaa

SEQ ID NO: 70276 - DNA, 22 bp, Homo sapiens
ctgctttaaaactgatacatga

SEQ ID NO: 70277 - DNA, 22 bp, Homo sapiens
gacactgcacttggggcccaca

SEQ ID NO: 70278 - DNA, 22 bp, Homo sapiens
aaaatcctgctgactcgagatg

SEQ ID NO: 70279 - DNA, 22 bp, Homo sapiens
cagagagaatcttggcagctga

SEQ ID NO: 70280 - DNA, 22 bp, Homo sapiens
tccaggattgtcagccagaagg

SEQ ID NO: 70281 - DNA, 22 bp, Homo sapiens
ggaggctgaggcaggcggatca

SEQ ID NO: 70282 - DNA, 22 bp, Homo sapiens
cgagagatgggttggcaggggc

SEQ ID NO: 70283 - DNA, 22 bp, Homo sapiens
tgcaccctcatcagtcaaatgg

SEQ ID NO: 70284 - DNA, 22 bp, Homo sapiens
tctggcttccctctgttctggg

SEQ ID NO: 70285 - DNA, 22 bp, Homo sapiens
ggcagcactgcagcttgttggg

SEQ ID NO: 70286 - DNA, 22 bp, Homo sapiens
ggcttcagtggccagagatgat

SEQ ID NO: 70287 - DNA, 18 bp, Homo sapiens
tgggaagaaattcttctc

SEQ ID NO: 70288 - DNA, 22 bp, Homo sapiens
ctgtcctgccagtcctggactc

SEQ ID NO: 70289 - DNA, 22 bp, Homo sapiens
gcgtggcttagagtggggtacc

SEQ ID NO: 70290 - DNA, 22 bp, Homo sapiens
tctaatccttgctacctgggtg

SEQ ID NO: 70291 - DNA, 22 bp, Homo sapiens
tgtatgaggcatacatcaggca

SEQ ID NO: 70292 - DNA, 22 bp, Homo sapiens
gtggggtagatctttctcagga

SEQ ID NO: 70293 - DNA, 22 bp, Homo sapiens
gctctctgcagcctccttggag

SEQ ID NO: 70294 - DNA, 22 bp, Homo sapiens
agcatggccatctgggccgtcc

SEQ ID NO: 70295 - DNA, 22 bp, Homo sapiens
tgggttcgatgtatatgtagcc

SEQ ID NO: 70296 - DNA, 22 bp, Homo sapiens
gggacttaatgcagagagggac

SEQ ID NO: 70297 - DNA, 22 bp, Homo sapiens
ggcgccgcactcggtgcagccg

SEQ ID NO: 70298 - DNA, 22 bp, Homo sapiens
aatggaatacctaggtggccca

SEQ ID NO: 70299 - DNA, 22 bp, Homo sapiens
atttgtgggactataatgcagg

SEQ ID NO: 70300 - DNA, 22 bp, Homo sapiens
agtccaaagcagatgagggcca

SEQ ID NO: 70301 - DNA, 22 bp, Homo sapiens
gatgtggctgctctaaagccca

SEQ ID NO: 70302 - DNA, 22 bp, Homo sapiens
atgccactgcacttcagcctgg

SEQ ID NO: 70303 - DNA, 22 bp, Homo sapiens
cactgcaacctccatcttctgg

SEQ ID NO: 70304 - DNA, 22 bp, Homo sapiens
gaggaggcttccgggaggcacg

SEQ ID NO: 70305 - DNA, 22 bp, Homo sapiens
aactgctgacaagtgaccagtg

SEQ ID NO: 70306 - DNA, 22 bp, Homo sapiens
cacgggagacgtgatcttggac

SEQ ID NO: 70307 - DNA, 22 bp, Homo sapiens
acacttggagcaacacttatgg

SEQ ID NO: 70308 - DNA, 20 bp, Homo sapiens
caagggtttgcattggcttt

SEQ ID NO: 70309 - DNA, 22 bp, Homo sapiens
tgtgacctcatcttaactggaa

SEQ ID NO: 70310 - DNA, 22 bp, Homo sapiens
gagtggctattgatccgtgatg

SEQ ID NO: 70311 - DNA, 22 bp, Homo sapiens
gaggctgaggttgcagtgagcc

SEQ ID NO: 70312 - DNA, 22 bp, Homo sapiens
aacttaggaaaataaggcatga

SEQ ID NO: 70313 - DNA, 22 bp, Homo sapiens
tcattacaagatttccaatttg

SEQ ID NO: 70314 - DNA, 22 bp, Homo sapiens
ggaggcggaggctgcagtgagc

SEQ ID NO: 70315 - DNA, 22 bp, Homo sapiens
aggtaaagacagtgaaagaggg

SEQ ID NO: 70316 - DNA, 22 bp, Homo sapiens
tttgaagggcacgacaatagtt

SEQ ID NO: 70317 - DNA, 22 bp, Homo sapiens
agagcactttcgagagccggag

SEQ ID NO: 70318 - DNA, 22 bp, Homo sapiens
tgcaggctcttggtgacgtggg

SEQ ID NO: 70319 - DNA, 22 bp, Homo sapiens
tttctttatcatagcatctttg

SEQ ID NO: 70320 - DNA, 22 bp, Homo sapiens
aaactgtcctcccgaggtttcc

SEQ ID NO: 70321 - DNA, 22 bp, Homo sapiens
gagaaagcttctttcccacagg

SEQ ID NO: 70322 - DNA, 22 bp, Homo sapiens
tgtgctggagatcagcttattt

SEQ ID NO: 70323 - DNA, 22 bp, Homo sapiens
gaccttgtgatctgcccacctt

SEQ ID NO: 70324 - DNA, 18 bp, Homo sapiens
tcctttctccctcatctt

SEQ ID NO: 70325 - DNA, 22 bp, Homo sapiens
gcccagccacagtcactttcat

SEQ ID NO: 70326 - DNA, 22 bp, Homo sapiens
ggcaaagccctgcctggttcaa

SEQ ID NO: 70327 - DNA, 22 bp, Homo sapiens
actcatgtaagcggaatgtagt

SEQ ID NO: 70328 - DNA, 22 bp, Homo sapiens
cttccgtgtcagttccaggtgg

SEQ ID NO: 70329 - DNA, 22 bp, Homo sapiens
ttctcttacattttctcagcct

SEQ ID NO: 70330 - DNA, 22 bp, Homo sapiens
gggcaccttgggtctcaggcaa

SEQ ID NO: 70331 - DNA, 22 bp, Homo sapiens
gtgtgcacagagctccagtgtt

SEQ ID NO: 70332 - DNA, 22 bp, Homo sapiens
accagcctggccaacatggcaa

SEQ ID NO: 70333 - DNA, 22 bp, Homo sapiens
gctcccagtctgatggaggaga

SEQ ID NO: 70334 - DNA, 22 bp, Homo sapiens
agctggggctgtggttgtgatt

SEQ ID NO: 70335 - DNA, 22 bp, Homo sapiens
ctgtggctctttagttgagcac

SEQ ID NO: 70336 - DNA, 22 bp, Homo sapiens
gaggggagcccccatcctccag

SEQ ID NO: 70337 - DNA, 22 bp, Homo sapiens
agggaagtggtctgggaacttg

SEQ ID NO: 70338 - DNA, 22 bp, Homo sapiens
actccacaccacgggggccgcc

SEQ ID NO: 70339 - DNA, 22 bp, Homo sapiens
atgtatacgtgcaggtcacagg

SEQ ID NO: 70340 - DNA, 17 bp, Homo sapiens
caggtgacctggtgatg

SEQ ID NO: 70341 - DNA, 22 bp, Homo sapiens
ttgtcgggcttacgcagggcca

SEQ ID NO: 70342 - DNA, 22 bp, Homo sapiens
ctcggagggcaacagaagtgct

SEQ ID NO: 70343 - DNA, 20 bp, Homo sapiens
cagagccagggttttgtttt

SEQ ID NO: 70344 - DNA, 22 bp, Homo sapiens
cggccgctgacaaatagttccc

SEQ ID NO: 70345 - DNA, 22 bp, Homo sapiens
atatccagcagcaggtgagtat

SEQ ID NO: 70346 - DNA, 22 bp, Homo sapiens
tcagattgttggagccaaacag

SEQ ID NO: 70347 - DNA, 22 bp, Homo sapiens
ccgtggtcacctgagctccttg

SEQ ID NO: 70348 - DNA, 22 bp, Homo sapiens
cacgcacgctgggtggaggcgc

SEQ ID NO: 70349 - DNA, 22 bp, Homo sapiens
tatcacagccttttggtgaggg

SEQ ID NO: 70350 - DNA, 22 bp, Homo sapiens
gcggcaggagtaaaggaggaag

SEQ ID NO: 70351 - DNA, 22 bp, Homo sapiens
ctggctgggagcgagctgctca

SEQ ID NO: 70352 - DNA, 22 bp, Homo sapiens
ggtgacagtggttaaaatttgt

SEQ ID NO: 70353 - DNA, 17 bp, Homo sapiens
tccttcagtgcctctgc

SEQ ID NO: 70354 - DNA, 22 bp, Homo sapiens
gttcccattggggatcttgggc

SEQ ID NO: 70355 - DNA, 22 bp, Homo sapiens
ctggccagatgttacgtccaat

SEQ ID NO: 70356 - DNA, 22 bp, Homo sapiens
gaggctgaggcggatggatcac

SEQ ID NO: 70357 - DNA, 22 bp, Homo sapiens
ctctttggatagaattacaaag

SEQ ID NO: 70358 - DNA, 22 bp, Homo sapiens
ctatgaccccagcatgaataag

SEQ ID NO: 70359 - DNA, 22 bp, Homo sapiens
ccctgctgtcaggtgctgggag

SEQ ID NO: 70360 - DNA, 22 bp, Homo sapiens
aactcaaagatgcatgacgctt

SEQ ID NO: 70361 - DNA, 22 bp, Homo sapiens
tgagatcattgacttgttcctg

SEQ ID NO: 70362 - DNA, 22 bp, Homo sapiens
ttgtgttaaggtgcatctagtg

SEQ ID NO: 70363 - DNA, 22 bp, Homo sapiens
aagaagcattctttcattggtt

SEQ ID NO: 70364 - DNA, 22 bp, Homo sapiens
atgtttttggaaatgggaacat

SEQ ID NO: 70365 - DNA, 22 bp, Homo sapiens
cccaggctggagtgtaatggtg

SEQ ID NO: 70366 - DNA, 22 bp, Homo sapiens
cttctggcgttggaggtctgag

SEQ ID NO: 70367 - DNA, 22 bp, Homo sapiens
gtggctgcagcggctgtggaga

SEQ ID NO: 70368 - DNA, 22 bp, Homo sapiens
agtgctgggctatctactgcta

SEQ ID NO: 70369 - DNA, 22 bp, Homo sapiens
cggctgggttcggctgcaggcc

SEQ ID NO: 70370 - DNA, 22 bp, Homo sapiens
accattgccccctagtgtctgt

SEQ ID NO: 70371 - DNA, 22 bp, Homo sapiens
gggatttcaccatgttggttgg

SEQ ID NO: 70372 - DNA, 22 bp, Homo sapiens
tagctgggactactggccctgc

SEQ ID NO: 70373 - DNA, 22 bp, Homo sapiens
aacaattactaccaaggcctgt

SEQ ID NO: 70374 - DNA, 22 bp, Homo sapiens
atcttctcatgtgtaatgaggt

SEQ ID NO: 70375 - DNA, 22 bp, Homo sapiens
aggtaaatgtcagagcctttaa

SEQ ID NO: 70376 - DNA, 22 bp, Homo sapiens
tgagacaggcttccttcttggg

SEQ ID NO: 70377 - DNA, 22 bp, Homo sapiens
cctggcactgctgaagtcctgg

SEQ ID NO: 70378 - DNA, 22 bp, Homo sapiens
gagagttagttgagcagtctga

SEQ ID NO: 70379 - DNA, 22 bp, Homo sapiens
gggaaggccttgtcagcggatt

SEQ ID NO: 70380 - DNA, 22 bp, Homo sapiens
agtcttagaactacagtgccta

SEQ ID NO: 70381 - DNA, 21 bp, Homo sapiens
tggcggggacttgtggctgcc

SEQ ID NO: 70382 - DNA, 22 bp, Homo sapiens
tccaggtgacagagacaggata

SEQ ID NO: 70383 - DNA, 22 bp, Homo sapiens
actgcatttgtctgtctcaatt

SEQ ID NO: 70384 - DNA, 22 bp, Homo sapiens
aacacagcatcccttaggtcgt

SEQ ID NO: 70385 - DNA, 22 bp, Homo sapiens
attgtcagtttaatatagtcaa

SEQ ID NO: 70386 - DNA, 22 bp, Homo sapiens
gcacagagagggaaggtaactt

SEQ ID NO: 70387 - DNA, 22 bp, Homo sapiens
cttagagatgggttttacttag

SEQ ID NO: 70388 - DNA, 22 bp, Homo sapiens
taagggttcagaatgcagtggt

SEQ ID NO: 70389 - DNA, 22 bp, Homo sapiens
atatgtggcattatttctgagg

SEQ ID NO: 70390 - DNA, 22 bp, Homo sapiens
gacccggctccaggcccagcag

SEQ ID NO: 70391 - DNA, 22 bp, Homo sapiens
aggccctattcaatggggccca

SEQ ID NO: 70392 - DNA, 22 bp, Homo sapiens
taagtcttcatagtctaatgtc

SEQ ID NO: 70393 - DNA, 22 bp, Homo sapiens
atgccactgcgctctagcctgg

SEQ ID NO: 70394 - DNA, 22 bp, Homo sapiens
caggcaggtcagtgaagaagga

SEQ ID NO: 70395 - DNA, 22 bp, Homo sapiens
cacccaggttggagtgcagtgg

SEQ ID NO: 70396 - DNA, 22 bp, Homo sapiens
gagcaggtgcctgtagctctct

SEQ ID NO: 70397 - DNA, 22 bp, Homo sapiens
gcccaggaggcagaggttgtgg

SEQ ID NO: 70398 - DNA, 22 bp, Homo sapiens
actcccagaacatgctcttctt

SEQ ID NO: 70399 - DNA, 22 bp, Homo sapiens
ttatgatttgccacagattggt

SEQ ID NO: 70400 - DNA, 22 bp, Homo sapiens
agaccactaaaactttctctat

SEQ ID NO: 70401 - DNA, 23 bp, Homo sapiens
ttgcttgagcccaggaagtggag

SEQ ID NO: 70402 - DNA, 22 bp, Homo sapiens
ctggaaggagcccgggcggatc

SEQ ID NO: 70403 - DNA, 22 bp, Homo sapiens
aggctgaggcaagaggatcact

SEQ ID NO: 70404 - DNA, 22 bp, Homo sapiens
gacagtgaacaggttcccactg

SEQ ID NO: 70405 - DNA, 22 bp, Homo sapiens
aaggagtggggcatatcacaga

SEQ ID NO: 70406 - DNA, 22 bp, Homo sapiens
tcctgtgatattgtttgttata

SEQ ID NO: 70407 - DNA, 22 bp, Homo sapiens
cctgggccctcaccgccggtgg

SEQ ID NO: 70408 - DNA, 19 bp, Homo sapiens
tcctggggaggggcatggc

SEQ ID NO: 70409 - DNA, 22 bp, Homo sapiens
gggacaatggaggcctctctcc

SEQ ID NO: 70410 - DNA, 22 bp, Homo sapiens
acgcccagactcccatactttg

SEQ ID NO: 70411 - DNA, 23 bp, Homo sapiens
cactgcaatctctgcctcctggg

SEQ ID NO: 70412 - DNA, 22 bp, Homo sapiens
ttgtgctcctatgagaatctaa

SEQ ID NO: 70413 - DNA, 22 bp, Homo sapiens
ccgaggtcctggacttggccct

SEQ ID NO: 70414 - DNA, 22 bp, Homo sapiens
agggcgacaatggagagcgttt

SEQ ID NO: 70415 - DNA, 22 bp, Homo sapiens
tgcctccctggcaagtctctcc

SEQ ID NO: 70416 - DNA, 23 bp, Homo sapiens
gctcatcaggcttagagtcaagg

SEQ ID NO: 70417 - DNA, 22 bp, Homo sapiens
cccaggctggagtgcagtggcg

SEQ ID NO: 70418 - DNA, 22 bp, Homo sapiens
aagagagtcagtctgagcacca

SEQ ID NO: 70419 - DNA, 22 bp, Homo sapiens
tggacacaaagatcaaatattg

SEQ ID NO: 70420 - DNA, 22 bp, Homo sapiens
ttgtgaatagtgccgcaataaa

SEQ ID NO: 70421 - DNA, 22 bp, Homo sapiens
tctaaattactttgggcagtat

SEQ ID NO: 70422 - DNA, 22 bp, Homo sapiens
tacaaaaaattgatactgacga

SEQ ID NO: 70423 - DNA, 22 bp, Homo sapiens
cccaaaggttgaggctgcagtg

SEQ ID NO: 70424 - DNA, 22 bp, Homo sapiens
tggctgtgtccctgtccagagt

SEQ ID NO: 70425 - DNA, 22 bp, Homo sapiens
tccagtgtttttcttcacaggt

SEQ ID NO: 70426 - DNA, 22 bp, Homo sapiens
attgcacatctgcactacagcc

SEQ ID NO: 70427 - DNA, 22 bp, Homo sapiens
tttcactcagctctcattgtct

SEQ ID NO: 70428 - DNA, 22 bp, Homo sapiens
ttgcactccagcccgagcaaca

SEQ ID NO: 70429 - DNA, 22 bp, Homo sapiens
gaaagacatagttgcaagatgg

SEQ ID NO: 70430 - DNA, 20 bp, Homo sapiens
aggggcacctgcgacggggc

SEQ ID NO: 70431 - DNA, 22 bp, Homo sapiens
gcctcatcgctgctcggcccgg

SEQ ID NO: 70432 - DNA, 22 bp, Homo sapiens
gttatataagacaaatcagagt

SEQ ID NO: 70433 - DNA, 22 bp, Homo sapiens
gccagggtcctgaagaccaagt

SEQ ID NO: 70434 - DNA, 22 bp, Homo sapiens
cctcggctgggccttggccact

SEQ ID NO: 70435 - DNA, 22 bp, Homo sapiens
gcagcgaggtgatgaaatagct

SEQ ID NO: 70436 - DNA, 19 bp, Homo sapiens
gattttgctgaaacccaca

SEQ ID NO: 70437 - DNA, 22 bp, Homo sapiens
ttctcaagaacatatgtagggt

SEQ ID NO: 70438 - DNA, 22 bp, Homo sapiens
gggaagatagtgttgagggccc

SEQ ID NO: 70439 - DNA, 22 bp, Homo sapiens
ttgccgccgtctgctcgccccg

SEQ ID NO: 70440 - DNA, 22 bp, Homo sapiens
cctgcacatgtgtgcgcctgta

SEQ ID NO: 70441 - DNA, 22 bp, Homo sapiens
cactgcactccagcctggcgac

SEQ ID NO: 70442 - DNA, 22 bp, Homo sapiens
ggggaaggaaagttattagcag

SEQ ID NO: 70443 - DNA, 22 bp, Homo sapiens
atatattttttgagacagagtc

SEQ ID NO: 70444 - DNA, 22 bp, Homo sapiens
ccagaggtgctctttggaagtg

SEQ ID NO: 70445 - DNA, 22 bp, Homo sapiens
tggtattacttctagacacaag

SEQ ID NO: 70446 - DNA, 21 bp, Homo sapiens
gttcttgcaggatttccttcc

SEQ ID NO: 70447 - DNA, 22 bp, Homo sapiens
ttatttttaaaagttcacacag

SEQ ID NO: 70448 - DNA, 22 bp, Homo sapiens
gagcccaggaagtggaggctga

SEQ ID NO: 70449 - DNA, 22 bp, Homo sapiens
agggccagcactcctggcagga

SEQ ID NO: 70450 - DNA, 22 bp, Homo sapiens
gctccccaaaagctccaggaaa

SEQ ID NO: 70451 - DNA, 22 bp, Homo sapiens
ctgggcgcgtcccctgaggcgg

SEQ ID NO: 70452 - DNA, 22 bp, Homo sapiens
aacccgagggccccaggctcgg

SEQ ID NO: 70453 - DNA, 22 bp, Homo sapiens
ggtgggaggactgtttgaggca

SEQ ID NO: 70454 - DNA, 22 bp, Homo sapiens
gaagcctcaacatctctgcgtc

SEQ ID NO: 70455 - DNA, 22 bp, Homo sapiens
gcacggctaatttttgtatttt

SEQ ID NO: 70456 - DNA, 22 bp, Homo sapiens
gacagacacaattgatccatga

SEQ ID NO: 70457 - DNA, 22 bp, Homo sapiens
actgcaacctccacctcctggg

SEQ ID NO: 70458 - DNA, 22 bp, Homo sapiens
acagtgcttagcacagagtaga

SEQ ID NO: 70459 - DNA, 22 bp, Homo sapiens
gcgctgcgcctcctcttccgca

SEQ ID NO: 70460 - DNA, 22 bp, Homo sapiens
tactgcactccagcctgggtga

SEQ ID NO: 70461 - DNA, 22 bp, Homo sapiens
atgtgtattacctcgattgtga

SEQ ID NO: 70462 - DNA, 23 bp, Homo sapiens
gcctgccgcctggctgagaactg

SEQ ID NO: 70463 - DNA, 22 bp, Homo sapiens
agatcacagtggcaactccctt

SEQ ID NO: 70464 - DNA, 22 bp, Homo sapiens
cacttcattgggaccagggctg

SEQ ID NO: 70465 - DNA, 22 bp, Homo sapiens
gggctagcctcttccctgctcc

SEQ ID NO: 70466 - DNA, 22 bp, Homo sapiens
aatttgttataacttgggctga

SEQ ID NO: 70467 - DNA, 22 bp, Homo sapiens
gttactcctggttgagcttggt

SEQ ID NO: 70468 - DNA, 22 bp, Homo sapiens
ctggagggctgcagcgaggctg

SEQ ID NO: 70469 - DNA, 18 bp, Homo sapiens
acggatccgcgggaccgc

SEQ ID NO: 70470 - DNA, 21 bp, Homo sapiens
tcctgtaagcttgggtggctc

SEQ ID NO: 70471 - DNA, 22 bp, Homo sapiens
tcagcctgctccaagtgctgcc

SEQ ID NO: 70472 - DNA, 22 bp, Homo sapiens
ccaaaaggaactttttgaaggt

SEQ ID NO: 70473 - DNA, 22 bp, Homo sapiens
gcaggagaacaaagcaagctgc

SEQ ID NO: 70474 - DNA, 22 bp, Homo sapiens
caggagatgacagggaagaacc

SEQ ID NO: 70475 - DNA, 22 bp, Homo sapiens
gagagtgagatcctcctgggga

SEQ ID NO: 70476 - DNA, 22 bp, Homo sapiens
ggcaatagttgtgggttcttta

SEQ ID NO: 70477 - DNA, 22 bp, Homo sapiens
ggccagcctggggctcccagac

SEQ ID NO: 70478 - DNA, 22 bp, Homo sapiens
gtagaagagattttattcctta

SEQ ID NO: 70479 - DNA, 22 bp, Homo sapiens
gatgcgggcccgctccactgcc

SEQ ID NO: 70480 - DNA, 22 bp, Homo sapiens
gaggggctgccctggtgtcagg

SEQ ID NO: 70481 - DNA, 22 bp, Homo sapiens
gtgaaatatttaacgtccaggt

SEQ ID NO: 70482 - DNA, 22 bp, Homo sapiens
ccggcgtctcttccacttccta

SEQ ID NO: 70483 - DNA, 22 bp, Homo sapiens
ctcggaatggaacaacagcggt

SEQ ID NO: 70484 - DNA, 22 bp, Homo sapiens
gcaccgccttggaccgcccgct

SEQ ID NO: 70485 - DNA, 22 bp, Homo sapiens
ggaggtgactggatcatgggca

SEQ ID NO: 70486 - DNA, 22 bp, Homo sapiens
aaaagagcttggttgattttgc

SEQ ID NO: 70487 - DNA, 22 bp, Homo sapiens
gttctgggagatcttgagcttc

SEQ ID NO: 70488 - DNA, 22 bp, Homo sapiens
aaagccttcttgtatcgagcca

SEQ ID NO: 70489 - DNA, 22 bp, Homo sapiens
agataaagtccaaactgtgtag

SEQ ID NO: 70490 - DNA, 22 bp, Homo sapiens
agcctggcctgggcaggcacat

SEQ ID NO: 70491 - DNA, 22 bp, Homo sapiens
cctgacgaaaggcgtgctggag

SEQ ID NO: 70492 - DNA, 22 bp, Homo sapiens
attgtctctgaattttcagctg

SEQ ID NO: 70493 - DNA, 17 bp, Homo sapiens
cccgttctcttcgctgg

SEQ ID NO: 70494 - DNA, 22 bp, Homo sapiens
aagacacaatgtagcccagcac

SEQ ID NO: 70495 - DNA, 22 bp, Homo sapiens
catgctgggtaaaggtggtgaa

SEQ ID NO: 70496 - DNA, 22 bp, Homo sapiens
gcaccactacactccagcctgg

SEQ ID NO: 70497 - DNA, 22 bp, Homo sapiens
gcgctcctgagggttctgcatc

SEQ ID NO: 70498 - DNA, 22 bp, Homo sapiens
tgtaatattgtagtgacagtac

SEQ ID NO: 70499 - DNA, 22 bp, Homo sapiens
gtggaatttttacctatgaatg

SEQ ID NO: 70500 - DNA, 22 bp, Homo sapiens
tctggctctggagtccacctgc

SEQ ID NO: 70501 - DNA, 22 bp, Homo sapiens
catgatctggtcctactgtggg

SEQ ID NO: 70502 - DNA, 23 bp, Homo sapiens
ccatcccttggaagctggtttta

SEQ ID NO: 70503 - DNA, 22 bp, Homo sapiens
ccattgcactccatcctgggca

SEQ ID NO: 70504 - DNA, 22 bp, Homo sapiens
agatacattgttctaagcattg

SEQ ID NO: 70505 - DNA, 22 bp, Homo sapiens
ccaccgccatggcgttgtacag

SEQ ID NO: 70506 - DNA, 22 bp, Homo sapiens
ggttccacctggcgaggggtat

SEQ ID NO: 70507 - DNA, 22 bp, Homo sapiens
tgacctattagatttccttgcc

SEQ ID NO: 70508 - DNA, 22 bp, Homo sapiens
gtagtctgaacagtaattttgt

SEQ ID NO: 70509 - DNA, 19 bp, Homo sapiens
cgtggcctgcactcgcagc

SEQ ID NO: 70510 - DNA, 22 bp, Homo sapiens
cccactgtttccctgaggctct

SEQ ID NO: 70511 - DNA, 22 bp, Homo sapiens
gatagtcacctcccttaacttt

SEQ ID NO: 70512 - DNA, 22 bp, Homo sapiens
ttagctcagaaaatttaaactt

SEQ ID NO: 70513 - DNA, 22 bp, Homo sapiens
aggagcaccattgtgctggtgt

SEQ ID NO: 70514 - DNA, 22 bp, Homo sapiens
ggttgctgggggtggcagagct

SEQ ID NO: 70515 - DNA, 22 bp, Homo sapiens
agagttaagctttgcctaaaga

SEQ ID NO: 70516 - DNA, 19 bp, Homo sapiens
gccatcccaagcattttgg

SEQ ID NO: 70517 - DNA, 22 bp, Homo sapiens
actcatgtcctaggagtaaagc

SEQ ID NO: 70518 - DNA, 22 bp, Homo sapiens
gcgcttccaccgaaggcagctc

SEQ ID NO: 70519 - DNA, 22 bp, Homo sapiens
aaggctgagacagcacaggtcc

SEQ ID NO: 70520 - DNA, 22 bp, Homo sapiens
tgggaaggggagctggaaagga

SEQ ID NO: 70521 - DNA, 22 bp, Homo sapiens
gctggtagacctcactgcactc

SEQ ID NO: 70522 - DNA, 22 bp, Homo sapiens
accatgtcatttattggccaaa

SEQ ID NO: 70523 - DNA, 22 bp, Homo sapiens
tgtgggacctcagagggtcccc

SEQ ID NO: 70524 - DNA, 22 bp, Homo sapiens
gcagattgtggggttcaggttt

SEQ ID NO: 70525 - DNA, 22 bp, Homo sapiens
tatgttgcaccaacctaataat

SEQ ID NO: 70526 - DNA, 22 bp, Homo sapiens
caggctggagtgcagtggcgcc

SEQ ID NO: 70527 - DNA, 22 bp, Homo sapiens
ggtgggagagctctgtctccag

SEQ ID NO: 70528 - DNA, 22 bp, Homo sapiens
ggctccccaggtccaggagctg

SEQ ID NO: 70529 - DNA, 22 bp, Homo sapiens
cagccctcctaccctgccaggc

SEQ ID NO: 70530 - DNA, 14 bp, Homo sapiens
gcaggcggatcact

SEQ ID NO: 70531 - DNA, 22 bp, Homo sapiens
gtctttcttaaacaacagaaca

SEQ ID NO: 70532 - DNA, 22 bp, Homo sapiens
actgtgtgtttgtctagcacag

SEQ ID NO: 70533 - DNA, 22 bp, Homo sapiens
gccagttttctgaggattaagt

SEQ ID NO: 70534 - DNA, 22 bp, Homo sapiens
tgcaatgatattgtcaaagcat

SEQ ID NO: 70535 - DNA, 22 bp, Homo sapiens
taggtttcagaggtgccgggaa

SEQ ID NO: 70536 - DNA, 22 bp, Homo sapiens
aagctgttgttcatcctgaatt

SEQ ID NO: 70537 - DNA, 22 bp, Homo sapiens
tgccctggctcttcttgttcca

SEQ ID NO: 70538 - DNA, 22 bp, Homo sapiens
acccaggctggagtgcagtggg

SEQ ID NO: 70539 - DNA, 22 bp, Homo sapiens
gatggcctcatggctgcaggcc

SEQ ID NO: 70540 - DNA, 22 bp, Homo sapiens
aagggctctgtgcttgtcccat

SEQ ID NO: 70541 - DNA, 22 bp, Homo sapiens
aagagactgtaaaggcgtgagt

SEQ ID NO: 70542 - DNA, 22 bp, Homo sapiens
cattgcaacttcaaactcctgg

SEQ ID NO: 70543 - DNA, 22 bp, Homo sapiens
gcgcaccacctccaggtggccg

SEQ ID NO: 70544 - DNA, 22 bp, Homo sapiens
gcagctctatgtgatggtaaat

SEQ ID NO: 70545 - DNA, 22 bp, Homo sapiens
gtacaaatgcaggtttgttaca

SEQ ID NO: 70546 - DNA, 22 bp, Homo sapiens
ttccttacattcatatggcttc

SEQ ID NO: 70547 - DNA, 22 bp, Homo sapiens
tcacagagttaaaagtttcttt

SEQ ID NO: 70548 - DNA, 22 bp, Homo sapiens
agcagtgtgggctgcacgctgg

SEQ ID NO: 70549 - DNA, 22 bp, Homo sapiens
actccacatttgaacacagttc

SEQ ID NO: 70550 - DNA, 22 bp, Homo sapiens
cagtgcccgccgccgttcctgg

SEQ ID NO: 70551 - DNA, 22 bp, Homo sapiens
gggcccggaccttcctctctga

SEQ ID NO: 70552 - DNA, 22 bp, Homo sapiens
gctgctgcttgaaggctcggag

SEQ ID NO: 70553 - DNA, 22 bp, Homo sapiens
tctaatcctatggtggggaggg

SEQ ID NO: 70554 - DNA, 22 bp, Homo sapiens
gctgcgccggatcccacgttcc

SEQ ID NO: 70555 - DNA, 22 bp, Homo sapiens
ttctcccatctcagtcttacat

SEQ ID NO: 70556 - DNA, 22 bp, Homo sapiens
ggatgcacgaaggcgcctcgga

SEQ ID NO: 70557 - DNA, 22 bp, Homo sapiens
tagccgggtgttgtgtcatgca

SEQ ID NO: 70558 - DNA, 22 bp, Homo sapiens
acccacgaagatgagcggcatg

SEQ ID NO: 70559 - DNA, 22 bp, Homo sapiens
gaggtggatgttgcagtgagct

SEQ ID NO: 70560 - DNA, 22 bp, Homo sapiens
tggggagtgatgcctcggataa

SEQ ID NO: 70561 - DNA, 22 bp, Homo sapiens
agtggctgagtgactgtgactc

SEQ ID NO: 70562 - DNA, 22 bp, Homo sapiens
cactgcactccagcctgggcca

SEQ ID NO: 70563 - DNA, 20 bp, Homo sapiens
tttcttgtcggctgttgctg

SEQ ID NO: 70564 - DNA, 22 bp, Homo sapiens
ctctggaggtggaggttgcagt

SEQ ID NO: 70565 - DNA, 22 bp, Homo sapiens
agtacccttttcactgtcacaa

SEQ ID NO: 70566 - DNA, 22 bp, Homo sapiens
tgcgcatgagtctgtgcataca

SEQ ID NO: 70567 - DNA, 20 bp, Homo sapiens
aggccccaggtggacactag

SEQ ID NO: 70568 - DNA, 22 bp, Homo sapiens
ttttcctggagatggagttgtt

SEQ ID NO: 70569 - DNA, 22 bp, Homo sapiens
actgcatttggtaaagtcaaga

SEQ ID NO: 70570 - DNA, 22 bp, Homo sapiens
agagtactgcctcagttatgaa

SEQ ID NO: 70571 - DNA, 22 bp, Homo sapiens
tcaccttgtgatctccctgcct

SEQ ID NO: 70572 - DNA, 22 bp, Homo sapiens
tacaagatgacaggtgcatgat

SEQ ID NO: 70573 - DNA, 22 bp, Homo sapiens
tgctgtgttactgagatccggc

SEQ ID NO: 70574 - DNA, 22 bp, Homo sapiens
cctcttctaggacgtccttgtg

SEQ ID NO: 70575 - DNA, 22 bp, Homo sapiens
cccagtttcaactttccagtgg

SEQ ID NO: 70576 - DNA, 22 bp, Homo sapiens
tggtcttagctggaaggaggga

SEQ ID NO: 70577 - DNA, 18 bp, Homo sapiens
actctttctgcccacagg

SEQ ID NO: 70578 - DNA, 22 bp, Homo sapiens
aatttaagaacatttcaggact

SEQ ID NO: 70579 - DNA, 22 bp, Homo sapiens
gccctgccctctcggcactcgc

SEQ ID NO: 70580 - DNA, 22 bp, Homo sapiens
tcgggctcgctctcctagcgga

SEQ ID NO: 70581 - DNA, 22 bp, Homo sapiens
ctaggctcaggtgactccaagc

SEQ ID NO: 70582 - DNA, 22 bp, Homo sapiens
ggaggcggaagttgcagtgagc

SEQ ID NO: 70583 - DNA, 22 bp, Homo sapiens
tctgttttgcataatgttcttt

SEQ ID NO: 70584 - DNA, 22 bp, Homo sapiens
ataaagtggaggtagtattcat

SEQ ID NO: 70585 - DNA, 22 bp, Homo sapiens
gaacgggtgcagccatgggccc

SEQ ID NO: 70586 - DNA, 22 bp, Homo sapiens
acccgggaggcaggagtcatag

SEQ ID NO: 70587 - DNA, 20 bp, Homo sapiens
gtctccactgggggttaacc

SEQ ID NO: 70588 - DNA, 22 bp, Homo sapiens
tcttgggcaatttctctagagg

SEQ ID NO: 70589 - DNA, 22 bp, Homo sapiens
tgaccctgagagctgaatggct

SEQ ID NO: 70590 - DNA, 22 bp, Homo sapiens
gcctggattccttgtttctcag

SEQ ID NO: 70591 - DNA, 22 bp, Homo sapiens
agagggatcaccctgtttctgg

SEQ ID NO: 70592 - DNA, 18 bp, Homo sapiens
atgagaggtgtcagaaga

SEQ ID NO: 70593 - DNA, 22 bp, Homo sapiens
atgaattgaggaaaacagtcgt

SEQ ID NO: 70594 - DNA, 22 bp, Homo sapiens
aaagaaggtagggctggtgact

SEQ ID NO: 70595 - DNA, 22 bp, Homo sapiens
acctagaatttaaaacattgct

SEQ ID NO: 70596 - DNA, 22 bp, Homo sapiens
agagtgtaccaaatatcctaca

SEQ ID NO: 70597 - DNA, 22 bp, Homo sapiens
ctctgagtagatagggaacctg

SEQ ID NO: 70598 - DNA, 22 bp, Homo sapiens
gcctgtgacccagggcccagga

SEQ ID NO: 70599 - DNA, 22 bp, Homo sapiens
gacaggtgctaagggacctggc

SEQ ID NO: 70600 - DNA, 22 bp, Homo sapiens
ctacttgttcactgtaggtcgc

SEQ ID NO: 70601 - DNA, 22 bp, Homo sapiens
aaagatgttgctgctccgccct

SEQ ID NO: 70602 - DNA, 22 bp, Homo sapiens
tcgtgaggctctgcatcgcaca

SEQ ID NO: 70603 - DNA, 22 bp, Homo sapiens
ctgcagggagaggggacagcct

SEQ ID NO: 70604 - DNA, 22 bp, Homo sapiens
atccatttgacataatttcagc

SEQ ID NO: 70605 - DNA, 22 bp, Homo sapiens
atttcagcagcccatgtttgga

SEQ ID NO: 70606 - DNA, 20 bp, Homo sapiens
gccaacgcgctggggctgcc

SEQ ID NO: 70607 - DNA, 22 bp, Homo sapiens
taatatctacttcatagagttt

SEQ ID NO: 70608 - DNA, 22 bp, Homo sapiens
ttctcttttcaccagttgctaa

SEQ ID NO: 70609 - DNA, 22 bp, Homo sapiens
gccatgggcaaatgcagagctg

SEQ ID NO: 70610 - DNA, 22 bp, Homo sapiens
tttgaggttagctagcagatca

SEQ ID NO: 70611 - DNA, 22 bp, Homo sapiens
aggaattcaagaccagctgggc

SEQ ID NO: 70612 - DNA, 22 bp, Homo sapiens
aagcagagaatctgggagcgag

SEQ ID NO: 70613 - DNA, 22 bp, Homo sapiens
gctgccaatccagctgtgggag

SEQ ID NO: 70614 - DNA, 22 bp, Homo sapiens
ctgaggtgtgaaatggtggcaa

SEQ ID NO: 70615 - DNA, 22 bp, Homo sapiens
tttagattgtgacctcccccca

SEQ ID NO: 70616 - DNA, 22 bp, Homo sapiens
ctgtggtcatgagtccttccat

SEQ ID NO: 70617 - DNA, 22 bp, Homo sapiens
gcgaggaggggtgctgggcccc

SEQ ID NO: 70618 - DNA, 22 bp, Homo sapiens
agcacctccagagcttgaagct

SEQ ID NO: 70619 - DNA, 22 bp, Homo sapiens
acttgccccagaattgctgctg

SEQ ID NO: 70620 - DNA, 22 bp, Homo sapiens
atatgcagtctcttgcccttct

SEQ ID NO: 70621 - DNA, 22 bp, Homo sapiens
tggtggctaccaggtcctgggg

SEQ ID NO: 70622 - DNA, 20 bp, Homo sapiens
ttcgctgggagtggccaggc

SEQ ID NO: 70623 - DNA, 22 bp, Homo sapiens
acaccatactcatgttggttcc

SEQ ID NO: 70624 - DNA, 22 bp, Homo sapiens
tccaactttctcctccggcttg

SEQ ID NO: 70625 - DNA, 22 bp, Homo sapiens
agaaggcatagaccggattatg

SEQ ID NO: 70626 - DNA, 22 bp, Homo sapiens
aagagggctgcaatcttattgc

SEQ ID NO: 70627 - DNA, 20 bp, Homo sapiens
cagcctgcatcatctgcagc

SEQ ID NO: 70628 - DNA, 23 bp, Homo sapiens
ggttctgccgcttactgctgtgc

SEQ ID NO: 70629 - DNA, 22 bp, Homo sapiens
ttcagcttgctgactgcggcag

SEQ ID NO: 70630 - DNA, 21 bp, Homo sapiens
gtggttctagagaaacagaat

SEQ ID NO: 70631 - DNA, 22 bp, Homo sapiens
attgcagatgatccccaagtta

SEQ ID NO: 70632 - DNA, 22 bp, Homo sapiens
atggggaagcaattggatttcc

SEQ ID NO: 70633 - DNA, 22 bp, Homo sapiens
ggatgtcgaggatggggtagca

SEQ ID NO: 70634 - DNA, 22 bp, Homo sapiens
tgggtgctctgcgaccgtaggg

SEQ ID NO: 70635 - DNA, 22 bp, Homo sapiens
gggaagtgatggagccaggatt

SEQ ID NO: 70636 - DNA, 22 bp, Homo sapiens
ttgcactataggaaaatgtgtc

SEQ ID NO: 70637 - DNA, 22 bp, Homo sapiens
agctttacctgccttggggcac

SEQ ID NO: 70638 - DNA, 22 bp, Homo sapiens
gtggcttggaccagtcacagtg

SEQ ID NO: 70639 - DNA, 22 bp, Homo sapiens
cagggccagcgtctcgggctat

SEQ ID NO: 70640 - DNA, 22 bp, Homo sapiens
gtgaggtggtacaatattaact

SEQ ID NO: 70641 - DNA, 22 bp, Homo sapiens
gaagggaactgggtctccttgt

SEQ ID NO: 70642 - DNA, 22 bp, Homo sapiens
acaggatcgccctgttgcccag

SEQ ID NO: 70643 - DNA, 22 bp, Homo sapiens
atgaagcgttcgagataggtag

SEQ ID NO: 70644 - DNA, 22 bp, Homo sapiens
caccgagtgacagtagccatca

SEQ ID NO: 70645 - DNA, 22 bp, Homo sapiens
ctgggctcaagtgatccaccca

SEQ ID NO: 70646 - DNA, 22 bp, Homo sapiens
agttatgtcctcagcaaatcaa

SEQ ID NO: 70647 - DNA, 22 bp, Homo sapiens
acacccaggctggcgtgcagtg

SEQ ID NO: 70648 - DNA, 22 bp, Homo sapiens
ccttgctcaagctagtgacggg

SEQ ID NO: 70649 - DNA, 22 bp, Homo sapiens
tccgttttcacactgctataaa

SEQ ID NO: 70650 - DNA, 22 bp, Homo sapiens
gatgtagacacttggaggctta

SEQ ID NO: 70651 - DNA, 22 bp, Homo sapiens
ctcgcatgccctgcctcatcca

SEQ ID NO: 70652 - DNA, 19 bp, Homo sapiens
ggagtttccaatgggtaaa

SEQ ID NO: 70653 - DNA, 22 bp, Homo sapiens
ttattagagtgctttgagaaag

SEQ ID NO: 70654 - DNA, 22 bp, Homo sapiens
tgccacagacaggacagaacag

SEQ ID NO: 70655 - DNA, 23 bp, Homo sapiens
actcgtggaattctctgcgatcg

SEQ ID NO: 70656 - DNA, 22 bp, Homo sapiens
actgagcaggagaatcacttta

SEQ ID NO: 70657 - DNA, 22 bp, Homo sapiens
tacatagctcctagtgatgcat

SEQ ID NO: 70658 - DNA, 22 bp, Homo sapiens
aagagggaaattgttggctgct

SEQ ID NO: 70659 - DNA, 22 bp, Homo sapiens
gacggagctggttgctgcggct

SEQ ID NO: 70660 - DNA, 22 bp, Homo sapiens
gtcagcgtgctcagcctattat

SEQ ID NO: 70661 - DNA, 22 bp, Homo sapiens
agcctggtttaagcattttata

SEQ ID NO: 70662 - DNA, 22 bp, Homo sapiens
gagtcggaggcaggagacctgg

SEQ ID NO: 70663 - DNA, 22 bp, Homo sapiens
tcctggcaaagatgttggtgtt

SEQ ID NO: 70664 - DNA, 22 bp, Homo sapiens
cggctcactgcagctccgcctc

SEQ ID NO: 70665 - DNA, 22 bp, Homo sapiens
ggaaaggcctgggtgtcctggg

SEQ ID NO: 70666 - DNA, 22 bp, Homo sapiens
tgctcgaggtccccaccggctc

SEQ ID NO: 70667 - DNA, 22 bp, Homo sapiens
ccaggcagcctgctccattctg

SEQ ID NO: 70668 - DNA, 22 bp, Homo sapiens
tgagacgaagtcttgctctgtt

SEQ ID NO: 70669 - DNA, 22 bp, Homo sapiens
cctcggtttccacatctgtaca

SEQ ID NO: 70670 - DNA, 22 bp, Homo sapiens
ggctctgcttgaggccagcctg

SEQ ID NO: 70671 - DNA, 22 bp, Homo sapiens
ttacatgtttatgggggtacat

SEQ ID NO: 70672 - DNA, 22 bp, Homo sapiens
atggtttattagctgcacaggc

SEQ ID NO: 70673 - DNA, 22 bp, Homo sapiens
tatctatgtgctctgacctctc

SEQ ID NO: 70674 - DNA, 22 bp, Homo sapiens
cccaggaggtggagttcacagt

SEQ ID NO: 70675 - DNA, 22 bp, Homo sapiens
tggcgcgacgtgccccctgctt

SEQ ID NO: 70676 - DNA, 23 bp, Homo sapiens
ctatttctcatagttcaggtctt

SEQ ID NO: 70677 - DNA, 22 bp, Homo sapiens
acatatgcgatcataggatgca

SEQ ID NO: 70678 - DNA, 22 bp, Homo sapiens
caagtctgacctctgggtgaag

SEQ ID NO: 70679 - DNA, 22 bp, Homo sapiens
ctgctaaacctctctgagagct

SEQ ID NO: 70680 - DNA, 22 bp, Homo sapiens
ctccttctgggcctggcagtgg

SEQ ID NO: 70681 - DNA, 22 bp, Homo sapiens
aggaagttagtaaattatgtgc

SEQ ID NO: 70682 - DNA, 22 bp, Homo sapiens
ccaggtgtgctctgcagtggat

SEQ ID NO: 70683 - DNA, 22 bp, Homo sapiens
gaaggaagtcattagtgcagac

SEQ ID NO: 70684 - DNA, 22 bp, Homo sapiens
ttgtcttttgtgggaaatatgg

SEQ ID NO: 70685 - DNA, 18 bp, Homo sapiens
gctttctatgcgacagta

SEQ ID NO: 70686 - DNA, 22 bp, Homo sapiens
ctgggcacagcgttgggctctt

SEQ ID NO: 70687 - DNA, 22 bp, Homo sapiens
accagaagctggagcacaagga

SEQ ID NO: 70688 - DNA, 22 bp, Homo sapiens
gagacctcttggtatcgctagg

SEQ ID NO: 70689 - DNA, 23 bp, Homo sapiens
cgtcttgtcctcgggcgcctggg

SEQ ID NO: 70690 - DNA, 17 bp, Homo sapiens
ttaaggtggatcagcac

SEQ ID NO: 70691 - DNA, 22 bp, Homo sapiens
cgggttcacgccattctcctgc

SEQ ID NO: 70692 - DNA, 22 bp, Homo sapiens
gctaatcaatgttaaggctgtg

SEQ ID NO: 70693 - DNA, 22 bp, Homo sapiens
ttgtctaatgagctccacttca

SEQ ID NO: 70694 - DNA, 22 bp, Homo sapiens
ttccggacgcccgtcttccagc

SEQ ID NO: 70695 - DNA, 22 bp, Homo sapiens
tcaggcagtagaattgcttgaa

SEQ ID NO: 70696 - DNA, 22 bp, Homo sapiens
agaaaatttaaagagacacaca

SEQ ID NO: 70697 - DNA, 22 bp, Homo sapiens
agggagcattgtgacatatcac

SEQ ID NO: 70698 - DNA, 22 bp, Homo sapiens
gtaatagtctcaaactcctgga

SEQ ID NO: 70699 - DNA, 22 bp, Homo sapiens
ggcgcccccttcaaacagagca

SEQ ID NO: 70700 - DNA, 22 bp, Homo sapiens
gggcagagactcagaaacagaa

SEQ ID NO: 70701 - DNA, 22 bp, Homo sapiens
gccatgcttggtatgctgtgag

SEQ ID NO: 70702 - DNA, 22 bp, Homo sapiens
aagataagagggaggtgcctca

SEQ ID NO: 70703 - DNA, 23 bp, Homo sapiens
tgctggagaagcaaagttctgag

SEQ ID NO: 70704 - DNA, 22 bp, Homo sapiens
cttttgattgagcagtttcaaa

SEQ ID NO: 70705 - DNA, 22 bp, Homo sapiens
tctgcaacagtgccctgtaaat

SEQ ID NO: 70706 - DNA, 22 bp, Homo sapiens
gctgaggctcctcgggaggaca

SEQ ID NO: 70707 - DNA, 22 bp, Homo sapiens
actgtctgtagacatttttggt

SEQ ID NO: 70708 - DNA, 22 bp, Homo sapiens
ttaaactgcttgaattgggttt

SEQ ID NO: 70709 - DNA, 21 bp, Homo sapiens
aaggacgaggttttgattaca

SEQ ID NO: 70710 - DNA, 22 bp, Homo sapiens
gatttttatataaagtgagaaa

SEQ ID NO: 70711 - DNA, 22 bp, Homo sapiens
gcctgtgtggatgcgccggtgc

SEQ ID NO: 70712 - DNA, 22 bp, Homo sapiens
gtctatgatattttgttatagc

SEQ ID NO: 70713 - DNA, 22 bp, Homo sapiens
gttggagtgcagcttgtgcgat

SEQ ID NO: 70714 - DNA, 22 bp, Homo sapiens
gaacactgctgttgggttctga

SEQ ID NO: 70715 - DNA, 20 bp, Homo sapiens
aactcctagcctcaagtgat

SEQ ID NO: 70716 - DNA, 22 bp, Homo sapiens
ttcctagggcagagccgctggg

SEQ ID NO: 70717 - DNA, 22 bp, Homo sapiens
agtgaggggcagctgagtgggc

SEQ ID NO: 70718 - DNA, 22 bp, Homo sapiens
cctgtcacctaggtactgagca

SEQ ID NO: 70719 - DNA, 22 bp, Homo sapiens
caccatgcctggctaatttttt

SEQ ID NO: 70720 - DNA, 22 bp, Homo sapiens
tatttcacatctatgaagtgag

SEQ ID NO: 70721 - DNA, 22 bp, Homo sapiens
tgagtagagaattcagctaagg

SEQ ID NO: 70722 - DNA, 21 bp, Homo sapiens
tagcccttctccacctcgccc

SEQ ID NO: 70723 - DNA, 22 bp, Homo sapiens
ctcattgcagctgcattactgt

SEQ ID NO: 70724 - DNA, 22 bp, Homo sapiens
cactaggctggagtgcagtggc

SEQ ID NO: 70725 - DNA, 22 bp, Homo sapiens
tcccaggccacacttggggaac

SEQ ID NO: 70726 - DNA, 22 bp, Homo sapiens
cttgggaggcagaggttgcagt

SEQ ID NO: 70727 - DNA, 22 bp, Homo sapiens
cagtgggtcctgcgtctgccag

SEQ ID NO: 70728 - DNA, 22 bp, Homo sapiens
aagccaaagtgggcatgcctca

SEQ ID NO: 70729 - DNA, 22 bp, Homo sapiens
cccaggaggcagagatagcagt

SEQ ID NO: 70730 - DNA, 23 bp, Homo sapiens
tctgtgtctccacccaaatctca

SEQ ID NO: 70731 - DNA, 22 bp, Homo sapiens
gcaaaagtacagccggatttct

SEQ ID NO: 70732 - DNA, 22 bp, Homo sapiens
aatgctctttaacctattctga

SEQ ID NO: 70733 - DNA, 23 bp, Homo sapiens
cagagctggctcagagctgcctg

SEQ ID NO: 70734 - DNA, 22 bp, Homo sapiens
accccaggaagtggaggtcatg

SEQ ID NO: 70735 - DNA, 22 bp, Homo sapiens
atgagaaagttaatcatcatga

SEQ ID NO: 70736 - DNA, 22 bp, Homo sapiens
cagtggcgtgatctctgctcac

SEQ ID NO: 70737 - DNA, 22 bp, Homo sapiens
cgtgggtcgggactccgcctcg

SEQ ID NO: 70738 - DNA, 22 bp, Homo sapiens
tgggccgtggagcactctgaga

SEQ ID NO: 70739 - DNA, 22 bp, Homo sapiens
ccagggatgcagaggttgcagt

SEQ ID NO: 70740 - DNA, 22 bp, Homo sapiens
ggctggtgttgagtgcctgtag

SEQ ID NO: 70741 - DNA, 22 bp, Homo sapiens
gaggtagacttcttggaagtag

SEQ ID NO: 70742 - DNA, 22 bp, Homo sapiens
tcactgcaagctccacctcccg

SEQ ID NO: 70743 - DNA, 22 bp, Homo sapiens
tcaccggcagacgtggcctgat

SEQ ID NO: 70744 - DNA, 22 bp, Homo sapiens
cctgccctgctcactgtcggta

SEQ ID NO: 70745 - DNA, 22 bp, Homo sapiens
ggtgcagtgcagggtaattata

SEQ ID NO: 70746 - DNA, 22 bp, Homo sapiens
cactgaacaacaaatagtgaat

SEQ ID NO: 70747 - DNA, 19 bp, Homo sapiens
cttgaaactactgttgaga

SEQ ID NO: 70748 - DNA, 23 bp, Homo sapiens
gcagaggagcaagctggacacca

SEQ ID NO: 70749 - DNA, 22 bp, Homo sapiens
ctcaggacggccgggggagcct

SEQ ID NO: 70750 - DNA, 22 bp, Homo sapiens
gtgggccagcttttctcctggg

SEQ ID NO: 70751 - DNA, 21 bp, Homo sapiens
cggaaaggactagggctcaga

SEQ ID NO: 70752 - DNA, 22 bp, Homo sapiens
agctcaagctacacacagagtc

SEQ ID NO: 70753 - DNA, 21 bp, Homo sapiens
agaaggcaaaagcagacatct

SEQ ID NO: 70754 - DNA, 22 bp, Homo sapiens
cccattcatcctcgcttccttc

SEQ ID NO: 70755 - DNA, 22 bp, Homo sapiens
gtccacttctgcctttctggat

SEQ ID NO: 70756 - DNA, 22 bp, Homo sapiens
cagtgcacgggccagtcctgcc

SEQ ID NO: 70757 - DNA, 22 bp, Homo sapiens
ccgggccccacggtgacctcag

SEQ ID NO: 70758 - DNA, 22 bp, Homo sapiens
ctgaggcaggatggcctggctg

SEQ ID NO: 70759 - DNA, 23 bp, Homo sapiens
ccactagcacctgttcaacttct

SEQ ID NO: 70760 - DNA, 22 bp, Homo sapiens
tggcctcggcatccagcaagag

SEQ ID NO: 70761 - DNA, 22 bp, Homo sapiens
ggcatagatttctttaggttta

SEQ ID NO: 70762 - DNA, 23 bp, Homo sapiens
agcaatctgtgtttcagcaagcc

SEQ ID NO: 70763 - DNA, 22 bp, Homo sapiens
ctattgtttctatgctctgagg

SEQ ID NO: 70764 - DNA, 22 bp, Homo sapiens
gggcatttcttgtcaatgtagg

SEQ ID NO: 70765 - DNA, 19 bp, Homo sapiens
tgcctgctgtattccagag

SEQ ID NO: 70766 - DNA, 22 bp, Homo sapiens
ggcttggcaggtgccctgcgca

SEQ ID NO: 70767 - DNA, 22 bp, Homo sapiens
tatgtgtttgacaccctgcaag

SEQ ID NO: 70768 - DNA, 22 bp, Homo sapiens
ctgggaggcggaggttgtagtg

SEQ ID NO: 70769 - DNA, 22 bp, Homo sapiens
agttttcattaccatgctgcaa

SEQ ID NO: 70770 - DNA, 22 bp, Homo sapiens
ttcaaatgatggcagtcctggc

SEQ ID NO: 70771 - DNA, 22 bp, Homo sapiens
tggccggccacctccagggttg

SEQ ID NO: 70772 - DNA, 22 bp, Homo sapiens
acctggacacctgctgtcatct

SEQ ID NO: 70773 - DNA, 22 bp, Homo sapiens
tgtacacatggtgtacactccc

SEQ ID NO: 70774 - DNA, 22 bp, Homo sapiens
gcttctcgggcctgatgtcgtc

SEQ ID NO: 70775 - DNA, 22 bp, Homo sapiens
atgttggagtcgtaaggcatgg

SEQ ID NO: 70776 - DNA, 22 bp, Homo sapiens
cagcctggtccccggctcaccc

SEQ ID NO: 70777 - DNA, 22 bp, Homo sapiens
cttctgagatgttgttttacag

SEQ ID NO: 70778 - DNA, 22 bp, Homo sapiens
ttcttctttccaattacatggt

SEQ ID NO: 70779 - DNA, 23 bp, Homo sapiens
aaggggatacttccactttcttt

SEQ ID NO: 70780 - DNA, 22 bp, Homo sapiens
gctcccaccgccgctatgggta

SEQ ID NO: 70781 - DNA, 22 bp, Homo sapiens
cactctcagcataatgaatgtg

SEQ ID NO: 70782 - DNA, 22 bp, Homo sapiens
aaacaacctaaagttactgatc

SEQ ID NO: 70783 - DNA, 22 bp, Homo sapiens
agatgctgctccacaggccagg

SEQ ID NO: 70784 - DNA, 22 bp, Homo sapiens
attgcactccagcctgggtgac

SEQ ID NO: 70785 - DNA, 22 bp, Homo sapiens
tggaagggagctggaatttgga

SEQ ID NO: 70786 - DNA, 22 bp, Homo sapiens
gctgacccctacaggttgtgtt

SEQ ID NO: 70787 - DNA, 22 bp, Homo sapiens
gggcggggtggctcatgcctgt

SEQ ID NO: 70788 - DNA, 22 bp, Homo sapiens
cttatcttacttccccttcatg

SEQ ID NO: 70789 - DNA, 22 bp, Homo sapiens
ttgtgtgtactggttatgggca

SEQ ID NO: 70790 - DNA, 22 bp, Homo sapiens
actgcactccagcctgggtgac

SEQ ID NO: 70791 - DNA, 22 bp, Homo sapiens
tgtgactaggcctgagctcttg

SEQ ID NO: 70792 - DNA, 22 bp, Homo sapiens
ccagactgcttgcttcccagcc

SEQ ID NO: 70793 - DNA, 22 bp, Homo sapiens
tcaggggcttgaggtgcatgtc

SEQ ID NO: 70794 - DNA, 22 bp, Homo sapiens
cacttgttggtggtgaaatcac

SEQ ID NO: 70795 - DNA, 19 bp, Homo sapiens
tggttgtgcacgggttggt

SEQ ID NO: 70796 - DNA, 22 bp, Homo sapiens
tcctgccgtcctccggggcctc

SEQ ID NO: 70797 - DNA, 22 bp, Homo sapiens
gcgagcctctggagtcctctgg

SEQ ID NO: 70798 - DNA, 22 bp, Homo sapiens
gaatttaagaggatgaatctgt

SEQ ID NO: 70799 - DNA, 22 bp, Homo sapiens
atggcatttgaatctgtctttt

SEQ ID NO: 70800 - DNA, 22 bp, Homo sapiens
tgtgtaggatttcctggagcct

SEQ ID NO: 70801 - DNA, 23 bp, Homo sapiens
gcagccatgttcccgtctcagct

SEQ ID NO: 70802 - DNA, 22 bp, Homo sapiens
tgggggctttatgtaatgcaca

SEQ ID NO: 70803 - DNA, 22 bp, Homo sapiens
tgatatgggaaaagggctcgga

SEQ ID NO: 70804 - DNA, 22 bp, Homo sapiens
ttgcgcgcggctaggtctcggt

SEQ ID NO: 70805 - DNA, 21 bp, Homo sapiens
tccttcagtctagatgattgt

SEQ ID NO: 70806 - DNA, 22 bp, Homo sapiens
ggccctggtcctaggggtggaa

SEQ ID NO: 70807 - DNA, 22 bp, Homo sapiens
gtctcttgttatcatttctgag

SEQ ID NO: 70808 - DNA, 22 bp, Homo sapiens
ccaggggggcgtagatgctggg

SEQ ID NO: 70809 - DNA, 22 bp, Homo sapiens
aaaaagtattggccatggttga

SEQ ID NO: 70810 - DNA, 22 bp, Homo sapiens
tggagaattctatgttgagggg

SEQ ID NO: 70811 - DNA, 22 bp, Homo sapiens
atggccgcctgtccttcccgcc

SEQ ID NO: 70812 - DNA, 22 bp, Homo sapiens
ctaaagtgccaggaatacaggt

SEQ ID NO: 70813 - DNA, 23 bp, Homo sapiens
tcagaacagttcttggtgcatag

SEQ ID NO: 70814 - DNA, 22 bp, Homo sapiens
tcatcttcctcatttctccagg

SEQ ID NO: 70815 - DNA, 18 bp, Homo sapiens
tccatgcacatagccccc

SEQ ID NO: 70816 - DNA, 22 bp, Homo sapiens
caagtggtttatgggagttcca

SEQ ID NO: 70817 - DNA, 22 bp, Homo sapiens
tcgtggatgcgcagggcggcct

SEQ ID NO: 70818 - DNA, 22 bp, Homo sapiens
ccctctacagggaagcgctttc

SEQ ID NO: 70819 - DNA, 22 bp, Homo sapiens
ggccagaagttggaaaagagcc

SEQ ID NO: 70820 - DNA, 22 bp, Homo sapiens
agcactgatttaaactggattt

SEQ ID NO: 70821 - DNA, 22 bp, Homo sapiens
ttattttaccttcctctgagct

SEQ ID NO: 70822 - DNA, 22 bp, Homo sapiens
cctcggaggcggaggctgcagt

SEQ ID NO: 70823 - DNA, 22 bp, Homo sapiens
ccctttagcccctgcagagact

SEQ ID NO: 70824 - DNA, 22 bp, Homo sapiens
gatctcagacaggtggacaggg

SEQ ID NO: 70825 - DNA, 22 bp, Homo sapiens
gtcctaccatgaattcactcca

SEQ ID NO: 70826 - DNA, 22 bp, Homo sapiens
cccctcgcctgcagagcacagc

SEQ ID NO: 70827 - DNA, 22 bp, Homo sapiens
tcaccttgtgatccgcccacct

SEQ ID NO: 70828 - DNA, 22 bp, Homo sapiens
ttcttctccgaggagggctggt

SEQ ID NO: 70829 - DNA, 20 bp, Homo sapiens
aaaatatgtataactcttct

SEQ ID NO: 70830 - DNA, 18 bp, Homo sapiens
gaaagatgaacttttttc

SEQ ID NO: 70831 - DNA, 22 bp, Homo sapiens
aggaaataagggacaagacaaa

SEQ ID NO: 70832 - DNA, 22 bp, Homo sapiens
ctcattgcccagatccccacag

SEQ ID NO: 70833 - DNA, 22 bp, Homo sapiens
agcttttagctcctggttgcaa

SEQ ID NO: 70834 - DNA, 22 bp, Homo sapiens
gttgtgaatagtgccgcaataa

SEQ ID NO: 70835 - DNA, 17 bp, Homo sapiens
tgggatccgtctctgtg

SEQ ID NO: 70836 - DNA, 22 bp, Homo sapiens
ttttgcaacacaggctacttca

SEQ ID NO: 70837 - DNA, 22 bp, Homo sapiens
gttgagtgggttaggatgctga

SEQ ID NO: 70838 - DNA, 22 bp, Homo sapiens
ggtcccaggttgacagggagac

SEQ ID NO: 70839 - DNA, 19 bp, Homo sapiens
gttttgcaggcagagggga

SEQ ID NO: 70840 - DNA, 22 bp, Homo sapiens
cccaccagacctgcaccggcac

SEQ ID NO: 70841 - DNA, 23 bp, Homo sapiens
gggtccagccaattccaaggaaa

SEQ ID NO: 70842 - DNA, 22 bp, Homo sapiens
tcctttgcttctgtcattctcc

SEQ ID NO: 70843 - DNA, 22 bp, Homo sapiens
tagttctagggcatcatcccag

SEQ ID NO: 70844 - DNA, 19 bp, Homo sapiens
agggaatccggctgaggga

SEQ ID NO: 70845 - DNA, 22 bp, Homo sapiens
tccacaggtccggcatgaacag

SEQ ID NO: 70846 - DNA, 22 bp, Homo sapiens
gcttaattctggctcagtttcc

SEQ ID NO: 70847 - DNA, 22 bp, Homo sapiens
gtcactgtatccaggttccagc

SEQ ID NO: 70848 - DNA, 22 bp, Homo sapiens
cattcatctatcaaatggtacc

SEQ ID NO: 70849 - DNA, 22 bp, Homo sapiens
cgcgaggtggaggttgcagtga

SEQ ID NO: 70850 - DNA, 22 bp, Homo sapiens
gggcttcagttctgaccatctt

SEQ ID NO: 70851 - DNA, 22 bp, Homo sapiens
ccaggaggcagaagttgcagtg

SEQ ID NO: 70852 - DNA, 22 bp, Homo sapiens
cgtctaggccgtgccctgaggt

SEQ ID NO: 70853 - DNA, 22 bp, Homo sapiens
ctccagattccgtttattcagg

SEQ ID NO: 70854 - DNA, 22 bp, Homo sapiens
ctgatcctcctttaagtagctg

SEQ ID NO: 70855 - DNA, 22 bp, Homo sapiens
aaagggaagttgcacatgttcc

SEQ ID NO: 70856 - DNA, 22 bp, Homo sapiens
ccagaccctccattcaagctcc

SEQ ID NO: 70857 - DNA, 22 bp, Homo sapiens
aagaaatgctgatgttggatgg

SEQ ID NO: 70858 - DNA, 22 bp, Homo sapiens
cttgagtcatataaagacagag

SEQ ID NO: 70859 - DNA, 22 bp, Homo sapiens
aggcggaagatggccccataga

SEQ ID NO: 70860 - DNA, 20 bp, Homo sapiens
tcagccttgaatgcttgaaa

SEQ ID NO: 70861 - DNA, 19 bp, Homo sapiens
gcctcatttccacctcccc

SEQ ID NO: 70862 - DNA, 22 bp, Homo sapiens
gagagaagggggatatgagcct

SEQ ID NO: 70863 - DNA, 22 bp, Homo sapiens
gaattcttttctttctgaaagt

SEQ ID NO: 70864 - DNA, 22 bp, Homo sapiens
tgtttcttacgtttttagaggc

SEQ ID NO: 70865 - DNA, 22 bp, Homo sapiens
tttggaggggaagaccttggag

SEQ ID NO: 70866 - DNA, 22 bp, Homo sapiens
ggctgtgtggccgtgggctcta

SEQ ID NO: 70867 - DNA, 22 bp, Homo sapiens
ctgccgtgtttttcatgttaaa

SEQ ID NO: 70868 - DNA, 22 bp, Homo sapiens
tcagcagtgagaattaatgttg

SEQ ID NO: 70869 - DNA, 22 bp, Homo sapiens
ggctcatatcccggccatcatt

SEQ ID NO: 70870 - DNA, 22 bp, Homo sapiens
taggctgggggtaggaattgag

SEQ ID NO: 70871 - DNA, 22 bp, Homo sapiens
cacagagatggtctggcaggtg

SEQ ID NO: 70872 - DNA, 22 bp, Homo sapiens
ccctcgtgcatccatcatttag

SEQ ID NO: 70873 - DNA, 19 bp, Homo sapiens
aggcttcaggccacatgct

SEQ ID NO: 70874 - DNA, 22 bp, Homo sapiens
ccaagcagagcagcctctctgg

SEQ ID NO: 70875 - DNA, 22 bp, Homo sapiens
gaggaggcagcctatcccttag

SEQ ID NO: 70876 - DNA, 22 bp, Homo sapiens
gtgctaatgaattggagtgcct

SEQ ID NO: 70877 - DNA, 23 bp, Homo sapiens
actgagccagggcctgggtcagc

SEQ ID NO: 70878 - DNA, 22 bp, Homo sapiens
cctcccctcagacagagactgg

SEQ ID NO: 70879 - DNA, 22 bp, Homo sapiens
agggaaatctcagctctaaaat

SEQ ID NO: 70880 - DNA, 22 bp, Homo sapiens
caggccagggttgagaagagaa

SEQ ID NO: 70881 - DNA, 22 bp, Homo sapiens
acagtgcttagcacagagtaga

SEQ ID NO: 70882 - DNA, 22 bp, Homo sapiens
ttcaatatgatattagctgtgg

SEQ ID NO: 70883 - DNA, 21 bp, Homo sapiens
tctcttcctccgcgccgccgc

SEQ ID NO: 70884 - DNA, 22 bp, Homo sapiens
tttggcggactgagaacgcggg

SEQ ID NO: 70885 - DNA, 23 bp, Homo sapiens
aatatcaaggtgatgttcccaga

SEQ ID NO: 70886 - DNA, 22 bp, Homo sapiens
gcctcagtctcccgagtagctg

SEQ ID NO: 70887 - DNA, 22 bp, Homo sapiens
ggtttgacagcttggggctgtc

SEQ ID NO: 70888 - DNA, 22 bp, Homo sapiens
gccagatttacagatttgccct

SEQ ID NO: 70889 - DNA, 22 bp, Homo sapiens
tgcccagggtggagtgcagtgg

SEQ ID NO: 70890 - DNA, 22 bp, Homo sapiens
gtgtgaaagcttgtcctctgta

SEQ ID NO: 70891 - DNA, 22 bp, Homo sapiens
cagaatcaagtccaattagcac

SEQ ID NO: 70892 - DNA, 22 bp, Homo sapiens
accctctagagggaagcacttt

SEQ ID NO: 70893 - DNA, 22 bp, Homo sapiens
caggcactgtgctgagctctgc

SEQ ID NO: 70894 - DNA, 22 bp, Homo sapiens
agtgcaggccccaggccaggcc

SEQ ID NO: 70895 - DNA, 22 bp, Homo sapiens
gttaaggctgagcaggacactg

SEQ ID NO: 70896 - DNA, 21 bp, Homo sapiens
tctgagactgggttagaatgt

SEQ ID NO: 70897 - DNA, 22 bp, Homo sapiens
cccaggagttggaggctgcagt

SEQ ID NO: 70898 - DNA, 22 bp, Homo sapiens
tgagatcattgacttgttcctg

SEQ ID NO: 70899 - DNA, 22 bp, Homo sapiens
agctcaagctacacacagagtc

SEQ ID NO: 70900 - DNA, 22 bp, Homo sapiens
aggcaagggggcgccaccttcc

SEQ ID NO: 70901 - DNA, 22 bp, Homo sapiens
attggtagttttgtatttctct

SEQ ID NO: 70902 - DNA, 22 bp, Homo sapiens
tgagccaggagtttgaggctgt

SEQ ID NO: 70903 - DNA, 22 bp, Homo sapiens
cattggccttttatcctagagg

SEQ ID NO: 70904 - DNA, 22 bp, Homo sapiens
atgcacacgtaccctacaaggc

SEQ ID NO: 70905 - DNA, 22 bp, Homo sapiens
gttactcttgagaggctgaggt

SEQ ID NO: 70906 - DNA, 22 bp, Homo sapiens
cctggccgacatggtgaaacgc

SEQ ID NO: 70907 - DNA, 22 bp, Homo sapiens
caagggaattgtgtgtgagagg

SEQ ID NO: 70908 - DNA, 22 bp, Homo sapiens
ctctgcctcagtgatttcttta

SEQ ID NO: 70909 - DNA, 22 bp, Homo sapiens
caaatgaatatttccatgggtt

SEQ ID NO: 70910 - DNA, 20 bp, Homo sapiens
atgctttcttgtgtgctgct

SEQ ID NO: 70911 - DNA, 22 bp, Homo sapiens
ctgctcagtaatagtcctatct

SEQ ID NO: 70912 - DNA, 22 bp, Homo sapiens
agggactatttacccatctcac

SEQ ID NO: 70913 - DNA, 22 bp, Homo sapiens
gggttgaggcggatgtcggcgg

SEQ ID NO: 70914 - DNA, 22 bp, Homo sapiens
agagggtgggcacgtgatggat

SEQ ID NO: 70915 - DNA, 23 bp, Homo sapiens
agcctcttgtggatggtcagcga

SEQ ID NO: 70916 - DNA, 22 bp, Homo sapiens
ccggtctgtgtacttgctggcc

SEQ ID NO: 70917 - DNA, 22 bp, Homo sapiens
tctttgggccgacactcgtcaa

SEQ ID NO: 70918 - DNA, 22 bp, Homo sapiens
gtgacaggccactgcggctctg

SEQ ID NO: 70919 - DNA, 22 bp, Homo sapiens
tcccacaggtggagcttgcagt

SEQ ID NO: 70920 - DNA, 22 bp, Homo sapiens
ctgggaggcggaggttgtagtg

SEQ ID NO: 70921 - DNA, 22 bp, Homo sapiens
ataagattgtcatagtatggac

SEQ ID NO: 70922 - DNA, 22 bp, Homo sapiens
ttctgccatctgcagaagggga

SEQ ID NO: 70923 - DNA, 22 bp, Homo sapiens
ttgggcctctcaaagtgctggg

SEQ ID NO: 70924 - DNA, 22 bp, Homo sapiens
atggcagcggagctggaaatga

SEQ ID NO: 70925 - DNA, 22 bp, Homo sapiens
ctgaggggtcgtgggagcccag

SEQ ID NO: 70926 - DNA, 22 bp, Homo sapiens
ggcagacctctccagccccaca

SEQ ID NO: 70927 - DNA, 22 bp, Homo sapiens
ggaggctctgaccatttaccca

SEQ ID NO: 70928 - DNA, 22 bp, Homo sapiens
ccactgcactccagccttggca

SEQ ID NO: 70929 - DNA, 22 bp, Homo sapiens
attgcacttcagcctgggtgac

SEQ ID NO: 70930 - DNA, 22 bp, Homo sapiens
tcccgtaggttgctgtagtcgg

SEQ ID NO: 70931 - DNA, 22 bp, Homo sapiens
tgttcagaacaaaggtaaatga

SEQ ID NO: 70932 - DNA, 22 bp, Homo sapiens
agaaaacataggagacaggaaa

SEQ ID NO: 70933 - DNA, 22 bp, Homo sapiens
ggtcaggagcccttggccccct

SEQ ID NO: 70934 - DNA, 23 bp, Homo sapiens
attttttgtctttgtaactagat

SEQ ID NO: 70935 - DNA, 22 bp, Homo sapiens
gagcacagtaaagcagtgtcac

SEQ ID NO: 70936 - DNA, 22 bp, Homo sapiens
aggtgtctggacttgtgaagca

SEQ ID NO: 70937 - DNA, 22 bp, Homo sapiens
gggcaaaacctgggcatcatga

SEQ ID NO: 70938 - DNA, 21 bp, Homo sapiens
ccgccgctgatagctctgggc

SEQ ID NO: 70939 - DNA, 22 bp, Homo sapiens
cccacgtcgaacttgctccaga

SEQ ID NO: 70940 - DNA, 22 bp, Homo sapiens
gagggagggactagcattctct

SEQ ID NO: 70941 - DNA, 22 bp, Homo sapiens
gtcccgcattgggcattcctgg

SEQ ID NO: 70942 - DNA, 23 bp, Homo sapiens
cagtctgcagcccacttgggcag

SEQ ID NO: 70943 - DNA, 22 bp, Homo sapiens
cctgtgcttggccagagaggtt

SEQ ID NO: 70944 - DNA, 22 bp, Homo sapiens
cctttaggagtgaggaccgagc

SEQ ID NO: 70945 - DNA, 22 bp, Homo sapiens
cacccaggctggagtgcagtga

SEQ ID NO: 70946 - DNA, 22 bp, Homo sapiens
cacccaggctggaatgcagtgg

SEQ ID NO: 70947 - DNA, 22 bp, Homo sapiens
gctggccacagatccccaggga

SEQ ID NO: 70948 - DNA, 22 bp, Homo sapiens
agaccaaagaaaacacatctgg

SEQ ID NO: 70949 - DNA, 22 bp, Homo sapiens
agcttgggcaacacagcaagac

SEQ ID NO: 70950 - DNA, 20 bp, Homo sapiens
ctgggtggcaagcaaggggg

SEQ ID NO: 70951 - DNA, 22 bp, Homo sapiens
ctgagctcacgccattctcctt

SEQ ID NO: 70952 - DNA, 22 bp, Homo sapiens
caaatactacgattcttgcagt

SEQ ID NO: 70953 - DNA, 22 bp, Homo sapiens
tccgaggccaaagctgtgaata

SEQ ID NO: 70954 - DNA, 16 bp, Homo sapiens
gcaggcagatcacatg

SEQ ID NO: 70955 - DNA, 22 bp, Homo sapiens
catgcctgtaatcccagcactt

SEQ ID NO: 70956 - DNA, 22 bp, Homo sapiens
agttgcagacgcagagatgttg

SEQ ID NO: 70957 - DNA, 22 bp, Homo sapiens
cagtgcatgcacacacatggta

SEQ ID NO: 70958 - DNA, 22 bp, Homo sapiens
ttgctctgactggagtgcagtg

SEQ ID NO: 70959 - DNA, 22 bp, Homo sapiens
tgagaaattacttcagtgatgg

SEQ ID NO: 70960 - DNA, 22 bp, Homo sapiens
ccttggcaggcacgtcctgcgg

SEQ ID NO: 70961 - DNA, 22 bp, Homo sapiens
agtctgcaggaccgcgtcacat

SEQ ID NO: 70962 - DNA, 22 bp, Homo sapiens
ctggcctggcgcagtggctcac

SEQ ID NO: 70963 - DNA, 22 bp, Homo sapiens
aagtggcagttcaggaagcaga

SEQ ID NO: 70964 - DNA, 22 bp, Homo sapiens
tgtccccacctaaatcttatct

SEQ ID NO: 70965 - DNA, 22 bp, Homo sapiens
ggagcatgcgctctgtgaccga

SEQ ID NO: 70966 - DNA, 22 bp, Homo sapiens
tgcctaggctggagtgtagtgg

SEQ ID NO: 70967 - DNA, 22 bp, Homo sapiens
cacggtggcccacaggtgcaag

SEQ ID NO: 70968 - DNA, 22 bp, Homo sapiens
taagggaacagcttcaaactca

SEQ ID NO: 70969 - DNA, 22 bp, Homo sapiens
ccaaagtgctaggattacaggc

SEQ ID NO: 70970 - DNA, 22 bp, Homo sapiens
ttgacacagtcaacttgatttt

SEQ ID NO: 70971 - DNA, 22 bp, Homo sapiens
tgatttcaagccagggggcgtt

SEQ ID NO: 70972 - DNA, 22 bp, Homo sapiens
ggctcctgggggtgctcctgcc

SEQ ID NO: 70973 - DNA, 21 bp, Homo sapiens
gtggttctagagaaacagaat

SEQ ID NO: 70974 - DNA, 22 bp, Homo sapiens
ctcgggcaccctggttctggtg

SEQ ID NO: 70975 - DNA, 22 bp, Homo sapiens
gagaggaagccttctgtacttg

SEQ ID NO: 70976 - DNA, 22 bp, Homo sapiens
tctaattttggcattttaacct

SEQ ID NO: 70977 - DNA, 22 bp, Homo sapiens
tattgggtaaagatccagtttt

SEQ ID NO: 70978 - DNA, 22 bp, Homo sapiens
caggcagggagctggaaaggat

SEQ ID NO: 70979 - DNA, 22 bp, Homo sapiens
ctggagggtggagagaagtctc

SEQ ID NO: 70980 - DNA, 22 bp, Homo sapiens
tgtagtagcattcacgaagtgt

SEQ ID NO: 70981 - DNA, 22 bp, Homo sapiens
ccagaggtgctctttggaagtg

SEQ ID NO: 70982 - DNA, 22 bp, Homo sapiens
ccagatatcactgccgtgttgt

SEQ ID NO: 70983 - DNA, 22 bp, Homo sapiens
gggaacagcttgggctctgcca

SEQ ID NO: 70984 - DNA, 21 bp, Homo sapiens
gcccacagtgaggaggatccc

SEQ ID NO: 70985 - DNA, 22 bp, Homo sapiens
agctgcaccggctggaccactg

SEQ ID NO: 70986 - DNA, 22 bp, Homo sapiens
gcagtggggcaatcatagctca

SEQ ID NO: 70987 - DNA, 19 bp, Homo sapiens
tctcaattctccccactgc

SEQ ID NO: 70988 - DNA, 23 bp, Homo sapiens
ctgtggtgaggccctagaatctg

SEQ ID NO: 70989 - DNA, 22 bp, Homo sapiens
cccagacccagagggaggcagg

SEQ ID NO: 70990 - DNA, 18 bp, Homo sapiens
gcaaccacagattctttg

SEQ ID NO: 70991 - DNA, 22 bp, Homo sapiens
gtctgctcatgctaccgcgggc

SEQ ID NO: 70992 - DNA, 22 bp, Homo sapiens
agatggggtttcatcatgttgg

SEQ ID NO: 70993 - DNA, 22 bp, Homo sapiens
acacagggctgcgcctgacccc

SEQ ID NO: 70994 - DNA, 22 bp, Homo sapiens
caccagcagcggtgtgagggtg

SEQ ID NO: 70995 - DNA, 22 bp, Homo sapiens
gggtacagttcttccagtgtca

SEQ ID NO: 70996 - DNA, 22 bp, Homo sapiens
gcccagtggtaaaagcaggcct

SEQ ID NO: 70997 - DNA, 22 bp, Homo sapiens
ttataagactgtagtgagtatt

SEQ ID NO: 70998 - DNA, 22 bp, Homo sapiens
ttttcctttgattcccagatgt

SEQ ID NO: 70999 - DNA, 22 bp, Homo sapiens
atgcagtggcttcagtgtcagt

SEQ ID NO: 71000 - DNA, 22 bp, Homo sapiens
aggatgagccgcgcaagctgac

SEQ ID NO: 71001 - DNA, 22 bp, Homo sapiens
actgcactccagcctcggggtc

SEQ ID NO: 71002 - DNA, 22 bp, Homo sapiens
tcatcagggatattggcctgaa

SEQ ID NO: 71003 - DNA, 21 bp, Homo sapiens
tcagataccagactcaagggg

SEQ ID NO: 71004 - DNA, 22 bp, Homo sapiens
agagaggtctcaggagaaacca

SEQ ID NO: 71005 - DNA, 22 bp, Homo sapiens
tcctcagaatcacctggcagct

SEQ ID NO: 71006 - DNA, 22 bp, Homo sapiens
acatcctcccgatctactggct

SEQ ID NO: 71007 - DNA, 22 bp, Homo sapiens
gcctccggagtcacagtgtctt

SEQ ID NO: 71008 - DNA, 22 bp, Homo sapiens
cagatgtcatttcccatgcagc

SEQ ID NO: 71009 - DNA, 23 bp, Homo sapiens
gtgtggccccagggcctcctcgc

SEQ ID NO: 71010 - DNA, 22 bp, Homo sapiens
ctggacacactggagtctggca

SEQ ID NO: 71011 - DNA, 22 bp, Homo sapiens
gtggatggccctgcacacaggt

SEQ ID NO: 71012 - DNA, 22 bp, Homo sapiens
ggagaagcagcttcttgatgaa

SEQ ID NO: 71013 - DNA, 22 bp, Homo sapiens
cattgcactccagcctgggcaa

SEQ ID NO: 71014 - DNA, 22 bp, Homo sapiens
tgaggctccttgtagagagtgg

SEQ ID NO: 71015 - DNA, 21 bp, Homo sapiens
cttccccaggctggtctgtat

SEQ ID NO: 71016 - DNA, 22 bp, Homo sapiens
ctgagatctttatacgaggcac

SEQ ID NO: 71017 - DNA, 20 bp, Homo sapiens
aactcctagcctcaagtgat

SEQ ID NO: 71018 - DNA, 20 bp, Homo sapiens
acctcctggcgggcatcctc

SEQ ID NO: 71019 - DNA, 22 bp, Homo sapiens
tgccctggctcttcttgttcca

SEQ ID NO: 71020 - DNA, 22 bp, Homo sapiens
tcttcatgtcatggtatattga

SEQ ID NO: 71021 - DNA, 22 bp, Homo sapiens
actgcaacacctcctgggttca

SEQ ID NO: 71022 - DNA, 22 bp, Homo sapiens
gaggtagtttagttttggggaa

SEQ ID NO: 71023 - DNA, 17 bp, Homo sapiens
ggcctgcacctcctgct

SEQ ID NO: 71024 - DNA, 22 bp, Homo sapiens
ctctaccaggagtctccaccgt

SEQ ID NO: 71025 - DNA, 22 bp, Homo sapiens
gctccgccacgcccactcctac

SEQ ID NO: 71026 - DNA, 22 bp, Homo sapiens
aagccaatgctagcccacatgc

SEQ ID NO: 71027 - DNA, 22 bp, Homo sapiens
acctttcagtgccctttctgtc

SEQ ID NO: 71028 - DNA, 22 bp, Homo sapiens
ttcctaagtcctgccagcagtc

SEQ ID NO: 71029 - DNA, 22 bp, Homo sapiens
gaaaaggcctggggcaaagtgt

SEQ ID NO: 71030 - DNA, 22 bp, Homo sapiens
aaaagtaattgcggtttttgct

SEQ ID NO: 71031 - DNA, 22 bp, Homo sapiens
ggctgagttgagaggattactt

SEQ ID NO: 71032 - DNA, 22 bp, Homo sapiens
taattcttcaggccttttgtct

SEQ ID NO: 71033 - DNA, 22 bp, Homo sapiens
gagaaagcttctttcccacagg

SEQ ID NO: 71034 - DNA, 22 bp, Homo sapiens
ttaattctgcctttcatgtaac

SEQ ID NO: 71035 - DNA, 22 bp, Homo sapiens
cgcgctgcagacagcggaggcc

SEQ ID NO: 71036 - DNA, 22 bp, Homo sapiens
gtctcgtcaatggcaggttccc

SEQ ID NO: 71037 - DNA, 22 bp, Homo sapiens
gcagctggaagtgacactctgt

SEQ ID NO: 71038 - DNA, 20 bp, Homo sapiens
ctcttccggaggggcgctcc

SEQ ID NO: 71039 - DNA, 22 bp, Homo sapiens
gccatcatatcccctgtgacct

SEQ ID NO: 71040 - DNA, 23 bp, Homo sapiens
aagttagtttcaataaagcaatt

SEQ ID NO: 71041 - DNA, 22 bp, Homo sapiens
aaattagtcatgttgtattact

SEQ ID NO: 71042 - DNA, 22 bp, Homo sapiens
ggaggctgaggcaggcggatca

SEQ ID NO: 71043 - DNA, 22 bp, Homo sapiens
cccaggagttagaggttgtggt

SEQ ID NO: 71044 - DNA, 22 bp, Homo sapiens
catcatcaaaagtgacagagaa

SEQ ID NO: 71045 - DNA, 22 bp, Homo sapiens
cagaagactgcagggaagggac

SEQ ID NO: 71046 - DNA, 22 bp, Homo sapiens
atgctattgaaaagaaataaga

SEQ ID NO: 71047 - DNA, 22 bp, Homo sapiens
ggtcacacaccaggacctgcag

SEQ ID NO: 71048 - DNA, 22 bp, Homo sapiens
gcaggagaacaaagcaagctgc

SEQ ID NO: 71049 - DNA, 22 bp, Homo sapiens
actccacatttgaacacagttc

SEQ ID NO: 71050 - DNA, 22 bp, Homo sapiens
tcctgccaggagatggtagcca

SEQ ID NO: 71051 - DNA, 22 bp, Homo sapiens
tgggaaggggagctggaaagga

SEQ ID NO: 71052 - DNA, 22 bp, Homo sapiens
tgtacttgaacttgactgtaga

SEQ ID NO: 71053 - DNA, 22 bp, Homo sapiens
gtgcgtcctgggggctgggtcg

SEQ ID NO: 71054 - DNA, 22 bp, Homo sapiens
ctgtccagcgactaggggatgg

SEQ ID NO: 71055 - DNA, 22 bp, Homo sapiens
ccagaaaaatcctcccttgtcc

SEQ ID NO: 71056 - DNA, 22 bp, Homo sapiens
cattgcaacttcaaactcctgg

SEQ ID NO: 71057 - DNA, 22 bp, Homo sapiens
acaggggcaagggctcacggcc

SEQ ID NO: 71058 - DNA, 18 bp, Homo sapiens
gaggatggaaggagatgc

SEQ ID NO: 71059 - DNA, 22 bp, Homo sapiens
tgagggaatattgatagatccg

SEQ ID NO: 71060 - DNA, 22 bp, Homo sapiens
tgttggagcccgagtcagggag

SEQ ID NO: 71061 - DNA, 22 bp, Homo sapiens
cagcccaggactgcaggtgttt

SEQ ID NO: 71062 - DNA, 22 bp, Homo sapiens
agaaatatgctgattagatgaa

SEQ ID NO: 71063 - DNA, 22 bp, Homo sapiens
gtctttcttaaacaacagaaca

SEQ ID NO: 71064 - DNA, 22 bp, Homo sapiens
tttggctcagctcacagatccc

SEQ ID NO: 71065 - DNA, 22 bp, Homo sapiens
atacaatgacccgggtccaagg

SEQ ID NO: 71066 - DNA, 19 bp, Homo sapiens
ttccatctatcttcttact

SEQ ID NO: 71067 - DNA, 22 bp, Homo sapiens
gcatctaaataaacgtgggagt

SEQ ID NO: 71068 - DNA, 22 bp, Homo sapiens
cttcctctgtggccagagtgta

SEQ ID NO: 71069 - DNA, 23 bp, Homo sapiens
ccaagactgttaggagtggggag

SEQ ID NO: 71070 - DNA, 22 bp, Homo sapiens
aaggccctggcaggaagcagga

SEQ ID NO: 71071 - DNA, 22 bp, Homo sapiens
cctgcagacacttgtccagcaa

SEQ ID NO: 71072 - DNA, 22 bp, Homo sapiens
ccaggagttggaggctgcagtg

SEQ ID NO: 71073 - DNA, 22 bp, Homo sapiens
cccattgtggttgttgaggata

SEQ ID NO: 71074 - DNA, 21 bp, Homo sapiens
gagagctaacagtgacagctc

SEQ ID NO: 71075 - DNA, 22 bp, Homo sapiens
ccaccagctgcatatgcacgta

SEQ ID NO: 71076 - DNA, 22 bp, Homo sapiens
tacgttttaaacacggagccag

SEQ ID NO: 71077 - DNA, 22 bp, Homo sapiens
ctgatctcaagtgatccaccca

SEQ ID NO: 71078 - DNA, 22 bp, Homo sapiens
ccacaagtttgttgattgaaac

SEQ ID NO: 71079 - DNA, 22 bp, Homo sapiens
tgctcgaggtccccaccggctc

SEQ ID NO: 71080 - DNA, 22 bp, Homo sapiens
ctcactgcaagctccacctctt

SEQ ID NO: 71081 - DNA, 22 bp, Homo sapiens
agctagtatttcattgaggatt

SEQ ID NO: 71082 - DNA, 23 bp, Homo sapiens
cagagctggctcagagctgcctg

SEQ ID NO: 71083 - DNA, 22 bp, Homo sapiens
tgtcatagtgtggtagcagtgg

SEQ ID NO: 71084 - DNA, 22 bp, Homo sapiens
gcacacggcagcctcctcctga

SEQ ID NO: 71085 - DNA, 22 bp, Homo sapiens
gcagtggcatgatgtgggctca

SEQ ID NO: 71086 - DNA, 22 bp, Homo sapiens
agcctagggttctgatgtcact

SEQ ID NO: 71087 - DNA, 22 bp, Homo sapiens
gaggcagaggttgttgcagtga

SEQ ID NO: 71088 - DNA, 22 bp, Homo sapiens
cctggggtcacttgcagccgca

SEQ ID NO: 71089 - DNA, 22 bp, Homo sapiens
gaccttgtgatctgcccacctt

SEQ ID NO: 71090 - DNA, 22 bp, Homo sapiens
ttccggaaggttctctagaatt

SEQ ID NO: 71091 - DNA, 22 bp, Homo sapiens
gcccagagttcaaggctgcagt

SEQ ID NO: 71092 - DNA, 22 bp, Homo sapiens
gcatggcttcggggtgctgcct

SEQ ID NO: 71093 - DNA, 22 bp, Homo sapiens
cgagcatgatgacggctgtggc

SEQ ID NO: 71094 - DNA, 22 bp, Homo sapiens
taaatcttctacatcatcataa

SEQ ID NO: 71095 - DNA, 22 bp, Homo sapiens
aaacactcatgtgttactctcc

SEQ ID NO: 71096 - DNA, 22 bp, Homo sapiens
cctgtcacctaggtactgagca

SEQ ID NO: 71097 - DNA, 22 bp, Homo sapiens
taattataacatgctttctggc

SEQ ID NO: 71098 - DNA, 22 bp, Homo sapiens
gaggcaggaggattgcttgagc

SEQ ID NO: 71099 - DNA, 22 bp, Homo sapiens
aggagcagaccgtagtcctgca

SEQ ID NO: 71100 - DNA, 22 bp, Homo sapiens
agcccgcatctcgctaaagata

SEQ ID NO: 71101 - DNA, 18 bp, Homo sapiens
acgtgctgtgccttttgc

SEQ ID NO: 71102 - DNA, 21 bp, Homo sapiens
tccctgagcccaaggggctcc

SEQ ID NO: 71103 - DNA, 22 bp, Homo sapiens
gagccaggtcgggccgcggcga

SEQ ID NO: 71104 - DNA, 22 bp, Homo sapiens
gggcggggtggctcatgcctgt

SEQ ID NO: 71105 - DNA, 22 bp, Homo sapiens
ctgtcaggttggtctcagagct

SEQ ID NO: 71106 - DNA, 22 bp, Homo sapiens
ccaggggggcgtagatgctggg

SEQ ID NO: 71107 - DNA, 22 bp, Homo sapiens
ttcaaatgatggcagtcctggc

SEQ ID NO: 71108 - DNA, 22 bp, Homo sapiens
ggaggctgagaggtcgcagtgg

SEQ ID NO: 71109 - DNA, 22 bp, Homo sapiens
gaagccagtgtttgaagaattt

SEQ ID NO: 71110 - DNA, 22 bp, Homo sapiens
cagggggctcaaaggagagtgc

SEQ ID NO: 71111 - DNA, 22 bp, Homo sapiens
caaagtgctaggattacaggcc

SEQ ID NO: 71112 - DNA, 22 bp, Homo sapiens
tctcaatttgattacattcata

SEQ ID NO: 71113 - DNA, 22 bp, Homo sapiens
ggggtgtggacggctgtgccag

SEQ ID NO: 71114 - DNA, 22 bp, Homo sapiens
cccagggagagcgcggaggcgg

SEQ ID NO: 71115 - DNA, 22 bp, Homo sapiens
gctgtgcagaggtgagaatcca

SEQ ID NO: 71116 - DNA, 22 bp, Homo sapiens
aggcactgtgcagtcccaagca

SEQ ID NO: 71117 - DNA, 22 bp, Homo sapiens
ccggtcccaggtgccccggtga

SEQ ID NO: 71118 - DNA, 22 bp, Homo sapiens
aatttgtataaaatggtgtttt

SEQ ID NO: 71119 - DNA, 22 bp, Homo sapiens
gcctgtgacccagggcccagga

SEQ ID NO: 71120 - DNA, 22 bp, Homo sapiens
tagatacctgctggacctcatt

SEQ ID NO: 71121 - DNA, 19 bp, Homo sapiens
taccatccaagctggtttg

SEQ ID NO: 71122 - DNA, 22 bp, Homo sapiens
gagtgtgtcggtcagcgtggcg

SEQ ID NO: 71123 - DNA, 22 bp, Homo sapiens
ttcataaacaaattaaggcctg

SEQ ID NO: 71124 - DNA, 22 bp, Homo sapiens
actgcactccagcctgggtgac

SEQ ID NO: 71125 - DNA, 22 bp, Homo sapiens
actgtactccagcctgggaaac

SEQ ID NO: 71126 - DNA, 23 bp, Homo sapiens
gaggtggcaatgagggcagttgg

SEQ ID NO: 71127 - DNA, 22 bp, Homo sapiens
atgattgaccatctgctgggct

SEQ ID NO: 71128 - DNA, 22 bp, Homo sapiens
gcctgtgtggatgcgccggtgc

SEQ ID NO: 71129 - DNA, 22 bp, Homo sapiens
ctggctgggagcgagctgctca

SEQ ID NO: 71130 - DNA, 22 bp, Homo sapiens
aaggatgattggtaatgacact

SEQ ID NO: 71131 - DNA, 22 bp, Homo sapiens
gccataggcagcgtggccagca

SEQ ID NO: 71132 - DNA, 22 bp, Homo sapiens
ttaccacagtgcctgtctaatg

SEQ ID NO: 71133 - DNA, 22 bp, Homo sapiens
ctccaccccgtgccggtgctgg

SEQ ID NO: 71134 - DNA, 22 bp, Homo sapiens
taatatctacttcatagagttt

SEQ ID NO: 71135 - DNA, 22 bp, Homo sapiens
ataaagctattcctctcttttt

SEQ ID NO: 71136 - DNA, 22 bp, Homo sapiens
gtggccgccaggtcctcgtcca

SEQ ID NO: 71137 - DNA, 22 bp, Homo sapiens
tcaggagtgccagtaccttttg

SEQ ID NO: 71138 - DNA, 22 bp, Homo sapiens
atggatggaactctgctgtggt

SEQ ID NO: 71139 - DNA, 18 bp, Homo sapiens
tggtcactgtggatagtg

SEQ ID NO: 71140 - DNA, 22 bp, Homo sapiens
ctctcctattgtgtggtaagga

SEQ ID NO: 71141 - DNA, 22 bp, Homo sapiens
tggttttagggaatcaatctat

SEQ ID NO: 71142 - DNA, 22 bp, Homo sapiens
tgttaaatgctcagctcgggga

SEQ ID NO: 71143 - DNA, 21 bp, Homo sapiens
tactgtagccttgcactgtag

SEQ ID NO: 71144 - DNA, 22 bp, Homo sapiens
gctcccaggatgaggagccagg

SEQ ID NO: 71145 - DNA, 22 bp, Homo sapiens
aggagaagccaagttgtgagca

SEQ ID NO: 71146 - DNA, 22 bp, Homo sapiens
aaagtgctgaaattacaggtgt

SEQ ID NO: 71147 - DNA, 22 bp, Homo sapiens
acttaccagagaggatccgccc

SEQ ID NO: 71148 - DNA, 22 bp, Homo sapiens
tatttcttttcgtgacttattg

SEQ ID NO: 71149 - DNA, 22 bp, Homo sapiens
cactgcacttcagcctgggtga

SEQ ID NO: 71150 - DNA, 22 bp, Homo sapiens
ggagcagggaattacagcgcag

SEQ ID NO: 71151 - DNA, 22 bp, Homo sapiens
aaagagactggtggcattttgc

SEQ ID NO: 71152 - DNA, 22 bp, Homo sapiens
agaaggcatagaccggattatg

SEQ ID NO: 71153 - DNA, 22 bp, Homo sapiens
tgaccactgtagccacttaaga

SEQ ID NO: 71154 - DNA, 22 bp, Homo sapiens
atgcacctgaactccatcagct

SEQ ID NO: 71155 - DNA, 22 bp, Homo sapiens
cggcccgctgcgagtgcaccgt

SEQ ID NO: 71156 - DNA, 22 bp, Homo sapiens
gaagtgtagtcttgagccccca

SEQ ID NO: 71157 - DNA, 18 bp, Homo sapiens
gctgtggaagtctttata

SEQ ID NO: 71158 - DNA, 22 bp, Homo sapiens
ttgaagactaatttagataatg

SEQ ID NO: 71159 - DNA, 22 bp, Homo sapiens
tggcctcggcatccagcaagag

SEQ ID NO: 71160 - DNA, 22 bp, Homo sapiens
accctcaagatggaagcagttt

SEQ ID NO: 71161 - DNA, 22 bp, Homo sapiens
cagaagatctcttagtggaggg

SEQ ID NO: 71162 - DNA, 22 bp, Homo sapiens
aaagcagaactgagagagctgg

SEQ ID NO: 71163 - DNA, 22 bp, Homo sapiens
tgttcattacccatcccaggtc

SEQ ID NO: 71164 - DNA, 22 bp, Homo sapiens
cctggtgctgctatcaggggta

SEQ ID NO: 71165 - DNA, 22 bp, Homo sapiens
actgcaacctccacctcctggg

SEQ ID NO: 71166 - DNA, 22 bp, Homo sapiens
gagaatgatgatttccaatttc

SEQ ID NO: 71167 - DNA, 22 bp, Homo sapiens
acctggaggcagaggttgcagt

SEQ ID NO: 71168 - DNA, 23 bp, Homo sapiens
aggatgtaggatgtatggcagag

SEQ ID NO: 71169 - DNA, 20 bp, Homo sapiens
tcagccattccttacctttc

SEQ ID NO: 71170 - DNA, 22 bp, Homo sapiens
ttgtttccataattaagtgtga

SEQ ID NO: 71171 - DNA, 22 bp, Homo sapiens
gcacatccaatgattgttttga

SEQ ID NO: 71172 - DNA, 22 bp, Homo sapiens
ggcgccgcactcggtgcagccg

SEQ ID NO: 71173 - DNA, 22 bp, Homo sapiens
tagtggatgttcagagatttga

SEQ ID NO: 71174 - DNA, 22 bp, Homo sapiens
gaagagctgacagtgtcatcct

SEQ ID NO: 71175 - DNA, 22 bp, Homo sapiens
aaagtgcaaggattacaggcat

SEQ ID NO: 71176 - DNA, 22 bp, Homo sapiens
gaaaaggcagagttccggggaa

SEQ ID NO: 71177 - DNA, 22 bp, Homo sapiens
ggctttctgtctgcgtctgtgt

SEQ ID NO: 71178 - DNA, 22 bp, Homo sapiens
actcatgtaagcggaatgtagt

SEQ ID NO: 71179 - DNA, 20 bp, Homo sapiens
cagcctgcatcatctgcagc

SEQ ID NO: 71180 - DNA, 22 bp, Homo sapiens
ttcctgcgcccttctcgcccgc

SEQ ID NO: 71181 - DNA, 22 bp, Homo sapiens
ggcatagatttctttaggttta

SEQ ID NO: 71182 - DNA, 22 bp, Homo sapiens
cttgaaagtcagcagagtggat

SEQ ID NO: 71183 - DNA, 22 bp, Homo sapiens
aaatgcaacgggctttccttat

SEQ ID NO: 71184 - DNA, 20 bp, Homo sapiens
ctgccgaccacagccatgga

SEQ ID NO: 71185 - DNA, 22 bp, Homo sapiens
tcgcgggttgcacatggccatc

SEQ ID NO: 71186 - DNA, 22 bp, Homo sapiens
ttgagagttctgaatgagtaac

SEQ ID NO: 71187 - DNA, 22 bp, Homo sapiens
ctggaaggcggaggttgtagtg

SEQ ID NO: 71188 - DNA, 17 bp, Homo sapiens
ctggagcagacaaaagg

SEQ ID NO: 71189 - DNA, 22 bp, Homo sapiens
catctttgcccatccacttcca

SEQ ID NO: 71190 - DNA, 22 bp, Homo sapiens
gtgattttctcctcctagaagt

SEQ ID NO: 71191 - DNA, 22 bp, Homo sapiens
tccgggcaactgaagggaggtt

SEQ ID NO: 71192 - DNA, 21 bp, Homo sapiens
caatggcgagatcttggctca

SEQ ID NO: 71193 - DNA, 22 bp, Homo sapiens
gggactggagtagaggccggtg

SEQ ID NO: 71194 - DNA, 22 bp, Homo sapiens
aagaccagcctatgttttccat

SEQ ID NO: 71195 - DNA, 22 bp, Homo sapiens
gtacactccccctgtgaagttg

SEQ ID NO: 71196 - DNA, 22 bp, Homo sapiens
tccttagacaaagagtgggctt

SEQ ID NO: 71197 - DNA, 22 bp, Homo sapiens
gagcagtgtttgtggacctgga

SEQ ID NO: 71198 - DNA, 20 bp, Homo sapiens
tatttctgggcaaccattta

SEQ ID NO: 71199 - DNA, 22 bp, Homo sapiens
ttcaacagacccttctttcttt

SEQ ID NO: 71200 - DNA, 22 bp, Homo sapiens
ttactttaagggtgtcttatta

SEQ ID NO: 71201 - DNA, 22 bp, Homo sapiens
gcagtgccgaaggtagtggttg

SEQ ID NO: 71202 - DNA, 22 bp, Homo sapiens
gaataatcatgaaattcagtga

SEQ ID NO: 71203 - DNA, 22 bp, Homo sapiens
acagcagcaatagcagtgacat

SEQ ID NO: 71204 - DNA, 22 bp, Homo sapiens
taagcctgcatgaaccatgaga

SEQ ID NO: 71205 - DNA, 22 bp, Homo sapiens
tcagcctgctccaagtgctgcc

SEQ ID NO: 71206 - DNA, 22 bp, Homo sapiens
aatgcaccttggcagggattca

SEQ ID NO: 71207 - DNA, 22 bp, Homo sapiens
actgtgaacggactgaagccca

SEQ ID NO: 71208 - DNA, 22 bp, Homo sapiens
tcctccccaaagcccagcctgg

SEQ ID NO: 71209 - DNA, 22 bp, Homo sapiens
gggaggcagtgctggaggctgg

SEQ ID NO: 71210 - DNA, 22 bp, Homo sapiens
tctggcttcgcagctcccagcc

SEQ ID NO: 71211 - DNA, 22 bp, Homo sapiens
aaagtgctgaaattacaggggt

SEQ ID NO: 71212 - DNA, 22 bp, Homo sapiens
tcactgcaagctcctcctcctg

SEQ ID NO: 71213 - DNA, 22 bp, Homo sapiens
ttatttgtggcatatgagacga

SEQ ID NO: 71214 - DNA, 19 bp, Homo sapiens
caccaagatggctctagtc

SEQ ID NO: 71215 - DNA, 22 bp, Homo sapiens
tagcagcatttttgtagagtat

SEQ ID NO: 71216 - DNA, 22 bp, Homo sapiens
gaggcctcatgaggtgagcatt

SEQ ID NO: 71217 - DNA, 17 bp, Homo sapiens
tccttcagtgcctctgc

SEQ ID NO: 71218 - DNA, 22 bp, Homo sapiens
ctgagggtcaacttgattgtat

SEQ ID NO: 71219 - DNA, 22 bp, Homo sapiens
ttcttttaattgtgggggagtg

SEQ ID NO: 71220 - DNA, 22 bp, Homo sapiens
ttccacattccttacattcata

SEQ ID NO: 71221 - DNA, 22 bp, Homo sapiens
ccaggtgtgctctgcagtggat

SEQ ID NO: 71222 - DNA, 22 bp, Homo sapiens
tatcttaaaaatcgaagcagat

SEQ ID NO: 71223 - DNA, 22 bp, Homo sapiens
tggttaacttctgagcaggctg

SEQ ID NO: 71224 - DNA, 21 bp, Homo sapiens
gggcagaggggcctcctgggt

SEQ ID NO: 71225 - DNA, 22 bp, Homo sapiens
gggggactggaccgtcctgggt

SEQ ID NO: 71226 - DNA, 22 bp, Homo sapiens
tgatcaggtctgaacagggagg

SEQ ID NO: 71227 - DNA, 22 bp, Homo sapiens
ggaggacaggggctgcagcaca

SEQ ID NO: 71228 - DNA, 22 bp, Homo sapiens
gggaagatagtgttgagggccc

SEQ ID NO: 71229 - DNA, 22 bp, Homo sapiens
ctgggaggtggaggttgcattg

SEQ ID NO: 71230 - DNA, 22 bp, Homo sapiens
aaaaaattatcatagttcctga

SEQ ID NO: 71231 - DNA, 22 bp, Homo sapiens
ctgccctttgaaagaacgtctt

SEQ ID NO: 71232 - DNA, 22 bp, Homo sapiens
gcaggcggaggttgcagtgagc

SEQ ID NO: 71233 - DNA, 20 bp, Homo sapiens
tgacatagctcttggggtgc

SEQ ID NO: 71234 - DNA, 22 bp, Homo sapiens
gaagatgttatggagagctcag

SEQ ID NO: 71235 - DNA, 22 bp, Homo sapiens
tttaatcataagaaggaaaata

SEQ ID NO: 71236 - DNA, 22 bp, Homo sapiens
ccaggagctggagggtgcagtg

SEQ ID NO: 71237 - DNA, 22 bp, Homo sapiens
acttgccccagaattgctgctg

SEQ ID NO: 71238 - DNA, 19 bp, Homo sapiens
agcggttctcaaagtcagg

SEQ ID NO: 71239 - DNA, 22 bp, Homo sapiens
aacctcaaactcttgggcttaa

SEQ ID NO: 71240 - DNA, 22 bp, Homo sapiens
ctgctctgctgatcagtgtctc

SEQ ID NO: 71241 - DNA, 22 bp, Homo sapiens
actgatcaagggtttaatttta

SEQ ID NO: 71242 - DNA, 22 bp, Homo sapiens
tcaatcacgtgttccatgttct

SEQ ID NO: 71243 - DNA, 22 bp, Homo sapiens
ttcacagcttaataaggctcag

SEQ ID NO: 71244 - DNA, 22 bp, Homo sapiens
tggtgctgccaggctcctgcca

SEQ ID NO: 71245 - DNA, 22 bp, Homo sapiens
agccagggtctctcgctctgtt

SEQ ID NO: 71246 - DNA, 22 bp, Homo sapiens
acaactttgacccttgttctta

SEQ ID NO: 71247 - DNA, 22 bp, Homo sapiens
acagaactgggaaatgcacata

SEQ ID NO: 71248 - DNA, 19 bp, Homo sapiens
gcagacaggtccagagagg

SEQ ID NO: 71249 - DNA, 22 bp, Homo sapiens
agtgaaaacctaatcatgcagt

SEQ ID NO: 71250 - DNA, 22 bp, Homo sapiens
gcgcggcctcacccctcggtga

SEQ ID NO: 71251 - DNA, 22 bp, Homo sapiens
gaatttcctctaaacccctgag

SEQ ID NO: 71252 - DNA, 19 bp, Homo sapiens
taggaccctggtggccccc

SEQ ID NO: 71253 - DNA, 22 bp, Homo sapiens
ttccctccatttcattttataa

SEQ ID NO: 71254 - DNA, 22 bp, Homo sapiens
tggcagtggcgggactcagggc

SEQ ID NO: 71255 - DNA, 22 bp, Homo sapiens
tggaggctggagtgcagtggcg

SEQ ID NO: 71256 - DNA, 21 bp, Homo sapiens
gggcactgaaagggaatagca

SEQ ID NO: 71257 - DNA, 16 bp, Homo sapiens
gaggagcccctctgcc

SEQ ID NO: 71258 - DNA, 21 bp, Homo sapiens
ggtgtgggatggactgaacca

SEQ ID NO: 71259 - DNA, 20 bp, Homo sapiens
aggggcacctgcgacggggc

SEQ ID NO: 71260 - DNA, 22 bp, Homo sapiens
gcaccacatcaatgaggggagc

SEQ ID NO: 71261 - DNA, 22 bp, Homo sapiens
ggagttccagaccagactggcc

SEQ ID NO: 71262 - DNA, 22 bp, Homo sapiens
tcgtacagcagactgaagtcct

SEQ ID NO: 71263 - DNA, 22 bp, Homo sapiens
agcagcttgaggctggattcca

SEQ ID NO: 71264 - DNA, 22 bp, Homo sapiens
ttaatgaaaggcagtttggaac

SEQ ID NO: 71265 - DNA, 18 bp, Homo sapiens
tccagttttcccagcatc

SEQ ID NO: 71266 - DNA, 22 bp, Homo sapiens
ccggctactcgggaggctgacg

SEQ ID NO: 71267 - DNA, 22 bp, Homo sapiens
atcgatcccgcgtaaggccccg

SEQ ID NO: 71268 - DNA, 22 bp, Homo sapiens
gactacaggtgtgtgccaccat

SEQ ID NO: 71269 - DNA, 22 bp, Homo sapiens
caggctggagttcagtggtgtg

SEQ ID NO: 71270 - DNA, 22 bp, Homo sapiens
tctcatctgccatttgcaggag

SEQ ID NO: 71271 - DNA, 22 bp, Homo sapiens
ggtgtcagactttgcatatcct

SEQ ID NO: 71272 - DNA, 22 bp, Homo sapiens
aggaaataggaccagacaaagc

SEQ ID NO: 71273 - DNA, 22 bp, Homo sapiens
tctgcgttgctcacgctgggag

SEQ ID NO: 71274 - DNA, 22 bp, Homo sapiens
aaggtgggtggatcacgaggtc

SEQ ID NO: 71275 - DNA, 22 bp, Homo sapiens
aaagtgcttccttttagaggct

SEQ ID NO: 71276 - DNA, 22 bp, Homo sapiens
gaagaaagatcaaatagtttcc

SEQ ID NO: 71277 - DNA, 22 bp, Homo sapiens
acctggccaatttttgtatttt

SEQ ID NO: 71278 - DNA, 22 bp, Homo sapiens
gccagggttgccaatgggggca

SEQ ID NO: 71279 - DNA, 22 bp, Homo sapiens
cggggccctggggctgaaggtc

SEQ ID NO: 71280 - DNA, 22 bp, Homo sapiens
gggctgggattgcttgctgtga

SEQ ID NO: 71281 - DNA, 22 bp, Homo sapiens
cagtggccaacttcctgcctct

SEQ ID NO: 71282 - DNA, 22 bp, Homo sapiens
agaacctcaattatttttgcac

SEQ ID NO: 71283 - DNA, 22 bp, Homo sapiens
tgtgggtggcatcgtcctggcc

SEQ ID NO: 71284 - DNA, 22 bp, Homo sapiens
catgtgaattccaaagctaggt

SEQ ID NO: 71285 - DNA, 22 bp, Homo sapiens
aagtgtgtgagcctgtcaggct

SEQ ID NO: 71286 - DNA, 22 bp, Homo sapiens
tgtaggagtccaatcaggagac

SEQ ID NO: 71287 - DNA, 22 bp, Homo sapiens
tactgcactccagcctgggtga

SEQ ID NO: 71288 - DNA, 22 bp, Homo sapiens
attgcactccggcctgggtgac

SEQ ID NO: 71289 - DNA, 22 bp, Homo sapiens
ctgagctcaagcgatcctccca

SEQ ID NO: 71290 - DNA, 22 bp, Homo sapiens
tgcgccatgtgctctcggccct

SEQ ID NO: 71291 - DNA, 22 bp, Homo sapiens
atcccaggcggcacaggttgca

SEQ ID NO: 71292 - DNA, 22 bp, Homo sapiens
aggattgtgcctccagtcagaa

SEQ ID NO: 71293 - DNA, 22 bp, Homo sapiens
gcaccaccaccatcggcacctc

SEQ ID NO: 71294 - DNA, 22 bp, Homo sapiens
aagttactggcaagggctgcag

SEQ ID NO: 71295 - DNA, 22 bp, Homo sapiens
gtgcctgcaggtgccggcttca

SEQ ID NO: 71296 - DNA, 22 bp, Homo sapiens
aaactgaggctcccgagggtgt

SEQ ID NO: 71297 - DNA, 22 bp, Homo sapiens
gcggcggagacagcaggaagcc

SEQ ID NO: 71298 - DNA, 22 bp, Homo sapiens
tagcatgtcagtcgccacacgt

SEQ ID NO: 71299 - DNA, 22 bp, Homo sapiens
gccgggttcaagccattctcct

SEQ ID NO: 71300 - DNA, 22 bp, Homo sapiens
acaaacagagttgaaaaatagg

SEQ ID NO: 71301 - DNA, 22 bp, Homo sapiens
atttcatactaaggctcaaaaa

SEQ ID NO: 71302 - DNA, 22 bp, Homo sapiens
atgtgggccgtgcgggtgtcct

SEQ ID NO: 71303 - DNA, 22 bp, Homo sapiens
tgcctactagtactattttgtg

SEQ ID NO: 71304 - DNA, 22 bp, Homo sapiens
agctcttacatttaggtctatg

SEQ ID NO: 71305 - DNA, 22 bp, Homo sapiens
tcactgaaacctccacctctcg

SEQ ID NO: 71306 - DNA, 22 bp, Homo sapiens
gccaccccataggtgttaggtg

SEQ ID NO: 71307 - DNA, 22 bp, Homo sapiens
ttgttgccggaaagatctcgac

SEQ ID NO: 71308 - DNA, 22 bp, Homo sapiens
tgaaatgtgtaatgtggatgcc

SEQ ID NO: 71309 - DNA, 22 bp, Homo sapiens
tccctgtgtcctgggggcacct

SEQ ID NO: 71310 - DNA, 22 bp, Homo sapiens
gaggggtccaggaggcacttac

SEQ ID NO: 71311 - DNA, 22 bp, Homo sapiens
tgtctccaccatcatcttacca

SEQ ID NO: 71312 - DNA, 22 bp, Homo sapiens
ttaccaaatgaaatagagattt

SEQ ID NO: 71313 - DNA, 22 bp, Homo sapiens
tggaagctcaaggcagggtgag

SEQ ID NO: 71314 - DNA, 22 bp, Homo sapiens
atccatcctgccatctgagtag

SEQ ID NO: 71315 - DNA, 22 bp, Homo sapiens
caaagtgctgggattacaggtg

SEQ ID NO: 71316 - DNA, 22 bp, Homo sapiens
aatcagaaattgagggtctggt

SEQ ID NO: 71317 - DNA, 22 bp, Homo sapiens
gtggcctggctggcaccacctc

SEQ ID NO: 71318 - DNA, 22 bp, Homo sapiens
agatttatgtggtcacactcag

SEQ ID NO: 71319 - DNA, 22 bp, Homo sapiens
actctgctctgtatttcactgt

SEQ ID NO: 71320 - DNA, 22 bp, Homo sapiens
cactgcaagctctgccacctgg

SEQ ID NO: 71321 - DNA, 22 bp, Homo sapiens
ggagagcttggagtgcgatttt

SEQ ID NO: 71322 - DNA, 22 bp, Homo sapiens
tcgccccgaggcagccctatgc

SEQ ID NO: 71323 - DNA, 22 bp, Homo sapiens
gcttagtcaattataaataggc

SEQ ID NO: 71324 - DNA, 22 bp, Homo sapiens
gcagaagcacaggtgacgggcc

SEQ ID NO: 71325 - DNA, 21 bp, Homo sapiens
tcctgtaagcttgggtggctc

SEQ ID NO: 71326 - DNA, 22 bp, Homo sapiens
tcctgggtccatggcagccgaa

SEQ ID NO: 71327 - DNA, 19 bp, Homo sapiens
gttggcactgaaaatggct

SEQ ID NO: 71328 - DNA, 22 bp, Homo sapiens
tctcccaagcctggcaggggca

SEQ ID NO: 71329 - DNA, 22 bp, Homo sapiens
aggtcagagcaatgtattgctt

SEQ ID NO: 71330 - DNA, 22 bp, Homo sapiens
gcggcaggagtaaaggaggaag

SEQ ID NO: 71331 - DNA, 22 bp, Homo sapiens
agccgcaagaagtacagcagca

SEQ ID NO: 71332 - DNA, 22 bp, Homo sapiens
tagcaaaggatgactatgtacc

SEQ ID NO: 71333 - DNA, 22 bp, Homo sapiens
aaattgcaaaagtacttttagg

SEQ ID NO: 71334 - DNA, 22 bp, Homo sapiens
gggaaactttcacaatgtccag

SEQ ID NO: 71335 - DNA, 22 bp, Homo sapiens
tgtggtgccgagagtctggacg

SEQ ID NO: 71336 - DNA, 22 bp, Homo sapiens
gtggctgcagcggctgtggaga

SEQ ID NO: 71337 - DNA, 22 bp, Homo sapiens
agagtactgcctcagttatgaa

SEQ ID NO: 71338 - DNA, 22 bp, Homo sapiens
cctgagtagctggaattaaagg

SEQ ID NO: 71339 - DNA, 22 bp, Homo sapiens
gggagaagaatgtgtcaattgt

SEQ ID NO: 71340 - DNA, 22 bp, Homo sapiens
ctggcctcggcagcaggaacag

SEQ ID NO: 71341 - DNA, 22 bp, Homo sapiens
aaggggaagagaccgcagagtc

SEQ ID NO: 71342 - DNA, 22 bp, Homo sapiens
gctagtgcagggaaatctttgg

SEQ ID NO: 71343 - DNA, 22 bp, Homo sapiens
gcaggaggttgagccaggactg

SEQ ID NO: 71344 - DNA, 22 bp, Homo sapiens
gtgggccttcaaccctgtctgg

SEQ ID NO: 71345 - DNA, 22 bp, Homo sapiens
gggagctgagctggaagagaat

SEQ ID NO: 71346 - DNA, 22 bp, Homo sapiens
gaggcctcagcctgccctgaac

SEQ ID NO: 71347 - DNA, 22 bp, Homo sapiens
atccccctcttggatggcggca

SEQ ID NO: 71348 - DNA, 22 bp, Homo sapiens
ttttaagttggattgctaagta

SEQ ID NO: 71349 - DNA, 22 bp, Homo sapiens
caatagtgtctgcttgtttcta

SEQ ID NO: 71350 - DNA, 22 bp, Homo sapiens
ggaggtgactggatcatgggca

SEQ ID NO: 71351 - DNA, 22 bp, Homo sapiens
aggcaggaaaatcgcttgaacc

SEQ ID NO: 71352 - DNA, 22 bp, Homo sapiens
cccaggaggttgaggctgcagt

SEQ ID NO: 71353 - DNA, 22 bp, Homo sapiens
gaaagacatagttgcaagatgg

SEQ ID NO: 71354 - DNA, 22 bp, Homo sapiens
atgtttttggaaatgggaacat

SEQ ID NO: 71355 - DNA, 22 bp, Homo sapiens
tgacagtgcgggtacatcatag

SEQ ID NO: 71356 - DNA, 22 bp, Homo sapiens
tagtatagattgaagcagatca

SEQ ID NO: 71357 - DNA, 19 bp, Homo sapiens
gggaatgatggaagacttc

SEQ ID NO: 71358 - DNA, 22 bp, Homo sapiens
ggagggcagagtcccctgctga

SEQ ID NO: 71359 - DNA, 22 bp, Homo sapiens
ttttctgtttgcttcaagacat

SEQ ID NO: 71360 - DNA, 22 bp, Homo sapiens
ggggtgggcgtgcagggacacc

SEQ ID NO: 71361 - DNA, 22 bp, Homo sapiens
tatgtttggcctggcaatttca

SEQ ID NO: 71362 - DNA, 22 bp, Homo sapiens
agcaacccgtccttgggggact

SEQ ID NO: 71363 - DNA, 22 bp, Homo sapiens
tgtaatattgtagtgacagtac

SEQ ID NO: 71364 - DNA, 18 bp, Homo sapiens
gcctggcttcggagccgc

SEQ ID NO: 71365 - DNA, 22 bp, Homo sapiens
attaaagctatccagtcatgaa

SEQ ID NO: 71366 - DNA, 22 bp, Homo sapiens
gagacctcttggtatcgctagg

SEQ ID NO: 71367 - DNA, 22 bp, Homo sapiens
attgtggtgtcagttataggca

SEQ ID NO: 71368 - DNA, 22 bp, Homo sapiens
gcccagctgcaccctggtgggt

SEQ ID NO: 71369 - DNA, 22 bp, Homo sapiens
tggggagtgatgcctcggataa

SEQ ID NO: 71370 - DNA, 22 bp, Homo sapiens
gaggagggagctggaagctctt

SEQ ID NO: 71371 - DNA, 22 bp, Homo sapiens
gctgggacaacaggtgagcacc

SEQ ID NO: 71372 - DNA, 22 bp, Homo sapiens
tttagattgtgacctcccccca

SEQ ID NO: 71373 - DNA, 22 bp, Homo sapiens
tgtgcggggaagggctcactca

SEQ ID NO: 71374 - DNA, 22 bp, Homo sapiens
cgctccttgagcgtgtcggcct

SEQ ID NO: 71375 - DNA, 22 bp, Homo sapiens
agttgcatgtccaagggggtag

SEQ ID NO: 71376 - DNA, 22 bp, Homo sapiens
gtgagaaatgacaaatgtgtcg

SEQ ID NO: 71377 - DNA, 20 bp, Homo sapiens
ttgttagaggaatgccatag

SEQ ID NO: 71378 - DNA, 22 bp, Homo sapiens
ttacatgtttatgtggtacatg

SEQ ID NO: 71379 - DNA, 22 bp, Homo sapiens
tgccctctttctgtacagctcc

SEQ ID NO: 71380 - DNA, 22 bp, Homo sapiens
ctgaggagaggtggcctgtgtt

SEQ ID NO: 71381 - DNA, 22 bp, Homo sapiens
tagctgggactactggccctgc

SEQ ID NO: 71382 - DNA, 22 bp, Homo sapiens
ctggggaacgcagcgagcagcg

SEQ ID NO: 71383 - DNA, 21 bp, Homo sapiens
agatcctggggtctggggagg

SEQ ID NO: 71384 - DNA, 22 bp, Homo sapiens
acagcccagctctttctctgca

SEQ ID NO: 71385 - DNA, 22 bp, Homo sapiens
tttgtgaataggttggcttcca

SEQ ID NO: 71386 - DNA, 22 bp, Homo sapiens
agtccaaagcagatgagggcca

SEQ ID NO: 71387 - DNA, 22 bp, Homo sapiens
tcacttcccagacggggtggca

SEQ ID NO: 71388 - DNA, 22 bp, Homo sapiens
ctttaattgtagctcccataat

SEQ ID NO: 71389 - DNA, 22 bp, Homo sapiens
gagatgcagaaccctcaggagc

SEQ ID NO: 71390 - DNA, 22 bp, Homo sapiens
aggcaggaggatcatggatgca

SEQ ID NO: 71391 - DNA, 22 bp, Homo sapiens
caggctggagtgcaatgacgcc

SEQ ID NO: 71392 - DNA, 22 bp, Homo sapiens
agcccaggctggagtgcagtgg

SEQ ID NO: 71393 - DNA, 22 bp, Homo sapiens
ttgatgtaggtttatctattgt

SEQ ID NO: 71394 - DNA, 22 bp, Homo sapiens
tgagccgtggtctctgagggtg

SEQ ID NO: 71395 - DNA, 22 bp, Homo sapiens
tcactgcaacctctgcctcccg

SEQ ID NO: 71396 - DNA, 22 bp, Homo sapiens
gtccaaaagagccagccgggcg

SEQ ID NO: 71397 - DNA, 22 bp, Homo sapiens
gtggagaggaacccagctctgt

SEQ ID NO: 71398 - DNA, 22 bp, Homo sapiens
aaagtgctgggattacaagcgt

SEQ ID NO: 71399 - DNA, 22 bp, Homo sapiens
agtcaggggatctagacttgaa

SEQ ID NO: 71400 - DNA, 22 bp, Homo sapiens
gggcatggtggcaggcacctgt

SEQ ID NO: 71401 - DNA, 22 bp, Homo sapiens
ctggcagatagtaagtgatcaa

SEQ ID NO: 71402 - DNA, 22 bp, Homo sapiens
tctgtagtaggttgtagttctt

SEQ ID NO: 71403 - DNA, 22 bp, Homo sapiens
ataccaccatctatgaaaggta

SEQ ID NO: 71404 - DNA, 22 bp, Homo sapiens
gcacagccacgtaatgtggtca

SEQ ID NO: 71405 - DNA, 22 bp, Homo sapiens
tgtgactggttgtcccgctttc

SEQ ID NO: 71406 - DNA, 22 bp, Homo sapiens
cagtagatttggtaaactagga

SEQ ID NO: 71407 - DNA, 22 bp, Homo sapiens
cacagctgaagtagccatgtgg

SEQ ID NO: 71408 - DNA, 22 bp, Homo sapiens
tattctcatcatcactggagct

SEQ ID NO: 71409 - DNA, 22 bp, Homo sapiens
cttcctttgctgttcggaggtt

SEQ ID NO: 71410 - DNA, 22 bp, Homo sapiens
attataggcttgagccaccgtg

SEQ ID NO: 71411 - DNA, 22 bp, Homo sapiens
aagagggctgcaatcttattgc

SEQ ID NO: 71412 - DNA, 22 bp, Homo sapiens
cttgtcttgcacacggttgcca

SEQ ID NO: 71413 - DNA, 22 bp, Homo sapiens
tgggaggccaaggcaggcggat

SEQ ID NO: 71414 - DNA, 22 bp, Homo sapiens
tcagggctgcagaagaggcagg

SEQ ID NO: 71415 - DNA, 22 bp, Homo sapiens
agcccttagtacatttctcaag

SEQ ID NO: 71416 - DNA, 22 bp, Homo sapiens
aagtcacttcttaggaaaggag

SEQ ID NO: 71417 - DNA, 22 bp, Homo sapiens
ctgggtggcagagcctgcagtg

SEQ ID NO: 71418 - DNA, 22 bp, Homo sapiens
atctattttaaatggcagtaaa

SEQ ID NO: 71419 - DNA, 22 bp, Homo sapiens
tgtctggtgggttgacaggcag

SEQ ID NO: 71420 - DNA, 22 bp, Homo sapiens
cttgctttcagtctcggcctca

SEQ ID NO: 71421 - DNA, 22 bp, Homo sapiens
tagggggctttgctgcttgaca

SEQ ID NO: 71422 - DNA, 22 bp, Homo sapiens
aaggaggttatcccagtggact

SEQ ID NO: 71423 - DNA, 22 bp, Homo sapiens
cagatcaaacaaaatgggttag

SEQ ID NO: 71424 - DNA, 22 bp, Homo sapiens
tgactacaacctccacctcccg

SEQ ID NO: 71425 - DNA, 22 bp, Homo sapiens
caaagtgctgggattacaggct

SEQ ID NO: 71426 - DNA, 22 bp, Homo sapiens
tggtatttctgtgcccagctca

SEQ ID NO: 71427 - DNA, 22 bp, Homo sapiens
cgtaggtggctcagcacctggg

SEQ ID NO: 71428 - DNA, 22 bp, Homo sapiens
ctggtgggagataattgaatca

SEQ ID NO: 71429 - DNA, 22 bp, Homo sapiens
gggcagccccagcgcgttggct

SEQ ID NO: 71430 - DNA, 22 bp, Homo sapiens
atcacaaaggtctcagagcaca

SEQ ID NO: 71431 - DNA, 22 bp, Homo sapiens
agaggaggctctgggatcgtcc

SEQ ID NO: 71432 - DNA, 22 bp, Homo sapiens
gtgggccactgggaggcaaggg

SEQ ID NO: 71433 - DNA, 22 bp, Homo sapiens
gaccctgtttctacaaataatt

SEQ ID NO: 71434 - DNA, 22 bp, Homo sapiens
ggtaccaccaattcagctgcca

SEQ ID NO: 71435 - DNA, 22 bp, Homo sapiens
cgggcaaggcgagactaggccc

SEQ ID NO: 71436 - DNA, 22 bp, Homo sapiens
tcaccaggctggagtgcagtgg

SEQ ID NO: 71437 - DNA, 22 bp, Homo sapiens
acaagtattggtgaggatgtag

SEQ ID NO: 71438 - DNA, 22 bp, Homo sapiens
ccagctttatagcttcaaagga

SEQ ID NO: 71439 - DNA, 20 bp, Homo sapiens
aaacgagccatcattctggt

SEQ ID NO: 71440 - DNA, 20 bp, Homo sapiens
tgatatggtttggctgtgtt

SEQ ID NO: 71441 - DNA, 21 bp, Homo sapiens
cccgcacagcggtaggccgcc

SEQ ID NO: 71442 - DNA, 22 bp, Homo sapiens
agaatgggggctacaggccaca

SEQ ID NO: 71443 - DNA, 22 bp, Homo sapiens
ttttggttgttgggtaagagta

SEQ ID NO: 71444 - DNA, 22 bp, Homo sapiens
ctcatcagaaatacctgacaaa

SEQ ID NO: 71445 - DNA, 22 bp, Homo sapiens
tgccgctccaggtctcgcggtg

SEQ ID NO: 71446 - DNA, 22 bp, Homo sapiens
ccttacactgcctggggccacg

SEQ ID NO: 71447 - DNA, 22 bp, Homo sapiens
gcgctctcttctcctggcccgc

SEQ ID NO: 71448 - DNA, 22 bp, Homo sapiens
tggttgtggtcctccacatcgc

SEQ ID NO: 71449 - DNA, 21 bp, Homo sapiens
cctcaagtgcctcctgctgct

SEQ ID NO: 71450 - DNA, 22 bp, Homo sapiens
cataaaaggtagcagtttgaaa

SEQ ID NO: 71451 - DNA, 22 bp, Homo sapiens
aaggaaagctgtggttctgaga

SEQ ID NO: 71452 - DNA, 22 bp, Homo sapiens
acgcctgtaatcccagcacttt

SEQ ID NO: 71453 - DNA, 22 bp, Homo sapiens
ctgaagaggctccgcccacaag

SEQ ID NO: 71454 - DNA, 22 bp, Homo sapiens
actcatgtcctaggagtaaagc

SEQ ID NO: 71455 - DNA, 22 bp, Homo sapiens
tggtgcaaaactaattgcggtt

SEQ ID NO: 71456 - DNA, 22 bp, Homo sapiens
ctcccagccttcgccagtctga

SEQ ID NO: 71457 - DNA, 22 bp, Homo sapiens
agaagccaccagctgaggaaga

SEQ ID NO: 71458 - DNA, 22 bp, Homo sapiens
gccacctcggctttctctgctc

SEQ ID NO: 71459 - DNA, 22 bp, Homo sapiens
ttaataaagtatgaattggaaa

SEQ ID NO: 71460 - DNA, 22 bp, Homo sapiens
ttcattcttttacatgtgaata

SEQ ID NO: 71461 - DNA, 19 bp, Homo sapiens
catctggatgattctcctg

SEQ ID NO: 71462 - DNA, 22 bp, Homo sapiens
tattagttgcaaaacattgact

SEQ ID NO: 71463 - DNA, 22 bp, Homo sapiens
ctatggtgatagaaatcagaat

SEQ ID NO: 71464 - DNA, 22 bp, Homo sapiens
gtagttctgcagtgtcacctga

SEQ ID NO: 71465 - DNA, 22 bp, Homo sapiens
gtttacttgtgccttggcttaa

SEQ ID NO: 71466 - DNA, 22 bp, Homo sapiens
gtggctcacgtctgtcatctca

SEQ ID NO: 71467 - DNA, 22 bp, Homo sapiens
tttacagcagcatgatttataa

SEQ ID NO: 71468 - DNA, 22 bp, Homo sapiens
gggttcagtccctcttgctact

SEQ ID NO: 71469 - DNA, 22 bp, Homo sapiens
tcacagctctgtcaattttata

SEQ ID NO: 71470 - DNA, 22 bp, Homo sapiens
tcccttatctggtattttttag

SEQ ID NO: 71471 - DNA, 22 bp, Homo sapiens
tccctgaggatggttgtattta

SEQ ID NO: 71472 - DNA, 22 bp, Homo sapiens
catgtaaagaatttcacacaag

SEQ ID NO: 71473 - DNA, 22 bp, Homo sapiens
actcccttggtggagaatgcaa

SEQ ID NO: 71474 - DNA, 22 bp, Homo sapiens
cttccccaggacctctgctaaa

SEQ ID NO: 71475 - DNA, 22 bp, Homo sapiens
gtggcccaggctggagtgcagt

SEQ ID NO: 71476 - DNA, 17 bp, Homo sapiens
cactagtagtctctggc

SEQ ID NO: 71477 - DNA, 22 bp, Homo sapiens
cccgggaggtggaggttgcagt

SEQ ID NO: 71478 - DNA, 22 bp, Homo sapiens
atgcagaagactgaaaagctga

SEQ ID NO: 71479 - DNA, 22 bp, Homo sapiens
catggcagctcctccagtgtga

SEQ ID NO: 71480 - DNA, 20 bp, Homo sapiens
ggcagagggcctgggagaag

SEQ ID NO: 71481 - DNA, 22 bp, Homo sapiens
gcaacaatggaggtttggaggg

SEQ ID NO: 71482 - DNA, 22 bp, Homo sapiens
aggagctgtcagagtgccagag

SEQ ID NO: 71483 - DNA, 22 bp, Homo sapiens
gataccagacagggagggagaa

SEQ ID NO: 71484 - DNA, 22 bp, Homo sapiens
agagctgtgtttagtagttacg

SEQ ID NO: 71485 - DNA, 22 bp, Homo sapiens
acagttaattgttgttgggtgt

SEQ ID NO: 71486 - DNA, 22 bp, Homo sapiens
cacctgtacagggccgggctgg

SEQ ID NO: 71487 - DNA, 22 bp, Homo sapiens
tcactgcactccagcctggtga

SEQ ID NO: 71488 - DNA, 22 bp, Homo sapiens
cggctcactgcagctccgcctc

SEQ ID NO: 71489 - DNA, 22 bp, Homo sapiens
ggccagaagttggaaaagagcc

SEQ ID NO: 71490 - DNA, 22 bp, Homo sapiens
tggctgtgtccctgtccagagt

SEQ ID NO: 71491 - DNA, 22 bp, Homo sapiens
aggggagccagggctgcgagtt

SEQ ID NO: 71492 - DNA, 22 bp, Homo sapiens
cctagagccgcacctcctccac

SEQ ID NO: 71493 - DNA, 22 bp, Homo sapiens
gggccctgggattcagagcaag

SEQ ID NO: 71494 - DNA, 22 bp, Homo sapiens
agggagcaaaggtttcagggtt

SEQ ID NO: 71495 - DNA, 20 bp, Homo sapiens
ttggatgtgcatggccgtgc

SEQ ID NO: 71496 - DNA, 22 bp, Homo sapiens
tccagtttccaatcactgcacg

SEQ ID NO: 71497 - DNA, 22 bp, Homo sapiens
gctgtatgtgaggccacagtga

SEQ ID NO: 71498 - DNA, 22 bp, Homo sapiens
tcaccagatctctctgtaatgg

SEQ ID NO: 71499 - DNA, 22 bp, Homo sapiens
agatgcagtggttaacaataca

SEQ ID NO: 71500 - DNA, 21 bp, Homo sapiens
agctgcctccacttctgaggc

SEQ ID NO: 71501 - DNA, 22 bp, Homo sapiens
ggcctctcttgggacagctgtc

SEQ ID NO: 71502 - DNA, 22 bp, Homo sapiens
aaattgtaatgacttcacttga

SEQ ID NO: 71503 - DNA, 22 bp, Homo sapiens
gttgaaatcctaaccccctagt

SEQ ID NO: 71504 - DNA, 22 bp, Homo sapiens
attcacatttagcctctgacat

SEQ ID NO: 71505 - DNA, 22 bp, Homo sapiens
ctgaaatgacggtttggggcaa

SEQ ID NO: 71506 - DNA, 18 bp, Homo sapiens
cttgttcttctcttggcg

SEQ ID NO: 71507 - DNA, 22 bp, Homo sapiens
gggcgccgtgggaaacagccgg

SEQ ID NO: 71508 - DNA, 22 bp, Homo sapiens
atgttgtgtttgactgttaccc

SEQ ID NO: 71509 - DNA, 23 bp, Homo sapiens
tcctcgcaggagggagatgatgc

SEQ ID NO: 71510 - DNA, 22 bp, Homo sapiens
ttgtgaatagtgccgcaataaa

SEQ ID NO: 71511 - DNA, 22 bp, Homo sapiens
tgcccaggctggagtacagtgg

SEQ ID NO: 71512 - DNA, 22 bp, Homo sapiens
gttgaggagcaagcatgtgtct

SEQ ID NO: 71513 - DNA, 22 bp, Homo sapiens
aagccggctgggccgaggctgc

SEQ ID NO: 71514 - DNA, 22 bp, Homo sapiens
tgatctggtcctactgtgggca

SEQ ID NO: 71515 - DNA, 22 bp, Homo sapiens
gctctctgcagcctccttggag

SEQ ID NO: 71516 - DNA, 22 bp, Homo sapiens
gggcttggcacatgggctcagc

SEQ ID NO: 71517 - DNA, 22 bp, Homo sapiens
aaattctgatttaataagtgta

SEQ ID NO: 71518 - DNA, 22 bp, Homo sapiens
acagattcactgcactggccat

SEQ ID NO: 71519 - DNA, 22 bp, Homo sapiens
caggaggattgcttgaggccag

SEQ ID NO: 71520 - DNA, 22 bp, Homo sapiens
agtgtattctgcatgggagact

SEQ ID NO: 71521 - DNA, 22 bp, Homo sapiens
gaaagtgctctctctatacaca

SEQ ID NO: 71522 - DNA, 22 bp, Homo sapiens
aggcaatcccctgaggatactt

SEQ ID NO: 71523 - DNA, 22 bp, Homo sapiens
cctgcttaacattgccatgaca

SEQ ID NO: 71524 - DNA, 22 bp, Homo sapiens
tagcacagcttcttgatgtcac

SEQ ID NO: 71525 - DNA, 22 bp, Homo sapiens
gcttcggggtccaagcgcgtgt

SEQ ID NO: 71526 - DNA, 22 bp, Homo sapiens
ggccaggcgatgacccctccac

SEQ ID NO: 71527 - DNA, 22 bp, Homo sapiens
cttcttgctgggggcctcagtg

SEQ ID NO: 71528 - DNA, 22 bp, Homo sapiens
ccactgcactccagcctgccaa

SEQ ID NO: 71529 - DNA, 22 bp, Homo sapiens
tttggtattgcacactgtcttc

SEQ ID NO: 71530 - DNA, 22 bp, Homo sapiens
gggaaatctcgtcctctattta

SEQ ID NO: 71531 - DNA, 18 bp, Homo sapiens
tggttccttgaaggggca

SEQ ID NO: 71532 - DNA, 22 bp, Homo sapiens
agtgttagattcttactcagtt

SEQ ID NO: 71533 - DNA, 22 bp, Homo sapiens
tggagtgcaatagtaataaggt

SEQ ID NO: 71534 - DNA, 17 bp, Homo sapiens
ttaaggtggatcagcac

SEQ ID NO: 71535 - DNA, 22 bp, Homo sapiens
agcccaggtccagttcactgca

SEQ ID NO: 71536 - DNA, 23 bp, Homo sapiens
aagtggttttgaacccggaccct

SEQ ID NO: 71537 - DNA, 22 bp, Homo sapiens
ccaggaggtggaggttgcggtg

SEQ ID NO: 71538 - DNA, 22 bp, Homo sapiens
tgcgggtcccagggtcacaggc

SEQ ID NO: 71539 - DNA, 22 bp, Homo sapiens
gccctgagaagaagtcggaggg

SEQ ID NO: 71540 - DNA, 22 bp, Homo sapiens
cagagagaatcttggcagctga

SEQ ID NO: 71541 - DNA, 22 bp, Homo sapiens
gaggctggacgtgcatttctac

SEQ ID NO: 71542 - DNA, 22 bp, Homo sapiens
cagagctggtgtgtcctggcat

SEQ ID NO: 71543 - DNA, 22 bp, Homo sapiens
accctaataatcacagactagt

SEQ ID NO: 71544 - DNA, 19 bp, Homo sapiens
agaatcccaggccccactg

SEQ ID NO: 71545 - DNA, 22 bp, Homo sapiens
tcactgcaacctccacctcctg

SEQ ID NO: 71546 - DNA, 19 bp, Homo sapiens
tcctggggaggggcatggc

SEQ ID NO: 71547 - DNA, 22 bp, Homo sapiens
gcttccacctactaaatgccac

SEQ ID NO: 71548 - DNA, 22 bp, Homo sapiens
aactcctctctggtggttcgtc

SEQ ID NO: 71549 - DNA, 22 bp, Homo sapiens
tcactgcaacctccacctcccg

SEQ ID NO: 71550 - DNA, 22 bp, Homo sapiens
agacaaagaaaccgtagaagca

SEQ ID NO: 71551 - DNA, 22 bp, Homo sapiens
agagctccagggttttgtagtg

SEQ ID NO: 71552 - DNA, 22 bp, Homo sapiens
tggccaccaccaatacttgcct

SEQ ID NO: 71553 - DNA, 22 bp, Homo sapiens
acccatacacacatatttatgt

SEQ ID NO: 71554 - DNA, 22 bp, Homo sapiens
cagggatggcgctggctgcccg

SEQ ID NO: 71555 - DNA, 22 bp, Homo sapiens
caagcgtggctgctctgatgga

SEQ ID NO: 71556 - DNA, 22 bp, Homo sapiens
cagtcaccttgaggactcagac

SEQ ID NO: 71557 - DNA, 22 bp, Homo sapiens
ttaagggccattatggatgggt

SEQ ID NO: 71558 - DNA, 22 bp, Homo sapiens
ggagctgttcaggactgcttca

SEQ ID NO: 71559 - DNA, 18 bp, Homo sapiens
tctgtgggatcagtgagg

SEQ ID NO: 71560 - DNA, 22 bp, Homo sapiens
tgagctgtctgaatggtgagga

SEQ ID NO: 71561 - DNA, 22 bp, Homo sapiens
gtgatatcttacaattctcttt

SEQ ID NO: 71562 - DNA, 20 bp, Homo sapiens
aaattactgccacacatttc

SEQ ID NO: 71563 - DNA, 22 bp, Homo sapiens
attaagtgttttacatacatta

SEQ ID NO: 71564 - DNA, 19 bp, Homo sapiens
gtgtccatggagcatggag

SEQ ID NO: 71565 - DNA, 22 bp, Homo sapiens
ctgaggcaggatggcctggctg

SEQ ID NO: 71566 - DNA, 22 bp, Homo sapiens
gctcactgcaagctccgcctcc

SEQ ID NO: 71567 - DNA, 20 bp, Homo sapiens
cagcagtggatgagagtttt

SEQ ID NO: 71568 - DNA, 22 bp, Homo sapiens
tacatgctccttatgagaatct

SEQ ID NO: 71569 - DNA, 22 bp, Homo sapiens
agttgggtttgtgtcagttgca

SEQ ID NO: 71570 - DNA, 18 bp, Homo sapiens
tgctgatggtccattagt

SEQ ID NO: 71571 - DNA, 22 bp, Homo sapiens
agactttaacaatgggtatgaa

SEQ ID NO: 71572 - DNA, 22 bp, Homo sapiens
cctcggctgggccttggccact

SEQ ID NO: 71573 - DNA, 22 bp, Homo sapiens
ggaaatctcagatctcccagat

SEQ ID NO: 71574 - DNA, 22 bp, Homo sapiens
tggctaacaaggtgaaaccccg

SEQ ID NO: 71575 - DNA, 23 bp, Homo sapiens
actcgtggaattctctgcgatcg

SEQ ID NO: 71576 - DNA, 20 bp, Homo sapiens
ttcgctgggagtggccaggc

SEQ ID NO: 71577 - DNA, 22 bp, Homo sapiens
atattgttagtaatatttcgaa

SEQ ID NO: 71578 - DNA, 22 bp, Homo sapiens
tctctcttttttgaacccgctc

SEQ ID NO: 71579 - DNA, 22 bp, Homo sapiens
aattgaaaatattgtagaccat

SEQ ID NO: 71580 - DNA, 22 bp, Homo sapiens
gaatcccttgcattatcccttt

SEQ ID NO: 71581 - DNA, 22 bp, Homo sapiens
tacttttcctggaaccactgct

SEQ ID NO: 71582 - DNA, 22 bp, Homo sapiens
ccagagctgattcctgggactt

SEQ ID NO: 71583 - DNA, 22 bp, Homo sapiens
cagcccgccctgaactttcggg

SEQ ID NO: 71584 - DNA, 22 bp, Homo sapiens
aaagattaaatcaaattggtca

SEQ ID NO: 71585 - DNA, 22 bp, Homo sapiens
aagcctggcacattggagtctg

SEQ ID NO: 71586 - DNA, 22 bp, Homo sapiens
ttcttctccgaggagggctggt

SEQ ID NO: 71587 - DNA, 22 bp, Homo sapiens
tctggagataagcagcaatgaa

SEQ ID NO: 71588 - DNA, 22 bp, Homo sapiens
cagctacaaatacttttgtatg

SEQ ID NO: 71589 - DNA, 22 bp, Homo sapiens
catagacagatggtaagaagct

SEQ ID NO: 71590 - DNA, 22 bp, Homo sapiens
tggctcctcacgtcctcagagc

SEQ ID NO: 71591 - DNA, 22 bp, Homo sapiens
ttgtcgggcttacgcagggcca

SEQ ID NO: 71592 - DNA, 22 bp, Homo sapiens
atgaaatgctattttggctaga

SEQ ID NO: 71593 - DNA, 22 bp, Homo sapiens
tcctttaaacaaccagctctca

SEQ ID NO: 71594 - DNA, 22 bp, Homo sapiens
cctacctggggcaggcctcggg

SEQ ID NO: 71595 - DNA, 23 bp, Homo sapiens
atcattaacagtgcaggggtagg

SEQ ID NO: 71596 - DNA, 22 bp, Homo sapiens
gaggtaacactgttcagtgggc

SEQ ID NO: 71597 - DNA, 22 bp, Homo sapiens
tcctgccttgcctgggacatca

SEQ ID NO: 71598 - DNA, 22 bp, Homo sapiens
tctcaagcttgttggtatgttt

SEQ ID NO: 71599 - DNA, 22 bp, Homo sapiens
tgaagaaacgcagagaggtagg

SEQ ID NO: 71600 - DNA, 22 bp, Homo sapiens
gcccagccacagtcactttcat

SEQ ID NO: 71601 - DNA, 22 bp, Homo sapiens
ggtctgtcttcccaatcgtggc

SEQ ID NO: 71602 - DNA, 22 bp, Homo sapiens
catgagatttgggaggggccag

SEQ ID NO: 71603 - DNA, 22 bp, Homo sapiens
aactaatacattaatacatgtg

SEQ ID NO: 71604 - DNA, 22 bp, Homo sapiens
caccaggctggagtgcagtggc

SEQ ID NO: 71605 - DNA, 22 bp, Homo sapiens
ccaaagaaacccaagctcaggg

SEQ ID NO: 71606 - DNA, 22 bp, Homo sapiens
caggagctcaagaccaccctgg

SEQ ID NO: 71607 - DNA, 22 bp, Homo sapiens
ccaaagtgctgggattcaggca

SEQ ID NO: 71608 - DNA, 22 bp, Homo sapiens
agtcaaagatgaccgagttcct

SEQ ID NO: 71609 - DNA, 22 bp, Homo sapiens
tgcctctgaggaagattgtgtt

SEQ ID NO: 71610 - DNA, 22 bp, Homo sapiens
ggctcttccgccaccagccaca

SEQ ID NO: 71611 - DNA, 19 bp, Homo sapiens
tcctgcctggggccgcctg

SEQ ID NO: 71612 - DNA, 23 bp, Homo sapiens
cctgcctccccatcagttataca

SEQ ID NO: 71613 - DNA, 22 bp, Homo sapiens
tctccattagtgggtggcagtg

SEQ ID NO: 71614 - DNA, 22 bp, Homo sapiens
ttacctaaaatagctcaattta

SEQ ID NO: 71615 - DNA, 22 bp, Homo sapiens
aagccctggacggcccttcccc

SEQ ID NO: 71616 - DNA, 22 bp, Homo sapiens
gaaccacaatgtgaagaaggag

SEQ ID NO: 71617 - DNA, 22 bp, Homo sapiens
acatcttttactctggttcggg

SEQ ID NO: 71618 - DNA, 22 bp, Homo sapiens
tgacacccatctgtgccagtcc

SEQ ID NO: 71619 - DNA, 22 bp, Homo sapiens
gtggcagaccttcccttctcct

SEQ ID NO: 71620 - DNA, 22 bp, Homo sapiens
gtccaagagtcaagaagggggc

SEQ ID NO: 71621 - DNA, 17 bp, Homo sapiens
ggctgcagtccaggagg

SEQ ID NO: 71622 - DNA, 22 bp, Homo sapiens
tttcaggacacctttaaaaacg

SEQ ID NO: 71623 - DNA, 22 bp, Homo sapiens
ggtgaagtaatgaaacagggag

SEQ ID NO: 71624 - DNA, 22 bp, Homo sapiens
tccagcttataggtagatttaa

SEQ ID NO: 71625 - DNA, 22 bp, Homo sapiens
gtcgtggagctcacagtgtgcc

SEQ ID NO: 71626 - DNA, 17 bp, Homo sapiens
tggctctgtcctcagct

SEQ ID NO: 71627 - DNA, 22 bp, Homo sapiens
ggatgcacgaaggcgcctcgga

SEQ ID NO: 71628 - DNA, 22 bp, Homo sapiens
gaggtagacttcttggaagtag

SEQ ID NO: 71629 - DNA, 22 bp, Homo sapiens
gctgaggctcctcgggaggaca

SEQ ID NO: 71630 - DNA, 22 bp, Homo sapiens
tattattgacatttacttggtg

SEQ ID NO: 71631 - DNA, 22 bp, Homo sapiens
gttattgaggtggagtctcact

SEQ ID NO: 71632 - DNA, 22 bp, Homo sapiens
acacggcactttaggaaggggc

SEQ ID NO: 71633 - DNA, 22 bp, Homo sapiens
ggtgttcaaatgaacacatgca

SEQ ID NO: 71634 - DNA, 22 bp, Homo sapiens
tttgaagactactgggagtgaa

SEQ ID NO: 71635 - DNA, 22 bp, Homo sapiens
ggctctgcttgaggccagcctg

SEQ ID NO: 71636 - DNA, 22 bp, Homo sapiens
ctagtgcaatgatgaatacaag

SEQ ID NO: 71637 - DNA, 20 bp, Homo sapiens
gctgaggtggaggaaggaga

SEQ ID NO: 71638 - DNA, 23 bp, Homo sapiens
tgaatgtttattctcggtgcaga

SEQ ID NO: 71639 - DNA, 22 bp, Homo sapiens
tgagcccagagatctgagctat

SEQ ID NO: 71640 - DNA, 22 bp, Homo sapiens
tctagggtgtataaggaagcct

SEQ ID NO: 71641 - DNA, 22 bp, Homo sapiens
tcagaacatgtttgagtaagac

SEQ ID NO: 71642 - DNA, 22 bp, Homo sapiens
atgcgagtgatgcagagtggct

SEQ ID NO: 71643 - DNA, 22 bp, Homo sapiens
agctcaatgcaacctccgcctc

SEQ ID NO: 71644 - DNA, 22 bp, Homo sapiens
aggtcacccgtttgactatcca

SEQ ID NO: 71645 - DNA, 22 bp, Homo sapiens
cactctcagcataatgaatgtg

SEQ ID NO: 71646 - DNA, 22 bp, Homo sapiens
caccaaagtcgcttctgtcgtc

SEQ ID NO: 71647 - DNA, 22 bp, Homo sapiens
cctgagcttacaatttaagaac

SEQ ID NO: 71648 - DNA, 19 bp, Homo sapiens
ggcttgtctcggcagccgc

SEQ ID NO: 71649 - DNA, 19 bp, Homo sapiens
atctgccttagtgctgctg

SEQ ID NO: 71650 - DNA, 22 bp, Homo sapiens
gctggtagacctcactgcactc

SEQ ID NO: 71651 - DNA, 22 bp, Homo sapiens
atgaccagccgagataaacaga

SEQ ID NO: 71652 - DNA, 22 bp, Homo sapiens
ctcctaggtaacagggtggttt

SEQ ID NO: 71653 - DNA, 21 bp, Homo sapiens
attctttgatgtgcaataagt

SEQ ID NO: 71654 - DNA, 22 bp, Homo sapiens
aggccttaccatagctgtagca

SEQ ID NO: 71655 - DNA, 22 bp, Homo sapiens
cggaggttgaggctgcagtgag

SEQ ID NO: 71656 - DNA, 22 bp, Homo sapiens
acggtgcagcctgtcccttctc

SEQ ID NO: 71657 - DNA, 23 bp, Homo sapiens
tactatggttattatccctctcc

SEQ ID NO: 71658 - DNA, 22 bp, Homo sapiens
aaaagagcttggttgattttgc

SEQ ID NO: 71659 - DNA, 22 bp, Homo sapiens
cactgctacctctgcctcccgg

SEQ ID NO: 71660 - DNA, 22 bp, Homo sapiens
aggaattggcacggccttctca

SEQ ID NO: 71661 - DNA, 22 bp, Homo sapiens
ggccctggcagccacgaaagcc

SEQ ID NO: 71662 - DNA, 20 bp, Homo sapiens
tcactgtaacatttgggggg

SEQ ID NO: 71663 - DNA, 22 bp, Homo sapiens
ggagagtggattccagctgtat

SEQ ID NO: 71664 - DNA, 22 bp, Homo sapiens
cctgccctgctcactgtcggta

SEQ ID NO: 71665 - DNA, 22 bp, Homo sapiens
tagcttatcccacagtgcccag

SEQ ID NO: 71666 - DNA, 22 bp, Homo sapiens
agtgctgtctccttcccccggg

SEQ ID NO: 71667 - DNA, 22 bp, Homo sapiens
tttgaaatgtatcagtataggt

SEQ ID NO: 71668 - DNA, 22 bp, Homo sapiens
aaagtgctgggattacaggcat

SEQ ID NO: 71669 - DNA, 22 bp, Homo sapiens
ctgcagggagaggggacagcct

SEQ ID NO: 71670 - DNA, 22 bp, Homo sapiens
ccttcccacattccttacatgc

SEQ ID NO: 71671 - DNA, 18 bp, Homo sapiens
actctgcggaggccccag

SEQ ID NO: 71672 - DNA, 20 bp, Homo sapiens
tgtcattcttctttcacagg

SEQ ID NO: 71673 - DNA, 19 bp, Homo sapiens
ggggcctgtgatggtcaca

SEQ ID NO: 71674 - DNA, 22 bp, Homo sapiens
ggcctgcctcacagtcagcacc

SEQ ID NO: 71675 - DNA, 22 bp, Homo sapiens
atgatactctaggtgatttaca

SEQ ID NO: 71676 - DNA, 22 bp, Homo sapiens
aggccagcagcatgacggcatc

SEQ ID NO: 71677 - DNA, 22 bp, Homo sapiens
tggtattctttctgtagatcat

SEQ ID NO: 71678 - DNA, 22 bp, Homo sapiens
agcgaggtgagtcctccagctc

SEQ ID NO: 71679 - DNA, 22 bp, Homo sapiens
ctggaatctttggagaatgtgg

SEQ ID NO: 71680 - DNA, 22 bp, Homo sapiens
gggtctcctaatggaggatgac

SEQ ID NO: 71681 - DNA, 22 bp, Homo sapiens
tccagcagtccatgtgagacac

SEQ ID NO: 71682 - DNA, 22 bp, Homo sapiens
ttccagttcactccatttctgg

SEQ ID NO: 71683 - DNA, 22 bp, Homo sapiens
actccacaccacgggggccgcc

SEQ ID NO: 71684 - DNA, 22 bp, Homo sapiens
aacagtgtttttcttcagcact

SEQ ID NO: 71685 - DNA, 22 bp, Homo sapiens
tagactagaggatcagcaaggg

SEQ ID NO: 71686 - DNA, 22 bp, Homo sapiens
ccagtgacttgccaggtggatc

SEQ ID NO: 71687 - DNA, 22 bp, Homo sapiens
atggtgtttataggcaaagatc

SEQ ID NO: 71688 - DNA, 19 bp, Homo sapiens
ctccttgccatttcttttc

SEQ ID NO: 71689 - DNA, 22 bp, Homo sapiens
agggtgaatctcacaactctta

SEQ ID NO: 71690 - DNA, 22 bp, Homo sapiens
aaaagtaattgtggtttttgct

SEQ ID NO: 71691 - DNA, 22 bp, Homo sapiens
ttgtgctctgtgttatttaagg

SEQ ID NO: 71692 - DNA, 22 bp, Homo sapiens
taagatgtttacagtatggaga

SEQ ID NO: 71693 - DNA, 22 bp, Homo sapiens
atgcccctggcctggggaacat

SEQ ID NO: 71694 - DNA, 22 bp, Homo sapiens
gtgccgcgacgcagtcggtgcc

SEQ ID NO: 71695 - DNA, 22 bp, Homo sapiens
ttcttctcagggtcccacatgg

SEQ ID NO: 71696 - DNA, 22 bp, Homo sapiens
ttgtcttttgtgggaaatatgg

SEQ ID NO: 71697 - DNA, 22 bp, Homo sapiens
aggaggaagggaagacaagtaa

SEQ ID NO: 71698 - DNA, 22 bp, Homo sapiens
ttcattttctttcacgctgctg

SEQ ID NO: 71699 - DNA, 19 bp, Homo sapiens
accttctgggaaacattcc

SEQ ID NO: 71700 - DNA, 22 bp, Homo sapiens
caccatttagtagcaagagctc

SEQ ID NO: 71701 - DNA, 22 bp, Homo sapiens
agagcggggatagttaatattc

SEQ ID NO: 71702 - DNA, 17 bp, Homo sapiens
aatgtccttggaccaca

SEQ ID NO: 71703 - DNA, 22 bp, Homo sapiens
ggaaggggtgggtgagcctcag

SEQ ID NO: 71704 - DNA, 22 bp, Homo sapiens
gacctcatgatccacctgcctt

SEQ ID NO: 71705 - DNA, 22 bp, Homo sapiens
gggagagtagctggaaggttct

SEQ ID NO: 71706 - DNA, 22 bp, Homo sapiens
actttaattaatgaactgtggc

SEQ ID NO: 71707 - DNA, 22 bp, Homo sapiens
tgtccagctcgagacactatct

SEQ ID NO: 71708 - DNA, 22 bp, Homo sapiens
gggggagagacgagcggctctg

SEQ ID NO: 71709 - DNA, 22 bp, Homo sapiens
cggccaagccggggccccgaag

SEQ ID NO: 71710 - DNA, 22 bp, Homo sapiens
acagagcaatgcgtgttctcta

SEQ ID NO: 71711 - DNA, 22 bp, Homo sapiens
acccaggagacggaggtgcagt

SEQ ID NO: 71712 - DNA, 22 bp, Homo sapiens
ggtagggctgcaatggtagtga

SEQ ID NO: 71713 - DNA, 22 bp, Homo sapiens
gggatctgggacaacaggtggt

SEQ ID NO: 71714 - DNA, 22 bp, Homo sapiens
atgccactgcgctctagcctgg

SEQ ID NO: 71715 - DNA, 22 bp, Homo sapiens
gctgcagggagctggaaggctc

SEQ ID NO: 71716 - DNA, 18 bp, Homo sapiens
ctgtacttcagcctgggt

SEQ ID NO: 71717 - DNA, 22 bp, Homo sapiens
ggagaagaggagctggaagcct

SEQ ID NO: 71718 - DNA, 22 bp, Homo sapiens
ccactattactgtgtggcagtc

SEQ ID NO: 71719 - DNA, 22 bp, Homo sapiens
ggtgccctggaagctgctgcat

SEQ ID NO: 71720 - DNA, 22 bp, Homo sapiens
agggatggagtgcggcccggac

SEQ ID NO: 71721 - DNA, 22 bp, Homo sapiens
agcctgcgatcccacctggcct

SEQ ID NO: 71722 - DNA, 22 bp, Homo sapiens
aacccgggaggcggaggttgtg

SEQ ID NO: 71723 - DNA, 22 bp, Homo sapiens
tctgctctgtggcttcagctaa

SEQ ID NO: 71724 - DNA, 22 bp, Homo sapiens
agaaacgcctgtgaaattatct

SEQ ID NO: 71725 - DNA, 18 bp, Homo sapiens
agagtgttctcagtgaaa

SEQ ID NO: 71726 - DNA, 22 bp, Homo sapiens
agcctattccaggatgagctca

SEQ ID NO: 71727 - DNA, 22 bp, Homo sapiens
acggggctagagaaggtttctt

SEQ ID NO: 71728 - DNA, 22 bp, Homo sapiens
tcttcctggatgggggttgatg

SEQ ID NO: 71729 - DNA, 22 bp, Homo sapiens
aggcaacttttggggatgatgg

SEQ ID NO: 71730 - DNA, 22 bp, Homo sapiens
caaccccactacacgttggaga

SEQ ID NO: 71731 - DNA, 22 bp, Homo sapiens
cccagctcttcaagtcaccccc

SEQ ID NO: 71732 - DNA, 22 bp, Homo sapiens
tgggcaggggccctgcttccgt

SEQ ID NO: 71733 - DNA, 22 bp, Homo sapiens
cccattcttcatacaagtctaa

SEQ ID NO: 71734 - DNA, 22 bp, Homo sapiens
gaatcccaatctgttattgaca

SEQ ID NO: 71735 - DNA, 22 bp, Homo sapiens
ctcggggatccatccacgtggc

SEQ ID NO: 71736 - DNA, 22 bp, Homo sapiens
ggagtgactctcggggccacta

SEQ ID NO: 71737 - DNA, 22 bp, Homo sapiens
ggcaggaacacagatggtgccg

SEQ ID NO: 71738 - DNA, 22 bp, Homo sapiens
aactcagatgtttggctacctt

SEQ ID NO: 71739 - DNA, 22 bp, Homo sapiens
taaagggtaggttttactgtaa

SEQ ID NO: 71740 - DNA, 22 bp, Homo sapiens
aagtggactaatacaaggacta

SEQ ID NO: 71741 - DNA, 22 bp, Homo sapiens
gatggcggtcgtcgacggtcct

SEQ ID NO: 71742 - DNA, 22 bp, Homo sapiens
gaactttgcgcagttcccgggg

SEQ ID NO: 71743 - DNA, 22 bp, Homo sapiens
aggtggtgtttggttacatgag

SEQ ID NO: 71744 - DNA, 22 bp, Homo sapiens
ttaaactgcttgaattgggttt

SEQ ID NO: 71745 - DNA, 22 bp, Homo sapiens
gctgcgccggatcccacgttcc

SEQ ID NO: 71746 - DNA, 22 bp, Homo sapiens
aagacacaatgtagcccagcac

SEQ ID NO: 71747 - DNA, 22 bp, Homo sapiens
cagtggcgtgatctctgctcac

SEQ ID NO: 71748 - DNA, 22 bp, Homo sapiens
gcccccgtagtagatgaggcgc

SEQ ID NO: 71749 - DNA, 22 bp, Homo sapiens
agcattccacactgaagtctgc

SEQ ID NO: 71750 - DNA, 22 bp, Homo sapiens
ttgtgaatggtgccgcaataaa

SEQ ID NO: 71751 - DNA, 22 bp, Homo sapiens
agatttccagaccaatttctca

SEQ ID NO: 71752 - DNA, 22 bp, Homo sapiens
cctggctgacagcttaattcca

SEQ ID NO: 71753 - DNA, 22 bp, Homo sapiens
aagatacagacagagccaaaat

SEQ ID NO: 71754 - DNA, 22 bp, Homo sapiens
agatgtgagaatcaagtgacca

SEQ ID NO: 71755 - DNA, 22 bp, Homo sapiens
acctctgtacctcctctgacag

SEQ ID NO: 71756 - DNA, 22 bp, Homo sapiens
gggcctcaggttctggagaagg

SEQ ID NO: 71757 - DNA, 22 bp, Homo sapiens
cactgcaccctcaaactcctgg

SEQ ID NO: 71758 - DNA, 22 bp, Homo sapiens
caacaacatgggattcatttct

SEQ ID NO: 71759 - DNA, 22 bp, Homo sapiens
acatgagactgggtttgtaggg

SEQ ID NO: 71760 - DNA, 22 bp, Homo sapiens
ctctccattccctacagttttc

SEQ ID NO: 71761 - DNA, 17 bp, Homo sapiens
tgtagcttctccttctc

SEQ ID NO: 71762 - DNA, 22 bp, Homo sapiens
gggacgacaggctctgtggtag

SEQ ID NO: 71763 - DNA, 23 bp, Homo sapiens
agagcaaggaaatgaggtgtgat

SEQ ID NO: 71764 - DNA, 22 bp, Homo sapiens
aggggagagttaatgtgaatgt

SEQ ID NO: 71765 - DNA, 22 bp, Homo sapiens
gagagtctaggaacctcatata

SEQ ID NO: 71766 - DNA, 22 bp, Homo sapiens
tgcagtttaaacttggcaactt

SEQ ID NO: 71767 - DNA, 22 bp, Homo sapiens
catttctgggagacatgctaga

SEQ ID NO: 71768 - DNA, 22 bp, Homo sapiens
cccaggctggagtgtaatggtg

SEQ ID NO: 71769 - DNA, 22 bp, Homo sapiens
ggagtgaagtggcgcgatctcg

SEQ ID NO: 71770 - DNA, 22 bp, Homo sapiens
tgacagtgaataagtctcttaa

SEQ ID NO: 71771 - DNA, 22 bp, Homo sapiens
catagcggtattccacgtggtt

SEQ ID NO: 71772 - DNA, 22 bp, Homo sapiens
gacaattgcttttgccgaataa

SEQ ID NO: 71773 - DNA, 22 bp, Homo sapiens
tgcagaaacaagccatcattca

SEQ ID NO: 71774 - DNA, 23 bp, Homo sapiens
catgatgttaactttgttatgct

SEQ ID NO: 71775 - DNA, 22 bp, Homo sapiens
ccctgctgtcaggtgctgggag

SEQ ID NO: 71776 - DNA, 22 bp, Homo sapiens
gtgtgtctcccaagaaggccca

SEQ ID NO: 71777 - DNA, 22 bp, Homo sapiens
aggtgactggtttatctggcag

SEQ ID NO: 71778 - DNA, 22 bp, Homo sapiens
agtgagtttagggtgcaggtgt

SEQ ID NO: 71779 - DNA, 22 bp, Homo sapiens
tctagttctagatccctgagga

SEQ ID NO: 71780 - DNA, 22 bp, Homo sapiens
tagaagaaagtgaagctgggga

SEQ ID NO: 71781 - DNA, 22 bp, Homo sapiens
gcctcactgcagccccaggaag

SEQ ID NO: 71782 - DNA, 22 bp, Homo sapiens
taaccaagcaaactttcattgt

SEQ ID NO: 71783 - DNA, 20 bp, Homo sapiens
ttcatgggagcaaagaggcc

SEQ ID NO: 71784 - DNA, 23 bp, Homo sapiens
atgggccaagcaagacccatgac

SEQ ID NO: 71785 - DNA, 22 bp, Homo sapiens
caggacatctacccagtgtttc

SEQ ID NO: 71786 - DNA, 22 bp, Homo sapiens
tggtctgctgaacagccgtatc

SEQ ID NO: 71787 - DNA, 22 bp, Homo sapiens
tgtttcaaattacttgaggatt

SEQ ID NO: 71788 - DNA, 22 bp, Homo sapiens
attcatcagctaatggacattt

SEQ ID NO: 71789 - DNA, 22 bp, Homo sapiens
agcgagtgggtcagcgttgcag

SEQ ID NO: 71790 - DNA, 22 bp, Homo sapiens
cgtgattggcttctgcattgga

SEQ ID NO: 71791 - DNA, 22 bp, Homo sapiens
ccgggttgaggttcccatagat

SEQ ID NO: 71792 - DNA, 22 bp, Homo sapiens
tgactcctggtatggatgacag

SEQ ID NO: 71793 - DNA, 17 bp, Homo sapiens
tggtagaatgacaggcc

SEQ ID NO: 71794 - DNA, 22 bp, Homo sapiens
ataaaatttgctactgttaaat

SEQ ID NO: 71795 - DNA, 22 bp, Homo sapiens
tgcctaggctggagtgcaatgg

SEQ ID NO: 71796 - DNA, 22 bp, Homo sapiens
gtggaggagaggcgccttgcgg

SEQ ID NO: 71797 - DNA, 22 bp, Homo sapiens
gcccagagtttgaagatacagt

SEQ ID NO: 71798 - DNA, 22 bp, Homo sapiens
acgtgcaggatctggttggcga

SEQ ID NO: 71799 - DNA, 22 bp, Homo sapiens
agcacctgtcaagtccaggctg

SEQ ID NO: 71800 - DNA, 22 bp, Homo sapiens
caggctgatcagggctgggatg

SEQ ID NO: 71801 - DNA, 18 bp, Homo sapiens
tttctcagactctctttc

SEQ ID NO: 71802 - DNA, 22 bp, Homo sapiens
cgggagcctctgggtcacactg

SEQ ID NO: 71803 - DNA, 22 bp, Homo sapiens
gttcatcactcagagacctccc

SEQ ID NO: 71804 - DNA, 17 bp, Homo sapiens
aatctgtttacagtcag

SEQ ID NO: 71805 - DNA, 22 bp, Homo sapiens
gtgcggatcggtgtcctccaaa

SEQ ID NO: 71806 - DNA, 22 bp, Homo sapiens
agctgctgagccaggctgatgt

SEQ ID NO: 71807 - DNA, 22 bp, Homo sapiens
aatgttacgatcaacaacacat

SEQ ID NO: 71808 - DNA, 22 bp, Homo sapiens
ttgatgagaccattgccgcgtc

SEQ ID NO: 71809 - DNA, 17 bp, Homo sapiens
tactgaggggtctggag

SEQ ID NO: 71810 - DNA, 22 bp, Homo sapiens
gcacagagagggaaggtaactt

SEQ ID NO: 71811 - DNA, 22 bp, Homo sapiens
tcttgcacttcatgaatatgtt

SEQ ID NO: 71812 - DNA, 22 bp, Homo sapiens
agaaagtgcttccctttggact

SEQ ID NO: 71813 - DNA, 22 bp, Homo sapiens
aagaactgagtacgttaataaa

SEQ ID NO: 71814 - DNA, 22 bp, Homo sapiens
aggccgtctgcaggcctgcagg

SEQ ID NO: 71815 - DNA, 22 bp, Homo sapiens
accagcctggccaacatggcaa

SEQ ID NO: 71816 - DNA, 22 bp, Homo sapiens
ggagagggtaggggtcctgccc

SEQ ID NO: 71817 - DNA, 22 bp, Homo sapiens
gagccagactgcctgaagctca

SEQ ID NO: 71818 - DNA, 22 bp, Homo sapiens
ccgggccccacggtgacctcag

SEQ ID NO: 71819 - DNA, 22 bp, Homo sapiens
tccaagatctacagcagtttag

SEQ ID NO: 71820 - DNA, 22 bp, Homo sapiens
gtggtgagagtaggtgtcctct

SEQ ID NO: 71821 - DNA, 22 bp, Homo sapiens
taggggcaggatcctttgagcc

SEQ ID NO: 71822 - DNA, 22 bp, Homo sapiens
cccttagaattttgtagttatt

SEQ ID NO: 71823 - DNA, 22 bp, Homo sapiens
tttgctattgtgaatagtgcca

SEQ ID NO: 71824 - DNA, 22 bp, Homo sapiens
aggactcatccctgcttgtcag

SEQ ID NO: 71825 - DNA, 22 bp, Homo sapiens
gccagggttcgaatccgtatgg

SEQ ID NO: 71826 - DNA, 22 bp, Homo sapiens
tacagtgcttggtatctagtaa

SEQ ID NO: 71827 - DNA, 22 bp, Homo sapiens
acccagggctcaagcgtaggca

SEQ ID NO: 71828 - DNA, 19 bp, Homo sapiens
aggagcactgccagcacca

SEQ ID NO: 71829 - DNA, 22 bp, Homo sapiens
tgctggaggccagaagtctgag

SEQ ID NO: 71830 - DNA, 22 bp, Homo sapiens
aaggagaaatggtagatgtgca

SEQ ID NO: 71831 - DNA, 22 bp, Homo sapiens
agtgccaaatcgagggctctga

SEQ ID NO: 71832 - DNA, 22 bp, Homo sapiens
gctccctggtagccatgctctc

SEQ ID NO: 71833 - DNA, 22 bp, Homo sapiens
ctgattctcctcaagactttcg

SEQ ID NO: 71834 - DNA, 22 bp, Homo sapiens
ctacccttaagtttctgtgggg

SEQ ID NO: 71835 - DNA, 22 bp, Homo sapiens
ggtcgctgtgtaggttcagcta

SEQ ID NO: 71836 - DNA, 22 bp, Homo sapiens
actgggcctgattgggtcggag

SEQ ID NO: 71837 - DNA, 22 bp, Homo sapiens
ctaggctggagtgcagtggcac

SEQ ID NO: 71838 - DNA, 22 bp, Homo sapiens
tctccgatcacaggttttcaat

SEQ ID NO: 71839 - DNA, 22 bp, Homo sapiens
ggaggtgggctaaggactctct

SEQ ID NO: 71840 - DNA, 22 bp, Homo sapiens
tgtgagttattttcaggagttt

SEQ ID NO: 71841 - DNA, 22 bp, Homo sapiens
gaccatcctggccaacgtggta

SEQ ID NO: 71842 - DNA, 22 bp, Homo sapiens
tgcagagtgaagacatcacccc

SEQ ID NO: 71843 - DNA, 22 bp, Homo sapiens
agactcagccacacaagactac

SEQ ID NO: 71844 - DNA, 22 bp, Homo sapiens
tcagggattgcaaaattcatcc

SEQ ID NO: 71845 - DNA, 22 bp, Homo sapiens
tgctttgtgacagattagtttt

SEQ ID NO: 71846 - DNA, 22 bp, Homo sapiens
gccctgttgtcggacgtcaagg

SEQ ID NO: 71847 - DNA, 22 bp, Homo sapiens
ctgcatccatgttgctgcaaag

SEQ ID NO: 71848 - DNA, 22 bp, Homo sapiens
gggagctggagctggaagactc

SEQ ID NO: 71849 - DNA, 22 bp, Homo sapiens
gtagaggggtgattctgtgaga

SEQ ID NO: 71850 - DNA, 22 bp, Homo sapiens
tctcgatctcctgaccttgtga

SEQ ID NO: 71851 - DNA, 22 bp, Homo sapiens
caggcagaagaagtggaaggac

SEQ ID NO: 71852 - DNA, 22 bp, Homo sapiens
tgtccagatcaatgcccacatg

SEQ ID NO: 71853 - DNA, 22 bp, Homo sapiens
tataccatgtgtgcacactccc

SEQ ID NO: 71854 - DNA, 22 bp, Homo sapiens
ccctctacagggaagcgctttc

SEQ ID NO: 71855 - DNA, 22 bp, Homo sapiens
gccactgagcccggccattgtt

SEQ ID NO: 71856 - DNA, 22 bp, Homo sapiens
ttccacaatggttaagctcgtt

SEQ ID NO: 71857 - DNA, 22 bp, Homo sapiens
tgagaaacacaggcatgaatag

SEQ ID NO: 71858 - DNA, 22 bp, Homo sapiens
ctgatattctattttgcttgct

SEQ ID NO: 71859 - DNA, 22 bp, Homo sapiens
tagccgggtgttgtgtcatgca

SEQ ID NO: 71860 - DNA, 22 bp, Homo sapiens
ggggccgaccgcggttcaggcc

SEQ ID NO: 71861 - DNA, 22 bp, Homo sapiens
tattcatagtaaacaaaagtgg

SEQ ID NO: 71862 - DNA, 22 bp, Homo sapiens
ttagaggaaagactgggactaa

SEQ ID NO: 71863 - DNA, 22 bp, Homo sapiens
aacagcttgctgcaccttaata

SEQ ID NO: 71864 - DNA, 22 bp, Homo sapiens
tggaagggagctggaatttgga

SEQ ID NO: 71865 - DNA, 22 bp, Homo sapiens
tgctcttcacagtttcagcatc

SEQ ID NO: 71866 - DNA, 22 bp, Homo sapiens
ggcaggtcaggtccatgaccaa

SEQ ID NO: 71867 - DNA, 22 bp, Homo sapiens
tggagccagagcgcagcctggg

SEQ ID NO: 71868 - DNA, 22 bp, Homo sapiens
gacgccgtgtcccggcactctt

SEQ ID NO: 71869 - DNA, 22 bp, Homo sapiens
cttcctcctccatctcgaaggc

SEQ ID NO: 71870 - DNA, 22 bp, Homo sapiens
aggcctgaggaccagataaatg

SEQ ID NO: 71871 - DNA, 22 bp, Homo sapiens
ttgaatctgggtacttgtaata

SEQ ID NO: 71872 - DNA, 17 bp, Homo sapiens
tgtatttatcatgtcag

SEQ ID NO: 71873 - DNA, 22 bp, Homo sapiens
atgttcatatccccattctgat

SEQ ID NO: 71874 - DNA, 22 bp, Homo sapiens
atgaaatatcttgaagaaattc

SEQ ID NO: 71875 - DNA, 20 bp, Homo sapiens
cagtgcattgcttctgattt

SEQ ID NO: 71876 - DNA, 21 bp, Homo sapiens
tgaaggggtggcagtgtgctt

SEQ ID NO: 71877 - DNA, 22 bp, Homo sapiens
agatacattgttctaagcattg

SEQ ID NO: 71878 - DNA, 22 bp, Homo sapiens
atggcctgcagtgctgccacag

SEQ ID NO: 71879 - DNA, 22 bp, Homo sapiens
atcatgttttaattagcaaact

SEQ ID NO: 71880 - DNA, 22 bp, Homo sapiens
gaagccttgaactgcaaacccc

SEQ ID NO: 71881 - DNA, 22 bp, Homo sapiens
ttatttaatgtgatctgaagag

SEQ ID NO: 71882 - DNA, 22 bp, Homo sapiens
gcaggtctgttgattacagtca

SEQ ID NO: 71883 - DNA, 21 bp, Homo sapiens
tctctttctggaagcttccct

SEQ ID NO: 71884 - DNA, 21 bp, Homo sapiens
ttaaagcctccctcataagga

SEQ ID NO: 71885 - DNA, 22 bp, Homo sapiens
tggaggcgagagcgcgcgggct

SEQ ID NO: 71886 - DNA, 22 bp, Homo sapiens
tctccatggatttggaaatgat

SEQ ID NO: 71887 - DNA, 22 bp, Homo sapiens
tcttaattctgtgtcttcacta

SEQ ID NO: 71888 - DNA, 22 bp, Homo sapiens
tggctagcactctacctttctc

SEQ ID NO: 71889 - DNA, 22 bp, Homo sapiens
atacaatgattggttctcaccc

SEQ ID NO: 71890 - DNA, 22 bp, Homo sapiens
tcttggattttaatggatcaaa

SEQ ID NO: 71891 - DNA, 22 bp, Homo sapiens
tgtgggacctcagagggtcccc

SEQ ID NO: 71892 - DNA, 22 bp, Homo sapiens
gaaggtggcgagcggattgctg

SEQ ID NO: 71893 - DNA, 22 bp, Homo sapiens
cccagtttcaactttccagtgg

SEQ ID NO: 71894 - DNA, 22 bp, Homo sapiens
gtggggtagatctttctcagga

SEQ ID NO: 71895 - DNA, 22 bp, Homo sapiens
ttgaggcctgctggaaggtgtt

SEQ ID NO: 71896 - DNA, 22 bp, Homo sapiens
tctatgtctcgacccaagacaa

SEQ ID NO: 71897 - DNA, 21 bp, Homo sapiens
tggtaggtactggcttcaggc

SEQ ID NO: 71898 - DNA, 22 bp, Homo sapiens
caaagctggaaaaggaggctgg

SEQ ID NO: 71899 - DNA, 22 bp, Homo sapiens
cagaaaccaaatgggatgggga

SEQ ID NO: 71900 - DNA, 22 bp, Homo sapiens
cccgttgccttctgggagttgt

SEQ ID NO: 71901 - DNA, 22 bp, Homo sapiens
ttcagcttgctgactgcggcag

SEQ ID NO: 71902 - DNA, 22 bp, Homo sapiens
atataatttttggttagctcaa

SEQ ID NO: 71903 - DNA, 22 bp, Homo sapiens
cttgcctttgtcttcaaaggct

SEQ ID NO: 71904 - DNA, 22 bp, Homo sapiens
taggcaagtggaccagaggttt

SEQ ID NO: 71905 - DNA, 22 bp, Homo sapiens
gaagcttgaacagggccaggct

SEQ ID NO: 71906 - DNA, 22 bp, Homo sapiens
taacaatacccattctaattac

SEQ ID NO: 71907 - DNA, 22 bp, Homo sapiens
tcttagaaattccccagtggct

SEQ ID NO: 71908 - DNA, 22 bp, Homo sapiens
cttaactctacactgcacttta

SEQ ID NO: 71909 - DNA, 22 bp, Homo sapiens
aggaattcaagaccagctgggc

SEQ ID NO: 71910 - DNA, 22 bp, Homo sapiens
tataaagagtctcaaagaagtt

SEQ ID NO: 71911 - DNA, 22 bp, Homo sapiens
atggccaggcacctctggctga

SEQ ID NO: 71912 - DNA, 22 bp, Homo sapiens
gaggtgggtgtatcacaggtca

SEQ ID NO: 71913 - DNA, 22 bp, Homo sapiens
attgtgtcctcattgaccttca

SEQ ID NO: 71914 - DNA, 22 bp, Homo sapiens
ctcactgcaagctcagcctccc

SEQ ID NO: 71915 - DNA, 22 bp, Homo sapiens
ctccagttggccccagttggtt

SEQ ID NO: 71916 - DNA, 22 bp, Homo sapiens
gagatatgttggcagctggtat

SEQ ID NO: 71917 - DNA, 20 bp, Homo sapiens
ggccggggagctctccaggg

SEQ ID NO: 71918 - DNA, 22 bp, Homo sapiens
taggaatggtgctcagcagaaa

SEQ ID NO: 71919 - DNA, 22 bp, Homo sapiens
accaggcccgctgctatggtgg

SEQ ID NO: 71920 - DNA, 22 bp, Homo sapiens
tcactgcaagctcagcctcccg

SEQ ID NO: 71921 - DNA, 22 bp, Homo sapiens
ccctcccagatgggcttgaggt

SEQ ID NO: 71922 - DNA, 22 bp, Homo sapiens
tatctattatgttctatgtgtc

SEQ ID NO: 71923 - DNA, 22 bp, Homo sapiens
gaggcagaagttgcagtgagca

SEQ ID NO: 71924 - DNA, 22 bp, Homo sapiens
tcaggcaatctgacagctggag

SEQ ID NO: 71925 - DNA, 22 bp, Homo sapiens
tgaaatcttcactaagtctctt

SEQ ID NO: 71926 - DNA, 22 bp, Homo sapiens
accagcctggccaacatggtga

SEQ ID NO: 71927 - DNA, 22 bp, Homo sapiens
ccacaggggcccacgagccgct

SEQ ID NO: 71928 - DNA, 22 bp, Homo sapiens
cttaatctcacctgcaaagtcc

SEQ ID NO: 71929 - DNA, 22 bp, Homo sapiens
gtcgatcacctcgtcctccgtg

SEQ ID NO: 71930 - DNA, 22 bp, Homo sapiens
tgtcacagtttgtactttatag

SEQ ID NO: 71931 - DNA, 22 bp, Homo sapiens
cagctgctgttcagttttgttt

SEQ ID NO: 71932 - DNA, 22 bp, Homo sapiens
tgtgacaagcattgtatattgg

SEQ ID NO: 71933 - DNA, 22 bp, Homo sapiens
aagtccattaggcccctgcctg

SEQ ID NO: 71934 - DNA, 22 bp, Homo sapiens
acgcccagactcccatactttg

SEQ ID NO: 71935 - DNA, 19 bp, Homo sapiens
ctctgggcaagtcacttaa

SEQ ID NO: 71936 - DNA, 22 bp, Homo sapiens
atggtactggggtcccggagtt

SEQ ID NO: 71937 - DNA, 22 bp, Homo sapiens
gtgcccagcagcagcgtccccg

SEQ ID NO: 71938 - DNA, 22 bp, Homo sapiens
cctcttctaggacgtccttgtg

SEQ ID NO: 71939 - DNA, 22 bp, Homo sapiens
cagtgagctcatggccaagtca

SEQ ID NO: 71940 - DNA, 22 bp, Homo sapiens
ccttctagcaaatcaacataaa

SEQ ID NO: 71941 - DNA, 22 bp, Homo sapiens
cactctgcagctgaagggctgg

SEQ ID NO: 71942 - DNA, 22 bp, Homo sapiens
ctggctggagtgcaggtgagtg

SEQ ID NO: 71943 - DNA, 22 bp, Homo sapiens
cttcatcagctggcttactgtt

SEQ ID NO: 71944 - DNA, 22 bp, Homo sapiens
cacttcattgggaccagggctg

SEQ ID NO: 71945 - DNA, 22 bp, Homo sapiens
agcctgggcaacagagcaaaac

SEQ ID NO: 71946 - DNA, 22 bp, Homo sapiens
ccgggcgggggctctcgtcacc

SEQ ID NO: 71947 - DNA, 23 bp, Homo sapiens
tctctgcatgtcctgagcacatc

SEQ ID NO: 71948 - DNA, 22 bp, Homo sapiens
ggaggcggaggttgcagtgagc

SEQ ID NO: 71949 - DNA, 22 bp, Homo sapiens
gcggggcccggacccagcctct

SEQ ID NO: 71950 - DNA, 22 bp, Homo sapiens
ctgaggtgtgaaatggtggcaa

SEQ ID NO: 71951 - DNA, 22 bp, Homo sapiens
gccgggaccaaggccacggagc

SEQ ID NO: 71952 - DNA, 21 bp, Homo sapiens
gtgcggatgccgtcattgtca

SEQ ID NO: 71953 - DNA, 22 bp, Homo sapiens
ggcgcccccttcaaacagagca

SEQ ID NO: 71954 - DNA, 22 bp, Homo sapiens
atttcagcagcccatgtttgga

SEQ ID NO: 71955 - DNA, 22 bp, Homo sapiens
ttgcttcagagggagacacttt

SEQ ID NO: 71956 - DNA, 22 bp, Homo sapiens
gggaggaggaatgttttgtgta

SEQ ID NO: 71957 - DNA, 22 bp, Homo sapiens
tgctgtgaggttgagaaggaag

SEQ ID NO: 71958 - DNA, 22 bp, Homo sapiens
gcccggcagtcacacacccagg

SEQ ID NO: 71959 - DNA, 22 bp, Homo sapiens
ccctgcctacagggttttcttt

SEQ ID NO: 71960 - DNA, 22 bp, Homo sapiens
tcacagctcactgtagcctcga

SEQ ID NO: 71961 - DNA, 22 bp, Homo sapiens
actgcactccagcctgggtgat

SEQ ID NO: 71962 - DNA, 22 bp, Homo sapiens
tcccctctttctggaaacacaa

SEQ ID NO: 71963 - DNA, 22 bp, Homo sapiens
ctctggaggtggaggttgcagt

SEQ ID NO: 71964 - DNA, 22 bp, Homo sapiens
tgctccagcaccaagagctcca

SEQ ID NO: 71965 - DNA, 22 bp, Homo sapiens
agctgccccgaggcggcgggaa

SEQ ID NO: 71966 - DNA, 22 bp, Homo sapiens
caggagatgacagggaagaacc

SEQ ID NO: 71967 - DNA, 22 bp, Homo sapiens
aaagtgctgtgattacaggcat

SEQ ID NO: 71968 - DNA, 22 bp, Homo sapiens
actcctacatattagcattaac

SEQ ID NO: 71969 - DNA, 22 bp, Homo sapiens
gctggtgagcaaaggagaagga

SEQ ID NO: 71970 - DNA, 22 bp, Homo sapiens
tgaactcctgacctcatgatcc

SEQ ID NO: 71971 - DNA, 22 bp, Homo sapiens
caggagtgttgattgctcagga

SEQ ID NO: 71972 - DNA, 22 bp, Homo sapiens
gcaaatacatgttgagcaccta

SEQ ID NO: 71973 - DNA, 22 bp, Homo sapiens
tctgcgcgctgctggtaccgaa

SEQ ID NO: 71974 - DNA, 22 bp, Homo sapiens
tgggccactgctgcggaaggcg

SEQ ID NO: 71975 - DNA, 22 bp, Homo sapiens
acccaggctggagtgcagtgat

SEQ ID NO: 71976 - DNA, 22 bp, Homo sapiens
ttctcctttcattccctgtaga

SEQ ID NO: 71977 - DNA, 22 bp, Homo sapiens
ttccatcattaacaccacaagg

SEQ ID NO: 71978 - DNA, 22 bp, Homo sapiens
gtgttggacagcttctactgtg

SEQ ID NO: 71979 - DNA, 22 bp, Homo sapiens
gtcggccacgcaggtgcggtag

SEQ ID NO: 71980 - DNA, 22 bp, Homo sapiens
agaggcaggaggttgacttgag

SEQ ID NO: 71981 - DNA, 22 bp, Homo sapiens
aagatattcaaagatttattag

SEQ ID NO: 71982 - DNA, 22 bp, Homo sapiens
tactgtactgcagttctgcaaa

SEQ ID NO: 71983 - DNA, 22 bp, Homo sapiens
ggactgctgtttacctggcttt

SEQ ID NO: 71984 - DNA, 22 bp, Homo sapiens
aggacttagaacattatgtact

SEQ ID NO: 71985 - DNA, 22 bp, Homo sapiens
caaatgtataaatgtactttct

SEQ ID NO: 71986 - DNA, 22 bp, Homo sapiens
agcataagttggtacagccact

SEQ ID NO: 71987 - DNA, 22 bp, Homo sapiens
acgaggttggagagttgtttgg

SEQ ID NO: 71988 - DNA, 22 bp, Homo sapiens
acgtggcggccgccgtgagcgg

SEQ ID NO: 71989 - DNA, 22 bp, Homo sapiens
agtgactggtgtgaagttaaat

SEQ ID NO: 71990 - DNA, 20 bp, Homo sapiens
ccagagctgatggctgcccg

SEQ ID NO: 71991 - DNA, 22 bp, Homo sapiens
tcccagattcctgctcttatat

SEQ ID NO: 71992 - DNA, 22 bp, Homo sapiens
catctgtaaagtaggaatattg

SEQ ID NO: 71993 - DNA, 22 bp, Homo sapiens
gtggagagagataagcctggtc

SEQ ID NO: 71994 - DNA, 22 bp, Homo sapiens
attggccatttgcatgtattat

SEQ ID NO: 71995 - DNA, 22 bp, Homo sapiens
tgtgtctgtgtatacacggcat

SEQ ID NO: 71996 - DNA, 22 bp, Homo sapiens
ttttaatactgctattgtagga

SEQ ID NO: 71997 - DNA, 19 bp, Homo sapiens
tctgccgagctagaccact

SEQ ID NO: 71998 - DNA, 22 bp, Homo sapiens
acttttcttatcagaaaggcca

SEQ ID NO: 71999 - DNA, 22 bp, Homo sapiens
catataaatacaacatgtgtta

SEQ ID NO: 72000 - DNA, 22 bp, Homo sapiens
caagccattctcctgcctcagc

SEQ ID NO: 72001 - DNA, 22 bp, Homo sapiens
cagtgatatttatcctactcac

SEQ ID NO: 72002 - DNA, 22 bp, Homo sapiens
tgagccagaggaggctgtgtgg

SEQ ID NO: 72003 - DNA, 22 bp, Homo sapiens
ctgctccccagcctgcgccttt

SEQ ID NO: 72004 - DNA, 22 bp, Homo sapiens
gctcactgcaacctccacctcc

SEQ ID NO: 72005 - DNA, 22 bp, Homo sapiens
agctggggctgtggttgtgatt

SEQ ID NO: 72006 - DNA, 17 bp, Homo sapiens
gagcccctttccaagtt

SEQ ID NO: 72007 - DNA, 22 bp, Homo sapiens
ttcaatttgtgctaaggcaccg

SEQ ID NO: 72008 - DNA, 22 bp, Homo sapiens
acggcctggtgcagcaggtcgc

SEQ ID NO: 72009 - DNA, 22 bp, Homo sapiens
cggccaggcacagtggcccacg

SEQ ID NO: 72010 - DNA, 22 bp, Homo sapiens
gatgtgtttccaggatttgttt

SEQ ID NO: 72011 - DNA, 22 bp, Homo sapiens
cctggcaggtggcgccctcggc

SEQ ID NO: 72012 - DNA, 22 bp, Homo sapiens
cactgcactccagcctgggtca

SEQ ID NO: 72013 - DNA, 22 bp, Homo sapiens
ggtccccgtggaggctggagcg

SEQ ID NO: 72014 - DNA, 22 bp, Homo sapiens
caggctggagtgcagtggggcg

SEQ ID NO: 72015 - DNA, 22 bp, Homo sapiens
tcccgttgatgacggtgcatcc

SEQ ID NO: 72016 - DNA, 22 bp, Homo sapiens
gctgctaagcgtttctgttcca

SEQ ID NO: 72017 - DNA, 19 bp, Homo sapiens
atcaggcttctattttctc

SEQ ID NO: 72018 - DNA, 22 bp, Homo sapiens
taagggttcagaatgcagtggt

SEQ ID NO: 72019 - DNA, 22 bp, Homo sapiens
ggcctgtaatcccagctactca

SEQ ID NO: 72020 - DNA, 22 bp, Homo sapiens
tttctgagaaattaaacacttt

SEQ ID NO: 72021 - DNA, 22 bp, Homo sapiens
tcctggtgctgacacccatagc

SEQ ID NO: 72022 - DNA, 18 bp, Homo sapiens
taatccatatgctttgcc

SEQ ID NO: 72023 - DNA, 22 bp, Homo sapiens
tctgctggaaaaccagggaatt

SEQ ID NO: 72024 - DNA, 22 bp, Homo sapiens
ggagctgaggacactacatttt

SEQ ID NO: 72025 - DNA, 22 bp, Homo sapiens
atgcctgtaatcccagcacttt

SEQ ID NO: 72026 - DNA, 22 bp, Homo sapiens
tgtgtttctgagaatcccacct

SEQ ID NO: 72027 - DNA, 22 bp, Homo sapiens
tcacagcctggacagttgcctg

SEQ ID NO: 72028 - DNA, 22 bp, Homo sapiens
tgcaggctgtgtcatttagtga

SEQ ID NO: 72029 - DNA, 22 bp, Homo sapiens
gtcatggtgctagcgggaatgt

SEQ ID NO: 72030 - DNA, 22 bp, Homo sapiens
atgccactgcacttcagcttgg

SEQ ID NO: 72031 - DNA, 22 bp, Homo sapiens
gtgttgatgacattttagaaac

SEQ ID NO: 72032 - DNA, 22 bp, Homo sapiens
ttgggctgaaccctgcagctga

SEQ ID NO: 72033 - DNA, 22 bp, Homo sapiens
gacatagctcagagctcagcac

SEQ ID NO: 72034 - DNA, 22 bp, Homo sapiens
gccttattacctgcactttgaa

SEQ ID NO: 72035 - DNA, 22 bp, Homo sapiens
tctgttgcaatgtgcatggtga

SEQ ID NO: 72036 - DNA, 22 bp, Homo sapiens
gggcgcatcacctgaggtcagg

SEQ ID NO: 72037 - DNA, 22 bp, Homo sapiens
gagggccctggctggctccagc

SEQ ID NO: 72038 - DNA, 22 bp, Homo sapiens
caggctggagtgcagtggcgct

SEQ ID NO: 72039 - DNA, 19 bp, Homo sapiens
agccagccagcaggtatgc

SEQ ID NO: 72040 - DNA, 22 bp, Homo sapiens
agggcgctgaaatactaacatg

SEQ ID NO: 72041 - DNA, 22 bp, Homo sapiens
gtgtgggctgcagaggcacagc

SEQ ID NO: 72042 - DNA, 22 bp, Homo sapiens
cctctgatgggcacagggtggc

SEQ ID NO: 72043 - DNA, 22 bp, Homo sapiens
tcctggtcttcaggttgcaaaa

SEQ ID NO: 72044 - DNA, 21 bp, Homo sapiens
gccagcggccgccctccagga

SEQ ID NO: 72045 - DNA, 22 bp, Homo sapiens
gcgtggcttagagtggggtacc

SEQ ID NO: 72046 - DNA, 22 bp, Homo sapiens
tgccagctgcttgtcccccaca

SEQ ID NO: 72047 - DNA, 22 bp, Homo sapiens
agtggagacaggacagtcgata

SEQ ID NO: 72048 - DNA, 22 bp, Homo sapiens
atggaaggctttatgactcaaa

SEQ ID NO: 72049 - DNA, 22 bp, Homo sapiens
tcactgcactccagcctgggtg

SEQ ID NO: 72050 - DNA, 23 bp, Homo sapiens
ctcaaccctagtaagggagtagg

SEQ ID NO: 72051 - DNA, 22 bp, Homo sapiens
aataaaatggtcagttttctca

SEQ ID NO: 72052 - DNA, 22 bp, Homo sapiens
gcaaatgctaaagtgtagagac

SEQ ID NO: 72053 - DNA, 22 bp, Homo sapiens
tgggtactcctattagttcagt

SEQ ID NO: 72054 - DNA, 18 bp, Homo sapiens
ttcacaagggcttggttt

SEQ ID NO: 72055 - DNA, 22 bp, Homo sapiens
ggctgcaggttggttggcagct

SEQ ID NO: 72056 - DNA, 22 bp, Homo sapiens
tgtgagcagagacatgaaaagc

SEQ ID NO: 72057 - DNA, 22 bp, Homo sapiens
taaattgagattattagggtaa

SEQ ID NO: 72058 - DNA, 22 bp, Homo sapiens
ttgtctctggaaggaaaaagca

SEQ ID NO: 72059 - DNA, 22 bp, Homo sapiens
gcatacatgggtgcagggacat

SEQ ID NO: 72060 - DNA, 22 bp, Homo sapiens
aatctgagggaacttgaactcc

SEQ ID NO: 72061 - DNA, 22 bp, Homo sapiens
tgagacgaagtcttgctctgtt

SEQ ID NO: 72062 - DNA, 22 bp, Homo sapiens
cacctgccaaatggggatgctg

SEQ ID NO: 72063 - DNA, 22 bp, Homo sapiens
tgggtgtgtccatattttgact

SEQ ID NO: 72064 - DNA, 22 bp, Homo sapiens
aggggatggagctggaaggcag

SEQ ID NO: 72065 - DNA, 21 bp, Homo sapiens
gttcttgcaggatttccttcc

SEQ ID NO: 72066 - DNA, 22 bp, Homo sapiens
gagcccaggagtttgatgctgc

SEQ ID NO: 72067 - DNA, 22 bp, Homo sapiens
actgggcctacccagattggca

SEQ ID NO: 72068 - DNA, 22 bp, Homo sapiens
ttgttcttgtctttgccttcac

SEQ ID NO: 72069 - DNA, 22 bp, Homo sapiens
aggaaaatggaccagagttgtt

SEQ ID NO: 72070 - DNA, 22 bp, Homo sapiens
agggaattcactggaacgccct

SEQ ID NO: 72071 - DNA, 22 bp, Homo sapiens
taaaggtagtgtgacatattgt

SEQ ID NO: 72072 - DNA, 22 bp, Homo sapiens
aagcctgaacattactagttgt

SEQ ID NO: 72073 - DNA, 23 bp, Homo sapiens
tctgtgtctccacccaaatctca

SEQ ID NO: 72074 - DNA, 22 bp, Homo sapiens
gcagggcacaaggacgcacagg

SEQ ID NO: 72075 - DNA, 22 bp, Homo sapiens
acagacaagtagttcagacaag

SEQ ID NO: 72076 - DNA, 22 bp, Homo sapiens
tgcctgtgtcagcaggtggaag

SEQ ID NO: 72077 - DNA, 22 bp, Homo sapiens
tctgcaacagtgccctgtaaat

SEQ ID NO: 72078 - DNA, 22 bp, Homo sapiens
tctggctctggagtccacctgc

SEQ ID NO: 72079 - DNA, 22 bp, Homo sapiens
cccaggaggcagatgttgcagt

SEQ ID NO: 72080 - DNA, 22 bp, Homo sapiens
aggtgggcgctgctcccgctgg

SEQ ID NO: 72081 - DNA, 22 bp, Homo sapiens
ggctcaatgcaacttctgcctc

SEQ ID NO: 72082 - DNA, 22 bp, Homo sapiens
accctccccaagaggtcgtgcc

SEQ ID NO: 72083 - DNA, 22 bp, Homo sapiens
tcccaccttccgtggaacccgt

SEQ ID NO: 72084 - DNA, 22 bp, Homo sapiens
tttgtcttatccaatctctcag

SEQ ID NO: 72085 - DNA, 22 bp, Homo sapiens
tatacgtgcaggtcacagggga

SEQ ID NO: 72086 - DNA, 22 bp, Homo sapiens
tgcttttagctagtaactagta

SEQ ID NO: 72087 - DNA, 22 bp, Homo sapiens
cccaggcttttctcttgcccca

SEQ ID NO: 72088 - DNA, 22 bp, Homo sapiens
ttgaataatatgcttcgttctc

SEQ ID NO: 72089 - DNA, 19 bp, Homo sapiens
gctgaaggaggtgcctgca

SEQ ID NO: 72090 - DNA, 22 bp, Homo sapiens
tcaccggcagacgtggcctgat

SEQ ID NO: 72091 - DNA, 22 bp, Homo sapiens
tggagagttctgtagatatcta

SEQ ID NO: 72092 - DNA, 22 bp, Homo sapiens
tagcagtattccggaatacttt

SEQ ID NO: 72093 - DNA, 22 bp, Homo sapiens
gctgatcacatttccaaaaccc

SEQ ID NO: 72094 - DNA, 22 bp, Homo sapiens
gagccgaggcgcacagctcggg

SEQ ID NO: 72095 - DNA, 22 bp, Homo sapiens
tatgaggtaggtattatactta

SEQ ID NO: 72096 - DNA, 21 bp, Homo sapiens
cggaaaggactagggctcaga

SEQ ID NO: 72097 - DNA, 22 bp, Homo sapiens
atgatccaaagccacaggggca

SEQ ID NO: 72098 - DNA, 19 bp, Homo sapiens
gcataaatacactattgtc

SEQ ID NO: 72099 - DNA, 22 bp, Homo sapiens
ccaggagttggaagctgccatg

SEQ ID NO: 72100 - DNA, 17 bp, Homo sapiens
tggtccaggtggagcca

SEQ ID NO: 72101 - DNA, 22 bp, Homo sapiens
gagtagaactggttatctaata

SEQ ID NO: 72102 - DNA, 22 bp, Homo sapiens
gagccaggttggaggctgcagt

SEQ ID NO: 72103 - DNA, 22 bp, Homo sapiens
ataaaaactgacccatcctttg

SEQ ID NO: 72104 - DNA, 22 bp, Homo sapiens
ttgtgggggctgccctgtacgg

SEQ ID NO: 72105 - DNA, 22 bp, Homo sapiens
tccgccaggactgagggcccat

SEQ ID NO: 72106 - DNA, 22 bp, Homo sapiens
tgtatatacacactcccatgtt

SEQ ID NO: 72107 - DNA, 22 bp, Homo sapiens
ttgcatagtgctgaggttcggg

SEQ ID NO: 72108 - DNA, 22 bp, Homo sapiens
acagtatagggcttatattgta

SEQ ID NO: 72109 - DNA, 22 bp, Homo sapiens
atatacacatctttttaaatat

SEQ ID NO: 72110 - DNA, 22 bp, Homo sapiens
ccctgctgtgtagcggaggaac

SEQ ID NO: 72111 - DNA, 22 bp, Homo sapiens
cctcggggcaccgcggcctgct

SEQ ID NO: 72112 - DNA, 22 bp, Homo sapiens
gggtaggccgtgggtcaccagg

SEQ ID NO: 72113 - DNA, 22 bp, Homo sapiens
acacagagccaaaccatatcac

SEQ ID NO: 72114 - DNA, 22 bp, Homo sapiens
ttctaattaaatctacgctagg

SEQ ID NO: 72115 - DNA, 23 bp, Homo sapiens
ggcctcagtgatgatgggttaaa

SEQ ID NO: 72116 - DNA, 22 bp, Homo sapiens
catggcggtcaggatgtaggtg

SEQ ID NO: 72117 - DNA, 22 bp, Homo sapiens
tcccgcttcttccgaatcgcga

SEQ ID NO: 72118 - DNA, 22 bp, Homo sapiens
cctttcccgctttgagggcaag

SEQ ID NO: 72119 - DNA, 22 bp, Homo sapiens
taattataacagttacatctta

SEQ ID NO: 72120 - DNA, 22 bp, Homo sapiens
gtggctcacacctgtaatccca

SEQ ID NO: 72121 - DNA, 22 bp, Homo sapiens
cactgcactccagcccgggcaa

SEQ ID NO: 72122 - DNA, 22 bp, Homo sapiens
aggctagaggcttctggcttca

SEQ ID NO: 72123 - DNA, 18 bp, Homo sapiens
cagcctctgattggttgc

SEQ ID NO: 72124 - DNA, 22 bp, Homo sapiens
gctgcagacttctcatctcatt

SEQ ID NO: 72125 - DNA, 22 bp, Homo sapiens
aatgtgttgaataaattgtgcc

SEQ ID NO: 72126 - DNA, 20 bp, Homo sapiens
gccactgggcaccagcaggg

SEQ ID NO: 72127 - DNA, 22 bp, Homo sapiens
tgacagtgaacaggttaccact

SEQ ID NO: 72128 - DNA, 22 bp, Homo sapiens
gctcccagtctgatggaggaga

SEQ ID NO: 72129 - DNA, 22 bp, Homo sapiens
tccacagtggttgaactagttt

SEQ ID NO: 72130 - DNA, 22 bp, Homo sapiens
gtgggggcaggcagtgctagga

SEQ ID NO: 72131 - DNA, 22 bp, Homo sapiens
gcaggtggatcacctgaggtca

SEQ ID NO: 72132 - DNA, 22 bp, Homo sapiens
ttattagagtgctttgagaaag

SEQ ID NO: 72133 - DNA, 22 bp, Homo sapiens
tccacagtggttgaactagtaa

SEQ ID NO: 72134 - DNA, 22 bp, Homo sapiens
ttttcatttttgtagatgcaag

SEQ ID NO: 72135 - DNA, 22 bp, Homo sapiens
tggaaagaaagtaaaggcgtat

SEQ ID NO: 72136 - DNA, 22 bp, Homo sapiens
tggcaggcgggagccatagagg

SEQ ID NO: 72137 - DNA, 22 bp, Homo sapiens
agagctaagaaacagaattgct

SEQ ID NO: 72138 - DNA, 22 bp, Homo sapiens
ttgatcaaatcagctactgagg

SEQ ID NO: 72139 - DNA, 22 bp, Homo sapiens
tacagggattgttttaatcacc

SEQ ID NO: 72140 - DNA, 22 bp, Homo sapiens
ctgggggcagcaagaagccatg

SEQ ID NO: 72141 - DNA, 22 bp, Homo sapiens
cctaggagttcgaagctgcagt

SEQ ID NO: 72142 - DNA, 22 bp, Homo sapiens
tcccagaaacgcatatgttcat

SEQ ID NO: 72143 - DNA, 22 bp, Homo sapiens
cagccagtgtgaccgaggagga

SEQ ID NO: 72144 - DNA, 22 bp, Homo sapiens
gtgctgacaggagcctggcggt

SEQ ID NO: 72145 - DNA, 22 bp, Homo sapiens
tcaacaccacaatttcttaact

SEQ ID NO: 72146 - DNA, 22 bp, Homo sapiens
tgggatgccggcaggaggcaat

SEQ ID NO: 72147 - DNA, 22 bp, Homo sapiens
cttagagatgggttttacttag

SEQ ID NO: 72148 - DNA, 22 bp, Homo sapiens
tggtatgaccgtggtgcaagca

SEQ ID NO: 72149 - DNA, 22 bp, Homo sapiens
tgatcagcatcttcccagctcg

SEQ ID NO: 72150 - DNA, 22 bp, Homo sapiens
tcactacaacctccgcctcctg

SEQ ID NO: 72151 - DNA, 22 bp, Homo sapiens
atcatgacatacttttgagaag

SEQ ID NO: 72152 - DNA, 18 bp, Homo sapiens
tgtccctgcaaataacat

SEQ ID NO: 72153 - DNA, 17 bp, Homo sapiens
gattagagaactaagga

SEQ ID NO: 72154 - DNA, 22 bp, Homo sapiens
aagatactttgcatgcatgaag

SEQ ID NO: 72155 - DNA, 22 bp, Homo sapiens
tgagagcaacacgcagtagtat

SEQ ID NO: 72156 - DNA, 22 bp, Homo sapiens
tcagccagccagctacaggctt

SEQ ID NO: 72157 - DNA, 22 bp, Homo sapiens
gtcatcttgctgttttagatct

SEQ ID NO: 72158 - DNA, 22 bp, Homo sapiens
tgggggctgggatgtcactttc

SEQ ID NO: 72159 - DNA, 22 bp, Homo sapiens
gacctcgtgatccgcccgcttt

SEQ ID NO: 72160 - DNA, 22 bp, Homo sapiens
acttttaaatgagtttcagttg

SEQ ID NO: 72161 - DNA, 22 bp, Homo sapiens
tgatatgcatgtaagggagaca

SEQ ID NO: 72162 - DNA, 22 bp, Homo sapiens
ggctttgacatgctgaattaaa

SEQ ID NO: 72163 - DNA, 22 bp, Homo sapiens
cttgtattaggaagaatgcttt

SEQ ID NO: 72164 - DNA, 22 bp, Homo sapiens
ttatttaaaagtggtaagattc

SEQ ID NO: 72165 - DNA, 22 bp, Homo sapiens
tctgtgcctgcttccccaccca

SEQ ID NO: 72166 - DNA, 22 bp, Homo sapiens
tctaatcctatggtggggaggg

SEQ ID NO: 72167 - DNA, 22 bp, Homo sapiens
ttgattatagactcactaatct

SEQ ID NO: 72168 - DNA, 22 bp, Homo sapiens
cttttgattgagcagtttcaaa

SEQ ID NO: 72169 - DNA, 22 bp, Homo sapiens
caggctggagtacaattgtgtg

SEQ ID NO: 72170 - DNA, 20 bp, Homo sapiens
taagcatagttgtcagggtc

SEQ ID NO: 72171 - DNA, 23 bp, Homo sapiens
gcagaggagcaagctggacacca

SEQ ID NO: 72172 - DNA, 22 bp, Homo sapiens
tttgaaatatgtgtcttttgaa

SEQ ID NO: 72173 - DNA, 22 bp, Homo sapiens
tagaacctccacaggacctcca

SEQ ID NO: 72174 - DNA, 22 bp, Homo sapiens
caggagctcagatgacatctca

SEQ ID NO: 72175 - DNA, 22 bp, Homo sapiens
tctgcatattgttaatggaatg

SEQ ID NO: 72176 - DNA, 22 bp, Homo sapiens
tgtaagtagtaatggaaggaca

SEQ ID NO: 72177 - DNA, 22 bp, Homo sapiens
tgatctaggttggcttcaactg

SEQ ID NO: 72178 - DNA, 22 bp, Homo sapiens
agcgtgaattagttggtacaca

SEQ ID NO: 72179 - DNA, 23 bp, Homo sapiens
tgagtgtgaaaatcctggagatg

SEQ ID NO: 72180 - DNA, 22 bp, Homo sapiens
tccagggccatctccatgaggc

SEQ ID NO: 72181 - DNA, 22 bp, Homo sapiens
caaggtgccatgctgggcgggg

SEQ ID NO: 72182 - DNA, 22 bp, Homo sapiens
gtgcaaaagtaattgtggtttt

SEQ ID NO: 72183 - DNA, 22 bp, Homo sapiens
ctgtctgaatcctaagcttcct

SEQ ID NO: 72184 - DNA, 22 bp, Homo sapiens
tcccggcgctgggaggtgggtc

SEQ ID NO: 72185 - DNA, 22 bp, Homo sapiens
ctctggagtgtctggccagggt

SEQ ID NO: 72186 - DNA, 22 bp, Homo sapiens
tgcgcatgcgtggctctccggc

SEQ ID NO: 72187 - DNA, 22 bp, Homo sapiens
agggcgacaatggagagcgttt

SEQ ID NO: 72188 - DNA, 22 bp, Homo sapiens
tggggcatgtgaacctggatgt

SEQ ID NO: 72189 - DNA, 22 bp, Homo sapiens
atcgcaagtttaaaaatctttg

SEQ ID NO: 72190 - DNA, 22 bp, Homo sapiens
atttacaggtagaattttaagt

SEQ ID NO: 72191 - DNA, 22 bp, Homo sapiens
gaagaggttcaacgtggtcatc

SEQ ID NO: 72192 - DNA, 22 bp, Homo sapiens
gctgatagactgaatgttggga

SEQ ID NO: 72193 - DNA, 22 bp, Homo sapiens
ggaggggatttagtagatgcta

SEQ ID NO: 72194 - DNA, 22 bp, Homo sapiens
ggaggtggaggttgcagtgagc

SEQ ID NO: 72195 - DNA, 22 bp, Homo sapiens
ggaggcggaggttgcagtgagt

SEQ ID NO: 72196 - DNA, 22 bp, Homo sapiens
gcaaacaaggacatacatcctg

SEQ ID NO: 72197 - DNA, 22 bp, Homo sapiens
atgtctgtttgctgagcccggc

SEQ ID NO: 72198 - DNA, 22 bp, Homo sapiens
taaaatttgtccctgagtgttg

SEQ ID NO: 72199 - DNA, 22 bp, Homo sapiens
tgagtgattaggtttttccttc

SEQ ID NO: 72200 - DNA, 22 bp, Homo sapiens
tttccctttagcctgagaatcc

SEQ ID NO: 72201 - DNA, 22 bp, Homo sapiens
cgcaactcagcaacttaactgc

SEQ ID NO: 72202 - DNA, 22 bp, Homo sapiens
taattgtaaagtagtagtacag

SEQ ID NO: 72203 - DNA, 22 bp, Homo sapiens
accctcttgagggaagcacttt

SEQ ID NO: 72204 - DNA, 22 bp, Homo sapiens
tggtggctaccaggtcctgggg

SEQ ID NO: 72205 - DNA, 22 bp, Homo sapiens
tcctgcagctgataaatacagt

SEQ ID NO: 72206 - DNA, 22 bp, Homo sapiens
tcagtgatttctggggtgaggg

SEQ ID NO: 72207 - DNA, 22 bp, Homo sapiens
gtggctcacgcctgtaatccca

SEQ ID NO: 72208 - DNA, 22 bp, Homo sapiens
tgcatattatgtgtatctgtct

SEQ ID NO: 72209 - DNA, 22 bp, Homo sapiens
cgccccggacgtctgaccaaac

SEQ ID NO: 72210 - DNA, 22 bp, Homo sapiens
gctttatccgcttgacccttac

SEQ ID NO: 72211 - DNA, 22 bp, Homo sapiens
gaggccacggaagggagctgtg

SEQ ID NO: 72212 - DNA, 22 bp, Homo sapiens
gtgaggtggtacaatattaact

SEQ ID NO: 72213 - DNA, 23 bp, Homo sapiens
tgttccagatacgccttttcctc

SEQ ID NO: 72214 - DNA, 22 bp, Homo sapiens
catgcaggcgcaacttctacaa

SEQ ID NO: 72215 - DNA, 22 bp, Homo sapiens
ttctgcagtgttaacaatgtca

SEQ ID NO: 72216 - DNA, 22 bp, Homo sapiens
cgccgtcccctaggaaagagct

SEQ ID NO: 72217 - DNA, 22 bp, Homo sapiens
aaaatatgtataactcttctgc

SEQ ID NO: 72218 - DNA, 21 bp, Homo sapiens
tccttcagtctagatgattgt

SEQ ID NO: 72219 - DNA, 22 bp, Homo sapiens
aggccagcctcaggcagggacc

SEQ ID NO: 72220 - DNA, 22 bp, Homo sapiens
acaggggaatttactgtcatta

SEQ ID NO: 72221 - DNA, 20 bp, Homo sapiens
tttgagaccagtctgcccaa

SEQ ID NO: 72222 - DNA, 22 bp, Homo sapiens
gtgcatgtgtctttatagtagc

SEQ ID NO: 72223 - DNA, 22 bp, Homo sapiens
ttggcgcccaggacgccgccgc

SEQ ID NO: 72224 - DNA, 22 bp, Homo sapiens
gggttactgcttcaaaaaatta

SEQ ID NO: 72225 - DNA, 22 bp, Homo sapiens
atccatttgacataatttcagc

SEQ ID NO: 72226 - DNA, 22 bp, Homo sapiens
ttcttctttccaattacatggt

SEQ ID NO: 72227 - DNA, 22 bp, Homo sapiens
agccaccaccactgaaaggtta

SEQ ID NO: 72228 - DNA, 17 bp, Homo sapiens
caggtgttctgtttttc

SEQ ID NO: 72229 - DNA, 22 bp, Homo sapiens
tagaactaagagttatcattta

SEQ ID NO: 72230 - DNA, 22 bp, Homo sapiens
tgattcatcagaataggagttt

SEQ ID NO: 72231 - DNA, 22 bp, Homo sapiens
aggtggggaggagtgtctcttt

SEQ ID NO: 72232 - DNA, 22 bp, Homo sapiens
tatttaataaaactatggcatg

SEQ ID NO: 72233 - DNA, 22 bp, Homo sapiens
ctgctgtttctcaaaattaagt

SEQ ID NO: 72234 - DNA, 23 bp, Homo sapiens
gtgtgttcccggagtagctcccg

SEQ ID NO: 72235 - DNA, 22 bp, Homo sapiens
gctcagacctgtaatcttagca

SEQ ID NO: 72236 - DNA, 22 bp, Homo sapiens
ctcctggaggatagtgactggg

SEQ ID NO: 72237 - DNA, 22 bp, Homo sapiens
cccagaaggtcgaggctgcagt

SEQ ID NO: 72238 - DNA, 22 bp, Homo sapiens
cccaggaggtcgaagctgcagt

SEQ ID NO: 72239 - DNA, 22 bp, Homo sapiens
aagatgcggttgaccatggtgt

SEQ ID NO: 72240 - DNA, 22 bp, Homo sapiens
aggagggagcttaagccaggca

SEQ ID NO: 72241 - DNA, 22 bp, Homo sapiens
gagtggctattgatccgtgatg

SEQ ID NO: 72242 - DNA, 22 bp, Homo sapiens
atgaaaacggaccagagctatt

SEQ ID NO: 72243 - DNA, 22 bp, Homo sapiens
gtatcacttttgagagtgagaa

SEQ ID NO: 72244 - DNA, 22 bp, Homo sapiens
tgatgggaggtgctgcaggacc

SEQ ID NO: 72245 - DNA, 22 bp, Homo sapiens
agtccccctctgagcccaggga

SEQ ID NO: 72246 - DNA, 22 bp, Homo sapiens
ctgtgcgtaagtagccaaaata

SEQ ID NO: 72247 - DNA, 22 bp, Homo sapiens
ggcaatatggtgaaaccccatc

SEQ ID NO: 72248 - DNA, 22 bp, Homo sapiens
cccgggttgtccgcgcgtccgg

SEQ ID NO: 72249 - DNA, 23 bp, Homo sapiens
catctagcatccagtgagtagtg

SEQ ID NO: 72250 - DNA, 22 bp, Homo sapiens
caattgtcagtgctgtttaaat

SEQ ID NO: 72251 - DNA, 22 bp, Homo sapiens
agagtggctctgctgggcacag

SEQ ID NO: 72252 - DNA, 22 bp, Homo sapiens
gcactttgcccctcctttggca

SEQ ID NO: 72253 - DNA, 22 bp, Homo sapiens
ttcaggatccccaccgcgttta

SEQ ID NO: 72254 - DNA, 22 bp, Homo sapiens
aggtggcagatgggggtgctcg

SEQ ID NO: 72255 - DNA, 22 bp, Homo sapiens
atcactgtgtatgtatatgcag

SEQ ID NO: 72256 - DNA, 23 bp, Homo sapiens
ttttgcaataagtcactggaata

SEQ ID NO: 72257 - DNA, 22 bp, Homo sapiens
ggcccaggctggagtgcagtgg

SEQ ID NO: 72258 - DNA, 21 bp, Homo sapiens
aggcttggatctagacaggcc

SEQ ID NO: 72259 - DNA, 22 bp, Homo sapiens
tgtatattctgcctaaaagctt

SEQ ID NO: 72260 - DNA, 22 bp, Homo sapiens
tccagctgaggtggcctctgtg

SEQ ID NO: 72261 - DNA, 22 bp, Homo sapiens
agtgcagtggttaggagccagg

SEQ ID NO: 72262 - DNA, 22 bp, Homo sapiens
gggcaccttgggtctcaggcaa

SEQ ID NO: 72263 - DNA, 22 bp, Homo sapiens
ccgggctggagtgcaatggctc

SEQ ID NO: 72264 - DNA, 22 bp, Homo sapiens
gccagagttgaggcagtttatt

SEQ ID NO: 72265 - DNA, 22 bp, Homo sapiens
gtggttttattcgttcctctgt

SEQ ID NO: 72266 - DNA, 22 bp, Homo sapiens
gactcgctcccttttgtcttat

SEQ ID NO: 72267 - DNA, 22 bp, Homo sapiens
ccagggatgcagaggttgcagt

SEQ ID NO: 72268 - DNA, 22 bp, Homo sapiens
accagcacttccagaggtcagg

SEQ ID NO: 72269 - DNA, 22 bp, Homo sapiens
ctactggccatctgatctacaa

SEQ ID NO: 72270 - DNA, 22 bp, Homo sapiens
gtacccagtgattccttcttca

SEQ ID NO: 72271 - DNA, 22 bp, Homo sapiens
gcagcctcaaactccccagctc

SEQ ID NO: 72272 - DNA, 21 bp, Homo sapiens
tggcggggacttgtggctgcc

SEQ ID NO: 72273 - DNA, 22 bp, Homo sapiens
attttctctttgtatatgctag

SEQ ID NO: 72274 - DNA, 22 bp, Homo sapiens
actaaagctcacagagttgaac

SEQ ID NO: 72275 - DNA, 22 bp, Homo sapiens
tagatgaccttgtgttaggcaa

SEQ ID NO: 72276 - DNA, 19 bp, Homo sapiens
tgaacgatgtctcagggca

SEQ ID NO: 72277 - DNA, 22 bp, Homo sapiens
gtgtgtcccttggaacctcagc

SEQ ID NO: 72278 - DNA, 22 bp, Homo sapiens
ctgaacttattgagtgcttgct

SEQ ID NO: 72279 - DNA, 22 bp, Homo sapiens
tgttttaagggtcaactgtcac

SEQ ID NO: 72280 - DNA, 22 bp, Homo sapiens
ttttctcttccctctggacctg

SEQ ID NO: 72281 - DNA, 22 bp, Homo sapiens
cactgcaacctccatcttctgg

SEQ ID NO: 72282 - DNA, 22 bp, Homo sapiens
gccttgagaaatgtttggtttt

SEQ ID NO: 72283 - DNA, 22 bp, Homo sapiens
tagagctctccttcctctgtgg

SEQ ID NO: 72284 - DNA, 22 bp, Homo sapiens
gccaggttgctgacgacgatct

SEQ ID NO: 72285 - DNA, 22 bp, Homo sapiens
acaaagtgctgacattacaggc

SEQ ID NO: 72286 - DNA, 22 bp, Homo sapiens
atacagggacatccagtttttc

SEQ ID NO: 72287 - DNA, 22 bp, Homo sapiens
tgtgcatgtgtctttatagtag

SEQ ID NO: 72288 - DNA, 22 bp, Homo sapiens
ctaggtgatccactgctctctt

SEQ ID NO: 72289 - DNA, 22 bp, Homo sapiens
tgatctttggtaatctggcaca

SEQ ID NO: 72290 - DNA, 22 bp, Homo sapiens
gctgtctcatacaaggccctgc

SEQ ID NO: 72291 - DNA, 18 bp, Homo sapiens
tggcgatggtcatttttc

SEQ ID NO: 72292 - DNA, 22 bp, Homo sapiens
gaagttctttatagcagtgtga

SEQ ID NO: 72293 - DNA, 22 bp, Homo sapiens
ccaggagttggaggttgcagtg

SEQ ID NO: 72294 - DNA, 22 bp, Homo sapiens
ggccggggcctgctcgcctgtg

SEQ ID NO: 72295 - DNA, 22 bp, Homo sapiens
ttcagtttcaagtccctctggg

SEQ ID NO: 72296 - DNA, 22 bp, Homo sapiens
aaggagtctgggccattcagag

SEQ ID NO: 72297 - DNA, 23 bp, Homo sapiens
aaacttgctatggctgaaatcat

SEQ ID NO: 72298 - DNA, 22 bp, Homo sapiens
gcctcctgtcccaggctgagga

SEQ ID NO: 72299 - DNA, 22 bp, Homo sapiens
tttctcttcactgtgtgcctca

SEQ ID NO: 72300 - DNA, 22 bp, Homo sapiens
ttaagtgcaaaaatgaaagtat

SEQ ID NO: 72301 - DNA, 22 bp, Homo sapiens
agcctggcggtcgtcggtcagg

SEQ ID NO: 72302 - DNA, 22 bp, Homo sapiens
cagctgttcattgttgccaccc

SEQ ID NO: 72303 - DNA, 22 bp, Homo sapiens
tcacattttcaaaagctggtgc

SEQ ID NO: 72304 - DNA, 22 bp, Homo sapiens
aggaggggttctcgggtgctga

SEQ ID NO: 72305 - DNA, 22 bp, Homo sapiens
attgtactccagcctgggtgac

SEQ ID NO: 72306 - DNA, 22 bp, Homo sapiens
ttgtgttaaggtgcatctagtg

SEQ ID NO: 72307 - DNA, 22 bp, Homo sapiens
gatggaggagatggcagggtgc

SEQ ID NO: 72308 - DNA, 22 bp, Homo sapiens
gggccccaagaacctcctcctg

SEQ ID NO: 72309 - DNA, 22 bp, Homo sapiens
ccacagtctatgcaacaaggtc

SEQ ID NO: 72310 - DNA, 22 bp, Homo sapiens
ctttgcttgacactgtgattgt

SEQ ID NO: 72311 - DNA, 22 bp, Homo sapiens
acgcccggtctccatagttttt

SEQ ID NO: 72312 - DNA, 22 bp, Homo sapiens
tgagtgactccactggggcaga

SEQ ID NO: 72313 - DNA, 22 bp, Homo sapiens
agctacagtcggaaggacagac

SEQ ID NO: 72314 - DNA, 22 bp, Homo sapiens
gatttagtggcccttggtacac

SEQ ID NO: 72315 - DNA, 22 bp, Homo sapiens
cagtcctgaatactggacggtg

SEQ ID NO: 72316 - DNA, 22 bp, Homo sapiens
cctcggaggcggaggctgcagt

SEQ ID NO: 72317 - DNA, 22 bp, Homo sapiens
tcagtgttaatcagtggtacct

SEQ ID NO: 72318 - DNA, 22 bp, Homo sapiens
gagccaagctcttctccatgag

SEQ ID NO: 72319 - DNA, 22 bp, Homo sapiens
ggttccacctggcgaggggtat

SEQ ID NO: 72320 - DNA, 22 bp, Homo sapiens
tggttgcctctcagagattccg

SEQ ID NO: 72321 - DNA, 22 bp, Homo sapiens
tcgcccagctcatctcccacaa

SEQ ID NO: 72322 - DNA, 18 bp, Homo sapiens
acctgattggcgcagccc

SEQ ID NO: 72323 - DNA, 22 bp, Homo sapiens
catcaagtggttctccaggttg

SEQ ID NO: 72324 - DNA, 22 bp, Homo sapiens
ctcaggatattgggctggagca

SEQ ID NO: 72325 - DNA, 22 bp, Homo sapiens
ctgtctgtagacatttttggtt

SEQ ID NO: 72326 - DNA, 22 bp, Homo sapiens
gatctggaatctgaaggctgag

SEQ ID NO: 72327 - DNA, 22 bp, Homo sapiens
gaccttgtgatccccctgcctt

SEQ ID NO: 72328 - DNA, 22 bp, Homo sapiens
attgaggtcccagaaaggactg

SEQ ID NO: 72329 - DNA, 22 bp, Homo sapiens
aagaaatgtgaatattgaatag

SEQ ID NO: 72330 - DNA, 22 bp, Homo sapiens
actgggccaggtgtgggtgagt

SEQ ID NO: 72331 - DNA, 22 bp, Homo sapiens
aatatttcttctaaagcccttt

SEQ ID NO: 72332 - DNA, 22 bp, Homo sapiens
tcactgcactccagcctgggca

SEQ ID NO: 72333 - DNA, 22 bp, Homo sapiens
aagggcctgccagctcttcatg

SEQ ID NO: 72334 - DNA, 22 bp, Homo sapiens
attgtgaatagtgctgcaataa

SEQ ID NO: 72335 - DNA, 22 bp, Homo sapiens
ctgaagagaaagggagctcttc

SEQ ID NO: 72336 - DNA, 22 bp, Homo sapiens
tttcttcctgctttgtcccatg

SEQ ID NO: 72337 - DNA, 22 bp, Homo sapiens
attaattagagaggtgcctgtt

SEQ ID NO: 72338 - DNA, 22 bp, Homo sapiens
gactttctgatgtaaacattta

SEQ ID NO: 72339 - DNA, 19 bp, Homo sapiens
ctctggagtcattgctccc

SEQ ID NO: 72340 - DNA, 21 bp, Homo sapiens
caaaagagactgattcttgga

SEQ ID NO: 72341 - DNA, 22 bp, Homo sapiens
ccagactgcttgcttcccagcc

SEQ ID NO: 72342 - DNA, 22 bp, Homo sapiens
aggaggcagtctgtcccttagc

SEQ ID NO: 72343 - DNA, 22 bp, Homo sapiens
aggcttttctccagaatgtact

SEQ ID NO: 72344 - DNA, 21 bp, Homo sapiens
tcacgtggtcacatgagcttt

SEQ ID NO: 72345 - DNA, 22 bp, Homo sapiens
tggtattacttctagacacaag

SEQ ID NO: 72346 - DNA, 21 bp, Homo sapiens
agtggctctcagcttgctaag

SEQ ID NO: 72347 - DNA, 22 bp, Homo sapiens
cctccctgccggctggactagt

SEQ ID NO: 72348 - DNA, 22 bp, Homo sapiens
ataatctttcttttccagatag

SEQ ID NO: 72349 - DNA, 22 bp, Homo sapiens
ttgggctcaggagtttgagacc

SEQ ID NO: 72350 - DNA, 19 bp, Homo sapiens
acacagggatcagagggtt

SEQ ID NO: 72351 - DNA, 22 bp, Homo sapiens
attgtactctagcctctgggca

SEQ ID NO: 72352 - DNA, 22 bp, Homo sapiens
tgagggctgtctgaagcttggg

SEQ ID NO: 72353 - DNA, 22 bp, Homo sapiens
tgatatgggaaaagggctcgga

SEQ ID NO: 72354 - DNA, 22 bp, Homo sapiens
cctggaaagagaatgaatgagc

SEQ ID NO: 72355 - DNA, 23 bp, Homo sapiens
ggggcctgcaccggtctgcgcgg

SEQ ID NO: 72356 - DNA, 22 bp, Homo sapiens
tctaaattactttgggcagtat

SEQ ID NO: 72357 - DNA, 19 bp, Homo sapiens
gctgttaaggaccctcgga

SEQ ID NO: 72358 - DNA, 22 bp, Homo sapiens
agggaaattaatgtgagcaatg

SEQ ID NO: 72359 - DNA, 22 bp, Homo sapiens
atgttatgtctgggaaggggta

SEQ ID NO: 72360 - DNA, 22 bp, Homo sapiens
tcacatgtgtacagtcctccca

SEQ ID NO: 72361 - DNA, 22 bp, Homo sapiens
aaggatacttttagagcctgag

SEQ ID NO: 72362 - DNA, 22 bp, Homo sapiens
gcgggccaccttggagagcgct

SEQ ID NO: 72363 - DNA, 22 bp, Homo sapiens
gtggccaacctggccctgaact

SEQ ID NO: 72364 - DNA, 22 bp, Homo sapiens
agccacacagcttaatgacaga

SEQ ID NO: 72365 - DNA, 22 bp, Homo sapiens
cctggtgcaggtgtgttgccag

SEQ ID NO: 72366 - DNA, 22 bp, Homo sapiens
tggttcctcaagcgctggcggc

SEQ ID NO: 72367 - DNA, 22 bp, Homo sapiens
tgtgcctgttcccactttgcct

SEQ ID NO: 72368 - DNA, 22 bp, Homo sapiens
agggaagaggaccagagtctct

SEQ ID NO: 72369 - DNA, 22 bp, Homo sapiens
agagggatcaccctgtttctgg

SEQ ID NO: 72370 - DNA, 22 bp, Homo sapiens
atcttctcatgtgtaatgaggt

SEQ ID NO: 72371 - DNA, 22 bp, Homo sapiens
agagcacagggttttgtgccgg

SEQ ID NO: 72372 - DNA, 22 bp, Homo sapiens
aagtgattgttccgttgagtgt

SEQ ID NO: 72373 - DNA, 22 bp, Homo sapiens
atccccactgctgctggtgtag

SEQ ID NO: 72374 - DNA, 22 bp, Homo sapiens
gaggctgaggcggatggatcac

SEQ ID NO: 72375 - DNA, 22 bp, Homo sapiens
tagcacagagcttttaaacttc

SEQ ID NO: 72376 - DNA, 18 bp, Homo sapiens
gagtcgtcggagagtctg

SEQ ID NO: 72377 - DNA, 22 bp, Homo sapiens
caccgcggagtgatggagaaac

SEQ ID NO: 72378 - DNA, 18 bp, Homo sapiens
acttcccagatgagggga

SEQ ID NO: 72379 - DNA, 23 bp, Homo sapiens
agcaatctgtgtttcagcaagcc

SEQ ID NO: 72380 - DNA, 22 bp, Homo sapiens
cacttcaacctctgagtcctgg

SEQ ID NO: 72381 - DNA, 22 bp, Homo sapiens
tttcataatactgtacatgaaa

SEQ ID NO: 72382 - DNA, 22 bp, Homo sapiens
tcacatctaattccatttctgc

SEQ ID NO: 72383 - DNA, 22 bp, Homo sapiens
gtgaccatcatctcagctagtt

SEQ ID NO: 72384 - DNA, 22 bp, Homo sapiens
ttctgattgctgatgaggccca

SEQ ID NO: 72385 - DNA, 22 bp, Homo sapiens
ctttatgaaaacctgaattatg

SEQ ID NO: 72386 - DNA, 23 bp, Homo sapiens
cgcccagcctcagtgacctgggc

SEQ ID NO: 72387 - DNA, 22 bp, Homo sapiens
ttggagaggcagtcttgctctg

SEQ ID NO: 72388 - DNA, 22 bp, Homo sapiens
ctggcaggagcattcacagagg

SEQ ID NO: 72389 - DNA, 22 bp, Homo sapiens
ccgcgccacccattcccactga

SEQ ID NO: 72390 - DNA, 22 bp, Homo sapiens
acccgatgttggtgctctagta

SEQ ID NO: 72391 - DNA, 22 bp, Homo sapiens
cggggttcatccatgctgtggc

SEQ ID NO: 72392 - DNA, 22 bp, Homo sapiens
atggtcacaccactgtactcca

SEQ ID NO: 72393 - DNA, 22 bp, Homo sapiens
ctagcctgggatttgaacttat

SEQ ID NO: 72394 - DNA, 22 bp, Homo sapiens
ggcttgaagggaggaaagcagg

SEQ ID NO: 72395 - DNA, 22 bp, Homo sapiens
gagtcacatactatgtaataga

SEQ ID NO: 72396 - DNA, 22 bp, Homo sapiens
tgggaagaggggtataaagaag

SEQ ID NO: 72397 - DNA, 22 bp, Homo sapiens
ttgcccaggctggagtgcagtg

SEQ ID NO: 72398 - DNA, 22 bp, Homo sapiens
agtggctgagtgactgtgactc

SEQ ID NO: 72399 - DNA, 22 bp, Homo sapiens
ggggccttggatctgtgccccg

SEQ ID NO: 72400 - DNA, 22 bp, Homo sapiens
aacgcccagccttgatcaaatg

SEQ ID NO: 72401 - DNA, 22 bp, Homo sapiens
tacgcctgtaatcccagcactt

SEQ ID NO: 72402 - DNA, 22 bp, Homo sapiens
atgtggcaccgatctttagcca

SEQ ID NO: 72403 - DNA, 22 bp, Homo sapiens
tggagaagattggtcaccattc

SEQ ID NO: 72404 - DNA, 22 bp, Homo sapiens
gttactcttccccggggtctgg

SEQ ID NO: 72405 - DNA, 22 bp, Homo sapiens
ttagtttataattcatttctgt

SEQ ID NO: 72406 - DNA, 22 bp, Homo sapiens
atgccactgcacttcagcctgg

SEQ ID NO: 72407 - DNA, 22 bp, Homo sapiens
gcgagcctctggagtcctctgg

SEQ ID NO: 72408 - DNA, 22 bp, Homo sapiens
tcacccaggctggagtgtagtg

SEQ ID NO: 72409 - DNA, 23 bp, Homo sapiens
agagtgcagagatatgcttgtgt

SEQ ID NO: 72410 - DNA, 22 bp, Homo sapiens
cttttgtgattcctcagttact

SEQ ID NO: 72411 - DNA, 22 bp, Homo sapiens
gcagagctcatgcctgcacctc

SEQ ID NO: 72412 - DNA, 22 bp, Homo sapiens
ctgcagtctacctggattttta

SEQ ID NO: 72413 - DNA, 22 bp, Homo sapiens
tacaaaggaggtgcatagaaca

SEQ ID NO: 72414 - DNA, 22 bp, Homo sapiens
tgaggcaggagaatcacatgaa

SEQ ID NO: 72415 - DNA, 22 bp, Homo sapiens
agaggaagtaatcaggacctgc

SEQ ID NO: 72416 - DNA, 22 bp, Homo sapiens
cccaggaggtggaggctgcagt

SEQ ID NO: 72417 - DNA, 22 bp, Homo sapiens
tgggcttggtttctaggtaggt

SEQ ID NO: 72418 - DNA, 22 bp, Homo sapiens
tgtgaatggacaattaaatcta

SEQ ID NO: 72419 - DNA, 22 bp, Homo sapiens
gaggtgctgctgtacttcttgc

SEQ ID NO: 72420 - DNA, 16 bp, Homo sapiens
gcgcctcctcggcctc

SEQ ID NO: 72421 - DNA, 22 bp, Homo sapiens
tgtagatatagaaaaagactga

SEQ ID NO: 72422 - DNA, 22 bp, Homo sapiens
tgcgcctgtaagtccagagtcc

SEQ ID NO: 72423 - DNA, 22 bp, Homo sapiens
tggttaagtccagaaaggaagc

SEQ ID NO: 72424 - DNA, 22 bp, Homo sapiens
ccagactcatctgccattgctg

SEQ ID NO: 72425 - DNA, 22 bp, Homo sapiens
gaggttggggctgcagtgagct

SEQ ID NO: 72426 - DNA, 22 bp, Homo sapiens
gaggtggccaagcgaggaaggg

SEQ ID NO: 72427 - DNA, 22 bp, Homo sapiens
agggtggcactggtggctctat

SEQ ID NO: 72428 - DNA, 22 bp, Homo sapiens
cgagagagacatggtgacctgc

SEQ ID NO: 72429 - DNA, 22 bp, Homo sapiens
gggagaggttacccgagcaact

SEQ ID NO: 72430 - DNA, 22 bp, Homo sapiens
agatacattgcacgatgcagat

SEQ ID NO: 72431 - DNA, 22 bp, Homo sapiens
tctagcaagctcgtgctcaagg

SEQ ID NO: 72432 - DNA, 22 bp, Homo sapiens
ctgtggctctcagaggctgctg

SEQ ID NO: 72433 - DNA, 22 bp, Homo sapiens
gcataaactccaaaaggcaggg

SEQ ID NO: 72434 - DNA, 22 bp, Homo sapiens
tctcgacagcctggcacagtgg

SEQ ID NO: 72435 - DNA, 22 bp, Homo sapiens
ggtcacgtgaccgcacctgcct

SEQ ID NO: 72436 - DNA, 22 bp, Homo sapiens
tctccccagtatggattctctg

SEQ ID NO: 72437 - DNA, 22 bp, Homo sapiens
ggttttatcctacccacacagc

SEQ ID NO: 72438 - DNA, 22 bp, Homo sapiens
gcaccactacactccagcctgg

SEQ ID NO: 72439 - DNA, 22 bp, Homo sapiens
accgggaagtcctgcactgggc

SEQ ID NO: 72440 - DNA, 22 bp, Homo sapiens
tgtgactgaggctccaagctag

SEQ ID NO: 72441 - DNA, 18 bp, Homo sapiens
ccctcttgcacaaagcaa

SEQ ID NO: 72442 - DNA, 22 bp, Homo sapiens
cgattgtcatattctgttggat

SEQ ID NO: 72443 - DNA, 22 bp, Homo sapiens
gtccagttgtatgtccagtgtc

SEQ ID NO: 72444 - DNA, 18 bp, Homo sapiens
gcaagtgtctgtcccctt

SEQ ID NO: 72445 - DNA, 20 bp, Homo sapiens
ctgtggaattttaccatgcg

SEQ ID NO: 72446 - DNA, 22 bp, Homo sapiens
aggtctcttgctgtctctgggc

SEQ ID NO: 72447 - DNA, 22 bp, Homo sapiens
tgtgagttcttagaaagtcagt

SEQ ID NO: 72448 - DNA, 22 bp, Homo sapiens
tggatggctgtggtctttgccc

SEQ ID NO: 72449 - DNA, 22 bp, Homo sapiens
gtgctttgtcttcaggatcata

SEQ ID NO: 72450 - DNA, 22 bp, Homo sapiens
gctgctgggatcctgggtctca

SEQ ID NO: 72451 - DNA, 22 bp, Homo sapiens
atttcagtattatacaactgct

SEQ ID NO: 72452 - DNA, 18 bp, Homo sapiens
gaggtagataagattttc

SEQ ID NO: 72453 - DNA, 22 bp, Homo sapiens
gtgctcatagatgatgctcttt

SEQ ID NO: 72454 - DNA, 22 bp, Homo sapiens
tgggggctttatgtaatgcaca

SEQ ID NO: 72455 - DNA, 22 bp, Homo sapiens
ctgtaatcccagctacctggga

SEQ ID NO: 72456 - DNA, 22 bp, Homo sapiens
ccacgacgagtcatcagggcga

SEQ ID NO: 72457 - DNA, 21 bp, Homo sapiens
ttgctgttttcccaatgcagt

SEQ ID NO: 72458 - DNA, 22 bp, Homo sapiens
aacagtgctgttataaatgtac

SEQ ID NO: 72459 - DNA, 22 bp, Homo sapiens
tcctgggatcaagtgatcctcc

SEQ ID NO: 72460 - DNA, 22 bp, Homo sapiens
gtgtttggtcagacgtccgggg

SEQ ID NO: 72461 - DNA, 22 bp, Homo sapiens
taaatgttgtaagtacatctaa

SEQ ID NO: 72462 - DNA, 22 bp, Homo sapiens
gctcactgcctgggcaacaaga

SEQ ID NO: 72463 - DNA, 22 bp, Homo sapiens
aataaacaaaggacaaggaggt

SEQ ID NO: 72464 - DNA, 22 bp, Homo sapiens
ttatacagggagtttccctgca

SEQ ID NO: 72465 - DNA, 22 bp, Homo sapiens
aggaatgacagatgtccgcacc

SEQ ID NO: 72466 - DNA, 22 bp, Homo sapiens
tccaccaagccggggccacttc

SEQ ID NO: 72467 - DNA, 22 bp, Homo sapiens
ccagtgtgcattatcatgtgtc

SEQ ID NO: 72468 - DNA, 22 bp, Homo sapiens
tgggtgtccagaccctgcacat

SEQ ID NO: 72469 - DNA, 22 bp, Homo sapiens
gccgggtgcagcgggcccgcca

SEQ ID NO: 72470 - DNA, 22 bp, Homo sapiens
cacaaaccttctgcagcctgta

SEQ ID NO: 72471 - DNA, 23 bp, Homo sapiens
atgtttgcagtaacccatcctgg

SEQ ID NO: 72472 - DNA, 20 bp, Homo sapiens
tagcatgggtgagggtagag

SEQ ID NO: 72473 - DNA, 22 bp, Homo sapiens
cagcagcagtggctgcagaaca

SEQ ID NO: 72474 - DNA, 22 bp, Homo sapiens
tatcagtccagggttttgtgac

SEQ ID NO: 72475 - DNA, 22 bp, Homo sapiens
aagaagcaggtcacagacaggg

SEQ ID NO: 72476 - DNA, 18 bp, Homo sapiens
tcaagccattctcctgcc

SEQ ID NO: 72477 - DNA, 22 bp, Homo sapiens
gagtgcagtggcgtgatctctg

SEQ ID NO: 72478 - DNA, 22 bp, Homo sapiens
actctggccatcttggaccttg

SEQ ID NO: 72479 - DNA, 22 bp, Homo sapiens
tccaaacgggagccaaatgagc

SEQ ID NO: 72480 - DNA, 22 bp, Homo sapiens
agggaagcagcagccgcctgtc

SEQ ID NO: 72481 - DNA, 22 bp, Homo sapiens
catggggcccatgtgctccaag

SEQ ID NO: 72482 - DNA, 19 bp, Homo sapiens
cggtccatccgattttaca

SEQ ID NO: 72483 - DNA, 22 bp, Homo sapiens
gcgagtgccgagagggcagggc

SEQ ID NO: 72484 - DNA, 21 bp, Homo sapiens
tacaatgcacaggagagcctc

SEQ ID NO: 72485 - DNA, 22 bp, Homo sapiens
tggggaaaatgcttgtagtcag

SEQ ID NO: 72486 - DNA, 21 bp, Homo sapiens
tggtacaccttgcctgtcaga

SEQ ID NO: 72487 - DNA, 22 bp, Homo sapiens
tagtgtctcttcctgtttgaaa

SEQ ID NO: 72488 - DNA, 23 bp, Homo sapiens
ctcaccaagcgccgccgctgtgt

SEQ ID NO: 72489 - DNA, 22 bp, Homo sapiens
tgagctgtagcagatgctgttg

SEQ ID NO: 72490 - DNA, 23 bp, Homo sapiens
tgctggagaagcaaagttctgag

SEQ ID NO: 72491 - DNA, 22 bp, Homo sapiens
ggcaggaggtgagtggcgggtg

SEQ ID NO: 72492 - DNA, 22 bp, Homo sapiens
ccttgctcaagctagtgacggg

SEQ ID NO: 72493 - DNA, 22 bp, Homo sapiens
gcgagggcacgcggttgaaggc

SEQ ID NO: 72494 - DNA, 22 bp, Homo sapiens
ggaggcagaatagagtgtgggt

SEQ ID NO: 72495 - DNA, 22 bp, Homo sapiens
cacccaggctggagagcagtgg

SEQ ID NO: 72496 - DNA, 22 bp, Homo sapiens
acatgtttaagtttgttatatg

SEQ ID NO: 72497 - DNA, 22 bp, Homo sapiens
cacccaggctggattgcagtgg

SEQ ID NO: 72498 - DNA, 22 bp, Homo sapiens
tgggggtgtcctggtgcacaca

SEQ ID NO: 72499 - DNA, 22 bp, Homo sapiens
ggaggtggagctggaagttcca

SEQ ID NO: 72500 - DNA, 22 bp, Homo sapiens
tgttcttgagcctttagaccta

SEQ ID NO: 72501 - DNA, 21 bp, Homo sapiens
acataggcgaatgttcgggag

SEQ ID NO: 72502 - DNA, 22 bp, Homo sapiens
cagcgtctcgttgtgggcctcg

SEQ ID NO: 72503 - DNA, 22 bp, Homo sapiens
attgtgaataatgctgcaataa

SEQ ID NO: 72504 - DNA, 18 bp, Homo sapiens
acggatccgcgggaccgc

SEQ ID NO: 72505 - DNA, 22 bp, Homo sapiens
ttggcataccttagtggtggag

SEQ ID NO: 72506 - DNA, 22 bp, Homo sapiens
gctggcagacttcctctggaac

SEQ ID NO: 72507 - DNA, 22 bp, Homo sapiens
gtgttaaccagctaaactttgc

SEQ ID NO: 72508 - DNA, 20 bp, Homo sapiens
tgaggcccagcagagtcggg

SEQ ID NO: 72509 - DNA, 19 bp, Homo sapiens
tcattgtgctgagcaaggt

SEQ ID NO: 72510 - DNA, 22 bp, Homo sapiens
gctcttgtcaaaaattagttga

SEQ ID NO: 72511 - DNA, 22 bp, Homo sapiens
ctcctgagctctgaggaagctt

SEQ ID NO: 72512 - DNA, 22 bp, Homo sapiens
gggctagcctcttccctgctcc

SEQ ID NO: 72513 - DNA, 22 bp, Homo sapiens
cccatgcaccctctaagaagga

SEQ ID NO: 72514 - DNA, 22 bp, Homo sapiens
gctgtatgtttatttgggaatt

SEQ ID NO: 72515 - DNA, 22 bp, Homo sapiens
ccgggcctcgggacaccgggta

SEQ ID NO: 72516 - DNA, 22 bp, Homo sapiens
ctcagctgcagcctggctggca

SEQ ID NO: 72517 - DNA, 22 bp, Homo sapiens
gaagcctcaacatctctgcgtc

SEQ ID NO: 72518 - DNA, 22 bp, Homo sapiens
aaccagctaacatgtggaatga

SEQ ID NO: 72519 - DNA, 22 bp, Homo sapiens
atccccctgtatctggaagaat

SEQ ID NO: 72520 - DNA, 22 bp, Homo sapiens
tcagtgtgaattcaggagccta

SEQ ID NO: 72521 - DNA, 22 bp, Homo sapiens
cagtggaggccttgggaccttt

SEQ ID NO: 72522 - DNA, 21 bp, Homo sapiens
accaccctgtttatccagagg

SEQ ID NO: 72523 - DNA, 22 bp, Homo sapiens
aaggccttgccgaaggatgcca

SEQ ID NO: 72524 - DNA, 22 bp, Homo sapiens
cagagggttgatgtgaggctta

SEQ ID NO: 72525 - DNA, 17 bp, Homo sapiens
gaacttgttcactgtga

SEQ ID NO: 72526 - DNA, 22 bp, Homo sapiens
aggaagatgtgcaaagttggaa

SEQ ID NO: 72527 - DNA, 20 bp, Homo sapiens
tctcgcactcggagcagccg

SEQ ID NO: 72528 - DNA, 22 bp, Homo sapiens
tttgaggttagctagcagatca

SEQ ID NO: 72529 - DNA, 19 bp, Homo sapiens
gactcacaccttccgctgt

SEQ ID NO: 72530 - DNA, 22 bp, Homo sapiens
gtgggctgcccttgaggtcagc

SEQ ID NO: 72531 - DNA, 22 bp, Homo sapiens
gcttacaggtgaggcagcaaga

SEQ ID NO: 72532 - DNA, 22 bp, Homo sapiens
ttcaaagcagagggtcaataca

SEQ ID NO: 72533 - DNA, 20 bp, Homo sapiens
caagggtttgcattggcttt

SEQ ID NO: 72534 - DNA, 19 bp, Homo sapiens
gactccaactttaagcatg

SEQ ID NO: 72535 - DNA, 20 bp, Homo sapiens
tgcctataaagggccaggta

SEQ ID NO: 72536 - DNA, 22 bp, Homo sapiens
gactacaggccggcatcagaga

SEQ ID NO: 72537 - DNA, 22 bp, Homo sapiens
tccccagcttgctacttctgct

SEQ ID NO: 72538 - DNA, 22 bp, Homo sapiens
tggagccagcggcctgctgagg

SEQ ID NO: 72539 - DNA, 19 bp, Homo sapiens
ccctcttgcacaaagcaaa

SEQ ID NO: 72540 - DNA, 22 bp, Homo sapiens
gtggcttggaccagtcacagtg

SEQ ID NO: 72541 - DNA, 22 bp, Homo sapiens
gaaggaccctctggggtctcag

SEQ ID NO: 72542 - DNA, 22 bp, Homo sapiens
acccccaagaggggccttcagc

SEQ ID NO: 72543 - DNA, 22 bp, Homo sapiens
tcaaatgaagacagttgacttg

SEQ ID NO: 72544 - DNA, 22 bp, Homo sapiens
gcggggttccgtgccccagagt

SEQ ID NO: 72545 - DNA, 22 bp, Homo sapiens
tcagtggagagcttccaggatt

SEQ ID NO: 72546 - DNA, 22 bp, Homo sapiens
tttcttctatgtgtgatatttt

SEQ ID NO: 72547 - DNA, 22 bp, Homo sapiens
acaattctgatggtttcccagt

SEQ ID NO: 72548 - DNA, 22 bp, Homo sapiens
tatactacgcaccaaacaaagg

SEQ ID NO: 72549 - DNA, 22 bp, Homo sapiens
cagaggtagcatgctgtggctt

SEQ ID NO: 72550 - DNA, 22 bp, Homo sapiens
cagcagagaaattacatatttg

SEQ ID NO: 72551 - DNA, 22 bp, Homo sapiens
acccacgaagatgagcggcatg

SEQ ID NO: 72552 - DNA, 22 bp, Homo sapiens
gcgtctcaaggcccccaggcca

SEQ ID NO: 72553 - DNA, 22 bp, Homo sapiens
cagtcacaagcgtacctaattt

SEQ ID NO: 72554 - DNA, 22 bp, Homo sapiens
agtccctctgggagcaggactg

SEQ ID NO: 72555 - DNA, 22 bp, Homo sapiens
agaggtgagtcattacctagtg

SEQ ID NO: 72556 - DNA, 22 bp, Homo sapiens
aatggcactttataaatgttaa

SEQ ID NO: 72557 - DNA, 22 bp, Homo sapiens
actgccaatggtagtttgatgg

SEQ ID NO: 72558 - DNA, 22 bp, Homo sapiens
tgggggagctcagtccagccca

SEQ ID NO: 72559 - DNA, 22 bp, Homo sapiens
cacactgtctttatgagctgta

SEQ ID NO: 72560 - DNA, 22 bp, Homo sapiens
cggagccagaggctggagaggc

SEQ ID NO: 72561 - DNA, 22 bp, Homo sapiens
tattggccgggcgcggtggctc

SEQ ID NO: 72562 - DNA, 22 bp, Homo sapiens
gcacatgaggctgtctttgtct

SEQ ID NO: 72563 - DNA, 22 bp, Homo sapiens
agtcttagaactacagtgccta

SEQ ID NO: 72564 - DNA, 22 bp, Homo sapiens
ctcccggctgctccggctcccg

SEQ ID NO: 72565 - DNA, 22 bp, Homo sapiens
tccgatgcttccagggccacct

SEQ ID NO: 72566 - DNA, 22 bp, Homo sapiens
acccaggccattggcaagagtc

SEQ ID NO: 72567 - DNA, 19 bp, Homo sapiens
agccccttggtactgtcct

SEQ ID NO: 72568 - DNA, 22 bp, Homo sapiens
cccaggaggcagaagttgcagt

SEQ ID NO: 72569 - DNA, 19 bp, Homo sapiens
aggaatggaattaattctg

SEQ ID NO: 72570 - DNA, 22 bp, Homo sapiens
gctcactgcaagctctgcctcc

SEQ ID NO: 72571 - DNA, 22 bp, Homo sapiens
aacttgatcctgctgggtacta

SEQ ID NO: 72572 - DNA, 22 bp, Homo sapiens
gttaagtgagggcttttgagtc

SEQ ID NO: 72573 - DNA, 22 bp, Homo sapiens
ttctatttttgtggaactgtag

SEQ ID NO: 72574 - DNA, 22 bp, Homo sapiens
cttggtgccacagcagcttgcg

SEQ ID NO: 72575 - DNA, 22 bp, Homo sapiens
gcttcttgcctgtgtagagaat

SEQ ID NO: 72576 - DNA, 22 bp, Homo sapiens
gcggcccgagcaggacgggtgg

SEQ ID NO: 72577 - DNA, 22 bp, Homo sapiens
tgagtggacacctgcttcttta

SEQ ID NO: 72578 - DNA, 22 bp, Homo sapiens
ctgctcttgagggactgcggtc

SEQ ID NO: 72579 - DNA, 22 bp, Homo sapiens
acaaagtgaattgcatcgagtt

SEQ ID NO: 72580 - DNA, 22 bp, Homo sapiens
acatctagactcttgccctctt

SEQ ID NO: 72581 - DNA, 22 bp, Homo sapiens
tttaatcaggcaaagcataata

SEQ ID NO: 72582 - DNA, 22 bp, Homo sapiens
actctccttttgatcttcagaa

SEQ ID NO: 72583 - DNA, 22 bp, Homo sapiens
tgtaccgcaaatgctgctgcct

SEQ ID NO: 72584 - DNA, 22 bp, Homo sapiens
acagttaataagtagtaagtca

SEQ ID NO: 72585 - DNA, 22 bp, Homo sapiens
gggtaggcaaagcaatgacgtt

SEQ ID NO: 72586 - DNA, 22 bp, Homo sapiens
cagggccagcgtctcgggctat

SEQ ID NO: 72587 - DNA, 22 bp, Homo sapiens
cttctttcaagaatggattagg

SEQ ID NO: 72588 - DNA, 22 bp, Homo sapiens
taggatttaataaaagaataga

SEQ ID NO: 72589 - DNA, 22 bp, Homo sapiens
tggcccgaagatccgagggtca

SEQ ID NO: 72590 - DNA, 22 bp, Homo sapiens
agagcccctgggtcacacagcc

SEQ ID NO: 72591 - DNA, 22 bp, Homo sapiens
tcttttgtgattcttcagttac

SEQ ID NO: 72592 - DNA, 23 bp, Homo sapiens
gtctctagagtgtggagcaaaga

SEQ ID NO: 72593 - DNA, 23 bp, Homo sapiens
agaaagtcatggccaggtttgat

SEQ ID NO: 72594 - DNA, 22 bp, Homo sapiens
caaagtgctggaattacaggtg

SEQ ID NO: 72595 - DNA, 22 bp, Homo sapiens
cctacagttatattcttgattg

SEQ ID NO: 72596 - DNA, 22 bp, Homo sapiens
gggccggagctgggtcccgcgc

SEQ ID NO: 72597 - DNA, 22 bp, Homo sapiens
catgcacttacctgaaattcaa

SEQ ID NO: 72598 - DNA, 22 bp, Homo sapiens
gaaactctcgcatcctgggaac

SEQ ID NO: 72599 - DNA, 22 bp, Homo sapiens
ttaggtattttgttatgtcagc

SEQ ID NO: 72600 - DNA, 22 bp, Homo sapiens
gcgggttgaagggcgcatcgaa

SEQ ID NO: 72601 - DNA, 22 bp, Homo sapiens
aaagtgctgggattacaggcgt

SEQ ID NO: 72602 - DNA, 22 bp, Homo sapiens
aaagtgctgagattacaagcgt

SEQ ID NO: 72603 - DNA, 22 bp, Homo sapiens
aagagggaaattgttggctgct

SEQ ID NO: 72604 - DNA, 22 bp, Homo sapiens
atgtcttctctgtaggtaaatt

SEQ ID NO: 72605 - DNA, 22 bp, Homo sapiens
tgccatagcaatggtaagctga

SEQ ID NO: 72606 - DNA, 22 bp, Homo sapiens
ggcaaggggtcaggctgagaca

SEQ ID NO: 72607 - DNA, 22 bp, Homo sapiens
tggggtacacgtggggcaggat

SEQ ID NO: 72608 - DNA, 22 bp, Homo sapiens
caggggcgggtaaaaggcctcc

SEQ ID NO: 72609 - DNA, 22 bp, Homo sapiens
tggccttggccgtgctggggtc

SEQ ID NO: 72610 - DNA, 22 bp, Homo sapiens
gtgctgatgttgcttcccttgg

SEQ ID NO: 72611 - DNA, 22 bp, Homo sapiens
gcccaggagttcaagtctagtg

SEQ ID NO: 72612 - DNA, 22 bp, Homo sapiens
gctgctttggaaagcatggaaa

SEQ ID NO: 72613 - DNA, 22 bp, Homo sapiens
tccattatacttctgattcaaa

SEQ ID NO: 72614 - DNA, 22 bp, Homo sapiens
gcaggtccagtcaccagagaga

SEQ ID NO: 72615 - DNA, 22 bp, Homo sapiens
tagagagtcgggaacttacctg

SEQ ID NO: 72616 - DNA, 22 bp, Homo sapiens
tgtgcctactgatagagccaag

SEQ ID NO: 72617 - DNA, 22 bp, Homo sapiens
tcttgaattgtactcccataag

SEQ ID NO: 72618 - DNA, 22 bp, Homo sapiens
gtggatggagctggaagccatt

SEQ ID NO: 72619 - DNA, 22 bp, Homo sapiens
gtgcgggcctgggggtttctct

SEQ ID NO: 72620 - DNA, 22 bp, Homo sapiens
gaatgcttggaacctgaagttc

SEQ ID NO: 72621 - DNA, 22 bp, Homo sapiens
ttgaaattttaggccttgcaat

SEQ ID NO: 72622 - DNA, 22 bp, Homo sapiens
tccaaggtcagcgagagtcact

SEQ ID NO: 72623 - DNA, 22 bp, Homo sapiens
ggatgttctggggttctcttgt

SEQ ID NO: 72624 - DNA, 22 bp, Homo sapiens
aaatgcctcattttctctcact

SEQ ID NO: 72625 - DNA, 22 bp, Homo sapiens
aactatgttaataagtttcatt

SEQ ID NO: 72626 - DNA, 22 bp, Homo sapiens
aggggaccaaaatgtcctgcct

SEQ ID NO: 72627 - DNA, 22 bp, Homo sapiens
acggtgaccaagcatcaccgag

SEQ ID NO: 72628 - DNA, 22 bp, Homo sapiens
gtgtctcttagcctgctaatgc

SEQ ID NO: 72629 - DNA, 22 bp, Homo sapiens
gggctgtaggagctggaatggg

SEQ ID NO: 72630 - DNA, 22 bp, Homo sapiens
ggacacgtggctgaaggcggcc

SEQ ID NO: 72631 - DNA, 22 bp, Homo sapiens
aagaggagaaaggctggctttg

SEQ ID NO: 72632 - DNA, 22 bp, Homo sapiens
atggagttctgccagcgctgct

SEQ ID NO: 72633 - DNA, 22 bp, Homo sapiens
ggctagggatctagaccaggac

SEQ ID NO: 72634 - DNA, 22 bp, Homo sapiens
gtcctggggattatagagtgtt

SEQ ID NO: 72635 - DNA, 22 bp, Homo sapiens
cactgcactccagcctgggaga

SEQ ID NO: 72636 - DNA, 22 bp, Homo sapiens
aggtattattagcatctctatt

SEQ ID NO: 72637 - DNA, 19 bp, Homo sapiens
tctgaagaattagagagca

SEQ ID NO: 72638 - DNA, 22 bp, Homo sapiens
attaagtgactaaagtaatgct

SEQ ID NO: 72639 - DNA, 22 bp, Homo sapiens
attgcactccagcctgggtgac

SEQ ID NO: 72640 - DNA, 22 bp, Homo sapiens
tcaagcaattctcctgcctcag

SEQ ID NO: 72641 - DNA, 22 bp, Homo sapiens
atgattgaaaatgacattgcca

SEQ ID NO: 72642 - DNA, 18 bp, Homo sapiens
ttgcttcttttctctagg

SEQ ID NO: 72643 - DNA, 22 bp, Homo sapiens
agatgctgctccacaggccagg

SEQ ID NO: 72644 - DNA, 22 bp, Homo sapiens
agagcactttcgagagccggag

SEQ ID NO: 72645 - DNA, 22 bp, Homo sapiens
tccttaggaaaatgatgagggg

SEQ ID NO: 72646 - DNA, 22 bp, Homo sapiens
cagggtgacaagtggcaaggag

SEQ ID NO: 72647 - DNA, 23 bp, Homo sapiens
gctcatcaggcttagagtcaagg

SEQ ID NO: 72648 - DNA, 22 bp, Homo sapiens
gaacactgctgttgggttctga

SEQ ID NO: 72649 - DNA, 22 bp, Homo sapiens
agagcacagccaccatttacaa

SEQ ID NO: 72650 - DNA, 19 bp, Homo sapiens
gagcagtgaggaccaccag

SEQ ID NO: 72651 - DNA, 22 bp, Homo sapiens
tacaaaaaattgatactgacga

SEQ ID NO: 72652 - DNA, 22 bp, Homo sapiens
gtctgaatacgtacttgtgaag

SEQ ID NO: 72653 - DNA, 22 bp, Homo sapiens
gggaagtgagctggaatcaagg

SEQ ID NO: 72654 - DNA, 22 bp, Homo sapiens
gcttctggtgaggcctcaggaa

SEQ ID NO: 72655 - DNA, 22 bp, Homo sapiens
cttgcctacttgtcaaccagca

SEQ ID NO: 72656 - DNA, 22 bp, Homo sapiens
ggagtgaatcactagatgcaga

SEQ ID NO: 72657 - DNA, 22 bp, Homo sapiens
agacgcggtggtgcatgcctgt

SEQ ID NO: 72658 - DNA, 22 bp, Homo sapiens
taggctaggctgaaggttttgg

SEQ ID NO: 72659 - DNA, 17 bp, Homo sapiens
cagtcgaggaggacctg

SEQ ID NO: 72660 - DNA, 22 bp, Homo sapiens
ttttctaacatctagtaatttg

SEQ ID NO: 72661 - DNA, 22 bp, Homo sapiens
acatggcgggagtttcagatac

SEQ ID NO: 72662 - DNA, 22 bp, Homo sapiens
tctgcaccatcgtatgcttaat

SEQ ID NO: 72663 - DNA, 22 bp, Homo sapiens
cttatttgcccatgtttcttta

SEQ ID NO: 72664 - DNA, 22 bp, Homo sapiens
ctgctcctgtccagcagggcca

SEQ ID NO: 72665 - DNA, 22 bp, Homo sapiens
ggttcagggctaccagtgggtg

SEQ ID NO: 72666 - DNA, 22 bp, Homo sapiens
cagagctgtccaaaccctgaca

SEQ ID NO: 72667 - DNA, 22 bp, Homo sapiens
aggtggagaagagatgggcagt

SEQ ID NO: 72668 - DNA, 22 bp, Homo sapiens
tcctcagtcacggtagcacatt

SEQ ID NO: 72669 - DNA, 22 bp, Homo sapiens
tgaaggggttcagcatgggggt

SEQ ID NO: 72670 - DNA, 22 bp, Homo sapiens
aaaactacatttgacattttgt

SEQ ID NO: 72671 - DNA, 22 bp, Homo sapiens
gtggcccatcacgtttcgcctt

SEQ ID NO: 72672 - DNA, 22 bp, Homo sapiens
aatgcaatgcagcacctccttg

SEQ ID NO: 72673 - DNA, 23 bp, Homo sapiens
gtatacgtgcaagtcacagggga

SEQ ID NO: 72674 - DNA, 22 bp, Homo sapiens
aaaactgaaatacgatccaatg

SEQ ID NO: 72675 - DNA, 22 bp, Homo sapiens
gcccaggctggagtgcagtggc

SEQ ID NO: 72676 - DNA, 22 bp, Homo sapiens
aggtcaccatggcatgctccac

SEQ ID NO: 72677 - DNA, 22 bp, Homo sapiens
ctgcttctccctgagatagtgt

SEQ ID NO: 72678 - DNA, 22 bp, Homo sapiens
ttccttacattcatatggcttc

SEQ ID NO: 72679 - DNA, 22 bp, Homo sapiens
gggacttcatagctaggcactt

SEQ ID NO: 72680 - DNA, 18 bp, Homo sapiens
ggaaaaggagtgtctagc

SEQ ID NO: 72681 - DNA, 22 bp, Homo sapiens
ttgctttcccaaggcagaacat

SEQ ID NO: 72682 - DNA, 22 bp, Homo sapiens
ggtcgagtcacttgttgccttt

SEQ ID NO: 72683 - DNA, 22 bp, Homo sapiens
attgcaggctctgacaccaggc

SEQ ID NO: 72684 - DNA, 22 bp, Homo sapiens
tgaagactcagaagctaagata

SEQ ID NO: 72685 - DNA, 22 bp, Homo sapiens
ccaggctggagtgcaatggcat

SEQ ID NO: 72686 - DNA, 22 bp, Homo sapiens
ggcagagcttgcagtgagccga

SEQ ID NO: 72687 - DNA, 22 bp, Homo sapiens
gtatagaaacccagaaagatag

SEQ ID NO: 72688 - DNA, 22 bp, Homo sapiens
tgacagaggagctggaatgatt

SEQ ID NO: 72689 - DNA, 21 bp, Homo sapiens
tatcagagacattgagaggca

SEQ ID NO: 72690 - DNA, 22 bp, Homo sapiens
aggacgctctcgctgaacttct

SEQ ID NO: 72691 - DNA, 22 bp, Homo sapiens
tagcccctgcctttgaacctgg

SEQ ID NO: 72692 - DNA, 22 bp, Homo sapiens
aagggggcggcagccagtggaa

SEQ ID NO: 72693 - DNA, 22 bp, Homo sapiens
gctctagtaggaatgtccctct

SEQ ID NO: 72694 - DNA, 22 bp, Homo sapiens
tgcgcgccagctcccaggttcg

SEQ ID NO: 72695 - DNA, 21 bp, Homo sapiens
accctgctttatgccgtcctc

SEQ ID NO: 72696 - DNA, 22 bp, Homo sapiens
cttcccaccaaagcccttgttg

SEQ ID NO: 72697 - DNA, 22 bp, Homo sapiens
ctgtgctccctctggcgccccg

SEQ ID NO: 72698 - DNA, 22 bp, Homo sapiens
tgaggcaggaggattgcaggat

SEQ ID NO: 72699 - DNA, 22 bp, Homo sapiens
gatattcctgaaggacagggtt

SEQ ID NO: 72700 - DNA, 22 bp, Homo sapiens
atcatccaagcgtagttcttct

SEQ ID NO: 72701 - DNA, 22 bp, Homo sapiens
gacctggtccttgtactttgaa

SEQ ID NO: 72702 - DNA, 22 bp, Homo sapiens
gccttgccgctcagcagtgggg

SEQ ID NO: 72703 - DNA, 22 bp, Homo sapiens
tgggcgacagagcaagactccg

SEQ ID NO: 72704 - DNA, 22 bp, Homo sapiens
gctatgggatgtgctgtggatg

SEQ ID NO: 72705 - DNA, 22 bp, Homo sapiens
tcctgagataaatctcatgtga

SEQ ID NO: 72706 - DNA, 22 bp, Homo sapiens
cctctgtgtgatgcgcaaagta

SEQ ID NO: 72707 - DNA, 22 bp, Homo sapiens
gtattgcttgagcccaggagtt

SEQ ID NO: 72708 - DNA, 22 bp, Homo sapiens
aggggaatgggtagactgttga

SEQ ID NO: 72709 - DNA, 22 bp, Homo sapiens
gtaggccatggtggttgtctct

SEQ ID NO: 72710 - DNA, 22 bp, Homo sapiens
agaggacagagtgctggattta

SEQ ID NO: 72711 - DNA, 22 bp, Homo sapiens
ctggcaagaaatatatatctta

SEQ ID NO: 72712 - DNA, 22 bp, Homo sapiens
agtggaccagaagactgaagct

SEQ ID NO: 72713 - DNA, 22 bp, Homo sapiens
tgggatgctcagggcctggagc

SEQ ID NO: 72714 - DNA, 20 bp, Homo sapiens
aaactaaaggtgtttggttt

SEQ ID NO: 72715 - DNA, 22 bp, Homo sapiens
tggcatctttgtcccagaagct

SEQ ID NO: 72716 - DNA, 22 bp, Homo sapiens
tgtcatctgcgggtggcactgc

SEQ ID NO: 72717 - DNA, 22 bp, Homo sapiens
tactgtgtgcccagccgagctg

SEQ ID NO: 72718 - DNA, 22 bp, Homo sapiens
gactgtggggaagcagatgcca

SEQ ID NO: 72719 - DNA, 22 bp, Homo sapiens
agcatggccatctgggccgtcc

SEQ ID NO: 72720 - DNA, 22 bp, Homo sapiens
gaatatcccgctatgcaaagta

SEQ ID NO: 72721 - DNA, 22 bp, Homo sapiens
agaatagaattctcatagaatt

SEQ ID NO: 72722 - DNA, 22 bp, Homo sapiens
ttcatagtgtttccttccagtg

SEQ ID NO: 72723 - DNA, 22 bp, Homo sapiens
tactgcgccttcaccaagcggc

SEQ ID NO: 72724 - DNA, 22 bp, Homo sapiens
ctgggcacagcgttgggctctt

SEQ ID NO: 72725 - DNA, 22 bp, Homo sapiens
ccctttagcccctgcagagact

SEQ ID NO: 72726 - DNA, 22 bp, Homo sapiens
aaccaccattctctcctcttcc

SEQ ID NO: 72727 - DNA, 22 bp, Homo sapiens
tgacagtattgatggcaggatt

SEQ ID NO: 72728 - DNA, 22 bp, Homo sapiens
gtgtggtcgaagttctcccgga

SEQ ID NO: 72729 - DNA, 22 bp, Homo sapiens
agcgctgtgggcgtgcgaggag

SEQ ID NO: 72730 - DNA, 22 bp, Homo sapiens
gatgcacggtcatgtcttttca

SEQ ID NO: 72731 - DNA, 22 bp, Homo sapiens
tcatctaagagtcttacattta

SEQ ID NO: 72732 - DNA, 22 bp, Homo sapiens
gctgtggcctggcgcagagctg

SEQ ID NO: 72733 - DNA, 22 bp, Homo sapiens
tggtggctcacgtctgtaatct

SEQ ID NO: 72734 - DNA, 22 bp, Homo sapiens
ctcagccccagcccagatagca

SEQ ID NO: 72735 - DNA, 21 bp, Homo sapiens
gacattgagcgtgtcgcagtg

SEQ ID NO: 72736 - DNA, 22 bp, Homo sapiens
ggccgtgctccaaagtcatcgt

SEQ ID NO: 72737 - DNA, 22 bp, Homo sapiens
ccccatcatctttgaggtcatt

SEQ ID NO: 72738 - DNA, 22 bp, Homo sapiens
gaatttaagaggatgaatctgt

SEQ ID NO: 72739 - DNA, 22 bp, Homo sapiens
gggagtgggtttggcctaggcc

SEQ ID NO: 72740 - DNA, 22 bp, Homo sapiens
tttgatccgttgctggtgagga

SEQ ID NO: 72741 - DNA, 22 bp, Homo sapiens
gcctgcagggcctgggcctacc

SEQ ID NO: 72742 - DNA, 19 bp, Homo sapiens
caggcctcttaccctctct

SEQ ID NO: 72743 - DNA, 22 bp, Homo sapiens
gccagtgcctcgccgcgctcct

SEQ ID NO: 72744 - DNA, 22 bp, Homo sapiens
gtggattacaagacagttgaga

SEQ ID NO: 72745 - DNA, 22 bp, Homo sapiens
agtatgtcagagtgaaaatggt

SEQ ID NO: 72746 - DNA, 20 bp, Homo sapiens
tggcctctgagatgccacgg

SEQ ID NO: 72747 - DNA, 22 bp, Homo sapiens
ggaactgaatgtctcggtataa

SEQ ID NO: 72748 - DNA, 22 bp, Homo sapiens
cccaggaggcggaggttgcagt

SEQ ID NO: 72749 - DNA, 22 bp, Homo sapiens
aatgctctttaacctattctga

SEQ ID NO: 72750 - DNA, 22 bp, Homo sapiens
gtgagatggagttggtgtcttt

SEQ ID NO: 72751 - DNA, 22 bp, Homo sapiens
ctcctctttagccccagctgga

SEQ ID NO: 72752 - DNA, 22 bp, Homo sapiens
ggagctcctggcagtgacagag

SEQ ID NO: 72753 - DNA, 22 bp, Homo sapiens
ctcagggccaaggatgctgttg

SEQ ID NO: 72754 - DNA, 22 bp, Homo sapiens
gaaaggatttggtgccaagcgt

SEQ ID NO: 72755 - DNA, 22 bp, Homo sapiens
aaagttctctatggtgtaaaaa

SEQ ID NO: 72756 - DNA, 22 bp, Homo sapiens
ttttgcaatgagatgcttgtca

SEQ ID NO: 72757 - DNA, 22 bp, Homo sapiens
ggccaattccaggagccggcgg

SEQ ID NO: 72758 - DNA, 22 bp, Homo sapiens
gtagtcccagctaccccggagg

SEQ ID NO: 72759 - DNA, 22 bp, Homo sapiens
catggcactgagcaggtatgca

SEQ ID NO: 72760 - DNA, 22 bp, Homo sapiens
gaccttgtgatccgcccgcctt

SEQ ID NO: 72761 - DNA, 22 bp, Homo sapiens
caagattaccaaggaccagcgg

SEQ ID NO: 72762 - DNA, 22 bp, Homo sapiens
tgggaggtgattaaattatggg

SEQ ID NO: 72763 - DNA, 22 bp, Homo sapiens
gccatgcttggtatgctgtgag

SEQ ID NO: 72764 - DNA, 22 bp, Homo sapiens
gaccggttctgccgtggactgg

SEQ ID NO: 72765 - DNA, 22 bp, Homo sapiens
cctgagagcattccacactgaa

SEQ ID NO: 72766 - DNA, 22 bp, Homo sapiens
cgtgcgcctcagcctcgtgcgc

SEQ ID NO: 72767 - DNA, 22 bp, Homo sapiens
gttgaggtgatgccagccctgc

SEQ ID NO: 72768 - DNA, 22 bp, Homo sapiens
ccgtggtcacctgagctccttg

SEQ ID NO: 72769 - DNA, 22 bp, Homo sapiens
ggtgtccacattccctggcagg

SEQ ID NO: 72770 - DNA, 22 bp, Homo sapiens
ctgaggcctctcccactccagc

SEQ ID NO: 72771 - DNA, 22 bp, Homo sapiens
gctggaaatgattaaatggtga

SEQ ID NO: 72772 - DNA, 22 bp, Homo sapiens
tgagccaagttcacaccattgc

SEQ ID NO: 72773 - DNA, 22 bp, Homo sapiens
aagcacaatgaacatcttagat

SEQ ID NO: 72774 - DNA, 22 bp, Homo sapiens
gtctatgatattttgttatagc

SEQ ID NO: 72775 - DNA, 22 bp, Homo sapiens
gggcaggaacaaatcaaatgat

SEQ ID NO: 72776 - DNA, 22 bp, Homo sapiens
taagagaccgatattcttaagt

SEQ ID NO: 72777 - DNA, 22 bp, Homo sapiens
taggtcagaacaagcagtatcg

SEQ ID NO: 72778 - DNA, 17 bp, Homo sapiens
cttcccaccatctcctg

SEQ ID NO: 72779 - DNA, 22 bp, Homo sapiens
tatgccgcagccggatttcccc

SEQ ID NO: 72780 - DNA, 22 bp, Homo sapiens
tcaagcaaagtttagctggtta

SEQ ID NO: 72781 - DNA, 22 bp, Homo sapiens
ccctcccggcgtgctgggctcg

SEQ ID NO: 72782 - DNA, 22 bp, Homo sapiens
agacccaggattggggctgccg

SEQ ID NO: 72783 - DNA, 22 bp, Homo sapiens
atcagagtgtaagttctttcct

SEQ ID NO: 72784 - DNA, 22 bp, Homo sapiens
ggttggacactaggtaggagcg

SEQ ID NO: 72785 - DNA, 22 bp, Homo sapiens
cagctgcccctccagggctggg

SEQ ID NO: 72786 - DNA, 22 bp, Homo sapiens
cctctgtgtctccaagaggcct

SEQ ID NO: 72787 - DNA, 18 bp, Homo sapiens
ctgtaccaccctgagggc

SEQ ID NO: 72788 - DNA, 22 bp, Homo sapiens
tgggaacagaggacttgactgt

SEQ ID NO: 72789 - DNA, 22 bp, Homo sapiens
ctgtcctgccagtcctggactc

SEQ ID NO: 72790 - DNA, 17 bp, Homo sapiens
gcccgtgggctacggta

SEQ ID NO: 72791 - DNA, 22 bp, Homo sapiens
ttttggccacatccttttgagt

SEQ ID NO: 72792 - DNA, 20 bp, Homo sapiens
ttcaggaataagatagcagc

SEQ ID NO: 72793 - DNA, 22 bp, Homo sapiens
tggctcatttctaaacccagct

SEQ ID NO: 72794 - DNA, 22 bp, Homo sapiens
taacaaagtattgtttgtgtat

SEQ ID NO: 72795 - DNA, 22 bp, Homo sapiens
agctggtgtgccagttccagtt

SEQ ID NO: 72796 - DNA, 22 bp, Homo sapiens
tgtctgggagactgatcacccg

SEQ ID NO: 72797 - DNA, 22 bp, Homo sapiens
cagagactggagtgcagtggcg

SEQ ID NO: 72798 - DNA, 22 bp, Homo sapiens
gtcctcgcggcgcgaagccagt

SEQ ID NO: 72799 - DNA, 20 bp, Homo sapiens
aggaaaaatggaaactggag

SEQ ID NO: 72800 - DNA, 22 bp, Homo sapiens
tttttagtagaggtgggtttca

SEQ ID NO: 72801 - DNA, 22 bp, Homo sapiens
tgttatctgagcaacgtcgacg

SEQ ID NO: 72802 - DNA, 22 bp, Homo sapiens
gagccaagattgtgtccctgca

SEQ ID NO: 72803 - DNA, 22 bp, Homo sapiens
tgacatttcctagtgctttgtg

SEQ ID NO: 72804 - DNA, 22 bp, Homo sapiens
tgtagatattaattattccttt

SEQ ID NO: 72805 - DNA, 22 bp, Homo sapiens
tcactgcacttcagcttgggca

SEQ ID NO: 72806 - DNA, 22 bp, Homo sapiens
atgccactgcactccagcctgg

SEQ ID NO: 72807 - DNA, 22 bp, Homo sapiens
cccagagcatgtgctgcctttg

SEQ ID NO: 72808 - DNA, 22 bp, Homo sapiens
tcgcgcccccaagcgtcattgg

SEQ ID NO: 72809 - DNA, 22 bp, Homo sapiens
atacaaagtattaatcctggat

SEQ ID NO: 72810 - DNA, 22 bp, Homo sapiens
catggcattgcataacggggct

SEQ ID NO: 72811 - DNA, 21 bp, Homo sapiens
ctggccactgcacctcttcct

SEQ ID NO: 72812 - DNA, 22 bp, Homo sapiens
atcggcaagccccacaccgtcc

SEQ ID NO: 72813 - DNA, 22 bp, Homo sapiens
ttcctgttcaggaaagttgtgt

SEQ ID NO: 72814 - DNA, 22 bp, Homo sapiens
cctcctgcacctccaggaactc

SEQ ID NO: 72815 - DNA, 22 bp, Homo sapiens
caatttctaacattccatggat

SEQ ID NO: 72816 - DNA, 21 bp, Homo sapiens
tgactgaggcttcttcacaca

SEQ ID NO: 72817 - DNA, 22 bp, Homo sapiens
tcaccttgtgatctccctgcct

SEQ ID NO: 72818 - DNA, 22 bp, Homo sapiens
ggatgttgattgaatggccatt

SEQ ID NO: 72819 - DNA, 22 bp, Homo sapiens
tgctagtgtgtgagatgttcaa

SEQ ID NO: 72820 - DNA, 22 bp, Homo sapiens
catgagataatttttctccagt

SEQ ID NO: 72821 - DNA, 22 bp, Homo sapiens
acactccagggagggagggaat

SEQ ID NO: 72822 - DNA, 22 bp, Homo sapiens
aaggcggaggttgcagtgagct

SEQ ID NO: 72823 - DNA, 22 bp, Homo sapiens
tgtccaggctggagtgcagtgg

SEQ ID NO: 72824 - DNA, 22 bp, Homo sapiens
cggtctcccgtgtgtgtgcgct

SEQ ID NO: 72825 - DNA, 22 bp, Homo sapiens
tgagatggagtctcactctgtt

SEQ ID NO: 72826 - DNA, 22 bp, Homo sapiens
ctctcagtcctgcgcgcctctg

SEQ ID NO: 72827 - DNA, 22 bp, Homo sapiens
ggcttcagtggccagagatgat

SEQ ID NO: 72828 - DNA, 17 bp, Homo sapiens
tgcatgtcctttgttcc

SEQ ID NO: 72829 - DNA, 22 bp, Homo sapiens
gggctgagacgatggggtcttc

SEQ ID NO: 72830 - DNA, 23 bp, Homo sapiens
cagggccctgctcaatttctcca

SEQ ID NO: 72831 - DNA, 22 bp, Homo sapiens
ccaggctggagtgcagtggcac

SEQ ID NO: 72832 - DNA, 22 bp, Homo sapiens
gagacgtggcctttgcctgagc

SEQ ID NO: 72833 - DNA, 21 bp, Homo sapiens
tggacttatggagtgtttctt

SEQ ID NO: 72834 - DNA, 22 bp, Homo sapiens
atgggctgtccattgctggctg

SEQ ID NO: 72835 - DNA, 22 bp, Homo sapiens
atcattatcctcctatttgcct

SEQ ID NO: 72836 - DNA, 22 bp, Homo sapiens
tcccgtcttgctgttgtctgcg

SEQ ID NO: 72837 - DNA, 22 bp, Homo sapiens
cctcttcaggcactcgaaggcc

SEQ ID NO: 72838 - DNA, 21 bp, Homo sapiens
cagggccaatcctgacctcta

SEQ ID NO: 72839 - DNA, 22 bp, Homo sapiens
aacccaggagacaggttgcagt

SEQ ID NO: 72840 - DNA, 19 bp, Homo sapiens
gggcttggggctgaagcct

SEQ ID NO: 72841 - DNA, 22 bp, Homo sapiens
ggcagcactgcagcttgttggg

SEQ ID NO: 72842 - DNA, 22 bp, Homo sapiens
cacagtcctgccagagggcctt

SEQ ID NO: 72843 - DNA, 22 bp, Homo sapiens
gcggggggaggaacatcttgca

SEQ ID NO: 72844 - DNA, 20 bp, Homo sapiens
aagacaccagtggcagcccc

SEQ ID NO: 72845 - DNA, 22 bp, Homo sapiens
tctggtgtcagtattctttgaa

SEQ ID NO: 72846 - DNA, 20 bp, Homo sapiens
cgcccagtgcggttctgacc

SEQ ID NO: 72847 - DNA, 22 bp, Homo sapiens
ctcctgggaaaggctggacaca

SEQ ID NO: 72848 - DNA, 22 bp, Homo sapiens
tggggtgagattcagatattca

SEQ ID NO: 72849 - DNA, 22 bp, Homo sapiens
tcgtctgtgaaattgggataag

SEQ ID NO: 72850 - DNA, 17 bp, Homo sapiens
acctattgatctgtcac

SEQ ID NO: 72851 - DNA, 22 bp, Homo sapiens
taaggctatcttttgagtgtgt

SEQ ID NO: 72852 - DNA, 22 bp, Homo sapiens
ggtgcagaggagccagctgggg

SEQ ID NO: 72853 - DNA, 22 bp, Homo sapiens
atacaaagtattgatcctgagt

SEQ ID NO: 72854 - DNA, 22 bp, Homo sapiens
gtagggttggagagcacaacca

SEQ ID NO: 72855 - DNA, 22 bp, Homo sapiens
tgaacatgctgttgatggcctg

SEQ ID NO: 72856 - DNA, 22 bp, Homo sapiens
tcgggctcgctctcctagcgga

SEQ ID NO: 72857 - DNA, 22 bp, Homo sapiens
cccaggaggcctgcctggccgg

SEQ ID NO: 72858 - DNA, 22 bp, Homo sapiens
acactggttggttgaatttact

SEQ ID NO: 72859 - DNA, 22 bp, Homo sapiens
taccaccatttgcctgctgtat

SEQ ID NO: 72860 - DNA, 22 bp, Homo sapiens
ttttcagctaagtcacacgctg

SEQ ID NO: 72861 - DNA, 22 bp, Homo sapiens
caatccatcaattacacaggct

SEQ ID NO: 72862 - DNA, 22 bp, Homo sapiens
aaatgtaagtctttgtttctta

SEQ ID NO: 72863 - DNA, 22 bp, Homo sapiens
ttgctaccattgataccagcac

SEQ ID NO: 72864 - DNA, 22 bp, Homo sapiens
tagcgaggtgtttctaggactg

SEQ ID NO: 72865 - DNA, 22 bp, Homo sapiens
tgctgggggtagctctgcgtag

SEQ ID NO: 72866 - DNA, 22 bp, Homo sapiens
acaatgaagctccactgagctt

SEQ ID NO: 72867 - DNA, 22 bp, Homo sapiens
tataactacttgaagagttcag

SEQ ID NO: 72868 - DNA, 22 bp, Homo sapiens
tggggtacttgtatcaaagcac

SEQ ID NO: 72869 - DNA, 21 bp, Homo sapiens
aaactgaccttgcctgagaca

SEQ ID NO: 72870 - DNA, 22 bp, Homo sapiens
ctgggctcaagtgatccaccca

SEQ ID NO: 72871 - DNA, 21 bp, Homo sapiens
ggcaagaaacacaatcaagta

SEQ ID NO: 72872 - DNA, 22 bp, Homo sapiens
tctgagaaatttctttgtgatg

SEQ ID NO: 72873 - DNA, 22 bp, Homo sapiens
gcttctcaattctcaccctcca

SEQ ID NO: 72874 - DNA, 22 bp, Homo sapiens
cagagcccctcgtctccaccac

SEQ ID NO: 72875 - DNA, 22 bp, Homo sapiens
tatcacatttggagatttatga

SEQ ID NO: 72876 - DNA, 22 bp, Homo sapiens
gagggaaaggttaatacatgat

SEQ ID NO: 72877 - DNA, 22 bp, Homo sapiens
ggtgacagtggttaaaatttgt

SEQ ID NO: 72878 - DNA, 22 bp, Homo sapiens
tgagccatgggactccaaggga

SEQ ID NO: 72879 - DNA, 22 bp, Homo sapiens
gagtggggggtccgtctcagtg

SEQ ID NO: 72880 - DNA, 22 bp, Homo sapiens
tatgtgtttgacaccctgcaag

SEQ ID NO: 72881 - DNA, 22 bp, Homo sapiens
gcgaggaggggtgctgggcccc

SEQ ID NO: 72882 - DNA, 22 bp, Homo sapiens
ctgggcagctgtatcagggagt

SEQ ID NO: 72883 - DNA, 22 bp, Homo sapiens
ttcccttaaattatggcatcta

SEQ ID NO: 72884 - DNA, 22 bp, Homo sapiens
ccaggaggcggaggttgcagcg

SEQ ID NO: 72885 - DNA, 22 bp, Homo sapiens
atacataattacttccgatgtt

SEQ ID NO: 72886 - DNA, 22 bp, Homo sapiens
gacagacacaattgatccatga

SEQ ID NO: 72887 - DNA, 22 bp, Homo sapiens
tgcctgtggaaaggctggtgct

SEQ ID NO: 72888 - DNA, 20 bp, Homo sapiens
agatacagtggtttctttag

SEQ ID NO: 72889 - DNA, 22 bp, Homo sapiens
ggcttagcaactcctgaggctc

SEQ ID NO: 72890 - DNA, 22 bp, Homo sapiens
ctggaggccactgtacagattg

SEQ ID NO: 72891 - DNA, 22 bp, Homo sapiens
ggtgtccgcgctgtagaaggtc

SEQ ID NO: 72892 - DNA, 22 bp, Homo sapiens
ggggtggatttcaggcggtgtc

SEQ ID NO: 72893 - DNA, 22 bp, Homo sapiens
tgaggcaggagttcaggctgcg

SEQ ID NO: 72894 - DNA, 22 bp, Homo sapiens
cctgacaggcggaggctgcagt

SEQ ID NO: 72895 - DNA, 22 bp, Homo sapiens
ggttccccaggcggcccttgga

SEQ ID NO: 72896 - DNA, 22 bp, Homo sapiens
agaacagaggccttatgtttca

SEQ ID NO: 72897 - DNA, 22 bp, Homo sapiens
gtgcaaacatcatagagtgtac

SEQ ID NO: 72898 - DNA, 22 bp, Homo sapiens
gtatttggaaaccaccagtgcc

SEQ ID NO: 72899 - DNA, 22 bp, Homo sapiens
tgaggcaggagaatcaccggaa

SEQ ID NO: 72900 - DNA, 22 bp, Homo sapiens
aaccaggtgactcatggtgagc

SEQ ID NO: 72901 - DNA, 22 bp, Homo sapiens
tcgaatggcaaggaaagaggct

SEQ ID NO: 72902 - DNA, 23 bp, Homo sapiens
tgctaattggacttgattctgca

SEQ ID NO: 72903 - DNA, 22 bp, Homo sapiens
atagagtgatgtaaggtatgtg

SEQ ID NO: 72904 - DNA, 22 bp, Homo sapiens
acaggatcgccctgttgcccag

SEQ ID NO: 72905 - DNA, 22 bp, Homo sapiens
gtccccgccgtcgctcaggctg

SEQ ID NO: 72906 - DNA, 22 bp, Homo sapiens
aacagaatgcaggggatgctgc

SEQ ID NO: 72907 - DNA, 22 bp, Homo sapiens
gcctggccaacgtggtgaaacc

SEQ ID NO: 72908 - DNA, 22 bp, Homo sapiens
caaaccacactcagcgtatcgg

SEQ ID NO: 72909 - DNA, 22 bp, Homo sapiens
tatgtaagttgcaaatgaagga

SEQ ID NO: 72910 - DNA, 22 bp, Homo sapiens
cctgacgaaaggcgtgctggag

SEQ ID NO: 72911 - DNA, 22 bp, Homo sapiens
ccaaagtgctaggattacaggt

SEQ ID NO: 72912 - DNA, 22 bp, Homo sapiens
aggaaaacagaccaaggagctc

SEQ ID NO: 72913 - DNA, 22 bp, Homo sapiens
tggtacacatgtccaaggtcag

SEQ ID NO: 72914 - DNA, 22 bp, Homo sapiens
gtctcttagaaccttgttttgg

SEQ ID NO: 72915 - DNA, 22 bp, Homo sapiens
gagcctcagggttttgttgaca

SEQ ID NO: 72916 - DNA, 22 bp, Homo sapiens
tctttggatggaaattggagtc

SEQ ID NO: 72917 - DNA, 22 bp, Homo sapiens
tggaacaagggcgtggcggtcg

SEQ ID NO: 72918 - DNA, 17 bp, Homo sapiens
agtttttggacctgtgt

SEQ ID NO: 72919 - DNA, 22 bp, Homo sapiens
gctcactgcaacctccgccttc

SEQ ID NO: 72920 - DNA, 22 bp, Homo sapiens
ggtgccaggctgtagtcagggt

SEQ ID NO: 72921 - DNA, 22 bp, Homo sapiens
gtttctctgtctgttacattgg

SEQ ID NO: 72922 - DNA, 22 bp, Homo sapiens
tcccccaggctggagtgcagtg

SEQ ID NO: 72923 - DNA, 22 bp, Homo sapiens
tacgggcacgcaccacgatgcc

SEQ ID NO: 72924 - DNA, 22 bp, Homo sapiens
tcactgtatcatgttgcactta

SEQ ID NO: 72925 - DNA, 22 bp, Homo sapiens
ggggcagagaataaaaacctaa

SEQ ID NO: 72926 - DNA, 23 bp, Homo sapiens
ggcccccggaacgctctgtgacc

SEQ ID NO: 72927 - DNA, 22 bp, Homo sapiens
ccactgcacttcagcctgggtg

SEQ ID NO: 72928 - DNA, 22 bp, Homo sapiens
aagcagcacagcaatgactcta

SEQ ID NO: 72929 - DNA, 22 bp, Homo sapiens
ggccctgggccctctagcttgt

SEQ ID NO: 72930 - DNA, 22 bp, Homo sapiens
atagcagggatgtcagcaagta

SEQ ID NO: 72931 - DNA, 22 bp, Homo sapiens
ttctccctgtcctatcaagact

SEQ ID NO: 72932 - DNA, 22 bp, Homo sapiens
gcccaggaggagaggctgcagt

SEQ ID NO: 72933 - DNA, 22 bp, Homo sapiens
ttagatttgtagtgagttcaga

SEQ ID NO: 72934 - DNA, 19 bp, Homo sapiens
gatgctcattcaggtggaa

SEQ ID NO: 72935 - DNA, 22 bp, Homo sapiens
gagcctggagctggaacgaagc

SEQ ID NO: 72936 - DNA, 22 bp, Homo sapiens
tcaccttgtgatccgcccacct

SEQ ID NO: 72937 - DNA, 22 bp, Homo sapiens
catgtgtgtctccaccagctgc

SEQ ID NO: 72938 - DNA, 22 bp, Homo sapiens
tccaggattgtcagccagaagg

SEQ ID NO: 72939 - DNA, 22 bp, Homo sapiens
gcagctgacatctggctgggcc

SEQ ID NO: 72940 - DNA, 22 bp, Homo sapiens
ctcagcttggcctggacgtagc

SEQ ID NO: 72941 - DNA, 22 bp, Homo sapiens
gctgacccctacaggttgtgtt

SEQ ID NO: 72942 - DNA, 22 bp, Homo sapiens
ccgccgtgcaggccgcgacgtg

SEQ ID NO: 72943 - DNA, 22 bp, Homo sapiens
cgccaggcttggtagctcatgc

SEQ ID NO: 72944 - DNA, 22 bp, Homo sapiens
tgtggcacatacacaggagggc

SEQ ID NO: 72945 - DNA, 22 bp, Homo sapiens
tcataaattctggtgctgtgag

SEQ ID NO: 72946 - DNA, 22 bp, Homo sapiens
ttagattttaagaagggaggta

SEQ ID NO: 72947 - DNA, 22 bp, Homo sapiens
tctttggtttctgtctctgtaa

SEQ ID NO: 72948 - DNA, 22 bp, Homo sapiens
aggtgcttggctcgtgcacaca

SEQ ID NO: 72949 - DNA, 18 bp, Homo sapiens
gatatggaaggccatgcc

SEQ ID NO: 72950 - DNA, 22 bp, Homo sapiens
tcttggccactaccacctggag

SEQ ID NO: 72951 - DNA, 22 bp, Homo sapiens
gggtgctttggctcacgcctgt

SEQ ID NO: 72952 - DNA, 22 bp, Homo sapiens
tttgcttgttcaagatttctgt

SEQ ID NO: 72953 - DNA, 22 bp, Homo sapiens
tggcagttcaggttggactctt

SEQ ID NO: 72954 - DNA, 18 bp, Homo sapiens
ggctcaagtgatcctcct

SEQ ID NO: 72955 - DNA, 18 bp, Homo sapiens
tgggaatgctcaaggccc

SEQ ID NO: 72956 - DNA, 21 bp, Homo sapiens
aggcatgagccctgcatggac

SEQ ID NO: 72957 - DNA, 22 bp, Homo sapiens
ggcaaaaaccataattactttt

SEQ ID NO: 72958 - DNA, 22 bp, Homo sapiens
agcagcagtatccttccccggc

SEQ ID NO: 72959 - DNA, 20 bp, Homo sapiens
gggtgtgtgcagggcctggt

SEQ ID NO: 72960 - DNA, 22 bp, Homo sapiens
tgggaaatctttccgtatttat

SEQ ID NO: 72961 - DNA, 22 bp, Homo sapiens
ggaacagttgcgtcatgggcct

SEQ ID NO: 72962 - DNA, 21 bp, Homo sapiens
tcgacctgctgggctcgggct

SEQ ID NO: 72963 - DNA, 22 bp, Homo sapiens
gctcccaccttaaccttcacat

SEQ ID NO: 72964 - DNA, 22 bp, Homo sapiens
agcttgtgtttttctaagtatc

SEQ ID NO: 72965 - DNA, 22 bp, Homo sapiens
cctcagctcccatgagatctgc

SEQ ID NO: 72966 - DNA, 22 bp, Homo sapiens
acaggtgcatgctaccatgtct

SEQ ID NO: 72967 - DNA, 22 bp, Homo sapiens
aagccctggcgggtggagggcc

SEQ ID NO: 72968 - DNA, 22 bp, Homo sapiens
ctgggaggcggaggttgcagtg

SEQ ID NO: 72969 - DNA, 22 bp, Homo sapiens
gagcctcgtggcggccactgcg

SEQ ID NO: 72970 - DNA, 22 bp, Homo sapiens
aatcacacaaaggcaacttttg

SEQ ID NO: 72971 - DNA, 22 bp, Homo sapiens
ttcactggtcctttataggaac

SEQ ID NO: 72972 - DNA, 22 bp, Homo sapiens
ccactgccctgcaaaagctgga

SEQ ID NO: 72973 - DNA, 22 bp, Homo sapiens
gcagtgagttatgatcatgcca

SEQ ID NO: 72974 - DNA, 22 bp, Homo sapiens
aagtaaatatctgtagtcttta

SEQ ID NO: 72975 - DNA, 22 bp, Homo sapiens
cggatcctcagtcgtgcgggag

SEQ ID NO: 72976 - DNA, 22 bp, Homo sapiens
gtagaccatttatctggggagt

SEQ ID NO: 72977 - DNA, 22 bp, Homo sapiens
aaagcactgcacatatatttgc

SEQ ID NO: 72978 - DNA, 22 bp, Homo sapiens
attgtaaatagtgccacaataa

SEQ ID NO: 72979 - DNA, 22 bp, Homo sapiens
ggggaccctcaggactgcgtct

SEQ ID NO: 72980 - DNA, 22 bp, Homo sapiens
tgtctgttattggtgtataaga

SEQ ID NO: 72981 - DNA, 22 bp, Homo sapiens
cttgcagtttaggtcctctgtg

SEQ ID NO: 72982 - DNA, 22 bp, Homo sapiens
aggagatggagctcagtgggca

SEQ ID NO: 72983 - DNA, 22 bp, Homo sapiens
ctctctgggcccagttggcacc

SEQ ID NO: 72984 - DNA, 22 bp, Homo sapiens
ctgcggctggggacagctgttg

SEQ ID NO: 72985 - DNA, 22 bp, Homo sapiens
gagtctctgaccagggtgccaa

SEQ ID NO: 72986 - DNA, 22 bp, Homo sapiens
ggactgggaatcagggagatgc

SEQ ID NO: 72987 - DNA, 22 bp, Homo sapiens
tctagtcattcatgctatgatt

SEQ ID NO: 72988 - DNA, 22 bp, Homo sapiens
tcatggggccacagctgccagc

SEQ ID NO: 72989 - DNA, 22 bp, Homo sapiens
gcccctgcctttgaacctggag

SEQ ID NO: 72990 - DNA, 22 bp, Homo sapiens
ggaaggcagaggtgtcgtgggg

SEQ ID NO: 72991 - DNA, 22 bp, Homo sapiens
cagctggttgaagaggagctgg

SEQ ID NO: 72992 - DNA, 22 bp, Homo sapiens
ctcttagtaatgccatgaagca

SEQ ID NO: 72993 - DNA, 21 bp, Homo sapiens
gaccccagaccagcagacaca

SEQ ID NO: 72994 - DNA, 22 bp, Homo sapiens
aggctcccaagcactgacccca

SEQ ID NO: 72995 - DNA, 22 bp, Homo sapiens
ttaggatttgaaaaggggcaga

SEQ ID NO: 72996 - DNA, 22 bp, Homo sapiens
tgtacacatggtgtacactccc

SEQ ID NO: 72997 - DNA, 22 bp, Homo sapiens
gctgccttgccctcttcccata

SEQ ID NO: 72998 - DNA, 22 bp, Homo sapiens
cttgtagacccctggactcacg

SEQ ID NO: 72999 - DNA, 22 bp, Homo sapiens
gctggggaggcagcagagaaca

SEQ ID NO: 73000 - DNA, 22 bp, Homo sapiens
aagtcagacagctgagctgcct

SEQ ID NO: 73001 - DNA, 21 bp, Homo sapiens
ggtgacacgtggccccgctct

SEQ ID NO: 73002 - DNA, 19 bp, Homo sapiens
ttcacattggaagaagtag

SEQ ID NO: 73003 - DNA, 22 bp, Homo sapiens
tggaaacacccacgcatgcata

SEQ ID NO: 73004 - DNA, 22 bp, Homo sapiens
tcctccagttccttggtttcag

SEQ ID NO: 73005 - DNA, 22 bp, Homo sapiens
aggtaaacaggagaaaatgaga

SEQ ID NO: 73006 - DNA, 22 bp, Homo sapiens
ctgtgaagggacggatgctgct

SEQ ID NO: 73007 - DNA, 22 bp, Homo sapiens
cgaggaggaaacgcggagaact

SEQ ID NO: 73008 - DNA, 22 bp, Homo sapiens
ctttttcctcgtagagcctaat

SEQ ID NO: 73009 - DNA, 22 bp, Homo sapiens
ggcctgggctccgggagttact

SEQ ID NO: 73010 - DNA, 22 bp, Homo sapiens
attgttcaatgtaataattttg

SEQ ID NO: 73011 - DNA, 22 bp, Homo sapiens
tccgggaggcagaggttgcagt

SEQ ID NO: 73012 - DNA, 22 bp, Homo sapiens
tgctccatgcgctcggccggcg

SEQ ID NO: 73013 - DNA, 22 bp, Homo sapiens
actggacagaggaaatatggag

SEQ ID NO: 73014 - DNA, 22 bp, Homo sapiens
aatgagatggaattcccgccta

SEQ ID NO: 73015 - DNA, 22 bp, Homo sapiens
gctgtcttgctcactcttgcag

SEQ ID NO: 73016 - DNA, 22 bp, Homo sapiens
ctgcatgtttacatttttgaga

SEQ ID NO: 73017 - DNA, 23 bp, Homo sapiens
tagatgtattaagtgcattttca

SEQ ID NO: 73018 - DNA, 22 bp, Homo sapiens
atattacacacggtatcacggg

SEQ ID NO: 73019 - DNA, 22 bp, Homo sapiens
cctggctctgccacttactgcc

SEQ ID NO: 73020 - DNA, 22 bp, Homo sapiens
gaggcagaggttgcagtgagct

SEQ ID NO: 73021 - DNA, 22 bp, Homo sapiens
tgtccaggttagcttcaaacac

SEQ ID NO: 73022 - DNA, 22 bp, Homo sapiens
aacttaggaaaataaggcatga

SEQ ID NO: 73023 - DNA, 22 bp, Homo sapiens
tgtgtctcaagtcagagcatca

SEQ ID NO: 73024 - DNA, 22 bp, Homo sapiens
ggcccagacccaagagtggtgg

SEQ ID NO: 73025 - DNA, 22 bp, Homo sapiens
tgagatgtaaggtatgcttact

SEQ ID NO: 73026 - DNA, 23 bp, Homo sapiens
ggaagctcacgtagtcctgcact

SEQ ID NO: 73027 - DNA, 22 bp, Homo sapiens
atttgattgtgtctgagacgat

SEQ ID NO: 73028 - DNA, 22 bp, Homo sapiens
atatgggggggcgtgcagagga

SEQ ID NO: 73029 - DNA, 22 bp, Homo sapiens
accccagaggcggaggctgcag

SEQ ID NO: 73030 - DNA, 23 bp, Homo sapiens
cagtacaatgtggaaaaggagtg

SEQ ID NO: 73031 - DNA, 23 bp, Homo sapiens
tcgttgaatagcaatagcacaac

SEQ ID NO: 73032 - DNA, 22 bp, Homo sapiens
atgggtaaagcaggaagagagt

SEQ ID NO: 73033 - DNA, 22 bp, Homo sapiens
ccaattttattcttctgcaagt

SEQ ID NO: 73034 - DNA, 22 bp, Homo sapiens
cttcagctgcagttatgtttag

SEQ ID NO: 73035 - DNA, 22 bp, Homo sapiens
aaatactcatcccaggaactgg

SEQ ID NO: 73036 - DNA, 23 bp, Homo sapiens
tgaggcaggcggatcacgaggtc

SEQ ID NO: 73037 - DNA, 22 bp, Homo sapiens
gcctgtgtctgggtggccagag

SEQ ID NO: 73038 - DNA, 22 bp, Homo sapiens
gcaactgaacatgtgtgtggcc

SEQ ID NO: 73039 - DNA, 23 bp, Homo sapiens
actgcagtcttgatctcctgggc

SEQ ID NO: 73040 - DNA, 22 bp, Homo sapiens
caaagtaattacggttttggcc

SEQ ID NO: 73041 - DNA, 23 bp, Homo sapiens
ggacttcatgcattaacagcatc

SEQ ID NO: 73042 - DNA, 22 bp, Homo sapiens
gtgtcaataaatagcggtgtgg

SEQ ID NO: 73043 - DNA, 22 bp, Homo sapiens
tccaaggagcagtcttcaacct

SEQ ID NO: 73044 - DNA, 22 bp, Homo sapiens
caggctggagtgcagtggcgcc

SEQ ID NO: 73045 - DNA, 22 bp, Homo sapiens
aagtcacactagacaactgagg

SEQ ID NO: 73046 - DNA, 22 bp, Homo sapiens
agcgccgcccctgctggtgttg

SEQ ID NO: 73047 - DNA, 22 bp, Homo sapiens
gagtccaagctagagccactca

SEQ ID NO: 73048 - DNA, 22 bp, Homo sapiens
gatcctgggcccttctgggtca

SEQ ID NO: 73049 - DNA, 22 bp, Homo sapiens
acactctagagggaagcgcttt

SEQ ID NO: 73050 - DNA, 22 bp, Homo sapiens
actcccagaacatgctcttctt

SEQ ID NO: 73051 - DNA, 22 bp, Homo sapiens
cttctcggccgtgtggatgcgc

SEQ ID NO: 73052 - DNA, 22 bp, Homo sapiens
aaggcaggatgggaaaagattt

SEQ ID NO: 73053 - DNA, 22 bp, Homo sapiens
agcaggcctgccacctcggggt

SEQ ID NO: 73054 - DNA, 22 bp, Homo sapiens
acactgatgttggccctggtca

SEQ ID NO: 73055 - DNA, 23 bp, Homo sapiens
gtgcgccaggacaacctgacgga

SEQ ID NO: 73056 - DNA, 22 bp, Homo sapiens
agtggagcttttcctatcagag

SEQ ID NO: 73057 - DNA, 22 bp, Homo sapiens
cctgcctatgagacgttttgcc

SEQ ID NO: 73058 - DNA, 22 bp, Homo sapiens
gaggctgaggcaggaggatcac

SEQ ID NO: 73059 - DNA, 22 bp, Homo sapiens
agttctgcctatatagaaactc

SEQ ID NO: 73060 - DNA, 22 bp, Homo sapiens
tgggccacacacagaagaatca

SEQ ID NO: 73061 - DNA, 22 bp, Homo sapiens
gctgcagtgagccaagatcgtg

SEQ ID NO: 73062 - DNA, 22 bp, Homo sapiens
gcagcaacgcggccctactgct

SEQ ID NO: 73063 - DNA, 22 bp, Homo sapiens
cattgctttgtgcatatttaaa

SEQ ID NO: 73064 - DNA, 22 bp, Homo sapiens
atatgcagtctcttgcccttct

SEQ ID NO: 73065 - DNA, 22 bp, Homo sapiens
gagccaggggtcagctccgagg

SEQ ID NO: 73066 - DNA, 22 bp, Homo sapiens
taacctctctgtgcctcagttt

SEQ ID NO: 73067 - DNA, 17 bp, Homo sapiens
ttcttttctgagccttg

SEQ ID NO: 73068 - DNA, 22 bp, Homo sapiens
gtagcccacctggggagggcga

SEQ ID NO: 73069 - DNA, 22 bp, Homo sapiens
atgggatgatcacctgagctca

SEQ ID NO: 73070 - DNA, 22 bp, Homo sapiens
agtgggtgtagtcttcctcctg

SEQ ID NO: 73071 - DNA, 22 bp, Homo sapiens
cctgggcctctcaaagtgctgg

SEQ ID NO: 73072 - DNA, 22 bp, Homo sapiens
ctggctctcaggctggtcccca

SEQ ID NO: 73073 - DNA, 22 bp, Homo sapiens
gcaccgccttggaccgcccgct

SEQ ID NO: 73074 - DNA, 22 bp, Homo sapiens
acacttctttgtcacctgcttc

SEQ ID NO: 73075 - DNA, 22 bp, Homo sapiens
cagccccatggtgtgctccagc

SEQ ID NO: 73076 - DNA, 22 bp, Homo sapiens
cactgttttacatgttatttaa

SEQ ID NO: 73077 - DNA, 22 bp, Homo sapiens
ccaggaggcggaggttgcagtg

SEQ ID NO: 73078 - DNA, 22 bp, Homo sapiens
gtggccaaatcatgtcaaaggc

SEQ ID NO: 73079 - DNA, 22 bp, Homo sapiens
tgagatgaataactcctgctaa

SEQ ID NO: 73080 - DNA, 22 bp, Homo sapiens
ggggctgaacctggaggtggtc

SEQ ID NO: 73081 - DNA, 22 bp, Homo sapiens
tctgttgactcctagcagccat

SEQ ID NO: 73082 - DNA, 22 bp, Homo sapiens
gccggggctggggagagacatg

SEQ ID NO: 73083 - DNA, 22 bp, Homo sapiens
cgggcagtgtggctccagagtc

SEQ ID NO: 73084 - DNA, 22 bp, Homo sapiens
taggtttactgaattagtggaa

SEQ ID NO: 73085 - DNA, 22 bp, Homo sapiens
tctttcttgtgggtgccctttt

SEQ ID NO: 73086 - DNA, 22 bp, Homo sapiens
ggtgagcagctgtctgtatgga

SEQ ID NO: 73087 - DNA, 22 bp, Homo sapiens
ctagggtgtgcagattttgcct

SEQ ID NO: 73088 - DNA, 22 bp, Homo sapiens
gatggcacacagacatccccgc

SEQ ID NO: 73089 - DNA, 22 bp, Homo sapiens
ccatgtacatgaacacggcggc

SEQ ID NO: 73090 - DNA, 22 bp, Homo sapiens
tgccctttatttctggggcaga

SEQ ID NO: 73091 - DNA, 22 bp, Homo sapiens
agggtcctgggtgcagttgctt

SEQ ID NO: 73092 - DNA, 22 bp, Homo sapiens
tgctcccaaacctgacaggctc

SEQ ID NO: 73093 - DNA, 22 bp, Homo sapiens
gcacttgtggatttgatataca

SEQ ID NO: 73094 - DNA, 22 bp, Homo sapiens
agaggctgcacttgctcatgat

SEQ ID NO: 73095 - DNA, 22 bp, Homo sapiens
ggattgcaacaagctagtttag

SEQ ID NO: 73096 - DNA, 22 bp, Homo sapiens
gcccgcagagatctttaacaaa

SEQ ID NO: 73097 - DNA, 22 bp, Homo sapiens
acccaggctggagtgcagtggg

SEQ ID NO: 73098 - DNA, 22 bp, Homo sapiens
tttattctgtgctacatgaaga

SEQ ID NO: 73099 - DNA, 22 bp, Homo sapiens
gctgccaatccagctgtgggag

SEQ ID NO: 73100 - DNA, 22 bp, Homo sapiens
ccagatgtccctctcaggtttg

SEQ ID NO: 73101 - DNA, 22 bp, Homo sapiens
ttctgtccctctagagaaccat

SEQ ID NO: 73102 - DNA, 22 bp, Homo sapiens
ctacaaaagtaattgtggtttt

SEQ ID NO: 73103 - DNA, 22 bp, Homo sapiens
ccagtggctacaggggggttga

SEQ ID NO: 73104 - DNA, 22 bp, Homo sapiens
aagaggtttaactgactcacag

SEQ ID NO: 73105 - DNA, 22 bp, Homo sapiens
ttttggctctgtctgtatcttt

SEQ ID NO: 73106 - DNA, 22 bp, Homo sapiens
gcccttacagggtggtcagcca

SEQ ID NO: 73107 - DNA, 23 bp, Homo sapiens
aaactacaacgccaggcactgag

SEQ ID NO: 73108 - DNA, 19 bp, Homo sapiens
tccaggggctccacctcct

SEQ ID NO: 73109 - DNA, 22 bp, Homo sapiens
taaggcaggaactggctgtttt

SEQ ID NO: 73110 - DNA, 22 bp, Homo sapiens
agaaactctggaagaactttta

SEQ ID NO: 73111 - DNA, 18 bp, Homo sapiens
actctttctgcccacagg

SEQ ID NO: 73112 - DNA, 22 bp, Homo sapiens
tccaaagtgttgggattatagg

SEQ ID NO: 73113 - DNA, 22 bp, Homo sapiens
ggacaagcctgtgagtgggttt

SEQ ID NO: 73114 - DNA, 22 bp, Homo sapiens
atgctatgtaactggcagatag

SEQ ID NO: 73115 - DNA, 22 bp, Homo sapiens
gtaggtcagacataagaggaca

SEQ ID NO: 73116 - DNA, 22 bp, Homo sapiens
aaacatctactgtaggctggag

SEQ ID NO: 73117 - DNA, 22 bp, Homo sapiens
tgagcctgtcattattcagaga

SEQ ID NO: 73118 - DNA, 22 bp, Homo sapiens
atcagagtagttgttgcccaga

SEQ ID NO: 73119 - DNA, 22 bp, Homo sapiens
gccgtgcgtgcgcaggtgctgt

SEQ ID NO: 73120 - DNA, 22 bp, Homo sapiens
tggcgcgacgtgccccctgctt

SEQ ID NO: 73121 - DNA, 22 bp, Homo sapiens
gcccgcgccagcctctccatct

SEQ ID NO: 73122 - DNA, 22 bp, Homo sapiens
gaggagctgcccgtgtgtctgc

SEQ ID NO: 73123 - DNA, 22 bp, Homo sapiens
cccaggaagtggaggttgcagt

SEQ ID NO: 73124 - DNA, 21 bp, Homo sapiens
gttcaaatcctgacactacac

SEQ ID NO: 73125 - DNA, 22 bp, Homo sapiens
tttccagagggtgctcagggcg

SEQ ID NO: 73126 - DNA, 20 bp, Homo sapiens
acgtggccaccagtggctta

SEQ ID NO: 73127 - DNA, 22 bp, Homo sapiens
acaagcatgggctttgacatca

SEQ ID NO: 73128 - DNA, 22 bp, Homo sapiens
tcaaagatcagatggttgtagg

SEQ ID NO: 73129 - DNA, 22 bp, Homo sapiens
tgactcagtacatctggagttg

SEQ ID NO: 73130 - DNA, 22 bp, Homo sapiens
atggctagcaccgcgttgctgg

SEQ ID NO: 73131 - DNA, 22 bp, Homo sapiens
atggggggatgaaggagtccaa

SEQ ID NO: 73132 - DNA, 22 bp, Homo sapiens
tggagacacaggaccagactgc

SEQ ID NO: 73133 - DNA, 22 bp, Homo sapiens
caggcaggtcagtgaagaagga

SEQ ID NO: 73134 - DNA, 23 bp, Homo sapiens
aatggtcttcctccacccctctg

SEQ ID NO: 73135 - DNA, 22 bp, Homo sapiens
aagaggttgtctgtgatgagtt

SEQ ID NO: 73136 - DNA, 22 bp, Homo sapiens
aacactgctgctgggttctgtg

SEQ ID NO: 73137 - DNA, 22 bp, Homo sapiens
tccgggagctgaacgtcttgcg

SEQ ID NO: 73138 - DNA, 22 bp, Homo sapiens
ttatttttaaaagttcacacag

SEQ ID NO: 73139 - DNA, 22 bp, Homo sapiens
tgaagttgttaaggttgccatt

SEQ ID NO: 73140 - DNA, 21 bp, Homo sapiens
aggcaccacatctccctcccc

SEQ ID NO: 73141 - DNA, 22 bp, Homo sapiens
tcagtttttctatactttgtag

SEQ ID NO: 73142 - DNA, 18 bp, Homo sapiens
gcactgaggaaaacctct

SEQ ID NO: 73143 - DNA, 22 bp, Homo sapiens
ccctggctgataccggaaaggc

SEQ ID NO: 73144 - DNA, 22 bp, Homo sapiens
gagcatcgctgagatcccagac

SEQ ID NO: 73145 - DNA, 19 bp, Homo sapiens
tcctgcccaccagccaggg

SEQ ID NO: 73146 - DNA, 22 bp, Homo sapiens
ctgtaatcccagctactcggga

SEQ ID NO: 73147 - DNA, 22 bp, Homo sapiens
tcatcataatatggaatcttgt

SEQ ID NO: 73148 - DNA, 22 bp, Homo sapiens
caaagggaaaagccatgtgggc

SEQ ID NO: 73149 - DNA, 22 bp, Homo sapiens
atttggcagtataaattctggc

SEQ ID NO: 73150 - DNA, 22 bp, Homo sapiens
agggctggagccacagctggga

SEQ ID NO: 73151 - DNA, 22 bp, Homo sapiens
cctgtctctgcagggccctgcc

SEQ ID NO: 73152 - DNA, 22 bp, Homo sapiens
tcttgggcaatttctctagagg

SEQ ID NO: 73153 - DNA, 22 bp, Homo sapiens
aaaatcctgctgactcgagatg

SEQ ID NO: 73154 - DNA, 22 bp, Homo sapiens
agttattactctttaacatatt

SEQ ID NO: 73155 - DNA, 22 bp, Homo sapiens
tgttatcctcagctcacctcta

SEQ ID NO: 73156 - DNA, 22 bp, Homo sapiens
tgtcagtgtctatgaagaattt

SEQ ID NO: 73157 - DNA, 22 bp, Homo sapiens
cagcaagtcatccaggatgatg

SEQ ID NO: 73158 - DNA, 22 bp, Homo sapiens
tgagctgtatattgttttaata

SEQ ID NO: 73159 - DNA, 22 bp, Homo sapiens
cactgcactccatcctgggaaa

SEQ ID NO: 73160 - DNA, 22 bp, Homo sapiens
tatactctgagaaacgtgtcac

SEQ ID NO: 73161 - DNA, 22 bp, Homo sapiens
tacagctgcaagggtttctggg

SEQ ID NO: 73162 - DNA, 22 bp, Homo sapiens
tggtggggccagacttcagctc

SEQ ID NO: 73163 - DNA, 22 bp, Homo sapiens
ggaggagacagtaaaaagcacg

SEQ ID NO: 73164 - DNA, 22 bp, Homo sapiens
ctggagggctgcagcgaggctg

SEQ ID NO: 73165 - DNA, 22 bp, Homo sapiens
gaaatcatattctcagtccttc

SEQ ID NO: 73166 - DNA, 22 bp, Homo sapiens
tggcctctcctggctgagtttc

SEQ ID NO: 73167 - DNA, 22 bp, Homo sapiens
ttcaccctggaccagaaattgg

SEQ ID NO: 73168 - DNA, 22 bp, Homo sapiens
gtgtatgttctacttaatatta

SEQ ID NO: 73169 - DNA, 22 bp, Homo sapiens
ctgggcgcgtcccctgaggcgg

SEQ ID NO: 73170 - DNA, 22 bp, Homo sapiens
ggctgggctccgggagcatgcg

SEQ ID NO: 73171 - DNA, 22 bp, Homo sapiens
tgctgggctggggcctcagacc

SEQ ID NO: 73172 - DNA, 22 bp, Homo sapiens
ggtgggagccaacacccttctg

SEQ ID NO: 73173 - DNA, 22 bp, Homo sapiens
agcgccactgcactccagcctg

SEQ ID NO: 73174 - DNA, 22 bp, Homo sapiens
gagagtctagtgcacctagttt

SEQ ID NO: 73175 - DNA, 22 bp, Homo sapiens
ccatgaattcactccatgctag

SEQ ID NO: 73176 - DNA, 22 bp, Homo sapiens
tgagtgtggggaatgtcatgag

SEQ ID NO: 73177 - DNA, 22 bp, Homo sapiens
cgagagttagctaggagtcaca

SEQ ID NO: 73178 - DNA, 20 bp, Homo sapiens
gggcaaggaaacagccccca

SEQ ID NO: 73179 - DNA, 22 bp, Homo sapiens
tctacctggagtccgttgttaa

SEQ ID NO: 73180 - DNA, 22 bp, Homo sapiens
gttaggtagaagtttactttga

SEQ ID NO: 73181 - DNA, 22 bp, Homo sapiens
gctggaggatggactggaagaa

SEQ ID NO: 73182 - DNA, 20 bp, Homo sapiens
tgttgattggtgtcatctca

SEQ ID NO: 73183 - DNA, 22 bp, Homo sapiens
gcccatgcactttctgtgatgg

SEQ ID NO: 73184 - DNA, 22 bp, Homo sapiens
gggcccctgggaattctgtgat

SEQ ID NO: 73185 - DNA, 22 bp, Homo sapiens
gatgatcatctgtaaagttaga

SEQ ID NO: 73186 - DNA, 22 bp, Homo sapiens
ctgaggggatgtttttgacgga

SEQ ID NO: 73187 - DNA, 22 bp, Homo sapiens
atggccgcctgtccttcccgcc

SEQ ID NO: 73188 - DNA, 22 bp, Homo sapiens
ctagttctagatccctgaggaa

SEQ ID NO: 73189 - DNA, 22 bp, Homo sapiens
ggcatagcggctcagcgtccag

SEQ ID NO: 73190 - DNA, 22 bp, Homo sapiens
tcacccaggctggactgcagtg

SEQ ID NO: 73191 - DNA, 18 bp, Homo sapiens
cagctgccagctcatgga

SEQ ID NO: 73192 - DNA, 22 bp, Homo sapiens
acccggagtcggaggttgcagt

SEQ ID NO: 73193 - DNA, 22 bp, Homo sapiens
cccattcatcctcgcttccttc

SEQ ID NO: 73194 - DNA, 22 bp, Homo sapiens
actgaataaggtgaatgctctg

SEQ ID NO: 73195 - DNA, 21 bp, Homo sapiens
ctggaggcaggtggtgccagg

SEQ ID NO: 73196 - DNA, 22 bp, Homo sapiens
aagtagttaggaacattctctc

SEQ ID NO: 73197 - DNA, 22 bp, Homo sapiens
ggccttggcctagccctccagg

SEQ ID NO: 73198 - DNA, 22 bp, Homo sapiens
ggttcccggatctccgagtccc

SEQ ID NO: 73199 - DNA, 23 bp, Homo sapiens
gttttacaggtgagaaaatggag

SEQ ID NO: 73200 - DNA, 22 bp, Homo sapiens
atgccaggaacaaacagtggtg

SEQ ID NO: 73201 - DNA, 22 bp, Homo sapiens
cccaggaattggaggctgcagt

SEQ ID NO: 73202 - DNA, 22 bp, Homo sapiens
tgaggcactccaggatgctgtt

SEQ ID NO: 73203 - DNA, 22 bp, Homo sapiens
ctagggtcaggggcctgcgtcg

SEQ ID NO: 73204 - DNA, 22 bp, Homo sapiens
tatgttgcaccaacctaataat

SEQ ID NO: 73205 - DNA, 19 bp, Homo sapiens
cttgaaactactgttgaga

SEQ ID NO: 73206 - DNA, 22 bp, Homo sapiens
ggctcaggcctgtaatcctagc

SEQ ID NO: 73207 - DNA, 22 bp, Homo sapiens
gatttttatataaagtgagaaa

SEQ ID NO: 73208 - DNA, 22 bp, Homo sapiens
aggggttggacataagacagaa

SEQ ID NO: 73209 - DNA, 22 bp, Homo sapiens
ctgtccccacccaaatctcatc

SEQ ID NO: 73210 - DNA, 22 bp, Homo sapiens
actttatttcctattgcatcca

SEQ ID NO: 73211 - DNA, 22 bp, Homo sapiens
ctgtcctggggaaagccagccc

SEQ ID NO: 73212 - DNA, 22 bp, Homo sapiens
tgtgtcagaaggcaatggggat

SEQ ID NO: 73213 - DNA, 22 bp, Homo sapiens
attcacagggggagaagggtat

SEQ ID NO: 73214 - DNA, 23 bp, Homo sapiens
caccactttctccttctccttgg

SEQ ID NO: 73215 - DNA, 22 bp, Homo sapiens
gtctctatcatagctgaaccct

SEQ ID NO: 73216 - DNA, 22 bp, Homo sapiens
actttcttggtcccatgtttga

SEQ ID NO: 73217 - DNA, 22 bp, Homo sapiens
agtccgtggccagactcaagag

SEQ ID NO: 73218 - DNA, 22 bp, Homo sapiens
cagccctcctaccctgccaggc

SEQ ID NO: 73219 - DNA, 21 bp, Homo sapiens
tgctccaggagggggcagtcc

SEQ ID NO: 73220 - DNA, 18 bp, Homo sapiens
agctccatctgtcagcat

SEQ ID NO: 73221 - DNA, 22 bp, Homo sapiens
ctgcgttctgcctggcggccta

SEQ ID NO: 73222 - DNA, 22 bp, Homo sapiens
ccagcatccatgctccctcggg

SEQ ID NO: 73223 - DNA, 22 bp, Homo sapiens
actcggggtggagagagcggtg

SEQ ID NO: 73224 - DNA, 22 bp, Homo sapiens
ctggcccaggtggtcgttgagg

SEQ ID NO: 73225 - DNA, 22 bp, Homo sapiens
ctgggctagaaggaccaggatg

SEQ ID NO: 73226 - DNA, 22 bp, Homo sapiens
ttgcagttttgacagaccaaat

SEQ ID NO: 73227 - DNA, 22 bp, Homo sapiens
cagtttcttcctcccccagaga

SEQ ID NO: 73228 - DNA, 22 bp, Homo sapiens
tttatagcagcatgatttataa

SEQ ID NO: 73229 - DNA, 22 bp, Homo sapiens
gcgcttccaccgaaggcagctc

SEQ ID NO: 73230 - DNA, 22 bp, Homo sapiens
ctgggaggcagaggttgtagtg

SEQ ID NO: 73231 - DNA, 22 bp, Homo sapiens
tccgggttttacactcacatca

SEQ ID NO: 73232 - DNA, 22 bp, Homo sapiens
aacccacaaaggatttcagctc

SEQ ID NO: 73233 - DNA, 22 bp, Homo sapiens
gcgttggggaccccgaagctgg

SEQ ID NO: 73234 - DNA, 22 bp, Homo sapiens
taggtttaggagtgaaggtgaa

SEQ ID NO: 73235 - DNA, 22 bp, Homo sapiens
ggctttagtgtaggtttctgtt

SEQ ID NO: 73236 - DNA, 22 bp, Homo sapiens
atgtaattattaacacctgtgc

SEQ ID NO: 73237 - DNA, 22 bp, Homo sapiens
ggtgccagatgaggcccgcgat

SEQ ID NO: 73238 - DNA, 22 bp, Homo sapiens
cgcgctctccttctggcaccca

SEQ ID NO: 73239 - DNA, 22 bp, Homo sapiens
atgtgccaacgtgcaggtttgt

SEQ ID NO: 73240 - DNA, 22 bp, Homo sapiens
attggccagacttatccttcag

SEQ ID NO: 73241 - DNA, 22 bp, Homo sapiens
agacggattacctgaggtcagg

SEQ ID NO: 73242 - DNA, 22 bp, Homo sapiens
gtcccctgtccagggccagcca

SEQ ID NO: 73243 - DNA, 22 bp, Homo sapiens
tgcctgcctaggaagctgtgaa

SEQ ID NO: 73244 - DNA, 20 bp, Homo sapiens
tccaaagaagttcacattta

SEQ ID NO: 73245 - DNA, 21 bp, Homo sapiens
acacaggcagtgtcccgaggt

SEQ ID NO: 73246 - DNA, 22 bp, Homo sapiens
ttgcccagagtcacccagctca

SEQ ID NO: 73247 - DNA, 22 bp, Homo sapiens
cctgggctctgtcagaattggg

SEQ ID NO: 73248 - DNA, 22 bp, Homo sapiens
ccctgtgggaactcctgagttg

SEQ ID NO: 73249 - DNA, 22 bp, Homo sapiens
actgcacttcagcctgggtgac

SEQ ID NO: 73250 - DNA, 22 bp, Homo sapiens
aagaatgagctcaaagatctta

SEQ ID NO: 73251 - DNA, 22 bp, Homo sapiens
cagcctggtccccggctcaccc

SEQ ID NO: 73252 - DNA, 22 bp, Homo sapiens
tatccgtgatgtttataaacca

SEQ ID NO: 73253 - DNA, 22 bp, Homo sapiens
gaggttggttccaaccctccca

SEQ ID NO: 73254 - DNA, 22 bp, Homo sapiens
aatatgcactctgatttagcag

SEQ ID NO: 73255 - DNA, 22 bp, Homo sapiens
ggccactgctctccagcctggg

SEQ ID NO: 73256 - DNA, 22 bp, Homo sapiens
atgtatatgcatgcattcaaag

SEQ ID NO: 73257 - DNA, 22 bp, Homo sapiens
gagtccctgctgtcaggtgctg

SEQ ID NO: 73258 - DNA, 19 bp, Homo sapiens
ccagagagctaggtacaga

SEQ ID NO: 73259 - DNA, 22 bp, Homo sapiens
ttaaatattatgttgtctgcaa

SEQ ID NO: 73260 - DNA, 22 bp, Homo sapiens
ggtgacgaatccatagcatcga

SEQ ID NO: 73261 - DNA, 22 bp, Homo sapiens
gctgctgcttgaaggctcggag

SEQ ID NO: 73262 - DNA, 22 bp, Homo sapiens
gagatgggcgagaaggtggact

SEQ ID NO: 73263 - DNA, 22 bp, Homo sapiens
ccaggaggttgaggctgcagtg

SEQ ID NO: 73264 - DNA, 22 bp, Homo sapiens
tagcagtgtctaggtaggccat

SEQ ID NO: 73265 - DNA, 22 bp, Homo sapiens
cccaggctggagtgcagtggcg

SEQ ID NO: 73266 - DNA, 22 bp, Homo sapiens
ggaggaggggtgactgaatgct

SEQ ID NO: 73267 - DNA, 19 bp, Homo sapiens
agggttacccgctgccacc

SEQ ID NO: 73268 - DNA, 22 bp, Homo sapiens
catctgtctgcatgctctgggt

SEQ ID NO: 73269 - DNA, 22 bp, Homo sapiens
tggcaaattccaaagttaattc

SEQ ID NO: 73270 - DNA, 22 bp, Homo sapiens
cccctcttggcattgagtgcca

SEQ ID NO: 73271 - DNA, 22 bp, Homo sapiens
attgataaattgcaatggggct

SEQ ID NO: 73272 - DNA, 22 bp, Homo sapiens
gggcggatcatttgaggtcagg

SEQ ID NO: 73273 - DNA, 22 bp, Homo sapiens
tggaatgcagtgggagcttacc

SEQ ID NO: 73274 - DNA, 22 bp, Homo sapiens
aagcatgaatcgactcggcaac

SEQ ID NO: 73275 - DNA, 22 bp, Homo sapiens
gtgcaattcactgttatgtctg

SEQ ID NO: 73276 - DNA, 22 bp, Homo sapiens
gtccctgataagagccatcgat

SEQ ID NO: 73277 - DNA, 22 bp, Homo sapiens
ggtgtgtctgccaggaactgca

SEQ ID NO: 73278 - DNA, 22 bp, Homo sapiens
acccaggctggcgtgcagtggc

SEQ ID NO: 73279 - DNA, 22 bp, Homo sapiens
cccgtgtgtgcgaggctcccgc

SEQ ID NO: 73280 - DNA, 22 bp, Homo sapiens
ttggaggcaatgggaaggaggc

SEQ ID NO: 73281 - DNA, 22 bp, Homo sapiens
gggcaggggtcagtggccccaa

SEQ ID NO: 73282 - DNA, 22 bp, Homo sapiens
ttcatatgtgaactcagtgatg

SEQ ID NO: 73283 - DNA, 22 bp, Homo sapiens
ttcaggcccagcacagcgcgtg

SEQ ID NO: 73284 - DNA, 22 bp, Homo sapiens
aggggatgcctagtggagtctc

SEQ ID NO: 73285 - DNA, 22 bp, Homo sapiens
aacaattactaccaaggcctgt

SEQ ID NO: 73286 - DNA, 21 bp, Homo sapiens
gagcgccgctcacctcccctg

SEQ ID NO: 73287 - DNA, 22 bp, Homo sapiens
tttgggcaggcttttccctaga

SEQ ID NO: 73288 - DNA, 22 bp, Homo sapiens
gaattttattactagtcaactg

SEQ ID NO: 73289 - DNA, 22 bp, Homo sapiens
gacctcgtgatccgccctcctt

SEQ ID NO: 73290 - DNA, 22 bp, Homo sapiens
ttggagtgacagatgaggaaac

SEQ ID NO: 73291 - DNA, 22 bp, Homo sapiens
cactgggcacttgggttgcttc

SEQ ID NO: 73292 - DNA, 22 bp, Homo sapiens
ccgcccacactaaatatgagcg

SEQ ID NO: 73293 - DNA, 22 bp, Homo sapiens
aaatcggttggttcaaggtaat

SEQ ID NO: 73294 - DNA, 22 bp, Homo sapiens
gggagcaagccggaggtactgt

SEQ ID NO: 73295 - DNA, 22 bp, Homo sapiens
taagtcttcatagtctaatgtc

SEQ ID NO: 73296 - DNA, 22 bp, Homo sapiens
ctatacagcagcttactagtta

SEQ ID NO: 73297 - DNA, 21 bp, Homo sapiens
gctgctcgagatccagtgctt

SEQ ID NO: 73298 - DNA, 22 bp, Homo sapiens
ttgtaacaggtactaaataact

SEQ ID NO: 73299 - DNA, 22 bp, Homo sapiens
actgttgaagtgccagcttgat

SEQ ID NO: 73300 - DNA, 22 bp, Homo sapiens
tacaccattcccaggtggattt

SEQ ID NO: 73301 - DNA, 22 bp, Homo sapiens
tgcctcaagccctccactgcac

SEQ ID NO: 73302 - DNA, 22 bp, Homo sapiens
aaagctgtcaaggcaggaggct

SEQ ID NO: 73303 - DNA, 22 bp, Homo sapiens
tgtcttcaggagtaaatatcat

SEQ ID NO: 73304 - DNA, 22 bp, Homo sapiens
taggcatgcaaataaatgtgca

SEQ ID NO: 73305 - DNA, 22 bp, Homo sapiens
taagtgagggagctgggacttg

SEQ ID NO: 73306 - DNA, 22 bp, Homo sapiens
actgcacttcaccctgggtgac

SEQ ID NO: 73307 - DNA, 19 bp, Homo sapiens
tgttgtctaccatgaagtc

SEQ ID NO: 73308 - DNA, 22 bp, Homo sapiens
tgagctgtgtcttggtgagagt

SEQ ID NO: 73309 - DNA, 22 bp, Homo sapiens
gccagtggtcactgaggaagaa

SEQ ID NO: 73310 - DNA, 22 bp, Homo sapiens
tttctaatctgattctcctacc

SEQ ID NO: 73311 - DNA, 22 bp, Homo sapiens
tgatcaaaacattactccacca

SEQ ID NO: 73312 - DNA, 22 bp, Homo sapiens
gccctgggcaaggttctggcca

SEQ ID NO: 73313 - DNA, 22 bp, Homo sapiens
tttacacagaggacactgggct

SEQ ID NO: 73314 - DNA, 22 bp, Homo sapiens
gtatccatgggggattggttcc

SEQ ID NO: 73315 - DNA, 22 bp, Homo sapiens
ggccgctctccggtgtggatct

SEQ ID NO: 73316 - DNA, 22 bp, Homo sapiens
gggaagtgatggagccaggatt

SEQ ID NO: 73317 - DNA, 22 bp, Homo sapiens
cgggcgcactccgggcagctgt

SEQ ID NO: 73318 - DNA, 22 bp, Homo sapiens
atcatcatgcccacttgagact

SEQ ID NO: 73319 - DNA, 21 bp, Homo sapiens
agcctcaggttgttggttctt

SEQ ID NO: 73320 - DNA, 22 bp, Homo sapiens
atcccaagctctacaagtgatt

SEQ ID NO: 73321 - DNA, 22 bp, Homo sapiens
aagaataagaggatttagaaca

SEQ ID NO: 73322 - DNA, 22 bp, Homo sapiens
gtgcacatcgtgcaggtttgtt

SEQ ID NO: 73323 - DNA, 22 bp, Homo sapiens
tgtttctgtatgatcaatattg

SEQ ID NO: 73324 - DNA, 22 bp, Homo sapiens
cctgggaggctgaggctgcagt

SEQ ID NO: 73325 - DNA, 22 bp, Homo sapiens
gaaggaagtcattagtgcagac

SEQ ID NO: 73326 - DNA, 22 bp, Homo sapiens
cacccaggttggagtgcagtgg

SEQ ID NO: 73327 - DNA, 22 bp, Homo sapiens
catctgctgttccttggactca

SEQ ID NO: 73328 - DNA, 22 bp, Homo sapiens
gtgctggggagataggaagaga

SEQ ID NO: 73329 - DNA, 22 bp, Homo sapiens
ccttcccatgcagcctgtctga

SEQ ID NO: 73330 - DNA, 22 bp, Homo sapiens
ggcaagagggcagatggagtgc

SEQ ID NO: 73331 - DNA, 22 bp, Homo sapiens
aagcctggactatcgcgtgtgc

SEQ ID NO: 73332 - DNA, 22 bp, Homo sapiens
tcacagagaaatgtggcacaaa

SEQ ID NO: 73333 - DNA, 22 bp, Homo sapiens
agtgcactggcaccatctcagc

SEQ ID NO: 73334 - DNA, 22 bp, Homo sapiens
ctaggaccactgtaacaaagta

SEQ ID NO: 73335 - DNA, 22 bp, Homo sapiens
attgagaagaaaatctaatata

SEQ ID NO: 73336 - DNA, 20 bp, Homo sapiens
agagtgagactccatctcag

SEQ ID NO: 73337 - DNA, 22 bp, Homo sapiens
agtatacatagtgcttcctctt

SEQ ID NO: 73338 - DNA, 17 bp, Homo sapiens
gctccagaattctagtc

SEQ ID NO: 73339 - DNA, 22 bp, Homo sapiens
acgcagtttgtggacatttttt

SEQ ID NO: 73340 - DNA, 22 bp, Homo sapiens
tcttcccccgtgctccagtgca

SEQ ID NO: 73341 - DNA, 22 bp, Homo sapiens
gtgggggctggaaatcttgcca

SEQ ID NO: 73342 - DNA, 22 bp, Homo sapiens
gccctgccctctcggcactcgc

SEQ ID NO: 73343 - DNA, 22 bp, Homo sapiens
gctgtctgtcttcacatctcgc

SEQ ID NO: 73344 - DNA, 22 bp, Homo sapiens
ggaatcctgccagctctgcccc

SEQ ID NO: 73345 - DNA, 22 bp, Homo sapiens
tgcactccaggctgggtgacag

SEQ ID NO: 73346 - DNA, 22 bp, Homo sapiens
actaggggctcaggcccaggga

SEQ ID NO: 73347 - DNA, 22 bp, Homo sapiens
gccgtgtcatctgcgggtggca

SEQ ID NO: 73348 - DNA, 19 bp, Homo sapiens
ccacagcctgctgtcttcc

SEQ ID NO: 73349 - DNA, 22 bp, Homo sapiens
ttccaactttgtcatatattat

SEQ ID NO: 73350 - DNA, 22 bp, Homo sapiens
cgtgggtcgggactccgcctcg

SEQ ID NO: 73351 - DNA, 23 bp, Homo sapiens
aattatctatttcaaatttagca

SEQ ID NO: 73352 - DNA, 22 bp, Homo sapiens
agggcagagctgtctaaatggc

SEQ ID NO: 73353 - DNA, 18 bp, Homo sapiens
atggtctcatactgggag

SEQ ID NO: 73354 - DNA, 22 bp, Homo sapiens
tccggactcacctgacaatggc

SEQ ID NO: 73355 - DNA, 22 bp, Homo sapiens
gccaaggccctgtctgttttac

SEQ ID NO: 73356 - DNA, 20 bp, Homo sapiens
gtctccactgggggttaacc

SEQ ID NO: 73357 - DNA, 22 bp, Homo sapiens
gaccttgtgatccacccgcctt

SEQ ID NO: 73358 - DNA, 22 bp, Homo sapiens
cgtcccgggttcacgccattct

SEQ ID NO: 73359 - DNA, 22 bp, Homo sapiens
cctgtaatctcagctactcggg

SEQ ID NO: 73360 - DNA, 22 bp, Homo sapiens
tgagcacatttcacatgacagg

SEQ ID NO: 73361 - DNA, 16 bp, Homo sapiens
gcagaggaaaggggag

SEQ ID NO: 73362 - DNA, 22 bp, Homo sapiens
caggaggagggcagccgcctcc

SEQ ID NO: 73363 - DNA, 22 bp, Homo sapiens
ggctgtggcagctggaagtggt

SEQ ID NO: 73364 - DNA, 22 bp, Homo sapiens
tgttgattagtgtttagactta

SEQ ID NO: 73365 - DNA, 22 bp, Homo sapiens
ttgcaattgctatggagagcgt

SEQ ID NO: 73366 - DNA, 22 bp, Homo sapiens
tggtggctcacacctgtaatcc

SEQ ID NO: 73367 - DNA, 22 bp, Homo sapiens
ggcagggagtggagactcccta

SEQ ID NO: 73368 - DNA, 22 bp, Homo sapiens
gacagctgcatcctcagacaca

SEQ ID NO: 73369 - DNA, 22 bp, Homo sapiens
ttgtgaatagtgctgcaataaa

SEQ ID NO: 73370 - DNA, 22 bp, Homo sapiens
tcgctgaggctgcacggctgcc

SEQ ID NO: 73371 - DNA, 22 bp, Homo sapiens
tcagggattaaggtcaaaggtg

SEQ ID NO: 73372 - DNA, 22 bp, Homo sapiens
cacatgaaggctggggtcgtga

SEQ ID NO: 73373 - DNA, 22 bp, Homo sapiens
caattgacaatgacagtgtcaa

SEQ ID NO: 73374 - DNA, 22 bp, Homo sapiens
atcaaatacaaagggcataagg

SEQ ID NO: 73375 - DNA, 22 bp, Homo sapiens
acagattagctggggccattga

SEQ ID NO: 73376 - DNA, 22 bp, Homo sapiens
gacaggaggcagagctcaggtg

SEQ ID NO: 73377 - DNA, 22 bp, Homo sapiens
gtctcccaaactctgatggtcc

SEQ ID NO: 73378 - DNA, 22 bp, Homo sapiens
accacctcatcaagctggattg

SEQ ID NO: 73379 - DNA, 22 bp, Homo sapiens
ttagcttttgagaatgatttct

SEQ ID NO: 73380 - DNA, 22 bp, Homo sapiens
gtcctgtgagattcatgctcaa

SEQ ID NO: 73381 - DNA, 22 bp, Homo sapiens
acttgtgttaccaaggtttggt

SEQ ID NO: 73382 - DNA, 22 bp, Homo sapiens
caggaaggggctcactctggcc

SEQ ID NO: 73383 - DNA, 19 bp, Homo sapiens
tggctctgtcgaaggcaca

SEQ ID NO: 73384 - DNA, 22 bp, Homo sapiens
tgcaggcctggactgatgtggt

SEQ ID NO: 73385 - DNA, 21 bp, Homo sapiens
ttgttcctatctgcctcctgc

SEQ ID NO: 73386 - DNA, 22 bp, Homo sapiens
atgtgagtgctatgatagacag

SEQ ID NO: 73387 - DNA, 22 bp, Homo sapiens
ctgaggctggagtgcagtggtg

SEQ ID NO: 73388 - DNA, 22 bp, Homo sapiens
gctgccgacccacaggggttaa

SEQ ID NO: 73389 - DNA, 22 bp, Homo sapiens
ctgccctggggggcctccttgc

SEQ ID NO: 73390 - DNA, 22 bp, Homo sapiens
tccttcactccctctgcatcca

SEQ ID NO: 73391 - DNA, 22 bp, Homo sapiens
tccagctgttccatcagctctt

SEQ ID NO: 73392 - DNA, 22 bp, Homo sapiens
tcttctatcctcagcccctgcc

SEQ ID NO: 73393 - DNA, 22 bp, Homo sapiens
caccaggaggacaggcccctac

SEQ ID NO: 73394 - DNA, 22 bp, Homo sapiens
gaggaggcttccgggaggcacg

SEQ ID NO: 73395 - DNA, 22 bp, Homo sapiens
aatgttgtgcatgtattttgta

SEQ ID NO: 73396 - DNA, 22 bp, Homo sapiens
cctggaggcggaggttgcagtg

SEQ ID NO: 73397 - DNA, 22 bp, Homo sapiens
ctccaacgaggctggggtacaa

SEQ ID NO: 73398 - DNA, 22 bp, Homo sapiens
ataatggtagatgtccacgcag

SEQ ID NO: 73399 - DNA, 22 bp, Homo sapiens
gcggtcggcagaggggctctgc

SEQ ID NO: 73400 - DNA, 22 bp, Homo sapiens
cacagggcttctcatggggtgc

SEQ ID NO: 73401 - DNA, 22 bp, Homo sapiens
ggcttggaccagtcacagtggt

SEQ ID NO: 73402 - DNA, 22 bp, Homo sapiens
ggcagggcaggaaagtcaggaa

SEQ ID NO: 73403 - DNA, 22 bp, Homo sapiens
ccaggtagccaaggggtctggg

SEQ ID NO: 73404 - DNA, 22 bp, Homo sapiens
gctctgccagcccaaggcgcag

SEQ ID NO: 73405 - DNA, 22 bp, Homo sapiens
gtccacagctctgaggtctccc

SEQ ID NO: 73406 - DNA, 22 bp, Homo sapiens
atgagcacactgataagcccct

SEQ ID NO: 73407 - DNA, 22 bp, Homo sapiens
gagaactttctgtgtttttatc

SEQ ID NO: 73408 - DNA, 22 bp, Homo sapiens
ccatcacagtccccatcgtgat

SEQ ID NO: 73409 - DNA, 22 bp, Homo sapiens
ccaccgccatggcgttgtacag

SEQ ID NO: 73410 - DNA, 23 bp, Homo sapiens
tgagctgggcctgcaggggtctc

SEQ ID NO: 73411 - DNA, 22 bp, Homo sapiens
tccttgcagggtttgataaaga

SEQ ID NO: 73412 - DNA, 22 bp, Homo sapiens
aggagggtgggaagcagtttta

SEQ ID NO: 73413 - DNA, 22 bp, Homo sapiens
agacagggtgatcgcttgagcc

SEQ ID NO: 73414 - DNA, 22 bp, Homo sapiens
tggatgctgtaggacacgctct

SEQ ID NO: 73415 - DNA, 22 bp, Homo sapiens
gtggtgtttgagctgccaggga

SEQ ID NO: 73416 - DNA, 22 bp, Homo sapiens
ttgccttgttattctctcagaa

SEQ ID NO: 73417 - DNA, 22 bp, Homo sapiens
ctgaattatttaaggtgaaggg

SEQ ID NO: 73418 - DNA, 22 bp, Homo sapiens
tagtaacccacacaacagtaga

SEQ ID NO: 73419 - DNA, 23 bp, Homo sapiens
aggtaggttattgctgctacctg

SEQ ID NO: 73420 - DNA, 22 bp, Homo sapiens
acgtgctggagaagagctcgcc

SEQ ID NO: 73421 - DNA, 22 bp, Homo sapiens
gatgctgagaggtggagggaac

SEQ ID NO: 73422 - DNA, 18 bp, Homo sapiens
ggagactaaactgttgac

SEQ ID NO: 73423 - DNA, 22 bp, Homo sapiens
tcaaattgtcatcttgataatg

SEQ ID NO: 73424 - DNA, 22 bp, Homo sapiens
gccaggaaagggaattccctga

SEQ ID NO: 73425 - DNA, 22 bp, Homo sapiens
aacgcccgtggttgccaaggta

SEQ ID NO: 73426 - DNA, 21 bp, Homo sapiens
tctgatggtagatgagatgtg

SEQ ID NO: 73427 - DNA, 22 bp, Homo sapiens
cacatttttactgccaacttaa

SEQ ID NO: 73428 - DNA, 22 bp, Homo sapiens
ggcctggcagagcgcgcggctg

SEQ ID NO: 73429 - DNA, 22 bp, Homo sapiens
ttccaatagtgtgaccttatag

SEQ ID NO: 73430 - DNA, 22 bp, Homo sapiens
ctgagcagatgaccagccccag

SEQ ID NO: 73431 - DNA, 22 bp, Homo sapiens
cccaggccctggcagagcttgt

SEQ ID NO: 73432 - DNA, 22 bp, Homo sapiens
tcttgggggactttggcatgga

SEQ ID NO: 73433 - DNA, 22 bp, Homo sapiens
ctaaagtgccaggaatacaggt

SEQ ID NO: 73434 - DNA, 22 bp, Homo sapiens
gccaccctggacgcactgttcg

SEQ ID NO: 73435 - DNA, 22 bp, Homo sapiens
gatggtgcaggtgaagtgctgg

SEQ ID NO: 73436 - DNA, 22 bp, Homo sapiens
aggacagagggaccagagccca

SEQ ID NO: 73437 - DNA, 22 bp, Homo sapiens
tctgcaacattcctctccccac

SEQ ID NO: 73438 - DNA, 22 bp, Homo sapiens
atgttattgatgcctgaggctt

SEQ ID NO: 73439 - DNA, 22 bp, Homo sapiens
gcggggcctgactctgacccgc

SEQ ID NO: 73440 - DNA, 22 bp, Homo sapiens
gcctccggagttgcagtgtctt

SEQ ID NO: 73441 - DNA, 22 bp, Homo sapiens
caatagtaaattacggaggaga

SEQ ID NO: 73442 - DNA, 22 bp, Homo sapiens
tttcttaggctctaaaatgact

SEQ ID NO: 73443 - DNA, 22 bp, Homo sapiens
gcgctcagaaaagattttcttc

SEQ ID NO: 73444 - DNA, 19 bp, Homo sapiens
cgcgccgtcgggtccagcc

SEQ ID NO: 73445 - DNA, 22 bp, Homo sapiens
gccctcctggcaggcagtgatg

SEQ ID NO: 73446 - DNA, 22 bp, Homo sapiens
agttatgtcctcagcaaatcaa

SEQ ID NO: 73447 - DNA, 22 bp, Homo sapiens
gcccagcccagaaaggttcgga

SEQ ID NO: 73448 - DNA, 22 bp, Homo sapiens
ttctagtgtccttggacttgct

SEQ ID NO: 73449 - DNA, 22 bp, Homo sapiens
agctggtgctcggggagctggc

SEQ ID NO: 73450 - DNA, 22 bp, Homo sapiens
cgtgagcaaaatggacactccc

SEQ ID NO: 73451 - DNA, 22 bp, Homo sapiens
agtccaggactgtttcagctga

SEQ ID NO: 73452 - DNA, 22 bp, Homo sapiens
ccagaagcagagcctgaggcag

SEQ ID NO: 73453 - DNA, 22 bp, Homo sapiens
caaagtgctaggattacaggcg

SEQ ID NO: 73454 - DNA, 22 bp, Homo sapiens
cggctgggttcggctgcaggcc

SEQ ID NO: 73455 - DNA, 22 bp, Homo sapiens
ttgtgctcctatgagaatctaa

SEQ ID NO: 73456 - DNA, 22 bp, Homo sapiens
gtgctccctccttcctcaagga

SEQ ID NO: 73457 - DNA, 22 bp, Homo sapiens
ctgccaggattctgtgaacccc

SEQ ID NO: 73458 - DNA, 22 bp, Homo sapiens
tggtatgtaaattgtaactcaa

SEQ ID NO: 73459 - DNA, 22 bp, Homo sapiens
gggatgcagactacagggctta

SEQ ID NO: 73460 - DNA, 22 bp, Homo sapiens
caggaaggcgcggctgtgcctg

SEQ ID NO: 73461 - DNA, 22 bp, Homo sapiens
gcctcctgagtagctgggattg

SEQ ID NO: 73462 - DNA, 22 bp, Homo sapiens
cctagagctctgctttatctaa

SEQ ID NO: 73463 - DNA, 22 bp, Homo sapiens
tccaggctttggggcaggagcg

SEQ ID NO: 73464 - DNA, 22 bp, Homo sapiens
cggaagagggacagcgccagcc

SEQ ID NO: 73465 - DNA, 22 bp, Homo sapiens
ggtctcttgtccaaggtcacac

SEQ ID NO: 73466 - DNA, 22 bp, Homo sapiens
agtgctgggctatctactgcta

SEQ ID NO: 73467 - DNA, 22 bp, Homo sapiens
ctgcactgacttccccggctgc

SEQ ID NO: 73468 - DNA, 22 bp, Homo sapiens
ggttgcaaactcctgggatcaa

SEQ ID NO: 73469 - DNA, 22 bp, Homo sapiens
tgcaggctcttggtgacgtggg

SEQ ID NO: 73470 - DNA, 22 bp, Homo sapiens
acagcagagcctggtacttact

SEQ ID NO: 73471 - DNA, 22 bp, Homo sapiens
cttgtgcatttcattcctcagg

SEQ ID NO: 73472 - DNA, 19 bp, Homo sapiens
ggcttcgaggctggggaag

SEQ ID NO: 73473 - DNA, 22 bp, Homo sapiens
ccctggaggttgaggctgcagt

SEQ ID NO: 73474 - DNA, 22 bp, Homo sapiens
cacactgtctttcagaatggtt

SEQ ID NO: 73475 - DNA, 22 bp, Homo sapiens
ctgggatccacgggctcccaag

SEQ ID NO: 73476 - DNA, 22 bp, Homo sapiens
cgcccaggctggagagcagtgg

SEQ ID NO: 73477 - DNA, 19 bp, Homo sapiens
gatttaaacgtggctctat

SEQ ID NO: 73478 - DNA, 22 bp, Homo sapiens
tcacaatatttatcttccaatt

SEQ ID NO: 73479 - DNA, 22 bp, Homo sapiens
atgtatacgtgcaggtcacagg

SEQ ID NO: 73480 - DNA, 22 bp, Homo sapiens
gagctgaaggagaaagcagggg

SEQ ID NO: 73481 - DNA, 22 bp, Homo sapiens
tgcctccctggcaagtctctcc

SEQ ID NO: 73482 - DNA, 22 bp, Homo sapiens
agctttacctgccttggggcac

SEQ ID NO: 73483 - DNA, 22 bp, Homo sapiens
tgggagcagcctcagcttcggg

SEQ ID NO: 73484 - DNA, 21 bp, Homo sapiens
ctcccagggtgactgttcaac

SEQ ID NO: 73485 - DNA, 22 bp, Homo sapiens
aagaggtaaccatagcaaccac

SEQ ID NO: 73486 - DNA, 22 bp, Homo sapiens
cggccgctgacaaatagttccc

SEQ ID NO: 73487 - DNA, 22 bp, Homo sapiens
agcccagaggctgggcgtgcat

SEQ ID NO: 73488 - DNA, 22 bp, Homo sapiens
ttggagagtgatattcagatgc

SEQ ID NO: 73489 - DNA, 18 bp, Homo sapiens
tcctttctccctcatctt

SEQ ID NO: 73490 - DNA, 22 bp, Homo sapiens
cattgcactcctgcctgggcaa

SEQ ID NO: 73491 - DNA, 22 bp, Homo sapiens
gaccttgtgatctgcctgcctt

SEQ ID NO: 73492 - DNA, 19 bp, Homo sapiens
tttgatagggcataatata

SEQ ID NO: 73493 - DNA, 22 bp, Homo sapiens
tctaaacttgtaaacaagcata

SEQ ID NO: 73494 - DNA, 22 bp, Homo sapiens
tggtagtcggcctcggtggctc

SEQ ID NO: 73495 - DNA, 22 bp, Homo sapiens
ccaggaggcggaaggtacagtg

SEQ ID NO: 73496 - DNA, 22 bp, Homo sapiens
gggatttcaccatgttggttgg

SEQ ID NO: 73497 - DNA, 22 bp, Homo sapiens
tcattgccatggcatttgcaga

SEQ ID NO: 73498 - DNA, 22 bp, Homo sapiens
ttggcttttatgcagcttaggt

SEQ ID NO: 73499 - DNA, 17 bp, Homo sapiens
tctgagaatgctggagg

SEQ ID NO: 73500 - DNA, 22 bp, Homo sapiens
tcagtgcacccaattctctcca

SEQ ID NO: 73501 - DNA, 22 bp, Homo sapiens
aagaggcgccgggtacgtggcg

SEQ ID NO: 73502 - DNA, 22 bp, Homo sapiens
gctgtagtgaatggccgcgttc

SEQ ID NO: 73503 - DNA, 23 bp, Homo sapiens
ctggggctttcaaatctgggcag

SEQ ID NO: 73504 - DNA, 22 bp, Homo sapiens
catcaagtaggtcctttcaaga

SEQ ID NO: 73505 - DNA, 22 bp, Homo sapiens
gctgcaagtgcatgttgcaact

SEQ ID NO: 73506 - DNA, 22 bp, Homo sapiens
cgtgaggggggtaaggcgtccg

SEQ ID NO: 73507 - DNA, 18 bp, Homo sapiens
gcagtgaagaaagagctt

SEQ ID NO: 73508 - DNA, 22 bp, Homo sapiens
gggctgcatcagcaggacccgg

SEQ ID NO: 73509 - DNA, 22 bp, Homo sapiens
gggaagagggagctggaatgat

SEQ ID NO: 73510 - DNA, 21 bp, Homo sapiens
tcgtgcagcagctgaggcttg

SEQ ID NO: 73511 - DNA, 22 bp, Homo sapiens
acaggggattgattggaagtct

SEQ ID NO: 73512 - DNA, 22 bp, Homo sapiens
ctaccgggttctcagccaggca

SEQ ID NO: 73513 - DNA, 22 bp, Homo sapiens
ttgcatcttctggttgagcccc

SEQ ID NO: 73514 - DNA, 22 bp, Homo sapiens
aatttgttataacttgggctga

SEQ ID NO: 73515 - DNA, 22 bp, Homo sapiens
ggcggtctcagcaccctcttgg

SEQ ID NO: 73516 - DNA, 22 bp, Homo sapiens
tgagacaggcttccttcttggg

SEQ ID NO: 73517 - DNA, 22 bp, Homo sapiens
gcaggcagatcacctgtcagga

SEQ ID NO: 73518 - DNA, 22 bp, Homo sapiens
aattcacatccgaccaggtcaa

SEQ ID NO: 73519 - DNA, 22 bp, Homo sapiens
tggaagaatatgggggtacaga

SEQ ID NO: 73520 - DNA, 17 bp, Homo sapiens
gaggccaaggcaggcgg

SEQ ID NO: 73521 - DNA, 22 bp, Homo sapiens
aggttatatgactgtcatgcct

SEQ ID NO: 73522 - DNA, 22 bp, Homo sapiens
ctgatagacaatcaccatggga

SEQ ID NO: 73523 - DNA, 22 bp, Homo sapiens
atcacagggtgaggattagacc

SEQ ID NO: 73524 - DNA, 22 bp, Homo sapiens
ctctgcctgtctcatcctgcaa

SEQ ID NO: 73525 - DNA, 22 bp, Homo sapiens
tgccgcagtgcggggagggccc

SEQ ID NO: 73526 - DNA, 22 bp, Homo sapiens
ctctgtggtggagtgggtcacc

SEQ ID NO: 73527 - DNA, 22 bp, Homo sapiens
tttctttatcatagcatctttg

SEQ ID NO: 73528 - DNA, 22 bp, Homo sapiens
cctgtggcgggggccagtgcct

SEQ ID NO: 73529 - DNA, 22 bp, Homo sapiens
acaatgctccctgtagtcagga

SEQ ID NO: 73530 - DNA, 22 bp, Homo sapiens
aaagtaattgcagtttctgcca

SEQ ID NO: 73531 - DNA, 22 bp, Homo sapiens
aagagaattctggttttcctat

SEQ ID NO: 73532 - DNA, 22 bp, Homo sapiens
gccaggctgaggctctggaaga

SEQ ID NO: 73533 - DNA, 22 bp, Homo sapiens
ttaggtcacatcggtgaccaaa

SEQ ID NO: 73534 - DNA, 22 bp, Homo sapiens
cctgtaatcccagctactcggg

SEQ ID NO: 73535 - DNA, 22 bp, Homo sapiens
tctgctttcttactaaaaatga

SEQ ID NO: 73536 - DNA, 22 bp, Homo sapiens
taatgtataacaaatactcatc

SEQ ID NO: 73537 - DNA, 22 bp, Homo sapiens
aaaatcttgtgacttaggaagg

SEQ ID NO: 73538 - DNA, 22 bp, Homo sapiens
gccgtccacctcgatggccact

SEQ ID NO: 73539 - DNA, 22 bp, Homo sapiens
tgaaatgtgttctagtgttttg

SEQ ID NO: 73540 - DNA, 22 bp, Homo sapiens
ggctagcaaggtagcagaatgc

SEQ ID NO: 73541 - DNA, 22 bp, Homo sapiens
ctcattgcaacctccgcctccc

SEQ ID NO: 73542 - DNA, 22 bp, Homo sapiens
cacagcggcctccgatgctgat

SEQ ID NO: 73543 - DNA, 22 bp, Homo sapiens
ctcactgcaagttccacctacc

SEQ ID NO: 73544 - DNA, 22 bp, Homo sapiens
gggcagccgcgtgacctgccag

SEQ ID NO: 73545 - DNA, 22 bp, Homo sapiens
agtgctatcgagttctaatgct

SEQ ID NO: 73546 - DNA, 22 bp, Homo sapiens
gtggagggtgattgccggctgt

SEQ ID NO: 73547 - DNA, 22 bp, Homo sapiens
cccacacacatttatgatagga

SEQ ID NO: 73548 - DNA, 22 bp, Homo sapiens
gctcgcgccgcaccggtccacc

SEQ ID NO: 73549 - DNA, 22 bp, Homo sapiens
gttgcctaggctggtcttgaac

SEQ ID NO: 73550 - DNA, 22 bp, Homo sapiens
cccatggcttaggagggagtgt

SEQ ID NO: 73551 - DNA, 22 bp, Homo sapiens
tatctcattttattgcaaatgt

SEQ ID NO: 73552 - DNA, 22 bp, Homo sapiens
tctcgctctgtcgcccaggctg

SEQ ID NO: 73553 - DNA, 22 bp, Homo sapiens
tgagtacaagcagtgctttctc

SEQ ID NO: 73554 - DNA, 22 bp, Homo sapiens
tcccagaaccctgccaggtcct

SEQ ID NO: 73555 - DNA, 22 bp, Homo sapiens
ccggtgttcaaagtctggtatg

SEQ ID NO: 73556 - DNA, 22 bp, Homo sapiens
ggcgtttcaccatgttgaccag

SEQ ID NO: 73557 - DNA, 22 bp, Homo sapiens
tgattttctccattgtaaattc

SEQ ID NO: 73558 - DNA, 22 bp, Homo sapiens
ttggccatctaagcccagccac

SEQ ID NO: 73559 - DNA, 19 bp, Homo sapiens
gcctatgtcttcaaatcat

SEQ ID NO: 73560 - DNA, 22 bp, Homo sapiens
agacgctattttgaggggtcta

SEQ ID NO: 73561 - DNA, 22 bp, Homo sapiens
ccttttgctctcccatccagaa

SEQ ID NO: 73562 - DNA, 22 bp, Homo sapiens
taatttcagtgcaagctcacgg

SEQ ID NO: 73563 - DNA, 22 bp, Homo sapiens
tttgttttcaatgtgtcattca

SEQ ID NO: 73564 - DNA, 18 bp, Homo sapiens
ggtgagggagctggaagc

SEQ ID NO: 73565 - DNA, 22 bp, Homo sapiens
ccaggcaggcgatggtgcagtg

SEQ ID NO: 73566 - DNA, 22 bp, Homo sapiens
actgcacttcagcctgggtgtc

SEQ ID NO: 73567 - DNA, 22 bp, Homo sapiens
cgtcacttcttagtctattttc

SEQ ID NO: 73568 - DNA, 22 bp, Homo sapiens
ggaccaggactggtggtatctc

SEQ ID NO: 73569 - DNA, 23 bp, Homo sapiens
actctcaggttctttccagcagg

SEQ ID NO: 73570 - DNA, 22 bp, Homo sapiens
ctgcaccctcaaactcctgggc

SEQ ID NO: 73571 - DNA, 22 bp, Homo sapiens
attcagagcactgggtagaatt

SEQ ID NO: 73572 - DNA, 22 bp, Homo sapiens
ccccatgaagtagggtctctga

SEQ ID NO: 73573 - DNA, 22 bp, Homo sapiens
tgattaatatcaccaccattgg

SEQ ID NO: 73574 - DNA, 22 bp, Homo sapiens
caggaggacatactggctcaca

SEQ ID NO: 73575 - DNA, 23 bp, Homo sapiens
agtgggctcagtcctccaacccc

SEQ ID NO: 73576 - DNA, 22 bp, Homo sapiens
ccaggaggtggagattgcagtg

SEQ ID NO: 73577 - DNA, 22 bp, Homo sapiens
cacagcctcctctggctcacgg

SEQ ID NO: 73578 - DNA, 22 bp, Homo sapiens
tttgctttgtttaaaagtggta

SEQ ID NO: 73579 - DNA, 22 bp, Homo sapiens
tacatagctcctagtgatgcat

SEQ ID NO: 73580 - DNA, 20 bp, Homo sapiens
gagattaactgagaatctag

SEQ ID NO: 73581 - DNA, 22 bp, Homo sapiens
tcctggatggcctgcaggcggt

SEQ ID NO: 73582 - DNA, 18 bp, Homo sapiens
ctgccagtgtgctctccg

SEQ ID NO: 73583 - DNA, 22 bp, Homo sapiens
ggcggagcttgcagtgagccga

SEQ ID NO: 73584 - DNA, 22 bp, Homo sapiens
caagagtgaaactctgtctcaa

SEQ ID NO: 73585 - DNA, 22 bp, Homo sapiens
cccccagctctgctgggtcccg

SEQ ID NO: 73586 - DNA, 22 bp, Homo sapiens
gtcagaggggcagctgccaggc

SEQ ID NO: 73587 - DNA, 22 bp, Homo sapiens
aagagagtcagtctgagcacca

SEQ ID NO: 73588 - DNA, 22 bp, Homo sapiens
cagtgcagccaaggacaggcac

SEQ ID NO: 73589 - DNA, 22 bp, Homo sapiens
aaggcaaaagaggtgtcatcac

SEQ ID NO: 73590 - DNA, 22 bp, Homo sapiens
tgggaatgcaaggaaagctgtt

SEQ ID NO: 73591 - DNA, 19 bp, Homo sapiens
ggctgccttctgctcatct

SEQ ID NO: 73592 - DNA, 22 bp, Homo sapiens
tgccgtggggctgaggctggag

SEQ ID NO: 73593 - DNA, 22 bp, Homo sapiens
tgcctcagctgaggccgctcca

SEQ ID NO: 73594 - DNA, 22 bp, Homo sapiens
ctgaggaggctaatttgaggat

SEQ ID NO: 73595 - DNA, 22 bp, Homo sapiens
ggaggtagcctcaaaagcagct

SEQ ID NO: 73596 - DNA, 22 bp, Homo sapiens
ttgcaaatcagaagtatagatt

SEQ ID NO: 73597 - DNA, 22 bp, Homo sapiens
aggaaagcttggcaaactaaat

SEQ ID NO: 73598 - DNA, 22 bp, Homo sapiens
gtgctttgttaagtctgaaatt

SEQ ID NO: 73599 - DNA, 22 bp, Homo sapiens
agtattctggaattctatgtga

SEQ ID NO: 73600 - DNA, 22 bp, Homo sapiens
ttcctttctctggactgcagcc

SEQ ID NO: 73601 - DNA, 20 bp, Homo sapiens
tttgcgaggccaaggcgggc

SEQ ID NO: 73602 - DNA, 22 bp, Homo sapiens
gcagagctgggatatgaaccca

SEQ ID NO: 73603 - DNA, 22 bp, Homo sapiens
ctggagtagccggacgggtctg

SEQ ID NO: 73604 - DNA, 22 bp, Homo sapiens
tgcgatggcgtagacaaatccc

SEQ ID NO: 73605 - DNA, 22 bp, Homo sapiens
tgtctcatctcttaaccccact

SEQ ID NO: 73606 - DNA, 22 bp, Homo sapiens
gggcctgtgtgttcaggagcct

SEQ ID NO: 73607 - DNA, 22 bp, Homo sapiens
tcagtgcagggtgggagagaga

SEQ ID NO: 73608 - DNA, 20 bp, Homo sapiens
tgtttactctagagggtaga

SEQ ID NO: 73609 - DNA, 22 bp, Homo sapiens
ctggcaggtggaggttgcagtg

SEQ ID NO: 73610 - DNA, 22 bp, Homo sapiens
agaagcattggaccaggggccc

SEQ ID NO: 73611 - DNA, 22 bp, Homo sapiens
ctctggcaattgctgctgactc

SEQ ID NO: 73612 - DNA, 22 bp, Homo sapiens
gggaggttctgttcgcacttga

SEQ ID NO: 73613 - DNA, 22 bp, Homo sapiens
gggctccgcccttggctgagct

SEQ ID NO: 73614 - DNA, 22 bp, Homo sapiens
actgtacctcaaactctggaac

SEQ ID NO: 73615 - DNA, 22 bp, Homo sapiens
aaagatcacgtcccaggactcg

SEQ ID NO: 73616 - DNA, 22 bp, Homo sapiens
agtccaggcattccagccattc

SEQ ID NO: 73617 - DNA, 22 bp, Homo sapiens
tggggcagttaataaacattct

SEQ ID NO: 73618 - DNA, 22 bp, Homo sapiens
gggtggtggccagcagtgggca

SEQ ID NO: 73619 - DNA, 22 bp, Homo sapiens
gggcctgctgcaggttcaggat

SEQ ID NO: 73620 - DNA, 22 bp, Homo sapiens
ttcattcttcagagctgcgctt

SEQ ID NO: 73621 - DNA, 22 bp, Homo sapiens
gtggccccagggccctgtctgg

SEQ ID NO: 73622 - DNA, 22 bp, Homo sapiens
aaggagcacacaatctagaacc

SEQ ID NO: 73623 - DNA, 22 bp, Homo sapiens
tgagcctgggagatggaggctg

SEQ ID NO: 73624 - DNA, 22 bp, Homo sapiens
aacagaatattttgcctttctc

SEQ ID NO: 73625 - DNA, 22 bp, Homo sapiens
accagggaccgccacactgcaa

SEQ ID NO: 73626 - DNA, 23 bp, Homo sapiens
tcaagcaattctcctgcctcggc

SEQ ID NO: 73627 - DNA, 22 bp, Homo sapiens
tgagcacatgccagcccttctc

SEQ ID NO: 73628 - DNA, 22 bp, Homo sapiens
ttctgtgaatcttttttcccac

SEQ ID NO: 73629 - DNA, 22 bp, Homo sapiens
gtccaggcctgcctctgaggag

SEQ ID NO: 73630 - DNA, 22 bp, Homo sapiens
atagaataatggttgtcaggag

SEQ ID NO: 73631 - DNA, 22 bp, Homo sapiens
tctgtggcccaagtgatggctg

SEQ ID NO: 73632 - DNA, 22 bp, Homo sapiens
atggatcagaatcccgggaggg

SEQ ID NO: 73633 - DNA, 22 bp, Homo sapiens
ggtgtagctctgtgtcccactg

SEQ ID NO: 73634 - DNA, 21 bp, Homo sapiens
cagaggcctatcacagactcc

SEQ ID NO: 73635 - DNA, 22 bp, Homo sapiens
gagaatgtttctgtctgccctt

SEQ ID NO: 73636 - DNA, 22 bp, Homo sapiens
cactgcaacctccacctcctgg

SEQ ID NO: 73637 - DNA, 22 bp, Homo sapiens
cactccagcctcagtgacagag

SEQ ID NO: 73638 - DNA, 22 bp, Homo sapiens
tgggatgccctgaccctctgga

SEQ ID NO: 73639 - DNA, 22 bp, Homo sapiens
tgctgctcagaacccctgggct

SEQ ID NO: 73640 - DNA, 22 bp, Homo sapiens
aagggctctgtgcttgtcccat

SEQ ID NO: 73641 - DNA, 22 bp, Homo sapiens
aatgccttggagagcctagagg

SEQ ID NO: 73642 - DNA, 22 bp, Homo sapiens
agaggggcccggttctccgtct

SEQ ID NO: 73643 - DNA, 22 bp, Homo sapiens
tcacagagttaaaagtttcttt

SEQ ID NO: 73644 - DNA, 22 bp, Homo sapiens
aggtcacgtcctgtgatgtcat

SEQ ID NO: 73645 - DNA, 22 bp, Homo sapiens
ttgtctaatgagctccacttca

SEQ ID NO: 73646 - DNA, 22 bp, Homo sapiens
gagagtgagatcctcctgggga

SEQ ID NO: 73647 - DNA, 22 bp, Homo sapiens
aaggctgaggcagtgaggcaga

SEQ ID NO: 73648 - DNA, 22 bp, Homo sapiens
aaagtgctgggattacaggcct

SEQ ID NO: 73649 - DNA, 22 bp, Homo sapiens
tcagtgccatgggcagacaggc

SEQ ID NO: 73650 - DNA, 22 bp, Homo sapiens
cggctggtgtcgggcacagcaa

SEQ ID NO: 73651 - DNA, 22 bp, Homo sapiens
cttcactttaagccaatcatga

SEQ ID NO: 73652 - DNA, 22 bp, Homo sapiens
tgtgtggattcatctcaaagag

SEQ ID NO: 73653 - DNA, 22 bp, Homo sapiens
aagctctttccactaaaccact

SEQ ID NO: 73654 - DNA, 22 bp, Homo sapiens
cactctgcgctgggcgccagcg

SEQ ID NO: 73655 - DNA, 22 bp, Homo sapiens
ttagggttacaccagcctcctg

SEQ ID NO: 73656 - DNA, 22 bp, Homo sapiens
ttgttgtcattgtagaggattt

SEQ ID NO: 73657 - DNA, 22 bp, Homo sapiens
tccttgtaacgttgggctgggg

SEQ ID NO: 73658 - DNA, 22 bp, Homo sapiens
gaactcattagcctgctttcag

SEQ ID NO: 73659 - DNA, 22 bp, Homo sapiens
cgcggtggcggcctccagcgcc

SEQ ID NO: 73660 - DNA, 22 bp, Homo sapiens
tctgccttgtttgagctttgac

SEQ ID NO: 73661 - DNA, 22 bp, Homo sapiens
atgccactgcactccagcctag

SEQ ID NO: 73662 - DNA, 22 bp, Homo sapiens
atatatttgagaatattcatga

SEQ ID NO: 73663 - DNA, 22 bp, Homo sapiens
taggtagctttggcgtttcttg

SEQ ID NO: 73664 - DNA, 17 bp, Homo sapiens
catccgtgagctcggca

SEQ ID NO: 73665 - DNA, 22 bp, Homo sapiens
ttgccaggctggagtgcagtgg

SEQ ID NO: 73666 - DNA, 22 bp, Homo sapiens
cttgaagtggagcttttgaaat

SEQ ID NO: 73667 - DNA, 22 bp, Homo sapiens
cagtggcaggatttcagctcag

SEQ ID NO: 73668 - DNA, 21 bp, Homo sapiens
acagcctccatctcctgggct

SEQ ID NO: 73669 - DNA, 22 bp, Homo sapiens
cagggagtgtacaccatgtgta

SEQ ID NO: 73670 - DNA, 22 bp, Homo sapiens
ttggaaacgtcaccttttcctt

SEQ ID NO: 73671 - DNA, 20 bp, Homo sapiens
aaaatatgtataactcttct

SEQ ID NO: 73672 - DNA, 22 bp, Homo sapiens
tcctgggccctccggatcaggt

SEQ ID NO: 73673 - DNA, 23 bp, Homo sapiens
tgtgggcgcattgtaagggtagc

SEQ ID NO: 73674 - DNA, 22 bp, Homo sapiens
atagaatatgacttttagatcc

SEQ ID NO: 73675 - DNA, 22 bp, Homo sapiens
acctggacacctgctgtcatct

SEQ ID NO: 73676 - DNA, 22 bp, Homo sapiens
gccttgtttcattacacgtggt

SEQ ID NO: 73677 - DNA, 22 bp, Homo sapiens
cccgggaggcagaggttgcagt

SEQ ID NO: 73678 - DNA, 22 bp, Homo sapiens
atgttctacagatggaaagggg

SEQ ID NO: 73679 - DNA, 22 bp, Homo sapiens
tgcacgtgggctctctgctctt

SEQ ID NO: 73680 - DNA, 22 bp, Homo sapiens
tgggagaaagaaccctgagtga

SEQ ID NO: 73681 - DNA, 22 bp, Homo sapiens
tgtccaggctaaagtgcagtgg

SEQ ID NO: 73682 - DNA, 22 bp, Homo sapiens
agtgggccggacagcccaggcc

SEQ ID NO: 73683 - DNA, 22 bp, Homo sapiens
ttcttcatgggttcttttagga

SEQ ID NO: 73684 - DNA, 22 bp, Homo sapiens
caggctgctgacaggcttggag

SEQ ID NO: 73685 - DNA, 23 bp, Homo sapiens
ttctgggctgtggaagcctcggg

SEQ ID NO: 73686 - DNA, 22 bp, Homo sapiens
agctcaccacaacctccgcctc

SEQ ID NO: 73687 - DNA, 22 bp, Homo sapiens
tttattggatatttacaagata

SEQ ID NO: 73688 - DNA, 22 bp, Homo sapiens
atatattttttgagacagagtc

SEQ ID NO: 73689 - DNA, 22 bp, Homo sapiens
ttccagagagttattcccctgg

SEQ ID NO: 73690 - DNA, 22 bp, Homo sapiens
cctgcacagccggacccctgct

SEQ ID NO: 73691 - DNA, 22 bp, Homo sapiens
cctggggccccgagccagaagc

SEQ ID NO: 73692 - DNA, 20 bp, Homo sapiens
agcagagtgcccatcccgga

SEQ ID NO: 73693 - DNA, 22 bp, Homo sapiens
agtggcctggagccccgcctgg

SEQ ID NO: 73694 - DNA, 22 bp, Homo sapiens
cactgcactccagcactccagc

SEQ ID NO: 73695 - DNA, 22 bp, Homo sapiens
gagatcggtaaagagcatgcac

SEQ ID NO: 73696 - DNA, 22 bp, Homo sapiens
ggcttggaaactagagtgtgca

SEQ ID NO: 73697 - DNA, 22 bp, Homo sapiens
cagcacatgctcatcagggaag

SEQ ID NO: 73698 - DNA, 22 bp, Homo sapiens
ctgcgggctgtcaggcgtgcca

SEQ ID NO: 73699 - DNA, 22 bp, Homo sapiens
gctgtgtccaggtgggggtgac

SEQ ID NO: 73700 - DNA, 22 bp, Homo sapiens
cctgaggatgccagcatgggtg

SEQ ID NO: 73701 - DNA, 22 bp, Homo sapiens
tcctgagccctactctagacga

SEQ ID NO: 73702 - DNA, 22 bp, Homo sapiens
aaagtgctaggattacaagcgt

SEQ ID NO: 73703 - DNA, 22 bp, Homo sapiens
tgtctattaattccacataaaa

SEQ ID NO: 73704 - DNA, 22 bp, Homo sapiens
ggcatcttgttgctcaaatcta

SEQ ID NO: 73705 - DNA, 22 bp, Homo sapiens
aagacactcattatcactggtt

SEQ ID NO: 73706 - DNA, 21 bp, Homo sapiens
tctgccagctgaagaggtgga

SEQ ID NO: 73707 - DNA, 22 bp, Homo sapiens
gtgagcagagatcgcgtgattg

SEQ ID NO: 73708 - DNA, 22 bp, Homo sapiens
aatgactaaatctgaagatagg

SEQ ID NO: 73709 - DNA, 22 bp, Homo sapiens
ttgctcttgaaaattgatgctg

SEQ ID NO: 73710 - DNA, 22 bp, Homo sapiens
tggtctttgtccctccttgatc

SEQ ID NO: 73711 - DNA, 22 bp, Homo sapiens
acacttggagcaacacttatgg

SEQ ID NO: 73712 - DNA, 22 bp, Homo sapiens
gcccagtagttcaaggttgcag

SEQ ID NO: 73713 - DNA, 22 bp, Homo sapiens
ctggcagagttgggtctcaaat

SEQ ID NO: 73714 - DNA, 22 bp, Homo sapiens
cactaggcgccgggtggctgtg

SEQ ID NO: 73715 - DNA, 22 bp, Homo sapiens
caaagcaggaagctcctgacag

SEQ ID NO: 73716 - DNA, 22 bp, Homo sapiens
tgagcaggcgcagcaggaggtc

SEQ ID NO: 73717 - DNA, 22 bp, Homo sapiens
tggcacttttcccagttttggt

SEQ ID NO: 73718 - DNA, 22 bp, Homo sapiens
gtgtaagtatctttgtatcttt

SEQ ID NO: 73719 - DNA, 22 bp, Homo sapiens
aagtgcttccatgtttgagtgt

SEQ ID NO: 73720 - DNA, 22 bp, Homo sapiens
ttccaaagaagttcacatttac

SEQ ID NO: 73721 - DNA, 22 bp, Homo sapiens
gactggaaagcctgtcctcaga

SEQ ID NO: 73722 - DNA, 20 bp, Homo sapiens
gtgcaatggcaccatctcag

SEQ ID NO: 73723 - DNA, 22 bp, Homo sapiens
tttggtaagtacccacctgggt

SEQ ID NO: 73724 - DNA, 22 bp, Homo sapiens
cctgtaatcccaactacttggg

SEQ ID NO: 73725 - DNA, 22 bp, Homo sapiens
tgacttgtctctttgggagaca

SEQ ID NO: 73726 - DNA, 20 bp, Homo sapiens
tgttctgtcgtctttcttca

SEQ ID NO: 73727 - DNA, 22 bp, Homo sapiens
ttgatacccaagtgttatgggt

SEQ ID NO: 73728 - DNA, 22 bp, Homo sapiens
cacagagctggaaaggctgggc

SEQ ID NO: 73729 - DNA, 22 bp, Homo sapiens
gcctcctggggtgccatcatct

SEQ ID NO: 73730 - DNA, 22 bp, Homo sapiens
aggctgtgtgctccttatgaga

SEQ ID NO: 73731 - DNA, 22 bp, Homo sapiens
gttctgggagatcttgagcttc

SEQ ID NO: 73732 - DNA, 22 bp, Homo sapiens
taaagattgctcaaaactgtga

SEQ ID NO: 73733 - DNA, 22 bp, Homo sapiens
gcttggctttactagggggaca

SEQ ID NO: 73734 - DNA, 22 bp, Homo sapiens
aaagtgctgggattacaggtgt

SEQ ID NO: 73735 - DNA, 22 bp, Homo sapiens
aggagagctggtgtctggaatc

SEQ ID NO: 73736 - DNA, 22 bp, Homo sapiens
gtcctgacggctgattggcctg

SEQ ID NO: 73737 - DNA, 22 bp, Homo sapiens
ggtgttgcagttgaagactggt

SEQ ID NO: 73738 - DNA, 22 bp, Homo sapiens
cttggggaagccactgatccct

SEQ ID NO: 73739 - DNA, 22 bp, Homo sapiens
aatcacttagaacccaggaagt

SEQ ID NO: 73740 - DNA, 22 bp, Homo sapiens
tgcttgtgacagaactgtgtcc

SEQ ID NO: 73741 - DNA, 22 bp, Homo sapiens
catcagaacgtgagctccttgt

SEQ ID NO: 73742 - DNA, 22 bp, Homo sapiens
aagattttcagtgcctaaaaca

SEQ ID NO: 73743 - DNA, 21 bp, Homo sapiens
tgaaggtgttcatgatgcggt

SEQ ID NO: 73744 - DNA, 22 bp, Homo sapiens
agctgccgatgcccagctgcat

SEQ ID NO: 73745 - DNA, 22 bp, Homo sapiens
agccaagcactcaactcctgga

SEQ ID NO: 73746 - DNA, 22 bp, Homo sapiens
cactgcccaccaagtggctggt

SEQ ID NO: 73747 - DNA, 22 bp, Homo sapiens
ctgcttgcaaagtgttggtgat

SEQ ID NO: 73748 - DNA, 22 bp, Homo sapiens
acattacctggcatttgatctt

SEQ ID NO: 73749 - DNA, 22 bp, Homo sapiens
cacccaggctggagtgcagtgg

SEQ ID NO: 73750 - DNA, 15 bp, Homo sapiens
ccttcccacccaccc

SEQ ID NO: 73751 - DNA, 22 bp, Homo sapiens
aaagtgctgggattacaagtgt

SEQ ID NO: 73752 - DNA, 18 bp, Homo sapiens
gatcgggggcgccccaag

SEQ ID NO: 73753 - DNA, 22 bp, Homo sapiens
cccgtgtggatgcgctggtgct

SEQ ID NO: 73754 - DNA, 22 bp, Homo sapiens
aggggcacgagtagagctctag

SEQ ID NO: 73755 - DNA, 22 bp, Homo sapiens
gaccttcttgctgtgtcctaac

SEQ ID NO: 73756 - DNA, 20 bp, Homo sapiens
agagatggggtatcaccgta

SEQ ID NO: 73757 - DNA, 22 bp, Homo sapiens
aaggggtgcaagttaatcagca

SEQ ID NO: 73758 - DNA, 22 bp, Homo sapiens
ccaggggttggaggttgcagtg

SEQ ID NO: 73759 - DNA, 22 bp, Homo sapiens
aggtaaatgtcagagcctttaa

SEQ ID NO: 73760 - DNA, 22 bp, Homo sapiens
gaggctgaggttgcagtgagct

SEQ ID NO: 73761 - DNA, 22 bp, Homo sapiens
aggcaaggtgctacagacagtg

SEQ ID NO: 73762 - DNA, 16 bp, Homo sapiens
cttggtgttggcagag

SEQ ID NO: 73763 - DNA, 22 bp, Homo sapiens
cagtctctaaatcaatctgaat

SEQ ID NO: 73764 - DNA, 22 bp, Homo sapiens
tgacagtaccactgaaagtctg

SEQ ID NO: 73765 - DNA, 22 bp, Homo sapiens
agtgaatgtccccgcgggtcag

SEQ ID NO: 73766 - DNA, 22 bp, Homo sapiens
ggtttattgttaataagtttga

SEQ ID NO: 73767 - DNA, 22 bp, Homo sapiens
gaatttcacaaggtgaggataa

SEQ ID NO: 73768 - DNA, 22 bp, Homo sapiens
tgttattgtcgctgcactggga

SEQ ID NO: 73769 - DNA, 23 bp, Homo sapiens
aaataggagtatctggatcatga

SEQ ID NO: 73770 - DNA, 22 bp, Homo sapiens
gggccaccccactgcccacgct

SEQ ID NO: 73771 - DNA, 22 bp, Homo sapiens
aggagctcagctaagttggaga

SEQ ID NO: 73772 - DNA, 22 bp, Homo sapiens
tccagcccaggctggagtgtag

SEQ ID NO: 73773 - DNA, 19 bp, Homo sapiens
ctgggatgtctcctcccag

SEQ ID NO: 73774 - DNA, 23 bp, Homo sapiens
gcctgccgcctggctgagaactg

SEQ ID NO: 73775 - DNA, 22 bp, Homo sapiens
tgagctgcttcttataatgtgt

SEQ ID NO: 73776 - DNA, 22 bp, Homo sapiens
cccaggccccagggcttgtcag

SEQ ID NO: 73777 - DNA, 22 bp, Homo sapiens
aggtttctttatgctgctagaa

SEQ ID NO: 73778 - DNA, 22 bp, Homo sapiens
ctgctaaacctctctgagagct

SEQ ID NO: 73779 - DNA, 22 bp, Homo sapiens
tggcacgacaattggcaccaat

SEQ ID NO: 73780 - DNA, 22 bp, Homo sapiens
ggcaagaaccacaattactttt

SEQ ID NO: 73781 - DNA, 22 bp, Homo sapiens
ccttctcagccccagctcccgc

SEQ ID NO: 73782 - DNA, 22 bp, Homo sapiens
cagcctgccgtcagccaggtag

SEQ ID NO: 73783 - DNA, 22 bp, Homo sapiens
tcagcctggcaggatggcctgg

SEQ ID NO: 73784 - DNA, 20 bp, Homo sapiens
gccgactgccttgtgagcct

SEQ ID NO: 73785 - DNA, 22 bp, Homo sapiens
tgtttacagctgatcaggcatc

SEQ ID NO: 73786 - DNA, 19 bp, Homo sapiens
agaaccactgctctcttca

SEQ ID NO: 73787 - DNA, 22 bp, Homo sapiens
ttctcaagaacatatgtagggt

SEQ ID NO: 73788 - DNA, 22 bp, Homo sapiens
taatgcacatagaagtacttag

SEQ ID NO: 73789 - DNA, 22 bp, Homo sapiens
ctgatccctccatagggcacag

SEQ ID NO: 73790 - DNA, 22 bp, Homo sapiens
tgaaatgttaaacaagtggctc

SEQ ID NO: 73791 - DNA, 22 bp, Homo sapiens
tagaggccgaatgctgagctgg

SEQ ID NO: 73792 - DNA, 22 bp, Homo sapiens
tcttgccgcgcaggcgcagttc

SEQ ID NO: 73793 - DNA, 22 bp, Homo sapiens
cacctagggtttcgcctttctt

SEQ ID NO: 73794 - DNA, 22 bp, Homo sapiens
gaggtaggtgtaggaggcctgc

SEQ ID NO: 73795 - DNA, 22 bp, Homo sapiens
tctgacattttgagaatgacat

SEQ ID NO: 73796 - DNA, 22 bp, Homo sapiens
actacagtgtgataagaggggc

SEQ ID NO: 73797 - DNA, 22 bp, Homo sapiens
gggtccctggaattacttgaca

SEQ ID NO: 73798 - DNA, 22 bp, Homo sapiens
cccaggaggtcaaggctgcagt

SEQ ID NO: 73799 - DNA, 22 bp, Homo sapiens
caggctgtccaggctcctttgg

SEQ ID NO: 73800 - DNA, 22 bp, Homo sapiens
cctagatgggatggcggccggg

SEQ ID NO: 73801 - DNA, 22 bp, Homo sapiens
atattagtttggagactacaat

SEQ ID NO: 73802 - DNA, 22 bp, Homo sapiens
cttagctgcgggccctcctcgc

SEQ ID NO: 73803 - DNA, 22 bp, Homo sapiens
tcctcctgtctaccagttcctg

SEQ ID NO: 73804 - DNA, 21 bp, Homo sapiens
gttgtggttggggctgcagct

SEQ ID NO: 73805 - DNA, 18 bp, Homo sapiens
cccggctaatttttggta

SEQ ID NO: 73806 - DNA, 22 bp, Homo sapiens
aactcactttgtggcttctgaa

SEQ ID NO: 73807 - DNA, 22 bp, Homo sapiens
aaaggcttcggatcagaaggta

SEQ ID NO: 73808 - DNA, 22 bp, Homo sapiens
aggggtgacacatatcagtgca

SEQ ID NO: 73809 - DNA, 22 bp, Homo sapiens
gaccttgtgatccacccgcttt

SEQ ID NO: 73810 - DNA, 22 bp, Homo sapiens
tgggcaaggctggagcctgcag

SEQ ID NO: 73811 - DNA, 22 bp, Homo sapiens
agcacctccagagcttgaagct

SEQ ID NO: 73812 - DNA, 22 bp, Homo sapiens
tcactgcaagctctgccttccg

SEQ ID NO: 73813 - DNA, 22 bp, Homo sapiens
tgctcgccccacatgccctcat

SEQ ID NO: 73814 - DNA, 22 bp, Homo sapiens
gtgtggaatggagtttttgccc

SEQ ID NO: 73815 - DNA, 22 bp, Homo sapiens
cgttaataggtgcaaggtaagg

SEQ ID NO: 73816 - DNA, 22 bp, Homo sapiens
aagctggagtgcagtgcaatgg

SEQ ID NO: 73817 - DNA, 22 bp, Homo sapiens
gggcagagactcagaaacagaa

SEQ ID NO: 73818 - DNA, 22 bp, Homo sapiens
tgctgagcgcatccggcggccg

SEQ ID NO: 73819 - DNA, 22 bp, Homo sapiens
ccaagcaaataatcacccacta

SEQ ID NO: 73820 - DNA, 22 bp, Homo sapiens
cgtcatcacggcaagcatctcc

SEQ ID NO: 73821 - DNA, 22 bp, Homo sapiens
gggggctaccgtctctggagct

SEQ ID NO: 73822 - DNA, 22 bp, Homo sapiens
gttctgagtcctcctttgaagg

SEQ ID NO: 73823 - DNA, 18 bp, Homo sapiens
catgggtgacaggtggat

SEQ ID NO: 73824 - DNA, 22 bp, Homo sapiens
gagcagtaggagaaccctgagc

SEQ ID NO: 73825 - DNA, 22 bp, Homo sapiens
aagcgccatggttcctgcgcag

SEQ ID NO: 73826 - DNA, 22 bp, Homo sapiens
aacccgagggccccaggctcgg

SEQ ID NO: 73827 - DNA, 22 bp, Homo sapiens
aagctgtagcttttcaaaacgt

SEQ ID NO: 73828 - DNA, 22 bp, Homo sapiens
cggccgcagcagtgtcggccca

SEQ ID NO: 73829 - DNA, 22 bp, Homo sapiens
tctgaatcgttcccatgcagga

SEQ ID NO: 73830 - DNA, 20 bp, Homo sapiens
caggtccagcacgtgcacgg

SEQ ID NO: 73831 - DNA, 22 bp, Homo sapiens
tggtcttagctggaaggaggga

SEQ ID NO: 73832 - DNA, 22 bp, Homo sapiens
tgtgcgtcctgtgcgcacactg

SEQ ID NO: 73833 - DNA, 22 bp, Homo sapiens
tgtctcctcggctgtccagcca

SEQ ID NO: 73834 - DNA, 21 bp, Homo sapiens
ccagagcctgagaggattatg

SEQ ID NO: 73835 - DNA, 22 bp, Homo sapiens
agatgtttataactcatgagtg

SEQ ID NO: 73836 - DNA, 22 bp, Homo sapiens
ccaaagtgctgagattacaggt

SEQ ID NO: 73837 - DNA, 22 bp, Homo sapiens
tttctggcagcgggacaggggt

SEQ ID NO: 73838 - DNA, 22 bp, Homo sapiens
ctggaaggcagaggttgcagtg

SEQ ID NO: 73839 - DNA, 22 bp, Homo sapiens
gaagaaggtggcccaggggtag

SEQ ID NO: 73840 - DNA, 22 bp, Homo sapiens
agtcccaacagcttacaaggaa

SEQ ID NO: 73841 - DNA, 22 bp, Homo sapiens
gctgctttgtctgtaaaatgga

SEQ ID NO: 73842 - DNA, 22 bp, Homo sapiens
cttctcttcctttgtcaactga

SEQ ID NO: 73843 - DNA, 22 bp, Homo sapiens
actcaaatagcaacggtgagaa

SEQ ID NO: 73844 - DNA, 22 bp, Homo sapiens
ggtatactgcatgacattgggg

SEQ ID NO: 73845 - DNA, 22 bp, Homo sapiens
cattgcacaccagcctgggcaa

SEQ ID NO: 73846 - DNA, 19 bp, Homo sapiens
tgctaccgtgggatgctta

SEQ ID NO: 73847 - DNA, 22 bp, Homo sapiens
ctgcagtatgagctacccaggt

SEQ ID NO: 73848 - DNA, 22 bp, Homo sapiens
aacatacgagcagtttatagag

SEQ ID NO: 73849 - DNA, 22 bp, Homo sapiens
atcctccagctcctgcttctgc

SEQ ID NO: 73850 - DNA, 22 bp, Homo sapiens
gattgagtctgaggatgctgca

SEQ ID NO: 73851 - DNA, 22 bp, Homo sapiens
cttatagtatgatgttgagaat

SEQ ID NO: 73852 - DNA, 22 bp, Homo sapiens
agcccaggagtttgaggctgtg

SEQ ID NO: 73853 - DNA, 21 bp, Homo sapiens
ctagaaagaatgttgtcgtct

SEQ ID NO: 73854 - DNA, 22 bp, Homo sapiens
tctttgctattgtgaatagtgc

SEQ ID NO: 73855 - DNA, 22 bp, Homo sapiens
gacaattagatcattcctttga

SEQ ID NO: 73856 - DNA, 22 bp, Homo sapiens
ccacagaattctgtctccagga

SEQ ID NO: 73857 - DNA, 22 bp, Homo sapiens
ccgcaaggcagaggttgcagtg

SEQ ID NO: 73858 - DNA, 22 bp, Homo sapiens
gaatgctaagcatgtgggagtt

SEQ ID NO: 73859 - DNA, 22 bp, Homo sapiens
tgtgctcagtctttggctggga

SEQ ID NO: 73860 - DNA, 22 bp, Homo sapiens
ctgggatgcggaggttgcggtg

SEQ ID NO: 73861 - DNA, 22 bp, Homo sapiens
ggaggcggaggctgcagtgagc

SEQ ID NO: 73862 - DNA, 22 bp, Homo sapiens
ctctttggatagaattacaaag

SEQ ID NO: 73863 - DNA, 22 bp, Homo sapiens
aagcccggttgggaacgtggtg

SEQ ID NO: 73864 - DNA, 22 bp, Homo sapiens
atgccactgacatggacaattt

SEQ ID NO: 73865 - DNA, 22 bp, Homo sapiens
gctaatcaatgttaaggctgtg

SEQ ID NO: 73866 - DNA, 22 bp, Homo sapiens
gaaaattattgaaaatggctct

SEQ ID NO: 73867 - DNA, 22 bp, Homo sapiens
ttatcacttatgagctttttgc

SEQ ID NO: 73868 - DNA, 22 bp, Homo sapiens
cttcatagtgagtttaatgatg

SEQ ID NO: 73869 - DNA, 22 bp, Homo sapiens
ctcttcatagcaaacatatggg

SEQ ID NO: 73870 - DNA, 22 bp, Homo sapiens
tggccagctttgactgtaaacc

SEQ ID NO: 73871 - DNA, 21 bp, Homo sapiens
gggcctggctgcgcaggacgg

SEQ ID NO: 73872 - DNA, 21 bp, Homo sapiens
ccgtgctcggctatggaccac

SEQ ID NO: 73873 - DNA, 22 bp, Homo sapiens
agaagcagaaactgggcttgtg

SEQ ID NO: 73874 - DNA, 22 bp, Homo sapiens
gaccaaggaagaggggagccag

SEQ ID NO: 73875 - DNA, 22 bp, Homo sapiens
cagctcacccatcacgtctgct

SEQ ID NO: 73876 - DNA, 22 bp, Homo sapiens
ctccatatgttcagttatgcag

SEQ ID NO: 73877 - DNA, 22 bp, Homo sapiens
tgggattcaccatgggcttcag

SEQ ID NO: 73878 - DNA, 22 bp, Homo sapiens
cgcaccactgaattccagcctg

SEQ ID NO: 73879 - DNA, 22 bp, Homo sapiens
ccaaagtgctgggattacaggc

SEQ ID NO: 73880 - DNA, 22 bp, Homo sapiens
aggatcagggtggtggaagtca

SEQ ID NO: 73881 - DNA, 22 bp, Homo sapiens
tgtgtgagtaaggctgagagag

SEQ ID NO: 73882 - DNA, 22 bp, Homo sapiens
cggcatgggcgtccccctcact

SEQ ID NO: 73883 - DNA, 22 bp, Homo sapiens
aattgcactttagcaatggtga

SEQ ID NO: 73884 - DNA, 22 bp, Homo sapiens
atgatgtaaaataagttgtgag

SEQ ID NO: 73885 - DNA, 22 bp, Homo sapiens
cacttgttggtggtgaaatcac

SEQ ID NO: 73886 - DNA, 22 bp, Homo sapiens
atttgtgggactataatgcagg

SEQ ID NO: 73887 - DNA, 22 bp, Homo sapiens
agaacactgatagctgagggga

SEQ ID NO: 73888 - DNA, 22 bp, Homo sapiens
tcccaggccacacttggggaac

SEQ ID NO: 73889 - DNA, 23 bp, Homo sapiens
aaaacagcttcctccagtggctc

SEQ ID NO: 73890 - DNA, 21 bp, Homo sapiens
atgcattcctcccctttcctc

SEQ ID NO: 73891 - DNA, 22 bp, Homo sapiens
gttcaagaccagcctggccaac

SEQ ID NO: 73892 - DNA, 22 bp, Homo sapiens
ggaggcccagaaggaagcccag

SEQ ID NO: 73893 - DNA, 22 bp, Homo sapiens
gctactgattgaccttggagag

SEQ ID NO: 73894 - DNA, 22 bp, Homo sapiens
gctctgagtcacactgccctgt

SEQ ID NO: 73895 - DNA, 22 bp, Homo sapiens
gggggaagaaagaacatggcat

SEQ ID NO: 73896 - DNA, 22 bp, Homo sapiens
gctcggtggccagcctgaggcc

SEQ ID NO: 73897 - DNA, 22 bp, Homo sapiens
agccagggacgctgcaggctac

SEQ ID NO: 73898 - DNA, 22 bp, Homo sapiens
ggagtagctgcattccgagcac

SEQ ID NO: 73899 - DNA, 22 bp, Homo sapiens
tagatctgatacaattcatctg

SEQ ID NO: 73900 - DNA, 22 bp, Homo sapiens
aagggcatgagaagcttgaaag

SEQ ID NO: 73901 - DNA, 22 bp, Homo sapiens
gggagctgaaggagccggcggg

SEQ ID NO: 73902 - DNA, 22 bp, Homo sapiens
ccaggctggagtgcaatggcgt

SEQ ID NO: 73903 - DNA, 22 bp, Homo sapiens
ttaaacatttatggaggcagca

SEQ ID NO: 73904 - DNA, 22 bp, Homo sapiens
ggctgggcaggtctgcacaggg

SEQ ID NO: 73905 - DNA, 22 bp, Homo sapiens
ttaggcctttgattggggtgct

SEQ ID NO: 73906 - DNA, 22 bp, Homo sapiens
tgaccacattgatttctcatcc

SEQ ID NO: 73907 - DNA, 22 bp, Homo sapiens
caggagtgtctccacacagcaa

SEQ ID NO: 73908 - DNA, 22 bp, Homo sapiens
ccacgcatccctccacagagag

SEQ ID NO: 73909 - DNA, 22 bp, Homo sapiens
agcatgcgcttgatcagctcca

SEQ ID NO: 73910 - DNA, 22 bp, Homo sapiens
ccagttccagtgctcacatcca

SEQ ID NO: 73911 - DNA, 22 bp, Homo sapiens
aggacaaaggaccagatctgga

SEQ ID NO: 73912 - DNA, 22 bp, Homo sapiens
catccatagcttgatctgttcc

SEQ ID NO: 73913 - DNA, 22 bp, Homo sapiens
ccattgtaaattctgtggaagt

SEQ ID NO: 73914 - DNA, 22 bp, Homo sapiens
caggagttttaaatctagcatg

SEQ ID NO: 73915 - DNA, 22 bp, Homo sapiens
gagagcaggaggcagcgggacg

SEQ ID NO: 73916 - DNA, 22 bp, Homo sapiens
tcgtgatctgtccacctcggcc

SEQ ID NO: 73917 - DNA, 22 bp, Homo sapiens
ttcagacaggcagctgggctgg

SEQ ID NO: 73918 - DNA, 22 bp, Homo sapiens
gcagggaggtttgctgacctgg

SEQ ID NO: 73919 - DNA, 22 bp, Homo sapiens
cttgatctacatagtgaaaccc

SEQ ID NO: 73920 - DNA, 22 bp, Homo sapiens
gggcggggggagctggaatgaa

SEQ ID NO: 73921 - DNA, 22 bp, Homo sapiens
agccggccatgtggtcttgtgc

SEQ ID NO: 73922 - DNA, 22 bp, Homo sapiens
ttagatttacaagcactgttta

SEQ ID NO: 73923 - DNA, 22 bp, Homo sapiens
cagtcactggaatagctgagga

SEQ ID NO: 73924 - DNA, 22 bp, Homo sapiens
aacagctttgtatacagtaact

SEQ ID NO: 73925 - DNA, 22 bp, Homo sapiens
ccagcctggttcagaattggct

SEQ ID NO: 73926 - DNA, 22 bp, Homo sapiens
aaggcaaggcttccagctcccc

SEQ ID NO: 73927 - DNA, 22 bp, Homo sapiens
accctggacatcttgtcatagc

SEQ ID NO: 73928 - DNA, 22 bp, Homo sapiens
tgcgcctggggccctggctgtc

SEQ ID NO: 73929 - DNA, 16 bp, Homo sapiens
ccacctgcagctctca

SEQ ID NO: 73930 - DNA, 22 bp, Homo sapiens
gaggtgggcggatcacaaggtc

SEQ ID NO: 73931 - DNA, 22 bp, Homo sapiens
cgtggcctctatggctcccgcc

SEQ ID NO: 73932 - DNA, 22 bp, Homo sapiens
gcggtatttgtgtgggtgtcga

SEQ ID NO: 73933 - DNA, 22 bp, Homo sapiens
tgggaggccgaggcaggtggat

SEQ ID NO: 73934 - DNA, 21 bp, Homo sapiens
cgtgactgggtccgtctggct

SEQ ID NO: 73935 - DNA, 22 bp, Homo sapiens
attctcaaaacataacttcact

SEQ ID NO: 73936 - DNA, 22 bp, Homo sapiens
gagggggctagcgcagtgccca

SEQ ID NO: 73937 - DNA, 22 bp, Homo sapiens
tgagataatcatgtgatttcat

SEQ ID NO: 73938 - DNA, 22 bp, Homo sapiens
gagctactgaaatattgatttt

SEQ ID NO: 73939 - DNA, 22 bp, Homo sapiens
caggaagaccagggctgtggct

SEQ ID NO: 73940 - DNA, 22 bp, Homo sapiens
gggctgtgaggtgagaacttac

SEQ ID NO: 73941 - DNA, 22 bp, Homo sapiens
ggcggctactcctcctggtgag

SEQ ID NO: 73942 - DNA, 22 bp, Homo sapiens
gaggggctgccctggtgtcagg

SEQ ID NO: 73943 - DNA, 22 bp, Homo sapiens
taactaggattacaagcgtgcg

SEQ ID NO: 73944 - DNA, 22 bp, Homo sapiens
aacggctgtggctggcggcagc

SEQ ID NO: 73945 - DNA, 22 bp, Homo sapiens
aggtgggcggattcatgaggtc

SEQ ID NO: 73946 - DNA, 22 bp, Homo sapiens
cactgcactccagcttgggcaa

SEQ ID NO: 73947 - DNA, 22 bp, Homo sapiens
ccacactccccgcaggcgtagg

SEQ ID NO: 73948 - DNA, 22 bp, Homo sapiens
atgttggagtcgtaaggcatgg

SEQ ID NO: 73949 - DNA, 22 bp, Homo sapiens
agctcctgaaaatccagactgg

SEQ ID NO: 73950 - DNA, 22 bp, Homo sapiens
ggcaaaaagttcccatcagtgt

SEQ ID NO: 73951 - DNA, 22 bp, Homo sapiens
agtgctgtcagttttatagata

SEQ ID NO: 73952 - DNA, 22 bp, Homo sapiens
tcactgcaacctctgcctgcca

SEQ ID NO: 73953 - DNA, 22 bp, Homo sapiens
cgccgcctgctgcagcagctgt

SEQ ID NO: 73954 - DNA, 22 bp, Homo sapiens
aaagaaatagatggcatttaaa

SEQ ID NO: 73955 - DNA, 22 bp, Homo sapiens
gacccttagaatgtgatcttat

SEQ ID NO: 73956 - DNA, 22 bp, Homo sapiens
atctggttcttcttaggcatca

SEQ ID NO: 73957 - DNA, 22 bp, Homo sapiens
tggcaaaatgagcaattacttt

SEQ ID NO: 73958 - DNA, 22 bp, Homo sapiens
tccagggagagccgctgctcca

SEQ ID NO: 73959 - DNA, 22 bp, Homo sapiens
aggtggaaatggctttcctagg

SEQ ID NO: 73960 - DNA, 22 bp, Homo sapiens
ttcagagaattggataattcgt

SEQ ID NO: 73961 - DNA, 22 bp, Homo sapiens
tggctacctgatttcttttcag

SEQ ID NO: 73962 - DNA, 22 bp, Homo sapiens
ccaggctgctgttggtgtccgc

SEQ ID NO: 73963 - DNA, 22 bp, Homo sapiens
cctgtatttaaaaatattctaa

SEQ ID NO: 73964 - DNA, 22 bp, Homo sapiens
tcacttgaacctgggaggcaga

SEQ ID NO: 73965 - DNA, 22 bp, Homo sapiens
aggtcaagggagctgagggcca

SEQ ID NO: 73966 - DNA, 22 bp, Homo sapiens
aggggaggtgtccccaaatctc

SEQ ID NO: 73967 - DNA, 22 bp, Homo sapiens
gagctcatccccatggtccgtc

SEQ ID NO: 73968 - DNA, 22 bp, Homo sapiens
ctggtttgtcttgggaggatgt

SEQ ID NO: 73969 - DNA, 23 bp, Homo sapiens
acctgtctgcctcccaccatcaa

SEQ ID NO: 73970 - DNA, 19 bp, Homo sapiens
ccatggcaatgatctgatg

SEQ ID NO: 73971 - DNA, 22 bp, Homo sapiens
gctgatgtatatagtgattgag

SEQ ID NO: 73972 - DNA, 22 bp, Homo sapiens
taagtcgtggatgattcttcgg

SEQ ID NO: 73973 - DNA, 21 bp, Homo sapiens
ccaggccaggcctacggggat

SEQ ID NO: 73974 - DNA, 22 bp, Homo sapiens
gccagcagcttcttctcatcct

SEQ ID NO: 73975 - DNA, 22 bp, Homo sapiens
ctatgaccccagcatgaataag

SEQ ID NO: 73976 - DNA, 22 bp, Homo sapiens
tatcacagccttttggtgaggg

SEQ ID NO: 73977 - DNA, 22 bp, Homo sapiens
ttgcttcttagatattcctctc

SEQ ID NO: 73978 - DNA, 22 bp, Homo sapiens
ggcaagaacctcaattaccttt

SEQ ID NO: 73979 - DNA, 22 bp, Homo sapiens
tgagcttgcagtgccagccttg

SEQ ID NO: 73980 - DNA, 22 bp, Homo sapiens
gagacacaggcacagaagaggc

SEQ ID NO: 73981 - DNA, 22 bp, Homo sapiens
tttctcggcagagatgatgggc

SEQ ID NO: 73982 - DNA, 22 bp, Homo sapiens
aggccctattcaatggggccca

SEQ ID NO: 73983 - DNA, 22 bp, Homo sapiens
ggctgatgggcatgagctgtca

SEQ ID NO: 73984 - DNA, 22 bp, Homo sapiens
ggaagtcctcatacctgattct

SEQ ID NO: 73985 - DNA, 22 bp, Homo sapiens
aaggtccttttgcagtgtgatc

SEQ ID NO: 73986 - DNA, 22 bp, Homo sapiens
actgcactccagcctgggtaac

SEQ ID NO: 73987 - DNA, 22 bp, Homo sapiens
actgcactccaacctgggtgac

SEQ ID NO: 73988 - DNA, 22 bp, Homo sapiens
aaagtgctggtattacaggtgt

SEQ ID NO: 73989 - DNA, 22 bp, Homo sapiens
gtcttgggacccgcactgtggg

SEQ ID NO: 73990 - DNA, 22 bp, Homo sapiens
cagaccagaaggaagccgacaa

SEQ ID NO: 73991 - DNA, 22 bp, Homo sapiens
gccctgtgcaggtgtgcagcag

SEQ ID NO: 73992 - DNA, 22 bp, Homo sapiens
aaaatggtctcagctggcacca

SEQ ID NO: 73993 - DNA, 20 bp, Homo sapiens
tcccagtctttggtctgagc

SEQ ID NO: 73994 - DNA, 22 bp, Homo sapiens
gtggtgagattgctggatcaaa

SEQ ID NO: 73995 - DNA, 22 bp, Homo sapiens
gggaaagaccttcctggggtgt

SEQ ID NO: 73996 - DNA, 18 bp, Homo sapiens
tgagaggctattttttgc

SEQ ID NO: 73997 - DNA, 22 bp, Homo sapiens
ccacgggcagatgtggttggtt

SEQ ID NO: 73998 - DNA, 22 bp, Homo sapiens
ggagaggggaacttgttgcttg

SEQ ID NO: 73999 - DNA, 22 bp, Homo sapiens
gctcaagccttctgcccacctc

SEQ ID NO: 74000 - DNA, 22 bp, Homo sapiens
cactgcactccagcctgggtga

SEQ ID NO: 74001 - DNA, 22 bp, Homo sapiens
ggccttggttccaaagcaggca

SEQ ID NO: 74002 - DNA, 22 bp, Homo sapiens
gagctcattcattcattgcctg

SEQ ID NO: 74003 - DNA, 22 bp, Homo sapiens
gatataggttcatagtgttaca

SEQ ID NO: 74004 - DNA, 22 bp, Homo sapiens
ggtcagccttggatttggtagc

SEQ ID NO: 74005 - DNA, 22 bp, Homo sapiens
ggcctcgcggcttctggtggct

SEQ ID NO: 74006 - DNA, 22 bp, Homo sapiens
gggacttaatgcagagagggac

SEQ ID NO: 74007 - DNA, 22 bp, Homo sapiens
cggagtcttgctatgttgccca

SEQ ID NO: 74008 - DNA, 22 bp, Homo sapiens
agtcaaggtggaccagaaaaat

SEQ ID NO: 74009 - DNA, 22 bp, Homo sapiens
cgcccaggctggagtgcagtgg

SEQ ID NO: 74010 - DNA, 22 bp, Homo sapiens
gcctggccgggtcttggatttt

SEQ ID NO: 74011 - DNA, 22 bp, Homo sapiens
caggtggcagtgcctgcattct

SEQ ID NO: 74012 - DNA, 22 bp, Homo sapiens
tatcactacacctggctaatta

SEQ ID NO: 74013 - DNA, 22 bp, Homo sapiens
tagactggtgaattagggggaa

SEQ ID NO: 74014 - DNA, 22 bp, Homo sapiens
ttatatgtttctgtttggaggc

SEQ ID NO: 74015 - DNA, 22 bp, Homo sapiens
acatccgcaggttataaagccc

SEQ ID NO: 74016 - DNA, 22 bp, Homo sapiens
gtctccggccgccctggtgctg

SEQ ID NO: 74017 - DNA, 22 bp, Homo sapiens
gcagctattgtctcctgggccc

SEQ ID NO: 74018 - DNA, 17 bp, Homo sapiens
aggaggccctggcgttt

SEQ ID NO: 74019 - DNA, 22 bp, Homo sapiens
ctctgatgtcgagtaaggtgtg

SEQ ID NO: 74020 - DNA, 22 bp, Homo sapiens
aactcaaagatgcatgacgctt

SEQ ID NO: 74021 - DNA, 22 bp, Homo sapiens
tgaggcaggaggttgagaactg

SEQ ID NO: 74022 - DNA, 22 bp, Homo sapiens
gaggccactgtccctgccttcc

SEQ ID NO: 74023 - DNA, 22 bp, Homo sapiens
ggctgccttccctgagccccgg

SEQ ID NO: 74024 - DNA, 22 bp, Homo sapiens
aatatttccaaggcctgtcagg

SEQ ID NO: 74025 - DNA, 22 bp, Homo sapiens
tcactgcaagctccacctcccg

SEQ ID NO: 74026 - DNA, 22 bp, Homo sapiens
gagaggtggaggttgcagtgag

SEQ ID NO: 74027 - DNA, 22 bp, Homo sapiens
attttctatgttgtaattgtta

SEQ ID NO: 74028 - DNA, 22 bp, Homo sapiens
ctcagcagtatactctgaagat

SEQ ID NO: 74029 - DNA, 22 bp, Homo sapiens
gctgctctcagagctcatgctg

SEQ ID NO: 74030 - DNA, 22 bp, Homo sapiens
ttgtaagtcacaccagggcagg

SEQ ID NO: 74031 - DNA, 22 bp, Homo sapiens
gagcccaggcagaggttgcagt

SEQ ID NO: 74032 - DNA, 22 bp, Homo sapiens
aggaattgtgttgtagtggaga

SEQ ID NO: 74033 - DNA, 18 bp, Homo sapiens
cagggctgtggggtcact

SEQ ID NO: 74034 - DNA, 22 bp, Homo sapiens
tggctgagttacgaacagagca

SEQ ID NO: 74035 - DNA, 22 bp, Homo sapiens
aggggcgtgctcttccccgacg

SEQ ID NO: 74036 - DNA, 22 bp, Homo sapiens
agggcactgcaagggttgaagg

SEQ ID NO: 74037 - DNA, 17 bp, Homo sapiens
caggtgacctggtgatg

SEQ ID NO: 74038 - DNA, 19 bp, Homo sapiens
gctgaggtggaggaaggag

SEQ ID NO: 74039 - DNA, 22 bp, Homo sapiens
gaaaggagagggttaaggagct

SEQ ID NO: 74040 - DNA, 22 bp, Homo sapiens
tcaggaggtccgcccgggaggg

SEQ ID NO: 74041 - DNA, 22 bp, Homo sapiens
cttggtctataggagagattgt

SEQ ID NO: 74042 - DNA, 22 bp, Homo sapiens
gtcttagatttcaccgataatg

SEQ ID NO: 74043 - DNA, 22 bp, Homo sapiens
acatgtaatacatccagcaata

SEQ ID NO: 74044 - DNA, 22 bp, Homo sapiens
atacttctttagcatattgaac

SEQ ID NO: 74045 - DNA, 22 bp, Homo sapiens
tggaagactcaaggtggtgaat

SEQ ID NO: 74046 - DNA, 22 bp, Homo sapiens
ctgccttttaaagccagtgtta

SEQ ID NO: 74047 - DNA, 22 bp, Homo sapiens
agttgttcgtggtggattcgct

SEQ ID NO: 74048 - DNA, 22 bp, Homo sapiens
cttctgagatgttgttttacag

SEQ ID NO: 74049 - DNA, 22 bp, Homo sapiens
ggggacctgggcttcaagggtt

SEQ ID NO: 74050 - DNA, 22 bp, Homo sapiens
aaattacagccttgggtagctt

SEQ ID NO: 74051 - DNA, 22 bp, Homo sapiens
gcctctgagctcctttgaccac

SEQ ID NO: 74052 - DNA, 22 bp, Homo sapiens
tcccagtttttctccactaagg

SEQ ID NO: 74053 - DNA, 22 bp, Homo sapiens
tcaccaggctagagtgcagtgg

SEQ ID NO: 74054 - DNA, 19 bp, Homo sapiens
agataagagttgactgtgg

SEQ ID NO: 74055 - DNA, 22 bp, Homo sapiens
acttcttcttcagctgggggat

SEQ ID NO: 74056 - DNA, 22 bp, Homo sapiens
gtgggtggacggtgcttttgtt

SEQ ID NO: 74057 - DNA, 22 bp, Homo sapiens
tcctgggaggcggaggttgcag

SEQ ID NO: 74058 - DNA, 22 bp, Homo sapiens
tcacgtgagggacctgtgtctg

SEQ ID NO: 74059 - DNA, 22 bp, Homo sapiens
ggtcagaggtcccagaagaagc

SEQ ID NO: 74060 - DNA, 23 bp, Homo sapiens
tcatgcccaggctccagatgtca

SEQ ID NO: 74061 - DNA, 22 bp, Homo sapiens
atcatcctagaaggaagctagg

SEQ ID NO: 74062 - DNA, 22 bp, Homo sapiens
ctgcccgcaccatccccgggct

SEQ ID NO: 74063 - DNA, 22 bp, Homo sapiens
gggacaatggaggcctctctcc

SEQ ID NO: 74064 - DNA, 22 bp, Homo sapiens
ccagccgcggtgagggtggctg

SEQ ID NO: 74065 - DNA, 22 bp, Homo sapiens
aacctgggcttgaacagtgcct

SEQ ID NO: 74066 - DNA, 22 bp, Homo sapiens
ttacatgtttatgggggtacat

SEQ ID NO: 74067 - DNA, 22 bp, Homo sapiens
ccctaaaagtctcattttccag

SEQ ID NO: 74068 - DNA, 16 bp, Homo sapiens
tgggtgggaggagcgg

SEQ ID NO: 74069 - DNA, 22 bp, Homo sapiens
taggctgggaagaaagattctc

SEQ ID NO: 74070 - DNA, 22 bp, Homo sapiens
actgttttctgtaaagggccag

SEQ ID NO: 74071 - DNA, 22 bp, Homo sapiens
tcactgcgcttcagcctgggtg

SEQ ID NO: 74072 - DNA, 22 bp, Homo sapiens
ggacagaaaccatatgagtgta

SEQ ID NO: 74073 - DNA, 22 bp, Homo sapiens
aggctcagatccttgtgtcctg

SEQ ID NO: 74074 - DNA, 22 bp, Homo sapiens
tcccagctactctagaggctga

SEQ ID NO: 74075 - DNA, 23 bp, Homo sapiens
tatgaactgcattgctggtgtgt

SEQ ID NO: 74076 - DNA, 22 bp, Homo sapiens
atgtgctgagtgtgtatataca

SEQ ID NO: 74077 - DNA, 22 bp, Homo sapiens
ctccatgtctgtaacacatgac

SEQ ID NO: 74078 - DNA, 22 bp, Homo sapiens
taccagggaacagggatattaa

SEQ ID NO: 74079 - DNA, 22 bp, Homo sapiens
gcctggagaaaggaaggtggga

SEQ ID NO: 74080 - DNA, 15 bp, Homo sapiens
catatcactgggaat

SEQ ID NO: 74081 - DNA, 22 bp, Homo sapiens
aaggccctgtctccaaatacag

SEQ ID NO: 74082 - DNA, 20 bp, Homo sapiens
ttgagcttttagtacagaca

SEQ ID NO: 74083 - DNA, 22 bp, Homo sapiens
tcctgggacaagccgtggaagt

SEQ ID NO: 74084 - DNA, 22 bp, Homo sapiens
agaaaatttaaagagacacaca

SEQ ID NO: 74085 - DNA, 22 bp, Homo sapiens
tagattcagatatttaggacaa

SEQ ID NO: 74086 - DNA, 22 bp, Homo sapiens
ctggagagaatgtggaatgatt

SEQ ID NO: 74087 - DNA, 22 bp, Homo sapiens
ctggcaggttatagagctgccc

SEQ ID NO: 74088 - DNA, 22 bp, Homo sapiens
tctggcttccctctgttctggg

SEQ ID NO: 74089 - DNA, 22 bp, Homo sapiens
tacttttctataggtttgaaat

SEQ ID NO: 74090 - DNA, 22 bp, Homo sapiens
tgtgttgtgacattcttggatg

SEQ ID NO: 74091 - DNA, 22 bp, Homo sapiens
ctgtctgcaggatagtaccctc

SEQ ID NO: 74092 - DNA, 22 bp, Homo sapiens
acaggcacctgccaccacatct

SEQ ID NO: 74093 - DNA, 22 bp, Homo sapiens
ttctcccatctcagtcttacat

SEQ ID NO: 74094 - DNA, 17 bp, Homo sapiens
gacctcaggtgatctgc

SEQ ID NO: 74095 - DNA, 18 bp, Homo sapiens
gcagctagccaggggggc

SEQ ID NO: 74096 - DNA, 22 bp, Homo sapiens
tgcttctgactaagctgcatga

SEQ ID NO: 74097 - DNA, 22 bp, Homo sapiens
tctgacattagattaattggaa

SEQ ID NO: 74098 - DNA, 20 bp, Homo sapiens
tgtggtttttgccagttgaa

SEQ ID NO: 74099 - DNA, 22 bp, Homo sapiens
ccaggctagaaactgaggcaca

SEQ ID NO: 74100 - DNA, 21 bp, Homo sapiens
cgcagagcgaacttgcggcgc

SEQ ID NO: 74101 - DNA, 20 bp, Homo sapiens
cattggacttggcttcatgg

SEQ ID NO: 74102 - DNA, 22 bp, Homo sapiens
gactttgctgtgtcagcttcag

SEQ ID NO: 74103 - DNA, 22 bp, Homo sapiens
aggactgggtgcagagggcatc

SEQ ID NO: 74104 - DNA, 22 bp, Homo sapiens
cccgggaggcggaggttgcagt

SEQ ID NO: 74105 - DNA, 22 bp, Homo sapiens
acccgggaggcaggagtcatag

SEQ ID NO: 74106 - DNA, 22 bp, Homo sapiens
gcttggaagtaggattgggaga

SEQ ID NO: 74107 - DNA, 19 bp, Homo sapiens
tccacagtggttgaactag

SEQ ID NO: 74108 - DNA, 22 bp, Homo sapiens
cgccggcttgaggcaggcggca

SEQ ID NO: 74109 - DNA, 22 bp, Homo sapiens
tggaggagaccgcattttattt

SEQ ID NO: 74110 - DNA, 21 bp, Homo sapiens
aagaggaagcattatggcata

SEQ ID NO: 74111 - DNA, 22 bp, Homo sapiens
cccaggaggcagagcttgcagt

SEQ ID NO: 74112 - DNA, 22 bp, Homo sapiens
gtctccttgtggatctcaagga

SEQ ID NO: 74113 - DNA, 22 bp, Homo sapiens
attgggatgccggctgataaga

SEQ ID NO: 74114 - DNA, 22 bp, Homo sapiens
acagtccagcctagtatgtata

SEQ ID NO: 74115 - DNA, 22 bp, Homo sapiens
tcaggaggcggaggttgcagtg

SEQ ID NO: 74116 - DNA, 22 bp, Homo sapiens
ttccagctaactcacatccctt

SEQ ID NO: 74117 - DNA, 22 bp, Homo sapiens
ctttggcaatgtcattttcaat

SEQ ID NO: 74118 - DNA, 20 bp, Homo sapiens
ataaaataactgccacaaga

SEQ ID NO: 74119 - DNA, 22 bp, Homo sapiens
atgggttcaagtgattctcctg

SEQ ID NO: 74120 - DNA, 22 bp, Homo sapiens
ctctgctgtgccgccagggcct

SEQ ID NO: 74121 - DNA, 22 bp, Homo sapiens
agagtactgctgctgggtactg

SEQ ID NO: 74122 - DNA, 22 bp, Homo sapiens
tataaactcctcttgcattcct

SEQ ID NO: 74123 - DNA, 22 bp, Homo sapiens
agaaaatgtgaacttgtgaatt

SEQ ID NO: 74124 - DNA, 22 bp, Homo sapiens
tatgccactgctctccatccta

SEQ ID NO: 74125 - DNA, 22 bp, Homo sapiens
tgagaattacaaatgagtcaca

SEQ ID NO: 74126 - DNA, 20 bp, Homo sapiens
ggggaagtcactgcagtcag

SEQ ID NO: 74127 - DNA, 22 bp, Homo sapiens
tcacagagatgaacttttgata

SEQ ID NO: 74128 - DNA, 22 bp, Homo sapiens
ttttccttcatatcccttatgt

SEQ ID NO: 74129 - DNA, 23 bp, Homo sapiens
caccccaccctgaggaggaggga

SEQ ID NO: 74130 - DNA, 22 bp, Homo sapiens
tattatccaaagagctgggagc

SEQ ID NO: 74131 - DNA, 22 bp, Homo sapiens
ccctggaggcggagcttgcagt

SEQ ID NO: 74132 - DNA, 22 bp, Homo sapiens
tgcaatgatattgtcaaagcat

SEQ ID NO: 74133 - DNA, 22 bp, Homo sapiens
ttgtgctcctgtgagaatctag

SEQ ID NO: 74134 - DNA, 22 bp, Homo sapiens
actgattgcattcatagggttt

SEQ ID NO: 74135 - DNA, 22 bp, Homo sapiens
tggattcacaccattctcctgc

SEQ ID NO: 74136 - DNA, 22 bp, Homo sapiens
agcagtgtgggctgcacgctgg

SEQ ID NO: 74137 - DNA, 22 bp, Homo sapiens
cattgcactccagcctgggcca

SEQ ID NO: 74138 - DNA, 22 bp, Homo sapiens
tcggagctgtagatgaaaccct

SEQ ID NO: 74139 - DNA, 22 bp, Homo sapiens
ggtgacctcacctggtcccacc

SEQ ID NO: 74140 - DNA, 22 bp, Homo sapiens
gcctcaaatgtggagcactatt

SEQ ID NO: 74141 - DNA, 22 bp, Homo sapiens
gagtcgagcagaaagccgtcgg

SEQ ID NO: 74142 - DNA, 22 bp, Homo sapiens
cccaggatggggctgcagttat

SEQ ID NO: 74143 - DNA, 22 bp, Homo sapiens
ccccacaactcatgttgaaact

SEQ ID NO: 74144 - DNA, 22 bp, Homo sapiens
attctacatgatagaagggaga

SEQ ID NO: 74145 - DNA, 22 bp, Homo sapiens
gtggcagagccaaggctggagc

SEQ ID NO: 74146 - DNA, 22 bp, Homo sapiens
gctcgaccgccagaaacttcct

SEQ ID NO: 74147 - DNA, 22 bp, Homo sapiens
cgcatgagacctgccggccatc

SEQ ID NO: 74148 - DNA, 22 bp, Homo sapiens
ttgtggttaaccgcacattttt

SEQ ID NO: 74149 - DNA, 22 bp, Homo sapiens
gtgagccgagtatagttcatag

SEQ ID NO: 74150 - DNA, 22 bp, Homo sapiens
caggccctgtgctgggtgatgt

SEQ ID NO: 74151 - DNA, 22 bp, Homo sapiens
ctgaggcaggagagttgcttga

SEQ ID NO: 74152 - DNA, 22 bp, Homo sapiens
cacattggcaaacggggttgca

SEQ ID NO: 74153 - DNA, 22 bp, Homo sapiens
ggcatggacgtctctgaggcca

SEQ ID NO: 74154 - DNA, 22 bp, Homo sapiens
cttttcattgtttgtacatgca

SEQ ID NO: 74155 - DNA, 22 bp, Homo sapiens
tatctatgtgctctgacctctc

SEQ ID NO: 74156 - DNA, 22 bp, Homo sapiens
tagatttgtttccttctctcca

SEQ ID NO: 74157 - DNA, 22 bp, Homo sapiens
ggaggtcccaggcctggcagca

SEQ ID NO: 74158 - DNA, 22 bp, Homo sapiens
tgaaggacagcagtggctccaa

SEQ ID NO: 74159 - DNA, 22 bp, Homo sapiens
tgcctaggctggagtgcagtga

SEQ ID NO: 74160 - DNA, 22 bp, Homo sapiens
cccaggaggcagagatagcagt

SEQ ID NO: 74161 - DNA, 23 bp, Homo sapiens
aggaaagcattcatttttaccat

SEQ ID NO: 74162 - DNA, 22 bp, Homo sapiens
ctggaaggagcccgggcggatc

SEQ ID NO: 74163 - DNA, 22 bp, Homo sapiens
actgtactccaacctgggcaac

SEQ ID NO: 74164 - DNA, 22 bp, Homo sapiens
cccacaggtgtgagcttgctgg

SEQ ID NO: 74165 - DNA, 22 bp, Homo sapiens
cagcagcattgctctggattcc

SEQ ID NO: 74166 - DNA, 22 bp, Homo sapiens
tagggtacatgtgcacaacatg

SEQ ID NO: 74167 - DNA, 22 bp, Homo sapiens
gaagtattactctgaatgtatt

SEQ ID NO: 74168 - DNA, 20 bp, Homo sapiens
caaatccctgctctgtgctg

SEQ ID NO: 74169 - DNA, 20 bp, Homo sapiens
tcaggtgacacacgtggcac

SEQ ID NO: 74170 - DNA, 22 bp, Homo sapiens
cttctcaaagttgtgaatcagg

SEQ ID NO: 74171 - DNA, 22 bp, Homo sapiens
attgaaaataaggccagaaaca

SEQ ID NO: 74172 - DNA, 22 bp, Homo sapiens
ccttcctaacattgccatgaca

SEQ ID NO: 74173 - DNA, 19 bp, Homo sapiens
tggttgtgcacgggttggt

SEQ ID NO: 74174 - DNA, 22 bp, Homo sapiens
gcctccagcccacgcaggcctg

SEQ ID NO: 74175 - DNA, 18 bp, Homo sapiens
ccctgccagctcccagca

SEQ ID NO: 74176 - DNA, 22 bp, Homo sapiens
cccatttcttgagttcagctct

SEQ ID NO: 74177 - DNA, 22 bp, Homo sapiens
ggctgtggagctgcagagttgg

SEQ ID NO: 74178 - DNA, 19 bp, Homo sapiens
aggctaaagagtcttgcgt

SEQ ID NO: 74179 - DNA, 22 bp, Homo sapiens
gctgggctgcgtcggggaagcc

SEQ ID NO: 74180 - DNA, 21 bp, Homo sapiens
ggcctcccggaccgcagcgcc

SEQ ID NO: 74181 - DNA, 22 bp, Homo sapiens
tgctgtgttactgagatccggc

SEQ ID NO: 74182 - DNA, 22 bp, Homo sapiens
atgtgtattacctcgattgtga

SEQ ID NO: 74183 - DNA, 22 bp, Homo sapiens
aaagaggcaatcaatgtagcaa

SEQ ID NO: 74184 - DNA, 22 bp, Homo sapiens
ccctgccttgtctgggctaggt

SEQ ID NO: 74185 - DNA, 22 bp, Homo sapiens
ctacattaaattggcttactta

SEQ ID NO: 74186 - DNA, 22 bp, Homo sapiens
gggacatctttctagtcagggt

SEQ ID NO: 74187 - DNA, 22 bp, Homo sapiens
ccagggtggcgtagatgctggg

SEQ ID NO: 74188 - DNA, 22 bp, Homo sapiens
tatacactgttgttgggagtct

SEQ ID NO: 74189 - DNA, 22 bp, Homo sapiens
tcaggctcaggttaggggccaa

SEQ ID NO: 74190 - DNA, 22 bp, Homo sapiens
agtgagagtattaatgtgaact

SEQ ID NO: 74191 - DNA, 22 bp, Homo sapiens
tggcacagactgggccaaggaa

SEQ ID NO: 74192 - DNA, 22 bp, Homo sapiens
gccttgtttctctcccagataa

SEQ ID NO: 74193 - DNA, 22 bp, Homo sapiens
ctgaatccacacaaggtgatgg

SEQ ID NO: 74194 - DNA, 22 bp, Homo sapiens
tcccagagctctggaggttgga

SEQ ID NO: 74195 - DNA, 22 bp, Homo sapiens
tagcccaggctggagtgcaggg

SEQ ID NO: 74196 - DNA, 22 bp, Homo sapiens
attttttgttaactcaggatag

SEQ ID NO: 74197 - DNA, 22 bp, Homo sapiens
aacattgaacttggcacaccca

SEQ ID NO: 74198 - DNA, 22 bp, Homo sapiens
tgatatgtaactactccttata

SEQ ID NO: 74199 - DNA, 22 bp, Homo sapiens
tgggaagggtcaacagctggaa

SEQ ID NO: 74200 - DNA, 22 bp, Homo sapiens
cccagcagtagagctcatatgg

SEQ ID NO: 74201 - DNA, 22 bp, Homo sapiens
tcttccagatggttctttagct

SEQ ID NO: 74202 - DNA, 22 bp, Homo sapiens
gatgctgagagattggagacta

SEQ ID NO: 74203 - DNA, 22 bp, Homo sapiens
gaggacaagctgtgagtggggt

SEQ ID NO: 74204 - DNA, 22 bp, Homo sapiens
gcccatgaggtggaggctgcag

SEQ ID NO: 74205 - DNA, 22 bp, Homo sapiens
cccaaaggttgaggctgcagtg

SEQ ID NO: 74206 - DNA, 22 bp, Homo sapiens
tagaggctttcagcggtaggtc

SEQ ID NO: 74207 - DNA, 22 bp, Homo sapiens
aaatggaagctatttatgattc

SEQ ID NO: 74208 - DNA, 22 bp, Homo sapiens
cactgcagcctcgctctcctga

SEQ ID NO: 74209 - DNA, 22 bp, Homo sapiens
gacctccgtgtacacctcccag

SEQ ID NO: 74210 - DNA, 21 bp, Homo sapiens
ccgccacctctaagctgggtc

SEQ ID NO: 74211 - DNA, 22 bp, Homo sapiens
agtttccatcccacacttgctt

SEQ ID NO: 74212 - DNA, 22 bp, Homo sapiens
aacactctctgttggtaaggct

SEQ ID NO: 74213 - DNA, 22 bp, Homo sapiens
ttttatctgtgacatctggcag

SEQ ID NO: 74214 - DNA, 22 bp, Homo sapiens
attctggacaaggcaagctcct

SEQ ID NO: 74215 - DNA, 22 bp, Homo sapiens
gtaatctcagctacttgggagg

SEQ ID NO: 74216 - DNA, 22 bp, Homo sapiens
gctcagaggcacgacctcttgg

SEQ ID NO: 74217 - DNA, 22 bp, Homo sapiens
cacctcaggcagcaaagtctca

SEQ ID NO: 74218 - DNA, 22 bp, Homo sapiens
tgccaccccggaccccgaagtg

SEQ ID NO: 74219 - DNA, 22 bp, Homo sapiens
gaatgcagatggctggtgtatg

SEQ ID NO: 74220 - DNA, 22 bp, Homo sapiens
caggagttcaaggttgcagtga

SEQ ID NO: 74221 - DNA, 19 bp, Homo sapiens
taaaacgtgcatggcagca

SEQ ID NO: 74222 - DNA, 22 bp, Homo sapiens
tggcatttgagctggaaggatg

SEQ ID NO: 74223 - DNA, 20 bp, Homo sapiens
gttaggaggttggacatgga

SEQ ID NO: 74224 - DNA, 22 bp, Homo sapiens
ctctgcaagtccagcccctggc

SEQ ID NO: 74225 - DNA, 18 bp, Homo sapiens
tcactgggtgtatgtggc

SEQ ID NO: 74226 - DNA, 22 bp, Homo sapiens
ctggccaagatggtgaaacccc

SEQ ID NO: 74227 - DNA, 22 bp, Homo sapiens
gggaggctctgctcagcccccg

SEQ ID NO: 74228 - DNA, 22 bp, Homo sapiens
ctgcaccgtgtctcgggctgcc

SEQ ID NO: 74229 - DNA, 22 bp, Homo sapiens
cttgtcagccaattgtggattt

SEQ ID NO: 74230 - DNA, 22 bp, Homo sapiens
atcaacatgtcataaagtgaaa

SEQ ID NO: 74231 - DNA, 22 bp, Homo sapiens
caggagtccatctggcctggtg

SEQ ID NO: 74232 - DNA, 22 bp, Homo sapiens
tcctggcaaagatgttggtgtt

SEQ ID NO: 74233 - DNA, 22 bp, Homo sapiens
agccctcttccagccagcacag

SEQ ID NO: 74234 - DNA, 22 bp, Homo sapiens
cctccccacagcccaggagact

SEQ ID NO: 74235 - DNA, 22 bp, Homo sapiens
aaagcctcccaggttatgagta

SEQ ID NO: 74236 - DNA, 22 bp, Homo sapiens
agtactgtcagcagggtgttga

SEQ ID NO: 74237 - DNA, 22 bp, Homo sapiens
gactttggttcagggctcagag

SEQ ID NO: 74238 - DNA, 22 bp, Homo sapiens
aatgaattgcagtactgacttg

SEQ ID NO: 74239 - DNA, 22 bp, Homo sapiens
ggctcactgcaaactgtgcctc

SEQ ID NO: 74240 - DNA, 22 bp, Homo sapiens
aaaagaggaactcttatatact

SEQ ID NO: 74241 - DNA, 22 bp, Homo sapiens
cagcaggaggtgagtagcaggt

SEQ ID NO: 74242 - DNA, 22 bp, Homo sapiens
tgtggttttggttcagaaacaa

SEQ ID NO: 74243 - DNA, 22 bp, Homo sapiens
gatccgaatcattgctctttta

SEQ ID NO: 74244 - DNA, 22 bp, Homo sapiens
cattcattacactcataaggtt

SEQ ID NO: 74245 - DNA, 22 bp, Homo sapiens
aaactagctcttagtttagagg

SEQ ID NO: 74246 - DNA, 22 bp, Homo sapiens
gagcaacacgcagtagtatacg

SEQ ID NO: 74247 - DNA, 23 bp, Homo sapiens
acagcaagaggaccagatgtgag

SEQ ID NO: 74248 - DNA, 22 bp, Homo sapiens
gccacctggtggcatcttctgg

SEQ ID NO: 74249 - DNA, 22 bp, Homo sapiens
gctgctctccaagcctccttga

SEQ ID NO: 74250 - DNA, 22 bp, Homo sapiens
ctgaagcagggagtgatgaagt

SEQ ID NO: 74251 - DNA, 22 bp, Homo sapiens
gcttctgagttcttgcttaata

SEQ ID NO: 74252 - DNA, 22 bp, Homo sapiens
cgttctctcatgatcttcccga

SEQ ID NO: 74253 - DNA, 22 bp, Homo sapiens
aaggttcctctctccacccagc

SEQ ID NO: 74254 - DNA, 22 bp, Homo sapiens
gccaggcgggtctcaaactcct

SEQ ID NO: 74255 - DNA, 22 bp, Homo sapiens
atggctgcctgggcgctggccg

SEQ ID NO: 74256 - DNA, 22 bp, Homo sapiens
tgtctcttttcaagctaccctt

SEQ ID NO: 74257 - DNA, 22 bp, Homo sapiens
tcactgtagcctcaactcttgg

SEQ ID NO: 74258 - DNA, 22 bp, Homo sapiens
gggcagatcacctgaggtcagg

SEQ ID NO: 74259 - DNA, 22 bp, Homo sapiens
gtagagcagggagcaggaagct

SEQ ID NO: 74260 - DNA, 22 bp, Homo sapiens
atcctagaatcagcccttgctg

SEQ ID NO: 74261 - DNA, 21 bp, Homo sapiens
tagcccttctccacctcgccc

SEQ ID NO: 74262 - DNA, 22 bp, Homo sapiens
cggcatccccacttcctcctgc

SEQ ID NO: 74263 - DNA, 22 bp, Homo sapiens
gagaaatatggctcagttccac

SEQ ID NO: 74264 - DNA, 22 bp, Homo sapiens
gactttgtgccaaacgccagaa

SEQ ID NO: 74265 - DNA, 22 bp, Homo sapiens
acacccaggctggcgtgcagtg

SEQ ID NO: 74266 - DNA, 22 bp, Homo sapiens
ggagtgcggtggcaccatctca

SEQ ID NO: 74267 - DNA, 22 bp, Homo sapiens
actattagcatatcatgaatgg

SEQ ID NO: 74268 - DNA, 22 bp, Homo sapiens
caagaatcaacattatttagtg

SEQ ID NO: 74269 - DNA, 22 bp, Homo sapiens
aggggctcctttgtgctgcgtc

SEQ ID NO: 74270 - DNA, 22 bp, Homo sapiens
tagctcaaaggttaagtgtgga

SEQ ID NO: 74271 - DNA, 22 bp, Homo sapiens
gtgaattacatgtatttttaag

SEQ ID NO: 74272 - DNA, 22 bp, Homo sapiens
tttttgggtccaggctgtatct

SEQ ID NO: 74273 - DNA, 22 bp, Homo sapiens
caattcccagctgccgggctgc

SEQ ID NO: 74274 - DNA, 23 bp, Homo sapiens
tcagaacagttcttggtgcatag

SEQ ID NO: 74275 - DNA, 22 bp, Homo sapiens
cggggaagcggttctggcggta

SEQ ID NO: 74276 - DNA, 22 bp, Homo sapiens
cgctgcagaagcgtgttcagga

SEQ ID NO: 74277 - DNA, 22 bp, Homo sapiens
ggtctgtctgcctcaggagatg

SEQ ID NO: 74278 - DNA, 22 bp, Homo sapiens
ccatgtggtgggaaggagaatg

SEQ ID NO: 74279 - DNA, 22 bp, Homo sapiens
cagcagcagtgttctagaatct

SEQ ID NO: 74280 - DNA, 22 bp, Homo sapiens
agctgaacgtgcttctgcagca

SEQ ID NO: 74281 - DNA, 22 bp, Homo sapiens
gacggagctggttgctgcggct

SEQ ID NO: 74282 - DNA, 22 bp, Homo sapiens
ctcacctccaggagctgctggc

SEQ ID NO: 74283 - DNA, 22 bp, Homo sapiens
aggctctgtcaggcggagcagc

SEQ ID NO: 74284 - DNA, 22 bp, Homo sapiens
aaatcgcttgaacccaggaagt

SEQ ID NO: 74285 - DNA, 22 bp, Homo sapiens
attgctaggaacaggttgcacc

SEQ ID NO: 74286 - DNA, 22 bp, Homo sapiens
tgtggactcgcatggctgaggc

SEQ ID NO: 74287 - DNA, 22 bp, Homo sapiens
tctgagacaggaagtggagggt

SEQ ID NO: 74288 - DNA, 22 bp, Homo sapiens
aaggtgggcagatcacaaggtc

SEQ ID NO: 74289 - DNA, 19 bp, Homo sapiens
agggagtttatatttgcac

SEQ ID NO: 74290 - DNA, 22 bp, Homo sapiens
cccagggaggcccaggctctgc

SEQ ID NO: 74291 - DNA, 22 bp, Homo sapiens
gaccactggggtgagggccatc

SEQ ID NO: 74292 - DNA, 22 bp, Homo sapiens
ctacttgttcactgtaggtcgc

SEQ ID NO: 74293 - DNA, 22 bp, Homo sapiens
ctggtgtggactccgcgcggag

SEQ ID NO: 74294 - DNA, 22 bp, Homo sapiens
caggctggagtgcagtggtgcc

SEQ ID NO: 74295 - DNA, 22 bp, Homo sapiens
gttgctcaggcaggagtacagt

SEQ ID NO: 74296 - DNA, 22 bp, Homo sapiens
actagctccaggctgaattgca

SEQ ID NO: 74297 - DNA, 22 bp, Homo sapiens
gccccagcctcccgagtagctg

SEQ ID NO: 74298 - DNA, 22 bp, Homo sapiens
gctgtgtatcagatgccacggg

SEQ ID NO: 74299 - DNA, 22 bp, Homo sapiens
gaagagtggttatccctgctgt

SEQ ID NO: 74300 - DNA, 22 bp, Homo sapiens
gatatcattgagcccaggagtt

SEQ ID NO: 74301 - DNA, 22 bp, Homo sapiens
atgaggcaggtggaggctgcca

SEQ ID NO: 74302 - DNA, 22 bp, Homo sapiens
tcttttgtgattctttagttac

SEQ ID NO: 74303 - DNA, 22 bp, Homo sapiens
cattccttaacgtggggagtct

SEQ ID NO: 74304 - DNA, 22 bp, Homo sapiens
tgctggtaccgcgcctccgcca

SEQ ID NO: 74305 - DNA, 22 bp, Homo sapiens
agacacttcatgtaagtggaat

SEQ ID NO: 74306 - DNA, 22 bp, Homo sapiens
actcagtacatctggagttggc

SEQ ID NO: 74307 - DNA, 22 bp, Homo sapiens
attctaaatcagagagctctgt

SEQ ID NO: 74308 - DNA, 22 bp, Homo sapiens
cgggcagcggcgtggccatggt

SEQ ID NO: 74309 - DNA, 22 bp, Homo sapiens
gctggctgacagatttggggtg

SEQ ID NO: 74310 - DNA, 22 bp, Homo sapiens
tgcagattcaaatgaaatgcaa

SEQ ID NO: 74311 - DNA, 22 bp, Homo sapiens
gaaagcatccgcctggaggtgg

SEQ ID NO: 74312 - DNA, 22 bp, Homo sapiens
gtatacgtgcaggtcacagggg

SEQ ID NO: 74313 - DNA, 22 bp, Homo sapiens
cgtgccactgcactctagcctg

SEQ ID NO: 74314 - DNA, 22 bp, Homo sapiens
agtgggtgacagtgaacacgta

SEQ ID NO: 74315 - DNA, 22 bp, Homo sapiens
ataatacatggttgatcttttc

SEQ ID NO: 74316 - DNA, 22 bp, Homo sapiens
cctcacctcagtctgggcctca

SEQ ID NO: 74317 - DNA, 22 bp, Homo sapiens
tccttaggcaatttgggagagt

SEQ ID NO: 74318 - DNA, 22 bp, Homo sapiens
gctgggttttcttccgggccta

SEQ ID NO: 74319 - DNA, 22 bp, Homo sapiens
tcaaatgctgtattgtagtaat

SEQ ID NO: 74320 - DNA, 22 bp, Homo sapiens
aacccaggagttggaggctgtg

SEQ ID NO: 74321 - DNA, 23 bp, Homo sapiens
cagagctggcttcatgggtgtgc

SEQ ID NO: 74322 - DNA, 19 bp, Homo sapiens
gccttcccaccacccgtcc

SEQ ID NO: 74323 - DNA, 23 bp, Homo sapiens
gggggccgtcctggggattatag

SEQ ID NO: 74324 - DNA, 22 bp, Homo sapiens
acaagcgggccacagtgctggt

SEQ ID NO: 74325 - DNA, 22 bp, Homo sapiens
aaatgcacaaagattttgcact

SEQ ID NO: 74326 - DNA, 22 bp, Homo sapiens
gacactctttcctcttctggaa

SEQ ID NO: 74327 - DNA, 22 bp, Homo sapiens
agagtccctcttcccaggaggc

SEQ ID NO: 74328 - DNA, 22 bp, Homo sapiens
ggggtccctgcaccagcatgtc

SEQ ID NO: 74329 - DNA, 22 bp, Homo sapiens
gactactcaaactttctctata

SEQ ID NO: 74330 - DNA, 22 bp, Homo sapiens
tttaatgtagcgtgaaatgatt

SEQ ID NO: 74331 - DNA, 22 bp, Homo sapiens
gagcctgagcaatgtgatgttt

SEQ ID NO: 74332 - DNA, 22 bp, Homo sapiens
agaagcctgttgagagggccgt

SEQ ID NO: 74333 - DNA, 22 bp, Homo sapiens
gactggtaaggaaattcactaa

SEQ ID NO: 74334 - DNA, 14 bp, Homo sapiens
gcaggcggatcact

SEQ ID NO: 74335 - DNA, 22 bp, Homo sapiens
agtggttttgaaagaggaagac

SEQ ID NO: 74336 - DNA, 22 bp, Homo sapiens
agaggccggccgagcccatggg

SEQ ID NO: 74337 - DNA, 22 bp, Homo sapiens
gtcccataagtagtgcaacttg

SEQ ID NO: 74338 - DNA, 22 bp, Homo sapiens
ctcagcttttcccggataggtg

SEQ ID NO: 74339 - DNA, 22 bp, Homo sapiens
gccctagcgccagctcagcacc

SEQ ID NO: 74340 - DNA, 22 bp, Homo sapiens
ccagtgtatttttgggacctgc

SEQ ID NO: 74341 - DNA, 22 bp, Homo sapiens
cactaggctggagtgcagtggc

SEQ ID NO: 74342 - DNA, 22 bp, Homo sapiens
ctgccgttgtgaagctcttaga

SEQ ID NO: 74343 - DNA, 22 bp, Homo sapiens
ccaggctggagtatagtggcgc

SEQ ID NO: 74344 - DNA, 22 bp, Homo sapiens
ggcgggaagttcttgcccactt

SEQ ID NO: 74345 - DNA, 22 bp, Homo sapiens
aggctgaggcaagaggatcact

SEQ ID NO: 74346 - DNA, 22 bp, Homo sapiens
tctgagctgggtcttgacagct

SEQ ID NO: 74347 - DNA, 22 bp, Homo sapiens
aggctgagataggtggatcatt

SEQ ID NO: 74348 - DNA, 22 bp, Homo sapiens
ccagtaacacctcgcagactcc

SEQ ID NO: 74349 - DNA, 22 bp, Homo sapiens
attacctatttcattttctgtc

SEQ ID NO: 74350 - DNA, 22 bp, Homo sapiens
tttgtagcagcatgatttataa

SEQ ID NO: 74351 - DNA, 22 bp, Homo sapiens
tgaacgcaggtccacatggctc

SEQ ID NO: 74352 - DNA, 22 bp, Homo sapiens
tttgcattgcattaagtattct

SEQ ID NO: 74353 - DNA, 22 bp, Homo sapiens
ttgccttcctgcccagcttctg

SEQ ID NO: 74354 - DNA, 22 bp, Homo sapiens
ttactggctgggcctgagggct

SEQ ID NO: 74355 - DNA, 22 bp, Homo sapiens
taaatacttagttttgtgtcta

SEQ ID NO: 74356 - DNA, 22 bp, Homo sapiens
ggtggttcacgcctataatccc

SEQ ID NO: 74357 - DNA, 22 bp, Homo sapiens
cttggggcagcccaggctgagc

SEQ ID NO: 74358 - DNA, 22 bp, Homo sapiens
gaacgggtgcagccatgggccc

SEQ ID NO: 74359 - DNA, 22 bp, Homo sapiens
agctgattccactttttcccca

SEQ ID NO: 74360 - DNA, 22 bp, Homo sapiens
ctccaggctcgtccaagatcga

SEQ ID NO: 74361 - DNA, 22 bp, Homo sapiens
tgggcagggagctggaaccaca

SEQ ID NO: 74362 - DNA, 22 bp, Homo sapiens
tgccaggcgtggtggtgcgcac

SEQ ID NO: 74363 - DNA, 22 bp, Homo sapiens
ccggaaggcggaacgtgcagtg

SEQ ID NO: 74364 - DNA, 22 bp, Homo sapiens
gtagatgagctcacatgacctt

SEQ ID NO: 74365 - DNA, 22 bp, Homo sapiens
ggggatggaggcgtgtggtcct

SEQ ID NO: 74366 - DNA, 22 bp, Homo sapiens
aggagccagtggagttcctgcc

SEQ ID NO: 74367 - DNA, 22 bp, Homo sapiens
ggctccctgcaacctccgcctc

SEQ ID NO: 74368 - DNA, 22 bp, Homo sapiens
gttgcagatgtggaactcgtgc

SEQ ID NO: 74369 - DNA, 22 bp, Homo sapiens
gagctgggcctgcgagtgctgc

SEQ ID NO: 74370 - DNA, 22 bp, Homo sapiens
gtgacaatattagctcaggggc

SEQ ID NO: 74371 - DNA, 22 bp, Homo sapiens
tttctcctcatgactggttgtg

SEQ ID NO: 74372 - DNA, 22 bp, Homo sapiens
agtctagtaggatctctgggct

SEQ ID NO: 74373 - DNA, 22 bp, Homo sapiens
tgtgacagcacggttcaactgc

SEQ ID NO: 74374 - DNA, 22 bp, Homo sapiens
atgcagttccacaggcgcatgg

SEQ ID NO: 74375 - DNA, 22 bp, Homo sapiens
cttggaggtggaagttgcagtg

SEQ ID NO: 74376 - DNA, 22 bp, Homo sapiens
tcaggggcttgaggtgcatgtc

SEQ ID NO: 74377 - DNA, 22 bp, Homo sapiens
ccctcaggtgaaaggaaaaatt

SEQ ID NO: 74378 - DNA, 22 bp, Homo sapiens
cctgggggccaggaaggtgtga

SEQ ID NO: 74379 - DNA, 22 bp, Homo sapiens
ctgtccctgagcaactcctgtt

SEQ ID NO: 74380 - DNA, 21 bp, Homo sapiens
acacaagcactcgtacatacg

SEQ ID NO: 74381 - DNA, 22 bp, Homo sapiens
tgtggctctcatgcactcccag

SEQ ID NO: 74382 - DNA, 22 bp, Homo sapiens
tcacttcgtaaacccctcccat

SEQ ID NO: 74383 - DNA, 22 bp, Homo sapiens
gggtaattggggccttgcagtg

SEQ ID NO: 74384 - DNA, 22 bp, Homo sapiens
agtcacagggggcccctgcaac

SEQ ID NO: 74385 - DNA, 21 bp, Homo sapiens
agaaggcaaaagcagacatct

SEQ ID NO: 74386 - DNA, 22 bp, Homo sapiens
ttgggtgctgtcatggggcacg

SEQ ID NO: 74387 - DNA, 19 bp, Homo sapiens
ggagccgccgcccttcatt

SEQ ID NO: 74388 - DNA, 20 bp, Homo sapiens
gtgtggccaggagctgcgct

SEQ ID NO: 74389 - DNA, 22 bp, Homo sapiens
gaccttgtgatccacctgcctt

SEQ ID NO: 74390 - DNA, 22 bp, Homo sapiens
tagtaagttctcgcattgttat

SEQ ID NO: 74391 - DNA, 18 bp, Homo sapiens
ggcgggtgttttattcac

SEQ ID NO: 74392 - DNA, 22 bp, Homo sapiens
aacccagggtggaggttgcagt

SEQ ID NO: 74393 - DNA, 22 bp, Homo sapiens
tggggtcccaactctgattgat

SEQ ID NO: 74394 - DNA, 22 bp, Homo sapiens
ggcatcgtcctgggcataggga

SEQ ID NO: 74395 - DNA, 22 bp, Homo sapiens
ctcaggacggccgggggagcct

SEQ ID NO: 74396 - DNA, 21 bp, Homo sapiens
ggagtttttctggaagggact

SEQ ID NO: 74397 - DNA, 22 bp, Homo sapiens
tatccaattcaccattgatggg

SEQ ID NO: 74398 - DNA, 22 bp, Homo sapiens
tgttgcccaggttctctcctgc

SEQ ID NO: 74399 - DNA, 22 bp, Homo sapiens
tcccaagtactaccaatctaat

SEQ ID NO: 74400 - DNA, 22 bp, Homo sapiens
ctggccagatgttacgtccaat

SEQ ID NO: 74401 - DNA, 22 bp, Homo sapiens
ggagacagggttgaaccacgca

SEQ ID NO: 74402 - DNA, 22 bp, Homo sapiens
tgaagctttaggatgggttcat

SEQ ID NO: 74403 - DNA, 22 bp, Homo sapiens
agcccaggttgaggctgcagtg

SEQ ID NO: 74404 - DNA, 22 bp, Homo sapiens
gctgaggtggaggaaggagacc

SEQ ID NO: 74405 - DNA, 22 bp, Homo sapiens
cggtcaggtgcagcgttggcac

SEQ ID NO: 74406 - DNA, 22 bp, Homo sapiens
aggaaggcttctttggtcttct

SEQ ID NO: 74407 - DNA, 22 bp, Homo sapiens
ttcctagggcagagccgctggg

SEQ ID NO: 74408 - DNA, 22 bp, Homo sapiens
ttgtgagtagtgccgcaataaa

SEQ ID NO: 74409 - DNA, 22 bp, Homo sapiens
ttgtgaatagtgccacaataaa

SEQ ID NO: 74410 - DNA, 22 bp, Homo sapiens
ttgtgaaacattcatggatttg

SEQ ID NO: 74411 - DNA, 22 bp, Homo sapiens
cagcagcccacgcgtgctgtcc

SEQ ID NO: 74412 - DNA, 22 bp, Homo sapiens
ccctgatagcccctatcatcag

SEQ ID NO: 74413 - DNA, 22 bp, Homo sapiens
agagtggagagaaacaactctg

SEQ ID NO: 74414 - DNA, 22 bp, Homo sapiens
gagccaggaggcagagactgca

SEQ ID NO: 74415 - DNA, 22 bp, Homo sapiens
gtccaggagctcagggcttatt

SEQ ID NO: 74416 - DNA, 22 bp, Homo sapiens
ggagtgcagtggtgggatctca

SEQ ID NO: 74417 - DNA, 22 bp, Homo sapiens
taggttttcctaaaattctggt

SEQ ID NO: 74418 - DNA, 22 bp, Homo sapiens
accccaggaagtggaggtcatg

SEQ ID NO: 74419 - DNA, 22 bp, Homo sapiens
cttgggaggcagaggttgcagt

SEQ ID NO: 74420 - DNA, 22 bp, Homo sapiens
atggcagaatatctgcatcgca

SEQ ID NO: 74421 - DNA, 22 bp, Homo sapiens
ggggaaggaaagttattagcag

SEQ ID NO: 74422 - DNA, 22 bp, Homo sapiens
accaggggatggttggcactgt

SEQ ID NO: 74423 - DNA, 22 bp, Homo sapiens
cagaggaacgtttggattgatt

SEQ ID NO: 74424 - DNA, 16 bp, Homo sapiens
aggctcagaggctgga

SEQ ID NO: 74425 - DNA, 22 bp, Homo sapiens
gaggctgcagctatcagacatt

SEQ ID NO: 74426 - DNA, 20 bp, Homo sapiens
gggcagagccagccagtccc

SEQ ID NO: 74427 - DNA, 22 bp, Homo sapiens
tacatttataaggcttctctgt

SEQ ID NO: 74428 - DNA, 22 bp, Homo sapiens
gaccttgtgatccagccacctt

SEQ ID NO: 74429 - DNA, 22 bp, Homo sapiens
tcactacaaccgctacctgaca

SEQ ID NO: 74430 - DNA, 22 bp, Homo sapiens
actgcactcctgcctgggtaac

SEQ ID NO: 74431 - DNA, 22 bp, Homo sapiens
agggctgcccagtgtgagagct

SEQ ID NO: 74432 - DNA, 22 bp, Homo sapiens
aaagagccgctgatgtcagccc

SEQ ID NO: 74433 - DNA, 22 bp, Homo sapiens
gtgagactcgcctttgtgtagc

SEQ ID NO: 74434 - DNA, 22 bp, Homo sapiens
tgttccgaccgtggggtttgat

SEQ ID NO: 74435 - DNA, 22 bp, Homo sapiens
gtcttgtcccagctctgccact

SEQ ID NO: 74436 - DNA, 22 bp, Homo sapiens
atttaagggatttggagaccaa

SEQ ID NO: 74437 - DNA, 22 bp, Homo sapiens
ttagccaggggagcagcttgtc

SEQ ID NO: 74438 - DNA, 22 bp, Homo sapiens
aagaaggcggaccagaagggag

SEQ ID NO: 74439 - DNA, 22 bp, Homo sapiens
ttctttcagaacacaagtgatt

SEQ ID NO: 74440 - DNA, 22 bp, Homo sapiens
aagccgggcctgagaaatgaca

SEQ ID NO: 74441 - DNA, 22 bp, Homo sapiens
gggcagagagctggaactcctt

SEQ ID NO: 74442 - DNA, 17 bp, Homo sapiens
gagacccccactacacc

SEQ ID NO: 74443 - DNA, 22 bp, Homo sapiens
ggtgggagagctctgtctccag

SEQ ID NO: 74444 - DNA, 22 bp, Homo sapiens
ctccaggccatggctgcggagg

SEQ ID NO: 74445 - DNA, 21 bp, Homo sapiens
gaacccagcagcagtgctctg

SEQ ID NO: 74446 - DNA, 22 bp, Homo sapiens
tacagctgctggtgctccatgc

SEQ ID NO: 74447 - DNA, 22 bp, Homo sapiens
gtcaggactctgacccgtcccg

SEQ ID NO: 74448 - DNA, 22 bp, Homo sapiens
ttgtatagcccagagagtgaga

SEQ ID NO: 74449 - DNA, 22 bp, Homo sapiens
ctgctgaggtggagattgcagt

SEQ ID NO: 74450 - DNA, 22 bp, Homo sapiens
tttaggttttttcacgtggcta

SEQ ID NO: 74451 - DNA, 22 bp, Homo sapiens
gcttggcccattgatcagctgg

SEQ ID NO: 74452 - DNA, 18 bp, Homo sapiens
tgagttcattagacttcc

SEQ ID NO: 74453 - DNA, 22 bp, Homo sapiens
aagccaggttccatggaggagc

SEQ ID NO: 74454 - DNA, 22 bp, Homo sapiens
tctcctggagcccagatgctgg

SEQ ID NO: 74455 - DNA, 22 bp, Homo sapiens
ggagaggcttccagagtcgtgc

SEQ ID NO: 74456 - DNA, 22 bp, Homo sapiens
gcagcctgggcaacagagtgag

SEQ ID NO: 74457 - DNA, 22 bp, Homo sapiens
gaggcaggcagattgcttgagg

SEQ ID NO: 74458 - DNA, 23 bp, Homo sapiens
ccccactaccgtgatgtgcgagg

SEQ ID NO: 74459 - DNA, 22 bp, Homo sapiens
cccttggggtggaggttgcagt

SEQ ID NO: 74460 - DNA, 22 bp, Homo sapiens
aataatctcactttatgtggaa

SEQ ID NO: 74461 - DNA, 22 bp, Homo sapiens
ttcaatagaaagtccctagtta

SEQ ID NO: 74462 - DNA, 22 bp, Homo sapiens
ctcaccttccggctgctccctg

SEQ ID NO: 74463 - DNA, 22 bp, Homo sapiens
aggatttctgtgcctggaaaat

SEQ ID NO: 74464 - DNA, 22 bp, Homo sapiens
actgcaacctccgcctgccagg

SEQ ID NO: 74465 - DNA, 22 bp, Homo sapiens
ttccgagggctcggcggccgcc

SEQ ID NO: 74466 - DNA, 22 bp, Homo sapiens
gggttggatcctggtggctgcc

SEQ ID NO: 74467 - DNA, 22 bp, Homo sapiens
acggtgctgggtattggggttc

SEQ ID NO: 74468 - DNA, 22 bp, Homo sapiens
agatttctgggcttcaccacct

SEQ ID NO: 74469 - DNA, 22 bp, Homo sapiens
aaggctgagacagcacaggtcc

SEQ ID NO: 74470 - DNA, 22 bp, Homo sapiens
ttattgaaggaactgaaataaa

SEQ ID NO: 74471 - DNA, 22 bp, Homo sapiens
aagtgctgagactacaggcatg

SEQ ID NO: 74472 - DNA, 22 bp, Homo sapiens
cagagatgtgatccagctgtct

SEQ ID NO: 74473 - DNA, 22 bp, Homo sapiens
gcttggccagcagccgggatgc

SEQ ID NO: 74474 - DNA, 22 bp, Homo sapiens
caggaagctgtgaaggagacgg

SEQ ID NO: 74475 - DNA, 22 bp, Homo sapiens
acgtagcactgagagatgcagg

SEQ ID NO: 74476 - DNA, 20 bp, Homo sapiens
atcaggtgttcagccactgc

SEQ ID NO: 74477 - DNA, 22 bp, Homo sapiens
gagaacagaagcattcctaatt

SEQ ID NO: 74478 - DNA, 22 bp, Homo sapiens
agaccactaaaactttctctat

SEQ ID NO: 74479 - DNA, 22 bp, Homo sapiens
tgaggcaggtggattacaaggt

SEQ ID NO: 74480 - DNA, 22 bp, Homo sapiens
gcaggcagaggtggaggagaca

SEQ ID NO: 74481 - DNA, 22 bp, Homo sapiens
ggctgggcctctccctcagctg

SEQ ID NO: 74482 - DNA, 22 bp, Homo sapiens
gggtggagagaaagaaacgtga

SEQ ID NO: 74483 - DNA, 22 bp, Homo sapiens
tctgactcccatattccacttc

SEQ ID NO: 74484 - DNA, 22 bp, Homo sapiens
ctcttcctagtgtgcagcgtgg

SEQ ID NO: 74485 - DNA, 22 bp, Homo sapiens
gccaatgacagtctcagttctg

SEQ ID NO: 74486 - DNA, 23 bp, Homo sapiens
tcggtgggcgtggaggccgaggc

SEQ ID NO: 74487 - DNA, 22 bp, Homo sapiens
agccctggtttgcagcatttgc

SEQ ID NO: 74488 - DNA, 22 bp, Homo sapiens
agctttgtttgctcacccgccg

SEQ ID NO: 74489 - DNA, 22 bp, Homo sapiens
agatggagtctcactcttgttg

SEQ ID NO: 74490 - DNA, 18 bp, Homo sapiens
gacatagctcagagctca

SEQ ID NO: 74491 - DNA, 22 bp, Homo sapiens
aagacttgaccaggttgaaggc

SEQ ID NO: 74492 - DNA, 22 bp, Homo sapiens
caggccggggcggcgccatctt

SEQ ID NO: 74493 - DNA, 20 bp, Homo sapiens
gtgtgacctcctgtggatgc

SEQ ID NO: 74494 - DNA, 19 bp, Homo sapiens
cggcccctcctctcgcgcc

SEQ ID NO: 74495 - DNA, 20 bp, Homo sapiens
agcggctggcggaggacacg

SEQ ID NO: 74496 - DNA, 22 bp, Homo sapiens
tgccgcactcggccaccagctg

SEQ ID NO: 74497 - DNA, 22 bp, Homo sapiens
gagggtggtggcttaaggtgct

SEQ ID NO: 74498 - DNA, 22 bp, Homo sapiens
atcttcccaggctggggagagg

SEQ ID NO: 74499 - DNA, 22 bp, Homo sapiens
ggcgctcagtgttgccccagag

SEQ ID NO: 74500 - DNA, 22 bp, Homo sapiens
ggaaacttggatgccagcactc

SEQ ID NO: 74501 - DNA, 22 bp, Homo sapiens
cgcagggccgcgagcgggacca

SEQ ID NO: 74502 - DNA, 22 bp, Homo sapiens
gtatgtgctgagctttccccgc

SEQ ID NO: 74503 - DNA, 22 bp, Homo sapiens
cttatcagattatctgggctgt

SEQ ID NO: 74504 - DNA, 22 bp, Homo sapiens
ggcgccagcactgcagcgcctc

SEQ ID NO: 74505 - DNA, 22 bp, Homo sapiens
gcaaagaatgcagatttgcctc

SEQ ID NO: 74506 - DNA, 22 bp, Homo sapiens
atttagtagagaaattaagaaa

SEQ ID NO: 74507 - DNA, 22 bp, Homo sapiens
tgcaccctcatcagtcaaatgg

SEQ ID NO: 74508 - DNA, 22 bp, Homo sapiens
cattctgaccctatgatttaag

SEQ ID NO: 74509 - DNA, 22 bp, Homo sapiens
gaggctgaggttgcagtgagcc

SEQ ID NO: 74510 - DNA, 22 bp, Homo sapiens
ccaggagtgcagggatggtatc

SEQ ID NO: 74511 - DNA, 22 bp, Homo sapiens
tgtgaagaattaatgtgaatca

SEQ ID NO: 74512 - DNA, 20 bp, Homo sapiens
aggccccaggtggacactag

SEQ ID NO: 74513 - DNA, 22 bp, Homo sapiens
atacaaaaattagccgggagta

SEQ ID NO: 74514 - DNA, 22 bp, Homo sapiens
gcgccccatctacagtactttt

SEQ ID NO: 74515 - DNA, 22 bp, Homo sapiens
tgcaaatgtgttttaaaccaaa

SEQ ID NO: 74516 - DNA, 22 bp, Homo sapiens
tgggtgctctgcgaccgtaggg

SEQ ID NO: 74517 - DNA, 22 bp, Homo sapiens
caaagtgctaggattataggtg

SEQ ID NO: 74518 - DNA, 19 bp, Homo sapiens
catggtgaaaccccgtctc

SEQ ID NO: 74519 - DNA, 22 bp, Homo sapiens
ttctcaaagtgtgctccctgga

SEQ ID NO: 74520 - DNA, 22 bp, Homo sapiens
atgccactgcgctccagcctgg

SEQ ID NO: 74521 - DNA, 21 bp, Homo sapiens
tgtaagtttcatctgaattgg

SEQ ID NO: 74522 - DNA, 22 bp, Homo sapiens
tgcccaggctggagtgcagtgg

SEQ ID NO: 74523 - DNA, 23 bp, Homo sapiens
gtgcatgtgtctttacagtagca

SEQ ID NO: 74524 - DNA, 22 bp, Homo sapiens
ttgagcaatgtcactgaggctt

SEQ ID NO: 74525 - DNA, 20 bp, Homo sapiens
attagagctacatggctaca

SEQ ID NO: 74526 - DNA, 22 bp, Homo sapiens
ccagaggagttgaggctttggg

SEQ ID NO: 74527 - DNA, 22 bp, Homo sapiens
tccaggattgcaggtgcacaac

SEQ ID NO: 74528 - DNA, 22 bp, Homo sapiens
ggagatatttgtattctgtctc

SEQ ID NO: 74529 - DNA, 22 bp, Homo sapiens
ttaaattttagaaacagactct

SEQ ID NO: 74530 - DNA, 22 bp, Homo sapiens
gaggcctgggcaagggggtctg

SEQ ID NO: 74531 - DNA, 22 bp, Homo sapiens
cccaggaggcgcaggttgcggt

SEQ ID NO: 74532 - DNA, 18 bp, Homo sapiens
tctgccccagccgcactg

SEQ ID NO: 74533 - DNA, 21 bp, Homo sapiens
atctcgggcttctcgcccagc

SEQ ID NO: 74534 - DNA, 22 bp, Homo sapiens
tggtcacctatagaggagatgt

SEQ ID NO: 74535 - DNA, 22 bp, Homo sapiens
ggcaatagttgtgggttcttta

SEQ ID NO: 74536 - DNA, 22 bp, Homo sapiens
atacacgtgccatgttggtgtg

SEQ ID NO: 74537 - DNA, 22 bp, Homo sapiens
attgtcgtcaatggacacatag

SEQ ID NO: 74538 - DNA, 22 bp, Homo sapiens
gaccaagatacagcatcataga

SEQ ID NO: 74539 - DNA, 22 bp, Homo sapiens
tcacaaatgtttgcatgtgtct

SEQ ID NO: 74540 - DNA, 22 bp, Homo sapiens
acactgcagatgaaagcataag

SEQ ID NO: 74541 - DNA, 22 bp, Homo sapiens
gccagaagcacatgagaggtga

SEQ ID NO: 74542 - DNA, 22 bp, Homo sapiens
aggtacatggggtgtgtgcacg

SEQ ID NO: 74543 - DNA, 22 bp, Homo sapiens
ttatagcagcatgatttacaat

SEQ ID NO: 74544 - DNA, 22 bp, Homo sapiens
gccaaactacaagttaaatttt

SEQ ID NO: 74545 - DNA, 22 bp, Homo sapiens
aagtgctgggattacaggcatg

SEQ ID NO: 74546 - DNA, 22 bp, Homo sapiens
aggctcgcatgccctgcaccac

SEQ ID NO: 74547 - DNA, 19 bp, Homo sapiens
ttctggtctggaatcaagg

SEQ ID NO: 74548 - DNA, 22 bp, Homo sapiens
catccgcatgcaagtgctgtcc

SEQ ID NO: 74549 - DNA, 22 bp, Homo sapiens
tctgactttggacagtggcgaa

SEQ ID NO: 74550 - DNA, 22 bp, Homo sapiens
tccacaaggcagctcctccagg

SEQ ID NO: 74551 - DNA, 22 bp, Homo sapiens
tctctatttgcctaggcttgtg

SEQ ID NO: 74552 - DNA, 22 bp, Homo sapiens
gcccaggctggagtgcagtggt

SEQ ID NO: 74553 - DNA, 22 bp, Homo sapiens
caggtgttggaagggcagtggg

SEQ ID NO: 74554 - DNA, 21 bp, Homo sapiens
cactccacttagaacagggtt

SEQ ID NO: 74555 - DNA, 22 bp, Homo sapiens
ctcattgcagctgcattactgt

SEQ ID NO: 74556 - DNA, 22 bp, Homo sapiens
tgacctattagatttccttgcc

SEQ ID NO: 74557 - DNA, 22 bp, Homo sapiens
tgggaagctgcattttaacaag

SEQ ID NO: 74558 - DNA, 22 bp, Homo sapiens
tgtagctctccagccagcaagg

SEQ ID NO: 74559 - DNA, 22 bp, Homo sapiens
ctgggggtcttgaaagggagag

SEQ ID NO: 74560 - DNA, 23 bp, Homo sapiens
ggatggacgtgatgccttagcca

SEQ ID NO: 74561 - DNA, 22 bp, Homo sapiens
gtggcaggagggcatcacttgg

SEQ ID NO: 74562 - DNA, 22 bp, Homo sapiens
ggaggagcatgagagggtagtg

SEQ ID NO: 74563 - DNA, 22 bp, Homo sapiens
taggtttcagaggtgccgggaa

SEQ ID NO: 74564 - DNA, 22 bp, Homo sapiens
gatagtcacctcccttaacttt

SEQ ID NO: 74565 - DNA, 22 bp, Homo sapiens
aatgctgagtcctgtgagtctt

SEQ ID NO: 74566 - DNA, 22 bp, Homo sapiens
accctggaggtggaggtgcagt

SEQ ID NO: 74567 - DNA, 22 bp, Homo sapiens
tccttcagcctcccagctcaaa

SEQ ID NO: 74568 - DNA, 22 bp, Homo sapiens
tgctgctgaggctaaagtatag

SEQ ID NO: 74569 - DNA, 22 bp, Homo sapiens
agaatccctgcttgtcttcaaa

SEQ ID NO: 74570 - DNA, 22 bp, Homo sapiens
tggaaccatcaaagagatcctg

SEQ ID NO: 74571 - DNA, 22 bp, Homo sapiens
gtatgtgaggttggtttccagg

SEQ ID NO: 74572 - DNA, 22 bp, Homo sapiens
tacttttagcctatttgattct

SEQ ID NO: 74573 - DNA, 23 bp, Homo sapiens
gacagagtgagaccttgtcttac

SEQ ID NO: 74574 - DNA, 22 bp, Homo sapiens
gaatccctaagatttttataaa

SEQ ID NO: 74575 - DNA, 22 bp, Homo sapiens
catgatctggtcctactgtggg

SEQ ID NO: 74576 - DNA, 22 bp, Homo sapiens
ccctagtccacaggttcctgga

SEQ ID NO: 74577 - DNA, 22 bp, Homo sapiens
ttaggctgttcttgtgttgtta

SEQ ID NO: 74578 - DNA, 22 bp, Homo sapiens
cagggcctcctaaggcatctaa

SEQ ID NO: 74579 - DNA, 22 bp, Homo sapiens
tgtctctgtgactccttccgcc

SEQ ID NO: 74580 - DNA, 22 bp, Homo sapiens
tggcactgagcagccgcggcag

SEQ ID NO: 74581 - DNA, 22 bp, Homo sapiens
tagagctggccgggacagctgg

SEQ ID NO: 74582 - DNA, 22 bp, Homo sapiens
accaggttggtgtccttctggc

SEQ ID NO: 74583 - DNA, 22 bp, Homo sapiens
tgttaaaccagttttgcatcat

SEQ ID NO: 74584 - DNA, 22 bp, Homo sapiens
gacccaggggcagggagaaagt

SEQ ID NO: 74585 - DNA, 22 bp, Homo sapiens
ctggcctaaaaatacagaacaa

SEQ ID NO: 74586 - DNA, 22 bp, Homo sapiens
ttgggctgcagcaattattagt

SEQ ID NO: 74587 - DNA, 22 bp, Homo sapiens
tacctcaagttccaggaaagcg

SEQ ID NO: 74588 - DNA, 22 bp, Homo sapiens
acgatgatgaaagagaacattc

SEQ ID NO: 74589 - DNA, 22 bp, Homo sapiens
tgtgaagatagctgttacatct

SEQ ID NO: 74590 - DNA, 22 bp, Homo sapiens
atctagattaggtataagagct

SEQ ID NO: 74591 - DNA, 22 bp, Homo sapiens
tgagcctgggtggtcgaggctg

SEQ ID NO: 74592 - DNA, 22 bp, Homo sapiens
gttccaggtggtcacagagctc

SEQ ID NO: 74593 - DNA, 22 bp, Homo sapiens
attggtggtgaggacatgccag

SEQ ID NO: 74594 - DNA, 22 bp, Homo sapiens
aggtcaagagtaaatttgggta

SEQ ID NO: 74595 - DNA, 22 bp, Homo sapiens
aaaggacacacaggaggtgtct

SEQ ID NO: 74596 - DNA, 22 bp, Homo sapiens
gtacaaatgcaggtttgttaca

SEQ ID NO: 74597 - DNA, 22 bp, Homo sapiens
ttcagcccaggagttggaggct

SEQ ID NO: 74598 - DNA, 22 bp, Homo sapiens
accattgccccctagtgtctgt

SEQ ID NO: 74599 - DNA, 22 bp, Homo sapiens
tgaaggtgggaattcaccaggt

SEQ ID NO: 74600 - DNA, 22 bp, Homo sapiens
tgtgcctagttctgtatttaca

SEQ ID NO: 74601 - DNA, 22 bp, Homo sapiens
gctgaaggcccggaggacaggg

SEQ ID NO: 74602 - DNA, 22 bp, Homo sapiens
tcaccgaggctggagtgcagtg

SEQ ID NO: 74603 - DNA, 22 bp, Homo sapiens
ttgtgaatagtgccgctataaa

SEQ ID NO: 74604 - DNA, 22 bp, Homo sapiens
aaagtgctgggattacaggctt

SEQ ID NO: 74605 - DNA, 22 bp, Homo sapiens
tttcaacagatctgtcttcagg

SEQ ID NO: 74606 - DNA, 22 bp, Homo sapiens
tgagcctgagttcaaggctgca

SEQ ID NO: 74607 - DNA, 22 bp, Homo sapiens
aaacttgagccaagggcttggg

SEQ ID NO: 74608 - DNA, 22 bp, Homo sapiens
acctggccagtggggccgcgct

SEQ ID NO: 74609 - DNA, 22 bp, Homo sapiens
gatggcctcatggctgcaggcc

SEQ ID NO: 74610 - DNA, 22 bp, Homo sapiens
tgtgtgcatgcttggggcagca

SEQ ID NO: 74611 - DNA, 21 bp, Homo sapiens
tttcttaggctctaaaatgac

SEQ ID NO: 74612 - DNA, 20 bp, Homo sapiens
tgtttgtgtggggccttggc

SEQ ID NO: 74613 - DNA, 22 bp, Homo sapiens
gcaggtggatcaccacgtcagg

SEQ ID NO: 74614 - DNA, 22 bp, Homo sapiens
gtgccactgataaatcagaatg

SEQ ID NO: 74615 - DNA, 22 bp, Homo sapiens
aacttagtgagccactcttgca

SEQ ID NO: 74616 - DNA, 22 bp, Homo sapiens
gtagggctcagtaaatactttg

SEQ ID NO: 74617 - DNA, 22 bp, Homo sapiens
tttgaagggcacgacaatagtt

SEQ ID NO: 74618 - DNA, 22 bp, Homo sapiens
ccactgtgcccagcctcatggg

SEQ ID NO: 74619 - DNA, 22 bp, Homo sapiens
agatgtgtttctagttcctgca

SEQ ID NO: 74620 - DNA, 22 bp, Homo sapiens
cagggccagggacacgctgtca

SEQ ID NO: 74621 - DNA, 22 bp, Homo sapiens
gattcactcatattttacgttt

SEQ ID NO: 74622 - DNA, 22 bp, Homo sapiens
aaacttttttaggttcataggc

SEQ ID NO: 74623 - DNA, 18 bp, Homo sapiens
tctggaacaacttcatgt

SEQ ID NO: 74624 - DNA, 22 bp, Homo sapiens
tgggactcactcttttggccag

SEQ ID NO: 74625 - DNA, 22 bp, Homo sapiens
actcaagtggccttgatggctt

SEQ ID NO: 74626 - DNA, 22 bp, Homo sapiens
acccagtctggagtgcagtgac

SEQ ID NO: 74627 - DNA, 23 bp, Homo sapiens
caggagatggctgctgtgtcagc

SEQ ID NO: 74628 - DNA, 22 bp, Homo sapiens
tgtagggcctaggggtatggat

SEQ ID NO: 74629 - DNA, 22 bp, Homo sapiens
tggctcactgtagccttgacct

SEQ ID NO: 74630 - DNA, 22 bp, Homo sapiens
tcagcctccgaaagtgctggga

SEQ ID NO: 74631 - DNA, 22 bp, Homo sapiens
aaattcttttgtgcggtgaagt

SEQ ID NO: 74632 - DNA, 21 bp, Homo sapiens
ggccgccgccttgtgctctgc

SEQ ID NO: 74633 - DNA, 22 bp, Homo sapiens
accactgcccatggtgaaaact

SEQ ID NO: 74634 - DNA, 22 bp, Homo sapiens
cccagcgagtttgccggtgaac

SEQ ID NO: 74635 - DNA, 22 bp, Homo sapiens
taagtcaaggtggcatttgaga

SEQ ID NO: 74636 - DNA, 22 bp, Homo sapiens
ccaaaaggaactttttgaaggt

SEQ ID NO: 74637 - DNA, 22 bp, Homo sapiens
actttaaaactgatcatcagag

SEQ ID NO: 74638 - DNA, 22 bp, Homo sapiens
gagctgtgtatgcatcattctg

SEQ ID NO: 74639 - DNA, 22 bp, Homo sapiens
cgggttcacgccattctcctgc

SEQ ID NO: 74640 - DNA, 22 bp, Homo sapiens
gggagtgtgcacacatggtata

SEQ ID NO: 74641 - DNA, 22 bp, Homo sapiens
ccctctgcatacaggcgaggag

SEQ ID NO: 74642 - DNA, 22 bp, Homo sapiens
cacggcctgtaaggacccagga

SEQ ID NO: 74643 - DNA, 22 bp, Homo sapiens
gtagcagagggcccaggtaact

SEQ ID NO: 74644 - DNA, 22 bp, Homo sapiens
gagcccaggaagtggaggctga

SEQ ID NO: 74645 - DNA, 22 bp, Homo sapiens
cccaactactctcaggcagctt

SEQ ID NO: 74646 - DNA, 22 bp, Homo sapiens
gtggtggatgtctgtaatctca

SEQ ID NO: 74647 - DNA, 21 bp, Homo sapiens
tgcaatccagcctgggcgaca

SEQ ID NO: 74648 - DNA, 22 bp, Homo sapiens
actgtactcaagcctgggcaat

SEQ ID NO: 74649 - DNA, 22 bp, Homo sapiens
agtgggtgacagttaacaggtt

SEQ ID NO: 74650 - DNA, 22 bp, Homo sapiens
cccaggaggtggagttcacagt

SEQ ID NO: 74651 - DNA, 17 bp, Homo sapiens
gggcagggactcctggg

SEQ ID NO: 74652 - DNA, 22 bp, Homo sapiens
ctcctgaattgtccctcacagc

SEQ ID NO: 74653 - DNA, 22 bp, Homo sapiens
agttattgagtgcagagcaggg

SEQ ID NO: 74654 - DNA, 22 bp, Homo sapiens
ttacactttaaatccagcttgt

SEQ ID NO: 74655 - DNA, 22 bp, Homo sapiens
taagagaatgttgtggctaggt

SEQ ID NO: 74656 - DNA, 22 bp, Homo sapiens
tggggccatctcacccactgtt

SEQ ID NO: 74657 - DNA, 22 bp, Homo sapiens
tgcacgtgtgagcattcacatg

SEQ ID NO: 74658 - DNA, 22 bp, Homo sapiens
tccataaattttatgaacatat

SEQ ID NO: 74659 - DNA, 22 bp, Homo sapiens
gcactgcaggtgggtggagagg

SEQ ID NO: 74660 - DNA, 22 bp, Homo sapiens
cagaggctggcggccgccccga

SEQ ID NO: 74661 - DNA, 22 bp, Homo sapiens
tagtttcatctccaccctgccc

SEQ ID NO: 74662 - DNA, 22 bp, Homo sapiens
cccagcaggaggaggttgcagt

SEQ ID NO: 74663 - DNA, 22 bp, Homo sapiens
gacaggcttccactatgttgcc

SEQ ID NO: 74664 - DNA, 22 bp, Homo sapiens
gtgcagttgtggacatgacaac

SEQ ID NO: 74665 - DNA, 22 bp, Homo sapiens
tgcaatccccgcctcaacagga

SEQ ID NO: 74666 - DNA, 22 bp, Homo sapiens
gtgagagattgattgtagcggc

SEQ ID NO: 74667 - DNA, 22 bp, Homo sapiens
ggccagcctggggctcccagac

SEQ ID NO: 74668 - DNA, 22 bp, Homo sapiens
cttctcggggttcccgcgccct

SEQ ID NO: 74669 - DNA, 22 bp, Homo sapiens
ggaatgaatttccagctgggtc

SEQ ID NO: 74670 - DNA, 21 bp, Homo sapiens
ttagaagctaatgcagctggt

SEQ ID NO: 74671 - DNA, 22 bp, Homo sapiens
tctgtcacccagagtgcagtgg

SEQ ID NO: 74672 - DNA, 22 bp, Homo sapiens
cagccccacacggtctagctct

SEQ ID NO: 74673 - DNA, 22 bp, Homo sapiens
gccagccagaaacgtcacactg

SEQ ID NO: 74674 - DNA, 22 bp, Homo sapiens
acaactccttcttgggtcctgg

SEQ ID NO: 74675 - DNA, 22 bp, Homo sapiens
ggaggcggaagttgcagtgagc

SEQ ID NO: 74676 - DNA, 22 bp, Homo sapiens
gaaagagaacctgggcctagat

SEQ ID NO: 74677 - DNA, 22 bp, Homo sapiens
aattatggtcactgttcctggg

SEQ ID NO: 74678 - DNA, 22 bp, Homo sapiens
aatattatcaaaagctttttca

SEQ ID NO: 74679 - DNA, 22 bp, Homo sapiens
ttttcaggctgatttgtgttag

SEQ ID NO: 74680 - DNA, 22 bp, Homo sapiens
ttacatgtggtgtgaagaagag

SEQ ID NO: 74681 - DNA, 22 bp, Homo sapiens
accttcaggtgagcacacagat

SEQ ID NO: 74682 - DNA, 22 bp, Homo sapiens
tcgcccaggctggaagtgcagt

SEQ ID NO: 74683 - DNA, 22 bp, Homo sapiens
aaacccagggttttgtcttccc

SEQ ID NO: 74684 - DNA, 22 bp, Homo sapiens
atggcaccttccccagagctca

SEQ ID NO: 74685 - DNA, 22 bp, Homo sapiens
atgaattgaggaaaacagtcgt

SEQ ID NO: 74686 - DNA, 22 bp, Homo sapiens
agagcagctcgctacctctcta

SEQ ID NO: 74687 - DNA, 22 bp, Homo sapiens
tctgccgtgcgaggtcccacca

SEQ ID NO: 74688 - DNA, 22 bp, Homo sapiens
gaggtggatgttgcagtgagct

SEQ ID NO: 74689 - DNA, 22 bp, Homo sapiens
tcacccctccattctctcatgt

SEQ ID NO: 74690 - DNA, 22 bp, Homo sapiens
agttggagtgaacatgagattg

SEQ ID NO: 74691 - DNA, 22 bp, Homo sapiens
tatgttaacatgttaggaactg

SEQ ID NO: 74692 - DNA, 22 bp, Homo sapiens
tagaataatctgaggaaatgct

SEQ ID NO: 74693 - DNA, 22 bp, Homo sapiens
ccaaagtgctgggattacaggt

SEQ ID NO: 74694 - DNA, 22 bp, Homo sapiens
ttcccaggaagcctctccaagc

SEQ ID NO: 74695 - DNA, 22 bp, Homo sapiens
ttccagtgggctgggagtaagg

SEQ ID NO: 74696 - DNA, 22 bp, Homo sapiens
caggaaagggatgggctgccac

SEQ ID NO: 74697 - DNA, 22 bp, Homo sapiens
tcattccctcattgttcactgg

SEQ ID NO: 74698 - DNA, 22 bp, Homo sapiens
agcctggtttaagcattttata

SEQ ID NO: 74699 - DNA, 22 bp, Homo sapiens
cagtgcttttaaaacaacatca

SEQ ID NO: 74700 - DNA, 21 bp, Homo sapiens
gttctacagttttagaattcc

SEQ ID NO: 74701 - DNA, 22 bp, Homo sapiens
gagcaggaaggccagaagggtc

SEQ ID NO: 74702 - DNA, 22 bp, Homo sapiens
tctacatgcagcgaggggactt

SEQ ID NO: 74703 - DNA, 22 bp, Homo sapiens
gtgcagagaggaccttggggag

SEQ ID NO: 74704 - DNA, 22 bp, Homo sapiens
aataaacaaatccttccttccc

SEQ ID NO: 74705 - DNA, 22 bp, Homo sapiens
caggaggttgagggtgcagtga

SEQ ID NO: 74706 - DNA, 22 bp, Homo sapiens
ggctggtgttgagtgcctgtag

SEQ ID NO: 74707 - DNA, 18 bp, Homo sapiens
tcttcatctcctgagctg

SEQ ID NO: 74708 - DNA, 18 bp, Homo sapiens
taggttacagccagccag

SEQ ID NO: 74709 - DNA, 22 bp, Homo sapiens
ggaagggcaaaagagatgaact

SEQ ID NO: 74710 - DNA, 22 bp, Homo sapiens
agttcaacaccagcctgaccaa

SEQ ID NO: 74711 - DNA, 22 bp, Homo sapiens
tggtgccatcatagctcactgc

SEQ ID NO: 74712 - DNA, 22 bp, Homo sapiens
atatcactagagaagttgttaa

SEQ ID NO: 74713 - DNA, 22 bp, Homo sapiens
gaagcgcggcgtcggcgtgggt

SEQ ID NO: 74714 - DNA, 22 bp, Homo sapiens
gaggactgaaacttacaggaaa

SEQ ID NO: 74715 - DNA, 22 bp, Homo sapiens
atacctgtgtatccacaagcgt

SEQ ID NO: 74716 - DNA, 22 bp, Homo sapiens
cataatttctaccagggccata

SEQ ID NO: 74717 - DNA, 22 bp, Homo sapiens
tcttcattttacaggcagacct

SEQ ID NO: 74718 - DNA, 22 bp, Homo sapiens
ttagctcagaaaatttaaactt

SEQ ID NO: 74719 - DNA, 23 bp, Homo sapiens
ggagtgcaatggcgccatctcgg

SEQ ID NO: 74720 - DNA, 22 bp, Homo sapiens
ggagggcgacagggcgaccgcg

SEQ ID NO: 74721 - DNA, 22 bp, Homo sapiens
tctcctggtacccttcctagca

SEQ ID NO: 74722 - DNA, 22 bp, Homo sapiens
attgtgaatagtgccgcagtaa

SEQ ID NO: 74723 - DNA, 22 bp, Homo sapiens
gccaaataagtgtccggccctc

SEQ ID NO: 74724 - DNA, 22 bp, Homo sapiens
aaaaagtattggccatggttga

SEQ ID NO: 74725 - DNA, 22 bp, Homo sapiens
ataaaagatcccttctgagctc

SEQ ID NO: 74726 - DNA, 22 bp, Homo sapiens
tcaagggcaaatgctacctata

SEQ ID NO: 74727 - DNA, 22 bp, Homo sapiens
accatgttggccaagctggtct

SEQ ID NO: 74728 - DNA, 22 bp, Homo sapiens
aggaatggtgctcagcagaaat

SEQ ID NO: 74729 - DNA, 22 bp, Homo sapiens
agagaagagtcttgtcaaatta

SEQ ID NO: 74730 - DNA, 22 bp, Homo sapiens
atgtcactgttgttattgttat

SEQ ID NO: 74731 - DNA, 22 bp, Homo sapiens
tggagaattctatgttgagggg

SEQ ID NO: 74732 - DNA, 22 bp, Homo sapiens
tggtcgaccagttggaaagtaa

SEQ ID NO: 74733 - DNA, 22 bp, Homo sapiens
aaaccgcaatcacttttgcacc

SEQ ID NO: 74734 - DNA, 22 bp, Homo sapiens
tctgaaaactccatgagctcgt

SEQ ID NO: 74735 - DNA, 22 bp, Homo sapiens
caagcttgtttctcctgggggt

SEQ ID NO: 74736 - DNA, 22 bp, Homo sapiens
caatcactctgcaacattcctg

SEQ ID NO: 74737 - DNA, 22 bp, Homo sapiens
acaggggacctaggaccctcgg

SEQ ID NO: 74738 - DNA, 22 bp, Homo sapiens
ccaaagtgctggggttacaggc

SEQ ID NO: 74739 - DNA, 22 bp, Homo sapiens
aaggggtgagcagaggcttcgc

SEQ ID NO: 74740 - DNA, 22 bp, Homo sapiens
tctgtgaagctctgaacagcag

SEQ ID NO: 74741 - DNA, 22 bp, Homo sapiens
gcagactgtatcaatgtcagta

SEQ ID NO: 74742 - DNA, 18 bp, Homo sapiens
aggagcggctgcggctgc

SEQ ID NO: 74743 - DNA, 22 bp, Homo sapiens
ctcaggacccggtccaggtggg

SEQ ID NO: 74744 - DNA, 21 bp, Homo sapiens
ctacttaagtaggggattagg

SEQ ID NO: 74745 - DNA, 22 bp, Homo sapiens
tttatagcagcatgatttatag

SEQ ID NO: 74746 - DNA, 22 bp, Homo sapiens
ggctcacgcaattatcccggcc

SEQ ID NO: 74747 - DNA, 22 bp, Homo sapiens
acaaccaagaacagagggaaag

SEQ ID NO: 74748 - DNA, 22 bp, Homo sapiens
aagctgttgttcatcctgaatt

SEQ ID NO: 74749 - DNA, 20 bp, Homo sapiens
tcacatcctctcccaacatg

SEQ ID NO: 74750 - DNA, 22 bp, Homo sapiens
ctgggaggcggagcttgcagtg

SEQ ID NO: 74751 - DNA, 22 bp, Homo sapiens
ctgctttaaaactgatacatga

SEQ ID NO: 74752 - DNA, 22 bp, Homo sapiens
ggagtgactcacagctgggaca

SEQ ID NO: 74753 - DNA, 22 bp, Homo sapiens
gagaaatgcatgcatgtcatca

SEQ ID NO: 74754 - DNA, 22 bp, Homo sapiens
accctgctttatgccgtcctct

SEQ ID NO: 74755 - DNA, 22 bp, Homo sapiens
tgacttcctgcactcaggtgat

SEQ ID NO: 74756 - DNA, 22 bp, Homo sapiens
acccaggctggagtgcagtggc

SEQ ID NO: 74757 - DNA, 22 bp, Homo sapiens
acccagccatgttcagttctct

SEQ ID NO: 74758 - DNA, 22 bp, Homo sapiens
tgctggacagggcacggcccat

SEQ ID NO: 74759 - DNA, 17 bp, Homo sapiens
aggtgggtggatcacct

SEQ ID NO: 74760 - DNA, 22 bp, Homo sapiens
gtgggggagatgcttaggtccg

SEQ ID NO: 74761 - DNA, 22 bp, Homo sapiens
tggagggcatgctgtccatggg

SEQ ID NO: 74762 - DNA, 22 bp, Homo sapiens
ttgagcaggatggctatgcaca

SEQ ID NO: 74763 - DNA, 20 bp, Homo sapiens
cagagccagggttttgtttt

SEQ ID NO: 74764 - DNA, 22 bp, Homo sapiens
gtgaaatatttaacgtccaggt

SEQ ID NO: 74765 - DNA, 22 bp, Homo sapiens
gtggaatttttacctatgaatg

SEQ ID NO: 74766 - DNA, 22 bp, Homo sapiens
cctcatcgtttccagaatgtgg

SEQ ID NO: 74767 - DNA, 22 bp, Homo sapiens
gcaggcaggcttccttgaactg

SEQ ID NO: 74768 - DNA, 22 bp, Homo sapiens
ttccgctgtttagttgaagttt

SEQ ID NO: 74769 - DNA, 22 bp, Homo sapiens
atggccctaatgagttggtgtt

SEQ ID NO: 74770 - DNA, 22 bp, Homo sapiens
gctcccaccgccgctatgggta

SEQ ID NO: 74771 - DNA, 22 bp, Homo sapiens
gcaccaggtgcagccgggcccc

SEQ ID NO: 74772 - DNA, 22 bp, Homo sapiens
tcaccaccagaagagctattct

SEQ ID NO: 74773 - DNA, 22 bp, Homo sapiens
ctggtaggggtgactgttatcg

SEQ ID NO: 74774 - DNA, 22 bp, Homo sapiens
ggccctggtcctaggggtggaa

SEQ ID NO: 74775 - DNA, 22 bp, Homo sapiens
aggtatatattctggtccttat

SEQ ID NO: 74776 - DNA, 22 bp, Homo sapiens
cgcccaggctggagtgcagtga

SEQ ID NO: 74777 - DNA, 22 bp, Homo sapiens
tgcatggacgtgacttggccaa

SEQ ID NO: 74778 - DNA, 22 bp, Homo sapiens
aaaagtaattgtggttttggcc

SEQ ID NO: 74779 - DNA, 22 bp, Homo sapiens
tgccttgtccttcgtcagggct

SEQ ID NO: 74780 - DNA, 22 bp, Homo sapiens
gggaggttgaggctgcagtgag

SEQ ID NO: 74781 - DNA, 22 bp, Homo sapiens
gaggccaactttggagaacagg

SEQ ID NO: 74782 - DNA, 22 bp, Homo sapiens
tgagtagagaattcagctaagg

SEQ ID NO: 74783 - DNA, 22 bp, Homo sapiens
agagtgcaaccgaaacaagcag

SEQ ID NO: 74784 - DNA, 22 bp, Homo sapiens
tcactgcaatctcagcctcctg

SEQ ID NO: 74785 - DNA, 22 bp, Homo sapiens
ggcgtgggcgaggtgctctatc

SEQ ID NO: 74786 - DNA, 22 bp, Homo sapiens
aaaggtcaaaatcgtgacattg

SEQ ID NO: 74787 - DNA, 22 bp, Homo sapiens
ctgctcttcacactacacccgt

SEQ ID NO: 74788 - DNA, 22 bp, Homo sapiens
ttcctggaaattatgctcacct

SEQ ID NO: 74789 - DNA, 22 bp, Homo sapiens
tagtggatgggtaaagtatttt

SEQ ID NO: 74790 - DNA, 22 bp, Homo sapiens
ggagagcagggaggctgctctg

SEQ ID NO: 74791 - DNA, 22 bp, Homo sapiens
atggtttattagctgcacaggc

SEQ ID NO: 74792 - DNA, 22 bp, Homo sapiens
ggacctgaacataaaacgaggc

SEQ ID NO: 74793 - DNA, 22 bp, Homo sapiens
ctgggaagaagggacaacagcg

SEQ ID NO: 74794 - DNA, 21 bp, Homo sapiens
gccatttcacacagacatttg

SEQ ID NO: 74795 - DNA, 22 bp, Homo sapiens
tctgccttttactagctggatg

SEQ ID NO: 74796 - DNA, 22 bp, Homo sapiens
gtgtgtccaaggcacggatgac

SEQ ID NO: 74797 - DNA, 22 bp, Homo sapiens
gtccacttctgcctttctggat

SEQ ID NO: 74798 - DNA, 22 bp, Homo sapiens
gcagcagtgctttggaatcctg

SEQ ID NO: 74799 - DNA, 22 bp, Homo sapiens
ctgcgtgcatgtctgcgtgcat

SEQ ID NO: 74800 - DNA, 22 bp, Homo sapiens
tgaatatgtgactttgatttca

SEQ ID NO: 74801 - DNA, 22 bp, Homo sapiens
agcctggcctgggcaggcacat

SEQ ID NO: 74802 - DNA, 22 bp, Homo sapiens
ggaccggtggcttcctcgggtc

SEQ ID NO: 74803 - DNA, 22 bp, Homo sapiens
aggtaaagacagtgaaagaggg

SEQ ID NO: 74804 - DNA, 22 bp, Homo sapiens
tgtgttcagaatttgctgcttt

SEQ ID NO: 74805 - DNA, 22 bp, Homo sapiens
ttagtctctttgcattgccata

SEQ ID NO: 74806 - DNA, 22 bp, Homo sapiens
agcaggagtttgatgcttttat

SEQ ID NO: 74807 - DNA, 22 bp, Homo sapiens
ggtagaaataatcttcaggctg

SEQ ID NO: 74808 - DNA, 22 bp, Homo sapiens
aaaagtcttggggaaggccagg

SEQ ID NO: 74809 - DNA, 22 bp, Homo sapiens
aataggtttaggaaagcgtttt

SEQ ID NO: 74810 - DNA, 18 bp, Homo sapiens
tcactgtgtgtcttgggt

SEQ ID NO: 74811 - DNA, 22 bp, Homo sapiens
tgcatctgcctggagtagcgcc

SEQ ID NO: 74812 - DNA, 22 bp, Homo sapiens
ttctctgcctcacaggtctaag

SEQ ID NO: 74813 - DNA, 22 bp, Homo sapiens
tgatttatgcattatactgttg

SEQ ID NO: 74814 - DNA, 22 bp, Homo sapiens
ttctccgctaagttctctgcag

SEQ ID NO: 74815 - DNA, 22 bp, Homo sapiens
gaatgaacaaatgtggtggaga

SEQ ID NO: 74816 - DNA, 18 bp, Homo sapiens
gtcaggcatgaatctggg

SEQ ID NO: 74817 - DNA, 22 bp, Homo sapiens
tacactgtttgaactgtggtcg

SEQ ID NO: 74818 - DNA, 22 bp, Homo sapiens
cttctacacgtggctgtgccaa

SEQ ID NO: 74819 - DNA, 22 bp, Homo sapiens
acagtcaaatgtctatcttctt

SEQ ID NO: 74820 - DNA, 22 bp, Homo sapiens
cctgccagagcagcttgtcctc

SEQ ID NO: 74821 - DNA, 22 bp, Homo sapiens
aatggtttctgaagttaggcag

SEQ ID NO: 74822 - DNA, 22 bp, Homo sapiens
atgtttaaagggttgagaaata

SEQ ID NO: 74823 - DNA, 22 bp, Homo sapiens
ctggagcaaaagtgactcctct

SEQ ID NO: 74824 - DNA, 23 bp, Homo sapiens
ccagtgattgcctggaaggaggt

SEQ ID NO: 74825 - DNA, 22 bp, Homo sapiens
catagagtgatgtaaggtatgt

SEQ ID NO: 74826 - DNA, 22 bp, Homo sapiens
tggggatcataaattgatggag

SEQ ID NO: 74827 - DNA, 22 bp, Homo sapiens
ctttggaacacccagctctgtg

SEQ ID NO: 74828 - DNA, 20 bp, Homo sapiens
tttcttgtcggctgttgctg

SEQ ID NO: 74829 - DNA, 22 bp, Homo sapiens
tcatctccatacggtctcgcag

SEQ ID NO: 74830 - DNA, 22 bp, Homo sapiens
aggaaggactccatggtccgtc

SEQ ID NO: 74831 - DNA, 22 bp, Homo sapiens
taactgattcctttttgaaaat

SEQ ID NO: 74832 - DNA, 22 bp, Homo sapiens
tgcctgttgcccacctgataaa

SEQ ID NO: 74833 - DNA, 20 bp, Homo sapiens
gctctgtggtttgagtctcc

SEQ ID NO: 74834 - DNA, 22 bp, Homo sapiens
agcctctctgttagtcactggg

SEQ ID NO: 74835 - DNA, 23 bp, Homo sapiens
atgacactcctgtgcgcaccctg

SEQ ID NO: 74836 - DNA, 22 bp, Homo sapiens
cttgtagaattgaaatggtctc

SEQ ID NO: 74837 - DNA, 22 bp, Homo sapiens
taagaaatttagttatagaatg

SEQ ID NO: 74838 - DNA, 22 bp, Homo sapiens
cactgggcgtgtcctgggtgag

SEQ ID NO: 74839 - DNA, 22 bp, Homo sapiens
tgtgggagaaggaagcaagctg

SEQ ID NO: 74840 - DNA, 22 bp, Homo sapiens
ctctcgccagcggggctgcgct

SEQ ID NO: 74841 - DNA, 22 bp, Homo sapiens
aaagtgctcggattacaggtat

SEQ ID NO: 74842 - DNA, 22 bp, Homo sapiens
ctgattaaaaacaggttctgag

SEQ ID NO: 74843 - DNA, 22 bp, Homo sapiens
ggtaacttagctcatggctgtg

SEQ ID NO: 74844 - DNA, 22 bp, Homo sapiens
gtgcatgtcggggtgcatgtca

SEQ ID NO: 74845 - DNA, 22 bp, Homo sapiens
ggcatgagcacgaagtggtacc

SEQ ID NO: 74846 - DNA, 22 bp, Homo sapiens
tggcacaggatctcagcggcca

SEQ ID NO: 74847 - DNA, 22 bp, Homo sapiens
tgcctgatgcaggagtatcaga

SEQ ID NO: 74848 - DNA, 22 bp, Homo sapiens
agcttagtggttgtatgagtta

SEQ ID NO: 74849 - DNA, 22 bp, Homo sapiens
ctggtagtttgcaaaatggtgt

SEQ ID NO: 74850 - DNA, 22 bp, Homo sapiens
agcgggctcacccggttgttgt

SEQ ID NO: 74851 - DNA, 22 bp, Homo sapiens
aagcctaggcctactctggttt

SEQ ID NO: 74852 - DNA, 22 bp, Homo sapiens
tttggcggggcaattctgaagc

SEQ ID NO: 74853 - DNA, 22 bp, Homo sapiens
ctgctgagagccccagctgaga

SEQ ID NO: 74854 - DNA, 22 bp, Homo sapiens
ttcagcagtgcagacacccagt

SEQ ID NO: 74855 - DNA, 22 bp, Homo sapiens
cccagttgttgccggctctgga

SEQ ID NO: 74856 - DNA, 22 bp, Homo sapiens
ccagcagagcatggggaggaag

SEQ ID NO: 74857 - DNA, 22 bp, Homo sapiens
tctgttttgcataatgttcttt

SEQ ID NO: 74858 - DNA, 22 bp, Homo sapiens
aatggctctgatgttgttgtga

SEQ ID NO: 74859 - DNA, 22 bp, Homo sapiens
ttcagcactgactgagtggtta

SEQ ID NO: 74860 - DNA, 18 bp, Homo sapiens
tccaccgcgtgcacctct

SEQ ID NO: 74861 - DNA, 22 bp, Homo sapiens
cctgggccctcaccgccggtgg

SEQ ID NO: 74862 - DNA, 22 bp, Homo sapiens
acgggccttctcttcaggcgag

SEQ ID NO: 74863 - DNA, 22 bp, Homo sapiens
aatataacacagatggcctgtt

SEQ ID NO: 74864 - DNA, 22 bp, Homo sapiens
gtgatggaagtcttgttccggg

SEQ ID NO: 74865 - DNA, 22 bp, Homo sapiens
tgcaatttttccatgacctaga

SEQ ID NO: 74866 - DNA, 22 bp, Homo sapiens
tttaagaagttatgttataaat

SEQ ID NO: 74867 - DNA, 22 bp, Homo sapiens
gcctccccaagcagcagggatt

SEQ ID NO: 74868 - DNA, 22 bp, Homo sapiens
tgtgtcccttggaacctcagct

SEQ ID NO: 74869 - DNA, 22 bp, Homo sapiens
tttgagatggagtcttgctctg

SEQ ID NO: 74870 - DNA, 21 bp, Homo sapiens
ccaccaggtcttctgctcggg

SEQ ID NO: 74871 - DNA, 22 bp, Homo sapiens
aggctctcaccctctgaccaga

SEQ ID NO: 74872 - DNA, 22 bp, Homo sapiens
ccaagggcgcctccgttccccc

SEQ ID NO: 74873 - DNA, 22 bp, Homo sapiens
cattaaacaaccttgaatcaat

SEQ ID NO: 74874 - DNA, 22 bp, Homo sapiens
gcaccctgtcaaaatggaccaa

SEQ ID NO: 74875 - DNA, 23 bp, Homo sapiens
agcagccagagatcctcggccct

SEQ ID NO: 74876 - DNA, 22 bp, Homo sapiens
gcaggatgagtgagtacattta

SEQ ID NO: 74877 - DNA, 22 bp, Homo sapiens
taacaactgctgaggtatttga

SEQ ID NO: 74878 - DNA, 22 bp, Homo sapiens
gtctatatattgcttgaataat

SEQ ID NO: 74879 - DNA, 22 bp, Homo sapiens
gcatgtgtctttatagcagcat

SEQ ID NO: 74880 - DNA, 22 bp, Homo sapiens
ctgagcctcctgcttctatttc

SEQ ID NO: 74881 - DNA, 22 bp, Homo sapiens
aaaggctttaaaatgtacatat

SEQ ID NO: 74882 - DNA, 22 bp, Homo sapiens
ggtgacggggcccaggtttcct

SEQ ID NO: 74883 - DNA, 22 bp, Homo sapiens
ctgttcccggtggccgggccag

SEQ ID NO: 74884 - DNA, 20 bp, Homo sapiens
tcccccactgtttctgctac

SEQ ID NO: 74885 - DNA, 22 bp, Homo sapiens
tcgcaccattgcactccagcca

SEQ ID NO: 74886 - DNA, 22 bp, Homo sapiens
tctgccttctatcttttgtctg

SEQ ID NO: 74887 - DNA, 22 bp, Homo sapiens
cacctctcatttctacagattc

SEQ ID NO: 74888 - DNA, 22 bp, Homo sapiens
cgactgtcatacacaagacatg

SEQ ID NO: 74889 - DNA, 22 bp, Homo sapiens
aggtgacaggacaggagctggt

SEQ ID NO: 74890 - DNA, 22 bp, Homo sapiens
gtggcattgccttctgcaggaa

SEQ ID NO: 74891 - DNA, 22 bp, Homo sapiens
ttacaaagtttaaggtggcact

SEQ ID NO: 74892 - DNA, 18 bp, Homo sapiens
acacttcctggtggtgtg

SEQ ID NO: 74893 - DNA, 18 bp, Homo sapiens
gaccccgggatctgtcga

SEQ ID NO: 74894 - DNA, 22 bp, Homo sapiens
tgctaataaactccaggctgag

SEQ ID NO: 74895 - DNA, 22 bp, Homo sapiens
actgtctgtagacatttttggt

SEQ ID NO: 74896 - DNA, 22 bp, Homo sapiens
atacaaaatatatactggagac

SEQ ID NO: 74897 - DNA, 22 bp, Homo sapiens
agggggctccttggtgtgcaga

SEQ ID NO: 74898 - DNA, 22 bp, Homo sapiens
agggccagcactcctggcagga

SEQ ID NO: 74899 - DNA, 22 bp, Homo sapiens
acctcctggcctcaagcaatcc

SEQ ID NO: 74900 - DNA, 22 bp, Homo sapiens
gccatgggcaaatgcagagctg

SEQ ID NO: 74901 - DNA, 22 bp, Homo sapiens
aatggcaagagccacagaggcg

SEQ ID NO: 74902 - DNA, 22 bp, Homo sapiens
agtcaataaaagctttagattc

SEQ ID NO: 74903 - DNA, 22 bp, Homo sapiens
agcccttggtattttccgatcc

SEQ ID NO: 74904 - DNA, 22 bp, Homo sapiens
agccaggatggtctcgatcggc

SEQ ID NO: 74905 - DNA, 22 bp, Homo sapiens
cccgagtgtctactcactccca

SEQ ID NO: 74906 - DNA, 22 bp, Homo sapiens
cgtgtggtcccggcaaggcaag

SEQ ID NO: 74907 - DNA, 22 bp, Homo sapiens
agaggccgggtgcctgctcaga

SEQ ID NO: 74908 - DNA, 22 bp, Homo sapiens
cttctggcgttggaggtctgag

SEQ ID NO: 74909 - DNA, 22 bp, Homo sapiens
ccacctgagataagagagctca

SEQ ID NO: 74910 - DNA, 22 bp, Homo sapiens
attctaatggcagagactcctg

SEQ ID NO: 74911 - DNA, 22 bp, Homo sapiens
gaggggagcccccatcctccag

SEQ ID NO: 74912 - DNA, 22 bp, Homo sapiens
ggggcaggagcccttcttcagc

SEQ ID NO: 74913 - DNA, 22 bp, Homo sapiens
ggggtctcactatgttacccag

SEQ ID NO: 74914 - DNA, 22 bp, Homo sapiens
caggctgctgcctagaatgaca

SEQ ID NO: 74915 - DNA, 22 bp, Homo sapiens
cctggcctttgaacgctagact

SEQ ID NO: 74916 - DNA, 22 bp, Homo sapiens
tgaatgtgatgctaaacatatg

SEQ ID NO: 74917 - DNA, 22 bp, Homo sapiens
ggtggctgcaatggctaacttc

SEQ ID NO: 74918 - DNA, 21 bp, Homo sapiens
ttgaccaagggtgcgtgctcc

SEQ ID NO: 74919 - DNA, 22 bp, Homo sapiens
tggacaacatagtgagacctca

SEQ ID NO: 74920 - DNA, 22 bp, Homo sapiens
ctcgtgatccgcccacctcagc

SEQ ID NO: 74921 - DNA, 22 bp, Homo sapiens
gcgctcctgagggttctgcatc

SEQ ID NO: 74922 - DNA, 22 bp, Homo sapiens
ggcggaggttgcagtaagccga

SEQ ID NO: 74923 - DNA, 17 bp, Homo sapiens
gtaaggcttgcagatgc

SEQ ID NO: 74924 - DNA, 22 bp, Homo sapiens
cacaaccatgcacagctaattt

SEQ ID NO: 74925 - DNA, 22 bp, Homo sapiens
ttctcttacattttctcagcct

SEQ ID NO: 74926 - DNA, 22 bp, Homo sapiens
atggggagctcaccacctgttt

SEQ ID NO: 74927 - DNA, 19 bp, Homo sapiens
tgagggtgagctttggaga

SEQ ID NO: 74928 - DNA, 22 bp, Homo sapiens
gagctgagaagcagcgcttgat

SEQ ID NO: 74929 - DNA, 22 bp, Homo sapiens
aagagactgtaaaggcgtgagt

SEQ ID NO: 74930 - DNA, 22 bp, Homo sapiens
gggaggcacgaggcgcgcagtg

SEQ ID NO: 74931 - DNA, 22 bp, Homo sapiens
aagaggtagcagtcacaaaaga

SEQ ID NO: 74932 - DNA, 21 bp, Homo sapiens
agcgtcaatatcgtcaacagg

SEQ ID NO: 74933 - DNA, 22 bp, Homo sapiens
agacgcgcagaaggaagcggcc

SEQ ID NO: 74934 - DNA, 22 bp, Homo sapiens
tttcctcttctggcaggcaggg

SEQ ID NO: 74935 - DNA, 22 bp, Homo sapiens
gtagtctgaacagtaattttgt

SEQ ID NO: 74936 - DNA, 22 bp, Homo sapiens
tgaggaaacttacaaggcagaa

SEQ ID NO: 74937 - DNA, 22 bp, Homo sapiens
atggtcaccttgggagcctgct

SEQ ID NO: 74938 - DNA, 22 bp, Homo sapiens
agacactgttctcacatgcttg

SEQ ID NO: 74939 - DNA, 22 bp, Homo sapiens
aacccgtgatcctgactcccct

SEQ ID NO: 74940 - DNA, 22 bp, Homo sapiens
aagaactgtttacaattttcac

SEQ ID NO: 74941 - DNA, 22 bp, Homo sapiens
tatttccttgagacggagtctc

SEQ ID NO: 74942 - DNA, 22 bp, Homo sapiens
gacttctgaattcctatcaggt

SEQ ID NO: 74943 - DNA, 22 bp, Homo sapiens
aacccgggaggcagaggttgtg

SEQ ID NO: 74944 - DNA, 22 bp, Homo sapiens
caggtgagaggcggtcctgcat

SEQ ID NO: 74945 - DNA, 22 bp, Homo sapiens
ctctgtagaaagagcccaggtg

SEQ ID NO: 74946 - DNA, 22 bp, Homo sapiens
caaagtgctgggattataggca

SEQ ID NO: 74947 - DNA, 22 bp, Homo sapiens
ctgagccaaggggacagtgaca

SEQ ID NO: 74948 - DNA, 22 bp, Homo sapiens
cccagcaggtcggtgctgcctg

SEQ ID NO: 74949 - DNA, 22 bp, Homo sapiens
cagtgccagctgcttggcctac

SEQ ID NO: 74950 - DNA, 22 bp, Homo sapiens
tagaaaagccccagctggaggg

SEQ ID NO: 74951 - DNA, 22 bp, Homo sapiens
tcgtgaggctctgcatcgcaca

SEQ ID NO: 74952 - DNA, 22 bp, Homo sapiens
gggaaggaaagttattagcaga

SEQ ID NO: 74953 - DNA, 22 bp, Homo sapiens
gaggccaaggtgggcagatcac

SEQ ID NO: 74954 - DNA, 22 bp, Homo sapiens
ggagtgctttgaagccttcatt

SEQ ID NO: 74955 - DNA, 22 bp, Homo sapiens
gcccagcgagcagaggtggacg

SEQ ID NO: 74956 - DNA, 22 bp, Homo sapiens
agtgaccgaggcacttggcaac

SEQ ID NO: 74957 - DNA, 22 bp, Homo sapiens
gcaggctgtctaaagttagagt

SEQ ID NO: 74958 - DNA, 22 bp, Homo sapiens
cttgccttcagtccatcagtca

SEQ ID NO: 74959 - DNA, 22 bp, Homo sapiens
ttctgtgctcaaaactttccaa

SEQ ID NO: 74960 - DNA, 20 bp, Homo sapiens
tttctccggtcttgagatcc

SEQ ID NO: 74961 - DNA, 22 bp, Homo sapiens
agctggaagtgcatttctcact

SEQ ID NO: 74962 - DNA, 22 bp, Homo sapiens
tctggctccaggaccgggcaca

SEQ ID NO: 74963 - DNA, 22 bp, Homo sapiens
gctcactgcaacctctgcctcc

SEQ ID NO: 74964 - DNA, 22 bp, Homo sapiens
tttgcatattaatatctgcgct

SEQ ID NO: 74965 - DNA, 22 bp, Homo sapiens
actgcaaagggaagccctttct

SEQ ID NO: 74966 - DNA, 22 bp, Homo sapiens
cttagatgaagtcacagaaccc

SEQ ID NO: 74967 - DNA, 18 bp, Homo sapiens
aggcttacagcagcaggc

SEQ ID NO: 74968 - DNA, 22 bp, Homo sapiens
tgtgctctgactttctcctggt

SEQ ID NO: 74969 - DNA, 22 bp, Homo sapiens
caatttgattaataccatactt

SEQ ID NO: 74970 - DNA, 21 bp, Homo sapiens
accactgcctccaaggttcag

SEQ ID NO: 74971 - DNA, 22 bp, Homo sapiens
accctcaacaaattcactctat

SEQ ID NO: 74972 - DNA, 22 bp, Homo sapiens
ttggatccatctcaggcatagg

SEQ ID NO: 74973 - DNA, 22 bp, Homo sapiens
tacaggcatgtagcatggtgat

SEQ ID NO: 74974 - DNA, 22 bp, Homo sapiens
cacagctgtgagaagggagcct

SEQ ID NO: 74975 - DNA, 22 bp, Homo sapiens
tggacaggcaagcaagacatac

SEQ ID NO: 74976 - DNA, 22 bp, Homo sapiens
acacatcctgaccaagttcagg

SEQ ID NO: 74977 - DNA, 18 bp, Homo sapiens
tgtagagccaggtttgcc

SEQ ID NO: 74978 - DNA, 22 bp, Homo sapiens
ttatagcagcatgatttatagt

SEQ ID NO: 74979 - DNA, 22 bp, Homo sapiens
acagagcaataacagggagagg

SEQ ID NO: 74980 - DNA, 19 bp, Homo sapiens
gggcaaagtgatcgtcctg

SEQ ID NO: 74981 - DNA, 22 bp, Homo sapiens
ggctcagatggtttgttctaga

SEQ ID NO: 74982 - DNA, 22 bp, Homo sapiens
aagcagagaatctgggagcgag

SEQ ID NO: 74983 - DNA, 22 bp, Homo sapiens
ctcggcaggtggaggttgtagt

SEQ ID NO: 74984 - DNA, 22 bp, Homo sapiens
ttctgatgaggaggtctctaag

SEQ ID NO: 74985 - DNA, 22 bp, Homo sapiens
ttctttgcccatgtttcctaag

SEQ ID NO: 74986 - DNA, 22 bp, Homo sapiens
aaaagcaattgcagttcttgcc

SEQ ID NO: 74987 - DNA, 22 bp, Homo sapiens
aagaagcattctttcattggtt

SEQ ID NO: 74988 - DNA, 22 bp, Homo sapiens
agggaagaaaatccatcgctgc

SEQ ID NO: 74989 - DNA, 19 bp, Homo sapiens
tgtgactggttgtctcgct

SEQ ID NO: 74990 - DNA, 22 bp, Homo sapiens
cggagcctgcttgttgcagctg

SEQ ID NO: 74991 - DNA, 22 bp, Homo sapiens
tagcagcaaagcaggatctgct

SEQ ID NO: 74992 - DNA, 22 bp, Homo sapiens
aggaagttagtaaattatgtgc

SEQ ID NO: 74993 - DNA, 22 bp, Homo sapiens
caccaagaatcttcacttttta

SEQ ID NO: 74994 - DNA, 22 bp, Homo sapiens
tcttaagcagagaagaagttga

SEQ ID NO: 74995 - DNA, 22 bp, Homo sapiens
gcggccttgtggcggagcaggc

SEQ ID NO: 74996 - DNA, 22 bp, Homo sapiens
ttgaccactgaatggttctgaa

SEQ ID NO: 74997 - DNA, 23 bp, Homo sapiens
tcctgtcaagtgcttgttcctgc

SEQ ID NO: 74998 - DNA, 22 bp, Homo sapiens
actgggaagtcagagagaggct

SEQ ID NO: 74999 - DNA, 22 bp, Homo sapiens
gctggagaggatcccaaagcca

SEQ ID NO: 75000 - DNA, 22 bp, Homo sapiens
aagcacctgcaccggtcgcctt

SEQ ID NO: 75001 - DNA, 19 bp, Homo sapiens
ttttggaaatgtgaacagc

SEQ ID NO: 75002 - DNA, 22 bp, Homo sapiens
cactgcactccagcttgggtga

SEQ ID NO: 75003 - DNA, 22 bp, Homo sapiens
tgaggcccaccttggccccggc

SEQ ID NO: 75004 - DNA, 22 bp, Homo sapiens
tcctgaagaaggcagatatttg

SEQ ID NO: 75005 - DNA, 22 bp, Homo sapiens
gatgtagacacttggaggctta

SEQ ID NO: 75006 - DNA, 22 bp, Homo sapiens
ggctccaccctgcttccagaag

SEQ ID NO: 75007 - DNA, 22 bp, Homo sapiens
tggcccagtatgtataatctta

SEQ ID NO: 75008 - DNA, 22 bp, Homo sapiens
gctttggacaataactgctttt

SEQ ID NO: 75009 - DNA, 22 bp, Homo sapiens
aaaagttattgatgcaggacaa

SEQ ID NO: 75010 - DNA, 22 bp, Homo sapiens
tagcagaagttgcaaactaggg

SEQ ID NO: 75011 - DNA, 22 bp, Homo sapiens
ccctaagaagcaaagtgatacc

SEQ ID NO: 75012 - DNA, 22 bp, Homo sapiens
ttccacggggctccccgctctt

SEQ ID NO: 75013 - DNA, 18 bp, Homo sapiens
tccctcagaattatagaa

SEQ ID NO: 75014 - DNA, 22 bp, Homo sapiens
cagtggcctctggctttgctgt

SEQ ID NO: 75015 - DNA, 22 bp, Homo sapiens
agagcaattctcaaggaggtgt

SEQ ID NO: 75016 - DNA, 22 bp, Homo sapiens
atgagaaagttaatcatcatga

SEQ ID NO: 75017 - DNA, 22 bp, Homo sapiens
agcactgtgagcaccagcacgc

SEQ ID NO: 75018 - DNA, 22 bp, Homo sapiens
ggggcccctcggacacgtgcgg

SEQ ID NO: 75019 - DNA, 22 bp, Homo sapiens
ttttttgttgggtagaacggaa

SEQ ID NO: 75020 - DNA, 22 bp, Homo sapiens
tgatattttatgagctttcata

SEQ ID NO: 75021 - DNA, 22 bp, Homo sapiens
gggccctgcgactcgcggcgga

SEQ ID NO: 75022 - DNA, 22 bp, Homo sapiens
cctcagacccctgctgagcttc

SEQ ID NO: 75023 - DNA, 22 bp, Homo sapiens
tggaatgtcagctacaagaggg

SEQ ID NO: 75024 - DNA, 22 bp, Homo sapiens
tctgagccagggtctcctccct

SEQ ID NO: 75025 - DNA, 22 bp, Homo sapiens
atgtatacgtgcaagtcacagg

SEQ ID NO: 75026 - DNA, 22 bp, Homo sapiens
gcatatgatcacgtgtgtcggt

SEQ ID NO: 75027 - DNA, 22 bp, Homo sapiens
gcatgcaatctatccttaggaa

SEQ ID NO: 75028 - DNA, 22 bp, Homo sapiens
cagacttacctaaggtcacaca

SEQ ID NO: 75029 - DNA, 22 bp, Homo sapiens
tagcataacaggtaagagtgag

SEQ ID NO: 75030 - DNA, 22 bp, Homo sapiens
gaaatctttgccttagctgtgt

SEQ ID NO: 75031 - DNA, 22 bp, Homo sapiens
atgtacataaaatgtataatga

SEQ ID NO: 75032 - DNA, 22 bp, Homo sapiens
taggtagatttaaagattttct

SEQ ID NO: 75033 - DNA, 22 bp, Homo sapiens
ggccactgacctacatctgggg

SEQ ID NO: 75034 - DNA, 22 bp, Homo sapiens
aagactgagtggcttaagaaaa

SEQ ID NO: 75035 - DNA, 22 bp, Homo sapiens
aggccagcctgcccaaagctgc

SEQ ID NO: 75036 - DNA, 22 bp, Homo sapiens
attgtactacaccatagtactg

SEQ ID NO: 75037 - DNA, 22 bp, Homo sapiens
gtggcccaggttggagtgcagt

SEQ ID NO: 75038 - DNA, 22 bp, Homo sapiens
tgatttacagtagtgtctaaac

SEQ ID NO: 75039 - DNA, 22 bp, Homo sapiens
actgtgtgtttgtctagcacag

SEQ ID NO: 75040 - DNA, 22 bp, Homo sapiens
cattctgcgatcctcaagcaca

SEQ ID NO: 75041 - DNA, 19 bp, Homo sapiens
gttctttcatagtaagagc

SEQ ID NO: 75042 - DNA, 22 bp, Homo sapiens
tccctagtcgcatctgtggaga

SEQ ID NO: 75043 - DNA, 22 bp, Homo sapiens
ttcccacattctttacattcat

SEQ ID NO: 75044 - DNA, 22 bp, Homo sapiens
ttggagatatcacaccttcaca

SEQ ID NO: 75045 - DNA, 22 bp, Homo sapiens
cactgcactccagcctgggcaa

SEQ ID NO: 75046 - DNA, 22 bp, Homo sapiens
ctgattgagaaggaaggggatc

SEQ ID NO: 75047 - DNA, 22 bp, Homo sapiens
aactctatttaccctactaaac

SEQ ID NO: 75048 - DNA, 22 bp, Homo sapiens
gctcatgactgtaatcccagca

SEQ ID NO: 75049 - DNA, 22 bp, Homo sapiens
tccagctctgctgtgcgccggt

SEQ ID NO: 75050 - DNA, 22 bp, Homo sapiens
agaacgtggaatgtggctcctt

SEQ ID NO: 75051 - DNA, 22 bp, Homo sapiens
tcacttagatggggatcatcac

SEQ ID NO: 75052 - DNA, 22 bp, Homo sapiens
atgatggctaggctggttttga

SEQ ID NO: 75053 - DNA, 22 bp, Homo sapiens
gaccagtcattactcatgccct

SEQ ID NO: 75054 - DNA, 22 bp, Homo sapiens
tattgacagtgactattggtag

SEQ ID NO: 75055 - DNA, 22 bp, Homo sapiens
gctgcactttgactgctggggt

SEQ ID NO: 75056 - DNA, 19 bp, Homo sapiens
atgtacccagtgtcaatcc

SEQ ID NO: 75057 - DNA, 22 bp, Homo sapiens
tctgaggctgaatggactccgt

SEQ ID NO: 75058 - DNA, 22 bp, Homo sapiens
gagagagctctgtgcctgggat

SEQ ID NO: 75059 - DNA, 22 bp, Homo sapiens
tggtaaggttccagatctagaa

SEQ ID NO: 75060 - DNA, 22 bp, Homo sapiens
tatgaagtgatgttgaattttg

SEQ ID NO: 75061 - DNA, 22 bp, Homo sapiens
cctactctgagcgcctccgcat

SEQ ID NO: 75062 - DNA, 22 bp, Homo sapiens
tgtctattcccccacctccgtt

SEQ ID NO: 75063 - DNA, 22 bp, Homo sapiens
aatactgcctgtgaggtaactc

SEQ ID NO: 75064 - DNA, 22 bp, Homo sapiens
gtgtggctgaaatcaaggcagg

SEQ ID NO: 75065 - DNA, 22 bp, Homo sapiens
ccgggagcaggcgccaccgcca

SEQ ID NO: 75066 - DNA, 17 bp, Homo sapiens
cgggcatggagggcagg

SEQ ID NO: 75067 - DNA, 22 bp, Homo sapiens
gcagggtctgaggccacagagg

SEQ ID NO: 75068 - DNA, 22 bp, Homo sapiens
cagtggctggttagggacagga

SEQ ID NO: 75069 - DNA, 22 bp, Homo sapiens
tctctcaggctggagtgcagtg

SEQ ID NO: 75070 - DNA, 22 bp, Homo sapiens
gcagccagagggggtgtgatca

SEQ ID NO: 75071 - DNA, 22 bp, Homo sapiens
aaagccttcttgtatcgagcca

SEQ ID NO: 75072 - DNA, 22 bp, Homo sapiens
agaggcagtatacaatccgagc

SEQ ID NO: 75073 - DNA, 22 bp, Homo sapiens
tcgttaccatagccttgtccct

SEQ ID NO: 75074 - DNA, 19 bp, Homo sapiens
cccaggaagcggaggttgc

SEQ ID NO: 75075 - DNA, 22 bp, Homo sapiens
atttagaactttgtttgccaat

SEQ ID NO: 75076 - DNA, 22 bp, Homo sapiens
tactagttcccagctaaaagta

SEQ ID NO: 75077 - DNA, 22 bp, Homo sapiens
cctgcctactgagttttatatt

SEQ ID NO: 75078 - DNA, 22 bp, Homo sapiens
acaaggcactttatgaagagga

SEQ ID NO: 75079 - DNA, 22 bp, Homo sapiens
tttttccacataccctaggcca

SEQ ID NO: 75080 - DNA, 22 bp, Homo sapiens
agggagcattgtgacatatcac

SEQ ID NO: 75081 - DNA, 22 bp, Homo sapiens
tctgtcttagccatctcaggct

SEQ ID NO: 75082 - DNA, 22 bp, Homo sapiens
ggtgctggacacgtggcactcc

SEQ ID NO: 75083 - DNA, 22 bp, Homo sapiens
agcagctttcacctccccgcct

SEQ ID NO: 75084 - DNA, 22 bp, Homo sapiens
tctttcattctagtctgaggtt

SEQ ID NO: 75085 - DNA, 22 bp, Homo sapiens
aagcatttcaggtagagatatt

SEQ ID NO: 75086 - DNA, 22 bp, Homo sapiens
ctgtggttggagtgcagtgaga

SEQ ID NO: 75087 - DNA, 22 bp, Homo sapiens
gcgagaaactaagtgccctttg

SEQ ID NO: 75088 - DNA, 22 bp, Homo sapiens
gattgggggtcaggctcaggtc

SEQ ID NO: 75089 - DNA, 22 bp, Homo sapiens
ttacttaaacagaaatgcagaa

SEQ ID NO: 75090 - DNA, 22 bp, Homo sapiens
acggcttcttgactgtgggttg

SEQ ID NO: 75091 - DNA, 22 bp, Homo sapiens
ctgggaggcagaggttgcagtg

SEQ ID NO: 75092 - DNA, 22 bp, Homo sapiens
acagcacttgggttttcctgtt

SEQ ID NO: 75093 - DNA, 22 bp, Homo sapiens
aatgtcaaaggctatacattca

SEQ ID NO: 75094 - DNA, 22 bp, Homo sapiens
agtccgcctgctgccgtggcag

SEQ ID NO: 75095 - DNA, 22 bp, Homo sapiens
tagccgggtgtggtggaactcc

SEQ ID NO: 75096 - DNA, 22 bp, Homo sapiens
cagggtttcaccatgttagcag

SEQ ID NO: 75097 - DNA, 22 bp, Homo sapiens
ttaagtaacttgtccaaatgag

SEQ ID NO: 75098 - DNA, 22 bp, Homo sapiens
cccaggaggtggagcttgcagt

SEQ ID NO: 75099 - DNA, 22 bp, Homo sapiens
caggtagaggctgccatcagct

SEQ ID NO: 75100 - DNA, 22 bp, Homo sapiens
ttggaagacaatgctgattctc

SEQ ID NO: 75101 - DNA, 22 bp, Homo sapiens
tcttgccacttcatcccctttc

SEQ ID NO: 75102 - DNA, 22 bp, Homo sapiens
ctgattgctaacctgttagaat

SEQ ID NO: 75103 - DNA, 22 bp, Homo sapiens
gcccaggctggagttcagtggt

SEQ ID NO: 75104 - DNA, 22 bp, Homo sapiens
ggagttgattttggatatatta

SEQ ID NO: 75105 - DNA, 22 bp, Homo sapiens
gttggagtgcagcttgtgcgat

SEQ ID NO: 75106 - DNA, 22 bp, Homo sapiens
aaaaatcacttttataggcagc

SEQ ID NO: 75107 - DNA, 22 bp, Homo sapiens
catgctgggtaaaggtggtgaa

SEQ ID NO: 75108 - DNA, 22 bp, Homo sapiens
caagacttcaccgctctgtgct

SEQ ID NO: 75109 - DNA, 22 bp, Homo sapiens
acatatgcgatcataggatgca

SEQ ID NO: 75110 - DNA, 21 bp, Homo sapiens
gctcctggtgctgcgtggcgc

SEQ ID NO: 75111 - DNA, 22 bp, Homo sapiens
aaggctgtggttctatacagaa

SEQ ID NO: 75112 - DNA, 22 bp, Homo sapiens
ataaagtggaggtagtattcat

SEQ ID NO: 75113 - DNA, 22 bp, Homo sapiens
tgtttcctttctggtgagcata

SEQ ID NO: 75114 - DNA, 22 bp, Homo sapiens
cgagagatgggttggcaggggc

SEQ ID NO: 75115 - DNA, 22 bp, Homo sapiens
gagcactgagctggaattggag

SEQ ID NO: 75116 - DNA, 23 bp, Homo sapiens
ttaacaggatctcgggcaagagg

SEQ ID NO: 75117 - DNA, 22 bp, Homo sapiens
gctccgtgggcattgctaggtg

SEQ ID NO: 75118 - DNA, 22 bp, Homo sapiens
gtagaggtagacttccttgtct

SEQ ID NO: 75119 - DNA, 22 bp, Homo sapiens
agattcaggcatgtcttcattt

SEQ ID NO: 75120 - DNA, 22 bp, Homo sapiens
gagccccaccctagacattctg

SEQ ID NO: 75121 - DNA, 22 bp, Homo sapiens
ttgagcccaggaggcctgggtg

SEQ ID NO: 75122 - DNA, 23 bp, Homo sapiens
gcctgggagttgcgatctgcccg

SEQ ID NO: 75123 - DNA, 22 bp, Homo sapiens
tccaccatgtaacaagctctgt

SEQ ID NO: 75124 - DNA, 22 bp, Homo sapiens
tagctgcttgaccaggcagtgg

SEQ ID NO: 75125 - DNA, 22 bp, Homo sapiens
ttgtacttgccatagaacaaca

SEQ ID NO: 75126 - DNA, 23 bp, Homo sapiens
tcatttggacaaggcacagcaga

SEQ ID NO: 75127 - DNA, 22 bp, Homo sapiens
aagtcgtggcaggcttgcacga

SEQ ID NO: 75128 - DNA, 22 bp, Homo sapiens
tcacaactgggtgtcttcatca

SEQ ID NO: 75129 - DNA, 22 bp, Homo sapiens
cgtgccctgcgcaagtgctgct

SEQ ID NO: 75130 - DNA, 19 bp, Homo sapiens
ttctctgctacattctcag

SEQ ID NO: 75131 - DNA, 22 bp, Homo sapiens
taggccacagagaggagatttc

SEQ ID NO: 75132 - DNA, 22 bp, Homo sapiens
ggtggcagtagcactgggcctg

SEQ ID NO: 75133 - DNA, 22 bp, Homo sapiens
tctctagtctcctttaacctga

SEQ ID NO: 75134 - DNA, 22 bp, Homo sapiens
tgttgagtatatacctacaagt

SEQ ID NO: 75135 - DNA, 19 bp, Homo sapiens
atcccaaggagctgggact

SEQ ID NO: 75136 - DNA, 22 bp, Homo sapiens
agtgcaatggtgccatcatagc

SEQ ID NO: 75137 - DNA, 21 bp, Homo sapiens
cagagctgtccaaaccctgac

SEQ ID NO: 75138 - DNA, 22 bp, Homo sapiens
taatggattaacgtccctgtcg

SEQ ID NO: 75139 - DNA, 22 bp, Homo sapiens
ttctgcaggctgtacaagaagc

SEQ ID NO: 75140 - DNA, 22 bp, Homo sapiens
aacttgtgggctcaagcaattt

SEQ ID NO: 75141 - DNA, 22 bp, Homo sapiens
cagggaaagtcccaccccacac

SEQ ID NO: 75142 - DNA, 17 bp, Homo sapiens
acttcccacccctccag

SEQ ID NO: 75143 - DNA, 19 bp, Homo sapiens
tgtccgtggccttctggat

SEQ ID NO: 75144 - DNA, 22 bp, Homo sapiens
catttacatttaaggttaatat

SEQ ID NO: 75145 - DNA, 22 bp, Homo sapiens
ccaggcagcctgctccattctg

SEQ ID NO: 75146 - DNA, 22 bp, Homo sapiens
ttagtattaggatcatatttga

SEQ ID NO: 75147 - DNA, 22 bp, Homo sapiens
tgctcattggcgatctgaggga

SEQ ID NO: 75148 - DNA, 22 bp, Homo sapiens
gattgtggaagtcagtggttct

SEQ ID NO: 75149 - DNA, 22 bp, Homo sapiens
tgcgcctctaatctcgggcgtc

SEQ ID NO: 75150 - DNA, 16 bp, Homo sapiens
atgctgctattagagg

SEQ ID NO: 75151 - DNA, 22 bp, Homo sapiens
tgcagtggcgccatctcagctc

SEQ ID NO: 75152 - DNA, 22 bp, Homo sapiens
agatttggtgtctggttgatat

SEQ ID NO: 75153 - DNA, 22 bp, Homo sapiens
cctcaccttcccagagacgatc

SEQ ID NO: 75154 - DNA, 22 bp, Homo sapiens
ttcctcaggctgctttcacata

SEQ ID NO: 75155 - DNA, 22 bp, Homo sapiens
actctgcctgcggtgggcggga

SEQ ID NO: 75156 - DNA, 22 bp, Homo sapiens
atgggtcagttcagtggccaac

SEQ ID NO: 75157 - DNA, 22 bp, Homo sapiens
gccctcctgagctagcacgtgt

SEQ ID NO: 75158 - DNA, 22 bp, Homo sapiens
ttctgtggttgaaaggagagat

SEQ ID NO: 75159 - DNA, 22 bp, Homo sapiens
gagtcggaggcaggagacctgg

SEQ ID NO: 75160 - DNA, 22 bp, Homo sapiens
tcttcccagaggaggtgccagc

SEQ ID NO: 75161 - DNA, 22 bp, Homo sapiens
tgtgtgattgcaggagatgtgg

SEQ ID NO: 75162 - DNA, 22 bp, Homo sapiens
gactccccacgttaaggaatgt

SEQ ID NO: 75163 - DNA, 22 bp, Homo sapiens
tatgaagtctctgatgttgagt

SEQ ID NO: 75164 - DNA, 22 bp, Homo sapiens
ttgtgtgtactggttatgggca

SEQ ID NO: 75165 - DNA, 22 bp, Homo sapiens
acatggcaaaaccccgtttcta

SEQ ID NO: 75166 - DNA, 20 bp, Homo sapiens
tgcagcacgggccctttcca

SEQ ID NO: 75167 - DNA, 22 bp, Homo sapiens
ttcctgggattattgtcaagca

SEQ ID NO: 75168 - DNA, 22 bp, Homo sapiens
gtacagaggttgctggaggctc

SEQ ID NO: 75169 - DNA, 22 bp, Homo sapiens
ttctcttttcaccagttgctaa

SEQ ID NO: 75170 - DNA, 22 bp, Homo sapiens
gggacgtgagtgaagaaggtct

SEQ ID NO: 75171 - DNA, 22 bp, Homo sapiens
cttcttgttgttagggtcctgt

SEQ ID NO: 75172 - DNA, 22 bp, Homo sapiens
ttctcatgaaactcgcttcctc

SEQ ID NO: 75173 - DNA, 22 bp, Homo sapiens
taaatgttttgtgggttgagtt

SEQ ID NO: 75174 - DNA, 22 bp, Homo sapiens
cagggtgctgcaccatccctca

SEQ ID NO: 75175 - DNA, 22 bp, Homo sapiens
ttgcgcgcggctaggtctcggt

SEQ ID NO: 75176 - DNA, 22 bp, Homo sapiens
aaagcagaggttgcagtgagct

SEQ ID NO: 75177 - DNA, 22 bp, Homo sapiens
cccaggggttcaaggctgcagt

SEQ ID NO: 75178 - DNA, 21 bp, Homo sapiens
ctgtttgcaagcctatgtgtc

SEQ ID NO: 75179 - DNA, 22 bp, Homo sapiens
agaaggggcccaaggatgtcag

SEQ ID NO: 75180 - DNA, 22 bp, Homo sapiens
agtaatcaatttttcggtggat

SEQ ID NO: 75181 - DNA, 22 bp, Homo sapiens
atcaagtgaagggctcttgaag

SEQ ID NO: 75182 - DNA, 22 bp, Homo sapiens
taactctgaatcctcacagcag

SEQ ID NO: 75183 - DNA, 22 bp, Homo sapiens
atgcttgcccatgtttctgaag

SEQ ID NO: 75184 - DNA, 22 bp, Homo sapiens
gagatggagtctttttctgtca

SEQ ID NO: 75185 - DNA, 22 bp, Homo sapiens
taacagtatatttaccaaacct

SEQ ID NO: 75186 - DNA, 22 bp, Homo sapiens
ggggccttttctgaatgtggaa

SEQ ID NO: 75187 - DNA, 22 bp, Homo sapiens
gtcagtgtcttaacagagatta

SEQ ID NO: 75188 - DNA, 20 bp, Homo sapiens
tgagacccgctgacaagttc

SEQ ID NO: 75189 - DNA, 22 bp, Homo sapiens
ggctcactgcaacttccgcctc

SEQ ID NO: 75190 - DNA, 22 bp, Homo sapiens
gggcggatcacctgaggtcagg

SEQ ID NO: 75191 - DNA, 22 bp, Homo sapiens
agccctcgtttctgcatcctgt

SEQ ID NO: 75192 - DNA, 22 bp, Homo sapiens
aagtgatgctacgactttgaca

SEQ ID NO: 75193 - DNA, 22 bp, Homo sapiens
gcagcgaggtgatgaaatagct

SEQ ID NO: 75194 - DNA, 22 bp, Homo sapiens
gcacttcaccactgtcctggtt

SEQ ID NO: 75195 - DNA, 22 bp, Homo sapiens
tggctcatgcctgtaatcttag

SEQ ID NO: 75196 - DNA, 22 bp, Homo sapiens
ctgtatctgtgttggatgagtt

SEQ ID NO: 75197 - DNA, 22 bp, Homo sapiens
ccagagtcccttgcagctcagt

SEQ ID NO: 75198 - DNA, 22 bp, Homo sapiens
gtggactgcgcttgagggggcc

SEQ ID NO: 75199 - DNA, 22 bp, Homo sapiens
gggccatgagaggttcatcaac

SEQ ID NO: 75200 - DNA, 22 bp, Homo sapiens
ggtgaggggctcctctgcccgg

SEQ ID NO: 75201 - DNA, 22 bp, Homo sapiens
gggttggcatcagggttctgtg

SEQ ID NO: 75202 - DNA, 22 bp, Homo sapiens
ggctgcttgatggaaggggacg

SEQ ID NO: 75203 - DNA, 22 bp, Homo sapiens
ccagtgtgcaatctctggctta

SEQ ID NO: 75204 - DNA, 18 bp, Homo sapiens
ccatcaccctaactagtg

SEQ ID NO: 75205 - DNA, 22 bp, Homo sapiens
acatttatataactcactagga

SEQ ID NO: 75206 - DNA, 22 bp, Homo sapiens
ggtctcatctttcagcgtcgag

SEQ ID NO: 75207 - DNA, 22 bp, Homo sapiens
tcactcaggctggagtgcagtg

SEQ ID NO: 75208 - DNA, 22 bp, Homo sapiens
cttcagctcttggtaaatgttt

SEQ ID NO: 75209 - DNA, 22 bp, Homo sapiens
ttattttaccttcctctgagct

SEQ ID NO: 75210 - DNA, 22 bp, Homo sapiens
gcacggctaatttttgtatttt

SEQ ID NO: 75211 - DNA, 22 bp, Homo sapiens
tgtatgaggcatacatcaggca

SEQ ID NO: 75212 - DNA, 23 bp, Homo sapiens
cgggttcacgccattctcctgcc

SEQ ID NO: 75213 - DNA, 22 bp, Homo sapiens
tgggagcagttgcatctccagt

SEQ ID NO: 75214 - DNA, 22 bp, Homo sapiens
tctcatttacttccacaggctg

SEQ ID NO: 75215 - DNA, 22 bp, Homo sapiens
atttctctgcagtgttcggaat

SEQ ID NO: 75216 - DNA, 22 bp, Homo sapiens
tcctcagcttttatttcacttg

SEQ ID NO: 75217 - DNA, 22 bp, Homo sapiens
tagagcaatgctctactccttg

SEQ ID NO: 75218 - DNA, 22 bp, Homo sapiens
gggtaaatctcttttcatggct

SEQ ID NO: 75219 - DNA, 22 bp, Homo sapiens
tttgtttgccacacaaaacagt

SEQ ID NO: 75220 - DNA, 20 bp, Homo sapiens
ttgcaactgtaagaagcagg

SEQ ID NO: 75221 - DNA, 22 bp, Homo sapiens
tcacccaggctggagtgcagtg

SEQ ID NO: 75222 - DNA, 22 bp, Homo sapiens
tctcccaggcaggagtgcagtg

SEQ ID NO: 75223 - DNA, 22 bp, Homo sapiens
tttaaaaaactagtctgagtct

SEQ ID NO: 75224 - DNA, 22 bp, Homo sapiens
agcccggcttccccggttgcta

SEQ ID NO: 75225 - DNA, 22 bp, Homo sapiens
gctgcagctgtaggacacaatt

SEQ ID NO: 75226 - DNA, 22 bp, Homo sapiens
gctaggttggggaagttctcct

SEQ ID NO: 75227 - DNA, 22 bp, Homo sapiens
tcctgccgtcctccggggcctc

SEQ ID NO: 75228 - DNA, 22 bp, Homo sapiens
tctgcggtccccttctcgccct

SEQ ID NO: 75229 - DNA, 22 bp, Homo sapiens
gcgctgcgcctcctcttccgca

SEQ ID NO: 75230 - DNA, 22 bp, Homo sapiens
tagggcaatatttcccagaaaa

SEQ ID NO: 75231 - DNA, 22 bp, Homo sapiens
tgctgttagtaaggaacatgac

SEQ ID NO: 75232 - DNA, 22 bp, Homo sapiens
atttttctctttccactgagat

SEQ ID NO: 75233 - DNA, 22 bp, Homo sapiens
cttgccttctctggggtggcag

SEQ ID NO: 75234 - DNA, 22 bp, Homo sapiens
tcactgcagcctctgcctcccg

SEQ ID NO: 75235 - DNA, 22 bp, Homo sapiens
gggaaacagcccaggctcaggg

SEQ ID NO: 75236 - DNA, 22 bp, Homo sapiens
gcctggattccttgtttctcag

SEQ ID NO: 75237 - DNA, 22 bp, Homo sapiens
gcctgtcccgcaccggagcccg

SEQ ID NO: 75238 - DNA, 22 bp, Homo sapiens
gttacagtcaggagatattttg

SEQ ID NO: 75239 - DNA, 21 bp, Homo sapiens
atgtagggtttgccttctcta

SEQ ID NO: 75240 - DNA, 19 bp, Homo sapiens
cgcctggcaggccctgcgc

SEQ ID NO: 75241 - DNA, 22 bp, Homo sapiens
ctctggaccctcctgctgagag

SEQ ID NO: 75242 - DNA, 20 bp, Homo sapiens
gccaacgcgctggggctgcc

SEQ ID NO: 75243 - DNA, 22 bp, Homo sapiens
aaatatcttaggagtatatgag

SEQ ID NO: 75244 - DNA, 22 bp, Homo sapiens
ctgcttctagcaccaagtccct

SEQ ID NO: 75245 - DNA, 22 bp, Homo sapiens
tcaggcagtagaattgcttgaa

SEQ ID NO: 75246 - DNA, 22 bp, Homo sapiens
aggtagaaggaccagaatttat

SEQ ID NO: 75247 - DNA, 22 bp, Homo sapiens
agtggccagcagcctagcctag

SEQ ID NO: 75248 - DNA, 22 bp, Homo sapiens
accatgtcatttattggccaaa

SEQ ID NO: 75249 - DNA, 22 bp, Homo sapiens
tgcagtcttccagctgcacaaa

SEQ ID NO: 75250 - DNA, 22 bp, Homo sapiens
ttttgacaatgctaatctcaat

SEQ ID NO: 75251 - DNA, 22 bp, Homo sapiens
gatgcgggcccgctccactgcc

SEQ ID NO: 75252 - DNA, 23 bp, Homo sapiens
ggctgggagctccgggtgcacgt

SEQ ID NO: 75253 - DNA, 22 bp, Homo sapiens
tccacgtgagcttcgtgtgcag

SEQ ID NO: 75254 - DNA, 22 bp, Homo sapiens
ccgaggtcctggacttggccct

SEQ ID NO: 75255 - DNA, 22 bp, Homo sapiens
ttatagcagcatgatttataat

SEQ ID NO: 75256 - DNA, 22 bp, Homo sapiens
ttgcccaggctggagtgcagta

SEQ ID NO: 75257 - DNA, 22 bp, Homo sapiens
gcccttctgctgttaggtagcc

SEQ ID NO: 75258 - DNA, 22 bp, Homo sapiens
caggctgaagtgcagtggtgtg

SEQ ID NO: 75259 - DNA, 22 bp, Homo sapiens
ttggaacatgccggggtccagg

SEQ ID NO: 75260 - DNA, 22 bp, Homo sapiens
tcttcctgtcaatgagaattaa

SEQ ID NO: 75261 - DNA, 22 bp, Homo sapiens
aaagaaggtagggctggtgact

SEQ ID NO: 75262 - DNA, 22 bp, Homo sapiens
tggaatggaaacaaactgagga

SEQ ID NO: 75263 - DNA, 22 bp, Homo sapiens
cagcagtgtacaaggtgtcaga

SEQ ID NO: 75264 - DNA, 22 bp, Homo sapiens
tctcagggctcagagctcaggc

SEQ ID NO: 75265 - DNA, 22 bp, Homo sapiens
tgtcctgtgattccagctcttc

SEQ ID NO: 75266 - DNA, 22 bp, Homo sapiens
aaagatgttgctgctccgccct

SEQ ID NO: 75267 - DNA, 22 bp, Homo sapiens
agaatccctggggagctgcagc

SEQ ID NO: 75268 - DNA, 22 bp, Homo sapiens
tattgtccaataggatgttcct

SEQ ID NO: 75269 - DNA, 22 bp, Homo sapiens
gaggtcctctcggaaccccttt

SEQ ID NO: 75270 - DNA, 22 bp, Homo sapiens
cagtgacgtaaactgcatgtgc

SEQ ID NO: 75271 - DNA, 20 bp, Homo sapiens
tctgccacgtctggtgactg

SEQ ID NO: 75272 - DNA, 22 bp, Homo sapiens
ggctttgggggtgtccaagaaa

SEQ ID NO: 75273 - DNA, 22 bp, Homo sapiens
agcatttatcttttgtttgagt

SEQ ID NO: 75274 - DNA, 17 bp, Homo sapiens
ttgaatgcattacttgg

SEQ ID NO: 75275 - DNA, 22 bp, Homo sapiens
tgcaaagttgaggaaggcatgg

SEQ ID NO: 75276 - DNA, 21 bp, Homo sapiens
aggagcattgttgtggtggag

SEQ ID NO: 75277 - DNA, 22 bp, Homo sapiens
tacagaagcttttgaaaagatg

SEQ ID NO: 75278 - DNA, 22 bp, Homo sapiens
tacaacaatttccacattagaa

SEQ ID NO: 75279 - DNA, 22 bp, Homo sapiens
tcactgcaacctctgcctcttg

SEQ ID NO: 75280 - DNA, 22 bp, Homo sapiens
tggatctcggcaatgcgggact

SEQ ID NO: 75281 - DNA, 22 bp, Homo sapiens
ccagaagtcaagtaagatgaag

SEQ ID NO: 75282 - DNA, 22 bp, Homo sapiens
atccaccctgtggtggctttct

SEQ ID NO: 75283 - DNA, 22 bp, Homo sapiens
ctgggcatcatggtgcgggcac

SEQ ID NO: 75284 - DNA, 22 bp, Homo sapiens
ctgctttgcatagctgccagag

SEQ ID NO: 75285 - DNA, 15 bp, Homo sapiens
gcctctgagagccac

SEQ ID NO: 75286 - DNA, 22 bp, Homo sapiens
ctcaggagttggaggctacagt

SEQ ID NO: 75287 - DNA, 22 bp, Homo sapiens
tgccacagacaggacagaacag

SEQ ID NO: 75288 - DNA, 19 bp, Homo sapiens
gagaaagcaggcacagcac

SEQ ID NO: 75289 - DNA, 22 bp, Homo sapiens
gcgctgaggctggaggcgcacg

SEQ ID NO: 75290 - DNA, 16 bp, Homo sapiens
aggtggagaagttcac

SEQ ID NO: 75291 - DNA, 22 bp, Homo sapiens
atgccacttcattccagcctcg

SEQ ID NO: 75292 - DNA, 22 bp, Homo sapiens
gtggcatctcagaggccaagaa

SEQ ID NO: 75293 - DNA, 22 bp, Homo sapiens
ctgtatttcttggacagttgct

SEQ ID NO: 75294 - DNA, 22 bp, Homo sapiens
acctagaatttaaaacattgct

SEQ ID NO: 75295 - DNA, 22 bp, Homo sapiens
tttgtggcaggagcggagaccg

SEQ ID NO: 75296 - DNA, 22 bp, Homo sapiens
cctgcgggctgtgctgaagcct

SEQ ID NO: 75297 - DNA, 22 bp, Homo sapiens
tcttgggcatgtgtttgatttc

SEQ ID NO: 75298 - DNA, 22 bp, Homo sapiens
ttatgatttgccacagattggt

SEQ ID NO: 75299 - DNA, 22 bp, Homo sapiens
atggaatgtttatacacagttg

SEQ ID NO: 75300 - DNA, 22 bp, Homo sapiens
gatatcatgggaaggtgtactt

SEQ ID NO: 75301 - DNA, 22 bp, Homo sapiens
tcactgcaacctccgcctgctg

SEQ ID NO: 75302 - DNA, 22 bp, Homo sapiens
agggttcagtgaggtgtactcc

SEQ ID NO: 75303 - DNA, 22 bp, Homo sapiens
tgcaatctcggcactttgggag

SEQ ID NO: 75304 - DNA, 22 bp, Homo sapiens
atatagacagatgacagggata

SEQ ID NO: 75305 - DNA, 22 bp, Homo sapiens
cctttcctgtgtccttttaagg

SEQ ID NO: 75306 - DNA, 22 bp, Homo sapiens
cctggagagctcgggccaggca

SEQ ID NO: 75307 - DNA, 22 bp, Homo sapiens
gaaggagccgagctcttcccca

SEQ ID NO: 75308 - DNA, 23 bp, Homo sapiens
tctacaaagctgtgtcaggaccc

SEQ ID NO: 75309 - DNA, 22 bp, Homo sapiens
gaagattgaaggctgggaatta

SEQ ID NO: 75310 - DNA, 22 bp, Homo sapiens
aaaagcaattgcgggttttgcc

SEQ ID NO: 75311 - DNA, 22 bp, Homo sapiens
cctgcgcgtctgggtctgtctc

SEQ ID NO: 75312 - DNA, 22 bp, Homo sapiens
agagggcattaactctgtcttg

SEQ ID NO: 75313 - DNA, 22 bp, Homo sapiens
ggttcacagtaaggtttgtgct

SEQ ID NO: 75314 - DNA, 22 bp, Homo sapiens
gttatataagacaaatcagagt

SEQ ID NO: 75315 - DNA, 22 bp, Homo sapiens
ccccaggacgtggccctcatag

SEQ ID NO: 75316 - DNA, 22 bp, Homo sapiens
gaggtggctgcttgctgggaaa

SEQ ID NO: 75317 - DNA, 23 bp, Homo sapiens
ctcctggtgctgctatcaggggt

SEQ ID NO: 75318 - DNA, 22 bp, Homo sapiens
tgtgttaaggtgcatctagtgc

SEQ ID NO: 75319 - DNA, 18 bp, Homo sapiens
gcctgagggtcaagtgtg

SEQ ID NO: 75320 - DNA, 21 bp, Homo sapiens
tcttttctcagctttgtggtt

SEQ ID NO: 75321 - DNA, 22 bp, Homo sapiens
tcttgaatctaatgcagtttct

SEQ ID NO: 75322 - DNA, 19 bp, Homo sapiens
acccagcccaggagtggca

SEQ ID NO: 75323 - DNA, 22 bp, Homo sapiens
agctggagatgagtgacgtgcc

SEQ ID NO: 75324 - DNA, 22 bp, Homo sapiens
ttggatctcatctaagtgcgtg

SEQ ID NO: 75325 - DNA, 21 bp, Homo sapiens
ctctgaatcctgcttctcagt

SEQ ID NO: 75326 - DNA, 22 bp, Homo sapiens
ccgaggctggagtgcagtggcg

SEQ ID NO: 75327 - DNA, 22 bp, Homo sapiens
acgggctgggacggggaagctc

SEQ ID NO: 75328 - DNA, 21 bp, Homo sapiens
ggccccgcagacccagcacgt

SEQ ID NO: 75329 - DNA, 22 bp, Homo sapiens
agcttgtagaaggccacgagca

SEQ ID NO: 75330 - DNA, 22 bp, Homo sapiens
ttctacagtgactgcagccata

SEQ ID NO: 75331 - DNA, 22 bp, Homo sapiens
tcacagacccttgctgagctct

SEQ ID NO: 75332 - DNA, 22 bp, Homo sapiens
ctggctcgcattatattttggg

SEQ ID NO: 75333 - DNA, 23 bp, Homo sapiens
ctcctcgtaactctgtggtgggt

SEQ ID NO: 75334 - DNA, 22 bp, Homo sapiens
cacgttaacagctaacagatga

SEQ ID NO: 75335 - DNA, 22 bp, Homo sapiens
aacatagaataaatgagttagg

SEQ ID NO: 75336 - DNA, 22 bp, Homo sapiens
tagattatccctgatttgtcca

SEQ ID NO: 75337 - DNA, 22 bp, Homo sapiens
aggcgcctgcgggatccttgcc

SEQ ID NO: 75338 - DNA, 18 bp, Homo sapiens
tcttccaacactgacacc

SEQ ID NO: 75339 - DNA, 22 bp, Homo sapiens
gaggcacagagtaggtgcacac

SEQ ID NO: 75340 - DNA, 22 bp, Homo sapiens
ggaagaaaggtggacaacaggt

SEQ ID NO: 75341 - DNA, 22 bp, Homo sapiens
gcccaggaggcagaggttgtgg

SEQ ID NO: 75342 - DNA, 22 bp, Homo sapiens
aatggaatacctaggtggccca

SEQ ID NO: 75343 - DNA, 22 bp, Homo sapiens
actgcgctccagcctgggtgac

SEQ ID NO: 75344 - DNA, 22 bp, Homo sapiens
ggcctcttatctggctcctgca

SEQ ID NO: 75345 - DNA, 19 bp, Homo sapiens
aatgtcagcatgttaattt

SEQ ID NO: 75346 - DNA, 22 bp, Homo sapiens
ggaactcctgctccaagcagct

SEQ ID NO: 75347 - DNA, 22 bp, Homo sapiens
tggcactgaagctggaaagcct

SEQ ID NO: 75348 - DNA, 22 bp, Homo sapiens
tgagagcctgtgttcaaatgcc

SEQ ID NO: 75349 - DNA, 22 bp, Homo sapiens
tttacaacccaagtccagagag

SEQ ID NO: 75350 - DNA, 20 bp, Homo sapiens
ttctccagtgcggtagccat

SEQ ID NO: 75351 - DNA, 22 bp, Homo sapiens
accagctagggtagcacatctc

SEQ ID NO: 75352 - DNA, 22 bp, Homo sapiens
gcagaggacacaggagggcaag

SEQ ID NO: 75353 - DNA, 22 bp, Homo sapiens
atgcaggcagacactgtgggca

SEQ ID NO: 75354 - DNA, 22 bp, Homo sapiens
agcctgggccctgcctcttctc

SEQ ID NO: 75355 - DNA, 22 bp, Homo sapiens
tcactgcaagctccgccttccg

SEQ ID NO: 75356 - DNA, 22 bp, Homo sapiens
ctgctttagacggctttcgctg

SEQ ID NO: 75357 - DNA, 22 bp, Homo sapiens
agattctaccagagctagtttg

SEQ ID NO: 75358 - DNA, 22 bp, Homo sapiens
taggcctggatctctgggagca

SEQ ID NO: 75359 - DNA, 22 bp, Homo sapiens
tgaggcaggacttgcataaagt

SEQ ID NO: 75360 - DNA, 22 bp, Homo sapiens
acccggcggagcctgcagtgag

SEQ ID NO: 75361 - DNA, 22 bp, Homo sapiens
cttccgtgtcagttccaggtgg

SEQ ID NO: 75362 - DNA, 21 bp, Homo sapiens
agtagtttagcacagggtttg

SEQ ID NO: 75363 - DNA, 22 bp, Homo sapiens
ccaagctacttaggagtctgag

SEQ ID NO: 75364 - DNA, 19 bp, Homo sapiens
ctgctgccggagactcgtc

SEQ ID NO: 75365 - DNA, 22 bp, Homo sapiens
tagagtgtcataacagtgccca

SEQ ID NO: 75366 - DNA, 22 bp, Homo sapiens
ctttaaggtgatgagagatgct

SEQ ID NO: 75367 - DNA, 22 bp, Homo sapiens
gggggggtcttcagacctcaga

SEQ ID NO: 75368 - DNA, 22 bp, Homo sapiens
aggccaggaatccttgtcccag

SEQ ID NO: 75369 - DNA, 22 bp, Homo sapiens
gctgcctacgcttgagccctgg

SEQ ID NO: 75370 - DNA, 22 bp, Homo sapiens
gcttttcatgacaactcagcga

SEQ ID NO: 75371 - DNA, 22 bp, Homo sapiens
gcccagcacctctctcagggtt

SEQ ID NO: 75372 - DNA, 22 bp, Homo sapiens
ttacaattacttgatctcagct

SEQ ID NO: 75373 - DNA, 22 bp, Homo sapiens
tgagatggagtctcgctctgtt

SEQ ID NO: 75374 - DNA, 22 bp, Homo sapiens
agctacctgatccttcttctga

SEQ ID NO: 75375 - DNA, 22 bp, Homo sapiens
aggctccctgaatcgcccgttc

SEQ ID NO: 75376 - DNA, 22 bp, Homo sapiens
cccaggggttctgagcagcagc

SEQ ID NO: 75377 - DNA, 22 bp, Homo sapiens
gtccgtagtggctgatgctttg

SEQ ID NO: 75378 - DNA, 22 bp, Homo sapiens
cgagtgtccctaccatttccta

SEQ ID NO: 75379 - DNA, 22 bp, Homo sapiens
tgggtggcagcttcagcatgtt

SEQ ID NO: 75380 - DNA, 22 bp, Homo sapiens
gaggggcacagtaaagggtccc

SEQ ID NO: 75381 - DNA, 22 bp, Homo sapiens
accacatcgggcggacactggg

SEQ ID NO: 75382 - DNA, 22 bp, Homo sapiens
cctggaagttggaggttgcagt

SEQ ID NO: 75383 - DNA, 22 bp, Homo sapiens
ccagagctgcaggtaaaatgct

SEQ ID NO: 75384 - DNA, 22 bp, Homo sapiens
aagtctctcacatatctggtcc

SEQ ID NO: 75385 - DNA, 20 bp, Homo sapiens
gaaatgtacacattaccaca

SEQ ID NO: 75386 - DNA, 22 bp, Homo sapiens
tatggctaattctttactgacc

SEQ ID NO: 75387 - DNA, 22 bp, Homo sapiens
tcggggtctttgacacgctctg

SEQ ID NO: 75388 - DNA, 22 bp, Homo sapiens
caagtctgacctctgggtgaag

SEQ ID NO: 75389 - DNA, 22 bp, Homo sapiens
gacaggtgctaagggacctggc

SEQ ID NO: 75390 - DNA, 20 bp, Homo sapiens
attagctcaggtgaggtcat

SEQ ID NO: 75391 - DNA, 22 bp, Homo sapiens
ttggggtcccacaggctgcctg

SEQ ID NO: 75392 - DNA, 22 bp, Homo sapiens
aattttctggtgtgtaatgaag

SEQ ID NO: 75393 - DNA, 22 bp, Homo sapiens
ttccatttggcacttcactgag

SEQ ID NO: 75394 - DNA, 22 bp, Homo sapiens
ctgggcctggggctgttgagag

SEQ ID NO: 75395 - DNA, 22 bp, Homo sapiens
atctggttttggctgtgtccct

SEQ ID NO: 75396 - DNA, 22 bp, Homo sapiens
atgcaactacccccaggatttt

SEQ ID NO: 75397 - DNA, 22 bp, Homo sapiens
tgtcaccttgctcatcctcgga

SEQ ID NO: 75398 - DNA, 23 bp, Homo sapiens
aatgggtgcaactatccatgaca

SEQ ID NO: 75399 - DNA, 22 bp, Homo sapiens
gttggctatgagagctttagtg

SEQ ID NO: 75400 - DNA, 22 bp, Homo sapiens
gcaaaaagtagtgctggttagg

SEQ ID NO: 75401 - DNA, 22 bp, Homo sapiens
ccctcccaggagtggccagaga

SEQ ID NO: 75402 - DNA, 22 bp, Homo sapiens
agagagcccgggccagggcaca

SEQ ID NO: 75403 - DNA, 22 bp, Homo sapiens
atagacgcggccgctgatgcag

SEQ ID NO: 75404 - DNA, 22 bp, Homo sapiens
tgggctgcaggggttgagagct

SEQ ID NO: 75405 - DNA, 22 bp, Homo sapiens
caggtgcctcaggatgagacaa

SEQ ID NO: 75406 - DNA, 22 bp, Homo sapiens
agtgttgtcaaacggctcagca

SEQ ID NO: 75407 - DNA, 22 bp, Homo sapiens
cagatgtacatgaagggcaatg

SEQ ID NO: 75408 - DNA, 22 bp, Homo sapiens
tatgcagtgagcactatttata

SEQ ID NO: 75409 - DNA, 22 bp, Homo sapiens
gcccagccacagtcactttcat

SEQ ID NO: 75410 - DNA, 22 bp, Homo sapiens
cctttcctgtgtccttttaagg

SEQ ID NO: 75411 - DNA, 22 bp, Homo sapiens
gcagtggcatgatgtgggctca

SEQ ID NO: 75412 - DNA, 22 bp, Homo sapiens
gccaccccataggtgttaggtg

SEQ ID NO: 75413 - DNA, 21 bp, Homo sapiens
tcctgtaagcttgggtggctc

SEQ ID NO: 75414 - DNA, 22 bp, Homo sapiens
gaggaggcttccgggaggcacg

SEQ ID NO: 75415 - DNA, 22 bp, Homo sapiens
aagcatttcaggtagagatatt

SEQ ID NO: 75416 - DNA, 22 bp, Homo sapiens
aacttaggaaaataaggcatga

SEQ ID NO: 75417 - DNA, 22 bp, Homo sapiens
ttctcttacattttctcagcct

SEQ ID NO: 75418 - DNA, 22 bp, Homo sapiens
attacctatttcattttctgtc

SEQ ID NO: 75419 - DNA, 22 bp, Homo sapiens
gctgtcttgctcactcttgcag

SEQ ID NO: 75420 - DNA, 22 bp, Homo sapiens
ttgatcaaatcagctactgagg

SEQ ID NO: 75421 - DNA, 22 bp, Homo sapiens
gagagcaggaggcagcgggacg

SEQ ID NO: 75422 - DNA, 22 bp, Homo sapiens
tgtccaggctaaagtgcagtgg

SEQ ID NO: 75423 - DNA, 23 bp, Homo sapiens
atgacactcctgtgcgcaccctg

SEQ ID NO: 75424 - DNA, 22 bp, Homo sapiens
caaagtgggtgccctgatgctc

SEQ ID NO: 75425 - DNA, 19 bp, Homo sapiens
cgcctggcaggccctgcgc

SEQ ID NO: 75426 - DNA, 22 bp, Homo sapiens
aaggatgattggtaatgacact

SEQ ID NO: 75427 - DNA, 22 bp, Homo sapiens
ctgagggtcaacttgattgtat

SEQ ID NO: 75428 - DNA, 22 bp, Homo sapiens
ggagagcagggaggctgctctg

SEQ ID NO: 75429 - DNA, 22 bp, Homo sapiens
aaggaggcctggcagatgaaga

SEQ ID NO: 75430 - DNA, 22 bp, Homo sapiens
caatccatcaattacacaggct

SEQ ID NO: 75431 - DNA, 22 bp, Homo sapiens
gaggcagaggttgcagtgagct

SEQ ID NO: 75432 - DNA, 22 bp, Homo sapiens
attaagtgactaaagtaatgct

SEQ ID NO: 75433 - DNA, 22 bp, Homo sapiens
agttcaacaccagcctgaccaa

SEQ ID NO: 75434 - DNA, 22 bp, Homo sapiens
ttaataaagtatgaattggaaa

SEQ ID NO: 75435 - DNA, 18 bp, Homo sapiens
gaggatggaaggagatgc

SEQ ID NO: 75436 - DNA, 22 bp, Homo sapiens
atgccactgcgctctagcctgg

SEQ ID NO: 75437 - DNA, 22 bp, Homo sapiens
atgccactgcgctccagcctgg

SEQ ID NO: 75438 - DNA, 22 bp, Homo sapiens
acacttggagcaacacttatgg

SEQ ID NO: 75439 - DNA, 22 bp, Homo sapiens
agaccaaagaaaacacatctgg

SEQ ID NO: 75440 - DNA, 22 bp, Homo sapiens
gatgtagacacttggaggctta

SEQ ID NO: 75441 - DNA, 21 bp, Homo sapiens
gggcagaggggcctcctgggt

SEQ ID NO: 75442 - DNA, 22 bp, Homo sapiens
ggtccccgtggaggctggagcg

SEQ ID NO: 75443 - DNA, 22 bp, Homo sapiens
cactgcactccagcctgggtca

SEQ ID NO: 75444 - DNA, 22 bp, Homo sapiens
cattcatctatcaaatggtacc

SEQ ID NO: 75445 - DNA, 22 bp, Homo sapiens
tttaatcaggcaaagcataata

SEQ ID NO: 75446 - DNA, 22 bp, Homo sapiens
gagccaggttggaggctgcagt

SEQ ID NO: 75447 - DNA, 22 bp, Homo sapiens
agaggccggccgagcccatggg

SEQ ID NO: 75448 - DNA, 22 bp, Homo sapiens
tggggagtgatgcctcggataa

SEQ ID NO: 75449 - DNA, 22 bp, Homo sapiens
aaggaaagctgtggttctgaga

SEQ ID NO: 75450 - DNA, 22 bp, Homo sapiens
caggcaggtcagtgaagaagga

SEQ ID NO: 75451 - DNA, 22 bp, Homo sapiens
ctgaggaggctaatttgaggat

SEQ ID NO: 75452 - DNA, 22 bp, Homo sapiens
tacaacaatttccacattagaa

SEQ ID NO: 75453 - DNA, 22 bp, Homo sapiens
tctaaacttgtaaacaagcata

SEQ ID NO: 75454 - DNA, 22 bp, Homo sapiens
acacggcactttaggaaggggc

SEQ ID NO: 75455 - DNA, 17 bp, Homo sapiens
gggcagggactcctggg

SEQ ID NO: 75456 - DNA, 22 bp, Homo sapiens
tggggcagttaataaacattct

SEQ ID NO: 75457 - DNA, 22 bp, Homo sapiens
tgtatatacacactcccatgtt

SEQ ID NO: 75458 - DNA, 22 bp, Homo sapiens
atgattagttaccttgatttaa

SEQ ID NO: 75459 - DNA, 22 bp, Homo sapiens
gctgctctccaagcctccttga

SEQ ID NO: 75460 - DNA, 22 bp, Homo sapiens
tacaaaaaattgatactgacga

SEQ ID NO: 75461 - DNA, 22 bp, Homo sapiens
ggaggcagaatagagtgtgggt

SEQ ID NO: 75462 - DNA, 23 bp, Homo sapiens
ctcaccaagcgccgccgctgtgt

SEQ ID NO: 75463 - DNA, 22 bp, Homo sapiens
tcggggtctttgacacgctctg

SEQ ID NO: 75464 - DNA, 22 bp, Homo sapiens
tgaagttgttaaggttgccatt

SEQ ID NO: 75465 - DNA, 22 bp, Homo sapiens
gccatcatatcccctgtgacct

SEQ ID NO: 75466 - DNA, 22 bp, Homo sapiens
gggcaggggtcagtggccccaa

SEQ ID NO: 75467 - DNA, 22 bp, Homo sapiens
acctagaatttaaaacattgct

SEQ ID NO: 75468 - DNA, 22 bp, Homo sapiens
tacagtcacattctgaggtctt

SEQ ID NO: 75469 - DNA, 22 bp, Homo sapiens
ttcaaagcagagggtcaataca

SEQ ID NO: 75470 - DNA, 22 bp, Homo sapiens
agtgactggtgtgaagttaaat

SEQ ID NO: 75471 - DNA, 22 bp, Homo sapiens
agcctattccaggatgagctca

SEQ ID NO: 75472 - DNA, 22 bp, Homo sapiens
ttgagggtctggatctgctgct

SEQ ID NO: 75473 - DNA, 22 bp, Homo sapiens
tttgggcaggcttttccctaga

SEQ ID NO: 75474 - DNA, 22 bp, Homo sapiens
ttccacattccttacattcata

SEQ ID NO: 75475 - DNA, 22 bp, Homo sapiens
agtgaaaacctaatcatgcagt

SEQ ID NO: 75476 - DNA, 22 bp, Homo sapiens
tgtcttcaggagtaaatatcat

SEQ ID NO: 75477 - DNA, 18 bp, Homo sapiens
tgtagagccaggtttgcc

SEQ ID NO: 75478 - DNA, 21 bp, Homo sapiens
atctcgggcttctcgcccagc

SEQ ID NO: 75479 - DNA, 22 bp, Homo sapiens
tctggtgtcagtattctttgaa

SEQ ID NO: 75480 - DNA, 22 bp, Homo sapiens
aactatgttaataagtttcatt

SEQ ID NO: 75481 - DNA, 22 bp, Homo sapiens
gggccatgagaggttcatcaac

SEQ ID NO: 75482 - DNA, 22 bp, Homo sapiens
ataggtccaaggagaggtcttt

SEQ ID NO: 75483 - DNA, 22 bp, Homo sapiens
ttcagagaattggataattcgt

SEQ ID NO: 75484 - DNA, 20 bp, Homo sapiens
gggcaaggaaacagccccca

SEQ ID NO: 75485 - DNA, 22 bp, Homo sapiens
accatgttggccaagctggtct

SEQ ID NO: 75486 - DNA, 22 bp, Homo sapiens
tggattcacaccattctcctgc

SEQ ID NO: 75487 - DNA, 20 bp, Homo sapiens
aaacgagccatcattctggt

SEQ ID NO: 75488 - DNA, 22 bp, Homo sapiens
acacagagccaaaccatatcac

SEQ ID NO: 75489 - DNA, 22 bp, Homo sapiens
caggagatgacagggaagaacc

SEQ ID NO: 75490 - DNA, 22 bp, Homo sapiens
gagacctcttggtatcgctagg

SEQ ID NO: 75491 - DNA, 22 bp, Homo sapiens
atggctgcctgggcgctggccg

SEQ ID NO: 75492 - DNA, 22 bp, Homo sapiens
tgccgctccaggtctcgcggtg

SEQ ID NO: 75493 - DNA, 22 bp, Homo sapiens
gggagctgagctggaagagaat

SEQ ID NO: 75494 - DNA, 22 bp, Homo sapiens
aggtgcttggctcgtgcacaca

SEQ ID NO: 75495 - DNA, 22 bp, Homo sapiens
tgttcagaacaaaggtaaatga

SEQ ID NO: 75496 - DNA, 22 bp, Homo sapiens
ttatttaaaagtggtaagattc

SEQ ID NO: 75497 - DNA, 23 bp, Homo sapiens
cagagctggctcagagctgcctg

SEQ ID NO: 75498 - DNA, 22 bp, Homo sapiens
atccccctgtatctggaagaat

SEQ ID NO: 75499 - DNA, 22 bp, Homo sapiens
tgaggcaggaggttgagaactg

SEQ ID NO: 75500 - DNA, 22 bp, Homo sapiens
tccaggctttggggcaggagcg

SEQ ID NO: 75501 - DNA, 22 bp, Homo sapiens
taatttcagtgcaagctcacgg

SEQ ID NO: 75502 - DNA, 22 bp, Homo sapiens
acaaacagagttgaaaaatagg

SEQ ID NO: 75503 - DNA, 22 bp, Homo sapiens
gaggcagaagttgcagtgagca

SEQ ID NO: 75504 - DNA, 22 bp, Homo sapiens
atacaaaatatatactggagac

SEQ ID NO: 75505 - DNA, 22 bp, Homo sapiens
tctcctggtacccttcctagca

SEQ ID NO: 75506 - DNA, 22 bp, Homo sapiens
cactgcactccagcttgggtga

SEQ ID NO: 75507 - DNA, 18 bp, Homo sapiens
ccctcttgcacaaagcaa

SEQ ID NO: 75508 - DNA, 22 bp, Homo sapiens
aaaagggacgacaacaggccac

SEQ ID NO: 75509 - DNA, 22 bp, Homo sapiens
aggggatggagctggaaggcag

SEQ ID NO: 75510 - DNA, 22 bp, Homo sapiens
ctccccgagagaggttgtccgc

SEQ ID NO: 75511 - DNA, 22 bp, Homo sapiens
gcaaagaatgcagatttgcctc

SEQ ID NO: 75512 - DNA, 22 bp, Homo sapiens
caaagtggaggctctggggcca

SEQ ID NO: 75513 - DNA, 22 bp, Homo sapiens
tatttcacatctatgaagtgag

SEQ ID NO: 75514 - DNA, 22 bp, Homo sapiens
aacaattactaccaaggcctgt

SEQ ID NO: 75515 - DNA, 22 bp, Homo sapiens
ccaggaggttgaggctgcagtg

SEQ ID NO: 75516 - DNA, 22 bp, Homo sapiens
gagccaggggtcagctccgagg

SEQ ID NO: 75517 - DNA, 22 bp, Homo sapiens
agatgtgagaatcaagtgacca

SEQ ID NO: 75518 - DNA, 22 bp, Homo sapiens
tcagccccacggggtcagccaa

SEQ ID NO: 75519 - DNA, 22 bp, Homo sapiens
gcaggcagaggtggaggagaca

SEQ ID NO: 75520 - DNA, 22 bp, Homo sapiens
tcttacccggcaacgtgtgtcg

SEQ ID NO: 75521 - DNA, 22 bp, Homo sapiens
tatactctgagaaacgtgtcac

SEQ ID NO: 75522 - DNA, 22 bp, Homo sapiens
gagccaggaggcagagactgca

SEQ ID NO: 75523 - DNA, 22 bp, Homo sapiens
agacagctggtagcacttcctg

SEQ ID NO: 75524 - DNA, 22 bp, Homo sapiens
gagctcattcattcattgcctg

SEQ ID NO: 75525 - DNA, 22 bp, Homo sapiens
gccaggttgctgacgacgatct

SEQ ID NO: 75526 - DNA, 22 bp, Homo sapiens
ctccttctgggcctggcagtgg

SEQ ID NO: 75527 - DNA, 22 bp, Homo sapiens
tcctccccaaagcccagcctgg

SEQ ID NO: 75528 - DNA, 22 bp, Homo sapiens
gtggtgtaggtcacagttagga

SEQ ID NO: 75529 - DNA, 22 bp, Homo sapiens
tcccacacagcccgctcaccgg

SEQ ID NO: 75530 - DNA, 22 bp, Homo sapiens
ttctcaaagtgtgctccctgga

SEQ ID NO: 75531 - DNA, 22 bp, Homo sapiens
gaatgcagtggcaccatctcag

SEQ ID NO: 75532 - DNA, 22 bp, Homo sapiens
aagaggagaaaggctggctttg

SEQ ID NO: 75533 - DNA, 22 bp, Homo sapiens
gcttctcaattctcaccctcca

SEQ ID NO: 75534 - DNA, 22 bp, Homo sapiens
tgcttctgactaagctgcatga

SEQ ID NO: 75535 - DNA, 22 bp, Homo sapiens
aaacatggccattcagactgtg

SEQ ID NO: 75536 - DNA, 22 bp, Homo sapiens
ttggtggacctcatcagaaccg

SEQ ID NO: 75537 - DNA, 22 bp, Homo sapiens
tattcatagtaaacaaaagtgg

SEQ ID NO: 75538 - DNA, 22 bp, Homo sapiens
tcacttagatggggatcatcac

SEQ ID NO: 75539 - DNA, 22 bp, Homo sapiens
cccgagtgtctactcactccca

SEQ ID NO: 75540 - DNA, 22 bp, Homo sapiens
ggcaatcattggcattctctgg

SEQ ID NO: 75541 - DNA, 22 bp, Homo sapiens
tggggtacttgtatcaaagcac

SEQ ID NO: 75542 - DNA, 22 bp, Homo sapiens
agagggtgggcacgtgatggat

SEQ ID NO: 75543 - DNA, 22 bp, Homo sapiens
tgcagattcaaatgaaatgcaa

SEQ ID NO: 75544 - DNA, 22 bp, Homo sapiens
ggctgtggcagctggaagtggt

SEQ ID NO: 75545 - DNA, 22 bp, Homo sapiens
aaggagtctgggccattcagag

SEQ ID NO: 75546 - DNA, 21 bp, Homo sapiens
cagagctgtccaaaccctgac

SEQ ID NO: 75547 - DNA, 22 bp, Homo sapiens
tcctcagcttttatttcacttg

SEQ ID NO: 75548 - DNA, 22 bp, Homo sapiens
gagtggggggtccgtctcagtg

SEQ ID NO: 75549 - DNA, 22 bp, Homo sapiens
taactctgaatcctcacagcag

SEQ ID NO: 75550 - DNA, 19 bp, Homo sapiens
gggtcccactgcccgtctg

SEQ ID NO: 75551 - DNA, 22 bp, Homo sapiens
acagttaataagtagtaagtca

SEQ ID NO: 75552 - DNA, 22 bp, Homo sapiens
tgcctagttctgtatttacagt

SEQ ID NO: 75553 - DNA, 22 bp, Homo sapiens
gatttttatataaagtgagaaa

SEQ ID NO: 75554 - DNA, 22 bp, Homo sapiens
cctcgcggcactcgggccggat

SEQ ID NO: 75555 - DNA, 22 bp, Homo sapiens
gggtccaggcggcatagttgta

SEQ ID NO: 75556 - DNA, 22 bp, Homo sapiens
tgtccaggttagcttcaaacac

SEQ ID NO: 75557 - DNA, 22 bp, Homo sapiens
ccggctcggcgaccaggctgaa

SEQ ID NO: 75558 - DNA, 22 bp, Homo sapiens
cactgcaacctccacctcctgg

SEQ ID NO: 75559 - DNA, 22 bp, Homo sapiens
aaaatatgtataactcttctgc

SEQ ID NO: 75560 - DNA, 22 bp, Homo sapiens
tttaaaaaactagtctgagtct

SEQ ID NO: 75561 - DNA, 22 bp, Homo sapiens
gtggggtagatctttctcagga

SEQ ID NO: 75562 - DNA, 22 bp, Homo sapiens
aggccagcctcaggcagggacc

SEQ ID NO: 75563 - DNA, 22 bp, Homo sapiens
aacagtgtttttcttcagcact

SEQ ID NO: 75564 - DNA, 22 bp, Homo sapiens
gtccagttgtatgtccagtgtc

SEQ ID NO: 75565 - DNA, 20 bp, Homo sapiens
gttaggaggttggacatgga

SEQ ID NO: 75566 - DNA, 22 bp, Homo sapiens
caccaaagtcgcttctgtcgtc

SEQ ID NO: 75567 - DNA, 22 bp, Homo sapiens
ctgcagggagaggggacagcct

SEQ ID NO: 75568 - DNA, 22 bp, Homo sapiens
caaatgaatatttccatgggtt

SEQ ID NO: 75569 - DNA, 22 bp, Homo sapiens
tccagtgcaatggctcattcat

SEQ ID NO: 75570 - DNA, 22 bp, Homo sapiens
ctcgggtaccatgctaggcact

SEQ ID NO: 75571 - DNA, 22 bp, Homo sapiens
taaaatttgtccctgagtgttg

SEQ ID NO: 75572 - DNA, 22 bp, Homo sapiens
agacggattacctgaggtcagg

SEQ ID NO: 75573 - DNA, 22 bp, Homo sapiens
cattaaacaaccttgaatcaat

SEQ ID NO: 75574 - DNA, 22 bp, Homo sapiens
aaaggctttaaaatgtacatat

SEQ ID NO: 75575 - DNA, 22 bp, Homo sapiens
gatttagtggcccttggtacac

SEQ ID NO: 75576 - DNA, 21 bp, Homo sapiens
agtagtttagcacagggtttg

SEQ ID NO: 75577 - DNA, 22 bp, Homo sapiens
aagggctctgtgcttgtcccat

SEQ ID NO: 75578 - DNA, 17 bp, Homo sapiens
gtaaggcttgcagatgc

SEQ ID NO: 75579 - DNA, 22 bp, Homo sapiens
aaagaaatagatggcatttaaa

SEQ ID NO: 75580 - DNA, 18 bp, Homo sapiens
cagggctgtggggtcact

SEQ ID NO: 75581 - DNA, 22 bp, Homo sapiens
tctttctacatcatttgcttct

SEQ ID NO: 75582 - DNA, 22 bp, Homo sapiens
gcttcggggtccaagcgcgtgt

SEQ ID NO: 75583 - DNA, 22 bp, Homo sapiens
agaagcattggaccaggggccc

SEQ ID NO: 75584 - DNA, 22 bp, Homo sapiens
ctccagtgcttctagaaaatac

SEQ ID NO: 75585 - DNA, 22 bp, Homo sapiens
ttgaataatatgcttcgttctc

SEQ ID NO: 75586 - DNA, 22 bp, Homo sapiens
tttgcatattaatatctgcgct

SEQ ID NO: 75587 - DNA, 22 bp, Homo sapiens
ttcttctttccaattacatggt

SEQ ID NO: 75588 - DNA, 22 bp, Homo sapiens
agagtgtaccaaatatcctaca

SEQ ID NO: 75589 - DNA, 22 bp, Homo sapiens
gggagaggttacccgagcaact

SEQ ID NO: 75590 - DNA, 22 bp, Homo sapiens
gtgagccgagtatagttcatag

SEQ ID NO: 75591 - DNA, 22 bp, Homo sapiens
aagatgcggttgaccatggtgt

SEQ ID NO: 75592 - DNA, 22 bp, Homo sapiens
ttacaaagtttaaggtggcact

SEQ ID NO: 75593 - DNA, 22 bp, Homo sapiens
cagctgctgttcagttttgttt

SEQ ID NO: 75594 - DNA, 20 bp, Homo sapiens
aagcagtgaggtgaggagtg

SEQ ID NO: 75595 - DNA, 22 bp, Homo sapiens
tgtgggagaaggaagcaagctg

SEQ ID NO: 75596 - DNA, 22 bp, Homo sapiens
gctgccgacccacaggggttaa

SEQ ID NO: 75597 - DNA, 22 bp, Homo sapiens
ccaggcagcctgctccattctg

SEQ ID NO: 75598 - DNA, 22 bp, Homo sapiens
aggaaaatggaccagagttgtt

SEQ ID NO: 75599 - DNA, 22 bp, Homo sapiens
taaaggtagtgtgacatattgt

SEQ ID NO: 75600 - DNA, 22 bp, Homo sapiens
ccagctttatagcttcaaagga

SEQ ID NO: 75601 - DNA, 22 bp, Homo sapiens
ataccaccatctatgaaaggta

SEQ ID NO: 75602 - DNA, 22 bp, Homo sapiens
tgcaatccccgcctcaacagga

SEQ ID NO: 75603 - DNA, 22 bp, Homo sapiens
gcctcctgagtagctgggattg

SEQ ID NO: 75604 - DNA, 22 bp, Homo sapiens
aatgagggagtggggcttgtcc

SEQ ID NO: 75605 - DNA, 22 bp, Homo sapiens
ttaaattttagaaacagactct

SEQ ID NO: 75606 - DNA, 22 bp, Homo sapiens
taagaaatttagttatagaatg

SEQ ID NO: 75607 - DNA, 22 bp, Homo sapiens
gtgcaaaagtaattgtggtttt

SEQ ID NO: 75608 - DNA, 22 bp, Homo sapiens
gaatgcagatggctggtgtatg

SEQ ID NO: 75609 - DNA, 23 bp, Homo sapiens
ggcactcggccgtgaactcgtgc

SEQ ID NO: 75610 - DNA, 22 bp, Homo sapiens
tgatatgtccctcgacatcagg

SEQ ID NO: 75611 - DNA, 22 bp, Homo sapiens
ggcagggcaggaaagtcaggaa

SEQ ID NO: 75612 - DNA, 22 bp, Homo sapiens
agtatgtcagagtgaaaatggt

SEQ ID NO: 75613 - DNA, 22 bp, Homo sapiens
cagccctcctaccctgccaggc

SEQ ID NO: 75614 - DNA, 22 bp, Homo sapiens
cactgcacttcagcctgggtga

SEQ ID NO: 75615 - DNA, 22 bp, Homo sapiens
cctggaggcggaggttgcagtg

SEQ ID NO: 75616 - DNA, 22 bp, Homo sapiens
ctagttctagatccctgaggaa

SEQ ID NO: 75617 - DNA, 23 bp, Homo sapiens
gggggccgtcctggggattatag

SEQ ID NO: 75618 - DNA, 22 bp, Homo sapiens
actgccaatggtagtttgatgg

SEQ ID NO: 75619 - DNA, 22 bp, Homo sapiens
caccatttagtagcaagagctc

SEQ ID NO: 75620 - DNA, 22 bp, Homo sapiens
ataaaatttgctactgttaaat

SEQ ID NO: 75621 - DNA, 22 bp, Homo sapiens
tgagatgaataactcctgctaa

SEQ ID NO: 75622 - DNA, 22 bp, Homo sapiens
tccaagatctacagcagtttag

SEQ ID NO: 75623 - DNA, 22 bp, Homo sapiens
atagggcctaaaaagtattgct

SEQ ID NO: 75624 - DNA, 22 bp, Homo sapiens
gggacaatggaggcctctctcc

SEQ ID NO: 75625 - DNA, 22 bp, Homo sapiens
aagaatgagctcaaagatctta

SEQ ID NO: 75626 - DNA, 22 bp, Homo sapiens
gagggagggactagcattctct

SEQ ID NO: 75627 - DNA, 22 bp, Homo sapiens
gctgtctgtcttcacatctcgc

SEQ ID NO: 75628 - DNA, 22 bp, Homo sapiens
gtggctcacacctgtaatccca

SEQ ID NO: 75629 - DNA, 22 bp, Homo sapiens
accactgcccatggtgaaaact

SEQ ID NO: 75630 - DNA, 23 bp, Homo sapiens
aaacttgctatggctgaaatcat

SEQ ID NO: 75631 - DNA, 22 bp, Homo sapiens
agctgccgatgcccagctgcat

SEQ ID NO: 75632 - DNA, 22 bp, Homo sapiens
tcgaactcatagtcgtagctgt

SEQ ID NO: 75633 - DNA, 22 bp, Homo sapiens
ggggtggatttcaggcggtgtc

SEQ ID NO: 75634 - DNA, 22 bp, Homo sapiens
tagagctggccgggacagctgg

SEQ ID NO: 75635 - DNA, 22 bp, Homo sapiens
tgagccatgggactccaaggga

SEQ ID NO: 75636 - DNA, 22 bp, Homo sapiens
gcaggcaggcttccttgaactg

SEQ ID NO: 75637 - DNA, 22 bp, Homo sapiens
ggcaggaggtgagtggcgggtg

SEQ ID NO: 75638 - DNA, 22 bp, Homo sapiens
tcctgccttgcctgggacatca

SEQ ID NO: 75639 - DNA, 22 bp, Homo sapiens
aggcaatcccctgaggatactt

SEQ ID NO: 75640 - DNA, 22 bp, Homo sapiens
gtaggccatggtggttgtctct

SEQ ID NO: 75641 - DNA, 22 bp, Homo sapiens
acaagcgggccacagtgctggt

SEQ ID NO: 75642 - DNA, 22 bp, Homo sapiens
ggcgcccccttcaaacagagca

SEQ ID NO: 75643 - DNA, 22 bp, Homo sapiens
gtggcagaccttcccttctcct

SEQ ID NO: 75644 - DNA, 22 bp, Homo sapiens
aaaatggtctcagctggcacca

SEQ ID NO: 75645 - DNA, 22 bp, Homo sapiens
gagccaggtcgggccgcggcga

SEQ ID NO: 75646 - DNA, 22 bp, Homo sapiens
ggctagggatctagaccaggac

SEQ ID NO: 75647 - DNA, 22 bp, Homo sapiens
ttgtcttttgtgggaaatatgg

SEQ ID NO: 75648 - DNA, 22 bp, Homo sapiens
actttatttcctattgcatcca

SEQ ID NO: 75649 - DNA, 22 bp, Homo sapiens
agttgggtttgtgtcagttgca

SEQ ID NO: 75650 - DNA, 22 bp, Homo sapiens
agtgagagtattaatgtgaact

SEQ ID NO: 75651 - DNA, 22 bp, Homo sapiens
ctctcagtcctgcgcgcctctg

SEQ ID NO: 75652 - DNA, 22 bp, Homo sapiens
gtgtttggtcagacgtccgggg

SEQ ID NO: 75653 - DNA, 22 bp, Homo sapiens
tttaggttttttcacgtggcta

SEQ ID NO: 75654 - DNA, 22 bp, Homo sapiens
attgcactccagcctgggggac

SEQ ID NO: 75655 - DNA, 17 bp, Homo sapiens
tgtagcttctccttctc

SEQ ID NO: 75656 - DNA, 22 bp, Homo sapiens
aagcgccatggttcctgcgcag

SEQ ID NO: 75657 - DNA, 22 bp, Homo sapiens
aaagcctcccaggttatgagta

SEQ ID NO: 75658 - DNA, 22 bp, Homo sapiens
catgcacttacctgaaattcaa

SEQ ID NO: 75659 - DNA, 21 bp, Homo sapiens
tctcttcctccgcgccgccgc

SEQ ID NO: 75660 - DNA, 22 bp, Homo sapiens
gaatatcccgctatgcaaagta

SEQ ID NO: 75661 - DNA, 22 bp, Homo sapiens
taagggttcagaatgcagtggt

SEQ ID NO: 75662 - DNA, 20 bp, Homo sapiens
aaaatatgtataactcttct

SEQ ID NO: 75663 - DNA, 22 bp, Homo sapiens
agcgtgaattagttggtacaca

SEQ ID NO: 75664 - DNA, 22 bp, Homo sapiens
cctagagctctgctttatctaa

SEQ ID NO: 75665 - DNA, 22 bp, Homo sapiens
tctgaggaactggcaaagatgg

SEQ ID NO: 75666 - DNA, 22 bp, Homo sapiens
ctcttagtaatgccatgaagca

SEQ ID NO: 75667 - DNA, 22 bp, Homo sapiens
aaagctgtcaaggcaggaggct

SEQ ID NO: 75668 - DNA, 22 bp, Homo sapiens
ttggatccatctcaggcatagg

SEQ ID NO: 75669 - DNA, 22 bp, Homo sapiens
gtacacaaagtgagacttgata

SEQ ID NO: 75670 - DNA, 22 bp, Homo sapiens
aaggctcggcaatgtgcggctc

SEQ ID NO: 75671 - DNA, 22 bp, Homo sapiens
cccccaaagtttgcacggataa

SEQ ID NO: 75672 - DNA, 22 bp, Homo sapiens
agagaagagtcttgtcaaatta

SEQ ID NO: 75673 - DNA, 22 bp, Homo sapiens
tctcagaacctcagtttgctct

SEQ ID NO: 75674 - DNA, 22 bp, Homo sapiens
aggggagagttaatgtgaatgt

SEQ ID NO: 75675 - DNA, 22 bp, Homo sapiens
gcagggaggtttgctgacctgg

SEQ ID NO: 75676 - DNA, 21 bp, Homo sapiens
tgactgaggcttcttcacaca

SEQ ID NO: 75677 - DNA, 22 bp, Homo sapiens
gcggctccgaagccaggccgcg

SEQ ID NO: 75678 - DNA, 22 bp, Homo sapiens
gaggggcacagtaaagggtccc

SEQ ID NO: 75679 - DNA, 22 bp, Homo sapiens
gtccaagagtcaagaagggggc

SEQ ID NO: 75680 - DNA, 22 bp, Homo sapiens
acatagtgttttgagagacagc

SEQ ID NO: 75681 - DNA, 22 bp, Homo sapiens
gttaaggatcttgagatgagga

SEQ ID NO: 75682 - DNA, 18 bp, Homo sapiens
ggtgagggagctggaagc

SEQ ID NO: 75683 - DNA, 22 bp, Homo sapiens
ggttttcacctccagaatgtgc

SEQ ID NO: 75684 - DNA, 22 bp, Homo sapiens
agcaacacgcagtagtatacga

SEQ ID NO: 75685 - DNA, 22 bp, Homo sapiens
aggtggagaagagatgggcagt

SEQ ID NO: 75686 - DNA, 22 bp, Homo sapiens
atacaaagtattaatcctggat

SEQ ID NO: 75687 - DNA, 22 bp, Homo sapiens
ttttcctttgattcccagatgt

SEQ ID NO: 75688 - DNA, 22 bp, Homo sapiens
gggcggggggagctggaatgaa

SEQ ID NO: 75689 - DNA, 22 bp, Homo sapiens
cactgcactccagcccgggcaa

SEQ ID NO: 75690 - DNA, 22 bp, Homo sapiens
tgtgactggttgtcccgctttc

SEQ ID NO: 75691 - DNA, 22 bp, Homo sapiens
tccttagacaaagagtgggctt

SEQ ID NO: 75692 - DNA, 22 bp, Homo sapiens
cgcaccactgaattccagcctg

SEQ ID NO: 75693 - DNA, 22 bp, Homo sapiens
gggagctggagctggaagactc

SEQ ID NO: 75694 - DNA, 22 bp, Homo sapiens
attcacatttagcctctgacat

SEQ ID NO: 75695 - DNA, 22 bp, Homo sapiens
gctgctaagcgtttctgttcca

SEQ ID NO: 75696 - DNA, 22 bp, Homo sapiens
gcctcagtctcccgagtagctg

SEQ ID NO: 75697 - DNA, 22 bp, Homo sapiens
ggctgcaggttggttggcagct

SEQ ID NO: 75698 - DNA, 22 bp, Homo sapiens
aagcagatctgatagggccctg

SEQ ID NO: 75699 - DNA, 22 bp, Homo sapiens
acacttctttgtcacctgcttc

SEQ ID NO: 75700 - DNA, 22 bp, Homo sapiens
atatacacatctttttaaatat

SEQ ID NO: 75701 - DNA, 22 bp, Homo sapiens
gcttctcgggcctgatgtcgtc

SEQ ID NO: 75702 - DNA, 22 bp, Homo sapiens
tgagtagagaattcagctaagg

SEQ ID NO: 75703 - DNA, 22 bp, Homo sapiens
tccattatacttctgattcaaa

SEQ ID NO: 75704 - DNA, 22 bp, Homo sapiens
ctcagctgcagcctggctggca

SEQ ID NO: 75705 - DNA, 22 bp, Homo sapiens
taaagggtaggttttactgtaa

SEQ ID NO: 75706 - DNA, 22 bp, Homo sapiens
cagagctgtccaaaccctgaca

SEQ ID NO: 75707 - DNA, 22 bp, Homo sapiens
cactgcactccatcctgggaaa

SEQ ID NO: 75708 - DNA, 22 bp, Homo sapiens
ggtgagaaagggattcctgttc

SEQ ID NO: 75709 - DNA, 22 bp, Homo sapiens
tttctttatcatagcatctttg

SEQ ID NO: 75710 - DNA, 22 bp, Homo sapiens
gcctcaaatgtggagcactatt

SEQ ID NO: 75711 - DNA, 22 bp, Homo sapiens
aaggcaggatgggaaaagattt

SEQ ID NO: 75712 - DNA, 22 bp, Homo sapiens
atgtttttaaatagacttacag

SEQ ID NO: 75713 - DNA, 22 bp, Homo sapiens
gaaagacatagttgcaagatgg

SEQ ID NO: 75714 - DNA, 22 bp, Homo sapiens
gcatacttcttgctgctttcag

SEQ ID NO: 75715 - DNA, 20 bp, Homo sapiens
aaattactgccacacatttc

SEQ ID NO: 75716 - DNA, 22 bp, Homo sapiens
tggtggggccagacttcagctc

SEQ ID NO: 75717 - DNA, 22 bp, Homo sapiens
tgcacgtgggctctctgctctt

SEQ ID NO: 75718 - DNA, 22 bp, Homo sapiens
tgatcagcatcttcccagctcg

SEQ ID NO: 75719 - DNA, 22 bp, Homo sapiens
gctgctctcagagctcatgctg

SEQ ID NO: 75720 - DNA, 22 bp, Homo sapiens
caggcagggagctggaaaggat

SEQ ID NO: 75721 - DNA, 22 bp, Homo sapiens
gggctgtaggagctggaatggg

SEQ ID NO: 75722 - DNA, 22 bp, Homo sapiens
atatatttgagaatattcatga

SEQ ID NO: 75723 - DNA, 22 bp, Homo sapiens
ttttccttcatatcccttatgt

SEQ ID NO: 75724 - DNA, 22 bp, Homo sapiens
tgtacttgaacttgactgtaga

SEQ ID NO: 75725 - DNA, 22 bp, Homo sapiens
gaagcttgaacagggccaggct

SEQ ID NO: 75726 - DNA, 22 bp, Homo sapiens
ttcaaatgatggcagtcctggc

SEQ ID NO: 75727 - DNA, 20 bp, Homo sapiens
ttgagcttttagtacagaca

SEQ ID NO: 75728 - DNA, 22 bp, Homo sapiens
tgaagaaacgcagagaggtagg

SEQ ID NO: 75729 - DNA, 22 bp, Homo sapiens
aggcaggaggatcatggatgca

SEQ ID NO: 75730 - DNA, 22 bp, Homo sapiens
gtcagtaggaacctagggtcaa

SEQ ID NO: 75731 - DNA, 22 bp, Homo sapiens
ccaccagctgcatatgcacgta

SEQ ID NO: 75732 - DNA, 22 bp, Homo sapiens
gcaggcagatcacctgtcagga

SEQ ID NO: 75733 - DNA, 22 bp, Homo sapiens
ctgtccctgagcaactcctgtt

SEQ ID NO: 75734 - DNA, 15 bp, Homo sapiens
gcaggcaggtcacct

SEQ ID NO: 75735 - DNA, 16 bp, Homo sapiens
tgggtgggaggagcgg

SEQ ID NO: 75736 - DNA, 22 bp, Homo sapiens
aaggtgggtggatcacgaggtc

SEQ ID NO: 75737 - DNA, 22 bp, Homo sapiens
cttaactctacactgcacttta

SEQ ID NO: 75738 - DNA, 17 bp, Homo sapiens
caggtgacctggtgatg

SEQ ID NO: 75739 - DNA, 22 bp, Homo sapiens
ccaggagttggaggctgcagtg

SEQ ID NO: 75740 - DNA, 22 bp, Homo sapiens
tttctcatggaacatcgtttag

SEQ ID NO: 75741 - DNA, 22 bp, Homo sapiens
tctccccagtatggattctctg

SEQ ID NO: 75742 - DNA, 22 bp, Homo sapiens
cacagacagtgtccctttgttg

SEQ ID NO: 75743 - DNA, 22 bp, Homo sapiens
tattccagccgcttgagctcgc

SEQ ID NO: 75744 - DNA, 22 bp, Homo sapiens
gaggggtccaggaggcacttac

SEQ ID NO: 75745 - DNA, 22 bp, Homo sapiens
aaagcagaggttgcagtgagct

SEQ ID NO: 75746 - DNA, 22 bp, Homo sapiens
tgctcatcaacatgatgatcat

SEQ ID NO: 75747 - DNA, 22 bp, Homo sapiens
tgagatgtaaggtatgcttact

SEQ ID NO: 75748 - DNA, 22 bp, Homo sapiens
atcacaaaggtctcagagcaca

SEQ ID NO: 75749 - DNA, 22 bp, Homo sapiens
tagcagtgtctaggtaggccat

SEQ ID NO: 75750 - DNA, 22 bp, Homo sapiens
aggcttttctccagaatgtact

SEQ ID NO: 75751 - DNA, 22 bp, Homo sapiens
ataatacatggttgatcttttc

SEQ ID NO: 75752 - DNA, 22 bp, Homo sapiens
cccagggagagcgcggaggcgg

SEQ ID NO: 75753 - DNA, 22 bp, Homo sapiens
acctgcaggcacaggtgtgcgc

SEQ ID NO: 75754 - DNA, 22 bp, Homo sapiens
acaaagtgctgacattacaggc

SEQ ID NO: 75755 - DNA, 22 bp, Homo sapiens
tcttggattttaatggatcaaa

SEQ ID NO: 75756 - DNA, 22 bp, Homo sapiens
aactcactttgtggcttctgaa

SEQ ID NO: 75757 - DNA, 22 bp, Homo sapiens
tagtttcatctccaccctgccc

SEQ ID NO: 75758 - DNA, 22 bp, Homo sapiens
tgtatattctgcctaaaagctt

SEQ ID NO: 75759 - DNA, 22 bp, Homo sapiens
cgagagttagctaggagtcaca

SEQ ID NO: 75760 - DNA, 22 bp, Homo sapiens
tgccgcagtgcggggagggccc

SEQ ID NO: 75761 - DNA, 21 bp, Homo sapiens
cactccacttagaacagggtt

SEQ ID NO: 75762 - DNA, 22 bp, Homo sapiens
tgaatgtgatgctaaacatatg

SEQ ID NO: 75763 - DNA, 22 bp, Homo sapiens
aataaaatggtcagttttctca

SEQ ID NO: 75764 - DNA, 22 bp, Homo sapiens
attgcaggctctgacaccaggc

SEQ ID NO: 75765 - DNA, 22 bp, Homo sapiens
gaattcttttctttctgaaagt

SEQ ID NO: 75766 - DNA, 22 bp, Homo sapiens
aaaactacatttgacattttgt

SEQ ID NO: 75767 - DNA, 22 bp, Homo sapiens
cacagtcctgccagagggcctt

SEQ ID NO: 75768 - DNA, 21 bp, Homo sapiens
acataggcgaatgttcgggag

SEQ ID NO: 75769 - DNA, 22 bp, Homo sapiens
ggaggtggaggttgcagtgagc

SEQ ID NO: 75770 - DNA, 22 bp, Homo sapiens
cttcatagtgagtttaatgatg

SEQ ID NO: 75771 - DNA, 22 bp, Homo sapiens
gtctcttagaaccttgttttgg

SEQ ID NO: 75772 - DNA, 22 bp, Homo sapiens
gtccaggcctgcctctgaggag

SEQ ID NO: 75773 - DNA, 22 bp, Homo sapiens
acagagacacggaagctaaaga

SEQ ID NO: 75774 - DNA, 22 bp, Homo sapiens
ggagaagaggagctggaagcct

SEQ ID NO: 75775 - DNA, 22 bp, Homo sapiens
agccagggtctctcgctctgtt

SEQ ID NO: 75776 - DNA, 22 bp, Homo sapiens
catccaggctgaagtgcagtgg

SEQ ID NO: 75777 - DNA, 22 bp, Homo sapiens
aggtggggaggagtgtctcttt

SEQ ID NO: 75778 - DNA, 22 bp, Homo sapiens
aacccgagggccccaggctcgg

SEQ ID NO: 75779 - DNA, 22 bp, Homo sapiens
cactgcactccagcctgggaga

SEQ ID NO: 75780 - DNA, 22 bp, Homo sapiens
ctgcggctctgcgggcagctgg

SEQ ID NO: 75781 - DNA, 22 bp, Homo sapiens
ccctttagcccctgcagagact

SEQ ID NO: 75782 - DNA, 22 bp, Homo sapiens
gctgcagtgagccaagatcgtg

SEQ ID NO: 75783 - DNA, 22 bp, Homo sapiens
caggaagctgtgaaggagacgg

SEQ ID NO: 75784 - DNA, 22 bp, Homo sapiens
gctggcagacttcctctggaac

SEQ ID NO: 75785 - DNA, 22 bp, Homo sapiens
agttggagtgaacatgagattg

SEQ ID NO: 75786 - DNA, 22 bp, Homo sapiens
ccaatgatggtgcccacgatga

SEQ ID NO: 75787 - DNA, 22 bp, Homo sapiens
tgtgtggattcatctcaaagag

SEQ ID NO: 75788 - DNA, 22 bp, Homo sapiens
gtcatggtgctagcgggaatgt

SEQ ID NO: 75789 - DNA, 22 bp, Homo sapiens
gttgcagatgtggaactcgtgc

SEQ ID NO: 75790 - DNA, 20 bp, Homo sapiens
aggaaaaatggaaactggag

SEQ ID NO: 75791 - DNA, 22 bp, Homo sapiens
tggtatgaccgtggtgcaagca

SEQ ID NO: 75792 - DNA, 22 bp, Homo sapiens
atgccacttcattccagcctcg

SEQ ID NO: 75793 - DNA, 22 bp, Homo sapiens
gcggcaggagtaaaggaggaag

SEQ ID NO: 75794 - DNA, 22 bp, Homo sapiens
agcctggcggtcgtcggtcagg

SEQ ID NO: 75795 - DNA, 22 bp, Homo sapiens
tggctcatgcctgtaatcttag

SEQ ID NO: 75796 - DNA, 22 bp, Homo sapiens
gggaaacagcccaggctcaggg

SEQ ID NO: 75797 - DNA, 22 bp, Homo sapiens
ctagcctgggatttgaacttat

SEQ ID NO: 75798 - DNA, 22 bp, Homo sapiens
ccttgctcaagctagtgacggg

SEQ ID NO: 75799 - DNA, 22 bp, Homo sapiens
ttttaatactgctattgtagga

SEQ ID NO: 75800 - DNA, 22 bp, Homo sapiens
ttccgctgtttagttgaagttt

SEQ ID NO: 75801 - DNA, 22 bp, Homo sapiens
agtgaggggcagctgagtgggc

SEQ ID NO: 75802 - DNA, 22 bp, Homo sapiens
gcaactgaacatgtgtgtggcc

SEQ ID NO: 75803 - DNA, 22 bp, Homo sapiens
agcaggagtttgatgcttttat

SEQ ID NO: 75804 - DNA, 22 bp, Homo sapiens
tgggcagggagctggaaccaca

SEQ ID NO: 75805 - DNA, 22 bp, Homo sapiens
tgtgctctgactttctcctggt

SEQ ID NO: 75806 - DNA, 20 bp, Homo sapiens
ttcatgggagcaaagaggcc

SEQ ID NO: 75807 - DNA, 22 bp, Homo sapiens
aaagcagaactgagagagctgg

SEQ ID NO: 75808 - DNA, 22 bp, Homo sapiens
tgagacgaagtcttgctctgtt

SEQ ID NO: 75809 - DNA, 22 bp, Homo sapiens
aagctgcagcacagagaggtgg

SEQ ID NO: 75810 - DNA, 22 bp, Homo sapiens
cttagatgaagtcacagaaccc

SEQ ID NO: 75811 - DNA, 22 bp, Homo sapiens
gaccttcttgctgtgtcctaac

SEQ ID NO: 75812 - DNA, 22 bp, Homo sapiens
actcctacatattagcattaac

SEQ ID NO: 75813 - DNA, 22 bp, Homo sapiens
tcgcgggttgcacatggccatc

SEQ ID NO: 75814 - DNA, 22 bp, Homo sapiens
atgccactgcacttcagcctgg

SEQ ID NO: 75815 - DNA, 22 bp, Homo sapiens
tactaggaagcagctgcattgg

SEQ ID NO: 75816 - DNA, 22 bp, Homo sapiens
tggttattaaggcctctttcag

SEQ ID NO: 75817 - DNA, 22 bp, Homo sapiens
cttagagatgggttttacttag

SEQ ID NO: 75818 - DNA, 22 bp, Homo sapiens
gggatctgggacaacaggtggt

SEQ ID NO: 75819 - DNA, 22 bp, Homo sapiens
ctcttcctagtgtgcagcgtgg

SEQ ID NO: 75820 - DNA, 23 bp, Homo sapiens
ctatttctcatagttcaggtctt

SEQ ID NO: 75821 - DNA, 18 bp, Homo sapiens
ccctgccagctcccagca

SEQ ID NO: 75822 - DNA, 14 bp, Homo sapiens
gcaggcagatcacc

SEQ ID NO: 75823 - DNA, 22 bp, Homo sapiens
agggactatttacccatctcac

SEQ ID NO: 75824 - DNA, 22 bp, Homo sapiens
tacccaaggccctttcaatttc

SEQ ID NO: 75825 - DNA, 22 bp, Homo sapiens
atgaattgaggaaaacagtcgt

SEQ ID NO: 75826 - DNA, 22 bp, Homo sapiens
gaatttcacaaggtgaggataa

SEQ ID NO: 75827 - DNA, 22 bp, Homo sapiens
tgtgaatggacaattaaatcta

SEQ ID NO: 75828 - DNA, 22 bp, Homo sapiens
gctgcagggagctggaaggctc

SEQ ID NO: 75829 - DNA, 22 bp, Homo sapiens
tgggggagctcagtccagccca

SEQ ID NO: 75830 - DNA, 22 bp, Homo sapiens
tattgcaggttccaaccgggaa

SEQ ID NO: 75831 - DNA, 22 bp, Homo sapiens
ctgccctggggggcctccttgc

SEQ ID NO: 75832 - DNA, 22 bp, Homo sapiens
ccagatatcactgccgtgttgt

SEQ ID NO: 75833 - DNA, 22 bp, Homo sapiens
ttctggaaggatgtttctatct

SEQ ID NO: 75834 - DNA, 22 bp, Homo sapiens
agacacttcatgtaagtggaat

SEQ ID NO: 75835 - DNA, 22 bp, Homo sapiens
ggccactgacctacatctgggg

SEQ ID NO: 75836 - DNA, 22 bp, Homo sapiens
ctgaggagaggtggcctgtgtt

SEQ ID NO: 75837 - DNA, 22 bp, Homo sapiens
tacagcctggcactaccctggg

SEQ ID NO: 75838 - DNA, 22 bp, Homo sapiens
tggacacaaagatcaaatattg

SEQ ID NO: 75839 - DNA, 22 bp, Homo sapiens
ggttcccggatctccgagtccc

SEQ ID NO: 75840 - DNA, 22 bp, Homo sapiens
ttccatatctgttgcatatcat

SEQ ID NO: 75841 - DNA, 22 bp, Homo sapiens
gtagtctgaacagtaattttgt

SEQ ID NO: 75842 - DNA, 22 bp, Homo sapiens
atgccactgcactccagcctag

SEQ ID NO: 75843 - DNA, 22 bp, Homo sapiens
cagcagcattgctctggattcc

SEQ ID NO: 75844 - DNA, 22 bp, Homo sapiens
gtagctctgtttaaagttcttt

SEQ ID NO: 75845 - DNA, 21 bp, Homo sapiens
cgtgactgggtccgtctggct

SEQ ID NO: 75846 - DNA, 17 bp, Homo sapiens
cccgttctcttcgctgg

SEQ ID NO: 75847 - DNA, 22 bp, Homo sapiens
aaaactgaaatacgatccaatg

SEQ ID NO: 75848 - DNA, 22 bp, Homo sapiens
acagattcactgcactggccat

SEQ ID NO: 75849 - DNA, 22 bp, Homo sapiens
gaagccttgaactgcaaacccc

SEQ ID NO: 75850 - DNA, 22 bp, Homo sapiens
gcccgcgccagcctctccatct

SEQ ID NO: 75851 - DNA, 22 bp, Homo sapiens
gtggctcacgcctgtaatccca

SEQ ID NO: 75852 - DNA, 20 bp, Homo sapiens
caagggtttgcattggcttt

SEQ ID NO: 75853 - DNA, 22 bp, Homo sapiens
taagcctgcatgaaccatgaga

SEQ ID NO: 75854 - DNA, 22 bp, Homo sapiens
atgaaatatcttgaagaaattc

SEQ ID NO: 75855 - DNA, 22 bp, Homo sapiens
atgttattgatgcctgaggctt

SEQ ID NO: 75856 - DNA, 22 bp, Homo sapiens
agcgggtctgcaagccttccct

SEQ ID NO: 75857 - DNA, 22 bp, Homo sapiens
gagaaatgcatgcatgtcatca

SEQ ID NO: 75858 - DNA, 22 bp, Homo sapiens
tccgcccgcacgtatggagtgg

SEQ ID NO: 75859 - DNA, 22 bp, Homo sapiens
gtgctggggagataggaagaga

SEQ ID NO: 75860 - DNA, 22 bp, Homo sapiens
atgccactgcactccagcctgg

SEQ ID NO: 75861 - DNA, 22 bp, Homo sapiens
gtggctcacgtctgtcatctca

SEQ ID NO: 75862 - DNA, 22 bp, Homo sapiens
ccgggttgaggttcccatagat

SEQ ID NO: 75863 - DNA, 22 bp, Homo sapiens
gatgccctggcctgtccccgca

SEQ ID NO: 75864 - DNA, 22 bp, Homo sapiens
tcctcagtcacggtagcacatt

SEQ ID NO: 75865 - DNA, 19 bp, Homo sapiens
agtcctggcctgggggacc

SEQ ID NO: 75866 - DNA, 22 bp, Homo sapiens
aggaggggttctcgggtgctga

SEQ ID NO: 75867 - DNA, 22 bp, Homo sapiens
gtctatgatattttgttatagc

SEQ ID NO: 75868 - DNA, 22 bp, Homo sapiens
gatgatcatctgtaaagttaga

SEQ ID NO: 75869 - DNA, 22 bp, Homo sapiens
actgcgtggggagctgtgacta

SEQ ID NO: 75870 - DNA, 22 bp, Homo sapiens
ttacctaaaatagctcaattta

SEQ ID NO: 75871 - DNA, 22 bp, Homo sapiens
ggatgttctggggttctcttgt

SEQ ID NO: 75872 - DNA, 22 bp, Homo sapiens
tgagaacggatactaagggctg

SEQ ID NO: 75873 - DNA, 22 bp, Homo sapiens
gcttaattctggctcagtttcc

SEQ ID NO: 75874 - DNA, 22 bp, Homo sapiens
atcatcctagaaggaagctagg

SEQ ID NO: 75875 - DNA, 22 bp, Homo sapiens
ggaggggatttagtagatgcta

SEQ ID NO: 75876 - DNA, 22 bp, Homo sapiens
aacactctctgttggtaaggct

SEQ ID NO: 75877 - DNA, 19 bp, Homo sapiens
agataagagttgactgtgg

SEQ ID NO: 75878 - DNA, 22 bp, Homo sapiens
ccaggagttggaagctgccatg

SEQ ID NO: 75879 - DNA, 22 bp, Homo sapiens
cggggccctggggctgaaggtc

SEQ ID NO: 75880 - DNA, 22 bp, Homo sapiens
tcagggctgcagaagaggcagg

SEQ ID NO: 75881 - DNA, 22 bp, Homo sapiens
tgacttgtctctttgggagaca

SEQ ID NO: 75882 - DNA, 22 bp, Homo sapiens
atttagacatgtatctgatagc

SEQ ID NO: 75883 - DNA, 22 bp, Homo sapiens
aggaaataggaccagacaaagc

SEQ ID NO: 75884 - DNA, 22 bp, Homo sapiens
gaggtggatgttgcagtgagct

SEQ ID NO: 75885 - DNA, 20 bp, Homo sapiens
aagacaccagtggcagcccc

SEQ ID NO: 75886 - DNA, 22 bp, Homo sapiens
gcagatgtgtcctggagggagg

SEQ ID NO: 75887 - DNA, 22 bp, Homo sapiens
cccagtttcaactttccagtgg

SEQ ID NO: 75888 - DNA, 22 bp, Homo sapiens
aaccaccattctctcctcttcc

SEQ ID NO: 75889 - DNA, 22 bp, Homo sapiens
agtccaggactgtttcagctga

SEQ ID NO: 75890 - DNA, 22 bp, Homo sapiens
tgtctattaattccacataaaa

SEQ ID NO: 75891 - DNA, 22 bp, Homo sapiens
tttcagaacataatgtgagcat

SEQ ID NO: 75892 - DNA, 22 bp, Homo sapiens
acatatgcgatcataggatgca

SEQ ID NO: 75893 - DNA, 22 bp, Homo sapiens
ctgggggtcttgaaagggagag

SEQ ID NO: 75894 - DNA, 22 bp, Homo sapiens
caaatactacgattcttgcagt

SEQ ID NO: 75895 - DNA, 22 bp, Homo sapiens
tccagggagagccgctgctcca

SEQ ID NO: 75896 - DNA, 23 bp, Homo sapiens
ttaaacactagttcgagtagcat

SEQ ID NO: 75897 - DNA, 22 bp, Homo sapiens
aggctatttccactcttctcat

SEQ ID NO: 75898 - DNA, 22 bp, Homo sapiens
atgttggagtcgtaaggcatgg

SEQ ID NO: 75899 - DNA, 22 bp, Homo sapiens
tctgacattttgagaatgacat

SEQ ID NO: 75900 - DNA, 19 bp, Homo sapiens
tcctgcccaccagccaggg

SEQ ID NO: 75901 - DNA, 22 bp, Homo sapiens
catccaccgcgtgcacctctac

SEQ ID NO: 75902 - DNA, 22 bp, Homo sapiens
ttactttaagggtgtcttatta

SEQ ID NO: 75903 - DNA, 22 bp, Homo sapiens
gttgaggtgatgccagccctgc

SEQ ID NO: 75904 - DNA, 22 bp, Homo sapiens
aggagctgtcagagtgccagag

SEQ ID NO: 75905 - DNA, 22 bp, Homo sapiens
ccatcacagtccccatcgtgat

SEQ ID NO: 75906 - DNA, 22 bp, Homo sapiens
caagcgtggctgctctgatgga

SEQ ID NO: 75907 - DNA, 22 bp, Homo sapiens
ttccagctaactcacatccctt

SEQ ID NO: 75908 - DNA, 22 bp, Homo sapiens
gcgagaaactaagtgccctttg

SEQ ID NO: 75909 - DNA, 17 bp, Homo sapiens
agtttttggacctgtgt

SEQ ID NO: 75910 - DNA, 22 bp, Homo sapiens
attgcactccggcctgggtgac

SEQ ID NO: 75911 - DNA, 22 bp, Homo sapiens
tggctaacaaggtgaaaccccg

SEQ ID NO: 75912 - DNA, 22 bp, Homo sapiens
gggtccagtagttggtggccgt

SEQ ID NO: 75913 - DNA, 22 bp, Homo sapiens
gttgtgattgtagctaaactag

SEQ ID NO: 75914 - DNA, 21 bp, Homo sapiens
tctgatggtagatgagatgtg

SEQ ID NO: 75915 - DNA, 22 bp, Homo sapiens
cactgggcgtgtcctgggtgag

SEQ ID NO: 75916 - DNA, 22 bp, Homo sapiens
tcactcaggctggagtgcagtg

SEQ ID NO: 75917 - DNA, 22 bp, Homo sapiens
gctggaggatggactggaagaa

SEQ ID NO: 75918 - DNA, 22 bp, Homo sapiens
ctggagggctgcagcgaggctg

SEQ ID NO: 75919 - DNA, 22 bp, Homo sapiens
taggtagctttggcgtttcttg

SEQ ID NO: 75920 - DNA, 22 bp, Homo sapiens
tgtgagttattttcaggagttt

SEQ ID NO: 75921 - DNA, 22 bp, Homo sapiens
acaggtcctcaagtcagctggg

SEQ ID NO: 75922 - DNA, 22 bp, Homo sapiens
tcgggctcgctctcctagcgga

SEQ ID NO: 75923 - DNA, 16 bp, Homo sapiens
ccacctgcagctctca

SEQ ID NO: 75924 - DNA, 22 bp, Homo sapiens
gtgtttgttcgtgactccaaag

SEQ ID NO: 75925 - DNA, 22 bp, Homo sapiens
ttgtaacaggtactaaataact

SEQ ID NO: 75926 - DNA, 22 bp, Homo sapiens
cctgaggatgccagcatgggtg

SEQ ID NO: 75927 - DNA, 22 bp, Homo sapiens
gtgctccctccttcctcaagga

SEQ ID NO: 75928 - DNA, 22 bp, Homo sapiens
aaatgtggggctggaggcagga

SEQ ID NO: 75929 - DNA, 22 bp, Homo sapiens
ctattattagataatctacttg

SEQ ID NO: 75930 - DNA, 22 bp, Homo sapiens
ctccatatgttcagttatgcag

SEQ ID NO: 75931 - DNA, 22 bp, Homo sapiens
agcctggcctgggcaggcacat

SEQ ID NO: 75932 - DNA, 22 bp, Homo sapiens
atacctgtgtatccacaagcgt

SEQ ID NO: 75933 - DNA, 22 bp, Homo sapiens
gttatataagacaaatcagagt

SEQ ID NO: 75934 - DNA, 23 bp, Homo sapiens
gggtccagccaattccaaggaaa

SEQ ID NO: 75935 - DNA, 22 bp, Homo sapiens
ttcatatttctttaaggacttt

SEQ ID NO: 75936 - DNA, 22 bp, Homo sapiens
tgcgatgcaacagcttggcgga

SEQ ID NO: 75937 - DNA, 22 bp, Homo sapiens
tgtctcatctcttaaccccact

SEQ ID NO: 75938 - DNA, 22 bp, Homo sapiens
aactcaaagatgcatgacgctt

SEQ ID NO: 75939 - DNA, 22 bp, Homo sapiens
cagggtttcaccatgttagcag

SEQ ID NO: 75940 - DNA, 22 bp, Homo sapiens
ggccaattccaggagccggcgg

SEQ ID NO: 75941 - DNA, 22 bp, Homo sapiens
gctcaagccttctgcccacctc

SEQ ID NO: 75942 - DNA, 22 bp, Homo sapiens
ttcccacattctttacattcat

SEQ ID NO: 75943 - DNA, 22 bp, Homo sapiens
cctgggggccaggaaggtgtga

SEQ ID NO: 75944 - DNA, 22 bp, Homo sapiens
gctgtgtatcagatgccacggg

SEQ ID NO: 75945 - DNA, 22 bp, Homo sapiens
caggctgctgacaggcttggag

SEQ ID NO: 75946 - DNA, 22 bp, Homo sapiens
ggtgggagccaacacccttctg

SEQ ID NO: 75947 - DNA, 22 bp, Homo sapiens
actgcaaagggaagccctttct

SEQ ID NO: 75948 - DNA, 22 bp, Homo sapiens
gcccagctgcaccctggtgggt

SEQ ID NO: 75949 - DNA, 22 bp, Homo sapiens
ctcctccacccgctggggccca

SEQ ID NO: 75950 - DNA, 22 bp, Homo sapiens
tgggcaggggccctgcttccgt

SEQ ID NO: 75951 - DNA, 22 bp, Homo sapiens
tatactacgcaccaaacaaagg

SEQ ID NO: 75952 - DNA, 22 bp, Homo sapiens
tgagctgcttcttataatgtgt

SEQ ID NO: 75953 - DNA, 22 bp, Homo sapiens
aagaataagaggatttagaaca

SEQ ID NO: 75954 - DNA, 22 bp, Homo sapiens
tgcactccaggctgggtgacag

SEQ ID NO: 75955 - DNA, 22 bp, Homo sapiens
ttgggctcaggagtttgagacc

SEQ ID NO: 75956 - DNA, 22 bp, Homo sapiens
tttgtggcaggagcggagaccg

SEQ ID NO: 75957 - DNA, 19 bp, Homo sapiens
agccccttggtactgtcct

SEQ ID NO: 75958 - DNA, 22 bp, Homo sapiens
atgttatgtctgggaaggggta

SEQ ID NO: 75959 - DNA, 22 bp, Homo sapiens
tgtcaccttgctcatcctcgga

SEQ ID NO: 75960 - DNA, 20 bp, Homo sapiens
gccaacgcgctggggctgcc

SEQ ID NO: 75961 - DNA, 22 bp, Homo sapiens
tttaatgtagcgtgaaatgatt

SEQ ID NO: 75962 - DNA, 22 bp, Homo sapiens
attgcactccagcctgggtgac

SEQ ID NO: 75963 - DNA, 22 bp, Homo sapiens
gagctgagaagcagcgcttgat

SEQ ID NO: 75964 - DNA, 22 bp, Homo sapiens
taatgcacatagaagtacttag

SEQ ID NO: 75965 - DNA, 22 bp, Homo sapiens
ctgggggcagcaagaagccatg

SEQ ID NO: 75966 - DNA, 22 bp, Homo sapiens
agtctgcaggaccgcgtcacat

SEQ ID NO: 75967 - DNA, 22 bp, Homo sapiens
accagggaccgccacactgcaa

SEQ ID NO: 75968 - DNA, 22 bp, Homo sapiens
tgacctattagatttccttgcc

SEQ ID NO: 75969 - DNA, 22 bp, Homo sapiens
taacaatacccattctaattac

SEQ ID NO: 75970 - DNA, 22 bp, Homo sapiens
attgataaattgcaatggggct

SEQ ID NO: 75971 - DNA, 22 bp, Homo sapiens
tgccgtggggctgaggctggag

SEQ ID NO: 75972 - DNA, 22 bp, Homo sapiens
gagcacagtaaagcagtgtcac

SEQ ID NO: 75973 - DNA, 22 bp, Homo sapiens
agtccaaagcagatgagggcca

SEQ ID NO: 75974 - DNA, 22 bp, Homo sapiens
aaggagaaatggtagatgtgca

SEQ ID NO: 75975 - DNA, 22 bp, Homo sapiens
ctggcaggtggaggttgcagtg

SEQ ID NO: 75976 - DNA, 22 bp, Homo sapiens
atcctttcatctggtaatatat

SEQ ID NO: 75977 - DNA, 19 bp, Homo sapiens
ccctcttgcacaaagcaaa

SEQ ID NO: 75978 - DNA, 22 bp, Homo sapiens
ccaggctggagtgcagtggcac

SEQ ID NO: 75979 - DNA, 22 bp, Homo sapiens
tgtccaggctggagtgcagtgg

SEQ ID NO: 75980 - DNA, 22 bp, Homo sapiens
tttaagaagttatgttataaat

SEQ ID NO: 75981 - DNA, 22 bp, Homo sapiens
tcagtatcaatagcgtcacaat

SEQ ID NO: 75982 - DNA, 22 bp, Homo sapiens
gaggccacggaagggagctgtg

SEQ ID NO: 75983 - DNA, 22 bp, Homo sapiens
cgctgataaacgtcacgttccc

SEQ ID NO: 75984 - DNA, 22 bp, Homo sapiens
agccttacataaacagccttat

SEQ ID NO: 75985 - DNA, 22 bp, Homo sapiens
attcatcagctaatggacattt

SEQ ID NO: 75986 - DNA, 22 bp, Homo sapiens
cagcaggaggtgagtagcaggt

SEQ ID NO: 75987 - DNA, 22 bp, Homo sapiens
gtctatatattgcttgaataat

SEQ ID NO: 75988 - DNA, 19 bp, Homo sapiens
gatttaaacgtggctctat

SEQ ID NO: 75989 - DNA, 22 bp, Homo sapiens
acaattctgatggtttcccagt

SEQ ID NO: 75990 - DNA, 22 bp, Homo sapiens
gcaggtggatcaccacgtcagg

SEQ ID NO: 75991 - DNA, 22 bp, Homo sapiens
aaaagcaattgcagttcttgcc

SEQ ID NO: 75992 - DNA, 22 bp, Homo sapiens
tgggaagggtcaacagctggaa

SEQ ID NO: 75993 - DNA, 22 bp, Homo sapiens
gggttcagtccctcttgctact

SEQ ID NO: 75994 - DNA, 22 bp, Homo sapiens
attgtactacaccatagtactg

SEQ ID NO: 75995 - DNA, 22 bp, Homo sapiens
atgaaaacggaccagagctatt

SEQ ID NO: 75996 - DNA, 22 bp, Homo sapiens
accacccagccagcttctccct

SEQ ID NO: 75997 - DNA, 22 bp, Homo sapiens
aggtgacaggacaggagctggt

SEQ ID NO: 75998 - DNA, 16 bp, Homo sapiens
gcaggcagatcacatg

SEQ ID NO: 75999 - DNA, 22 bp, Homo sapiens
tgtgacgttgttctggattccc

SEQ ID NO: 76000 - DNA, 20 bp, Homo sapiens
ccagagctgatggctgcccg

SEQ ID NO: 76001 - DNA, 19 bp, Homo sapiens
ggagccgccgcccttcatt

SEQ ID NO: 76002 - DNA, 22 bp, Homo sapiens
cgtcccgggttcacgccattct

SEQ ID NO: 76003 - DNA, 22 bp, Homo sapiens
tttcttctatgtgtgatatttt

SEQ ID NO: 76004 - DNA, 22 bp, Homo sapiens
cttgacactgtcactcaggcca

SEQ ID NO: 76005 - DNA, 22 bp, Homo sapiens
ttccggaaggttctctagaatt

SEQ ID NO: 76006 - DNA, 22 bp, Homo sapiens
tgtgagttcttagaaagtcagt

SEQ ID NO: 76007 - DNA, 22 bp, Homo sapiens
tgtgttgtgacattcttggatg

SEQ ID NO: 76008 - DNA, 22 bp, Homo sapiens
cagagctggtgtgtcctggcat

SEQ ID NO: 76009 - DNA, 22 bp, Homo sapiens
gcaaaaagtagtgctggttagg

SEQ ID NO: 76010 - DNA, 18 bp, Homo sapiens
ttcacaagggcttggttt

SEQ ID NO: 76011 - DNA, 22 bp, Homo sapiens
caagtctgacctctgggtgaag

SEQ ID NO: 76012 - DNA, 23 bp, Homo sapiens
aagtggttttgaacccggaccct

SEQ ID NO: 76013 - DNA, 22 bp, Homo sapiens
actccacatttgaacacagttc

SEQ ID NO: 76014 - DNA, 22 bp, Homo sapiens
cggggttcatccatgctgtggc

SEQ ID NO: 76015 - DNA, 22 bp, Homo sapiens
tatttcttttcgtgacttattg

SEQ ID NO: 76016 - DNA, 22 bp, Homo sapiens
tgtagtagcattcacgaagtgt

SEQ ID NO: 76017 - DNA, 17 bp, Homo sapiens
tggtccaggtggagcca

SEQ ID NO: 76018 - DNA, 22 bp, Homo sapiens
tgtgactaggcctgagctcttg

SEQ ID NO: 76019 - DNA, 22 bp, Homo sapiens
ttctcatgaaactcgcttcctc

SEQ ID NO: 76020 - DNA, 22 bp, Homo sapiens
ggagttgattttggatatatta

SEQ ID NO: 76021 - DNA, 22 bp, Homo sapiens
ttaccaaatgaaatagagattt

SEQ ID NO: 76022 - DNA, 22 bp, Homo sapiens
gtatgtctatagtttttaaata

SEQ ID NO: 76023 - DNA, 22 bp, Homo sapiens
tctgttgcaatgtgcatggtga

SEQ ID NO: 76024 - DNA, 22 bp, Homo sapiens
ggccagaagttggaaaagagcc

SEQ ID NO: 76025 - DNA, 22 bp, Homo sapiens
tacaccattcccaggtggattt

SEQ ID NO: 76026 - DNA, 22 bp, Homo sapiens
tgtctctgtgactccttccgcc

SEQ ID NO: 76027 - DNA, 22 bp, Homo sapiens
ggagctgaggacactacatttt

SEQ ID NO: 76028 - DNA, 22 bp, Homo sapiens
attctcataggagcgtgaacct

SEQ ID NO: 76029 - DNA, 22 bp, Homo sapiens
ttctacagtgactgcagccata

SEQ ID NO: 76030 - DNA, 22 bp, Homo sapiens
caagatcttcctcaatagacct

SEQ ID NO: 76031 - DNA, 22 bp, Homo sapiens
tgtaccactctactaagggttc

SEQ ID NO: 76032 - DNA, 22 bp, Homo sapiens
aaaaatcacttttataggcagc

SEQ ID NO: 76033 - DNA, 22 bp, Homo sapiens
ttacaattacttgatctcagct

SEQ ID NO: 76034 - DNA, 22 bp, Homo sapiens
tcccggcgctgggaggtgggtc

SEQ ID NO: 76035 - DNA, 22 bp, Homo sapiens
tgagctgacacccaatcatact

SEQ ID NO: 76036 - DNA, 22 bp, Homo sapiens
gtgcccagcagcagcgtccccg

SEQ ID NO: 76037 - DNA, 22 bp, Homo sapiens
ggaaaatgggaacctgaagcca

SEQ ID NO: 76038 - DNA, 22 bp, Homo sapiens
agccagggacgctgcaggctac

SEQ ID NO: 76039 - DNA, 22 bp, Homo sapiens
tataaagagtctcaaagaagtt

SEQ ID NO: 76040 - DNA, 22 bp, Homo sapiens
agttttcattaccatgctgcaa

SEQ ID NO: 76041 - DNA, 22 bp, Homo sapiens
tccgtgcccctggcactaggtc

SEQ ID NO: 76042 - DNA, 22 bp, Homo sapiens
atacaaagtattgatcctgagt

SEQ ID NO: 76043 - DNA, 22 bp, Homo sapiens
gacagctccagctcctccaggc

SEQ ID NO: 76044 - DNA, 22 bp, Homo sapiens
cgagcatgatgacggctgtggc

SEQ ID NO: 76045 - DNA, 21 bp, Homo sapiens
agctgcctccacttctgaggc

SEQ ID NO: 76046 - DNA, 22 bp, Homo sapiens
ttacttaaacagaaatgcagaa

SEQ ID NO: 76047 - DNA, 22 bp, Homo sapiens
caggccagggttgagaagagaa

SEQ ID NO: 76048 - DNA, 22 bp, Homo sapiens
tccaccatgtaacaagctctgt

SEQ ID NO: 76049 - DNA, 22 bp, Homo sapiens
ttatttaatgtgatctgaagag

SEQ ID NO: 76050 - DNA, 22 bp, Homo sapiens
tatccaattcaccattgatggg

SEQ ID NO: 76051 - DNA, 22 bp, Homo sapiens
cacagagatggtctggcaggtg

SEQ ID NO: 76052 - DNA, 22 bp, Homo sapiens
gcctgcagggcctgggcctacc

SEQ ID NO: 76053 - DNA, 22 bp, Homo sapiens
ccctggaggttgaggctgcagt

SEQ ID NO: 76054 - DNA, 22 bp, Homo sapiens
tttgtcttatccaatctctcag

SEQ ID NO: 76055 - DNA, 22 bp, Homo sapiens
cactgcactccagcctgggtga

SEQ ID NO: 76056 - DNA, 22 bp, Homo sapiens
tcaaatgaagacagttgacttg

SEQ ID NO: 76057 - DNA, 22 bp, Homo sapiens
ttcaccatgttggccaggctgg

SEQ ID NO: 76058 - DNA, 22 bp, Homo sapiens
ggtatttcagtattatacaact

SEQ ID NO: 76059 - DNA, 22 bp, Homo sapiens
taaatgttgtaagtacatctaa

SEQ ID NO: 76060 - DNA, 22 bp, Homo sapiens
attgcacttcagcctgggtgac

SEQ ID NO: 76061 - DNA, 22 bp, Homo sapiens
gggagtgggtttggcctaggcc

SEQ ID NO: 76062 - DNA, 23 bp, Homo sapiens
cagagctggcttcatgggtgtgc

SEQ ID NO: 76063 - DNA, 22 bp, Homo sapiens
aagtgatgctacgactttgaca

SEQ ID NO: 76064 - DNA, 22 bp, Homo sapiens
agtccaggcattccagccattc

SEQ ID NO: 76065 - DNA, 22 bp, Homo sapiens
tccagggccatctccatgaggc

SEQ ID NO: 76066 - DNA, 22 bp, Homo sapiens
tagcccctgcctttgaacctgg

SEQ ID NO: 76067 - DNA, 22 bp, Homo sapiens
agtgggtgtagtcttcctcctg

SEQ ID NO: 76068 - DNA, 22 bp, Homo sapiens
ttctcttttcaccagttgctaa

SEQ ID NO: 76069 - DNA, 22 bp, Homo sapiens
atgcagaagactgaaaagctga

SEQ ID NO: 76070 - DNA, 23 bp, Homo sapiens
ggagtgcaatggcgccatctcgg

SEQ ID NO: 76071 - DNA, 22 bp, Homo sapiens
ggccctggtcctaggggtggaa

SEQ ID NO: 76072 - DNA, 18 bp, Homo sapiens
gatcgggggcgccccaag

SEQ ID NO: 76073 - DNA, 22 bp, Homo sapiens
aggggaggtgtccccaaatctc

SEQ ID NO: 76074 - DNA, 22 bp, Homo sapiens
atgccactgcacttcagcttgg

SEQ ID NO: 76075 - DNA, 22 bp, Homo sapiens
ctctttggatagaattacaaag

SEQ ID NO: 76076 - DNA, 17 bp, Homo sapiens
cttcccaccatctcctg

SEQ ID NO: 76077 - DNA, 22 bp, Homo sapiens
ctcctctttagccccagctgga

SEQ ID NO: 76078 - DNA, 22 bp, Homo sapiens
tggtatgtaaattgtaactcaa

SEQ ID NO: 76079 - DNA, 22 bp, Homo sapiens
gagaggtggaggttgcagtgag

SEQ ID NO: 76080 - DNA, 22 bp, Homo sapiens
ggcctttgcgtccacgccgctt

SEQ ID NO: 76081 - DNA, 22 bp, Homo sapiens
tctgcaggtaagcgttcttgga

SEQ ID NO: 76082 - DNA, 22 bp, Homo sapiens
ctatgaccccagcatgaataag

SEQ ID NO: 76083 - DNA, 22 bp, Homo sapiens
ggaggagcatgagagggtagtg

SEQ ID NO: 76084 - DNA, 22 bp, Homo sapiens
gggtaaatctcttttcatggct

SEQ ID NO: 76085 - DNA, 22 bp, Homo sapiens
atatccagcagcaggtgagtat

SEQ ID NO: 76086 - DNA, 22 bp, Homo sapiens
gggctgcatcagcaggacccgg

SEQ ID NO: 76087 - DNA, 22 bp, Homo sapiens
cgttttcatgggtagaggttct

SEQ ID NO: 76088 - DNA, 22 bp, Homo sapiens
tttctcctcatgactggttgtg

SEQ ID NO: 76089 - DNA, 22 bp, Homo sapiens
cccacacacatttatgatagga

SEQ ID NO: 76090 - DNA, 22 bp, Homo sapiens
agggcgctgaaatactaacatg

SEQ ID NO: 76091 - DNA, 19 bp, Homo sapiens
aggattccagaacagtgtt

SEQ ID NO: 76092 - DNA, 22 bp, Homo sapiens
tcactgcgcttcagcctgggtg

SEQ ID NO: 76093 - DNA, 22 bp, Homo sapiens
atgttctacagatggaaagggg

SEQ ID NO: 76094 - DNA, 22 bp, Homo sapiens
gtagagttgagtagtggtaaca

SEQ ID NO: 76095 - DNA, 22 bp, Homo sapiens
gaagttctttatagcagtgtga

SEQ ID NO: 76096 - DNA, 22 bp, Homo sapiens
gctgctgcttgaaggctcggag

SEQ ID NO: 76097 - DNA, 22 bp, Homo sapiens
actttaaaactgatcatcagag

SEQ ID NO: 76098 - DNA, 22 bp, Homo sapiens
agtctagtaggatctctgggct

SEQ ID NO: 76099 - DNA, 18 bp, Homo sapiens
ccatcaccctaactagtg

SEQ ID NO: 76100 - DNA, 22 bp, Homo sapiens
aaggggaagagaccgcagagtc

SEQ ID NO: 76101 - DNA, 22 bp, Homo sapiens
cctcttctaggacgtccttgtg

SEQ ID NO: 76102 - DNA, 22 bp, Homo sapiens
tggttcctcaagcgctggcggc

SEQ ID NO: 76103 - DNA, 22 bp, Homo sapiens
ttgtggttaaccgcacattttt

SEQ ID NO: 76104 - DNA, 22 bp, Homo sapiens
taggccacagagaggagatttc

SEQ ID NO: 76105 - DNA, 22 bp, Homo sapiens
cagtcctgaatactggacggtg

SEQ ID NO: 76106 - DNA, 22 bp, Homo sapiens
tcagtgttaatcagtggtacct

SEQ ID NO: 76107 - DNA, 23 bp, Homo sapiens
ggaagctcacgtagtcctgcact

SEQ ID NO: 76108 - DNA, 22 bp, Homo sapiens
agagagcccgggccagggcaca

SEQ ID NO: 76109 - DNA, 22 bp, Homo sapiens
tcaaaaagttgaagagttgggg

SEQ ID NO: 76110 - DNA, 22 bp, Homo sapiens
gacccggctccaggcccagcag

SEQ ID NO: 76111 - DNA, 22 bp, Homo sapiens
tgtccttatctccaaacaatca

SEQ ID NO: 76112 - DNA, 22 bp, Homo sapiens
cgtctggcttctccacggtaaa

SEQ ID NO: 76113 - DNA, 22 bp, Homo sapiens
tctttcattctagtctgaggtt

SEQ ID NO: 76114 - DNA, 22 bp, Homo sapiens
catcatactgtttacactcaaa

SEQ ID NO: 76115 - DNA, 22 bp, Homo sapiens
ggaggagacagtaaaaagcacg

SEQ ID NO: 76116 - DNA, 22 bp, Homo sapiens
ctacattaaattggcttactta

SEQ ID NO: 76117 - DNA, 22 bp, Homo sapiens
tagcagcatttttgtagagtat

SEQ ID NO: 76118 - DNA, 22 bp, Homo sapiens
tcattgccatggcatttgcaga

SEQ ID NO: 76119 - DNA, 22 bp, Homo sapiens
tttcagatggaggtttaggaca

SEQ ID NO: 76120 - DNA, 22 bp, Homo sapiens
aggccagcagcatgacggcatc

SEQ ID NO: 76121 - DNA, 18 bp, Homo sapiens
tgagagcattcgaggcaa

SEQ ID NO: 76122 - DNA, 22 bp, Homo sapiens
ggccctgggccctctagcttgt

SEQ ID NO: 76123 - DNA, 22 bp, Homo sapiens
caggcagaagaagtggaaggac

SEQ ID NO: 76124 - DNA, 22 bp, Homo sapiens
tagcaaaggatgactatgtacc

SEQ ID NO: 76125 - DNA, 22 bp, Homo sapiens
ttgcacagaatgacaatatgta

SEQ ID NO: 76126 - DNA, 22 bp, Homo sapiens
gataccagacagggagggagaa

SEQ ID NO: 76127 - DNA, 22 bp, Homo sapiens
tactgtgtgcccagccgagctg

SEQ ID NO: 76128 - DNA, 22 bp, Homo sapiens
gctgctgggatcctgggtctca

SEQ ID NO: 76129 - DNA, 22 bp, Homo sapiens
tcagtgcagggtgggagagaga

SEQ ID NO: 76130 - DNA, 20 bp, Homo sapiens
tcccccactgtttctgctac

SEQ ID NO: 76131 - DNA, 22 bp, Homo sapiens
aagagagtcagtctgagcacca

SEQ ID NO: 76132 - DNA, 23 bp, Homo sapiens
gatgaggacctacaggtggccag

SEQ ID NO: 76133 - DNA, 22 bp, Homo sapiens
gtatcacttttgagagtgagaa

SEQ ID NO: 76134 - DNA, 19 bp, Homo sapiens
taggaccctggtggccccc

SEQ ID NO: 76135 - DNA, 22 bp, Homo sapiens
tgaacgcaggtccacatggctc

SEQ ID NO: 76136 - DNA, 22 bp, Homo sapiens
aaatcgcttgaacccaggaagt

SEQ ID NO: 76137 - DNA, 22 bp, Homo sapiens
aggcaaggtgctacagacagtg

SEQ ID NO: 76138 - DNA, 22 bp, Homo sapiens
cagagcttcctgctgggcttct

SEQ ID NO: 76139 - DNA, 22 bp, Homo sapiens
tttatgtagttacggactatca

SEQ ID NO: 76140 - DNA, 22 bp, Homo sapiens
ggtgacagtggttaaaatttgt

SEQ ID NO: 76141 - DNA, 22 bp, Homo sapiens
gcaggtctgttgattacagtca

SEQ ID NO: 76142 - DNA, 22 bp, Homo sapiens
gacaggaggcagagctcaggtg

SEQ ID NO: 76143 - DNA, 22 bp, Homo sapiens
tgttttaagctctagaagggga

SEQ ID NO: 76144 - DNA, 22 bp, Homo sapiens
tagcccttgatgctgcggccag

SEQ ID NO: 76145 - DNA, 22 bp, Homo sapiens
gcggggggaggaacatcttgca

SEQ ID NO: 76146 - DNA, 22 bp, Homo sapiens
cactgcaagctctgccacctgg

SEQ ID NO: 76147 - DNA, 22 bp, Homo sapiens
agaaaatgtgaacttgtgaatt

SEQ ID NO: 76148 - DNA, 22 bp, Homo sapiens
tccacaaggcagctcctccagg

SEQ ID NO: 76149 - DNA, 22 bp, Homo sapiens
aggggaggtgtccccaaatctc

SEQ ID NO: 76150 - DNA, 22 bp, Homo sapiens
gggcggggtggctcatgcctgt

SEQ ID NO: 76151 - DNA, 22 bp, Homo sapiens
atacctgtgtatccacaagcgt

SEQ ID NO: 76152 - DNA, 22 bp, Homo sapiens
cccaggaggtggagttcacagt

SEQ ID NO: 76153 - DNA, 22 bp, Homo sapiens
tttaggttttttcacgtggcta

SEQ ID NO: 76154 - DNA, 22 bp, Homo sapiens
gggcaggggtcagtggccccaa

SEQ ID NO: 76155 - DNA, 22 bp, Homo sapiens
cccccagctctgctgggtcccg

SEQ ID NO: 76156 - DNA, 22 bp, Homo sapiens
ctcatcagaaatacctgacaaa

SEQ ID NO: 76157 - DNA, 22 bp, Homo sapiens
tcttgaattgtactcccataag

SEQ ID NO: 76158 - DNA, 22 bp, Homo sapiens
ggggtgggcgtgcagggacacc

SEQ ID NO: 76159 - DNA, 22 bp, Homo sapiens
atgcccaatgtcacaatttttg

SEQ ID NO: 76160 - DNA, 22 bp, Homo sapiens
acctgcaggcacaggtgtgcgc

SEQ ID NO: 76161 - DNA, 22 bp, Homo sapiens
gcagatggatgtggacggcgcc

SEQ ID NO: 76162 - DNA, 22 bp, Homo sapiens
gatggcctcatggctgcaggcc

SEQ ID NO: 76163 - DNA, 22 bp, Homo sapiens
tcactacaaccgctacctgaca

SEQ ID NO: 76164 - DNA, 22 bp, Homo sapiens
agcccttagtacatttctcaag

SEQ ID NO: 76165 - DNA, 22 bp, Homo sapiens
gcccaggctggagtgcagtggt

SEQ ID NO: 76166 - DNA, 18 bp, Homo sapiens
tgtccctgcaaataacat

SEQ ID NO: 76167 - DNA, 22 bp, Homo sapiens
ggagagtggattccagctgtat

SEQ ID NO: 76168 - DNA, 22 bp, Homo sapiens
tctatgcttgagacagatgggg

SEQ ID NO: 76169 - DNA, 22 bp, Homo sapiens
agagggtgggcacgtgatggat

SEQ ID NO: 76170 - DNA, 22 bp, Homo sapiens
cccaggaggtggaggctgcagt

SEQ ID NO: 76171 - DNA, 22 bp, Homo sapiens
gaggtaacactgttcagtgggc

SEQ ID NO: 76172 - DNA, 22 bp, Homo sapiens
cgcccaggctggagtgcagtgg

SEQ ID NO: 76173 - DNA, 22 bp, Homo sapiens
ccctggaggcggagcttgcagt

SEQ ID NO: 76174 - DNA, 22 bp, Homo sapiens
gttgggaatttattccttttct

SEQ ID NO: 76175 - DNA, 22 bp, Homo sapiens
tgagcttccctcctgcactaca

SEQ ID NO: 76176 - DNA, 22 bp, Homo sapiens
agggtgaatctcacaactctta

SEQ ID NO: 76177 - DNA, 22 bp, Homo sapiens
ctggtctggctacccagcgaat

SEQ ID NO: 76178 - DNA, 22 bp, Homo sapiens
agaaggggcccaaggatgtcag

SEQ ID NO: 76179 - DNA, 22 bp, Homo sapiens
ctgggaggcggaggttgcagtg

SEQ ID NO: 76180 - DNA, 22 bp, Homo sapiens
tgcagtcttccagctgcacaaa

SEQ ID NO: 76181 - DNA, 22 bp, Homo sapiens
cagggggctcaaaggagagtgc

SEQ ID NO: 76182 - DNA, 22 bp, Homo sapiens
ctgaggcaggagagttgcttga

SEQ ID NO: 76183 - DNA, 22 bp, Homo sapiens
atgcacacgtaccctacaaggc

SEQ ID NO: 76184 - DNA, 22 bp, Homo sapiens
caggggcggtggctcacgcctg

SEQ ID NO: 76185 - DNA, 22 bp, Homo sapiens
gctgacccctacaggttgtgtt

SEQ ID NO: 76186 - DNA, 22 bp, Homo sapiens
gcaggtctatcaggctgcaggt

SEQ ID NO: 76187 - DNA, 22 bp, Homo sapiens
ttgtgctcctgtgagaatctag

SEQ ID NO: 76188 - DNA, 22 bp, Homo sapiens
tctagctctgcttatcatggct

SEQ ID NO: 76189 - DNA, 22 bp, Homo sapiens
ctacattaaattggcttactta

SEQ ID NO: 76190 - DNA, 22 bp, Homo sapiens
gagaggaagccttctgtacttg

SEQ ID NO: 76191 - DNA, 22 bp, Homo sapiens
ggaagggcaaaagagatgaact

SEQ ID NO: 76192 - DNA, 22 bp, Homo sapiens
gtgaaatatttaacgtccaggt

SEQ ID NO: 76193 - DNA, 22 bp, Homo sapiens
gaggctgaggttgcagtgagcc

SEQ ID NO: 76194 - DNA, 22 bp, Homo sapiens
agcctgcgatcccacctggcct

SEQ ID NO: 76195 - DNA, 22 bp, Homo sapiens
ggctcactgcaacttccgcctc

SEQ ID NO: 76196 - DNA, 22 bp, Homo sapiens
gatgtagacacttggaggctta

SEQ ID NO: 76197 - DNA, 22 bp, Homo sapiens
gcaggagaacaaagcaagctgc

SEQ ID NO: 76198 - DNA, 22 bp, Homo sapiens
ccttttgctctcccatccagaa

SEQ ID NO: 76199 - DNA, 22 bp, Homo sapiens
ctctggaggtggaggttgcagt

SEQ ID NO: 76200 - DNA, 22 bp, Homo sapiens
ttgcctgtgtcagcaggtggaa

SEQ ID NO: 76201 - DNA, 22 bp, Homo sapiens
ggagtgactctcggggccacta

SEQ ID NO: 76202 - DNA, 22 bp, Homo sapiens
atgaaaacggaccagagctatt

SEQ ID NO: 76203 - DNA, 22 bp, Homo sapiens
cactgcaccctcaaactcctgg

SEQ ID NO: 76204 - DNA, 22 bp, Homo sapiens
aggtgggcgctgctcccgctgg

SEQ ID NO: 76205 - DNA, 22 bp, Homo sapiens
cctggcctttgaacgctagact

SEQ ID NO: 76206 - DNA, 22 bp, Homo sapiens
gtcagcgtgctcagcctattat

SEQ ID NO: 76207 - DNA, 22 bp, Homo sapiens
ctccagttggccccagttggtt

SEQ ID NO: 76208 - DNA, 22 bp, Homo sapiens
caccatgcccggctaattttgg

SEQ ID NO: 76209 - DNA, 22 bp, Homo sapiens
gcccagtggtaaaagcaggcct

SEQ ID NO: 76210 - DNA, 22 bp, Homo sapiens
ttgcccaggctggagtgcagta

SEQ ID NO: 76211 - DNA, 22 bp, Homo sapiens
ttgatcaaatcagctactgagg

SEQ ID NO: 76212 - DNA, 20 bp, Homo sapiens
ccagagctgatggctgcccg

SEQ ID NO: 76213 - DNA, 22 bp, Homo sapiens
caggagtgtctccacacagcaa

SEQ ID NO: 76214 - DNA, 22 bp, Homo sapiens
ccagcatccatgctccctcggg

SEQ ID NO: 76215 - DNA, 22 bp, Homo sapiens
agtgaggggcagctgagtgggc

SEQ ID NO: 76216 - DNA, 22 bp, Homo sapiens
taagggttcagaatgcagtggt

SEQ ID NO: 76217 - DNA, 22 bp, Homo sapiens
tcagaattgtggagaaagggga

SEQ ID NO: 76218 - DNA, 22 bp, Homo sapiens
cccctcttggcattgagtgcca

SEQ ID NO: 76219 - DNA, 22 bp, Homo sapiens
tgaaggggttcagcatgggggt

SEQ ID NO: 76220 - DNA, 21 bp, Homo sapiens
gggcctggctgcgcaggacgg

SEQ ID NO: 76221 - DNA, 22 bp, Homo sapiens
aagccaggttccatggaggagc

SEQ ID NO: 76222 - DNA, 22 bp, Homo sapiens
cctccccacagcccaggagact

SEQ ID NO: 76223 - DNA, 22 bp, Homo sapiens
caaagtgctgggattacaggct

SEQ ID NO: 76224 - DNA, 19 bp, Homo sapiens
ctctggagtcattgctccc

SEQ ID NO: 76225 - DNA, 22 bp, Homo sapiens
attgcactccagcctgggggac

SEQ ID NO: 76226 - DNA, 22 bp, Homo sapiens
tggctccacaggccagggtgtg

SEQ ID NO: 76227 - DNA, 22 bp, Homo sapiens
aagctgcagcacagagaggtgg

SEQ ID NO: 76228 - DNA, 19 bp, Homo sapiens
agccagccagcaggtatgc

SEQ ID NO: 76229 - DNA, 22 bp, Homo sapiens
aggaaggcttctttggtcttct

SEQ ID NO: 76230 - DNA, 22 bp, Homo sapiens
gtcagatctttggggatgctgt

SEQ ID NO: 76231 - DNA, 22 bp, Homo sapiens
actgcaacctccacctcctggg

SEQ ID NO: 76232 - DNA, 22 bp, Homo sapiens
cagctggttgaagaggagctgg

SEQ ID NO: 76233 - DNA, 22 bp, Homo sapiens
ccttctagcaaatcaacataaa

SEQ ID NO: 76234 - DNA, 22 bp, Homo sapiens
aaagaggcaatcaatgtagcaa

SEQ ID NO: 76235 - DNA, 22 bp, Homo sapiens
cgggttcacgccattctcctgc

SEQ ID NO: 76236 - DNA, 22 bp, Homo sapiens
actcaaatagcaacggtgagaa

SEQ ID NO: 76237 - DNA, 22 bp, Homo sapiens
gtcagtgtcttaacagagatta

SEQ ID NO: 76238 - DNA, 23 bp, Homo sapiens
gtgcgccaggacaacctgacgga

SEQ ID NO: 76239 - DNA, 22 bp, Homo sapiens
attttctctttgtatatgctag

SEQ ID NO: 76240 - DNA, 22 bp, Homo sapiens
ggagctcctggcagtgacagag

SEQ ID NO: 76241 - DNA, 22 bp, Homo sapiens
accagcctggccaacatggcaa

SEQ ID NO: 76242 - DNA, 22 bp, Homo sapiens
caggaaggggctcactctggcc

SEQ ID NO: 76243 - DNA, 22 bp, Homo sapiens
ccaggtgtgctctgcagtggat

SEQ ID NO: 76244 - DNA, 22 bp, Homo sapiens
aaagtgcaaggattacaggcat

SEQ ID NO: 76245 - DNA, 22 bp, Homo sapiens
aggcaagggggcgccaccttcc

SEQ ID NO: 76246 - DNA, 22 bp, Homo sapiens
agaaaatttaaagagacacaca

SEQ ID NO: 76247 - DNA, 22 bp, Homo sapiens
cagcacatgctcatcagggaag

SEQ ID NO: 76248 - DNA, 22 bp, Homo sapiens
gcaactgaacatgtgtgtggcc

SEQ ID NO: 76249 - DNA, 22 bp, Homo sapiens
ctgggctcaagtgatccaccca

SEQ ID NO: 76250 - DNA, 22 bp, Homo sapiens
aaagtgctgggattacaggtgt

SEQ ID NO: 76251 - DNA, 23 bp, Homo sapiens
agctctgctcgggcatgccctgc

SEQ ID NO: 76252 - DNA, 22 bp, Homo sapiens
gcctcctgtcccaggctgagga

SEQ ID NO: 76253 - DNA, 22 bp, Homo sapiens
tcctgggaggcggaggttgcag

SEQ ID NO: 76254 - DNA, 22 bp, Homo sapiens
tgagcccagagatctgagctat

SEQ ID NO: 76255 - DNA, 22 bp, Homo sapiens
aaggaggcctggcagatgaaga

SEQ ID NO: 76256 - DNA, 22 bp, Homo sapiens
agcacctccagagcttgaagct

SEQ ID NO: 76257 - DNA, 22 bp, Homo sapiens
agtgactggtgtgaagttaaat

SEQ ID NO: 76258 - DNA, 22 bp, Homo sapiens
ctggcctagacagaccctgatc

SEQ ID NO: 76259 - DNA, 22 bp, Homo sapiens
tgagataatcatgtgatttcat

SEQ ID NO: 76260 - DNA, 22 bp, Homo sapiens
catccaggctgaagtgcagtgg

SEQ ID NO: 76261 - DNA, 22 bp, Homo sapiens
cacagacagtgtccctttgttg

SEQ ID NO: 76262 - DNA, 22 bp, Homo sapiens
agcctggtttaagcattttata

SEQ ID NO: 76263 - DNA, 22 bp, Homo sapiens
agaggcaggaggttgacttgag

SEQ ID NO: 76264 - DNA, 22 bp, Homo sapiens
ccctctacagggaagcgctttc

SEQ ID NO: 76265 - DNA, 22 bp, Homo sapiens
ttatttaatgtgatctgaagag

SEQ ID NO: 76266 - DNA, 22 bp, Homo sapiens
tgtggacgtcattaaagcagtg

SEQ ID NO: 76267 - DNA, 22 bp, Homo sapiens
tccaagatctacagcagtttag

SEQ ID NO: 76268 - DNA, 19 bp, Homo sapiens
taaaacgtgcatggcagca

SEQ ID NO: 76269 - DNA, 18 bp, Homo sapiens
tcttcatctcctgagctg

SEQ ID NO: 76270 - DNA, 22 bp, Homo sapiens
tgggcaaggctggagcctgcag

SEQ ID NO: 76271 - DNA, 22 bp, Homo sapiens
ggccttggcctagccctccagg

SEQ ID NO: 76272 - DNA, 22 bp, Homo sapiens
ggcatgattttggctcactgca

SEQ ID NO: 76273 - DNA, 22 bp, Homo sapiens
gcaaaagtacagccggatttct

SEQ ID NO: 76274 - DNA, 22 bp, Homo sapiens
tgagcctgggtggtcgaggctg

SEQ ID NO: 76275 - DNA, 23 bp, Homo sapiens
ccatcccttggaagctggtttta

SEQ ID NO: 76276 - DNA, 22 bp, Homo sapiens
tgggccacacacagaagaatca

SEQ ID NO: 76277 - DNA, 22 bp, Homo sapiens
taggctgggggtaggaattgag

SEQ ID NO: 76278 - DNA, 22 bp, Homo sapiens
cccaggaggtggagcttgcagt

SEQ ID NO: 76279 - DNA, 22 bp, Homo sapiens
ttatacagggagtttccctgca

SEQ ID NO: 76280 - DNA, 22 bp, Homo sapiens
aggctagaggcttctggcttca

SEQ ID NO: 76281 - DNA, 22 bp, Homo sapiens
gggaggttgaggctgcagtgag

SEQ ID NO: 76282 - DNA, 22 bp, Homo sapiens
gatgtgtttccaggatttgttt

SEQ ID NO: 76283 - DNA, 22 bp, Homo sapiens
gaggctgaggttgcagtgagct

SEQ ID NO: 76284 - DNA, 22 bp, Homo sapiens
gctgtgtatcagatgccacggg

SEQ ID NO: 76285 - DNA, 22 bp, Homo sapiens
gatgctgagaggtggagggaac

SEQ ID NO: 76286 - DNA, 17 bp, Homo sapiens
gaggccaaggcaggcgg

SEQ ID NO: 76287 - DNA, 22 bp, Homo sapiens
ctctgcctcccaggttcaagcg

SEQ ID NO: 76288 - DNA, 22 bp, Homo sapiens
gggaaggaaagttattagcaga

SEQ ID NO: 76289 - DNA, 22 bp, Homo sapiens
cactgcactccatcctgggaaa

SEQ ID NO: 76290 - DNA, 22 bp, Homo sapiens
ccggcgtctcttccacttccta

SEQ ID NO: 76291 - DNA, 22 bp, Homo sapiens
ccaaagtgctggggttacaggc

SEQ ID NO: 76292 - DNA, 22 bp, Homo sapiens
gccctcctggcaggcagtgatg

SEQ ID NO: 76293 - DNA, 22 bp, Homo sapiens
atttagacatgtatctgatagc

SEQ ID NO: 76294 - DNA, 22 bp, Homo sapiens
ggaggtagcctcaaaagcagct

SEQ ID NO: 76295 - DNA, 22 bp, Homo sapiens
gtatccatgggggattggttcc

SEQ ID NO: 76296 - DNA, 22 bp, Homo sapiens
tctgtcttagccatctcaggct

SEQ ID NO: 76297 - DNA, 22 bp, Homo sapiens
catgagatttgggaggggccag

SEQ ID NO: 76298 - DNA, 22 bp, Homo sapiens
tcatggcttttattatgttgag

SEQ ID NO: 76299 - DNA, 22 bp, Homo sapiens
tgtgtcccttggaacctcagct

SEQ ID NO: 76300 - DNA, 22 bp, Homo sapiens
tcatcagaggcatctggcaagg

SEQ ID NO: 76301 - DNA, 22 bp, Homo sapiens
cccaggaggcagaagttgcagt

SEQ ID NO: 76302 - DNA, 20 bp, Homo sapiens
ttcgctgggagtggccaggc

SEQ ID NO: 76303 - DNA, 22 bp, Homo sapiens
cctacagttatattcttgattg

SEQ ID NO: 76304 - DNA, 22 bp, Homo sapiens
atccatttgacataatttcagc

SEQ ID NO: 76305 - DNA, 22 bp, Homo sapiens
aacactatctgccttacaggga

SEQ ID NO: 76306 - DNA, 22 bp, Homo sapiens
ttgtgctcctatgagaatctaa

SEQ ID NO: 76307 - DNA, 22 bp, Homo sapiens
ggtgtagctctgtgtcccactg

SEQ ID NO: 76308 - DNA, 22 bp, Homo sapiens
atggggagctcaccacctgttt

SEQ ID NO: 76309 - DNA, 22 bp, Homo sapiens
aaaaagtattggccatggttga

SEQ ID NO: 76310 - DNA, 22 bp, Homo sapiens
accaggcccgctgctatggtgg

SEQ ID NO: 76311 - DNA, 22 bp, Homo sapiens
caggctgaagtgcagtggtgtg

SEQ ID NO: 76312 - DNA, 22 bp, Homo sapiens
cacatttttactgccaacttaa

SEQ ID NO: 76313 - DNA, 22 bp, Homo sapiens
aaagcagaggttgcagtgagct

SEQ ID NO: 76314 - DNA, 22 bp, Homo sapiens
ctgggaggtggaggttgcattg

SEQ ID NO: 76315 - DNA, 22 bp, Homo sapiens
cagatgtacatgaagggcaatg

SEQ ID NO: 76316 - DNA, 22 bp, Homo sapiens
ctctctgggcccagttggcacc

SEQ ID NO: 76317 - DNA, 22 bp, Homo sapiens
accctcaacaaattcactctat

SEQ ID NO: 76318 - DNA, 22 bp, Homo sapiens
gagtccaagctagagccactca

SEQ ID NO: 76319 - DNA, 22 bp, Homo sapiens
ctggggaacgcagcgagcagcg

SEQ ID NO: 76320 - DNA, 22 bp, Homo sapiens
cacctagggtttcgcctttctt

SEQ ID NO: 76321 - DNA, 20 bp, Homo sapiens
acgtggccaccagtggctta

SEQ ID NO: 76322 - DNA, 22 bp, Homo sapiens
gccatcatatcccctgtgacct

SEQ ID NO: 76323 - DNA, 22 bp, Homo sapiens
tggggagtgatgcctcggataa

SEQ ID NO: 76324 - DNA, 22 bp, Homo sapiens
gttctgagtcctcctttgaagg

SEQ ID NO: 76325 - DNA, 22 bp, Homo sapiens
caggagctcagatgacatctca

SEQ ID NO: 76326 - DNA, 22 bp, Homo sapiens
ataatacatggttgatcttttc

SEQ ID NO: 76327 - DNA, 22 bp, Homo sapiens
tttgtgaataggttggcttcca

SEQ ID NO: 76328 - DNA, 22 bp, Homo sapiens
caaagtgctaggattacaggcc

SEQ ID NO: 76329 - DNA, 22 bp, Homo sapiens
gttgaggtgatgccagccctgc

SEQ ID NO: 76330 - DNA, 22 bp, Homo sapiens
ctatgaccccagcatgaataag

SEQ ID NO: 76331 - DNA, 22 bp, Homo sapiens
tgagatgagatttcactgtcct

SEQ ID NO: 76332 - DNA, 22 bp, Homo sapiens
aaaacgatgtttaaaagctctg

SEQ ID NO: 76333 - DNA, 22 bp, Homo sapiens
ggcaaggggtcaggctgagaca

SEQ ID NO: 76334 - DNA, 22 bp, Homo sapiens
cagctacaaatacttttgtatg

SEQ ID NO: 76335 - DNA, 22 bp, Homo sapiens
agaagccaccagctgaggaaga

SEQ ID NO: 76336 - DNA, 22 bp, Homo sapiens
tgagtgtggggaatgtcatgag

SEQ ID NO: 76337 - DNA, 22 bp, Homo sapiens
ggcagggcaggaaagtcaggaa

SEQ ID NO: 76338 - DNA, 18 bp, Homo sapiens
cagggctgtggggtcact

SEQ ID NO: 76339 - DNA, 22 bp, Homo sapiens
ggtgccaggctgtagtcagggt

SEQ ID NO: 76340 - DNA, 22 bp, Homo sapiens
aagcccttggcgcacaccgggc

SEQ ID NO: 76341 - DNA, 22 bp, Homo sapiens
cagtggcgtgatctctgctcac

SEQ ID NO: 76342 - DNA, 22 bp, Homo sapiens
gtgtcctttccgggcctggagg

SEQ ID NO: 76343 - DNA, 22 bp, Homo sapiens
cttccgtgtcagttccaggtgg

SEQ ID NO: 76344 - DNA, 21 bp, Homo sapiens
aaactgaccttgcctgagaca

SEQ ID NO: 76345 - DNA, 22 bp, Homo sapiens
cgtgtggtcccggcaaggcaag

SEQ ID NO: 76346 - DNA, 22 bp, Homo sapiens
gtaaaaaggccaagcccttgtg

SEQ ID NO: 76347 - DNA, 22 bp, Homo sapiens
ttgcagatatttccgatgctat

SEQ ID NO: 76348 - DNA, 22 bp, Homo sapiens
ggagagcagggaggctgctctg

SEQ ID NO: 76349 - DNA, 22 bp, Homo sapiens
ctgtctgaatcctaagcttcct

SEQ ID NO: 76350 - DNA, 22 bp, Homo sapiens
gtgagccgagtatagttcatag

SEQ ID NO: 76351 - DNA, 22 bp, Homo sapiens
gctgtagtgaatggccgcgttc

SEQ ID NO: 76352 - DNA, 22 bp, Homo sapiens
agagctgggtggacttgtagtt

SEQ ID NO: 76353 - DNA, 22 bp, Homo sapiens
tgaagctacagaccttcgcggt

SEQ ID NO: 76354 - DNA, 22 bp, Homo sapiens
cctcttctaggacgtccttgtg

SEQ ID NO: 76355 - DNA, 22 bp, Homo sapiens
agcccagaggctgggcgtgcat

SEQ ID NO: 76356 - DNA, 22 bp, Homo sapiens
tctctttgcctgctgccatcca

SEQ ID NO: 76357 - DNA, 22 bp, Homo sapiens
aattacagtcggagcagcactg

SEQ ID NO: 76358 - DNA, 22 bp, Homo sapiens
gtacagaggttgctggaggctc

SEQ ID NO: 76359 - DNA, 22 bp, Homo sapiens
ggactgggaatcagggagatgc

SEQ ID NO: 76360 - DNA, 22 bp, Homo sapiens
cccagtttcaactttccagtgg

SEQ ID NO: 76361 - DNA, 22 bp, Homo sapiens
gagacctcttggtatcgctagg

SEQ ID NO: 76362 - DNA, 22 bp, Homo sapiens
gaggttggggctgcagtgagct

SEQ ID NO: 76363 - DNA, 22 bp, Homo sapiens
ctgcattaagttgcctgtaaga

SEQ ID NO: 76364 - DNA, 22 bp, Homo sapiens
gttgcctaggctggagtgcagt

SEQ ID NO: 76365 - DNA, 22 bp, Homo sapiens
cttaatctcacctgcaaagtcc

SEQ ID NO: 76366 - DNA, 22 bp, Homo sapiens
ttctgcagtgttaacaatgtca

SEQ ID NO: 76367 - DNA, 22 bp, Homo sapiens
actgcatttgtctgtctcaatt

SEQ ID NO: 76368 - DNA, 22 bp, Homo sapiens
tttgaaatgtatcagtataggt

SEQ ID NO: 76369 - DNA, 22 bp, Homo sapiens
ctcagggccaaggatgctgttg

SEQ ID NO: 76370 - DNA, 22 bp, Homo sapiens
ctgggaggcggagcttgcagtg

SEQ ID NO: 76371 - DNA, 22 bp, Homo sapiens
tcctccccaaagcccagcctgg

SEQ ID NO: 76372 - DNA, 22 bp, Homo sapiens
ttcatgggtccagagccctggg

SEQ ID NO: 76373 - DNA, 22 bp, Homo sapiens
gactgtggggaagcagatgcca

SEQ ID NO: 76374 - DNA, 22 bp, Homo sapiens
ttcaaatgatggcagtcctggc

SEQ ID NO: 76375 - DNA, 22 bp, Homo sapiens
ttcaaagcagagggtcaataca

SEQ ID NO: 76376 - DNA, 22 bp, Homo sapiens
aaagtgctgtgattacaggcat

SEQ ID NO: 76377 - DNA, 22 bp, Homo sapiens
tctgagaatggtggatgtggtg

SEQ ID NO: 76378 - DNA, 22 bp, Homo sapiens
ttaaattttagaaacagactct

SEQ ID NO: 76379 - DNA, 22 bp, Homo sapiens
aatgtgaggccttggtagttat

SEQ ID NO: 76380 - DNA, 22 bp, Homo sapiens
tgcaggctgtgtcatttagtga

SEQ ID NO: 76381 - DNA, 22 bp, Homo sapiens
gagcccgagcgcgtacccggcg

SEQ ID NO: 76382 - DNA, 22 bp, Homo sapiens
tacccagtgccaccctctgagg

SEQ ID NO: 76383 - DNA, 22 bp, Homo sapiens
cagcagcagtgttctagaatct

SEQ ID NO: 76384 - DNA, 22 bp, Homo sapiens
aagcatttcaggtagagatatt

SEQ ID NO: 76385 - DNA, 22 bp, Homo sapiens
gcaggcattagcccccatggct

SEQ ID NO: 76386 - DNA, 22 bp, Homo sapiens
attttttgttaactcaggatag

SEQ ID NO: 76387 - DNA, 22 bp, Homo sapiens
gaaaattattgaaaatggctct

SEQ ID NO: 76388 - DNA, 22 bp, Homo sapiens
tttacagcagcatgatttataa

SEQ ID NO: 76389 - DNA, 22 bp, Homo sapiens
tacataggtacagcctttttta

SEQ ID NO: 76390 - DNA, 21 bp, Homo sapiens
agcctcaggttgttggttctt

SEQ ID NO: 76391 - DNA, 22 bp, Homo sapiens
tggctgtgtccctgtccagagt

SEQ ID NO: 76392 - DNA, 22 bp, Homo sapiens
tcgcccaggctggaagtgcagt

SEQ ID NO: 76393 - DNA, 22 bp, Homo sapiens
ggggccgaccgcggttcaggcc

SEQ ID NO: 76394 - DNA, 22 bp, Homo sapiens
agcactgatttaaactggattt

SEQ ID NO: 76395 - DNA, 22 bp, Homo sapiens
caaaatgcatctgagaccaggc

SEQ ID NO: 76396 - DNA, 22 bp, Homo sapiens
ccaaagtgctgggattacaggt

SEQ ID NO: 76397 - DNA, 19 bp, Homo sapiens
ccacagcctgctgtcttcc

SEQ ID NO: 76398 - DNA, 22 bp, Homo sapiens
gcaggcggaggttgcagtgagc

SEQ ID NO: 76399 - DNA, 22 bp, Homo sapiens
tggaggctggagtgcagtggcg

SEQ ID NO: 76400 - DNA, 22 bp, Homo sapiens
agcctgggcaacagagcaaaac

SEQ ID NO: 76401 - DNA, 22 bp, Homo sapiens
ggtggcagtagcactgggcctg

SEQ ID NO: 76402 - DNA, 22 bp, Homo sapiens
tgatggggaattaattaatggg

SEQ ID NO: 76403 - DNA, 22 bp, Homo sapiens
tttgagtgcccatgtttcccag

SEQ ID NO: 76404 - DNA, 22 bp, Homo sapiens
ttttgacaatgctaatctcaat

SEQ ID NO: 76405 - DNA, 22 bp, Homo sapiens
tggcctcggcatccagcaagag

SEQ ID NO: 76406 - DNA, 22 bp, Homo sapiens
tcctggcttgtcacatctacgt

SEQ ID NO: 76407 - DNA, 22 bp, Homo sapiens
aatttcggttcaaggcccagtt

SEQ ID NO: 76408 - DNA, 22 bp, Homo sapiens
actttatttcctattgcatcca

SEQ ID NO: 76409 - DNA, 22 bp, Homo sapiens
acttttaaatgagtttcagttg

SEQ ID NO: 76410 - DNA, 22 bp, Homo sapiens
ttaccaaatgaaatagagattt

SEQ ID NO: 76411 - DNA, 22 bp, Homo sapiens
tttggactgcatgatgatctgg

SEQ ID NO: 76412 - DNA, 22 bp, Homo sapiens
cagggcctcctaaggcatctaa

SEQ ID NO: 76413 - DNA, 22 bp, Homo sapiens
ttttcatttttgtagatgcaag

SEQ ID NO: 76414 - DNA, 22 bp, Homo sapiens
agtggcctggagccccgcctgg

SEQ ID NO: 76415 - DNA, 22 bp, Homo sapiens
actaggggctcaggcccaggga

SEQ ID NO: 76416 - DNA, 22 bp, Homo sapiens
ctgtccctgagcaactcctgtt

SEQ ID NO: 76417 - DNA, 22 bp, Homo sapiens
cgagagatgggttggcaggggc

SEQ ID NO: 76418 - DNA, 22 bp, Homo sapiens
agcaagatttttcaggttagta

SEQ ID NO: 76419 - DNA, 22 bp, Homo sapiens
gaggccaaggtgggcagatcac

SEQ ID NO: 76420 - DNA, 22 bp, Homo sapiens
cagggtgctgcaccatccctca

SEQ ID NO: 76421 - DNA, 17 bp, Homo sapiens
aggaggccctggcgttt

SEQ ID NO: 76422 - DNA, 22 bp, Homo sapiens
aaatcggttggttcaaggtaat

SEQ ID NO: 76423 - DNA, 22 bp, Homo sapiens
tggaggttgggatgcttgtgat

SEQ ID NO: 76424 - DNA, 22 bp, Homo sapiens
cagctggcgactctcctcgatg

SEQ ID NO: 76425 - DNA, 22 bp, Homo sapiens
cttgcctacttgtcaaccagca

SEQ ID NO: 76426 - DNA, 22 bp, Homo sapiens
tcttggattttaatggatcaaa

SEQ ID NO: 76427 - DNA, 21 bp, Homo sapiens
ttgctgttttcccaatgcagt

SEQ ID NO: 76428 - DNA, 23 bp, Homo sapiens
gtgcatgtgtctttacagtagca

SEQ ID NO: 76429 - DNA, 22 bp, Homo sapiens
atgaaatatcttgaagaaattc

SEQ ID NO: 76430 - DNA, 22 bp, Homo sapiens
ctcggagggcaacagaagtgct

SEQ ID NO: 76431 - DNA, 22 bp, Homo sapiens
caagacttcaccgctctgtgct

SEQ ID NO: 76432 - DNA, 22 bp, Homo sapiens
ttctcaagaacatatgtagggt

SEQ ID NO: 76433 - DNA, 22 bp, Homo sapiens
gcctgacttgtgtattttacat

SEQ ID NO: 76434 - DNA, 22 bp, Homo sapiens
atgcttgcccatgtttctgaag

SEQ ID NO: 76435 - DNA, 22 bp, Homo sapiens
cagagatgtgatccagctgtct

SEQ ID NO: 76436 - DNA, 22 bp, Homo sapiens
gcctccggagtcacagtgtctt

SEQ ID NO: 76437 - DNA, 22 bp, Homo sapiens
ggcaagttctaatgattagaat

SEQ ID NO: 76438 - DNA, 22 bp, Homo sapiens
cagagagaatcttggcagctga

SEQ ID NO: 76439 - DNA, 22 bp, Homo sapiens
aatggaatcagtttctctaagt

SEQ ID NO: 76440 - DNA, 22 bp, Homo sapiens
gtaatagtctcaaactcctgga

SEQ ID NO: 76441 - DNA, 22 bp, Homo sapiens
aactatgttaataagtttcatt

SEQ ID NO: 76442 - DNA, 19 bp, Homo sapiens
catctggatgattctcctg

SEQ ID NO: 76443 - DNA, 22 bp, Homo sapiens
ggaggcggaggctgcagtgagc

SEQ ID NO: 76444 - DNA, 20 bp, Homo sapiens
tttgagaccagtctgcccaa

SEQ ID NO: 76445 - DNA, 22 bp, Homo sapiens
atgtcttctctgtaggtaaatt

SEQ ID NO: 76446 - DNA, 22 bp, Homo sapiens
acttgccccagaattgctgctg

SEQ ID NO: 76447 - DNA, 22 bp, Homo sapiens
gaggttcattcagctctgtcac

SEQ ID NO: 76448 - DNA, 22 bp, Homo sapiens
aggctaggaacagcccggccct

SEQ ID NO: 76449 - DNA, 22 bp, Homo sapiens
acatatgcgatcataggatgca

SEQ ID NO: 76450 - DNA, 22 bp, Homo sapiens
atggggggatgaaggagtccaa

SEQ ID NO: 76451 - DNA, 22 bp, Homo sapiens
ctagtgcaatgatgaatacaag

SEQ ID NO: 76452 - DNA, 22 bp, Homo sapiens
agacaaagaaaccgtagaagca

SEQ ID NO: 76453 - DNA, 22 bp, Homo sapiens
aaaactgaaatacgatccaatg

SEQ ID NO: 76454 - DNA, 22 bp, Homo sapiens
gatcgggtgggttctgccatca

SEQ ID NO: 76455 - DNA, 21 bp, Homo sapiens
tagcccttctccacctcgccc

SEQ ID NO: 76456 - DNA, 22 bp, Homo sapiens
aggtcaagggagctgagggcca

SEQ ID NO: 76457 - DNA, 21 bp, Homo sapiens
cttccccaggctggtctgtat

SEQ ID NO: 76458 - DNA, 22 bp, Homo sapiens
cctcggaggcggaggctgcagt

SEQ ID NO: 76459 - DNA, 22 bp, Homo sapiens
ttctcatgaaactcgcttcctc

SEQ ID NO: 76460 - DNA, 22 bp, Homo sapiens
gcagggtctgaggccacagagg

SEQ ID NO: 76461 - DNA, 22 bp, Homo sapiens
ggacctgaacataaaacgaggc

SEQ ID NO: 76462 - DNA, 22 bp, Homo sapiens
atcagagtgtaagttctttcct

SEQ ID NO: 76463 - DNA, 22 bp, Homo sapiens
caccgcggagtgatggagaaac

SEQ ID NO: 76464 - DNA, 22 bp, Homo sapiens
ttggagtgacagatgaggaaac

SEQ ID NO: 76465 - DNA, 22 bp, Homo sapiens
gggctgagacgatggggtcttc

SEQ ID NO: 76466 - DNA, 22 bp, Homo sapiens
tgacatttcctagtgctttgtg

SEQ ID NO: 76467 - DNA, 22 bp, Homo sapiens
gtcgtggagctcacagtgtgcc

SEQ ID NO: 76468 - DNA, 22 bp, Homo sapiens
acagattcactgcactggccat

SEQ ID NO: 76469 - DNA, 22 bp, Homo sapiens
tgacagtgaataagtctcttaa

SEQ ID NO: 76470 - DNA, 22 bp, Homo sapiens
gggcccctgggaattctgtgat

SEQ ID NO: 76471 - DNA, 22 bp, Homo sapiens
caactgctgggatggggtagag

SEQ ID NO: 76472 - DNA, 18 bp, Homo sapiens
aggtttggtggaaacata

SEQ ID NO: 76473 - DNA, 22 bp, Homo sapiens
tctcaagcttgttggtatgttt

SEQ ID NO: 76474 - DNA, 22 bp, Homo sapiens
gaggctgaggcggatggatcac

SEQ ID NO: 76475 - DNA, 22 bp, Homo sapiens
aggggaatgggtagactgttga

SEQ ID NO: 76476 - DNA, 22 bp, Homo sapiens
gctcactgcaagctccgcctcc

SEQ ID NO: 76477 - DNA, 22 bp, Homo sapiens
aatgccttggagagcctagagg

SEQ ID NO: 76478 - DNA, 22 bp, Homo sapiens
gtggggtagatctttctcagga

SEQ ID NO: 76479 - DNA, 23 bp, Homo sapiens
tcctcgcaggagggagatgatgc

SEQ ID NO: 76480 - DNA, 22 bp, Homo sapiens
gtgcatgtcggggtgcatgtca

SEQ ID NO: 76481 - DNA, 22 bp, Homo sapiens
aagggcctgccagctcttcatg

SEQ ID NO: 76482 - DNA, 22 bp, Homo sapiens
tcactgcaagctcagcctcccg

SEQ ID NO: 76483 - DNA, 22 bp, Homo sapiens
tcctggtgctgacacccatagc

SEQ ID NO: 76484 - DNA, 22 bp, Homo sapiens
tccaggctttggggcaggagcg

SEQ ID NO: 76485 - DNA, 22 bp, Homo sapiens
ggaggtgactggatcatgggca

SEQ ID NO: 76486 - DNA, 22 bp, Homo sapiens
ctggcctaaaaatacagaacaa

SEQ ID NO: 76487 - DNA, 22 bp, Homo sapiens
tgatcagcatcttcccagctcg

SEQ ID NO: 76488 - DNA, 22 bp, Homo sapiens
aacatagccagaatgtctcctg

SEQ ID NO: 76489 - DNA, 22 bp, Homo sapiens
gccctgggcaaggttctggcca

SEQ ID NO: 76490 - DNA, 23 bp, Homo sapiens
ggatggacgtgatgccttagcca

SEQ ID NO: 76491 - DNA, 22 bp, Homo sapiens
tcactgcaacctccacctcccg

SEQ ID NO: 76492 - DNA, 22 bp, Homo sapiens
actcccagaacatgctcttctt

SEQ ID NO: 76493 - DNA, 22 bp, Homo sapiens
tacctcaagttccaggaaagcg

SEQ ID NO: 76494 - DNA, 22 bp, Homo sapiens
ctttcaggagaggattataaca

SEQ ID NO: 76495 - DNA, 22 bp, Homo sapiens
atagcaacaccccaattttcta

SEQ ID NO: 76496 - DNA, 22 bp, Homo sapiens
ggcccaggctggagtgcagtgg

SEQ ID NO: 76497 - DNA, 22 bp, Homo sapiens
catgagatctgcagggatgggc

SEQ ID NO: 76498 - DNA, 22 bp, Homo sapiens
actgttgaagtgccagcttgat

SEQ ID NO: 76499 - DNA, 22 bp, Homo sapiens
gctggtagacctcactgcactc

SEQ ID NO: 76500 - DNA, 22 bp, Homo sapiens
catgctgggtaaaggtggtgaa

SEQ ID NO: 76501 - DNA, 22 bp, Homo sapiens
acccagccatgttcagttctct

SEQ ID NO: 76502 - DNA, 22 bp, Homo sapiens
atgcagccccctggtgcccggg

SEQ ID NO: 76503 - DNA, 22 bp, Homo sapiens
agtccaggactgtttcagctga

SEQ ID NO: 76504 - DNA, 22 bp, Homo sapiens
ctggaaggcagaggttgcagtg

SEQ ID NO: 76505 - DNA, 22 bp, Homo sapiens
caatagtaaattacggaggaga

SEQ ID NO: 76506 - DNA, 22 bp, Homo sapiens
tttgttttcaatgtgtcattca

SEQ ID NO: 76507 - DNA, 22 bp, Homo sapiens
cggggttcatccatgctgtggc

SEQ ID NO: 76508 - DNA, 22 bp, Homo sapiens
gaatgctaagcatgtgggagtt

SEQ ID NO: 76509 - DNA, 22 bp, Homo sapiens
ttggaagacaatgctgattctc

SEQ ID NO: 76510 - DNA, 22 bp, Homo sapiens
gagcaggaaggccagaagggtc

SEQ ID NO: 76511 - DNA, 22 bp, Homo sapiens
cccaggatggggctgcagttat

SEQ ID NO: 76512 - DNA, 22 bp, Homo sapiens
ccctctctgctgcatagaggaa

SEQ ID NO: 76513 - DNA, 22 bp, Homo sapiens
acacggcactttaggaaggggc

SEQ ID NO: 76514 - DNA, 22 bp, Homo sapiens
ctctgtagaaagagcccaggtg

SEQ ID NO: 76515 - DNA, 22 bp, Homo sapiens
ggcgccgcactcggtgcagccg

SEQ ID NO: 76516 - DNA, 22 bp, Homo sapiens
tggtacctgaatgaagggagga

SEQ ID NO: 76517 - DNA, 22 bp, Homo sapiens
ctgctcatcagccgagcagggc

SEQ ID NO: 76518 - DNA, 21 bp, Homo sapiens
agcgtcaatatcgtcaacagg

SEQ ID NO: 76519 - DNA, 23 bp, Homo sapiens
tgtgtcatggggaaagactcacc

SEQ ID NO: 76520 - DNA, 22 bp, Homo sapiens
tggggccatctcacccactgtt

SEQ ID NO: 76521 - DNA, 22 bp, Homo sapiens
gtggggtctgtcctcttctggg

SEQ ID NO: 76522 - DNA, 19 bp, Homo sapiens
tcctgcctggggccgcctg

SEQ ID NO: 76523 - DNA, 22 bp, Homo sapiens
tcaatcacgtgttccatgttct

SEQ ID NO: 76524 - DNA, 22 bp, Homo sapiens
gaaagacatagttgcaagatgg

SEQ ID NO: 76525 - DNA, 22 bp, Homo sapiens
ctggctgggagcgagctgctca

SEQ ID NO: 76526 - DNA, 22 bp, Homo sapiens
gatggcacacagacatccccgc

SEQ ID NO: 76527 - DNA, 22 bp, Homo sapiens
gtggattacaagacagttgaga

SEQ ID NO: 76528 - DNA, 22 bp, Homo sapiens
cactgttttacatgttatttaa

SEQ ID NO: 76529 - DNA, 22 bp, Homo sapiens
caggaacagggtgtcctggcag

SEQ ID NO: 76530 - DNA, 20 bp, Homo sapiens
tgatatggtttggctgtgtt

SEQ ID NO: 76531 - DNA, 22 bp, Homo sapiens
tatctaataaatctgataagta

SEQ ID NO: 76532 - DNA, 22 bp, Homo sapiens
agtggctgagtgactgtgactc

SEQ ID NO: 76533 - DNA, 23 bp, Homo sapiens
ttgcttagagacctcctcatcag

SEQ ID NO: 76534 - DNA, 22 bp, Homo sapiens
gactttgtgccaaacgccagaa

SEQ ID NO: 76535 - DNA, 22 bp, Homo sapiens
ttggttttgaaatagcttattg

SEQ ID NO: 76536 - DNA, 19 bp, Homo sapiens
tggctctgtcgaaggcaca

SEQ ID NO: 76537 - DNA, 22 bp, Homo sapiens
tctgcaacagtgccctgtaaat

SEQ ID NO: 76538 - DNA, 22 bp, Homo sapiens
atccccactgctgctggtgtag

SEQ ID NO: 76539 - DNA, 20 bp, Homo sapiens
caaatccctgctctgtgctg

SEQ ID NO: 76540 - DNA, 22 bp, Homo sapiens
gcacttgtggatttgatataca

SEQ ID NO: 76541 - DNA, 22 bp, Homo sapiens
aggtcaccatggcatgctccac

SEQ ID NO: 76542 - DNA, 19 bp, Homo sapiens
aggagcactgccagcacca

SEQ ID NO: 76543 - DNA, 22 bp, Homo sapiens
ttgagatgtcttttggcattat

SEQ ID NO: 76544 - DNA, 22 bp, Homo sapiens
tgcctgataccctctgtctctc

SEQ ID NO: 76545 - DNA, 22 bp, Homo sapiens
tggatatccttgttaactttct

SEQ ID NO: 76546 - DNA, 22 bp, Homo sapiens
caagggaattgtgtgtgagagg

SEQ ID NO: 76547 - DNA, 22 bp, Homo sapiens
ctcgggcaccctggttctggtg

SEQ ID NO: 76548 - DNA, 22 bp, Homo sapiens
atggctgcctgggcgctggccg

SEQ ID NO: 76549 - DNA, 22 bp, Homo sapiens
tagcagtgtctaggtaggccat

SEQ ID NO: 76550 - DNA, 22 bp, Homo sapiens
gagctgggcctgcgagtgctgc

SEQ ID NO: 76551 - DNA, 22 bp, Homo sapiens
aagaatgagctcaaagatctta

SEQ ID NO: 76552 - DNA, 22 bp, Homo sapiens
cctgcctactgagttttatatt

SEQ ID NO: 76553 - DNA, 22 bp, Homo sapiens
tttaaaaaactagtctgagtct

SEQ ID NO: 76554 - DNA, 22 bp, Homo sapiens
gataccagacagggagggagaa

SEQ ID NO: 76555 - DNA, 22 bp, Homo sapiens
ggcctgtaatcccagctactca

SEQ ID NO: 76556 - DNA, 22 bp, Homo sapiens
gcacggctaatttttgtatttt

SEQ ID NO: 76557 - DNA, 22 bp, Homo sapiens
gagggagggactagcattctct

SEQ ID NO: 76558 - DNA, 22 bp, Homo sapiens
ttacatgtggtgtgaagaagag

SEQ ID NO: 76559 - DNA, 16 bp, Homo sapiens
gaggagcccctctgcc

SEQ ID NO: 76560 - DNA, 22 bp, Homo sapiens
tggtcttagctggaaggaggga

SEQ ID NO: 76561 - DNA, 22 bp, Homo sapiens
agaaacgcctgtgaaattatct

SEQ ID NO: 76562 - DNA, 22 bp, Homo sapiens
gggctgcatcagcaggacccgg

SEQ ID NO: 76563 - DNA, 22 bp, Homo sapiens
ggagacagggttgaaccacgca

SEQ ID NO: 76564 - DNA, 22 bp, Homo sapiens
tctgacattttgagaatgacat

SEQ ID NO: 76565 - DNA, 22 bp, Homo sapiens
taatgtataacaaatactcatc

SEQ ID NO: 76566 - DNA, 20 bp, Homo sapiens
aggccccaggtggacactag

SEQ ID NO: 76567 - DNA, 22 bp, Homo sapiens
actgcatttggtaaagtcaaga

SEQ ID NO: 76568 - DNA, 22 bp, Homo sapiens
atgccactgcactccagcctgg

SEQ ID NO: 76569 - DNA, 22 bp, Homo sapiens
tgagcacatttcacatgacagg

SEQ ID NO: 76570 - DNA, 22 bp, Homo sapiens
tctgtgaagctctgaacagcag

SEQ ID NO: 76571 - DNA, 22 bp, Homo sapiens
gccagccagaaacgtcacactg

SEQ ID NO: 76572 - DNA, 22 bp, Homo sapiens
aaattacagccttgggtagctt

SEQ ID NO: 76573 - DNA, 22 bp, Homo sapiens
tcattgccatggcatttgcaga

SEQ ID NO: 76574 - DNA, 22 bp, Homo sapiens
ctcactgcaagctcagcctccc

SEQ ID NO: 76575 - DNA, 22 bp, Homo sapiens
tgagacgaagtcttgctctgtt

SEQ ID NO: 76576 - DNA, 22 bp, Homo sapiens
tctctggttatgtcattaagca

SEQ ID NO: 76577 - DNA, 22 bp, Homo sapiens
ccagagctgattcctgggactt

SEQ ID NO: 76578 - DNA, 22 bp, Homo sapiens
ttgtaagtcacaccagggcagg

SEQ ID NO: 76579 - DNA, 22 bp, Homo sapiens
tgacagtgcgggtacatcatag

SEQ ID NO: 76580 - DNA, 22 bp, Homo sapiens
tttgggcaggcttttccctaga

SEQ ID NO: 76581 - DNA, 22 bp, Homo sapiens
gcactgcaggtgggtggagagg

SEQ ID NO: 76582 - DNA, 22 bp, Homo sapiens
gtcctaccatgaattcactcca

SEQ ID NO: 76583 - DNA, 22 bp, Homo sapiens
atctggttttggctgtgtccct

SEQ ID NO: 76584 - DNA, 22 bp, Homo sapiens
ctgtggctctttagttgagcac

SEQ ID NO: 76585 - DNA, 22 bp, Homo sapiens
ggcatcgtcctgggcataggga

SEQ ID NO: 76586 - DNA, 21 bp, Homo sapiens
cctcaaagatgatggggtttc

SEQ ID NO: 76587 - DNA, 22 bp, Homo sapiens
gctcaagccttctgcccacctc

SEQ ID NO: 76588 - DNA, 22 bp, Homo sapiens
atctgggagcggaggttgcagt

SEQ ID NO: 76589 - DNA, 22 bp, Homo sapiens
gagcctcgtggcggccactgcg

SEQ ID NO: 76590 - DNA, 22 bp, Homo sapiens
gttatgatggcaccactgcact

SEQ ID NO: 76591 - DNA, 22 bp, Homo sapiens
aggggctcctttgtgctgcgtc

SEQ ID NO: 76592 - DNA, 22 bp, Homo sapiens
tgtgactggttgtcccgctttc

SEQ ID NO: 76593 - DNA, 22 bp, Homo sapiens
cccgactagctgggattacagg

SEQ ID NO: 76594 - DNA, 21 bp, Homo sapiens
ggagtttttctggaagggact

SEQ ID NO: 76595 - DNA, 22 bp, Homo sapiens
atttacaggtagaattttaagt

SEQ ID NO: 76596 - DNA, 22 bp, Homo sapiens
ctggacacactggagtctggca

SEQ ID NO: 76597 - DNA, 22 bp, Homo sapiens
caggaggacatactggctcaca

SEQ ID NO: 76598 - DNA, 22 bp, Homo sapiens
ggaggcccagaaggaagcccag

SEQ ID NO: 76599 - DNA, 22 bp, Homo sapiens
agcgccgcccctgctggtgttg

SEQ ID NO: 76600 - DNA, 22 bp, Homo sapiens
agtgcagtggttaggagccagg

SEQ ID NO: 76601 - DNA, 22 bp, Homo sapiens
ccagcctggttcagaattggct

SEQ ID NO: 76602 - DNA, 22 bp, Homo sapiens
gctgcagtgagccaagatcgtg

SEQ ID NO: 76603 - DNA, 22 bp, Homo sapiens
atggaatgtttatacacagttg

SEQ ID NO: 76604 - DNA, 22 bp, Homo sapiens
tattgggtaaagatccagtttt

SEQ ID NO: 76605 - DNA, 22 bp, Homo sapiens
gggaggctctgctcagcccccg

SEQ ID NO: 76606 - DNA, 22 bp, Homo sapiens
ccaggctggagtgcaatggcat

SEQ ID NO: 76607 - DNA, 21 bp, Homo sapiens
aaggacgaggttttgattaca

SEQ ID NO: 76608 - DNA, 22 bp, Homo sapiens
tgagcaggcgcagcaggaggtc

SEQ ID NO: 76609 - DNA, 22 bp, Homo sapiens
ctcaggacccggtccaggtggg

SEQ ID NO: 76610 - DNA, 23 bp, Homo sapiens
ttttgcaataagtcactggaata

SEQ ID NO: 76611 - DNA, 22 bp, Homo sapiens
tggacaacatagtgagacctca

SEQ ID NO: 76612 - DNA, 22 bp, Homo sapiens
atcactgtgtatgtatatgcag

SEQ ID NO: 76613 - DNA, 22 bp, Homo sapiens
gtggaggagaggcgccttgcgg

SEQ ID NO: 76614 - DNA, 22 bp, Homo sapiens
actgaataaggtgaatgctctg

SEQ ID NO: 76615 - DNA, 22 bp, Homo sapiens
ctgggggcagcaagaagccatg

SEQ ID NO: 76616 - DNA, 22 bp, Homo sapiens
aggccctattcaatggggccca

SEQ ID NO: 76617 - DNA, 22 bp, Homo sapiens
gcaggctgtctaaagttagagt

SEQ ID NO: 76618 - DNA, 20 bp, Homo sapiens
agagatggggtatcaccgta

SEQ ID NO: 76619 - DNA, 22 bp, Homo sapiens
cttgtagaattgaaatggtctc

SEQ ID NO: 76620 - DNA, 22 bp, Homo sapiens
aacagcttgctgcaccttaata

SEQ ID NO: 76621 - DNA, 22 bp, Homo sapiens
ctgggggtcttgaaagggagag

SEQ ID NO: 76622 - DNA, 22 bp, Homo sapiens
gctggccacagatccccaggga

SEQ ID NO: 76623 - DNA, 22 bp, Homo sapiens
tttggctcagctcacagatccc

SEQ ID NO: 76624 - DNA, 22 bp, Homo sapiens
gctgtctgtcttcacatctcgc

SEQ ID NO: 76625 - DNA, 22 bp, Homo sapiens
ttgcttcctctagtttcttgaa

SEQ ID NO: 76626 - DNA, 22 bp, Homo sapiens
atgaccagccgagataaacaga

SEQ ID NO: 76627 - DNA, 22 bp, Homo sapiens
agtcaataaaagctttagattc

SEQ ID NO: 76628 - DNA, 22 bp, Homo sapiens
aataaaatggtcagttttctca

SEQ ID NO: 76629 - DNA, 22 bp, Homo sapiens
ctatggtgatagaaatcagaat

SEQ ID NO: 76630 - DNA, 22 bp, Homo sapiens
gggtcgctgccgctgctggacc

SEQ ID NO: 76631 - DNA, 22 bp, Homo sapiens
gcctcactgcagccccaggaag

SEQ ID NO: 76632 - DNA, 22 bp, Homo sapiens
agggctgcccagtgtgagagct

SEQ ID NO: 76633 - DNA, 18 bp, Homo sapiens
gaggatggaaggagatgc

SEQ ID NO: 76634 - DNA, 22 bp, Homo sapiens
gaagaaagatcaaatagtttcc

SEQ ID NO: 76635 - DNA, 22 bp, Homo sapiens
atatatttgagaatattcatga

SEQ ID NO: 76636 - DNA, 22 bp, Homo sapiens
tgagacaggcttccttcttggg

SEQ ID NO: 76637 - DNA, 22 bp, Homo sapiens
aaagtgctgggattacaagcgt

SEQ ID NO: 76638 - DNA, 22 bp, Homo sapiens
agaccaaagaaaacacatctgg

SEQ ID NO: 76639 - DNA, 22 bp, Homo sapiens
tcagtctttccctccctcagtt

SEQ ID NO: 76640 - DNA, 22 bp, Homo sapiens
tcctcggctgggccccaggctt

SEQ ID NO: 76641 - DNA, 22 bp, Homo sapiens
gaccttgtgatctgcctgcctt

SEQ ID NO: 76642 - DNA, 22 bp, Homo sapiens
cagtgcatgcacacacatggta

SEQ ID NO: 76643 - DNA, 22 bp, Homo sapiens
gctgctgcttgaaggctcggag

SEQ ID NO: 76644 - DNA, 22 bp, Homo sapiens
aagagaattctggttttcctat

SEQ ID NO: 76645 - DNA, 22 bp, Homo sapiens
ggaaggcagaggtgtcgtgggg

SEQ ID NO: 76646 - DNA, 22 bp, Homo sapiens
ccagatgtccctctcaggtttg

SEQ ID NO: 76647 - DNA, 22 bp, Homo sapiens
actgtgaacggactgaagccca

SEQ ID NO: 76648 - DNA, 22 bp, Homo sapiens
tagcttatcccacagtgcccag

SEQ ID NO: 76649 - DNA, 22 bp, Homo sapiens
tcttgcacttcatgaatatgtt

SEQ ID NO: 76650 - DNA, 22 bp, Homo sapiens
gcgctgcgcctcctcttccgca

SEQ ID NO: 76651 - DNA, 22 bp, Homo sapiens
accatgttggccaagctggtct

SEQ ID NO: 76652 - DNA, 22 bp, Homo sapiens
actccacaccacgggggccgcc

SEQ ID NO: 76653 - DNA, 22 bp, Homo sapiens
cctcagctcccatgagatctgc

SEQ ID NO: 76654 - DNA, 22 bp, Homo sapiens
ttgagggtctggatctgctgct

SEQ ID NO: 76655 - DNA, 22 bp, Homo sapiens
tatgttgcaccaacctaataat

SEQ ID NO: 76656 - DNA, 23 bp, Homo sapiens
atgtttgcagtaacccatcctgg

SEQ ID NO: 76657 - DNA, 22 bp, Homo sapiens
gctgctctccaagcctccttga

SEQ ID NO: 76658 - DNA, 22 bp, Homo sapiens
acatggcaaaaccccgtttcta

SEQ ID NO: 76659 - DNA, 22 bp, Homo sapiens
caaagtgctgggattataggca

SEQ ID NO: 76660 - DNA, 22 bp, Homo sapiens
ctgggtggcagagcctgcagtg

SEQ ID NO: 76661 - DNA, 22 bp, Homo sapiens
atgagatgaggaatggccctcc

SEQ ID NO: 76662 - DNA, 23 bp, Homo sapiens
tctgtgtctccacccaaatctca

SEQ ID NO: 76663 - DNA, 22 bp, Homo sapiens
gcttggccagcagccgggatgc

SEQ ID NO: 76664 - DNA, 22 bp, Homo sapiens
ttaaatattatgttgtctgcaa

SEQ ID NO: 76665 - DNA, 22 bp, Homo sapiens
gccacctggtggcatcttctgg

SEQ ID NO: 76666 - DNA, 22 bp, Homo sapiens
aatatgcactctgatttagcag

SEQ ID NO: 76667 - DNA, 16 bp, Homo sapiens
ttgccgcacaggtcgc

SEQ ID NO: 76668 - DNA, 22 bp, Homo sapiens
aagactgagtggcttaagaaaa

SEQ ID NO: 76669 - DNA, 22 bp, Homo sapiens
ctgagaacatcattcagatatt

SEQ ID NO: 76670 - DNA, 22 bp, Homo sapiens
gaggggagcccccatcctccag

SEQ ID NO: 76671 - DNA, 22 bp, Homo sapiens
agcccttggtattttccgatcc

SEQ ID NO: 76672 - DNA, 22 bp, Homo sapiens
ggccggggcctgctcgcctgtg

SEQ ID NO: 76673 - DNA, 22 bp, Homo sapiens
gaggtggatgttgcagtgagct

SEQ ID NO: 76674 - DNA, 22 bp, Homo sapiens
ccggcgggcagcggcagtgagc

SEQ ID NO: 76675 - DNA, 22 bp, Homo sapiens
acctggacacctgctgtcatct

SEQ ID NO: 76676 - DNA, 22 bp, Homo sapiens
agattctaccagagctagtttg

SEQ ID NO: 76677 - DNA, 19 bp, Homo sapiens
ccagagagctaggtacaga

SEQ ID NO: 76678 - DNA, 22 bp, Homo sapiens
agtgggtgtagtcttcctcctg

SEQ ID NO: 76679 - DNA, 22 bp, Homo sapiens
ttgtaacaggtactaaataact

SEQ ID NO: 76680 - DNA, 22 bp, Homo sapiens
agtattctggaattctatgtga

SEQ ID NO: 76681 - DNA, 22 bp, Homo sapiens
taaaggtagtgtgacatattgt

SEQ ID NO: 76682 - DNA, 22 bp, Homo sapiens
ctgtaatcccagctactcggga

SEQ ID NO: 76683 - DNA, 18 bp, Homo sapiens
cccggctaatttttggta

SEQ ID NO: 76684 - DNA, 22 bp, Homo sapiens
caaggtgccatgctgggcgggg

SEQ ID NO: 76685 - DNA, 22 bp, Homo sapiens
gagagtctagtgcacctagttt

SEQ ID NO: 76686 - DNA, 22 bp, Homo sapiens
agtgctatcgagttctaatgct

SEQ ID NO: 76687 - DNA, 22 bp, Homo sapiens
tggaagggagctggaatttgga

SEQ ID NO: 76688 - DNA, 22 bp, Homo sapiens
agtgaatgtccccgcgggtcag

SEQ ID NO: 76689 - DNA, 22 bp, Homo sapiens
tggttcctcaagcgctggcggc

SEQ ID NO: 76690 - DNA, 22 bp, Homo sapiens
agctgccgatgcccagctgcat

SEQ ID NO: 76691 - DNA, 22 bp, Homo sapiens
ctgccctggggggcctccttgc

SEQ ID NO: 76692 - DNA, 22 bp, Homo sapiens
gagcccaggagtttgatgctgc

SEQ ID NO: 76693 - DNA, 22 bp, Homo sapiens
tccccagcttgctacttctgct

SEQ ID NO: 76694 - DNA, 22 bp, Homo sapiens
gagagtgagatcctcctgggga

SEQ ID NO: 76695 - DNA, 22 bp, Homo sapiens
aacactgctgctgggttctgtg

SEQ ID NO: 76696 - DNA, 22 bp, Homo sapiens
tcacagagaaatgtggcacaaa

SEQ ID NO: 76697 - DNA, 22 bp, Homo sapiens
cagcaagtcatccaggatgatg

SEQ ID NO: 76698 - DNA, 22 bp, Homo sapiens
aattatggtcactgttcctggg

SEQ ID NO: 76699 - DNA, 22 bp, Homo sapiens
caggaggattgcttgaggccag

SEQ ID NO: 76700 - DNA, 22 bp, Homo sapiens
atatattttttgagacagagtc

SEQ ID NO: 76701 - DNA, 22 bp, Homo sapiens
tttaagtaataaagtagcagct

SEQ ID NO: 76702 - DNA, 22 bp, Homo sapiens
gctcactgcaacctccacctcc

SEQ ID NO: 76703 - DNA, 22 bp, Homo sapiens
ggacaagcctgtgagtgggttt

SEQ ID NO: 76704 - DNA, 22 bp, Homo sapiens
ccaagctacttaggagtctgag

SEQ ID NO: 76705 - DNA, 22 bp, Homo sapiens
tggggtcagcaggcctggcctg

SEQ ID NO: 76706 - DNA, 22 bp, Homo sapiens
tagtaagttctcgcattgttat

SEQ ID NO: 76707 - DNA, 22 bp, Homo sapiens
cactgcatggctgtgaggcagc

SEQ ID NO: 76708 - DNA, 22 bp, Homo sapiens
aactcaaagatgcatgacgctt

SEQ ID NO: 76709 - DNA, 18 bp, Homo sapiens
gcactgaggaaaacctct

SEQ ID NO: 76710 - DNA, 22 bp, Homo sapiens
tacgtgtgttcgtgtaagcact

SEQ ID NO: 76711 - DNA, 22 bp, Homo sapiens
aggaagatgtgcaaagttggaa

SEQ ID NO: 76712 - DNA, 22 bp, Homo sapiens
ctgggctagaaggaccaggatg

SEQ ID NO: 76713 - DNA, 22 bp, Homo sapiens
ctcattgcaacctccgcctccc

SEQ ID NO: 76714 - DNA, 22 bp, Homo sapiens
tagtttcatctccaccctgccc

SEQ ID NO: 76715 - DNA, 22 bp, Homo sapiens
ttgtcagccagctcgcactctt

SEQ ID NO: 76716 - DNA, 22 bp, Homo sapiens
cctgggggccaggaaggtgtga

SEQ ID NO: 76717 - DNA, 22 bp, Homo sapiens
agttgggtttgtgtcagttgca

SEQ ID NO: 76718 - DNA, 21 bp, Homo sapiens
gcccacagtgaggaggatccc

SEQ ID NO: 76719 - DNA, 22 bp, Homo sapiens
tctgaaaactccatgagctcgt

SEQ ID NO: 76720 - DNA, 22 bp, Homo sapiens
agacagggtgatcgcttgagcc

SEQ ID NO: 76721 - DNA, 22 bp, Homo sapiens
tgagatgtaaggtatgcttact

SEQ ID NO: 76722 - DNA, 22 bp, Homo sapiens
ggctgggcaggtctgcacaggg

SEQ ID NO: 76723 - DNA, 22 bp, Homo sapiens
aggtattattagcatctctatt

SEQ ID NO: 76724 - DNA, 17 bp, Homo sapiens
tcggtttgccaggcttc

SEQ ID NO: 76725 - DNA, 22 bp, Homo sapiens
gagaaagctaaataagttgatt

SEQ ID NO: 76726 - DNA, 22 bp, Homo sapiens
agccggccatgtggtcttgtgc

SEQ ID NO: 76727 - DNA, 22 bp, Homo sapiens
gcgagaaactaagtgccctttg

SEQ ID NO: 76728 - DNA, 22 bp, Homo sapiens
ttgcaattgctatggagagcgt

SEQ ID NO: 76729 - DNA, 22 bp, Homo sapiens
aacccgggaggcagaggttgtg

SEQ ID NO: 76730 - DNA, 22 bp, Homo sapiens
ttcccacattctttacattcat

SEQ ID NO: 76731 - DNA, 22 bp, Homo sapiens
tcactgcactccagcctgggca

SEQ ID NO: 76732 - DNA, 22 bp, Homo sapiens
tcagggctgcagaagaggcagg

SEQ ID NO: 76733 - DNA, 22 bp, Homo sapiens
gtctcctccctttcattcacct

SEQ ID NO: 76734 - DNA, 22 bp, Homo sapiens
tcactgcaacctccgcctgctg

SEQ ID NO: 76735 - DNA, 22 bp, Homo sapiens
tagtgtctcttcctgtttgaaa

SEQ ID NO: 76736 - DNA, 22 bp, Homo sapiens
tgattttctccattgtaaattc

SEQ ID NO: 76737 - DNA, 22 bp, Homo sapiens
tgatgggaggtgctgcaggacc

SEQ ID NO: 76738 - DNA, 22 bp, Homo sapiens
atcacaaaggtctcagagcaca

SEQ ID NO: 76739 - DNA, 22 bp, Homo sapiens
acagcagcaatagcagtgacat

SEQ ID NO: 76740 - DNA, 22 bp, Homo sapiens
acaaggcactttatgaagagga

SEQ ID NO: 76741 - DNA, 22 bp, Homo sapiens
gttacagtcaggagatattttg

SEQ ID NO: 76742 - DNA, 22 bp, Homo sapiens
tggaaacacccacgcatgcata

SEQ ID NO: 76743 - DNA, 22 bp, Homo sapiens
ggtgggagagcttgctttgatg

SEQ ID NO: 76744 - DNA, 23 bp, Homo sapiens
ggagcctccggtgtgtgagaggc

SEQ ID NO: 76745 - DNA, 21 bp, Homo sapiens
atctcgggcttctcgcccagc

SEQ ID NO: 76746 - DNA, 22 bp, Homo sapiens
gccccagcctcccgagtagctg

SEQ ID NO: 76747 - DNA, 22 bp, Homo sapiens
ggcaaaaaccataattactttt

SEQ ID NO: 76748 - DNA, 22 bp, Homo sapiens
aagagactgtaaaggcgtgagt

SEQ ID NO: 76749 - DNA, 22 bp, Homo sapiens
gggaggttctgttcgcacttga

SEQ ID NO: 76750 - DNA, 23 bp, Homo sapiens
aagtggttttgaacccggaccct

SEQ ID NO: 76751 - DNA, 22 bp, Homo sapiens
gggagaggttacccgagcaact

SEQ ID NO: 76752 - DNA, 22 bp, Homo sapiens
ttgagatggagtctcactctgt

SEQ ID NO: 76753 - DNA, 18 bp, Homo sapiens
cagctgccagctcatgga

SEQ ID NO: 76754 - DNA, 22 bp, Homo sapiens
tggggagaaatgtctttgttcc

SEQ ID NO: 76755 - DNA, 22 bp, Homo sapiens
cggggccctggggctgaaggtc

SEQ ID NO: 76756 - DNA, 18 bp, Homo sapiens
atggtctcatactgggag

SEQ ID NO: 76757 - DNA, 22 bp, Homo sapiens
tcccgttgatgacggtgcatcc

SEQ ID NO: 76758 - DNA, 22 bp, Homo sapiens
aggaagttagtaaattatgtgc

SEQ ID NO: 76759 - DNA, 22 bp, Homo sapiens
aggaaataggaccagacaaagc

SEQ ID NO: 76760 - DNA, 20 bp, Homo sapiens
ttggatgtgcatggccgtgc

SEQ ID NO: 76761 - DNA, 22 bp, Homo sapiens
ttgagcccaggaggcctgggtg

SEQ ID NO: 76762 - DNA, 22 bp, Homo sapiens
ttgtctctggaaggaaaaagca

SEQ ID NO: 76763 - DNA, 22 bp, Homo sapiens
tcctcagcttttatttcacttg

SEQ ID NO: 76764 - DNA, 22 bp, Homo sapiens
gcccagcacctctctcagggtt

SEQ ID NO: 76765 - DNA, 22 bp, Homo sapiens
aaattgtaatgacttcacttga

SEQ ID NO: 76766 - DNA, 22 bp, Homo sapiens
acggcttcttgactgtgggttg

SEQ ID NO: 76767 - DNA, 19 bp, Homo sapiens
ggagccgccgcccttcatt

SEQ ID NO: 76768 - DNA, 22 bp, Homo sapiens
cagctcacccatcacgtctgct

SEQ ID NO: 76769 - DNA, 22 bp, Homo sapiens
ttgtgtgtactggttatgggca

SEQ ID NO: 76770 - DNA, 22 bp, Homo sapiens
ctcagccccagcccagatagca

SEQ ID NO: 76771 - DNA, 21 bp, Homo sapiens
cgggaaggaggttctgaccct

SEQ ID NO: 76772 - DNA, 22 bp, Homo sapiens
aaagggaagttgcacatgttcc

SEQ ID NO: 76773 - DNA, 22 bp, Homo sapiens
gaagccttgaactgcaaacccc

SEQ ID NO: 76774 - DNA, 22 bp, Homo sapiens
tgagccagaggaggctgtgtgg

SEQ ID NO: 76775 - DNA, 22 bp, Homo sapiens
tcaagcaaagtttagctggtta

SEQ ID NO: 76776 - DNA, 22 bp, Homo sapiens
ataaaagatcccttctgagctc

SEQ ID NO: 76777 - DNA, 22 bp, Homo sapiens
caggcactgtgctgagctctgc

SEQ ID NO: 76778 - DNA, 22 bp, Homo sapiens
agaaggcatagaccggattatg

SEQ ID NO: 76779 - DNA, 22 bp, Homo sapiens
cctgaggatgccagcatgggtg

SEQ ID NO: 76780 - DNA, 22 bp, Homo sapiens
cttttcattgtttgtacatgca

SEQ ID NO: 76781 - DNA, 23 bp, Homo sapiens
aaggggatacttccactttcttt

SEQ ID NO: 76782 - DNA, 22 bp, Homo sapiens
gactgtgacttctgaagcaata

SEQ ID NO: 76783 - DNA, 22 bp, Homo sapiens
gggaaagaccttcctggggtgt

SEQ ID NO: 76784 - DNA, 22 bp, Homo sapiens
acacagagccaaaccatatcac

SEQ ID NO: 76785 - DNA, 22 bp, Homo sapiens
gccagggttgccaatgggggca

SEQ ID NO: 76786 - DNA, 22 bp, Homo sapiens
gggccatgagaggttcatcaac

SEQ ID NO: 76787 - DNA, 22 bp, Homo sapiens
aaatgtaagtctttgtttctta

SEQ ID NO: 76788 - DNA, 22 bp, Homo sapiens
ttgaggcctgctggaaggtgtt

SEQ ID NO: 76789 - DNA, 22 bp, Homo sapiens
caggccagggttgagaagagaa

SEQ ID NO: 76790 - DNA, 22 bp, Homo sapiens
ttttgcaatgagatgcttgtca

SEQ ID NO: 76791 - DNA, 22 bp, Homo sapiens
tgcctaggctggaatgcagtgg

SEQ ID NO: 76792 - DNA, 22 bp, Homo sapiens
gaggcctgggcaagggggtctg

SEQ ID NO: 76793 - DNA, 22 bp, Homo sapiens
tgtgggagaaggaagcaagctg

SEQ ID NO: 76794 - DNA, 22 bp, Homo sapiens
cccagttgttgccggctctgga

SEQ ID NO: 76795 - DNA, 22 bp, Homo sapiens
tactaggaagcagctgcattgg

SEQ ID NO: 76796 - DNA, 22 bp, Homo sapiens
gtcggccacgcaggtgcggtag

SEQ ID NO: 76797 - DNA, 22 bp, Homo sapiens
gcggggggcaggcagtacgttg

SEQ ID NO: 76798 - DNA, 22 bp, Homo sapiens
gttggctatgagagctttagtg

SEQ ID NO: 76799 - DNA, 22 bp, Homo sapiens
ctggcttttttcccattatgca

SEQ ID NO: 76800 - DNA, 19 bp, Homo sapiens
gcctatgtcttcaaatcat

SEQ ID NO: 76801 - DNA, 22 bp, Homo sapiens
aggggtgacacatatcagtgca

SEQ ID NO: 76802 - DNA, 22 bp, Homo sapiens
taggaatggtgctcagcagaaa

SEQ ID NO: 76803 - DNA, 22 bp, Homo sapiens
taccagggaacagggatattaa

SEQ ID NO: 76804 - DNA, 23 bp, Homo sapiens
gcagccatgttcccgtctcagct

SEQ ID NO: 76805 - DNA, 21 bp, Homo sapiens
tccttcagtctagatgattgt

SEQ ID NO: 76806 - DNA, 22 bp, Homo sapiens
taagtgagggagctgggacttg

SEQ ID NO: 76807 - DNA, 22 bp, Homo sapiens
ggttggtaactccctgtgcagt

SEQ ID NO: 76808 - DNA, 22 bp, Homo sapiens
gaaagagaacctgggcctagat

SEQ ID NO: 76809 - DNA, 23 bp, Homo sapiens
agagcaaggaaatgaggtgtgat

SEQ ID NO: 76810 - DNA, 22 bp, Homo sapiens
gctgagactgacatgaagaggt

SEQ ID NO: 76811 - DNA, 22 bp, Homo sapiens
cctgacaggcggaggctgcagt

SEQ ID NO: 76812 - DNA, 22 bp, Homo sapiens
tagtttaggatccaatctaaga

SEQ ID NO: 76813 - DNA, 22 bp, Homo sapiens
atgctctctgtcctgctcagag

SEQ ID NO: 76814 - DNA, 22 bp, Homo sapiens
cacatgaaggctggggtcgtga

SEQ ID NO: 76815 - DNA, 22 bp, Homo sapiens
catgtaaagaatttcacacaag

SEQ ID NO: 76816 - DNA, 22 bp, Homo sapiens
tcaccttgtgatctccctgcct

SEQ ID NO: 76817 - DNA, 22 bp, Homo sapiens
aaatgcacaaagattttgcact

SEQ ID NO: 76818 - DNA, 22 bp, Homo sapiens
ttatgatttgccacagattggt

SEQ ID NO: 76819 - DNA, 22 bp, Homo sapiens
aattttctggtgtgtaatgaag

SEQ ID NO: 76820 - DNA, 22 bp, Homo sapiens
tggctaggctggtgtcaagctc

SEQ ID NO: 76821 - DNA, 22 bp, Homo sapiens
ccaggctggagtgcagtggcac

SEQ ID NO: 76822 - DNA, 22 bp, Homo sapiens
cagtgcagccaaggacaggcac

SEQ ID NO: 76823 - DNA, 22 bp, Homo sapiens
ctggggtccttgccatgtgtca

SEQ ID NO: 76824 - DNA, 22 bp, Homo sapiens
ctgggcacagcgttgggctctt

SEQ ID NO: 76825 - DNA, 19 bp, Homo sapiens
tccaaagaagttcacattt

SEQ ID NO: 76826 - DNA, 20 bp, Homo sapiens
tttcaccatcttggccaggc

SEQ ID NO: 76827 - DNA, 22 bp, Homo sapiens
cagctgctgttcagttttgttt

SEQ ID NO: 76828 - DNA, 22 bp, Homo sapiens
atccccctcttggatggcggca

SEQ ID NO: 76829 - DNA, 22 bp, Homo sapiens
tagatctgatacaattcatctg

SEQ ID NO: 76830 - DNA, 22 bp, Homo sapiens
tgtgctctgactttctcctggt

SEQ ID NO: 76831 - DNA, 22 bp, Homo sapiens
ttccccttgggctgtggaggag

SEQ ID NO: 76832 - DNA, 22 bp, Homo sapiens
gccacgtagaagtgccgcgaga

SEQ ID NO: 76833 - DNA, 22 bp, Homo sapiens
tagaaaagccccagctggaggg

SEQ ID NO: 76834 - DNA, 22 bp, Homo sapiens
tgtgacaagcattgtatattgg

SEQ ID NO: 76835 - DNA, 22 bp, Homo sapiens
ccacagaattctgtctccagga

SEQ ID NO: 76836 - DNA, 22 bp, Homo sapiens
aagtgatgctacgactttgaca

SEQ ID NO: 76837 - DNA, 22 bp, Homo sapiens
ggttttatcctacccacacagc

SEQ ID NO: 76838 - DNA, 22 bp, Homo sapiens
tgcactccaggctgggtgacag

SEQ ID NO: 76839 - DNA, 22 bp, Homo sapiens
tgagctgtctgaatggtgagga

SEQ ID NO: 76840 - DNA, 22 bp, Homo sapiens
accacccagccagcttctccct

SEQ ID NO: 76841 - DNA, 22 bp, Homo sapiens
gcttccacctactaaatgccac

SEQ ID NO: 76842 - DNA, 22 bp, Homo sapiens
tgtctattaattccacataaaa

SEQ ID NO: 76843 - DNA, 22 bp, Homo sapiens
ggctcacgcaattatcccggcc

SEQ ID NO: 76844 - DNA, 19 bp, Homo sapiens
aatgctgcttctttttgca

SEQ ID NO: 76845 - DNA, 22 bp, Homo sapiens
gcaggaggttgagccaggactg

SEQ ID NO: 76846 - DNA, 22 bp, Homo sapiens
ctcctgggaaaggctggacaca

SEQ ID NO: 76847 - DNA, 22 bp, Homo sapiens
agcaggaaggggatgatgggca

SEQ ID NO: 76848 - DNA, 22 bp, Homo sapiens
ttgagatggagcttcactcttg

SEQ ID NO: 76849 - DNA, 22 bp, Homo sapiens
atgccactgcgctccagcctgg

SEQ ID NO: 76850 - DNA, 22 bp, Homo sapiens
cacaaaccttctgcagcctgta

SEQ ID NO: 76851 - DNA, 22 bp, Homo sapiens
ggaggcagaatagagtgtgggt

SEQ ID NO: 76852 - DNA, 22 bp, Homo sapiens
tgttatcctcagctcacctcta

SEQ ID NO: 76853 - DNA, 22 bp, Homo sapiens
ccagggtggcgtagatgctggg

SEQ ID NO: 76854 - DNA, 22 bp, Homo sapiens
tgccatggcctagacctgtgat

SEQ ID NO: 76855 - DNA, 22 bp, Homo sapiens
agcagcagtatccttccccggc

SEQ ID NO: 76856 - DNA, 20 bp, Homo sapiens
attagctcaggtgaggtcat

SEQ ID NO: 76857 - DNA, 22 bp, Homo sapiens
gccacctcggctttctctgctc

SEQ ID NO: 76858 - DNA, 22 bp, Homo sapiens
caggctgatcagggctgggatg

SEQ ID NO: 76859 - DNA, 22 bp, Homo sapiens
ggctccaccctgcttccagaag

SEQ ID NO: 76860 - DNA, 22 bp, Homo sapiens
accattgccccctagtgtctgt

SEQ ID NO: 76861 - DNA, 22 bp, Homo sapiens
gggtaaatctcttttcatggct

SEQ ID NO: 76862 - DNA, 22 bp, Homo sapiens
agcccaggctggagtgcagtgg

SEQ ID NO: 76863 - DNA, 22 bp, Homo sapiens
agctcctgaaaatccagactgg

SEQ ID NO: 76864 - DNA, 22 bp, Homo sapiens
aaggatacttttagagcctgag

SEQ ID NO: 76865 - DNA, 23 bp, Homo sapiens
tgagctgggcctgcaggggtctc

SEQ ID NO: 76866 - DNA, 22 bp, Homo sapiens
gcgttggggaccccgaagctgg

SEQ ID NO: 76867 - DNA, 22 bp, Homo sapiens
agagggatcaccctgtttctgg

SEQ ID NO: 76868 - DNA, 22 bp, Homo sapiens
ggagagcttggagtgcgatttt

SEQ ID NO: 76869 - DNA, 22 bp, Homo sapiens
cacagagatggtctggcaggtg

SEQ ID NO: 76870 - DNA, 22 bp, Homo sapiens
gaatttcacaaggtgaggataa

SEQ ID NO: 76871 - DNA, 22 bp, Homo sapiens
cctgggccctcaccgccggtgg

SEQ ID NO: 76872 - DNA, 23 bp, Homo sapiens
aaactacaacgccaggcactgag

SEQ ID NO: 76873 - DNA, 22 bp, Homo sapiens
atgcaggcagacactgtgggca

SEQ ID NO: 76874 - DNA, 22 bp, Homo sapiens
atgagaaagttaatcatcatga

SEQ ID NO: 76875 - DNA, 22 bp, Homo sapiens
gcagctattgtctcctgggccc

SEQ ID NO: 76876 - DNA, 22 bp, Homo sapiens
ttgcttcattttgggtgtgcag

SEQ ID NO: 76877 - DNA, 22 bp, Homo sapiens
tacatttataaggcttctctgt

SEQ ID NO: 76878 - DNA, 22 bp, Homo sapiens
gcggcctgcgctgctcccgacg

SEQ ID NO: 76879 - DNA, 22 bp, Homo sapiens
tcctgggtccatggcagccgaa

SEQ ID NO: 76880 - DNA, 22 bp, Homo sapiens
aggggcacgagtagagctctag

SEQ ID NO: 76881 - DNA, 22 bp, Homo sapiens
aagatacagacagagccaaaat

SEQ ID NO: 76882 - DNA, 16 bp, Homo sapiens
tgggtgggaggagcgg

SEQ ID NO: 76883 - DNA, 19 bp, Homo sapiens
tgagggtgagctttggaga

SEQ ID NO: 76884 - DNA, 22 bp, Homo sapiens
tgttctctaagccacccatttt

SEQ ID NO: 76885 - DNA, 22 bp, Homo sapiens
ggcctcttatctggctcctgca

SEQ ID NO: 76886 - DNA, 22 bp, Homo sapiens
tccacgtgagcttcgtgtgcag

SEQ ID NO: 76887 - DNA, 22 bp, Homo sapiens
attggtggtgaggacatgccag

SEQ ID NO: 76888 - DNA, 22 bp, Homo sapiens
cagtgacgtaaactgcatgtgc

SEQ ID NO: 76889 - DNA, 22 bp, Homo sapiens
gtccaaaagagccagccgggcg

SEQ ID NO: 76890 - DNA, 22 bp, Homo sapiens
tcaggcagtagaattgcttgaa

SEQ ID NO: 76891 - DNA, 22 bp, Homo sapiens
agggccagcactcctggcagga

SEQ ID NO: 76892 - DNA, 22 bp, Homo sapiens
cttgatctacatagtgaaaccc

SEQ ID NO: 76893 - DNA, 22 bp, Homo sapiens
gttcagtcacgtgcccaagttc

SEQ ID NO: 76894 - DNA, 22 bp, Homo sapiens
caaagttgcagttatgtgatta

SEQ ID NO: 76895 - DNA, 23 bp, Homo sapiens
ttgcttgagcccaggaagtggag

SEQ ID NO: 76896 - DNA, 22 bp, Homo sapiens
gggctagcctcttccctgctcc

SEQ ID NO: 76897 - DNA, 22 bp, Homo sapiens
ttgctcagtggcagggctggta

SEQ ID NO: 76898 - DNA, 22 bp, Homo sapiens
cccatggcttaggagggagtgt

SEQ ID NO: 76899 - DNA, 22 bp, Homo sapiens
cgtgggtcgggactccgcctcg

SEQ ID NO: 76900 - DNA, 22 bp, Homo sapiens
aacatatcatttaaccctcacc

SEQ ID NO: 76901 - DNA, 22 bp, Homo sapiens
ctttggctggcaccccagcggg

SEQ ID NO: 76902 - DNA, 22 bp, Homo sapiens
agcgccactgcactccagcctg

SEQ ID NO: 76903 - DNA, 22 bp, Homo sapiens
atttcagtattatacaactgct

SEQ ID NO: 76904 - DNA, 22 bp, Homo sapiens
gctcatgactgtaatcccagca

SEQ ID NO: 76905 - DNA, 22 bp, Homo sapiens
gcccaggctggagttcagtggt

SEQ ID NO: 76906 - DNA, 22 bp, Homo sapiens
gtgacaatattagctcaggggc

SEQ ID NO: 76907 - DNA, 22 bp, Homo sapiens
atggaaggctttatgactcaaa

SEQ ID NO: 76908 - DNA, 22 bp, Homo sapiens
ggagggcagagtcccctgctga

SEQ ID NO: 76909 - DNA, 22 bp, Homo sapiens
aggacaaaggaccagatctgga

SEQ ID NO: 76910 - DNA, 22 bp, Homo sapiens
tagctaccattattgagcacct

SEQ ID NO: 76911 - DNA, 22 bp, Homo sapiens
ttctaattaaatctacgctagg

SEQ ID NO: 76912 - DNA, 22 bp, Homo sapiens
aagaggagaaaggctggctttg

SEQ ID NO: 76913 - DNA, 22 bp, Homo sapiens
tgtgtctgtgtatacacggcat

SEQ ID NO: 76914 - DNA, 22 bp, Homo sapiens
tcacagcctggacagttgcctg

SEQ ID NO: 76915 - DNA, 22 bp, Homo sapiens
ttgaagaaccatctgtgccact

SEQ ID NO: 76916 - DNA, 22 bp, Homo sapiens
tagatttgtttccttctctcca

SEQ ID NO: 76917 - DNA, 22 bp, Homo sapiens
aatgccagtgtgttgattccag

SEQ ID NO: 76918 - DNA, 22 bp, Homo sapiens
tattagttgcaaaacattgact

SEQ ID NO: 76919 - DNA, 22 bp, Homo sapiens
agagcccctgggtcacacagcc

SEQ ID NO: 76920 - DNA, 22 bp, Homo sapiens
agcccaatcctagcactttgag

SEQ ID NO: 76921 - DNA, 22 bp, Homo sapiens
tgtcttcgctacaatgaaaagg

SEQ ID NO: 76922 - DNA, 22 bp, Homo sapiens
aaatgcctcattttctctcact

SEQ ID NO: 76923 - DNA, 22 bp, Homo sapiens
cttgtcagccaattgtggattt

SEQ ID NO: 76924 - DNA, 22 bp, Homo sapiens
ccaaagtgctgggattacaggc

SEQ ID NO: 76925 - DNA, 22 bp, Homo sapiens
agccaagcactcaactcctgga

SEQ ID NO: 76926 - DNA, 21 bp, Homo sapiens
gggcagaggggcctcctgggt

SEQ ID NO: 76927 - DNA, 22 bp, Homo sapiens
agggaagtggtctgggaacttg

SEQ ID NO: 76928 - DNA, 22 bp, Homo sapiens
atctgagtcaaatatttcattt

SEQ ID NO: 76929 - DNA, 22 bp, Homo sapiens
actgcactccagcctgggtgac

SEQ ID NO: 76930 - DNA, 22 bp, Homo sapiens
tgtcctgtaggaggcagaacaa

SEQ ID NO: 76931 - DNA, 22 bp, Homo sapiens
gggtacagttcttccagtgtca

SEQ ID NO: 76932 - DNA, 20 bp, Homo sapiens
gggcagtggcgctatctcag

SEQ ID NO: 76933 - DNA, 22 bp, Homo sapiens
aggacttccatggatggattgg

SEQ ID NO: 76934 - DNA, 22 bp, Homo sapiens
agagcggggatagttaatattc

SEQ ID NO: 76935 - DNA, 22 bp, Homo sapiens
tttggtattgcacactgtcttc

SEQ ID NO: 76936 - DNA, 22 bp, Homo sapiens
gggaagagggagctggaatgat

SEQ ID NO: 76937 - DNA, 22 bp, Homo sapiens
tcaccgaggctggagtgcagtg

SEQ ID NO: 76938 - DNA, 22 bp, Homo sapiens
agtgttgtcaaacggctcagca

SEQ ID NO: 76939 - DNA, 22 bp, Homo sapiens
gaggaggcttccgggaggcacg

SEQ ID NO: 76940 - DNA, 19 bp, Homo sapiens
aggaatggaattaattctg

SEQ ID NO: 76941 - DNA, 22 bp, Homo sapiens
taacagtatatttaccaaacct

SEQ ID NO: 76942 - DNA, 22 bp, Homo sapiens
gctgggttttcttccgggccta

SEQ ID NO: 76943 - DNA, 21 bp, Homo sapiens
caaaagagactgattcttgga

SEQ ID NO: 76944 - DNA, 22 bp, Homo sapiens
ttttttgttgggtagaacggaa

SEQ ID NO: 76945 - DNA, 22 bp, Homo sapiens
gttaaggctgagcaggacactg

SEQ ID NO: 76946 - DNA, 22 bp, Homo sapiens
aagaagcattctttcattggtt

SEQ ID NO: 76947 - DNA, 22 bp, Homo sapiens
ggggttaacagtattgctcatg

SEQ ID NO: 76948 - DNA, 22 bp, Homo sapiens
ctattattagataatctacttg

SEQ ID NO: 76949 - DNA, 22 bp, Homo sapiens
ggtccccgtggaggctggagcg

SEQ ID NO: 76950 - DNA, 22 bp, Homo sapiens
tggattcacaccattctcctgc

SEQ ID NO: 76951 - DNA, 22 bp, Homo sapiens
ccaaagtgctgagattacaggt

SEQ ID NO: 76952 - DNA, 22 bp, Homo sapiens
aaagtgctgaaattacaggtgt

SEQ ID NO: 76953 - DNA, 22 bp, Homo sapiens
aggaattgtgttgtagtggaga

SEQ ID NO: 76954 - DNA, 22 bp, Homo sapiens
gagatggagtctttttctgtca

SEQ ID NO: 76955 - DNA, 22 bp, Homo sapiens
agggcactctgcagggaccacc

SEQ ID NO: 76956 - DNA, 22 bp, Homo sapiens
catttctgggagacatgctaga

SEQ ID NO: 76957 - DNA, 22 bp, Homo sapiens
tgtcatagtgtggtagcagtgg

SEQ ID NO: 76958 - DNA, 22 bp, Homo sapiens
ccagaccctccattcaagctcc

SEQ ID NO: 76959 - DNA, 22 bp, Homo sapiens
gccagaattttgagactacttg

SEQ ID NO: 76960 - DNA, 22 bp, Homo sapiens
aaggcaggatgggaaaagattt

SEQ ID NO: 76961 - DNA, 22 bp, Homo sapiens
cccaggaggcggaggttgcagt

SEQ ID NO: 76962 - DNA, 22 bp, Homo sapiens
tcgaactcatagtcgtagctgt

SEQ ID NO: 76963 - DNA, 22 bp, Homo sapiens
gtgagatggagttggtgtcttt

SEQ ID NO: 76964 - DNA, 22 bp, Homo sapiens
cagccccatggtgtgctccagc

SEQ ID NO: 76965 - DNA, 22 bp, Homo sapiens
gggacaatggaggcctctctcc

SEQ ID NO: 76966 - DNA, 22 bp, Homo sapiens
aacccgggaggcggaggttgtg

SEQ ID NO: 76967 - DNA, 22 bp, Homo sapiens
aaggctgagacagcacaggtcc

SEQ ID NO: 76968 - DNA, 22 bp, Homo sapiens
gcagctgacatctggctgggcc

SEQ ID NO: 76969 - DNA, 22 bp, Homo sapiens
cagctgcccctccagggctggg

SEQ ID NO: 76970 - DNA, 21 bp, Homo sapiens
cagggccaatcctgacctcta

SEQ ID NO: 76971 - DNA, 22 bp, Homo sapiens
aagaggtagcagtcacaaaaga

SEQ ID NO: 76972 - DNA, 22 bp, Homo sapiens
gcctccggagttgcagtgtctt

SEQ ID NO: 76973 - DNA, 22 bp, Homo sapiens
actgtccgggacaggcccatcc

SEQ ID NO: 76974 - DNA, 22 bp, Homo sapiens
atagacgcggccgctgatgcag

SEQ ID NO: 76975 - DNA, 22 bp, Homo sapiens
aggacagagggaccagagccca

SEQ ID NO: 76976 - DNA, 22 bp, Homo sapiens
tgagccatgggactccaaggga

SEQ ID NO: 76977 - DNA, 22 bp, Homo sapiens
tgggaagggtcaacagctggaa

SEQ ID NO: 76978 - DNA, 22 bp, Homo sapiens
aaggggaagagaccgcagagtc

SEQ ID NO: 76979 - DNA, 22 bp, Homo sapiens
agaccactaaaactttctctat

SEQ ID NO: 76980 - DNA, 22 bp, Homo sapiens
tgtcctgtgattccagctcttc

SEQ ID NO: 76981 - DNA, 22 bp, Homo sapiens
cctgcagacacttgtccagcaa

SEQ ID NO: 76982 - DNA, 22 bp, Homo sapiens
ccctttagcccctgcagagact

SEQ ID NO: 76983 - DNA, 21 bp, Homo sapiens
ccagagcctgagaggattatg

SEQ ID NO: 76984 - DNA, 22 bp, Homo sapiens
tctgaggctgaatggactccgt

SEQ ID NO: 76985 - DNA, 22 bp, Homo sapiens
ctggggtcagggatcagagagc

SEQ ID NO: 76986 - DNA, 22 bp, Homo sapiens
tgattaatatcaccaccattgg

SEQ ID NO: 76987 - DNA, 22 bp, Homo sapiens
cacagcctcctctggctcacgg

SEQ ID NO: 76988 - DNA, 22 bp, Homo sapiens
cttcttgctgggggcctcagtg

SEQ ID NO: 76989 - DNA, 22 bp, Homo sapiens
attgataaattgcaatggggct

SEQ ID NO: 76990 - DNA, 22 bp, Homo sapiens
tcactgcaatctcagcctcctg

SEQ ID NO: 76991 - DNA, 22 bp, Homo sapiens
atggagttctgccagcgctgct

SEQ ID NO: 76992 - DNA, 22 bp, Homo sapiens
tcgtgatctgtccacctcggcc

SEQ ID NO: 76993 - DNA, 22 bp, Homo sapiens
gcctgctcccagttggcgcctc

SEQ ID NO: 76994 - DNA, 22 bp, Homo sapiens
gctccccaaaagctccaggaaa

SEQ ID NO: 76995 - DNA, 22 bp, Homo sapiens
tcagcctggcaggatggcctgg

SEQ ID NO: 76996 - DNA, 22 bp, Homo sapiens
cctgggctctgtcagaattggg

SEQ ID NO: 76997 - DNA, 22 bp, Homo sapiens
tcctgccttgcctgggacatca

SEQ ID NO: 76998 - DNA, 22 bp, Homo sapiens
cccagggagagcgcggaggcgg

SEQ ID NO: 76999 - DNA, 22 bp, Homo sapiens
ggctcaatgcaacttctgcctc

SEQ ID NO: 77000 - DNA, 22 bp, Homo sapiens
tgaggcaggagttcaggctgcg

SEQ ID NO: 77001 - DNA, 22 bp, Homo sapiens
tgcctagttctgtatttacagt

SEQ ID NO: 77002 - DNA, 22 bp, Homo sapiens
aatattatcaaaagctttttca

SEQ ID NO: 77003 - DNA, 22 bp, Homo sapiens
tcttgggggactttggcatgga

SEQ ID NO: 77004 - DNA, 22 bp, Homo sapiens
gtgggccagcttttctcctggg

SEQ ID NO: 77005 - DNA, 22 bp, Homo sapiens
caggaagaccagggctgtggct

SEQ ID NO: 77006 - DNA, 19 bp, Homo sapiens
gcccacggccctgctctgc

SEQ ID NO: 77007 - DNA, 22 bp, Homo sapiens
gttgaaatcctaaccccctagt

SEQ ID NO: 77008 - DNA, 22 bp, Homo sapiens
tgcacgtgggctctctgctctt

SEQ ID NO: 77009 - DNA, 22 bp, Homo sapiens
agatacattgttctaagcattg

SEQ ID NO: 77010 - DNA, 22 bp, Homo sapiens
ggggccttttctgaatgtggaa

SEQ ID NO: 77011 - DNA, 22 bp, Homo sapiens
tagcagaagttgcaaactaggg

SEQ ID NO: 77012 - DNA, 22 bp, Homo sapiens
ctgagatggagttttgctcttg

SEQ ID NO: 77013 - DNA, 22 bp, Homo sapiens
tcagcctgctccaagtgctgcc

SEQ ID NO: 77014 - DNA, 22 bp, Homo sapiens
tgctccatgcgctcggccggcg

SEQ ID NO: 77015 - DNA, 22 bp, Homo sapiens
ggagaagcagcttcttgatgaa

SEQ ID NO: 77016 - DNA, 22 bp, Homo sapiens
agccccttgtgggcgcacagca

SEQ ID NO: 77017 - DNA, 22 bp, Homo sapiens
tcacttcccagacggggtggca

SEQ ID NO: 77018 - DNA, 22 bp, Homo sapiens
gcccctgcctttgaacctggag

SEQ ID NO: 77019 - DNA, 22 bp, Homo sapiens
cagcagcagtggctgcagaaca

SEQ ID NO: 77020 - DNA, 22 bp, Homo sapiens
gctgaggctcctcgggaggaca

SEQ ID NO: 77021 - DNA, 22 bp, Homo sapiens
aaggctgaggcagtgaggcaga

SEQ ID NO: 77022 - DNA, 22 bp, Homo sapiens
gagcagtaggagaaccctgagc

SEQ ID NO: 77023 - DNA, 22 bp, Homo sapiens
ggcatcttgttgctcaaatcta

SEQ ID NO: 77024 - DNA, 22 bp, Homo sapiens
tctcgctctgtcgcccaggctg

SEQ ID NO: 77025 - DNA, 22 bp, Homo sapiens
catacccatttgtttcaggagc

SEQ ID NO: 77026 - DNA, 22 bp, Homo sapiens
atgaggcaggagtgcagtggca

SEQ ID NO: 77027 - DNA, 22 bp, Homo sapiens
ttgcccaggctggagtgcagtg

SEQ ID NO: 77028 - DNA, 19 bp, Homo sapiens
catggtgaaaccccgtctc

SEQ ID NO: 77029 - DNA, 22 bp, Homo sapiens
gtggcttggaccagtcacagtg

SEQ ID NO: 77030 - DNA, 22 bp, Homo sapiens
tgggccactgctgcggaaggcg

SEQ ID NO: 77031 - DNA, 22 bp, Homo sapiens
aggactgggtgcagagggcatc

SEQ ID NO: 77032 - DNA, 22 bp, Homo sapiens
gcgagtgccgagagggcagggc

SEQ ID NO: 77033 - DNA, 22 bp, Homo sapiens
tcactgcactccagcctgggtg

SEQ ID NO: 77034 - DNA, 21 bp, Homo sapiens
acacaggcagtgtcccgaggt

SEQ ID NO: 77035 - DNA, 22 bp, Homo sapiens
gcctgtgacccagggcccagga

SEQ ID NO: 77036 - DNA, 22 bp, Homo sapiens
tgctcccaaacctgacaggctc

SEQ ID NO: 77037 - DNA, 22 bp, Homo sapiens
cagaggaacgtttggattgatt

SEQ ID NO: 77038 - DNA, 22 bp, Homo sapiens
ttgaataatatgcttcgttctc

SEQ ID NO: 77039 - DNA, 22 bp, Homo sapiens
aatttaagaacatttcaggact

SEQ ID NO: 77040 - DNA, 22 bp, Homo sapiens
caggaagctgtgaaggagacgg

SEQ ID NO: 77041 - DNA, 22 bp, Homo sapiens
cccctcgcctgcagagcacagc

SEQ ID NO: 77042 - DNA, 22 bp, Homo sapiens
ccttgctcaagctagtgacggg

SEQ ID NO: 77043 - DNA, 22 bp, Homo sapiens
gcccgcagagatctttaacaaa

SEQ ID NO: 77044 - DNA, 22 bp, Homo sapiens
ggcatagatttctttaggttta

SEQ ID NO: 77045 - DNA, 22 bp, Homo sapiens
ggcaggaacacagatggtgccg

SEQ ID NO: 77046 - DNA, 22 bp, Homo sapiens
gccatgggcaaatgcagagctg

SEQ ID NO: 77047 - DNA, 22 bp, Homo sapiens
gtgcatgtgtctttatagtagc

SEQ ID NO: 77048 - DNA, 22 bp, Homo sapiens
cggccttggtcggcccacagct

SEQ ID NO: 77049 - DNA, 22 bp, Homo sapiens
atgtgggccgtgcgggtgtcct

SEQ ID NO: 77050 - DNA, 22 bp, Homo sapiens
ggccttggagtcagccttgagc

SEQ ID NO: 77051 - DNA, 22 bp, Homo sapiens
atacaaaatatatactggagac

SEQ ID NO: 77052 - DNA, 22 bp, Homo sapiens
cagaaaccaaatgggatgggga

SEQ ID NO: 77053 - DNA, 19 bp, Homo sapiens
ctctgggcaagtcacttaa

SEQ ID NO: 77054 - DNA, 22 bp, Homo sapiens
ctctggagtgtctggccagggt

SEQ ID NO: 77055 - DNA, 22 bp, Homo sapiens
ctggcaggttatagagctgccc

SEQ ID NO: 77056 - DNA, 22 bp, Homo sapiens
gtgacaggccactgcggctctg

SEQ ID NO: 77057 - DNA, 21 bp, Homo sapiens
agtttcaggaagttcagctgc

SEQ ID NO: 77058 - DNA, 22 bp, Homo sapiens
gtggcagagccaaggctggagc

SEQ ID NO: 77059 - DNA, 17 bp, Homo sapiens
cccgttctcttcgctgg

SEQ ID NO: 77060 - DNA, 22 bp, Homo sapiens
gagccccaccctagacattctg

SEQ ID NO: 77061 - DNA, 22 bp, Homo sapiens
tctcatggagtcaggagcagaa

SEQ ID NO: 77062 - DNA, 21 bp, Homo sapiens
tggcggggacttgtggctgcc

SEQ ID NO: 77063 - DNA, 23 bp, Homo sapiens
ctggggctttcaaatctgggcag

SEQ ID NO: 77064 - DNA, 22 bp, Homo sapiens
tcagcctccgaaagtgctggga

SEQ ID NO: 77065 - DNA, 22 bp, Homo sapiens
tgtggctcaggcggcttctcct

SEQ ID NO: 77066 - DNA, 22 bp, Homo sapiens
tccaggatggtgacggtggcca

SEQ ID NO: 77067 - DNA, 22 bp, Homo sapiens
ttatttaaaagtggtaagattc

SEQ ID NO: 77068 - DNA, 22 bp, Homo sapiens
ctgtatctgtgttggatgagtt

SEQ ID NO: 77069 - DNA, 21 bp, Homo sapiens
tccctgagcccaaggggctcc

SEQ ID NO: 77070 - DNA, 22 bp, Homo sapiens
cccaggaggcagatgttgcagt

SEQ ID NO: 77071 - DNA, 22 bp, Homo sapiens
gtgggccactgggaggcaaggg

SEQ ID NO: 77072 - DNA, 22 bp, Homo sapiens
actgcattccagcctgggcaac

SEQ ID NO: 77073 - DNA, 22 bp, Homo sapiens
gtgcaaaagtaattgtggtttt

SEQ ID NO: 77074 - DNA, 22 bp, Homo sapiens
aggcaatcccctgaggatactt

SEQ ID NO: 77075 - DNA, 22 bp, Homo sapiens
cactgcactccagcactccagc

SEQ ID NO: 77076 - DNA, 22 bp, Homo sapiens
aagatattcaaagatttattag

SEQ ID NO: 77077 - DNA, 22 bp, Homo sapiens
aagtccaggtcctcattccatc

SEQ ID NO: 77078 - DNA, 22 bp, Homo sapiens
tcctgaagaaggcagatatttg

SEQ ID NO: 77079 - DNA, 22 bp, Homo sapiens
agcattccacactgaagtctgc

SEQ ID NO: 77080 - DNA, 22 bp, Homo sapiens
tcacagagttaaaagtttcttt

SEQ ID NO: 77081 - DNA, 22 bp, Homo sapiens
ggccttatggcaaagtcagttg

SEQ ID NO: 77082 - DNA, 22 bp, Homo sapiens
agcgtgaattagttggtacaca

SEQ ID NO: 77083 - DNA, 22 bp, Homo sapiens
aggagggagcttaagccaggca

SEQ ID NO: 77084 - DNA, 19 bp, Homo sapiens
tcctgcccaccagccaggg

SEQ ID NO: 77085 - DNA, 22 bp, Homo sapiens
gcaaatacatgttgagcaccta

SEQ ID NO: 77086 - DNA, 22 bp, Homo sapiens
tgatgtggccccacttagctgt

SEQ ID NO: 77087 - DNA, 22 bp, Homo sapiens
ctgctctgctgatcagtgtctc
